United States Patent 10,900,036 (RNA INTERACTOME OF POLYCOMB REPRESSIVE COMPLEX 1 (PRC1)) - sequence listing, part 16

SEQ ID NO: 32553 - DNA, 1212 bp, Mus musculus
ctaattaggtttgtttgttattattgataatattactgttaatggatttatattatatttatatgcagctattaaaaacatcagtgttctgatttttgcaactggagatgagttttaagaggtggtcttttaagtactttcaaatacggaaaaacaatataaaaatataaaaatagtcctctaagtcttttgatgttctcttcagaaaggcttaggataatagagttttggttttgacagttactttttcttactgataaaaataaagacaatgttatgttaggcatgatgtctcacatctgtaaaccaacaattgagaggctaaggaaggattgtggcaagcctagactaagaggcgagaccttgtctcaaaaaagttatcaatcagagatgtcatagaatgtgtaattgaaaacttttttctttaattaattaattaattaatatttttgggaggcagggtttctttgtgtagccatggctgtcctggagctagctgtattgaccaggctggcctcagactatgtttccagaatccttaagtctgtttggcctatttataaaataccaaagactggtcaacaccccccttccccccaactccaaaaaatgtatctcacagtcaaggacactgagaaatcttaagatcagaactaattttcattgtaaatttgagtagtgttaggaggactaaggactgaacctagggcctctcaagttctaggaactgctctaccacttcctagtcctctgtacacactccagctcagaccttgaaatgggagtcctgccgccttccataggagctgtgattgcaggccagtatcactatgtctctgtatctctgtctctgtttattagggtttttgtttgtttgtttttgtttgttctttttttgattttattatatgagagtccacattggtgtggtgtctgtaggggtgagaagagagtgttggaactgctgtgactgggatatagacagttgttaattgccatgtgggctctagaaattgaacccaggtcctctggaagagcaacaagtgcttttaatttaacttttgaatcatctctccagccttccctatatttccctccccttcctttcttttttcttttgtctttttcccctccccgcttccctttcttgtgtcagtgtctctcactagcctctgaagctaggtaaatagtcgaagctggcctctaactcaa

SEQ ID NO: 32554 - DNA, 1136 bp, Mus musculus
cagttaatcactctgaggctgcttattgttattcttctattttgatcttgtagagctaaagtcagtggaatgtaagggtacagttgattgttgtattttgtgagccatatagtactacattgaaaagtagggattattatctttatcagaaatgcctgggaccagactatgtttcaaatttaagaatttttcagattttggcatgttcctatagactttactgtttgaacatacctagtctgaaaattcaaaatcggaaatattcctaaatccagcccttttttatttgctgccatgatgatttaaaacattctggattttggagtagttttggattgagaatatacctcattttctcaaatgaagagaccatttaagaaaacaatatactgaagaatagttcataaaggttttcctgtgataattattcttctaattttatattgactactgatttaaagctttgaagataatgacttgaacaatgaattgggtttatgctagtgttctaactaaaggtttgtttaatttattagaattattaagcctacgttcagatcaagttagcagctagactggtgtgacaacctgtttttaatcagtgactcaaagctgttatcaccctgatgtcaccgaatggccacagcttgtaaaaggtaattttgaatgttattttacagtcttagaaaggctgtcattgtaagatgaattatgtgctataaaaatgacaaaaatgcataggtagcaggaatattgctaagaataaaagacctaagaacggagccatttcttcatttaacctcctttctcagatatttattatagtgcatttcttacttacccttcagttcatgaagataagtaatcatcaaagacctgtttttctgcatagattaataagaaaatatgtcttaagtattttgaagattacagtgtggacattttaagagatatgtggaaaatatcttaagtattatttttaatattttatgtggcaggagtttcagtgcttctccagaaatgttgcacctttagtaaaatgagtgtactttttctcctagagagttacagtggagttaaaagtgcacctttacctccttaaaaggatggatttactaggtcatgttccagtgttc

SEQ ID NO: 32555 - DNA, 1188 bp, Mus musculus
tattacaacataaatgttctttttctttccattttctagatgtgatttacctaactgaagagaaagtatatgaaatttatgaattttgtagagagagtgaggattattcccctttaattcgtgtaattggaagaatattttctagtgctgaggcactggttctgagctttcggaaagtcaaacagcacacaaaggaggaattgaaatctcttcaagaaaaggatgaagacaaggatgaagatgaaaaggaaaaagctgcatgttctgctgctgctatggaagaagactcagaagcatcttcttcaaggatgggtgatagttcacagggagacaacaatgtacaaaaattaggtcctgatgatgtgactgtggatattgatgctattagaagggtctacagcagtttgctcgctaatgaaaaattagaaactgccttcctgaatgcacttgtatatctgtcacctaacgtggaatgtgatttgacatatcataatgtgtatactcgagatcctaattatctcaatttgttcattattgtaatggagaatagtaatctccacagtcctgaatatctggaaatggcgttgccattattttgcaaagctatgtgtaagctaccccttgaagctcaaggaaaactgattaggctgtggtctaaatacagtgctgaccagattcggagaatgatggaaacatttcagcaacttattacctacaaagtcataagcaatgaatttaatagccgaaatctagtgaatgatgatgatgccattgttgctgcttcaaagtgtttgaaaatggtttactatgcaaatgtagtgggaggggatgtggacacaaatcataatgaggaagatgatgaagaacccatacctgagtccagcgaattaacacttcaggagcttctgggagatgaaagaagaaataagaaaggtcctcgagtggatccactagaaaccgaacttggcgttaaaactctagactgtcgaaaaccacttatctcctttgaagaattcattaatgaaccactgaatgatgttctagaaatggacaaagattatacctttttcaaagttgaaacagagaacaaattctcttttatgacatgtccctttatattgaatgctgtcacaaagaatctgggattatattatgacaatagaattcgcatgtacagtgaaagaagaa

SEQ ID NO: 32556 - DNA, 1135 bp, Mus musculus
gacttatgtttattcttcaagagttgctaatgcttttttaagcactgaaccaactctctgaaatctaatttttaaacatagtaacaaaaaaaatactgctgaaggttttcttggggtggagggtgggtattaaaactagtccaaaagctaattgtgtttcatttgtatagaatatgctttcttgttaatattcctacaggaatttgtcaatctctattcagactacattctcaataaatctgtagaaaaacaattcaaggcatttcgcagaggttttcatatggtgactaatgaatcgcccttaaaatacttattcagaccagaagaaattgaattgcttatatgtggaagccgggtaagaaagacatatacaaaaaaggtcttttttttgtttgtttgtttttgtttgtttttttttttgttttgggtgttttgttttgttttttgttttggtgtactatggatgttaaggtgcttttttttccccctataattttcagaatctagatttccaggcactagaagaaactacagagtatgacggtggctatacgagggaatctgttgtgattaggtaaggtgtttaattcttaaaaaggaagattttattcatcaaacatgtagatgtgtgcttttgtgtcctgtatctgtaggtactggttaccaaacaagtaagctcaaaaatagacctgtattaatatttccaattttcatgcagtctaatgctttatttcatgaattaaatgatttaagtctcatattttctcaaccctttgccttatttttggtcatgtgtaagatggcacattatttagtctttaagatacttgggaagaaccatgtatactagtgattctgaacaattcttaggacagtattaccactaacatcgttctctagtcaaatgcccttatttctacttctgtaatatgctactatccaattctgaaagatctttccccccatcttctaatgtgactgatcaaaatgcagagtagtctttttggcatccactatgatgtcataggtatttaaacagttatctttttgtagatcacttgagctataagactcaaatatgttaacaatagaatgaatattaactgtgtctagtaatgatacattatcattgtta

SEQ ID NO: 32557 - DNA, 4283 bp, Mus musculus
atagacagaggccctttttttttcccctcttctactttcaaataagaaaattgactttggtaacagttgtaagaatatttgagtgcatgtatgtactgcatttcactatgtaaaggctgctaatccaggaatatttcactgaaaatgtacttgcaataatactagtagtctccatttgccacagtaaagaagtcttgtttttaacccttgagagccttgcagagttgggctacagcttcctgaaaggctcacttttccatcccaactcatagacaccttgtatggatactctcctgattgtacttagaagtactcctctgaacttcctgttcaacccaaagttttttctcttgcctcatattttgtgggtctcatatctcatatcatatcagacccgtgtttccaggacatcatcctggtacctctaagtcattatatagtacaaaacagtaccgataaaaacaaaattcttactcttgtatctcctagttatttcttgttacttcctttagaactgtcaattttttggcctggggagatggcttagtgggtaaaggtgctcactatataaaacttgacctgaagactctgcctagactccacataaacatggaaggaaagagcaactccacaaagttgtttcctggcctttccatgtttaccatagcttttgctgtttcctaccctctcacagtttatgtgcatatatatgcatgttgtcagttattgtctctcagacctatttaattgtactttatttcaggccccaatcctttgatttactcaggttatcttcctgactctgaactacttctaattcttttcattctcaaaaagcatttttttttctgatttgtatgagtacttcccctttgaatagtttgtacaggtggatttctgcataatttactagtgcatcctgttcagcatccctttcatcactactcaaaattcctttttagattaactttatacaactcacatattctttcagttggaattttgaaagtatcatactcataaagacttctattagttacagtgtgccttcatagtgtaatagcagcctacatatccctggtcacagcctggtggatcatatttatttgaacagttgaggaggccttcagaagtgcgttcccttccttctttcctgtgttttagctttgatattgtcccactattattattattttttttaaagcatcttctcttttgtatggaatctgagtaaattcacagtggaaactaccttgtactgatctttctgtctcttaggcagtaggcagataagcattaatcaagaaatatacacatacatttattgaatagagtttctggaatcactgtattatatctgccccagggtaaaaaagacagtaagttggaaaagactagatggttgaaagcaagacagttttgtaactctacatcctgtcttctggtgtactcttgaccaccgtctttatgccactcatactcttccagcagtcatggcaactgataccttaattcgttctgttattactgactagtctctcaaattttcatagaggaatcctccagatgctgttctctgtaaatatatgtgagtcatatttaacattttcttatactttgctgctcaaattcctgtaaattctgacaagaattttcaatgactgctaaagatctgtgcacatggtccttcattttcacaaagccaataaatatctgtaacttgagaggttatacaccttactaaaagtcatacaggcaggaaaagggatgacaaatggtaaggttgcgtccacatgaccacctaaaatttgtcatcttcctttttgcaaaaacaaacatgactaaattaaacaacaaattaagattattatgctgacatgcatggaaccttggatcattattatgatttttcattacccagaaacacatagaaaatgataaggaatgtatctggaatatagtacacactggttggggttgtagccttcagtcaaatgactctgaattttagtttggcactgccattcccttgacttggattatacccactcctaccttatctctggttgtgtggtttcagtgaaattaccatgcagctggtagataacatcttggaagacatcctgagaacagttctcccaacgttgcttgttaacttaaaaaaagagagagagagattagaaatgtctgtaatgaagacttattttctaaaacctgaccttatatcgtccacctttaaatggaagagatgtgttttctcacatcttttagatataattcacatagtataaaaattcgccattttaaaaagtgtaaaatttgtggttatagtatattcacagagttgtgaaattgtctttataaaattccagagcatttcatcgctgtaaaaagttttctgtacccattaagagtgactgcctgttcttaactccaacccctggcaactactcgtcttcgtatgcctatgaatttgcctattttggtcatttcatgttaatggagtcatacaattatgtggcctttttgtctgtttcgccaccttccacaaagcaatgagttcaaactgcatcaatgttgtagcatgtactggtactgtttcttttgtggctgaatattgtcattgtattgatatgctgtatttttttgcttgtccacttggttgtgcatacatgtgttctttctgctttttgcatattatgaatacaactatgaacactttgtgtacatgttttcatttctcctactgtcttttaagtatcttatggttttggttcttaaatttaggtctttgattcatttttgcatgtggtacattttagggatccagtttcattctctaatatgtggatatctagtagaacaatacctaattgttacaaagactattagtaatttccttatgagtaggcttgctatctttgtcaaaaacacgtacaaatgaccataaatatggctaattttggattcttgaactttgtcccattgtcctatgtgtgtctcttcctatgccagtaccatactgtcttaattactgtagccctagagtaagttttgaatttaggatgtgttagttctctagctttgttctacatcaagataattttacctgttctgggtcccttgcattccacatggattttagaatctatttgttaatttctacataaaaagcacctgtgattttgattgttcttgtgttgaatcgatacatcagattgacgtatgttggtattttaacagtattaaattttataatccataaatatggagtgtctttccatttatttaggtgtgtaatttctttcaatgctattttatagatttcagtgtatacatcttggcttttttgagttaaatgtttttcacttgatccttttacaaacaactttttttttaatatttgtttggattactcattgctacatctagaaagaattcatttttatgtattaaccttatatactgtagctattctgagctgattctgtttttaattttttatacaagattgtgcatctctgaatataaatacttttgtttcctctccaatctggattctttttatttgatttccctgcctaagtgccctggctagcacgtccaatatgatattaaattgaagtggcaagagtgtacatctttttcttgtttctgattgtagtggaaaagcattaggtctttcaccattaaatatgatgttagctgtgggattttcatagatgttgcaagttgagaaatattccatctattcctaccttactgagtctttttttaaatcaagaaaagggttttgaattttgtcaaatgcttcttctgtatctaataaggttgtcatgtagttttgtcctttattctattgatatgttgtattacattgatggaattttgtattgaaagaaccttgcattcctggaattaccccacttgtctatgctacataaaccattttctatgctgctggatttggtttgctagtattttgtttagcatatttgcacctgtattcataaaagatactggcctgtagttttcttgttatctttgtctggttgttatcagggtattactgatactggtctccaaatatgcctggagctttccaactgttcttaaatccagtgaggtgtgtttgaaataatatactttgaaagttattctgtggtctttagattctggatgacatgggagaggtaattgactcttgaaaggattccaaggtaagacatgtctaaagtgccatttgacagtagaataaaatgcagttaacaccagtcttgagt

SEQ ID NO: 32558 - DNA, 1202 bp, Mus musculus
caatgaaaattgaaataactaaacaaaacagaaaactgacagcccaaatcagaacactaaagagtaatattacaaattacctctctaagtaaaatcattttgaataaatgagataataatctcatgtcattcaaaatatattatatttttataataaaaatgcataaatgatgctctttgataatgaaataatagttgtgctttttttcctgtgttctctctcaggtggttaccgaattgaatagccgttggttctacagccactataatgatctgaaaagttgaatgtgttgcatgaacactttcaggaatcataatagaactcagctaattagatagagactggaatgttgatttgaagacaattactttataaagattttctcattgctgcttttgcattatcccaagaagtggagacactactacatggataagaactgtatgattgaattgactttggaatcatctcagtattgtcataagtatgaagtgtatttcatggtacttttgaagttagttatagaattttttcaattgatttttctatttttcaaagggtttaggtaatatgtagcatagtctgacttgagtggtaacattttagaaatataccaggtactgttagggcaatattgtgtgaagatttacttttatagtgcatgccaaattttgggttttctggtacattttattggattttatttattaatatttgttataagagcagctgattatgggttaagatgatagtattacagttatgtgtcaaaattctattactttgaactacattggcttggtatatcaagtctacatttgattaaatgtagacttagcaggattaatgaatttggccattaaaactacaggaattttagtcaacattcctctcatatttgtgtatttatgtatgtatgtatgtatgtacaggaattttagtcaacattcctctcatttgtatatgtatgtatgtatgtatttatttatttatttattatcaaatcatgctgttcatttctgctcattgtttgagtttccatgctaattatctattattcataagtacatttataaataagtctgtaagcaggtcatcatgtatgtcagataaaatactgtgttttctactctctgttttattactaagttgtatatgaattatgcattaaatacagaatgttctctcttatgtcatagtt

SEQ ID NO: 32559 - DNA, 1161 bp, Mus musculus
gatttccagtatatactcatatagatatagatatagctagatagatatgtatataagtagatagatagatagatacatacatacatacataattctttcaaatgtacagacggatactttaaatagtaacataatttaaataaaaacttggagtgttcaagaagataatttagctgttatgcacaccaactgtatttattaatgaccttaggtctgttcccatctatcagttgctgcctacaactacagctccggtgtacatcttgcctcagacacctgtcccatgtacaggtacatgcacttgaatgtaaagtaagatgctagggtcaaagctaaatttacaacatacagtacattttcagaggacttaagttaggatttcggcagctaatcacatctatcttttgtagtatctgaaacctctgctctatgagggctcaatggaaaatggatagaagcatttggtattaaatataaattgttttttttgttcaagaccaggctaattctcatttttttttccgtatacatcctactctatattgggtactttatttttcaggtgctcatgatgactagtccgaacctgtgaacttctgagaaaatttacagttctgaaaactagaggtaagaaaggatttgagtttttttcccccattaggtcaagaaaggtaatacaatttgaaacattcccatgcattctaattttctgagttaaattaatttctttgtgattggtgtggaaattgggcctcccatatactaaaccaagtgttgcataaagaaacaacaactgtagtttgaatcagtttatttttaaaaattgttgagaggtgtagtaggctatcatcaaataccctatgtggttgaggataaaggtaaacgtctgattgcatgccttccagtctcatacactgggactagagatatacttactcattcctgaactatgcagttgcaggaattgacgcatttgttctttccttaaaagtaccagctaacaatattttcagacctttcatcttaataaaataatgattccatacatggatgcacattatcctttagttaattgtcttaatatattccaatactccaatagttacttcacctatatcttagttaaaaaaaatgcattaacagggctggaaagaagatggc

SEQ ID NO: 32560 - DNA, 1223 bp, Mus musculus
aaggaattgtaagaatatgtattatttgttgcaattttagagttatctcctaatatttcatcatttgtgattctcaaatgtaatttgattttttttgttggacagtaagatagccaaataccagatctacgaaaagaacataaggattgcagcttaaggtgaatgtaatttaacagtgaaatattctctagaagaggggtgttgtattataaattaaaaaaagaaacaagttgccttcttgtagacatactttagttcatactaaaagagatagttaagaaattcctgattatgcatatgttgtgtcattaaggaaattaatacttttgtatcataatatgtattattttacagtaataattgaagatttgtgcaagtcaattaaactatacatgcttggaaattgccacatgggaccatcttgaatgaacagtttatgcaaacagaaaacatgttcaggaagaatgttaaaattttaacacttgtaaatagaaagaagatgacatttgcctgtctttgtaatttatgagggtatttgcaaataagcatcaaaacaagaagaaaatattaaaaagacattttgtgccaggacatcatggtagtgctggattgcctatccaactctgtataaaggtttttcaaacaatttgtgaagaatgttagtatcttcagagtcttctgcatcagcaaagagtagtgcattaactaatggaaaagagaagataaaatttctggtaagtattagtgacacatatgagtgaaatataatgttttagctaggatttaatgctgtgaagagacaccatgaatgtgagtatccttataaaggggaataattggtgctgtcttacagttttagaaaattagttcattttttgtcataatggggaacatggcattgtactggcagatatggtgttggaggagctgagaattctgcatcttgatcagtaggcagcaaggagtgaccatgtgccctgctgggcattgctttagtataggatacctgaaaacctgcccctgcaaacaggccacatgtcctaataatgtcatttcctatgaactgaacatacaacacatgaatctatgtgacaagtcctgttaaatgtatcacacgtagaaactaaaaagtattcagcaataaatattggtaatgtcagtcatgcttatgaatatagcatgctgtatcttatgtttttgttatgtctcatttaggatgagtt

SEQ ID NO: 32561 - DNA, 1280 bp, Mus musculus
aggggtgatctatgtgacaacttcacatagttttactccaataagaagttaataaatattgtgagtgaattcaatgttaacacactatacccttaatatgctaatacatatctaaaagatacaaaatcatttaaattgaataagaaatttctggccaactttgttttcagatttattttatatacaaatacacagttatttatatcacagaaaaatttttatattttaaattggaattggacactgaaataaaagattagaactttggtggtcaacagaatatattatatggattcttaagtagtatgatacagcaacatttctctgttaagggttaattaggaaatgctaagcagaggaaaggtattcttttttaaattggaattgctggatcatactttgaaattgccaatttagtcaagcccatctgtcagtctaactttcagcttgtttttgcctgtatttattttaaatcagacctgacaggattgataactgaaaaataatagagtcctatctttgtagaaacaaaagtaccttcaactgccaaaaacacatggcattactctatatgtttaatgagtagaatgtttgaactgtgtgtagtgactttgtttaaagaacttgcttaatagagaccatgttaacacattatatttcttgtatttatggatagctgtatttaaaaacatttggccagttttcaggtttttaagttgttctgtatgaaaagacatctttatttttgctgttaaatgttactggacatttatgtaaggctcattgtggtggtgtgatagtaaaagctgaattacctgagcattttattaaaagctctctctctctctctctctccctctctccctctccctctccctccctctctctctctccatatatatatatatatatatatatatatatatatatatatatataaatagtttgtatattctttaatggcatcaaggtagttatttctgaggataattcaagtacaagaattatagggtcactgttttctgaaaagtatgtatgctatataaatgacattgaagtttcattttatttttctaatcactaaaatgtgtgatataatttatttttccaaattatcaaggtatatcagaattccatgctttgtagttatctgatacatggcaaaaatggaactttctaattcgtacgacttttataccaatcatctagtagttgcagaaatattgagactcataatttttaaatttataaatatattgcaattcctattgtcttttaca

SEQ ID NO: 32562 - DNA, 1853 bp, Mus musculus
gttagacataagggtgttaaatgaatcactttgaaggtgggtaaaaataccacagggtagatagtttgctttgttagaattggctattttttttatgctgaggtttaaacccaagggcattgtatatagtttctttcttagggtcaaactgacaagtcaggctgtgtggatctgtttggtttcattgttttgttttgtttgggtttttgtttctttgttttgccttttgacactgggtctcattatgtaactgagtcacactggcatccaattcataatattcctgccttgctgttgcaagtgcttattttataggctcgccacacacctattttttcattcactcactcattcattagtgtgtatctgtgtgcccccaccccctaccgcactccaaaggacatactttctgtttaccttacaactaactacatacttagccaggccagactatattatttttaagctgtttatctagctcggagttttatgtgaagcaatagctttgtaatgaacgtgttctcctaaatcttgaggtttttctctaacacaggcctctaaaactcatgtttctactatatcagtaccatgtaaccatataccactttccatttttacagtttttttttaaagtcccttctgaaggactttggctggacttatgatgagctatgtttactgagcatgatgaaatgatgctcaaaatgattactctgaagtctagccaaagtgtcagtttaagaacttaggtaacaacttaagttctgggaatatgaaacaagatttttttcaaggagactggagctgtagatttttccaatatagcaaaattggttttaaacctatttcattttatttttgtaaagtgcctttgtgtttctaacaccatagctttttcacctttctttctatataataaattctagaaataaagaacttggaagttagtgtatcgctcagttacccaaaatgtaccctgtgtgatagtttcctgagcatgttcctagccattttgaatgtattgttccttgatttttttttataagataggaattttatgttttttcccaaatgctgaggataatccagagaggttaatctatctttattatcataaagcattgatggagtagtcactctgtaattgccaatactgaatatgagaaatatttggtaaattttgtttaattttttgctagtgagatcacgtactattcctgttttcaaacacgtggttgggtggtgtcaggataatcatctgcataccagtttgattttgttcctctgaagtgtgagtttccctgagctttgtatgttagctactgctgtagtgattgcttgttgtgtggtatccttctgcctttgtaatacttacttctggatctttgcatatctacatgcatacacagcaatagatttattttcctatataattataaaacaattcttaatctgttggttatggcaaatttattgctgtgatatagctttgttttaaatatatgataactttattggcataatttagtaaaacatgtgaaatgatgattataatatcttacatggttcagcgataaactagaaagatacttttgtaggactttactttttggttaattagtaaaaatcagttagattttgacctatttgttaggttaaggtgttttaaatggaatgatcttataaaataactaatcacagggataatttctataatgtacttggtaaatgattttatagaatttatgggagacatgtcaatgtttgagtagttaagaatagtgttaaacaaggggctataatgtgtattaaatataaatagaaaaagtcatcattttaaagtacatttgaga

SEQ ID NO: 32563 - DNA, 1210 bp, Mus musculus
tacggcggcctaagaaggtatcacaattccctggaactagaggtgtagacagtgttttaagagagcttatgttttaggagaactgaactagggtcctgtgcaaaagcatagtagcatctcataaacagagccaattatcttcctgttttcagtttttaaaactatcaattaaggtaggcatggtggctcttgcctttaatttcaccaatcaggaggaaaaggcaagtcgacctatgtaagttccaggccagtcagcctaaattaggagtttcaggctagtcagtgctatgtagagactctgtgtcagaaaagaattagccaattaaaaatatacaactaaattagacacctgttgactactccaataataaccatgaaatccttgtaccaatggtcctatcctaacagggttcacagcagaataggaatgaattttcttcagcatcctgtatcgcaccttttgacactgaaagctagccagcatttaggaagcttctggcacaatccagttggatatgtctgctctctgcaaataaattatgtagttatcttaagcgatgggtgcttgttatcaggttttggttggaaatgtaaaacaattacatcagtgtatgttatactgaggaggagatagtctgcaccacactgtaccaactcaagggaggtaattcacacctgacagtgggtgctttgtttgatacgttatgggtttggaaaggaacatcttcaaacccatgtaactaaaaatgaatgttttatttcacatacacacacacgtatatatatatatatatatatatatatatgtacttggaaagtttgattgatcagatttctgcattgatagaaagttgtaagccatcatttggatgcaaggaccagaaataggtcttttaagactattgaaccatcacttcagaccatttattttattgatttcagttctctggaggtctttatatattctagacagtttgcttctgtcggatatgacaagcaaaggtattttgcaattctgagagctctctatgtattctacgatgtgtccttttctgtacagaagctatttagttttgtgagtttgcagtattgattgttggatttgttttctgcattaccagagttttattattctttgcagtttggtctatttccctgtgaatttcattttctttatagctgaaaaagaaattgccagcaattagcattg

SEQ ID NO: 32564 - DNA, 1210 bp, Mus musculus; identical to SEQ ID NO: 32563

SEQ ID NO: 32565 - DNA, 1100 bp, Mus musculus
tatagaatgcagagtctgagtgctgtaacaataggtacttctttttttgttgtttatttgtctttgttttttagttttcgaggcagggtttctctgtgtagcactggcactggccgtcctgaaactcagagatctacctgcctctgcctcccacctgcagggattaaaggtgtgggccaccactggctgactgtttatttcttatgagactacttgacatttgttttggcatttgggagcagatactgcagatatttattactgtttctgcagatattatactgtttctgtagataatatactgcagatattattgctgtttcatatcctttatactaaaggactttttttccccaaaattgtagacaataggcaacacagcagtaaaatattttaattaaatcacatatataatacatacacacatatatatatataatacacacacacacacacacacacacacacatatatatccttccaaagtgatctgaaaaatacagtgcaattaaaagacatgattaaaatgatttttttgagatagggtctcactatgtagctctgtctgttctggatcttactatatagaccaggctggacccaaaatcactgatagcctcctgcctctaggatacaagatgagtaccactatacctggctaagaatgctttcttaaaataggagaaaataagaaaatattgactcataaaagttgtttatagtgtgtaaactttcaacaactatcttgcaaatggggaaggatgtcttgggtttttctgttttgaggagtggtctattagatgggccttggactggaaattacagcacttttaccttaggttcttcagaatcataggttatgtgctaatagaatataaatctcttggtatttgtttgttcatttcttctgattttatttcctgtttctcagaggttttaccaggtatctctggtggtcttacaattcactctgtacaccagattgacttcaaatttatggcaatccaattgtcactgccttctgagtacttacattatagttatgtgacaggaaatgcctcttgtgttttgctaattttttttctatagagcaataatat

SEQ ID NO: 32566 - DNA, 1100 bp, Mus musculus; identical to SEQ ID NO: 32565

SEQ ID NO: 32567 - DNA, 1244 bp, Mus musculus
gccatggcagccatggatggccagagatgagactggacgccactgggctggagcagggggcagtccagggttgtggggacacagatgagggctgggaggggaggaacgcaagagggcggggggtttcttcacgatcgcactggaagattttataagagttttgggggggggggggacagtaaacgtcctgagccacttgggttcttcaggagtttctcttagggaaagtttttttttcctctttttaatatataactataatatatatgaatataaatttagctaatgtttgtgagagtggggcctgcacacgtgttcctgtcagaggcaaggctcacattccttgccagcacctctttctctgcccaattgaggggaacaaaagggtgttcacagatggagcgagcttgcagccgcgtggctgtgctgctctgtgagaaggcgtgccagccattaggaagccccaccgccaaaggaggtgcacccaggagggtcctcagaatcatggacttctaccccattgctggtagacaattttcatctctgctggtggtggcctcttgttgactctgaaacttgtcaccttgtcaccagctagatgtcaagacttggctgccctctgatgtgggtgcttctgccccttccctgttctaactgtccgacaggctcccagtctctgtgtgtccaggccagaggaccagcactcaggagagtctgcctttggatgagttcccaaattagagtcatcgcaccagggtgcaatttttttttttttttccattttttattaggtatttagctcatttacatttccaatgctataccaaaagacccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcagtaaaatcttgctagtgtatgcaatggtgtcagcatttggaagctgattatgg

SEQ ID NO: 32568 - DNA, 1117 bp, Mus musculus
taaatctcaaatgagattttctaccaaaggtcattaaaaaacagagaattaacagatcaataaagtacaatatgaagccatatatacataattctataaaatatgtcctgaaactacatgtcaggagacattgttaaagtgtaaaacaaatagtgagacccaggaaatgagatagtttgatggaatagtgtttcttcttagagtgtcataatatacacacataaagtttcaccagtgtgattttcaaacatgagatgcaaaataaacaagctaaattgaagctacaaattgcatgtggccttaacagactagaaaatatttgatgaaccaaaggaatggtgagggaatgagacacattttccaaagtgaagaagacactaatttactaccctatacaaaaatgtgtatacttaaatatatatatatatgtatcatatacatgtgtgtagtctcccctcccccagcctgaaacctgcttgctcggggtggagcttcctgctcattcgttctgccacgcccactgccggaacctgaggagccacacacgtgcacctttctactggacccgagattattcggcgggaatcgggtcccctcccccttccttcataactagtgtcgcaacaataaaatttgagctttgatcagaatgaatttgtcttagctccgtttcttctttcgccccgtctagattcctctcttacagctcgagtagccttctcagtcgaaccattcatgttgcgagctgctggcagccacaatattttggcgccagaactgggacctgaagaatggcagagagatgctaagaggaacgctgctgtggagctccacaggaaaggatcttcgtatcagacatcggagcaacggacaggtacacatgctagcactagcttaaaatttcagttttgtaaagtgttgctgaggatgcggtaggatacgaattaagcttgaatcagtgctaacccaatgctggttctgcttgggtcagcagcgtgttaatcggaactagaaacggaaacaggcaggttagccgcagctttttaggaagctgcttaggtggaagaagaaagggtttaaagtcatggatcaggcggttgcccatagttttcaggag

SEQ ID NO: 32569 - DNA, 1139 bp, Mus musculus
accaaaatagagtaaaagtaaataaatgaaaatcaaaataacaatccaaaaacattaagataaaaataacaaaacaaaatgaacagcacccaaaacaaaatctcctgaaataaaaaatgaaacaaaaatgaagtctgctttatgttttacaactattcctgttcctggggcctgatctggaacatgtttgatataatcagtgacactgtttgaatagactgattttttttctttcctatcaacagaaattaattgcaaatactccttggttaggggttgcactttgtctcctttcccttctcatagttggaattttggatggattgaacctattcagctttgtttctgctgccacattctctgggcattcctgtgtctggcagtcctattgtatggatagcattgtttccttgcagtaattcaacaccctgacacttatctttctgctttctctttaacatagatccaagagtcttgaggagagaagtttaatgaagatccatttaacatctacagatgcacagtctctcactatctctacacagggcacttgagaatgccttagataattcttgtgaaagaggagacagccttgttgagaactgagcactgaattgaattatgggtagaacagtatgttggtaggaatcattttatttcagtttccctataggaaaatagcagtagtaggtttttttttttcttttctataacccaattctatctaaactcagattcatgggcacttggatgtataaggtatgaatttatcacatagacttagccctaaaatctaaaacaaacaaaacaaaaacaaataaacaaataaaacccccacaaactactaggtcagtttaacattgactaagtattgtgccagtgtaccctgaataaagttcactaatttacaatgcacattttgtggctgatgatattcaggaattttttcatcttcagttacatgtagtgtgatatgtaagaatatcttcagcattagagtattatcatctggttgctgtttgaagagaataaatcatagcctttcaaatgatttgtgaatttcatgtgcggggctttagtagtgctttgaccaatgactacataaaatttaaattctttttgtccctggagtaattatt

SEQ ID NO: 32570 - DNA, 1431 bp, Mus musculus
tttgccctggtcaaagccctcagcccagaggagctagacagggtggcgctcaacaaccgtatgcccatgacaggcctcctgctcatgatcctgagcctcatctatgtgaagggccgcggggccagagagggtgcggtctggaatgtgctgcgcatcctggggctgaggccctggaagaagcactccaccttcggagacgtgaggaagataatcaccgaggagttcgtccagcagaattacctgaagtaccagcgtgtgccccacatcgagcctcccgagtacgagttcttctgggggtccagagctaaccgtgaaatcaccaagatgcagatcatggagttcctggccagagtcttcaagaaagatccccaggcgtggccttcccgatacagggaggctctggagcaggccagagctctgcgggaggctaatcttgctgcccaggccccccgcagcagtgtctctgaggactaaaaaggtccaggggcacactgatagtttctgacccatactagggctgtgtaagggtggggttgagtcattagagtatcccaaatccacagtgcagtatttcatgtataatttttaagttttccatacagtgcttttgtaccttgtaatgctattcatttgtgtactcgtgtagtgtttaagattgatgcatgtgtgataagtatttggtactttcacttttgtgctttcgtgcatttttgtacaagagatgtgctgtgctaaacttgtgaaatacattgaggtgttctgtatcttgttctttgtatgggactgatgatctgtatcgacaaagaaggccctggagagttagcaggacttaacagcaacgcagacctgagcaagagaaaggtcaaggcctttctccatatgacttcaactggcacaggaagcatccatgtggaatggactgatttgaactggactgttctcagtgtaggcacttagcaccctttacaaaacatgtatgcaaccccaccataaataaacgttaaaatgagcattaaagatactgtgaaataatttcttggggggggggaggaggcatttatttttgatgaaagggggagtgggaatgggtggggatgagaaagattctccctgtgtgcagcataagcaaacacggtgtcctaacacagtgggagaccacacgaccactcagaagaaacttgcagtgctttaatcaatttgtcacataaaaggtataacaacaacaacaaaaaagctcattatcacataacatggggataataacaggtatatggagggcctgccccttttctgttgcattttttaaaatagtctttgatggacactttagcagaataaacccttatcatgcattttcttctttattttgtcctcccaccagccataagaagtaaggaataactgtatcatcacagagcaagaaaaaataaa

SEQ ID NO: 32571 - DNA, 1351 bp, Mus musculus
agtgtgtttttaaaggacacccattcctctttgggttcaaggtcagtttcctgggtgtgttccgtgtagtgggacttcagcacagacactaaccgaattgccttgctgagggatgagcacactgttttgcaaatgctggagtcctttaagggctctcctgccatctctgggagggggtggggtggctggtattgagtgtctgtgcttctggcccgaggccccctccccttccactccttccagcttccagacaaactgcctggagacagtgactgcattccaccttttcccccttgtttctgctgctctactcaagtggggtgacgctgctgatgctaggggcccggatagggggctggggaggcttctcataatgggcactccagggacacagtctcacacaaccgtgtataatgagctctaggggccggctctgcggggaacagctgcagttctctggatagacagagttgatttcctccttctgaccctcccccagctgtgccagctggcctttgtaagggaaggaaacctagtaaaaaatgtgaccttccaaaggggaaagctgcaggctttttgctattgtgactgtgaagtgcttcgaaatactgttcactctgagcaaccgttttcgttttagttttatggagttaatggcttgttcagcatccagatgtggctattgacaatatctactcttcgcaccagagtgactggagttgtggctgtcctgatgataggattttaacttaactgaaataactgtttttgaataaatgtattggttttttttccagaaaaaaaaaagaatgagaagcccaaaagtataaaccaggacattctgtatattttttacgagtctagtgaatgtatacgaaaataaatgagacatgcgttcttagtgtgacaattatacttaagcctaacatttttttccagttatgctagagaaactactagatcaggctgagtgcatgggcctagtgtatagtttagatttactattttcaatgatttttaaaaggtctcagtggtttatttgattatttgaccaaatgtatgtcataagctaatgtactcttgagtttgaaatgcccaatattccttggtttactcctcatgaaatgaattaatgcacagtcaaataacttgggatgcatctcaaggggagactccaaggcctgacactattactgatgctatggtgtgcttacagacaggagcctagcctagctgtcctctgagaggcccaacaagcagctgaaagagtcagattcagatactcacacccaaccaatggacagaagctcgagacgcctgtgtctgaattagggaaagggtggaagaagtt

SEQ ID NO: 32572 - DNA, 1153 bp, Mus musculus
gagttacccagcctgtattcacaggactgccagcacttgatgctgactgacactagggaagctgttcaaggctgtcacagctgcagcatctgagtttgttcctcataatcacaggttcgtttatcacatctcttcaaagaaggacagaaaaaggaaggcattatgtgtgtttcttttgttaagaaagcaaaatgtttgtcacacagagaccagcaggtttcctcttaaattttagacattcatggggaaaatggccacctgaatgcttttagatgcaagaaaaactggtagagcatatccaaattgtcttgatcagttgctaaccatgatgcatcacatgattgggtatgatacagccatcatacccaaaagcatggaacaaaagcaagcatagtaatgaagaaggaagtggatgggtcttaggcagtaaaccaagcacatatgccaggatcctataccaggttttctcccctcactcagtcgtacacatttaagcacgcatgtggtgcaagttcgcgtgcgcacacacacacacacacacacacacacacacctctggtcctcccctctgctctcctgtatcattattgaatcaccatacttccgtgtatgatggggatttaaggaagacgaattcctctcaagcatgtcagaccattgacgttacaacactacattctcatctgtaaagtttgtccctgaggtccatgtagctgagttatgataagtatcacctaaaaatgatgctgctatgtgtgaaggaagttacagctttttattggaccacttccgtagctaccctctgcttcttggaggcccacaggccacaggtttgacatgtgctctgacttgactttattcctttgtcaaactatattagagttttgtgcctatccacttctgttttataagctgctcctcaatgaatagctcccacgatgactgcattcaaatataagaaaaatcaacattgttcagacattgtcttctgtctgtgtttaagttttatacctcagggaaggcgtgttgctttctgaaaaagaacaaaataaaaatgtctcttgcttttgttgtgctcccttgcttgattcacagactagtttgtgttggcttctataaaatgaattttttttattgtgcttaaaatgcttca

SEQ ID NO: 32573 - DNA, 2049 bp, Mus musculus
ttctacagccatacagaaaatagccctttccaaagagggccttcggttctctcttgatgggtgctacgtaggggtggacagtgatgccctcgatgggagtgtggtcctggaggtgccctactgtgtcctgccatgccccttactcacaggacatgagatgcaaaggctccccacctccagcccacaccatggcaaccttgttctgagtccagcattggggcaggtggacaattcaccagagtgcagcctctgggtgcaaaattctgcaccctggcaaccccagtgaggggtggtttagatgtcgggatggatgaggggaggtgacattctctggacccaagagaaatgtggcagaacagagcggttacctttcaagacgaatgaatgcctcggccccactccgtccagaagactggcccttttcttgccagaagcaggtgctacgatggactgcacagggtcacagcatttcctagaggcttcagctgggatctccaccaagcaggggtgccgtccatgtgagactaacctgagcaatagcttggcctcgtctctcagctctgattgtggctttggttacaaggctacctattttgacctctgacaggtgttacccactgtccctcccccctcccctgtcccacttcacaaaaggtcatttggttagagacagtgctggcaggtctatgtgtagctatgttgtgatcgggaagagatactttgtaggtcacccacttttgtcttttttttttttttttttttttttttttttctgtccaaagtttccatctgtccgttctggaagctgtatctttcaaagctaaaatccagatgtttgactcactgttttgaaattaggatggcatgaggaagagccaggtcctgtgactaattttcctgattctgagtcttcgaaggtttgtcctggacacattccagagaatttcgtacccaaacatggatgcacagtccagcttactactgatacaggcctgagcactgctgagggagaggcccttcctcttggtggccagcggtcccagtccaccagggaagggaggtttgattggtttctttgacccatacagagttagtggacttgctctggaactctagcctagcccagcccagtcgtagtgtcccctcccccccctcccccatctcacacagctttaaaaccgtactacttttatttagaaacaaacaggatggcagagaggacacctcccccgcattcctgggggtgggcaggaaacttaggtcaggcctgagagcgggtccggctgtttccctagagtacttactgtgggtaggctgcctgtgctcatttgcccaatgcctgtgggccaggttgcctgtctcagtactgagactctagacttaggagaatcctctcccaggagtagctagttctacgtcccttgtgactcaagacactgcctggtcatctgctccagtggcagacctgacttacaatgtctaccctagtatgtgggtagaaggatctttctgttcccccattgcacactggagaagccctgggtaccgagtgtggggaccccatggacagtaccataaggctccctgctgagccactatgcattgtggggtcagagctcctgtccctccttggtgactgggaatccctgctgtggttttgttggacaggcccaggtgactgcttcccatccaaagccatcggtggaacttctgggggatcctttgccaaaaccccaaggcaaaatccaaggtccaaggccatttccagcagcttcccagttccctttcccataggaacttttttgttgaaacctagctcccaacatgcttccaaaggccatgttccgtctttcctggatcactacagtgaagtattacagttgtacagtttcccaatctggccttggcttgctcggataaaactttgttatgtattttgtaaggcatagattctatattgtaatgtcctatgcaaaagaaaaaaaattaatgaaattgtaaattttattgttttaacatgtatgcatgtttagtgacgtttacattttg

SEQ ID NO: 32574 - DNA, 2553 bp, Mus musculus
ctcgctcagcgactacagccgctccgatgccagcagccccaccatcagcccggccagctcaccctgagcacccgcgcctggaccgcgcctcctcacccctttggtaataggaaagctgagcgaacttgagaagtccacagcaaaacagttttcttcacctcaggtgtcaatttttaacaaaaagaaaaaaaaaatctcaaaaaaaaaattaaaacaaaacaaaaacaccacccacaaattgcacaaatacagctatccacgaagatgagattcagcggtgttgaacccccctctcccccaccccaccccccctttctcagggatgaacgcggtccacgaggtcagtgagggcatgcctttctgccgccttactttgtacatagatttgcactctggagtttctgtgaggtttaggattacattggggcagaacaggacagctggagacagtgatgtggtgtttttgcagaagaccccccccccccccccaaaggcctaggaccctctcttgcctaccactcaattgtggttctctgccctttggcctggctaagagaccggccacctcacagggatgtggtaagccatgacagaccatgggagcacttgcctatggaactgtgaaggacctctgccttctaaggctggtcctgtctgcctgcctgcctgcctgcctacctacctgcttccagaaatccttaggaaaatggaggccagatgcaaaccctgcctggattggcacatcatggctgccaaccacccatggaggcggctgggccctgcctgtcctacacgaaggcacctgggacccttcactatcacactatgttctcagactgggaaatagtaccctgggcacattgtactggacctgcttctccccaaaattgatgttgttttatccggcttcctaagctctcgtgccctgggccactggacaggaccgccacgccccctctctgcctcttcagtctgtgagtgtggcagcgctcacacatcccacaggactgatggtggcaacggcatcgtcagttaccgcctcagagcagcacagcaggtattccaggagatgctattggagagacaaggactgctgctctgggggacaccggatgaaaattgtgggaatgactttctcagaaccttgggtacagacttagcagacccacagttccacactgttgcattacccactcttctgtcctgcttctgcctgccctgcttgagagcacccaaaccgcacccagtctgcagtgtgggtcagggcaggggtgggtggcctgctgctggtcgggacagcaggaatagaaaccaggcctgctctatttctcctggagcctagacctgggctacattggcttcaggtgctgggcctcgtcagcaagaccatgttctggttgctcctttgcagatacttggagtatcatctcctcccaccctgcagaggttcaggcattcttccccttctcccacgaactctggggcccaggaacacaaagccccaggactggatgtgtgtgtgtgtgtgtgtgtgtgtgtgtgtgtgcgcgcgcgcgtgagtgtgtattgggtggtgggtgggtttgggatggacatgggttatcttacagagacctctcttcattttgatgtggagaattggcccttgtgactcagagggtcatagatgggcttcctgggcccagtgtgccttggttgtggccattctgcctccgccccaaccctcacacagtgtgggggtgcagcacaggggaaacccagagaccatgcccagccaagtctacagtttccagctgttgtcatgtggctcccacatggatcttgggcacccctttctaactacctgtgtcagttacaagaggctaacaatggcatatggtggcttctggtggcaccgtaggtgctgagttaggctgtggcattgttgctgccaaaagcaggcgtggtgggtggggggaggtccctgccctggtccagtgtaaagctggtaacagctctgcttgcatttcacctggggaagagagtggggtacgtggccaggaccttgactgaagaagggagccctgggtgcttggggtgtggcgatcttcatgctgagttccaaagtgtagtccctcccaaagtcatttgtgtgaggcagagaaagccacactctgaacacatttcatgtctcaggaattcacattccagattcaggaattttattccaaagtcctttggtgcacctacatccacagttctgaagccagaggcagcagtgtgccccagagaccagccacggtctctccttgggaggagccaggtgtctccttgtggcctacctccccatagagtcacagcaggaggccttctgactccgccactgtctgcacacgggaaggataaaaggactctaagccccatcatcttggaataaaagaaagagctggtttgttttagagcgggttgggggggagggggagggagagtgggcataggctgtttccaaagagagcacttaatttaatttttcctctgaatgacccagggctgttccatctgatagatggaagg

SEQ ID NO: 32575 - DNA, 1153 bp, Mus musculus
tgaataaactctattctatactatactatactatactatactatcctgtggctggtgcctcagggggaagggatacctcagcatgggcccgaggaggcacccctttccctcttacataacatagtccttttctccttatcttttaacaagacaccacagtgggtatcttctctgccccaatgggctgagggtgaaatctagactccttcattgagattggccttgtacatcaacatagacttgggaaatgagaaaggcagtctaagcctcaaggaacacaagagctctgggaaggtgctgcctgtatttctcttcttcccctgtagacagacattccctcatgctcttcctgctgcaggttctcaggtgcagtttggaggaggagacaggggaagagaataaagaatggtaggcagaccaggctggatcagacagtagctttcctgtccttagtgcctcatggacacccagcctggtcatctatcacctggtgcagtctacccactcactctcatataagcattaggaagctaaaactagctaaatatttggcaaggctaggcttggggctgggctactgatttatctggggctcaggtatcatgctatgtcccaggtaacccgaaagggcagacgaccctgtgtggatagccatgagtacttccaaaatgttcaaaaatgtaaagtgttagtagcatatactcaggtgctagaatgaaatgcatagatgtggagagccgtgccgcgagcaatcgccattataagatggcgctggcttccactgcgcctaactagtaaataagccttatgcgcaagtgcaagagtgaactcacgcctagtcactgcccatctcgcggggtagtaatggggtgatgggcgagcaatgaatcaggaactgtcacgccacatcaggtgctgaaacgtcacgctgcgggctatataagcagcgccattttcacgttcggggtcttccctcctgataagtaagcaataaaagctttgccgcagaagattccggttgtcctgagtgtgttcttgctggcggggacaaaagctcgggcaatacatagagaatcctcaagcgttctcaggggacaagacctctgacagcaccacggagagccctttccagcttccggctcactcagtggta

SEQ ID NO: 32576 - DNA, 1126 bp, Mus musculus
acatagccaggaccctgggtggctgggctgccagaggtgacgtggagaagaccagcacctgcccacagactctgagggctcagcatcactaggcagagacctggggtcaagtacaggtgctcaggcagctatggtcatacaggagaacatctcaaactgctgcctgtcagggctggtccttggccttcactgcagatggacctcagcaaccctgttggcgtctgactgtgattagaacccatgttcccagcatctaaccacctttcttttcattgttgccataggaagctgtcaaggaacttgaaaacctcttgtctcagaaaatctattgtcctgacagcagaggccgctggtgggatcgcctggctcttaacctgcaccagcacctgaagcgtctggaagaggtactggcagcataccccgctgcttatttggttcttaatggcaaactctaagtgcttcagcaccggggatggaactcaaggcatagttaaacaaacacttggccactgagctaccaaagcctacgaaagcaccttcctttaattagcttatttgtttgttggaggggtacagtttcactgtgtaactctgtctgtctgtctgtcagaacagagtttcactgtgtagctctggctgtcctagaactcaccatgtatagcaggctggcttcaagtacccagagatccacctgcttctgcttctccgttgctgatgtaaaaggcgtgcaccgtactggccatttattttactttaattaaaatgtaattgcaccacttccccctttccttctcctttcccattaatttctgtgttagtgctatcaccaaaaaagtaatttatggtcctgagaaaaaatagtaaaatgtatggtttttattaatagtgatgtatttctctataacacatggaaaaattactccagataaaaacaaaagcctttaaatatttagtttttataaaaaactttagaaaccactaatataacaaatgtgatagtcaaatcaaaacttaataaatgaaatttccaaatataattagaagatatttttcctttggctaacattctttgatttcttccaacctcatcccctaccccaggaaagcaggggtaattctaacacta

SEQ ID NO: 32577 - DNA, 1205 bp, Mus musculus
tgcttttttgtgatatgaaaaaaggaccacttattttgagacagggtctcactatgtagccctggctggcctggagtactgtgtagattgggcttgtttaaaagtcaaagatctacttacttctgcctctcaagcactgcgattaaaggcatgggccattacattgagcagtcattattattatcattattattgttgttgttattattgagatagggtttcatgtactcctgaaagacctggaactcactaaatagcctgagggtgatctttaacttctgatcctcctgcctcaacctttcaggtgctggtatagccggcatggactaccatgctctgtttttgtggggctagggactgaacccaaggctttatgtaggcaagacaaacattctaccacctgagctgtagccccagataatcacttttgaggttaaaaattaatttctttgctatacttcttactaagcatagaagtagatgtgttattctattgacttatttgcatttcaggcttgggatgacgtagaacgaaaagaaaaacctaaggaggatgcgtatgaatataaaaagcgtttgaccttagaccatgagaagagtaagctaagccttgctgagatttatgagcaggaatatctcaaactcaaccaggtaaggtgacctccaaggcacggttgtgactgaagaaccagatcgtcagccagtcctgatctaacctagctctcagatacctgtttcacagcacatggtaggaatagaggacttccagtgttcccactgagtgtgagcaagttggggcttgctctacaaaagcattgatttatataatcagctattgacttcctggcaattaaaggatgttgtaattctgaagtcatattttcttgatacttgaaataattgatgtattttatttctttatgagatgatctggacctttaggctcttcttgtttgttttgtttttgttttttaaattctaaaattagtttctagttaaatagcagaacaaggccatatcctggggaagacttatttcttcacctgggtttattgggatgaatgacatatgttatctgacctgggccacaggcagagccgctcacttcctattcctgtgcgccccgcgcccccccccccccccccccccggcacctctactatgttgtaattatgacaaagaaaaacaagcaaagaccattttac

SEQ ID NO: 32578 - DNA, 1182 bp, Mus musculus
tttaacaaaagttctatatgattttaataaagtattagagaatggccgaatctctggaagtcctttacagaaacttgagataaacagttttgatgatgagcagatttggcaacaactcgaattgcaaaatgaacctgtcttacaatacttccagaatgcagttagtgagacagttgaggatgaagatatcagccttctcccagaatgtgaagatgaggagtgcgaagaggatgcctcagaggtggaggctgacaaccaggagaacctagagacagacttggatgaagaacaactgtcagacgagggtggtgatgttcctaaagggagggacagagccaaaagctccaggaaatctgacccaaggaaaagtccagttttcagtgatgaagattctgaccttgactttgatattggcaaattggagcagcagaccaagatgcaaatcaagccacctggaaaaccaagagaaaagtctgtcgtagatgataagttcttcaaactgtctgaaatggagagcttcttagaaaaagtagaaaaagaagaggaaaaaagaccagatggtgaagaggaggacgaggaagacattgacctttttgaagacattgattcagatgaaagcgagggagggctgtttgggcggcagaagattaaggtaatgttttggaaaaaaacaaaaactgtttctttaaagtacaagtcatgttttcctacagagaaatgtaatgtgcctcagacctcatttgagcccaaatgaagtaaggaaaaaacaaacaaacataaagaaataaattaaaattaagagctgagccagtggtgcaggagtgtagtaatcctcagaagtgggaggctgaggcaggaagattgtggcttctcaaagccagcctttgctaagttgtgcttcagttgtccttatggttttatggtggtcaactagttgccagtttccctaataactatttctggtggggtagtggtgatgttaggaaccagtttgtgtgtgtaatatacataggcacatgagtatgtttatatatttttttatctttaaacttttcaaaaatgttttttattttagtcaaataaaagtagcagaaatctgaaatacaaagacttctttgatccagttgaaagtgacgaggacataactggggttgatgaagagctgggcccagacgaagagaa

SEQ ID NO: 32579 - DNA, 1261 bp, Mus musculus
gtcctggggcttatcttcatgaaaggcaacaccatcaccgagactgaggtctgggacttcctgcgacggctcggagtgtaccccactaagaaacacttaatttttggcgacccaaagaaactcattaccgaagactttgtgcggcagcgctacttggagtaccggaggataccccacaccgatcctgtggactatgaattacagtggggcccgcgaaccaacctggaaaccagcaagatgaaagttcttaagtttgtggccaaagtccataaccaggaccccaaagactggcccacacaatactgcgaggctttggcagatgaggagagtagggctagacctgcaactgctagtgccccagccacatcctcttgaactctttgagttatggtctgagggactctggagatccagtataaaagaacagggggaatgggggtcggaggaagcttgattctgctacgcataaaggccttggagcgttaggatgtgttgcagggttttttgtttgatttttttattattattattatggtttggagctttaaattttcatttaattgtctttttgtttataaagagttttctaactttctaaacctaaatgaaattgtatgatgccaaacatattcaagaaggaacactttggtaaattgctttgatgttctagacgataaagaaacagggtagctattatcttaatgactagttcctggggaaaaataaaagtctttttaaaattgaaaataaaattgttttagcttcttgtcaacacagctttaaatatacatattctgttgggtgtgagcacttgtggtcccacgaaatctatgtgatgtgttttctagcatttttatattcataatcataattctgttgtcctatgggttctacttaagattcttttctagtataacaaatactatacttttgagtcagttcaccattattattattattgtttccctgttagaaattgcggctaaaaaggaaatgtcatgattccagactttttttttttttccatgataagctaagtcaatggtgttgcagaagtgtgtgaatgtgtattagagcaagttgtaaaaatcgttaggtctccggtttataaaacagtgtcgtgtcgtatcgattaaccaggcctgattgggaaccacactgcccaagtgcagatcctgttccaccagaagaatttagcttgtgtatctgtagaatcaagtgtgcccttaaggtgaataaataggaaacgagataaagctga

SEQ ID NO: 32580 - DNA, 1967 bp, Mus musculus
gaggagtcttcaggaagtaggtgctacagaacttggcaaaataccctttgtttgcagtaactgagtgtgagcagtgtgttcttacatttagctcaaatgggttaacatacagttctatccaaaaagacggtgttaatagttgtgtacactgcagagcaactccagttgtctcagccatgtgattgtctgagtctttataacttttattcctatattaaaagtccagtgaattggataacaaaagagacatctaaaacagctttcagatgattgtagccagcaagtctacttaaaacactaagtttggatagaagtatactatttgaagaaatagaagaaaattctaatatgtgtgtttatatttgttccattaatagcaaaacattgtgggtagcagtctagacaatcatgagtgacatcagaatctttttttcctctcataggtgaccctaaaacctggcaaaacaagtgtcttcctggagatccgaattaccttgttggagccaactgtgtttctgtcctgattgaccacttttaattcttagtgtataggaactggactaagcaatgtgaacgtggattgaacttactaaatctaaatggaaccactctaatgagtattatattttcttagaatttatactgcaattggtagtattaagcatttgttggaactgatgaaggttagcgagcatgcccctgagccacggtcagaaaacatgctacaagctatgtgttattgagtgaagaactgtcaggcattggctagaggttcaaagatatttttgctttgtaatgatttttgtacttttttatggtcactgcttaacttcacatactgatttccgttaaaaataccagccagtaaatgggggtgcatttgagttctgttctttccaaagtacactcaaagtttattatggccttggcctagcatacacattttattttattatgcatgaggtaatgtgcacacattttttacaaatgcacctggaatatataaccagtatagtggatttaacagaaatgtacagcagggggatttataacttggggagggagggtcaaatgaagacaattacttattgtatatgaaaacacatttcttttagggaaggacaccaaagcatgtgagcccggttcatggcctctgaatctataaattaacatatcaccacagacatgtaaccagcaggaatgccttaccctagtgggtttaattcttccatcatttcgctgtgtattactaagtttttatgagttctgtgcatatctagatactgtaccatggaaaagactgagtagattgtggacttgatggtttcagaaatgtgcaaattacctggaagaaaataatggtgtgacttaaaatatttttttgacagggggagtggcagtcttctgttctttgggctgtgcatctgagatgtttgatgctttcaggacgcatgtacataatgcgtgcataccacttttgttcttggtttgtaaattaacttttataaactttacctttttatacataaacagaaccaagtttctaaggctacctttgtattctctcctgtacctcttgagccttgaactttgacctctgcagcaataaagcagcatttctacacatacaaggtcatttttctaagaaaaagaatgcacagagttgttacatttttaagtgctgcatttaaaagatacagttactctagtttgattaaattcttgcaaagtatcccttctgtaaaatttgtgatacaatactgtgccctaaagtgtatttttttactaatagacagtttattatggcacatcagcacgatttctgtttagataatacaccactacattctgttaataatcagtaggtgtgaaaggatttcttttgtggttattaaaaaaaaatctcaaatttctaaatctgcaagaataaaactttttaaaatacagtattagtttggtttatttgc

SEQ ID NO: 32581 - DNA, 1853 bp, Mus musculus
tatgtttatataaattatggtatccataaattttcttcatgatttttatcttcagtgtgaaaatcaaatagaagcagtcattctgtgaattaattttctgctaaatgaatactcatctttaccttacttgtgttggtataggctaaagcataagcatgcctacctatctgtagtgtaaatttttgagctttcacttgagctagctctctctactaatctgctgtgtccccagtagaagtggtagaatataccatttcacattttaaaattataacttaacatgtgtcattgcctaataaaatagaattaaaaacaagcccctgtgctaaaatttacttatgttttaaatgcaggtgtacaggaaggagccgtattctgaagaaatgatgagacaaaaccatattttaaaacaaccagctcttggtcacccagggcagaggccagataaagagccaaatctagcctatgaaccccaacttccatatatagaaaaacaagccagcagagaccttgagcagccgtcatacaggtatgaggtctcaagctacacagaccagttttctcggaactatgaccatcgcctacggtttgaagatcgaatccctacctatgaagaccagtggtcatattatgatgacaaacagccctaccaacctcggccttttgagaatcagcatccccgagacctggactccagacaacatcccgaagaggcttcagaacgaggttatttccagcgttttgaagagccagcccctctgtcgtacgacagtagaacacgctatgagcagctgcctcgaacctctactctacgacatgaagagcagccagcccctgcatatgaggtgcacaacaggtacaggccagaggcacagccctattcttcaacaggccctaagtcatctgagcccaagcagtactttgaccagtacccgcgaagttatgagcaagttccaccaccaggctttacctccaaaacaggccattacgagcctctccatggtgctgcagttgtccctcctctgataccttcctctcaacaaaagccagaagtcctgccctcggctaccaaaccacagcctccacccccaaccctaactgaggaggaggaggatccagcaatgaaaccacagtctgtgctcaccagagtcaaaatgtttgaaaacaaaagatctgcgtctttggagaacaagaaagatgtgaatgacactgccagctttaaggtaagctttaaggtgtgtcttagcccgagtctgtggtaccgactgagcgtcagatgtgtcctaactcccgcttcctcctgatgacagtgtccttgctaactgtctctctcttgttttctgcagcctccggaagtagcatctaaacctccaggtgcttctcttgctggccctaaacctgtccctcagagtcagtttagtgagcacgacaaaacgctctacaggtgggtgtgctgcacggcagtcacgtgagtctgaacaggaatgttggctttctagagagaaactggtgactcgttagtgacggggaagcgtgaggaggaaaaggagctcttactctccaagctgagcagccggctttcctgacaaaccctgagcacagggagagagtttgcatgtgctcctgtgaacaggctttagtcaacagatgttgggaaaagttgggttggtttgtttttaaaataagtgattgaaacaaaaagtctttaagccatattgtctccattttaagtacattcagagtctgaagtgttggtttgtaggagtgaaaggaaactctggctgattgaaatcaccacagttcttcatttagggagcagatgtaaagaactttctgtcattctatgtggagct

SEQ ID NO: 32582 - DNA, 1196 bp, Mus musculus
gtgtcttaaccaagtaaaccattaaaaaatgtagttcataataaataatttctatttgaggatgattgaattattctgttaactttatttaaggttctatagtcttccactattctcattaacagagaaagataaatatgatcagcatttatggcattatgagttaagtcaagtgccagccaatcctttataagtcagaagagtctttgttaactattggaattatataaaagtatatatgggtatatatctgcatcatttcatcatgcacctaatggaggtaccaagataaccttttatctttattcagcataaatggttgaagaacaacaagataaaataatcccagatacacagtgagaattgaggatgaactgggttatatatgctgatgtgggtattagcaggagtatcttcacagaatattttttatgcagattatgttttttttatcccagtagttattaattaatgtgtttcttttgatttcttagtttatcgccgcattgtagaatcagatgtaggagattcattctatattagaacgcattttgaatatgaaaaagaatctccttacggacttagttttaacaaaggagaggtgttccgggtcgtggatactttatacaatggaaagctgggctcttggcttgccattcgaattggcaaaaatcataaggaggtagaacgaggcatcatccctaataagaacaggtatgaacacttagaaactctttaaactgtgaattaagtgatgataggagactgggtgatccaagtttgcaagatctgtattgtttagtgtactcacttgctaccgtctaactgactcgctcaatcaccagacaaactactgattaagcctttgaaatgaaaggtgcatgtgagccttggtcctcaattttggcattctatttcatttcattgtgggttttttttcttgttgtcttttcagtaactctggtttctgtttgctttttctctttatagagctgaacagttagccagtgtacagtacacacttccaaagacagcgggtggtgatcgggcagacttctggaggtttcgaggtcttcgcagctccaagagaaatcttcgaaaaagcagagaggacttgtcagctcagccagttcaaactaagttcccagcttatgaaagggttgttcttcgagaaggtagtttatttcccatagctt

SEQ ID NO: 32583 - DNA, 1650 bp, Mus musculus
atatttaactgtattcttccagaatatggtcttcgattggccagccatatatttgtaaaggaaatttcacaagatagtttggcagcaagagatggtaacattcaagaaggggatgttgtcttgaaggtatagttatattttatattataataaattaaaccagggaacagagtctagagttattgtgtactctctgttggtgtgtgaagtggttttgctgtggagaatcatcagcgcttgtcctgctcctgtgaggtatgggattagcctgagagaattaattactgcaaatatgtatccttcaccgggataattttggtaattgttccagacactattgaagtgctttctagtttgctcataggaatgctttggatgatgtagaaaagtgtaaaggtcttcaagtgacctgacgagtttgtcctttcctgtaacatcagatttaagttttagtgtgtattttgttgtttacttttcaacctatagcttcttttctgttacagataaatggtactgtgacagaaaatatgtcattgacagatgcaaaaacactgatagaaaggtctaaaggcaagttaaaaatggtagtgcaaagagatgagcgggctaccttactgaacgtccctgacctttcggatagtatccattctgctaatgcctcggaaagagatggtgagtatggttctgtttggagcgtcccactgatttgcttcttaaagtatatgaagattggatatgtttgattggaatgatatttttctacaggagagatacctttgcacatacatttgaatgtgtgtttgtgtctgttgtcactacacacaaatactttgtaggtcatgtcattcaccgttgtagtttggtgaccactagagatgatattaacgtttcatatattttatgtgaaatatactcttagcttatttttaatattactagaattctttagtgtagtcatttcatgggaaaatcatctttttatttaacagacatttcagaaattcagtcactagcatcagaccattcaggtcgctcgcatgacaggccaccccgccgcagccagtcacgatctcctgaccaacgttcagagccctccgatcattccacgcagtctccacagcagcccagcaatggcaggtaaaaacaaaatacatttagagttacttataaataagattaggagataaatatttcttttattacttaagattgtgtctatttttcatcctcaacttaaaacttgtataaatagaagacagtccttttttttttctttttaaaaacaagatgctaggtagtacatttagtatgtaggcagccagagaagtgtttctttgtgctcaattctggctggtagcacagaggctctattaacagtataaaaatatgtagacatgggatagactttatttacagtaaccatagttaagagccagcctgtctgtcatggataaagctacagagacgtacatatgtaatagaataatgattcagtgaaaggaggcactccatcactttcagtaacatagacatagcccaggttattcaggggacagagaaacacatgagtgagcttacctctggaagcatagacacttaaacctcacagaacgagaggaaagaaggctgggcaggaagtagtgaagaggt

SEQ ID NO: 32584 - DNA, 1177 bp, Mus musculus
aatggatgctctgtgtcctctttagaagggttatctttcctttcctttatccagtaaaaatatgtttggggatccagggcttgtctgggtaatgatcctaaaaaaatgatccctcttgctgcagagccagccccaaggaggtggccagagaagctgtggcctggccacagttcccctccgaccttggactggttgtcacgcacacttggacagcgtttccgctctttgtctgagcatgcattcatcatcttgttggttgtatgagtctctctcatcctcctctttgcatcccgtcttcatttaaccccaatcttcactcttggggctggttgaggggtgatgggctcagctcccaggcagcctctggagacacagggcacttggcgcaggcagaagcacctcccctagctgatagccctgtgggggactctctcctgacaggaattgataagggcacattatgtaaaatctggagggcagagctttcccttttaggtcagtactcggcctggagctaaaaaggctaatcaacagaagcattttctgtgttcattccagagactttcccaggggcacaataaatctcacaggcctgtttacaggagcattgttatttaacaagccaggcttccgagtttaagagtttttggtttcatccaatctaacccaacccgccacattcatgattcattaccagttactcagactgcgttctgtaaggtaatgtaattttgcatacttaaaaataatcttcacatacaagattaaccttatgcgcgttggaagacgatttaaaagctgtatgtctttcttctctttttaagcctactgggaaagtgtcagtcctggctctaatctcaccagctaaggagaccaactgagctagttcatctcctttactcattcattcattcattcattcattcaggagatgcagcttatcatgtttatacatcattcattcatctgttctttcattcaaaacaatggttcaagcctggctctagaagatgaaaacatgcgtggagctcatgcagccttcaagatgctgcaggtcagcatcagaaggacctggtgctgtctggggagtggtcatttgatctgggtttggtcctaaagaacagagatggtttcagtggagggggaaggattaggggatgtgggcggagcctgatcc

SEQ ID NO: 32585 - DNA, 1286 bp, Mus musculus
aaaattgaagaacctcaaaaaatcacgtacgctaaatgccgaggaagacttctgaaggcttctccttgggcttctatataaccttgttttgacttctgaaatgtattttccctgtcacttaagatattagtacttctaagaaccctagggccacttgtagggctctaatgagttcaacctaagaaggaaaagtgattatttgatataaacaaaattttaatttgttgtgttctgagactaaataggagaagctggagaaatttgcaagctatcaagactccagagacctcagtgataaaatggtgtccattcaaagaggggaacactagcgagaattatcagaaatcatgctttgtttctttctcaaaagatgtgcttccagcctgggggctgtagcttcgtgaccagagcatccgcgttgcatgtatgaggcctgagctccatccccagcagccaccacctctcacccaacaatgacaggaataggctttcaataaaagcccatggcccttttgtaacatggaggggagatgtcttattttctaatacacacatctcaggtatttttatggctgctttactaaagttcacactgaaactcatgcccaaagctggaattgctatttcatttagtgtgcaatcataagagaagtactaatatcctgttagtggcaaaggactatgaaacctcaaagagattttgtacaatctgttatttgcattgtgagttaagagttacagttttaatgcttctaatcataattcattatatttatctttagaaacactaaagtcctaaataaaatgcatcacatggtgtttctagagcctcggtatgttccattgttggacgcttgcctggagttgaaccactgctttcctggggtgtttcacttgtatgttgaatcgagtatatttctgatttttttttttttaaatcaagactgggtttcacgatgtagttctggctggcctagaactcactgagatttgcctgtctgtgcctctggactgcatttctgatatatttaaattatttttattttgtgtgcatgggtattttgtctgttgtctgggcactgcaagagtgtcttgtgcttatagaggtcagaagagggtgccagattcctggaactgtagttctgggtgattgtgagccgcaggtgggtgcagggaatcaaatctaggtcctctggaagagcagccagtgctcctaactgccgactcagctctccagaccctgtagttccgatttcaaccttattgtcttggcacttaattaaaat

SEQ ID NO: 32586 - DNA, 1152 bp, Mus musculus
cgggcttcatttttccatcagtaacttttgctggaaaggacattggattggatttggagagctgtgtgttctggttccagttctgtccaacatgtcctctggtattttgcatagactctgccttatccaagctttagtttgtcctctgtgctaatagctcttgggtctgacctgggcccacattgtctctcaatgagcacttatagttttcatggccatgtgggaagcaggaaggagagacgttttactaatcacaccagttagcaggtcacagccagctggtgacagaaaccctcttagattgcaggtgtcactgaccccaactccaagctgtttgcattctagcacatgtgtccttgctgattgatctcgccaccattgaaaattgcctttcactgttcttttgctcaccatccgtagagaatcagctgttctctcacctcacagaaagtactgaaatccctccttacatgacgaagtgtccaagcaatggtttgtgtagcagacttcctgcagactgtatagaatgtgcgaccaatgtctcctgcacttacgggaagcctgtcacgttcgactgcacagtgaagccctctgttacctgtgtcgtaagtattgtagttcacttttcccaacggcatgcatcataacattaaaagcgtagcctctactggtcagcgctatgatgtaatgatttcactgtggtcttttataactgcactggaaagtatttttaaatcttgcatttggttctaggagtatatctcagcggtaaaacatatgcttagtatatacgaggccctgccctcaacaacctctgactcactgctaatttttttttccaaacatgaaaatcttggggtgagaacagtctgtgcacagatgaaggccagtgcttgggtccctagcaccagggtaaaaccttaggcgtggctgcgtgcacctgtatcccagaggcgggttcaggaggaccttaagaccttgctggcgccgggtgtggtggcgcacacctttaattccagcacttgggaggcagaggcaggcggatttctgagttcgaggccagcctggtctacagagtgagttccaggacagccagggctacacagagaaaccctgtctcaaaaaaaaaaaaaaaaaaaaaaaaaagaaaag

SEQ ID NO: 32587 - DNA, 1176 bp, Mus musculus
tatgtagtccagcctggtcacagacgtacacagaggtacagtcgtacctcaacctcccagtactattgaaccagccatatctcatctaaatttaaaataattttaatctcacagaaaattgcaaaggaaatagagttcccatggcatccttctcatgggccctaactttgtcaacattttacatcatacactgcactgaataactgattggaattatgaaagctttttttgtcgcaactcagcatgggttattcagagtgctcactctaaggagatgtctgtggtttgctccaaacgctgttggttccatggccccctcagataccaaaaccccgggcactcaggtcccctttttatcaaatagtgtagtgcttgcacgtcgcatacatacacccatacatacactcctctaccttctgtcatctgacctgacttaagccatccactgtaaacactgagtgaatacttgtcacttgctgaggtacagtttgtagttgtccagtacagatgcatttgtgttcggctggctgggatgatgaaccttcctttggatactgagcgctgactgctctgctctggggaggggtaggacgctaacagagtcagccgctgtgggtacttgttagccccagtactcgggctcctcccctgggcgctgtgaggtttgctttgagccattccgttatttcccagcagtcttagatcgtagaattaaaggaaacctttaagaaccatgcacagtactaagcctttagggagaagtacctgagattaggtgacttgatttgggtctgacaggtatgtcaagtgcctcaagactcagttcccgcctccagaacagcactcggcaagctgggtccctcagggaggctcatttctgtaacagaaaatgttaggtttcagcatagccgaaaattgtgtgtccttattctcccctgcatcgagactcaactccaggcctcccacatgctgagtccttgctcatcttagcagtcttcttgcctgttgtgaatgtgtggttaaggggttccgtcttcctagaccctttcctacgtggtgggaaccacccaacatcattggacctctgctcttcttttgcagcatcacccttggggggtttggagccgatcgcttctacctgggccagtggcgagaaggcctcggcaagctcttcag

SEQ ID NO: 32588 - DNA, 1100 bp, Mus musculus
ggcactactgtgtaattcagggccctttccagagctccctggggttccctacatcccaagcttctttgtccaccttgtttctttccccatccatcggggcagaaaccagggtatctccttgggtttttctcttccccagtgttggcagccactagggacaatccctgccagcctgcctccagttgcctctcccttaaacccttcccccaagccaggagccacagctcaggccagccccatgcttaagctctgctgacatccatatctgcctggttgccctccctgactcccttctcagccttcccctccaccaacaaccagaaggttctttagagccacaagcctcacattctcccttccccattttcaaagcatcagaggctcgcatgtagtgtggcacacagcccagtgtggggccccatctgcctcctgcgtatccccgagcctagctcctcgctccagcggtgccataactctgatgttctggaagtgttaccctagttctttctgtacctctgctgtttgttattgttcacaatctctctctatgtgatctacccagagagcttcatcaaccggtctactgccatcagggttgagcactgtccacccagaactccatgaagtccatcttctccctggatgacagcatggtgtagtagtatcttaatcatgcctatgcctcctcaggacttagcctgcttcctggcacatagaaggaaggctcagtaaacatgaaacaattccaggatcggtggtttcttgattctactcaccgggttaatgatcccaagggtgtgagtgagggaaaatgccaactttattgtcacagcttctagtgacttccaggtttgtaagtgtcaaggatgtgtacaggttgctacccagtgacatctcttggtaccttggttgggtggcttcttgttctccaggactgggtcttgcgccacaagttcagggttacctgcacgaacttaaaaatcaaagccaaaggacagagctgatatatctggtagtatccagagcccacgtcttaaagtaagtgtgaacccagccgggcgtggtggtgcacgcctttaatcccagcactcgggaggcag

SEQ ID NO: 32589 - DNA, 2037 bp, Mus musculus
tgcattgaaatggctcatgagggagaccctgcatcctgcctggtgtaccatcagtgctggcaaatggagaacagctgaatcttaacaagaccaaaaatctgaccccctccttttccttttctgttgccagccgatgagaccttctgcgagatggtgaagtccaatcggctctgcgaacggaagctcttcatccagttttgctgccgcacctgcctcctggctgggtaggggcaccagctgcccgcagagggcagggtcctcctgtctgcccgtttgcccatctaccttcctacagatggtcagccatagcctgttccttggggtagccctgcatctgacagctgtatctcccccagagctgggttctactgcagcatctctgagcacctgaacaggtggaggtggcccttaaggatatgtggctaaattgacaaaaatccccttgaactctgcttgctggctgcagtctaaagttggactcaaaacaggaacaaaaatgaattgtgagactcatacctgcagcttcggagtggcttctgggaccctagtttactgagacttcaagaccaaagcagaaaaagcgagatgcctggcgtcacatcacgtcctcctcccacatatctgtgtggccgtgacaaatctcagcgagtcggctggcaggaccctatgctgccctcacctatgatgaagggcctcgcttcctccctgtgcatcactggccaccaaacagccggagggacagtttgatcggactgtaaataaaatgggtttcagggcataagatgtatgaccactagagagagaatctatgtctacgcagtcagctccttccgaaacggcagccccggcctggacggcctagcaccaaaccgaaataggtccactcatcctctcttcagcgttctcttctgagtgagccgagctgtccacatggctgttctacctgtgtccctggggcctcctgggcccgagccaccagccatctacagctacagagcctgtgaaggaggatccaaaggagctacttaggattagccaaaagacatctgatggccaggcagttccataaacatgcaaagccagcccctgaatcactagtcgccagccctccatggcacacaactgcttttcaagtgtatttggcctctgcactcgggactctctgttcttgggtggatgctgcgctggtccagtatggtacaagcctacatgatagagctggattgatttttctgccaagcctgtgtgggcattttataagctacgtgttctaatttttaccgatgttaattattttgacaaatatttcatatattttcattgaaatgcgcaaatccgcttgctcagttccctgagctaagggaataacacttgccttaaatttccccaacctcgtctctctccacatggtcctgctctcctctctgactgtaatgtgtttgtcttgtcacctgtaggtggcaaggactcagctgttgtctgttgaatccacacttcaaataagaaatcagtgaagcaaatctaatgttaaccctgagttaataaaagagttaacatcccattgcaaaggggcttgtatttcttttcaagataaataaaactttgagcctcagtgctggccagtgggtgaaatggaaatcactttatgggttcttgatctgtcagatgtctgtattcgttatttttctcattgctataacaaaatagctgacaagaagcaatgtaaggggctagtgagatggctcagcagttggtcaagaacacttggtacacccctttaatcccagcacttggaaggcagagccagatggatctttgtgttcgaggacagcctgatctacaaagtgagttccaggacagccaggctacacagagaaaccctgtctcgaaaaacaaaaataaaataaaatagaacatttgttaatcttgcagaagacccaggttcagtttctagtatccacttggcagctcacaactgaatgtagctacagttccaagaaatccaatttcttcttacctctgtgggcaccaggcaca

SEQ ID NO: 32590 - DNA, 1242 bp, Mus musculus
cactttgtgagctgtctgtaagaagctaccagtatagccaaacaagccgggtaacttgtatctggaaaactgcagtttgcttccaagtaatagacagacttgtcagtagtttctctaaacattggagtaaggcaaaactttttggggtatggtgcggtatggtgtgtgtgtgtgtgtgtttgtgtttgtgagtgtgtgtgtgcgcgtgcgagcagtttgagacaggatctctctacatagccctggctgttctggaactcactatcaccaggctcgattcaaactcagatctgccacaaatcttggaacacaattaacaactatgtgtgcacatgcatgcatgttgatgtatattcattttttaatcaatgtgtatgtgagtgaacaaataatacaaaacttacataacttgacctgtgttctttcagggccgagtgatgagggtgaagaagagatagaagacgacacagtcacaaatgggtcctgagctctgccagatgctctgataagctctcttgggacaagtcttgcattttgagcatggagtaacaaccttgcttgtatcagcaacgtggactctcagctttgctgaatgttcagaacgactggtgataattttttaataggaaccttgaaataacaatgccagttttctacaaatggtaaaataaaggcgacttactgtgctgccggactgtgtgctgtgtatctgcagtgagatgtaaggggatgtttaagttagaagttggagagagtggtgttccggaatagacattattcccactcatgaaatgttacaggttcttcataaaggtaaggcaggaaggcttgaagactagacaaataggcattctttgaccttttaaatcaacatacatgaatatctcacaaatcaatttaaaatgatttgaaaagttttaaatagaaaatggggcttttgcttgagcaaaaataatcttccagcctctgggacagaggcacagaggccatggtttttctgtggggcaggttaaggcacgtttttctcagcatctaggcttcttactgtattctttatctagggaagattttgttgttaaataccagtgcctcagtttccctactctgccttgttgccttgagaacagtgcctcccactgagcctctcacttgcagcctgcaagtcccagcagtcctacctctgccccacagtactgggttgcaggcacgagtgtagacagacccagccttttacctgggttg

SEQ ID NO: 32591 - DNA, 1196 bp, Mus musculus
aggaaaatcttcaggccagaactgctacagttattattcaattttggatgtaatacaatgtttttatctttgtggaatttatttttaggtctgaacttggtattcttttgttccttggccataggacatcacagtggtcctgcatagactaatttttccaagggaggtcttaatccctcattcttctatcatttatccacaccatcctttgtccatcaggataagcccccgtgtagggcagagataactcaagccggtttaactttgttgttgtatctttttcctggaggggcattccatatgtgccccccccaatgttatatatgccacgtattcccctgagtgacaggaggaagaggctttaacctgattgatcggctgccaacctctccagcctgctgagtcttatttctcttttaagtttaccttgttctaattatcttgtgcctgagtaaatggagaggcgagtgcgtgatccaaggatatcttggagcctgagcctcacaaggagatctctggtgtctttatttgagacacaacctccgggcctaaggaagaccctcaagtagagccagataaggatgtctccctaaaagtggggtgagtggtatgcttaggactcccctaggaacgcttagaagctgtcctcttgggagaaggcataagagagtcatacgcttcccatcaatccccaagttgtacaaatattaaaagtccccaagcatgcaacacatggagatcaagaccagaagtggaagaccatgtgacagcgattgtatcgctctgctcagctttgatagatagcggtcaagcagctgtgctggctttgtgactttcactgttcccattagctgtggctgggccagttagtgggtcttaatttacagaggattaaaatgaaaatgtcacccttttctttgtgctccagcgacaccccccagtgaacctctctagaattattgtgagtgaccagaaactcagtgttagggtctgtctgtccctccatccctccctccctcccttccttcctccctcccttccttccttccttccttccttccttccttccttccttccttcttccagttactgtgccacacctccccccatctccagtgttaggttttacacgcactccattttgatttttccctgacctcatcagacctgatttccacttaccatttggttgttta

SEQ ID NO: 32592 - DNA, 1592 bp, Mus musculus
ggtatggtttctgttgtggatttgtttttgagacaaggtcttacttaggcttaggttggccaccagctccatatgtagccaaggtgaccttgatctgttgttcctcttgcctctacctggaccttcacacccttttaaaatgctttcattttgttttgtttttgagacagttaggtcatcttaacttaggacagcttaagtaattgcctactgggatttaaggctgcacaactatcttcacccaccttatttttatgtaatagctgaagtcccttggaaatggccataagatggaatctataccttgcaatttacatgctagatttgtggttatagttttaatataggatgttctcggatttccagccatcaaaatggttctgtttccttttcacttccaggttataaccctctgacgggtgaagggggtggaacctgctcctggagacctggacgcaggggcccatcatctggcggctgaaactaagactcttgttagtgtcgctctgacattagcaaggtgaacctttaaccctcaactcaattgccttacgcacactttcacagtgactggccaaggagaggtggggcttttctctgttctaaactacttgtactttaagggctttggtcagcatgagatatagacattgccattaggccacactctagacaagacagccatggcttttatggctgctggctagttggtaggttgaaggcttcttgctgtttagcagacttcataaagaaggcccagtgatgatactttggggtagaagtccttgctggcaggatggtctctgtgacgggatgcgttgaatgatgtcttccttataaatggtgaacccaccagtgaggattactgatgttcacagttgacggggtttgcttctgtatatttattttatgtacagaactttgtaaaaaaaaaaaaaagttaaatacttaaaaagtaacatttttagcatctttattaaactcaaggaaatttctttgtgagcttgactttgtcagacagtaaacagctttgtatcattcacagtctctggtttttcttatttctcatggctggtagcagatggtgggtgactttacagttgacaagctccttggggttcaggataaagcatcctcacagcaggctgtggtggtgtctagaaccccacactctgggtgcggatccctgcacacctgaggctagcctgaactatgtggtgagttccaggctcaccagagctatctagtgagaccctgctgaaggaaacacgagtgcattgtaataaactgctgaaacatgtttaaaagaaaacaggtaggcctgtaggagcttgcctgtaaatacttcagacaccgagcaatagccagtctgccctatgtagcaaaaccccatcttgccacacaaagacaacaacaaagtcttgcttgagctgctaggattcctgttatgcacatggctcatgtgttgcatccgtgagagacccaactggggatttgctataagacagttgattatgtatgtgtgtatgtgtcactgtttgatttgtttgtttgttctctgtgtgctgtcctggaatttactttgcagacca

SEQ ID NO: 32593 - DNA, 1161 bp, Mus musculus
gtcagtttggtttccagctgtaagtagaacttaacaataccttaccctcccttcacttggggttcttatgaaaatgaatctggagtcagtggagtctccattgaaggaggcaagcagaccaaatttaagcagtcacataatgattcaaaataagcagatacatgcatttctgaaaataattgtcctctaatctgtatttattttaattacagaacatggtccaagacaattcccgggaaggtggagttcttctctagcgagggttcagatacatctatacccattccagtggtgcccctgcggggtgtggatgactcctacccaccccagaagaagtctttcatgatgctcaagtacatgcacgatcactacctggacaagtacgagtggtttatgagggcagacgatgacgtttacatcaagggagatcgtctggagagtttcctgaggagtttgaatagcagcgagcccctcttcctcgggcagacaggactgggcaccacagaagaaatggggaagctggcccttgagcctggagagaacttctgcatgggcgggcctggtgtgattctgagccgggaagtgcttcggagaatggcaccacacattggcaagtgtctccgggaaatgtacaccacccatgaggatgtagaggtggggagatgtgtccggagattcgcaggcgtgcagtgtgtctggtcttatgaggtaagagcagaattctttatgtgggaaaaactgtcaattttgccttttgagctctgagttaatcataggaaactagcaataccagcctcttcagggttagcactggtataagttattggtacatgttttagccttagtttttaatttttagaattctcattacccagattccccctggccttttagactcctgggcctttagagtatgcctctggacttctgatgtcttttaaaataaatgacggcacttggggcttgaaggaaacgtagggtttactgatggtcactgcgacctttttccatgaaacccagaatcatctgatttctgttgattccaggaccttctgcaggagcataggctgctcccttgttttccagctcccaaaggctcccactttcgtctggtcaagatgacctacacagatcagaaacttacgtgttttgaacttataa

SEQ ID NO: 32594 - DNA, 2278 bp, Mus musculus
ttttgcctttactcagaaaacaggtttctggagaaactatgggtttggcatcacttgtatttacaagggagatcttgtcagagtgggtggcttcgatgtctccatccaaggctgggggctggaggatgtggacctctttaacaaggttgtccaggcagggttgaagacattcaggagccaggaggttggagttgttcacatccaccaccctgtcgtctgtgaccctaatctggaccccaaacagtataaaatgtgcttggggtcgaaagcatcgacatttgggtccacgcagcagctggccgaaatgtggctagaaaagaatgaccccagttacagcaaaggtggcagccacggctctgccaggacagcctgactccggccccactgcggagaacgttttttaattgcctaatttatttttaaaaagtttttgtataatcagtttttgaagtccatacaaggatatattttccaagtggttttcttacacaggactccttaaagattgagctttttgaacaaaaatgtgatcaatgtttgccttcgaacacaccttgctgaacactatgtagcaccggcttaatcctgacttgaagcatacctgatgaacaaaactttggtataagaatttttttgtttttggtttttacatttcttttccagacaattcccctgtctctgtagtcctaaggcagaaagctggaacattcctaggaagtctcgtcaccgtgatcagagcactgtaaccctggtcgatgctgagactgttaacttgtctctgggaagtgttctgctgtggctgtcacctgtcacctttgcacaaactccacctttttccttttttttttttttttaactgttttttttaagccatcttgagttccagtcataaagtaggcaacatgatagtagttgtgttgtcactctctccaagacagctttccaaatttgattattcccccacgtgctccacccaccgagggtcgcgcaggctttcccagtgggaggtggagggaagcacagaggtgctcgccccactgaactcccgtggcctcaacggacctggcactgaagtccaagaaggacttggcattttctctgccccaacccttctttttagagggtgcagtattattaagggggacagagtggctgttagcagtgtaatgagtgcgagctaaacagacaaacctctaatggaagtgtgagggaagctggggctctgctctctgtcctgtgctgtggatggagatggctgcttcattttttaattactgggttttctatcttgttatatgaaatacctttaatttatttaatatacccattgttttagatctctgccattttgagtacttgtcagttactagtatttatgtgcacggtgagtgtggttagaatattttatttgcagtaaactgatctccaaagatttccttttgaaaacactttttcctcatccttaatttttacattcccgtcttactaaagattaagtgttctttgataattttggtgctcatgtgttttggggacaaaggtgaaatgagtctgttgtcacaccagggtgtttgttttcaactcacagatccaatgtgccttaagaattggttttcatttagagttcagacagttgatagagttgccatttttaatatacatcgttggagatctgcttatttgtaaatagcctattgcacactcgaacaaataaaccagtggacagtatttttctattgtactctgcagacccattttgtctcattatttgtgttggttgaagacttgagttacatttggagagtaaaacactgaagcacggacttccttccagcctttgcagcgctgagtcggtgcttctgtggctgcagggggagtggcgtggagcgaactcctcaaggaggagctgctgactcccgtgtgaagcccagagggcctcaggccaggccaggcctctgcctggctcttggctacaaatcactttcatctgccaggggatcacctgttaagcagcatcccaggtaaaaaccatcaccaactgatggcttggggttctaggctccatctagccggagaaaaacttgcacatcagttgctgtagattcagaagtcaaaaagtgacctccggtgctattcgccaggttcagtagatgacagttataccctgagagaggcatccacagtgtgacgacacttgggtccagaacaatggcatcatgctcacagaactgctgtaatctgcctagctgccatccagtccctgcaggttgttgggttt

SEQ ID NO: 32595 - DNA, 1225 bp, Mus musculus
gaccatgcaggtctgcccctgaatttgttatcagagaagcagtctgtggccctaggagagaaaacagcccctcataacacagcccgttgactcaaaattcacactgagtcttttgcgcttcttttgaaatttattatttaagcctattactaaaactttataaaatgcatttggcgaatacaccaaagaaaccagctcataaaatatgatcattaacgaactgcaaacctcatcttttgaaaacaagggtgtttctttgtaaatatttgtgtttataaatgtacagcagagttaagagtgtttttttagattatttaattcccatatttctaaactatttactacagaataacccctgcttattagtttgggtgacttgattgtttgttttttttttttttaattcattaccagtcatgcttggagtgacgattctgctggagaggtcagcactctggcagtggctggagtcgcttgtaaagcatgggggagactagcatgacctgtcagactcctccctcgtaagacaccaggaaagcgtagcttaatggccagagtggaccatgagaaagagtttctaacttccctactgaatcacctgttagcccagggtggaattgggacaaggctgtttgcccacaaatttagctttcatgtaactcccagtgtgttgtatcataatatattctgttctttctttgtaacgtaagttttgctttgggtcgatttgaattaaaaaaaaaaatcttaaatctggtttaaaaaaaatactgaatttgtgttttctttctcttctatcttaactttttcacaactccaggtgtttggtaaagtggaataaagctgtatttttcatcagcacattaggtcactggtgactggatgagaaaattattcaaaaacaatgcacatttcaagccatttctttaactctcttttatttacttattttttagtgttttattacatttgtttatttacctacctgctttgtggagctgagaggaaagcctgcaggagtctattctctgctgctctgtgccccgcccaccatggggttcaagcccttcatgtgctgagccccccacccccaccccgcccctcctccctatagagtgcactctgtgaacacaagccagcaaagggcatggtcgtgagtgtatcactccagcacaaaggcttcatgagtcagattcgttatctgccacatcttggcaaaggagac

SEQ ID NO: 32596 - DNA, 1115 bp, Mus musculus
aaggacaatccgtggcacagctgcattgacttctgggctacagctactaagcaccactccccgccacctctcggatgatcgtttccagcactgaaggggactgtgtgctagagtgtgtctaacccgagtgaagcctagggttcaagccttttcaagccttaacatttttcagaaaagtgtacacacacacacacacacacacacacacacacacacgcgcatgtatgcacatgcgctcagcaaactctgccattcctgaatccacactgcacagtgcaatttagtgcatttgtagagttacccaactacagaaagaaatctcagtgagttttgttactaatatgttcagtcttaccctgttatcttcagtagagcagtcactcaaataaatatactactatttggctattctttcaactttgttcatcttagtgttttagaaagcgtaacattttcttagcagacttttgagaaggtagtgtataatctacctgcttaaaacccagagtcagtggtctattgacagtgcctgtaggtggccactagctgttcttcagtaccagactctccttccagaaactggctttcgtcggcttcttctgcagctgcagaaatcgagcctacatggtttccagcctcttccttctagcccactcctctgtttaatgttacattccgtgtcttgactttcgtcagtaacagtttcgtcaagataattccttatcaggatgtagttaagcctcagattccactgtttgggtgcaattgatttgcacttagctcagtgtggggcatttgaaattgttggcattttttttgctagggccagggagtgtccttgactggtcctttttctttttttcatttttttaaacctttgtcagagtttctcccttaattcctagaagtacttgccaagtcaaacagcattttatggatgctgacacattttcttccaaagagcctgcagttgcttcttgtggcctcctgggactgggtgggacagtgccctccccccacttctctcagcagcatattgccaggtggctggctcttccttgtgtgatgtgcttgcccctcccaaggtgacatataaatatcaaactgtagcaaga

SEQ ID NO: 32597 - DNA, 1152 bp, Mus musculus
cacagtgcctcatgctccggcttctccagttggagagaacacttgcccctggctcccctgggcttctgatgcctcctccgaatcccagagccaggtcatgatgcccaaggaaactctcccagtgccagctaatggcccaccttcccggacaccgcagagtctggtagattatgacagctccgaagcttctgaggaggaaaccacaagtgagcatttagcaaacagcaaacagacatctttatgtcaagaaaggtctgaggagatccagggcctgcctaggacatgggaggagcaaaaggaacatagcctggagcctttgctctctgcagagtccagttctcccttctctgccaagggtagagttgctgcagacgggactgtctggcaagtgggattgtttcttcgtacagtgaaatgccttgaggagctacagggagcaatttaccgtttgcaggagaaaaatctctttccatataacccagcggcacttctgaagttgttgaaaggtgtggaggccaagtgtgttaacgtctgagccctgggtaacacagcagcatctgtcctcggctttgttctccttgatagaaagcgtctacctaagataaataaaaacaagcaagaactgcaaacatgcgtgtctgggtctttgccttatggagcatagtagtgtttgagaaaggaccatcccatgacaggtcaactggcccagcttgctacagctgagagtttatgctagttcagactacacggaattcgccatgacaaatgactgcatattctgtagcccaaactaagtaagatttatcttctgagctcaagaggccagaagcttaaaatcaagatgtgcagtgtaatgtcctgggacgctgcacatcttatccatgatgcatctccatctctgcacgctctgcatcgtttgctaccatggttattttctcttctgttttgagcatagctttccagctggagtaacattgtctcgttgtagctttgatttgccctgccctgatcggagacatccactactcctccttgtccaaagatccagtttcaagttgaggaagaaaccctgtcttaaggcagaaaagcctagtcaaatagaagtgtggatgtcaaaacggttagggagacatgttggtgaggctgtgtgtt

SEQ ID NO: 32598 - DNA, 1222 bp, Mus musculus
gaacaaaattcaaagtcctgtatatcttttatcctagatttttaaatactccttttcctgaaaattaaagggtttaaaaatggctgctattttatattgaacaatgttgagcagctacctgcagtttttacttccattttgctttcccccccccgacttccctaaattctgctccttttgatgtttcctcatctgctgtcctgacaactcatcgccagccttcctgcccggcacacaggtattaggcacacacaccgtggcgagcgagcgggcacaggctgtgcagcggagagcgcctcactgaccgttggctagcacgtgttagcagaagccaaaaaagtggggtgatgtttgctctcctctctgtggtctcaacactcggctcttactcagaaaagagtaggcttgctttctgagatgtacggaattgacttacaggcacgttcttcataaggtcagacctgactaaaacaagacagtctcccaacactgaatgtccaagataacccttaccactttgtaaaccatttatagctttgaaagtattaagtgaccctttcatcattatttatgcatgttcatgaacttctgctgtatactggaataggagttaacacattcacatttactgtctattttcttgtgtgccttatgcgatggcttttctgactgtatctcaatagtctttctttctatgcaggtttgtaatcaggacaactactgttttctaaaggaatattacacgaggctcggagtttgtatttaaattacactgaccaagtcacaatgtattccgttttcaggaactgaatatctgactgttaatcttcccccatatgcccagtgtgatctggagcgtatgggtctgacatccttcacccagatgctcatgtgtgaacacatccacatccacggctctcagtggaagccagcctagagcagggaggacactgacagtgttgctttaaactgacttttcttaccctttgagactcatgtgttttgtataagacaccatcacaggaaagttttctcccttcagataacatattttattattaaaaagaaaaacaaaaaaagcttaagttgcactggacatgggaagttccctcaggactctaagtggttctatactgagagtgagtgtcaccgctgtgtcaacacaggtggtcccagtcaaaactccatcctttgagccctaattacatccattgtgttacaa

SEQ ID NO: 32599 - DNA, 1223 bp, Mus musculus
gcattagaatctgaattcagatcccccagaccacagaaaagccaggtacttggtgcatatctgtaaccctaattggtgtaaaggggtaaaggtggaacctggggctccctggccagccagagtagctgacgcagttagcagtaggttcatgagaggccctgcctcaaaaacgacggtggagagctgtggagaaagacggatgatgttttgcttctgatctccatacatgcactcatggttgaacacatttaagaacacagatgtgtacacatgcagcccctttctccaagtctggcaggctgagagaaacgtgcttagcaaggctgaatggtttgcagtctagccccaagttctaggcttcagcatcatctctgtggagatatatatataactaattgtatttacttgaattgtagcagtattgattctctttactttattctttggagttcaatcagaatgcgatttatattacctttggttttggttgtagaggttggcgatttgaaggagctgcagacactagacatttctagcaatcgcttgctagctttacccgagaggcttcacctgtgcctttctctgcagtacctcactgtggaccgcaatcggctatgctgtgtgccgcgccatctctgccagctgcccagcctcaatgagctctccatggctggaaaccatcttgcatctttgcccattggtaagtgttgtggttatatgatgactagacgagccaacacatacaagacaacattgtttccttaactagaacagattagcttagcgtctctctgttgatcctgatgattcctccgtaaagccatttttgacatgagcaacagccattatcgccagatgacaagggaggttattttagtcagggatgatgtcattgcttgtgttgccaggcagggtctccctgtatggccacgctgttttcttgaaccttcatcctcctgccttggcctcccatgtgccaccatgcctagctcagggatcccatacttacaaaatcagtcggtgccttcacagaatgtgccggctatgagaaattactctatgaagggaattaaaatgtgtgtgactgtaagtctgacagagagccttgagcattacgaaaggatgattcccagtacaagcacatctgctaagtcctgtttcctctgctcccttagtcctgtagatttaacccagggtcagacatgctaggcaagctctgtacc

SEQ ID NO: 32600 - DNA, 1164 bp, Mus musculus
atggagaatgcttacatttttttttttttgctattcattatcctctttaagaggtctgtattatggtccttgctattttttaattcaggttttcttgctgagttttaggagtttcctctatattttgagaatgtctttatcaaaaaagaatcactggaaaatattcttccagatttgccattttattctccaggtgctgtcttcatcagggcagaatttgttttatattgaattttcactgtgtatgtttttgtgtgcctagatacatagtgcataggtaaaggtcagaggacaaatttctggagtctcatctcttctacggtgtgtgggctctggagacgaactctggctctcagccatggcagcaagcatctttactcactgagctatctcactggcccagaaaaatcacaattttaatgatatctagcttatcaatcactccatgattggtgttttatctaaaaaattaccataaacccaacgtcaccgaggcactcctacagttttgtgttttactaggtctgtgatccagtgtaagttcgtttttataagcagcgtgagatctatgtctagattcatgttattttgctcgaatgctcagtgactcctacactgtacgtaggaaaggctgtctgctctccgccgagtcgccgttgggctttcatcgaaggtcagtgggtctgactctgagctctgttctgttccactgacctgtctccgcctgagagggcgctaggcttctcctcactcttctcattagtactgttttgactgtttttctccatatgaactcgtgaactactggttagtcaccataaaataactcccctacgttttgattatggcggtgctcagtctcgaggactgatcctctgctgtgtgagcagcatctccacctggctctctcagaactatccttgcgtggctcttgtaggtctgtagttttgtcgtgtgatgatgcttcacccttttgctagagttcagttcagaatcggatttttaagtgaaactgtatgaagatttcaatttgcagcgatggtgatgcaaatggtgttttgttttttatttcaaattcccatttgtctgttattggatgtgtggaagcaatcagccttaccttgctataagtgcctctcaggcccagggtttttaagacaaaac

SEQ ID NO: 32601 - DNA, 1161 bp, Mus musculus
acaacgcttcccgtcaggacttgacagtattttccactctcattccacggatgacctacctaagacctgatttgcctcagctcggtgagcatggctgcaaggcattaagagaggagaagcacgccttgtgtttgatgttcttgggccatgggtctcctctgcatcccctcctgaggcttcttcccaacagcaaaggccctcgctcaccggtctcccttccgtctacaggatctccgaggctgccgggaagtcaaggcaatcggtgaaagccaaagtagcattctgcaccagtgccccccagtacggcatgccagggaagggcaggcacagtgtagcagactgatgcgcccatgtgccgccccaaagaaagctccaagaaagacttggcattgcttgtaggatgctgaacaaacctctctccagctcgaaggtgaagttcagcagccactgcaggtttttaaggctgtttacttcagaatgcaatggcagtaccatgaatcttccacaccccaattgtgaatgccctttggggtgatatggtgctcttggttatcttctttcaccaaggagactctcctctgtcatctctgccgtggctgaaacactcttcccaagttggagcttcttgacaggaaaggagactcacctggtgacaggcagggctcctgctccatccagagccacatctggggcagcgagaccctgcacaaagcctccctcgtatgaaagtaatagtaactgagaagaaactaccaataaagagatgcttgtgctagcagcagtttgtgtgtttgaaatgaagactggagctggcaatgctgccccgggacagagcgcttgcctggactccatggagcctgctatggtttaaatgcgaaatgtctctcataggctcgtatatttgaacacttggttcccattgctgagaggccttgaggcaggagtccagttggatgaactgtgtcactggaggtgggctctgaggtttcttagccttagtcccattttctatgcactctctgcttcctgatggcagactcagtgggactagctggtggtgcctctgccacctgccttcctcaccattgtgtgtgtgtgtgtgtgtgtgtgtgtgtgtgtgtgtgtgtgtgtgtgtgtgtaaatatgcacacacacacccct

SEQ ID NO: 32602 - DNA, 1859 bp, Mus musculus
cccagcatctaggcccccagggcaggctgacagatggcaaaggccccacccgtgtgggccacagattatggacctggagctgtgcaccactgaatttaagaaggatgagtgtgctcatttgggattgttcctttacacatggacattgtttttaaagctcccatctcttaagacttggcatcacataaaaagaaaaagagcctctatagtgcagcagtctgtgagcgcagaatggtagctttcttgagtccgagctgtgcttttgaacccaggccacaaacctgcctgtggggcactgaggatcctagaggatgccatcttcaggtaggggaggagccttcttccctgacccgtgtgtgtttcacggggcatatctcccctctggttccagcaggtgggcaaaggagagtacgatgtttttcattgccaagtataagagaaacacagaacggcttaagatgatcttttcaaacgccttgcacggggtacaggaaggaagcggatttgaatggaaagcctttgttaccctcatgccaactgagctcagggttgtcagcctgagccaggagttactacggctgtggctcgtcatctcttatactgtcagagatgtgcggacttatttttttccataagcagaaaacccgagtgatttgtaagaatgtggccaaggtggtacagccttggtaccataatgcaagacacagtgacaatgtcgagtttattatgagtctaagtgggcttagctggatgtcattgtcctagttcatgaacttgtccatgggcgctggtgtgagcaggttataaataccgtggcacttctactttgaaaaataaatgtcttagaatgaaatactaattttcatttctaagttggaatccccatcgaggcaatgttatggttatgtttgaagaacctaccaggaaggaggagtcctcagctgtcactggttactatgtctccaccattacacccttgacattgtagcagatcaccgccaaagctccctgaggttttagaaatcagtcactctggagtcaaatcaacactgtgggagggcagggagggccccagtctctcccagtttgttattgttgagactacaggagactgaatgtttcttagcttcccactggttgttttgatcgtttgctttacagtgtttatttagaattatctaagaagcctattttgctaacctgttccctacaaagagaactgtcacaagaatgtgtagaaataaagatctgaggggggaaaaaaaacaactgtattgttcttaaagagaatgttttctggctgacttccatgtggttccttcgatgctgatgttccattcctgagtttctttccatgttttgatggtagccatgggttactggatgggtcataaatgttccttagttcctcctgagatcagaacttttccctataggttcaaactaggaagcatgcactaactagcttatatccaagtggatagtttggtggtaactgccatcccagcccggaagactgttgtcagcaggatgagacagccatccattctgcccaggatggaggagggagccaaggtacagttattcctgctgaacccagcattgtctggggctggagctggtcaagtagttactcgaagcacagtttgtaaggctattcatggccatttctcagtatcttaagatatagatatatgcttgaaacaaggagtgggtgactgttcgtctgtctataatctggccttttagcaacaaaaataaaaacatgagtagttgtatttcttctcacttgtgggagttaactgaagtcagtggaagatattactaagactcattgcattggttacatttctgttgct

SEQ ID NO: 32603 - DNA, 1186 bp, Mus musculus
caggttgcccaaattggggttcctcatagtgcatagttttctttcagcagctgcggctgcagggttgcacttggtagtaaaagggcaaaagatcagcatacaaagagcatagcgcccccccccaaagagaagactagaaaagggaagatgattggtccccccacaaacacttctgggcagttctagcatttgaattaggtctcctggtgcccctactctctggaaggattgtgataaggagacaggttggtgaccagtcaggtccccgtgacaaggaaaacctagctctgctcctggggcggtgactccataggatgttttctcggatttctttttgacccccgaatggcctccttatactttgctgagtaaatgttatcagataggatgtagagaaatcttttttgttccatctctcggtgggtttgagataattgggttattctgtgatgtgtctctgttcccttcagaagcctctgaataacgaatcggggaagcttcagagcagaagcagccagaaagtatccagtgttgcttccctcacagacccgggaagggaagcgcagagcagaaacgcccagcggtagacctccttggtagacctcctcacagttgcacagcctgtccagggggcctgaggggcctcctcctcacatcagtgcggatggatcttgccctcttcccccagctgatacctcttcctagctgtccactttatgaacacagcagggctctggcctcgatggccatacgggtttatgaatggaattctgggaatgtatacttttctctgaagaatgtttctgtagcgcaacaaacacttcttgtttgctgaggggtggggggggggggagaaatctttccaaagagtcactggatgccagagatggcgactaggggtgggctggagctcggggtgaagctgttcacactgacaatggacaaaaagtcagagcccctaaccttgccgaagaagtctgtcttgcaggattaatttcactgtaggtttgttgctagctatatagtgactatggcatttggtgcccatgcccttaataatacagggcttatgggtattcagttcttagcctgcgggtctctgagcctcacctgattgcctggcatgagtaggtttcagaccttggaggtggcccaatctcactgggaggcttctgaacttctttgg

SEQ ID NO: 32604 - DNA, 1234 bp, Mus musculus
acaacataaggaactgtattaaagggtcacagcattaggaaggttgagaactgtcgagaaccactgcaccagatagagaaaagtagggcagtttgggtttctttcaggtgtgtatggttccaaagaacaagtttcttaactatacaactcttcttgctttccaagttaaatctgatgaggggctgatgagatgaggtctgaagagatgactcagtggttaagagaagctactgatcttgtggaggccccacagtctatccccagacctcttgaggcagctcacgactgctgtaactccagctctaggggacctaagctatcagagggcagcagcactcaggtgcacatgcctacacatagacacataaaataaatgtaaaaacgagatctctgtatacttctgtaaattaagtgaaaaagatcccaaacggcacagtctctgaattatcaggtgtcagctggcgtactcattagaagcttgccagaagagatcctaaaacatagtctctaccttctgtagcaaggagctgcaatcacagggtggtgaccttccccgtccatctcgtattttcttggcagagtttatgtttttaacccgtgtgcttttaacttttttttgtaggtccagaggtgttatctggaaaagtgggcttctggccctgtttgtgttcatcctgtttctttgcaccgagagaagcccaaacacatacacaaagctgaactcaaaccttcctattgtttttccctagaggacatccccactttcagcttcacttcagggagcacagactgtgtgtggtcttagtgacctctcagctccctggagacagtagctagggtctccttgacttagctgggctttctcaggcattcacgcctgggtgggagtcactttcttctagaggaacccaaacagtaggccttggcagagtgtccttgagacagtatgtgtgagcctgtgtgtcttcccttagaagtatgtgtgactggccttgaaaatgctgtgggctttgaatgaggtttccctgggaagacatggctctcggttgtaacaccgtgtctgcaggtccgtgatcctgcaattaagggacaccatggcttcattttcagggcatctggtttaaaggcacagttaaaagaatttgtgttggtggttcccttaatttctaaaatacggctgtctgtggcttcatccatctggatacttgtattgagtattttattgccacataga

SEQ ID NO: 32605 - DNA, 2344 bp, Mus musculus
ggccctgcccctgtaacggtcagctaggtggagcagatgctgggtgcatacagaagggagacaaagagatttcatttgtgaatctgacctcctgtgtttctcaggtttgtagtagagtggcttttgaaaatcgtggagaataataggggagatgaaatgggctcagaaagattgaggcttcttcacctctcctctcacgtgcccataagcttcatggtggccactcttgtcaggcaatctctgtaccccaaacattttgcaaagaaattaatgttctgtaaagaaaaaaacaaaaatgaataatacccactgtttaaaggaaatcttaggcaaaggtttttctaatacatatttaccctaatgtgttttgtgtgtgtgtgtgttagagagagagagaaaatgagtgtgtgtgtgtgtgtgtgtgtctatatgatctggcggttttagggtggttttgtttgtctaaacctagggtatgcctaatatttgctatttagtgtattttgtaattacctcagtgccttgaaaagtcaacccagttcacttaaattcctttgaaccttttatatgatttgatgctcttcgaactagtacttgagaacgactacttttaagctctcagacgcacttagtttcagttgttggcctaattgcacaatatttttactcatttagacaagtccctaagggcttttgggatagtggcccttgttgtaagtccttccaactagaaaaacttcattaattgaaaaataatctccaattcacactaggttcaaaatgagtcatttttaccaagcatggcttaaagaatttgtttgcagtttttgtgtgtgatgctaggtacagaatcccagggcccctcacacaccagtcaagagtgtgttcccactccgctacacttccttatcctgagaggtcggtcggtgggtttgttttgttatttgagtgacatttcacggagtggcagaagtgtttgctccttccttcctcccggcaggcgtttctgcattatcctcatctgagctagcatgcagttgagtgactgtagccctaagctcattgaactgctcagcactttcccatgtttacaactgtaaaataataataattataatgatgcacccccttcttattattcaggtatcatacaaatgtgtcgttgtcatgcttaagggttagatatgtctgctacgttgtttgtttgagacgtgttgtgattctgcaacgcagcctatcttggagctcactttatagtccctgctggcttcgaactcaagacagccctcctgcctttcccctttgagtgctgggattgcaggcatgagccatccttcctggttcaactatgtgactcttaaggggaaagaactgcactcgttggtccatggaggcaggagaatcgggagctcaaggtcattctcagtcacacataaaatactaggccagcctgggctacctgagaccttgtctccagaaaagaaaaaggggaaaggaaaaaaaagaactaatgtattttaaagttggagaacagccttagacctgcagtggactgatgtctacttttcattttgtaaaatattttgaacatttctatttagcattcataatgctctaaatagaagcagaacactgtagctctcagatcctgggacaggcaggtcatgagggctctgactgtttggggacagtctgtgactcttgatgttttaaatgtagcaattatggccttgaaaaactgtaactctaatattggcatttgttggtcatctcagatgaacccaaactgaccattgctgtgtttgggtgaaacctgatgcttttgcttttttttctctgtttgcttttttctctatcataaaagtatttaattataaaaataagtgcttttcagatttccaccttcaatatattgactgtgggtttctgatgcagcatcagactggagcagcctgtcctttgaggcccagtgtttccatggcctggaaggaccctctcctgccgtcagtaacttctgtagcttctttcctcctagatgttcttccctgtccaccagtgaccaccactacctcttccccttctcctcctcctcctcctcccccctcccccttctccagatttcaggttcccgaagaacgagggagccagaactcatcatcttcatggcttgccttaccaggtatagccataagtccatttggtacctgctgtccactgaacttgacctggttttgccccacctgtgtctccacaagatgtatggttttgggaaatggccctgtcatcttatacttaagacaatgaatagggttttcaaagacagcatgcattctggtatctttca

SEQ ID NO: 32606 - DNA, 1174 bp, Mus musculus
cttcaagcgctgaaggcctacagtggggctgggtggcctgtaaactggcacccaggccatgcagaggatgtttctcacctctggcttcatccagggaggaggagatttgaccccctttggtcctttcccctcccactgttctccccttctgacctacatttccatcccttgatgaagacaggcaaaacagaagtcccactttctttgtctcttagggctaatttgctttttttattttgttgggttggggttttgccaaggatatgaaaaaggaaccactgttgtttggtttgatttggttttcctatcttaggtttcttggtttccttctggttcttagctacgagtaccaccctcaaagtgtcatggagtcctcagagattgagtacccgtgctggactgtttgtaccttgatgttctccttggtgggtcttagggaacagcatcttgtaatctctgtctaagggccgtttccatcctgtctgttactagtgtacgtgcctgatgaatgggaggtagctcgagagaagatcaccatgaaccgggagctcggacaagggtcctttgggatggtctatgaaggagtggccaagggtgtggtcaaggatgaacccgaaaccagagtggccatcaagacggtaaacgaggctgcaagtatgcgtgaaagaatcgagtttctcaacgaggcctcggtgatgaaggagttcaattgtcaccatgtggtaagaagccaagatgagacatggacagaaagtatggacagaaaggaccaccctgtatgtccttggccagctacgaattgttgccttgccctcttcccagtgggtagtttccccgttgcattcttgccacccacagacccttgaggtgggagcctcgccctcgccctcccaccagaactctgctcctggctacaggccccagcaccacccagttccgagaggcgtaggtcatcatgtgggatgcccccctccccctctgagtccttttcttgattcctccaggtccggttgctgggtgtggtatcccaaggccagcccaccctggtcatcatggaactaatgacacgcggtgatctcaaaagttatctccggtctctgaggccagaagtggaggtcagttttgttcctcgctgtgttatcttgcttggtccacttttttcaggagctggctt

SEQ ID NO: 32607 - DNA, 1129 bp, Mus musculus
agatggaactcgccctccttgaagaaggggaaagcagaactggttctccacccctcccccacccacagcaccccaagaattctggaggaagtggccatgggcaagcttgaaggtcaggttgtgggtcaaggtggtcctcacaccagcctcgtccccctccccgacctccctcctgcccctcccctgagggccacacactcgaaagggttccggggactcggcctggctgttggttatggatgttcgaggaagggattcagagccacagcagcctggagccgcccgcccaggcagtggatccaagcagtgtgagctttcacatggtctgttactaggacttcttcatgggtctctcagttctatgttagaccgtgaaacatttgcatacacatcgtctttaatgtcagttttataacttttttacagttcagatattcatctatacatctgtacaggaaaagaaaagctgctattttttttttgttctttatctttgtggatttaatctatgaaactttcaggtctaccccttcttcctttctgctcactccaagaaacttcctctgcttatcactagagtgtggtttttcttcctcttctccggcaactgatgcttctaggacataacttgccgtgaactgtttgatgccttttttataaatacatctcccttcccctgctccctgcagccccattcattaccctctaacccataggctctgtgagcacagtcacaggtgagggagtggggagggtgggagtccagagcccacagactcctgggccctactctctcctttccttgcttccccgcacacagcatctgctccagggcaaggcatgccacaaactcaggtcagaaacaaaaaggttaaaaatcccacacatcctggtttagtgtttctagtccctgttgttgaaagtcacactttgctttctctccttgctttggttcacacacacacacacacacacacacacacacacacacacacaccccaatttgggaatacaatagcagttttaactgcagacaatagtcattggattattatttaaatgaatatttgatctttcacacacacacacacacacacaatagctgctgagtccccaggatgcagcagag

SEQ ID NO: 32608 - DNA, 1108 bp, Mus musculus
acccagcagtcaccatgagcacagcacgccagtggaggggggctccccggcccatcctcagctggctgactttggaacagaactttctctacagattgaatgactgacaaattctatccctaagagagcaggtactcccaggttttgagggcaggaggcacccacacgtaggttgtcttgagagtcccaatgtgtgcacatgtcagggtgccctgtcagccccctcagctgctcctctgagacctgcaccgaggcaggggcatgccaccattgctctcctggcattggttcctcttggaggtacagcggtcagggagctcccccttctgcttctgacagaaggccagtataaaaaagggggcaagacgaagcctgtgccccctgcaggctgctgtccttccctcttcttccctcccttccccccccccccccgcaacccccagggctaaacaaggactgaccaaatcttgaggctggaaggccagtggttggcgcctagccttccccgtgctctgcctctgtccacccatccgtctgctgctcacaggtggacagtgcaatcctcaactccagcagctgctcttacaggccctggggacttcagctggggaccgcggtggctaatcttttcccccagtatggagaaactgcctaacagttcggttaagctcaggagcccttcgcctcctgctggaatgctgcccttctctgggttcctagatgctcacagggtcactgggagatactgtttgatcagggttttcttctacactgtaggtgacactctgggatagtggcctatcctctcgcacatacctgccggttttccacaactggatttctacagttcattcaattgattttaagggtttttttttttccttattattattatttttgaaactgtccgagttgttggtgttttgtttttgcgtgggtgttatttttttttttcctttaagtagagagacggcaccaacagcgtagtggccgtcataaactaatgctccagaaacacttcaataaaaagaaaaggttggcttgtacgagggtgcagtcgttctgctggactgacgcgccccgactattgcaaggcatcatatccaca

SEQ ID NO: 32609 - DNA, 1120 bp, Mus musculus
gcttacccaaggccctctgttgtcatcgttgggtcctctgagagtggccacagagtgctgaaagcatctcctttcctaaacactggcatccaggaggagacaggaccactccatcaaaatgctttggcccattttagcagtaatgaatttacggtttgggattttttttttccctttggtttttgtttttaatgttacttttatgtttgtctgatgtcttttcatttcctgggctaagcagctgcattgggagacctggaccagagagatccaccccttaagaaccagtgatgatggtcaaacttttaacagtccactttgaactaggtggtggtacaaatgagaacttcaagacaggatgtctgtgtaaaattgaacctctcttgccagagatgctgaagatacagaccttggacaggccaggggtctttgctttgggcttccagcttggatgaccagttggcgatttagagaaacgaacattccttgatgggatgacagagtgacggtgcagtaggcacccttggtaaccggcatcgtgacatgacgggaattgctgacagagggttaaagggcctggaagaagcatggaccatatttggacttgatggtgtctgaaggtgtcagagcatgtggaggctggggagtcaactgtgggcatttggtttcagataagacacttggcatcctgctctggaaacttctccttagagctaagtcacgtgcggaaggactcagactccatcacactcatcagatgagttgtcggtctggggcatgacgttagggattgatttgattttggtttctgtgagaacttcataatcactgatttgtgtgtccacatttgtgtctgcatctttccagtaaaccattctttaaattactcattatcctttcaatagggcttctaagtccagtagattacgggtagtcgttgacgaagctctggtttacaagaactaattcaatgtttcattgcatttttgtaagaacatagaataattttataaaatgtttgtagtttataattgccgaaaataatttaaaaacactttttttttctctctgtgtgtgcaaaaatatgtgtttgtggtcttttttccccctctttgtttcc

SEQ ID NO: 32610 - DNA, 1189 bp, Mus musculus
tgaggtggagggtggggtgggcatcccgggtgtctgcccatctctgcagacccgcccttggcactggcactctgtgaactcttctggcttagtaaacttttgtgtaagtcaccccaaggcgtggatttcattttcgcatctctgtaagccttatcctgggttcccaggaagagtttaatgcttttgtttttttccttaatgttgacaattagctgtcaggataaatactattgctgatagctggcacgtgttcaggaagcaccccagatgccaagactttcagacattacctcagaagacaagacagagaattggccacaaacacaaggttaggttagacaacagcaacttccttctagggtccttggcaagccttaggcgttcaagcattgggctgcaggtgtctgtctgtcctttcagatagctgctctctttaatagtcttttaaaaggcaatcaacatctggcctagccagttccagcatcaccgccgctgccttcttataaagttattctttttaaaaattgcttaaaaaattccaagtgtttatttggcaggtgggaggaggattggcagaagtgagagggccagagtataacttgtgccagtctggtctgttctctccttccaccatgtaaattctgtggatcaaactcatgtcatcaggcttgcttggaaacactctgagcaagctcactggcaagaaaagtatcaattttagcaacaattaaacttcccagaaaatccccaaaggatgtgctatttttggaggtaagtgttcttggtggataaagaaggctgatttttgttttgaaccatgttcacattgtgtgtgtgtgtgtgtgtgtgtgtgtgtgtgtgtgtgttcgtgttctacttgtccaggatgggatgaagtccttctcttcttccctttctgtctccgcctctgtcttctataatatgactagagcctcatgctttgttaagtgtctgctgaggtcagttctaggtgctttggcacatagctgtctcagtcgcgtcccttggacggtcactagccctgtgatctcagtgtctttataccttctcaggttgtcattttcctggcttgttagtttcggatagatggatgggcccagagaataattaagatgaaggggaaccacttaaaattcatcttctctaaagcatgtttctgtcctcattt

SEQ ID NO: 32611 - DNA, 2501 bp, Mus musculus
gctcccttgcacgctttaaaagtggatgaaaataggaattggaaaacgggaagtcctggtggtgagagaggaagtgaaagagtgcccagactgttgagcagaggcgtcttaggacctgggatgttactgaatgttactggagtgtgctttgaccagggctcacacacagttgtgaacttatggacttggtaggaagacatgatttggggaacaagacagctttgaaatgagtgagaatgagcgagtggtctactttcaatgcagttgaactccccagaccttggggtcttcatgatttcttatcatgttaccatagcaaggatccaggtccttgctggagtcagtggtcatgtgacatcctgatggaactgacagtggctccaggctttcgtgaggaagctagaagggattccttaacagcttgccatatcaaaaggaaaagaggaactgttcatgaaagtgtgtgttgtgaagggctgtacttacacttttaagaactgcttgcagggtctatgtttgattttcctcgtcccttatttacctagggaatattagaaaaaggaggagtaggcgggacatctttgggatacctgatactgacacagaacagagtgttctcttatcctacctctagtggctttgtcagacctgctctcaaaagtccaggcctggctgacctctggggtttctgctctatgcagttagcagactcctctcaacctgtcacttgacctgaaaactagaccaagggaaatgtccacgagctcagcattaaatagaaataaatataaacacctaagatcttaagaaatcccaaatcaaaagaggacaggagcgtgcctaaacttggttcctgtgaagaggccccagtgggtgggtgacagtttccgtgtagtgcatttgtgttccagtacattagtaattacattgatactgtgattttttttaattgttttggtgcaatattttgttgtctttgagcctcaggatattaagacctaaggactgtgttgttgctggcagagtcagccatgtctctaccagcctcctccctctgttcacagtcacatgctcagcctccagtctgttgctcccatgaactgagaaaattttctgacaccaggtgggagggagcctctcacagttaagagctggacaagccaaattctaagggtttgatttagaaaccctggtgcttcccaggcagagtgttgtgccacacccatcgtggagatggacttacctttcagtcaccatgtttccttagagacattctcctagtgtgaaattttatatcaaaagtcagtggagcattcgttcagggatttttgtaccaatgtccagtaaatgtgtacttctccccgctgagcatacctctcctgtggtcatcctagcgtcagtcacatgtatgtcactgtatgccattttcaaaaatgccaaatggtattgccagtaactgtggtgtgtgagaatcaccacggaaccctatttcttgttttggttttttagagatttctttcttttcttttctgttatgtgtctgtaaacagttaggattgttcacattccatctaaactgcttttatttttgccatggaaaagatggtgagctgtcctttttttagcttccagcctgtagtttacgtgctatgtcaagtcatggtccatccataaaaccaaaatggagggaaagaaagcaacagtacggagtggacagagagaaaatggagcgccgtggctcactgtagataagccctggcagtcgggttggttagagaaatcatgaagtcccccacagaacggaagcacagctaacagtggcattgaagagtgcaaagatataactttatacctgtctgtctggcctgaagcttatacccaggataacaggaatgtagaaaactacatctgaaaccctgtgactgaagatcagacttttagctgctaacacttgcctgtctagtcccctcttgctctcatttagtttgggaaaaacgaaaagtgcccttaggattttcttttggatgcacaaagcttgcgattcaaagtgagcatcttttggtgcacacagacccttcccttcccctggagcacaactttactttctgtgtctctgttttgcacaataagaaactcagtaggcaaaggttgtgtttttttttttggtaagttcacttgctttttaaaatttttattaaaaatgtaataatttaaccaaggggaaaataaagattgtattttgtattcttctttgaaccccatgggttcctttttgttaataaaatggttatactaatgatctgggtggctcatttttttcttcctgagttgacttcaaagactgagttaaatcattctagacttaaggaaaatcagtagccacacagacagcatcctgttattaaggtcatttgtttatgcctgagatcaagcccaatctggagcctactaggtctgtacacagggcagatgtccaaagacatgcaggggctagcaatcca

SEQ ID NO: 32612 - DNA, 1175 bp, Mus musculus
gacagtacatcctcaatattttcttttgcattgcattttcaaccttaatttacatgatgtgtatattacataaatatatatatatgagataatatagcataatagtcacatatataatatcttatataaatatatgtgtatttatatatgaatacaagatattagagcttcattgtgatctcaaagttattttcacatattttatagaaccaatatgtcaactccatgagagactttttctttgacagtgggtaccattttgattggattattttcattttgcatcacttcaggacatctatgtgtctgtcattgtcctgacatttttttagccatttcgctgtcttacacccgattcagctggtggcttcatatatcaggctcctctcccacctcctcagatccacttcctacccaggttccctttcaaaactttccatggactgttgtgtacagttctggccctcagaggaaagtgcacacagttggtgtctgcctccagccagcactctggccagccatgtgaggagtagaggatcccccccactttttttttcaactgagttctggctctgagactttagaaaaacagatctgttgccctggattcagtaaggggatgacagagatgattaatgggctgcggggctgatctgaagaaagattaaaacaaatgaagggaaacaggttgtccggtaaagaggacttctggacaggaagggaaccttgacagggggcctctcctccactgcctctgccttggctgagtcctctctgctgggcaccacctcagaaaagaaccttcaccaaactgttagaaagaaactgtgacaatgtgcctgggtagcaagggctcccagacagacggacaacagtaccatcctctcctaactgatttattgtagcctaatatacaagaatacctgggcttatgagactgtgacaggctctactgtttgcatgaaaggcatatttatgtcaatacatcactgaaaaaagatcaggtttagccacaaatactgtagagtcaacttgtacccttgtactcgaacatcacagattcaaccatgcacaactaaatattcttaaaaattgcatccacatgaaacaaggacaaacatttctctgtctttgcatctcatataaaacagtattgcaactatgtatatttgttt

SEQ ID NO: 32613 - DNA, 1154 bp, Mus musculus
agactgaaagtttcagggatcattgcctgtcactctccaccttaagttttgagaccgagtctctcaatgaatccagagctcgctagttcagctagactacatggccagtgagctcaggggctcatcctgtctccacattcccagtacaggaatgacagacacacaccacctataatacccagctttgtatgtggctactgggatccaaattcaggtcctcacgtctgcatagcatgagctttacccactgagtcatctccccagcatcctgcttgttttctttgttggtctttgttattgtggtagatctgagatttttgctggtagatcattggttaaaacaccaaaaccgaaaccaaaaaactatgtaccatcaatacataagcctgattaatatgaatatactttatgtaattgttactataaacaaattaataaatgtgcccctcactgtgcatagctaccactttacttgtacaatgcaatctgtgtgcttcagatgtgctctttcttagtaagttccacacaaacagcgaggagctatcagacctctagaatagcatagccgtcaactaaaaatctggacccaaaacaccaacccttatactcaccactttggcctctgtctctatgagaacattgaggagtaggggtagagagagggagagagagagagggggggggagagaaagagaaaagagagagagagattgagagagagagagatctagtcacacatgtatagagagacacacgtaaaagagttgtaaaaacagcaagtgtgtctgtttgctcccaagctgtggcactcccaacattagtcataagatacttgggtccatttgctaaaggctaattaacctccttattctctctatggaaagaagaggaaagttacaattgtattggaagcaactaaagaacatgttgtggggaaaaaacaacaggtagataaaagtacatgaatgaacagtaggcaggcagttagtaaacacacgccacgttcctggatttgggggaagtttgaggtatttgtcaagtgatgaaaatatttatcctgctgggatttattttcacattacattttacaaaaatatttattaatattttgaaattaattttgtgtttatgtttgaatttgaggaaatgttcta

SEQ ID NO: 32614 - DNA, 1229 bp, Mus musculus
gtgcagatcccagggagctcgaagtgtagagaaagcagcattccctcagcgtggattggctactgcgaatggaaaaccagaacccacttctatcagttgacattcattctgggaattgtttgcctttggatttgaactttccattcttcagacaagtgtatctctgatcatctctccctgaacagggacaactcagaccacattgcttcctttggggctttagagcgctatagacaaacataatccaagtttgtgtggaatgaatatttagtatataagttttgggattttttttttcaaggaagaatgtgaggtaatccctgcctttgggatacaatgcatattggagactgcctgggagagagacattctgtaatgggactcctaagccacggacagaaccccacatggatgtccaggcgggctgtgctcgagacggtgctcggcaggcgttggcccttagtgtctggctagctgtatctaaaggcctgtatctaagcctttcctctgctctacatagttgggcaatacaaagcccattcgtttccttgtgaactgtaactgagaaaagcagctcacaggtctgggctctccttacttagttattcttgcttttaacttatgtaagttcctgtggtgactccatgtaatatgtagtgaaattactgtatatagtttctattaaatgttaaaatgctatcaaaaaaaaaaaagaaagagagaacgagagaaagagaaagagagagaaagaaagaaagaaagaaagaaaggaggaaagaaagggaaaaagggaaggaaggaaaaaaagcagctgaaaacaaaatgtaaatgcccagaagatgtgtttaaactaaaaaatcagcaataaaaactcagtactgaaaacgttaagctttagttacagtaacaaagaatttacatactccctaccaaccctcaaatgtgagccttaagatatacggaatgcattatgcagacccgctaatgaaaatctatatcccataatttgcaacctgctggctctgttatgccaagtgcatgttaaacaagacatttttcaacctaattgcatggcatttctccgggctctaattgtgttaggaaaatacctctttctatctctcacgcacacccagatcactttgctttctgcctcgagcacatcaggaaaacaaaacaaaatagatgactcctctttttgcaacatgcaggaaatttccaggacaagt

SEQ ID NO: 32615 - DNA, 2222 bp, Mus musculus
ggggtagccaagctgttaaggtggcaggaggctggtcagcgtcgggttgggttgggttgggttgggttgtgggacagatggattttatcattgaatggctcttctcagtgtatggatactgggttgggccttgggttttactcactttcagtatagcttgccagtattgttaaggtatccaaagcctttctagatagagacaggaacattgacttgaacatatgtatgtaagagtccaggctcattctgagttgatgaaaagtcttgtttggacttctgcagggtttgactccctggacactctgagtggggtggtcatccaggcagtactattaatgacctccccagggcaggcatgagttgtgtcctgagtggaacatctggccatgcatggttgtgatgggccattgctttcgctgctttagagcaccacagacctgactgctgccgagtcggtccctgcagctaatgctcgaagaccttctgggctcctcgtggcactaggcccttcaccttgactgtgtgcatgcatgacctgcaatagagcccaccaaccacatagaagtcccctggctagagtctgatgcctggtggcttaccggacttctcagtcaattctgaaaggtatattttgggcacacagtgaaaagtgagccatagatggagcttcttgctgatcacattgacactgtctgtgtttgatttgctgagctcttggatgttgggagtgtagcaggcacaggaggtacctctgcagaaggaaggcggagggtggaggccttgcctttccatattcacctaggtcttgtctttcaacttgttggtagaagttacaaattattctcaaaactgtctgtctcatcatgaggaaaaaggaactttcttttgttcctattcaggacttgaggtatagtgccataaaatgtagcaaaaaccctatcggccagatcagtgttacattgattctaagattacagtatgtcccatcaaacatctgctgtaggtgagggagtggatttgaagaggggttgaaagaaaggaagcattcctcttgctttaaactagtatgtgcatcagatgcttacagcagaagtttgcacaggtaagagaagctgccagtgacgttctgtggggcctggctttgggcagctgctcatcattgaggaagtggcaggacttggaggaagttatgtgtgaatgttgtcaagtcctgaagtcctatgatgcactgtggccctagaaaacgaagatgaagcctccactgaccactgtgtcctctctgacttggccagcctgatggtccttccttctactctgtgtagtcattcctaagccccacagagggagcgccaacatttctcactgtgctgctgaggttctgacctggtgtgtctgacattgcatcaggctttgcagaacaaatgtgattcacttaaacgttcacacacagcaacactgaaatcctacagaccaaacaaacccacttgtcagcaggagccgtggtccagcccagcacctgtgctctcgtagccgaggccagccgtgttgggaagagagccatgccaagggtccaggctgctgtagtccacctgtgccctactcatttggggacaggtggtttttcttgtaaacttgtggacttttgaaacctgttgactaaacagtaattaatttatatttgtgaaaaatgccactgtcctggtgatttctgatgtaaataatgttgtttatatagtatgtattaaattttcctacattgtaaaactgctgtacttttttgattcttgtatattaaaaagtgttactaaggatttttagaattgggctaaccagttacattacattctggtgtgaggcacacgccacagtctccctccctggctggctgcaagctgtgtgtccatgcttgtttacatcttcgacaatggaagctttttaagttgcatttttgttattggttctaaatagttttctgtccctgaacagccacaaaccacagctgcgtacttcagggaatggcatggagccattaaaactgagtcatgagaggttgccctcatctttcacagtggtcatggggagcctgcttcaaacatccacctctgtccagagagaagtaagacatcaggcctacagcctacagctttagtgcagttaatcagttgggttatatactcttctcttcttttctctcccctcccctcccctcccctcccctcccc

SEQ ID NO: 32616 - DNA, 1385 bp, Mus musculus
tttactttgttatatctagaattatgtttttctataattattttgttgtgttggagactaaacccagggtcttgcttatatgaggcaaatactattgagctatgccttccttgtatttattgttcatgtgttgtaaaggttttttgtttgtttgtttaccttctttttacgtttttgatgtagttcaggctagtctggaactatgtcgtcaaggctatcctgaattttactgtgtagcttagatcagcctcaggctgtttctctgacttcatttctgggatcatcatggccaaatacattttatatttataattcatagatgtgactgaaaatcctccactttttgagttcatttaaattaaattcattttcttgttattgcatgattgaaacatttgatcttcaggaatattttctttttgtctgaaataatagcaattttcctttcgttacgaattttcttttttgtcataatttatataataattattcaatactaagtaaagcttatttttgtagtttcctgtatcctgcttatacatatagtgtgagctactcttgagtttatctgtgggcatgcgtcagagcttgaaatggggtacaagtaggccttgagtctactgactcaaatctgtaaataactgttggagtcaatgtgtggttcctatttgagtgctactctgtagagatgcttagctctgaaggtgcagtctcttactcatgcagcgttatttctcacacagttacaaagaagatgatgactttgagactgattcagatgatctcattgagatgactggagaaggaggtgatgaacagcaagataatagtgaaactattgaaaaggtcttagattcaagactgggaaagaaaggaggtttgtgtctttggggagcaaattactcactttggatttttgagacagggtctctggtagccttggctggcctctaacttgatatatagacaaggataaccttgaactcctaatcttcctgtctctacctcccaagttctgggatttcagttgtgcaccaccattttcagtatatgtggtgctgaggagttgaatcaggccttggtgatgcttgccaagcactggaccaactggctgcatctggagcccacaaatttttgtatgcaatttatatatgcatatatgtacatatattcaaaaatccaatgttttacatattctttaatgtgataaatatagtccacactagtattttgaattgtagaaattgtcctgacttatttcagagataaagacaaaataatgttttttttttaaatttaatctagttagatagtacataatgtagtgatgaaatcataggtacttactcattaacacagagcaaatctgtgtttagttagctgtt

SEQ ID NO: 32617 - DNA, 1859 bp, Mus musculus
gtattttgtatttcctagttcatgtaagttgtagtgtgagagagaaagttattttctaatatactcatattctggtctcattaacttgagatggaatacttttttttagtgatggggcagaaccttggttcttgagcatgctcagcaagcaccctatctcttacctccgtccccagtgcccagatttgtgacttttaaagtcagtattgtgtactgggttcttacatctatagagttgcccttgtttcatgctttccagattgtatcactattttgtgaaatctctccatattagatttgtagagtaaattctgaagggctattcttactcctgtcttagtgaaatgtcccctttctgccttaagaggattttgcacttcttagctatgtaacattcttttgatggaagctatgtattgacagccaaatgctggggagttaggtacaggttttattaggtgtcctcagaaagtcagattcacaccaacaccttcatgtttatgcatttgagttgtgagtggcttctgagctggtgagcctgggcttccctttcccgtagtttccagaccactgaaccatgctccttgtatccagttactgtgtgtactcgtcctgtcttatacgtcagtacatccttagcaggacccaggactaacagcagtaggaacagtgccattttggttcatttgggggaagacgctgtcacactgtctgtgactataatccttccttggcctagtgctgttagttcttcattcatgattgctgatgctcattgagtctaaggtgactaaatcagtaggcagtgcctttaaggcgcattcattaaatttggtattttttttctaggttgttagatctacagtggtttgtgcagttactgctagcacatgtggcttttaaaatttatatttagaattatgtaaaatttaaaatttacttctcagccctagagtaggcacatgtcaagtgctgagttctatgtggtggctggctcattgtgttggagggacatgatttaggtagttagttgtatttgtatttgatgttgctgctccacatgattctgaagtgtaaacacgagaaagagacactgtattttcaaagcaaaagaagagtgggctgcacctagcaagtactcaggcttcatttcatctaaagtcttcctgtgagttaaagtctaatcatctttcccctcccacactgaaggcaagtagcgggtctgagagtgggagtccgaaaagaagaggccagaggcagctgaaaaaacagtaagtctttatcatggggaaatgacctaatctgacagttttaaatatgtctgcgtttatgggacaatctttgtgttctgtctgtcccaggtctcaagattctctttaagtttgttagagctccaacttccacttcttaagtgctggtagcctaattagctcagttaatttttttcttgaatgtaaacaaataccaaagtagacattgcattcttgcaatgtaaagaagatttaaattggccaatctcatgttgatatggtaagattcatattgtttgtgcacttattttattatgaaatacataatgttttcatataattctaagattatagtttgtagaccagaagcttttaattcttgagtttagagttaaaaatttttttttccccctttggttttttcaagacagggtttctctgtatagccctggctgtcccggaactcactctgtagaccagactggtcttgaactcagaaatccgcctgcctctgcctcccaagtgctgggattaaaggtgtgcgccaccaccgcccggaagagttaaaatattttacaacaaattatattctgttcattattttttgca

SEQ ID NO: 32618 - DNA, 1123 bp, Mus musculus
ggctaggttggacagaactggactggaaactctccagggcccaccgctgtttatgaggagttcaggtgggcacctaccctgggagctgggtacccaggggagccctgaggaaacaggctctggactaactgctcaggttaatggaggcctcccacttggccttctcccatattgctgtagcaggaatgcttctgtgcaaatctaatagcagtgcctttgggaccctgggagtgcatcacgtctgggaaggtgacccttgttatctcagttccttttcatctttgtcctagggtttgtttgtgtatttgcctgtctaatgccctgctccattgctttggatgaaaactcgtaccttggccagctccaccactgtcaggttctccagttctgactggggttgtggtgatggcggtaggtgggaagatccaccctggctcaggagcctgacttgacactggttctttcagccctaagccagcatctgaggtgtgctgtgctcctgggatccattaatttcaccttttcggctggcttctctcatccttctgccattagccagaggggcgggttgtgaactggagccggtgactgtcctctcaccatggactgaagcacagtggtgactctaggaagctggccacctcgaagctgtacatcctctcagccttggagccgggactcgagggtcccagaactgcagctgaaccatctggaaaagctggattctctattctcctgccttatgtatgaacaccacggatccggctgccagccactcatcactgactggcaggagtggtgggacagtgaccttccaaatccttgatggaacttcaacaccgtaggcacttaaataaagatccttaaagcaaacaaaaaataaccttcagattgagtcacgagtgtgctgggtttggatattttctgatggagcaagtgagctgactcgctggttaagaacatgaacacgtgtttaccttaggaacagcttccggggggtgagcaggggtttctggggagggggttgtctgtgcccttgtgatttagaaagaggcatataaatggaatggggccgggaaaacaggcccagccctgccctccccccccggtccgtccacccccc

SEQ ID NO: 32619 - DNA, 1255 bp, Mus musculus
actgttttgtgagctgtgatacttgtgatcataaacccacaagctcctaagtgatcactgtccagtccatgaaaatgttagtgacaggtcccaggtcagtcctgaactctgtgcattgaaagtggctgaacctcagagcatcaccttgccatttgggataagaatcgtatgggtgttggggggagggaagatctcttgcaccagcacacttaagacaatgtggcctctctcatcaggggatggatcagatgggagcatatatatccatagcaaagggtccagtcagctcacccttcatacctctttattgaccttttttgtagacatacatacggtaccaaagtcgaccacaaaggatgcttggtttcatttttccaccttaaacatccactcacctgaagcaatgaaagaataaggccagaagagtaaagacatggatgttgtgccatattttctttttacagatagtataagtggggaagactaggtaatagcctcaaagtagagaagacatcaagcaaaggcaactgagaaaatgtctgtgtggcattgtggctatggttgaccatctcattcagggtgcttctaaaacagccctcccatctgtctaccaggagttagcctatccttgttgatgaacatagggtgctcatcagtatagtaactaggaatggggaacagttctccaaacagtttgtaaggtgatgttctgtcgctctgaaggctttgatcatgctccaaacaggttttggttcagtcttgttttgaaaatgaatgactaatgggtgaccgccctctctgtcgtgtgtctttgcaaacggaggccctgggatgtactctgtttcatgacatgatttgatttgatttttggaaaaaaaaataatgatttttaagctctttgtatcttggatttttttccccttaaaatgttcttaaagatagcaatggaacccaactccagggcttgctttttatcaacagttatttataaatttaaaatctccctgtggcaaaatgatttccatgagtgttgtgctctctttcaatttttcaatttttctcatgaatgtcaaaaaagaaaatccaatctacttttcactgtgcatccaaggttagatccagccccttggttgtctgcttggttttgagtggtattctagatgaaaactgtcctggtaagatctcccttgaacatacagaaaacaaaccggggatggatggagaagacgtatgaaaggaatgctggagtgctctc

SEQ ID NO: 32620 - DNA, 1202 bp, Mus musculus
gcagttgtgcagaaaccgacctgtaacttggtgcttgttgatgacctgcaggctggtcttgcagggacagatagttatctttcagtttacttgaaagagttctggtttaaattttttagcctaaatttgttttatttattttgtgtttgtgttgtgttttattttattttgaaagtgaccgaggactggccccgcagtgtaaaccctgttttcagtacagagtgaagtgtctgtgcaggtgcatgaggccctgaggaaagcggaggttgacatgggagctcctcttccgtcccatgcccattttgtcatgaggaacctttgctctttttgggaaatttttaaagttgccccattggctacttttgcctctttttgacaagattggtttggatctttaaagtctggggttttgtttcattggttgggttgttggttttttttgttttgttttttcctactaaaactatgatgtacttccctgaagaaccgtaacagcaagaagctagttgctcccttctccaagtccagctttgacttctcctgctgtcacagcagagcctgccatgcctcaaatccaccacagggtttcgctggctgtcctcgcccctgcctctgcctctggccgccccctcagggagactacttccactgcgaagcacttccacttgaggggaggagcctgactcccacctagacctgacagaaaatcagagagccctgccctcttccctgtgcagaggaaggccagtgaccgcctccaggatcactctgacactgcagtgagccactgtccacccggggaagcttcattcctcgccccccactcaccctccccgtaccctctgacccaaccagctgtgttgtgtttggcttgctttggttgtttttaaaaaccaatctcaattctacccacattccccaaaacaagggtcatgacagttaggagaagttagaatctaaagcagcctctgcatgccctaagctgcccagcttctccaggaacgctttgacctgcctgcaccacgccgcccctcctgcctgtcccgcacgcacgcacgcacgcacgcacgcacgcacgcacgcctggggagttgctgcttgcttaggaccctgaagattgctgtggctgagtcagcagccttctgcggattctcttctgtgagaagggtggtttgccagggaccaggcttgtgtcctgtcct

SEQ ID NO: 32621 - DNA, 1311 bp, Mus musculus
gcccattgctagccccgcccactgccacactggttcttcccagcctccctcatagcaacagcaagcacagatgtgatgaaccattcagggtaacatcagtacacacaggcttagtaaaggacacaacctgggcccgtaggccagagcttgcctacagtcctctccatgcaagtttgtaatgtctcctcctatccccgaggctcttgtcacctcacccactgttcttgccaaggctcttaagttgcctttgatacgtacccagaagacagtcacggagtgtgggcgtccttgtctggatacctgtgtatgggtgcctgtaagagaagcagcgacacacacacacacacacacacacacccctgcagagaccagctccttgttttctttcttgtagcataacattcctagttaagtttgctgcctgctggccaggtggagaaatgcaaagtattctaatgctgccataagcggggaggggtggcagaagccttttcctgcactcacaagacttactttgtcaaatgatcaacaggtcctgagttacttctccatctcaactaaggtgtaaagtgggtttgccccactactgcaagtgtgccctgcggagaaaccaggcaggcgctactgcctcagaccccagagggcctctgcagcaagcacagaacctatgccttagaaccctgctagcctcagctgccctgccttggttgacacctgctgggattggcttgtctcaggtttcttcctgaggcctgggctctacagaaggtgggcaggatacacctatctatacctctgttcttgttaagtcgtctccaaatgctgtatgaacatttctgtactaagccctattaaataaaaagtcgggttaaacccaagtgctgtatagtaatttgtaattatgtataaaattaagcagttttgaactgtaaagatttttcagtgtgttttctggaaatttgccacaacatactggctttgtattttatttatcatccattgtagttactggcttcaaactcttgtaaagtccccctcagacctttcaaaaataataaatgtctttgagatcttgacctctgccgtgatgtatttgtggtaagggagtattcacctccctaccctggcaagccatctgtttctgtgctgttgggagtagggtgtaaggaggagtggcctcccacagcaggcaaaaccaggagatccgccccaaacctccagggtcactgacccatccaccctaagtcagagtccaaaccaagcgtccatgaagtcagcacagtcaggttcaagctgctctgctgactacat

SEQ ID NO: 32622 - DNA, 3374 bp, Mus musculus
tgaacaaagcaactcttacaaaggacatttgattggggtggcttgcaggtccataggttcagtcctttattatcaagcggggagcatagcagtatccaggcagggatggtgctggaggagccaagagttctacttcttgatccaaaggctgacagaaggctggctcctacatggctaggaggagggcctcacagtgacacacctactccaacaaggccatacctccccatctgggccattccttggaccaagcactaatgcaattaattacagggaaaaactttctttaccccctcctatatgtgtttttaaggttaagcctaaaacaagtaactaagaaagaagcaaagtttgttcagctcagctatccttaataattacggtcctcaaactcatcagagacctgctcaagtggcattttatgtgcttaatggaaaaaagcctgctgtggcagagactccagctcctagcactcaccctaaggtctctaaagaagattagaaggggcaccaacgactccacctgaattgtggtaatgctaaccactgggcataactgccccaatgcctcatccgctgccaggaccctgcctaaaccgtggacaagcaggacactggagagttgattgccctactttgccgagacaaagcgaggtcaatttctcaaggtcctcctccacaggaagaaggcctctctgatttgccaggcctggcagctgaagatcgacgcagccctgcgacgtgtgcccccaacgaagccacggacaccacaggagcctggtgggttggcagctaggtaatagctaactaagtctctgttttaattgatatacaggccatttggattatattttcttttgtaagtttatccttttatagttcatccttctcagatctctgatgacattgacggctgtcagtttccgcagcagcagcaggcagctcctccacctaaggctttggcatcctcattccttttcctatgtaaaaaaccaagccttgctaactctagagttaccaggtctcttgttaagaagcggcagacaggtttgccttgctaacgggctaaaaattaaaaaagaaacaggtttcagatgtagctttttaccgtccctttatttaaacttgctttgcaatcactgttctcagtagcaactgctcatgtctctgacagatgcttggatggaggaaaaaaaaaggctcaaagtctgtaagttctgcgtgttcagaggtgtagaagcgtctgaggatgtggggcctggagtcattgaaggtgattaacgcgagtcataggaagggttttaaggtagctgaggaagtggggaatctcaggtctccttccccagctgtgttcttgctacgctaagatttcagacgttcagaactttagtatttatcagtggagttgtgacaagctggtgtggcgctggctgctcactattcaatcacaagctgaagattttaaatttcctttagttgtcttttgtgtagaaacttaacggtacttttcatcatgctaaaggcatctgtgtccaatctctacatccatccctctggaccgagacacgaatgttaatgctttttaacccaaagccatagcttttgctaggactcaggcgtgagtccactccaggtgtttaacagacgcctgttagctggcttttctatgatgtggactttttttgtacagattaatgctaatagatctaaaacttgtatctttttgtaaactaagaaaattcatgtaagggactggagagatggctcagaggttaggagcactggctgctcttcccaaggaccagggtttaattcccagcacccacatgacagctcataactgtctgtaactccagtcccaagggaccggatgatgtcttctggtctccttgtgcatatgtgagctgcacagacacacaggcaggggacacctacatatgtaaaaattaaacattgaaaagataaattcacgtgagcttccgagcattgaaggagtcattaagacttggacccacctctcacaggtcacaggggctccagataagtcctgcctaagcctgtctatctgcctgtccttgaggctgggatctcttacctggtcttgggactccgcccctcctctagtttccaggactgtgggcctgaaagtgccaaatgtaagattttcctttaaggtcctaaactttaacttctgtcccgagtctctctctgtctcagcagatgtccacttggctgacagacgccctccaggaatcaactgcggactaccaactgctccaaaaatgactctgcactctggactggaggaaagctgatgtgaaccagcccagccgatgtgcttgctccctgtctcttcagctgggtcatctaactggatgcctctgatgcatgtcccatcgccggaatccctccctgcctttgactaacattccagccttcctaggccctggcaacatccttgtttcagcaggaagtagttacagaagagagttcgtcgccccttttccccagctggctggaatgttagatcagaaggacattcactggcgtgggggacaaaatggctacctagactgcctattggcatcctaggaaaggtacctgttgaactcagagactcagatctatcaacaggtagattcattagctgaaatagttctacagagtgacggggcatgggatctgttttatgcagcagatggaggtgttgtgtgactttaagagaaaactattgtttgtatacaaagcactcagggatcatcagaggtaatctgaggacccgcaatgaagcaaatggctgtttcccagtctcatgctccttctagttagcaactcgctcggccatctcagggtctttgaccctgtatttctgctgattactattggctctggctcatcaattaatgccttaactggataataatttctgcctgggtaccattaagctggtggttattggattctgatgtaaacaggtacccatcacagagtcagggattcgactcaggatacaactcaaggggagaatgtgagagatagttatacttaaaattttaattatggtgccttaagagacccactaaacaaaaatgcctctattgtagaccaccttcctgaaaggccgggggctgccatctatgggagatagcaagccacatgttccacactccctaaacatctttgtttgacacaccacactggatgtgcttgatcacatgtagtggggaggcacgtgggcaggaaatacatcaggacatatgtttggacctgatgggaaatgcggtggctttatgggtttgcctttttaagcctaaatgtgatgacttattgccagtctctggaaacccgggagtggacctggccagagtctatcat

SEQ ID NO: 32623 - DNA, 4446 bp, Mus musculus
aatgcccctatcgaagacaggtctgttcccgctggggccagttttagctttaagagcatgtagtagggccatagctctttaaaattaggcccctaggagcctatggtaaccttttcagttggggccaatctaggggccgtctttacatttggtattttacaaaaacccttggggcccctcaccaatcagacagtggaaatgcaggggcaacaggggaagtcaaaactataaacagactgcagtggactgttaatccagggaagaggacagtgactcgttcttgcattgttctccctgactgtgcctgtttactttgctgggaagagacccaggcaagtcccgggcaacttcttaggagatgagactaaattatagctagggggtgcagccaaaatcctgttggtcacctgtttcttaagcgggaagtgccttctccatcaccagggtccaatcctaaagagaaatgaagagaacacctgccagagatgtttctaagggtttgggttaaggacaatcctcctgggagggtttagcatgtgttgccagttatagttgagctacttctgagcgggacaatactccatcatccgtgatggaggccagacagggaatcaagattcacattagatgtctgcactaggcaaccatactcattccatgcgagtcagcctggaagtcttcaaaacctaggaccaagactgtccaccagtctaggattgaaggggaatgtataggtgggtggaaacttatttgccccggtgtccccaactcctatcctctgcttcctgctgcctggcctttgggtttctactctcctggatctaaaggatgcattttttttcccccatccctttgtcaaagctaaatgcctgtttgcatttgagtgggctgaccttgacttggttacttcaaggtttcaactattcccctattatctttgacgtagtccttgaccaagacttaagtgagatttaagtgcttgacttaaaagtgcttgtcctgcactcctaaatgcagaaaaggctatgttgccccaagggtactgtatgtacatgatatagattttgggaatgtgactttattgaaatcaagcaaaggcctcatggatataataaataactttctggtctttatcaacacccgtcctggacagcccggatagtagctaagaaattaatgatggaagtcatccccaggatttggcgtctccttaactttgagatctgacagtggcctggtcttcatgaccaaactgtctcaaatgacttcagaagccctcagtataaattggaggctacatagcatgtgtcgtcctcaaagtacagggaaggtagaaaaaaatgaattgaaccttaaaagaaactcaactaaatccgttcttgagactgatagtaactgggttgacctcttgccttttgcccccactaagggcctgttgcacttcctactgtgaaaaagtcactccatgtgaatatatggatagccgctcccagtgatcccgcgggtaacatcaagagctaagaacagattccctaatctctgaatccctgaagggattccaattaactctggataagatctttcctcaagtctaggctgcccagttaactgggcactgcttgcctgaccaaccagcctggtgaccctcaactgcatggaatcaagatgatgcccgtctatcaggattctctggatgcccagtgctgttaagttgctgctagtcacatctcaagaaggcaccagaggatccctggaaggagagggccaccaaaaaatggagattaatcagatggcctcccttccacgttaagctctctaaagtttaatgttttcttgctgacctgctttgactccttttcttaggcgatggaagccgtaatgttagttttgatctgttgggttatgtcctggaactccagctgtgtatagtaactcacatggacaacccacttagaagtcggaacttagtctcacaggtgttggatacccttataacttccgatcagcctagcctgaaaactgaatgatgggctggggacatttacaattggagagaaacttatgtggtgtcctggtttacatctgtccagtccaggtaagcaaatcctgccagggtactaactgcctatcattgtgcctcttggggctccagaagtgtcaccccgcctgccctaaggcaaaacatgacattcttactgtaactcccaagccctctaaaaaccaactctttttttttcaagacagggtttctctgtatagccctggctgtcctggaactcactttgtacaccgggctggcttagaaatcagaaatccgcctgcctctgtctcccaagtgctccaccatgcccggcaaattaaaaccaactcttaattgtcagttggggtcatgtaacactattccccagcctaaactctggaacatttttgactcttatgaaaattcccactggaatgtaggaagaacctggggaatttgaccatatgcctggggctggatcccagttcctctattaccatgcagtgataaaggttagggcaagaacttaaaactcttaaaagcctgctgtggccccagtagagacctcccgattccccaggttcctccaccatgcccacgatccaaagatgcccaaccgccgactttcctgtttctttttttttttttggtttttcaagacagggtttctctgtatagccctggctgtcctggaactcactttgtagaccaggctggccttaaactcagaaatctgcctgcctctgcctcccgagtgctgggattaaaggcgtgcgccgccactgcctggctgacttgcctgtttctaacctctcctgagccacctccatccactgctcccatggaagttctactcctggctgtgctaacagcaacctttcctccaccattctactcctaacctgatgcaggactcacggttttgcctcgaccccaaacccacaatctgtcattccctgcattgtcacaagcctctgctgatgcctgcccctggttccagccccttctatccctcggtgaggtgctaggacaaggattgtttcctgtcagaagcttcaggctccctagcttgtccagatttgtttaattgtgccaccattattcagcacctgactggcacaggtggtgagaaccagccactatcccttccttcttgcctgagaccaactatcacaagtgtgcttgctggtcttacgcactgatacaccccaatcatgtcccttcctcaaggtgacatttcggatgggggtgaaggctgcctgaatctagccaagacaccagaccaccctcaaccaaagttgaggttggttctccccttggtcccaagctcagtgaattcagggattgtagggcctgcagcactaggaacatcagttccggtcctgtaagatcagggttcaaaactctgaatgctgaagtaggatttaaggttattataaaagactcagtccctagataggaagattaggtggattctctggcagaaaaaaattttatagaatagaaggcttgacttttcatgacgcaaggagggctgtgaaacctgttgtttttacgctgaccaatcaggcatagagaaacttgagctatggtaagaaacaatctgaaaaccagatatttagacaaacaggaaggacactgttggtgccagttccttgtaactggtcaccccacctaaccacccttgtttcagctgctgcaggtctccctcccgatactcctgtttcttaggactttcaggtgcgttacaagtcttgtcttccgacaaatagagaatgctaaagtgcttgcttctgctggcactagtaaccattagctagaaatggtagcttcctttcaaatatatgacaggagcacctgagacaggggaatcagaaaccagtccaagcccatttcaagaccaagagccattttgaggttctctttactgtaaaacttgagtttcaatttctgtttctcagaatttggctgtaccccatcccataaacaaagaacattttgtactggatgttccaggaagattttcctttttttttccccccactccagacagggtttctctatgtagccctggctgtcctggaactcactctgtaagatgacccgtccagcaggtccagttattcgagggtctcgaggggacctcctcctaagaaccaaatggggggtagagagggaagagggccttgtgcgaaaccgttctggaatgcatcaaagccccaaatgtattagtcaggcccgaggtttaaatgaacaagcaaaaggggaagtacagatacttatcagtgggaggggtagggcaatacaagcaaaaggagaagtacttatgggagggggggcaatagaaattctttcttttggcagctacttggggaagcaggaacttggtggtatcagggtgtggtcaggacatccgcgatgattta

SEQ ID NO: 32624 - DNA, 1189 bp, Mus musculus
cacgtgattgcgtaagtctgcagtttctcaagggcacatgaagcctagctgcatttgctcctgggtctcctgtataaagaggctccttagagtcacagacagagggagcacagtctgctgggtgacaaatgggagctctaggtcctgaactgtggagggctacacgggtagctgtgtcacagcctgagtcccagccctgggggctattgagtctggccaggctgtgaggacagtgtgggctttcatcgtctccctctgctttatcccacagactgcgtggttcctcctgcctgggccagaagctgacagctccagccccaggcggcagcagctcaagctgtccttaactctaggcagagaaatgaagttctccagcgtcacctgtgctctggtgtccaaagctggcagcggctcgtgtggagagaagcgtccagaggcacgggctggcaccagcaaccaacgacatttgtgcagagccttgaggctgattgtcacccaggcctggcaatggctaccagggaagagcaggggtcccttggcccagcagcacagcctttgactgtagggctgcctgtgggaggtgggaatgtttctccatagtctcctggacatcagggagcatagtctaactgaagacatattttataagggacagaacccccagggcaacccggcctcagatggtacccacaaggcttcatcaacagatggtaccagacccctaaggtcaaggggagatggcctgtgtgccctctgtcaagcactagctccccctcctaagaggcgacttctgggaagcttccatggacatagggcagatgcctgtgaccagccagacactgctaagagtcccccagcaggactctaggtcccccagcgctggtaggggtctgatgcttgccctccttagaggcacagaagagcagcatgatatacctgccagtagtactgggcctcttttctggacacccacctgccttagtcctgtgtcctgcctgctccataagagggcagtcatgagtcgaatggcagagggactcccacggtcactgcagtttgcacagaggttgtattgctgtcattgtggatctaggaccaaggctcccatcatgcctgctatcctccttggcaccagctggcagcctgaatcctgtctgattttcttccttgagctcagaaagaaggatcc

SEQ ID NO: 32625 - DNA, 1238 bp, Mus musculus
atcctcttgggtcagggaccctcacttgaaggccacgtgcctaccatactgaccagagttaagatatggaatatttgtacgtggccttgttgaaaggactgtgtcctcttctctccaactaagctgagctccattcagggctgcaggctgtggacgttctctttgtaattgttggttctgacatgttcacagggtgagggactataggaaatggctgctttttatctcttaacacaaatacaaaagtacagagactttttctcaaggggacctgattttagcttctttcagaccttgccggcagggacaggaaagtctatgatcagcagggttagcacaggtcttcttagccagattttctccctttgaggtgtggtttgtggaaatgaggaggttgctgacaacctgtttttaaaagagggggtgctatttggagagtgaacgagcaagctgagagccattgagtcagcatgggtcactgggcctccccctggctaagtggacctttactcacacacatgctggcatcagcaaacacaggactggtctttcctcctatcttactgctacttaccctgtgtcttgattaggggtttactgctgtgaacagacaccgtgaccaaggcaactgttacaaggacaacatttaattggggctggcttacaggttctgaggttcagtccattatcatggtgggagcatggcagcatctaggtaggcatggtgcagaaggagcagagagttctatatcttcatctaaaggcagatagaagactggcttccaggcagctaggatgagagtcttaaagcccacgcccacagtgacactcctctaacaaggctagacctcctaatagcgccactccctgggccaagcatatacaagctttcacacctgtgataatattgctcaggcccctagtctgagctcatcctccgatgagatagctgtgatggcccctgcagtcttccagtgactccatatccttctccattccattccacctgtctccacgccccctgcttcctagctgtttaccagcaccaagctctttgctctgtgcctgtcaggtttctcttctctgaacacttcctaccctgggctgcctggtccatccatccaaaatcctgcagcatctcctctggccgggctctccttaattcagtgtatctttctggtgactgtctcttcctgtcagtcctattgatctgtggttaggaggaccttgagctctgc

SEQ ID NO: 32626 - DNA, 1202 bp, Mus musculus
gcccacgccctctccctgtagggttactgttccccatttactcagaagtgacttttaggagtcatcttggtctgcttttcctccttgggtggctagccggccctcagcacaccatctgctgcgtttctatgtctgtggtcaaactgagcttctcagcccacaatccatcttggtaattgtccagcacctggcacagttgggaccccagagaacctctttgtaagattgggaagatgcaggggttccagaagagcattcagtgatacggagctgggtctgaaggcattggaggggtggggtttgggaacagcagtgtgtccagatgggggcagctctggctcaaggatagctggccgtctgatgtaggaaatcatctttgctggaggaaagaggcagagagctattgaacattgctgtatgaggtggaggctaggaggagacagacagacagacatgggagcacaacagtttataaagatcccggttcctccttctgcagattttggtttggggactcttggtgtggggtgttcagctggactgtgtttctgtagcgtttgctgccttgtgtccatacttctcacaccactgagaggagcttgaggctcagagcatggtctctgtatcagccgtcgtcccaaactactcagcttgtgggcctcatttctgtacagtaagggtgataatcctctggtgttaggagcaggtgtggcggcagtcctaaaggcgccagggactgcagctaagtcatatgacttgcacctgacttcctcatataagacacaaacatcttgagtgctgcgcaggtgtaccaggatacaggtgaatccaatttggtggagatttgcccctgctgccctgattagctgaagcctcgtgactgatgagggggcgtggcctgcggtgcgtggatgagagagagtataaaaggagtgagaggcccagggttcgggggagatatataaacaagggcgatatataaaaacaagggagatataaaaacaagggagatataaaaacaagggagatatataaacaagggagatataaaaacaagggagatatataaacaagaagaaacaggactgaataaatgtgtgcagaaggatcctgtagcagcgtcgttcttcctggcctgttgagtgcgtgcaacaagtggtgccgaaacccgggaaaagaaacatcttcagtcacgagcgaag

SEQ ID NO: 32627 - DNA, 1203 bp, Mus musculus
agagacggtgtcgggagcagcagtcacatctgagcagcattgtcactcctgaggaacaggagttcgtcaacagtgagtgtgggcaggggctgagggacaggacacagcagtgagagaaaagagccttgctggtcagaaatgagcagtcttgagttcagggttgtagctcagtgggcagagtgtgccttgtgtgtacaaggtccagcatggcagaaagggagggagggagacagagacagagaaagagggtacaggttgggtacactgcaggacagggagctagaggaaggtcaaacggtcccacattttcttcagagaagacacaggtcacagcagacccagggcagaccttgccagtcagagccatcccaggttaagcctgtagctgtctcctgcctgtatcagcctgaggaggtgttccagcatataccacaagcatgcatgtcctgagacccttgcaaggtccttagaagccagtggcatccacttgcccccttcctccctctccatgagttccagcccccagacagtgcagggtacccaacataagtgcaagcctatcttcccattccagaaaatgctcaagactaccagtggatcggtctgaatgacaggactatcgaaggggacttccgctggtctgacggacactctctggtgagttcccagagaataaggagtgggagaaaggccccaagaacagcgtgcaacaagtctgatgcaaactctctaagtagatgctactaggcaagggcaagcaggaacgctgtagggaaggggttctgtctctttcctgtgtctctggaggctgacctggggctggatagactttaccagggaagtcacaagatgggaaaaggagccaaaaggaaatgaaggtgtgacagcaaagcatgtgaaaagtgtatgacatttgagtttcctatgtgcaaaggacttgtgtctattcaacacataaaatacagagatcactagacagtgtaagaagtcagtggcaggtcaatgaagagctgaaccctaccagaaaatgaatccttgaggtttatgagcttctgaaaaaggatgaggggcgggctatgtaaccaggtccctaatctaggattcatagcacccggacgtccctcatctgatcagattcccagcatcctttgtgggttcccttacaacccaggtgttggggtaaaagaaaggaaaaacggagat

SEQ ID NO: 32628 - DNA, 1487 bp, Mus musculus
cacatccagtatgtggcgtcctacaaggtagcccacagtgatgatggtgtgcagtggactgtatatgaggagcaaggaagcagcaaggtgggtgtctgtccggctacaattcctgggatactgtgggtttctgatgggtgggggaggtggccgactgtggagcactactcctgacactccagtggtttccaggtcttccagggcaacttggacaacaactcccacaagaagaacatcttcgagaaacccttcatggctcgctacgtgcgtgtccttccagtgtcctggcataaccgcatcaccctgcgcctggagctgctgggctgttaatgctcagtcctgccagcccaaacgatgaggatggccagaggctgaggggcctcctggccctgcctcccaggccctgctgccttctgtggctgacgaccttcttggccttcccttctgattgtactggggctggaggcaggaagggccaggggatttcagagttgcccttcaccctttccctcaccctgcagcccccacaggcctcctgctagcccccttctctcaggcattctgggggagttggacaggtctgagatgaatagagaagaagagtgaagttggggtatgtgggctatctgtaccaaccaccccaagtcctaaacttcctgccagggcttgactcaggactgaagggagcccctgactgcccatccctctctgcacaccacacattcctccatgttccattccgggaaggagaggcccacgtccgcttgctgtcccttgggtcaccaggtcctgcctcttatctcctgagacgcctcttgacccttgcactggagcctcagttgacaaggagactggcgggtctggagaggtcggtggctctgggtggttgacaggttggctgtgggacctctgctggcttgctacccaagttaacaagcagattccaaaatacattcgtgttctccactggaccctctgtgcctcctcattgccctgtcctagccagactgcccggtgctgctccctgcctcgacctctaaccctgtcctcttgagcccaacactctcatgccagactgcaaatagcttaagagcaggagtggggggtggggccgctaggggtggatgcagttaggaggaggtttccctgtcctccgagtctgactcactatgtccctgtcatctccacttctatgctgctctggatctggcctgcagtgccacctggtgaagggccagagagggcctggcagagaggtagttcctgggactgttcccctccctctccctcactaagaaggtggccgaggcttgggtactgggttctcctttggtagtttccattttctttgtaatgggagtgctgggctggagactttttttttttttttttttttttaagaaacccaacaaacctggctttcagagaaagaggtctatggtagactggatatggtgggtgggggaagggtgcagtgtggaaaggaa

SEQ ID NO: 32629 - DNA, 1104 bp, Mus musculus
ttgcttagcccttagaccttcagagcataattacctagaaagctcgaagatgagacactcaagccatcttccttgagactgaatgctgatggtcagccttggttgaggctgcttcttctgaaaattgtgttatcacaaccatactgtcaaggcaaacaaaacaaaatcaacccgggatacagtcctttgttaaaaggtcaatcggatatcctaggttgcccaggttggcgcagacatgggacttttttgagacagggccacactatgtagctttggctggcctagaacttactatgtagaccagccaagtctttttgaacttacagagatctacttgcctctgatctttgattccttaatgctgggattaaaggtgtgcaccagaatacccagtgacatgggactttctatgctaatactgaaggagcctcaggcaagcaggatatgttaaccacaccgttttttacagtcttcgtctgtcatatagtgaggctgtttgttttctgagtgagtgagtgagtgagtgagtgagtgaatgagtatgcatttgaagttaattattaactttgccagtaactagctcagattatactcgggatattcatcccacttctctgtgtgtatcttagtgcagaccctgacaggcaggagagtaccactgtccttgaagcatcttactttgagtcgatcaaggtcactcccaggagcctgctgcagatctctacctgagatccagatcaaagcttcttgtaaagattctattccttctttcagaaattactgaagcccaaaatacctaagaaggttcagaactcagaattttcatgatctctccattttctttaaatagaggccatgtcattcacaccatagcaaccaattccagcttcccaaactcgcccccctcctacttcttcccccctcctgacaccctgttcatcaggcctgactgtgttcgtcaggactccgctgtgcctcatacctggatgtgcacgtgggaggtagaggcaagagaatcaggagctcagggtcagccacagctccatgagaccctggctccgcagggggggaatcaaatgaagcctctgctgcagtggatgccgt

SEQ ID NO: 32630 - DNA, 3898 bp, Mus musculus
ccaccaagaagtcagcatccctcgtgctgaagaaattactcagcttgggagtctgagaacctgggccttcctgggcctgagttttgcctgtgaaacaaaggaaattctctgaatcaaaagccgagttttccttctccttgtctcctcagacacctctgtctctgtcttgctgctgctgagagttgcatggggcacttgtctaaaaattcagcctcccagatccctcccctcggagccgctgacgcagtgggcttgggaagggctctggggattttaatttttgacaagtgccccagggaattctcatcatccagcaaaccgagggaaataccgtactactatgcctttaagttagaaagatcttggtggctcatttaattgacattcctaagccacagtgtccctctgctcccagagacctccaaagcagcaaggcctgttgtatggctgcctttgtgtgatccccctaaaagggagaagacattggagctgaaccctgtctctgcttctccctggctgtatgactctggataagtccctctggacttgactctcttcctctgttaagtagggggttggaccaggtagatggcagagatgcccatcggttcatccttccagggttgcctgggactccgcctcccaggttgagcatgcaagcgccattaattgcatttttccccttccccatttcatagaaagatttgagagtcttactcactctcttgtaattttactttttcaccccagttctacccaatgtctaattgataccaaacaacccaaaagttggatgggagtttgaagaaatgtatttgcagctaagagaagggagtgttcttttgaagttggtttgtacttaaatagcctctgcatgttgtctgttggatagatctttctgaaatgtcttctcaagcggacttctcactctagggtccaagtgctccacttctggaacgttgtggtacttgagtccctaagaacctgcactttgaaaagtatgcagttgctgtccagaattgaatgagacgatgagtgaatcgcctgggttattgtttcctctgcttcatctctgttggcaccaggacagcccaagaggtgtagtcgtgggtctgtgtggatggtaaaggagccacctgaacacctcagggcttcgggtggaatagagcgtgggcactggcccgagagactgacaggaaagcctgtacatgaagcgctgttttctgacaatcactagatcatcccagtcgtcactgagatgtctgcagcctccagtttgctttttgctataatttgtcacactcaccaaatcctgtccctgtgcccctctcatggtggccatttctctgttgcatttcccttagcacagattggcactttatccttcatccctcaatttggaagtgaatccttctctatcgatttttccctccaccctaccgcagccataatctagaagcctcacacacagttcctgtttcctgccttcatccctgaagacttttaatgagagcaataaggtcacagagtcgagtcaccgtccctggaagtgaggggctccctttgcttgcccgaggccatctcttcccaagtcctgacaaagcttgggtgcccccttttgtcatacttaggaggaagtgggaggttgtcctgggagcctggtccaagcaacaggcctggaggcccactggggagaggtggagctgccatacgcctagagatccaggccctccctggggctgggggaggggacgtgtaccagctgaagcctccttagtgtgtcactctgaatggcactggcattccattttgcttcacatgaaatcaactgaggctctttatttaagttttgggctctcagacatggaaatgagaccgtgaccgtggcagtcggacaggaaaattcttgtttggccctgaatgagagtacagaggcatgactgtggaggtgccagctttgcctaatgaatgggaggacagccctctatgtaggtcggctgctttccttcctctgggctgcctcgctctagcgtttagagagtattctgtttttaaatcaaggatataaattacatagatgtagacaattctgtggctggaataacattaagacccaagtgcggagtgcacctatattattccagttgtactccctgcttcccaaataattggaaaccatggacttcagtcaaattaggattacctagcatcaaaatgatgatcaagactgcctagttagcagggaagcttgcagacttgaacgcccgttctttcctgcaccaactttgtgtcttccatgccagagcagagtgaaggtggaaaacgtgtcagtgtatccctctcacgcctgtggtatcctacactcacagggaaccttgggatctactgaaacattcctctaagggtgtcttcctttattcacatggtgttacagaaccagcgtcaggagacctggttgctcacccccactggctctgactcatgccggacacacgggcaagtcacttcacctctcttgaacctgttaccttgttctatagcatctctgaggctgcttcactcacttgtgaatcattctctccatcattgttaagtgtgtctgaagttgcacgtagaagggagtgaaccctgacccctaagctcatcttcatcttaagagagagaaggcgcgtgtgcattcaacttttcctagttaggacacgaggcaacatccaaaaccccgtctctggcctctcttcctagtcttgaccgtcatgaccgtttccttgctattctgagggtagtcttgtgactgtagcgggtgagagccacagtaatgaggagagtgcctcggtcttcagtgtgaccaggctaagggtggatggttgccaagccagaggtccttcctgggcaggctcgctctggctcagctgaaccttctgggtggctgagcttatctggctggcatccggatgagagccctctttgtaagtggctgacttgagatagagtttgccaggtccggagatacagagcacgtgtttatgtttgccccggaagcaggtgttagagatgtgagaggcttttcttttcctgtggccttgatcctgacttgagtgacagttttaaaagaaggaggaagtgggtgtgggggtgtggagacaggacttgtggagttgaaggaacccctgggttttcttcctttaggcacatgagagagttcttaggaagcatgtcacctcagcatcctgtcacagtatcatctggaattgttttctttacccacaaagccttaacttgcctctagaaaatcccctggtatgacaacattgtggcctaagaattcaaactcttctcctatgaaagtctgaagcaaagccacagccaaaccagagaatttcctcaggtggcctggaggctcctatgacatcacccccacctctcaccccaacaacatgagtgatctggatctaagcccctccacccacccgtcgtcttggccttactctctttcaaagccacattagatcactcaaatgcttccaaaaggggcctgcttggcatttagagaccaagccattgagggccaagtttcttccacctgttagctaagcaaaggacagttgtcccctctgcctggggtcaattttcccaaactatgtttatagctaaggacacaggagcaggcccctgctggctaaggaaccccaacagcatccagagcaaaggctgctctgctggccttgctgcctccaggtgctacagcccagcatcctcctgaagtggtccttagcaacaggctacagagtacagcttgccaactatccccagacacccagaacacagacagctgtctcctttggaagagtctgtctgccatgttttccagctgtttttttcctagcgtatacataggtag

SEQ ID NO: 32631 - DNA, 1345 bp, Mus musculus
cacccttagtctcggtgggcattctgccccccagaccacagacacagagcagtcaacatcacctgaaatcattgctgacctcctcggtccccagggccaaccgccactctcccaggctgctctcctgagggaacctggttcctggtgataggagctgggctcgctttggtcttcattctggcctctttagttttcctaaagcacaaatccatgtagtgccctgttacctctccacacccattccaggtgacctggctctctcccgcagcctcaggcagaccttcactatacctgagtttgcaacttttcccccactgccgctgccttattgaccagggctggggtgggggaggggccagctcacctccctccttttcccaggtagactccaaccgaccactgtcttacgttggcagattctgcttccagattgatttttttttttttttttttttttttttttgagaaccatcactttcacattcctgattctgatgagttttgttttgttctctctgggtttcacggaactccagaggctgccctggaaatactgtattttggagtttgtgctctaaaagcccctgtgctgctgggtcttctgactcttccagcagcaggtgtttcggacttgcaatgagcaatgcaattttttctaaatatgaggatatttacctttattaagaaattatactaaacaatggcgtccttgattgttttctgttctcaacgttacttttggaatctgtggtggtaaacaaagatcattacaaacaaaaactgtaattttgttatctttgattcaacggaatttctttacttaaaaaattaaagacaaaaaaatgtaaaatgcttgtatgtgctctgtggagggagagttttctgcatgaaaagggggtgcatctgaggacggggcagggttgaccctgtggatacacaagctcgaggacctcacttcatatccccagcacccaagccggctgtggtagcacatgactgtgaattctatagctatgaggcaaagatggaggatccctggggcctaatgtctggctgttcttcctatcccaatggaactccagactcattgagagaacctgtctcaaaaaccaaggttgagctcaacagagggattcatccaatgttgacctctaacttcatgtgagcctacacgtgcacgcacacacacacacacacacacacacacacacacacacacgggtagatcctgtatctgcatcaaagcatggggcttaggggcaatgtgcagaacactaatttcctctcccagtgatgttgaagccaaccttgcagacaaatacctgagccagatgggaccagttct

SEQ ID NO: 32632 - DNA, 1215 bp, Mus musculus
cagcagtctcagctgtaaaacactgaggaggaagctgcctcggctagttttcccacacactaataaatcattcgtaaacacttgtgcttagaccaggggaaggctctgccttcctgagactaacctgggggaaaggctttctgagcctaacattgaggatgccccttggttctcagcgtggtagtgccatgtcaacaatacacagctacccaggcagtcatctgctcttcacacatccacgcagtctcctggtgggtgtctcgtgctttgtatgtccccaccacccctctcccttcgtaagaagtagtggcactcgttttcttcagcagcttctcagcgtatgaaacccagacttcccgtgggacccttcctaatacggtctttgccagttgctccagccctttccctcctcaccattcaccagatgtgtgtcttctctcaggtgctcaagcataccgaccccttgctcagcagaggcctgaatacagcgatgcctccaatggctctgtctctgtgggcacagccagccttttcttctctagccagtctctgctcacatgtctccgaccttggagaaggtttgccggttctacctgctcttggctcccctttcctccagctactgtctgtctttgtcatctttatgacatcttttctgttggttccccaccccccaccccccataagctctgagtcaaattaccgtgcccattttgttctctgaataagtatgtgcactacaagtattgcagatgggtgggcgggcatctctgaatcacgccacggcacctagtgctaacgaaagagttaataaatatttgtggaatgaaaccccgcccctcctttgggattttgagataaagtcttactttgtaatgtatatagacctcgagccacaccttagcctcccaatactgagctaaagacacgaactgctgttaccaaatcctgctcagccaaggatgaccttggacttctgatacccctgcctacatcttggaagctggggttataggtgtgtggccactgcagccagtttttggagtgcaagagtttgaacccagagtcttgtacataccagacaagcacattaccgactgagctgcatcccagccttagtctattattattattattataatatttatttttgagtagtttcactttgtggctcttgctggacttgtagttgctatgtatcctgggctggcctag

SEQ ID NO: 32633 - DNA, 1146 bp, Mus musculus
ggtagcgtggactgagaactgtgttacctgcttagctgcgggagagccactcgagttggctgtgcagcagccgtctcatggtcgcactcttaagaactgtcctcaacaatcagcgacgagagcatgaagttcttgccctcttttcttcctgggttccaggactgggagtgacgtttttgtcttcaccttgctgtactgttttgtggttcagaacagtgatgcatacccttggtagcaggcggtggaacactgagttacacacctgcctttgctgacttatacaaattgagttaagggcgctgctgagatggctcagcagctgaaaatacttgattccagtccctaggaaccacgaggtggaaggagaaagccaattcccggaaccggtctctgacctcaacacataaccctggcgtgcactccctccaccctccgcacccaaccacacctcctgataaacaaatgttcaaaaacagtttaaagtttgagacaggtctgagttgcctatgttggtcgcaaacttataattctcctgtctcagccttctgagtatctgaagttggaggtgtgtaccaccagactggcagggaagcatttatgttgatgttttctcatgaaggaaggcccgtctttagctcttgtaagttcccactgaagcttgcagcatttgtagcatcttaatctctttaaacagccgccgtagggttgtgtgtgatctcagatcagaaactataatcttggctcattttttttctttttttttttttaatttctgttatggagaaagtgtttattttgaaattattttaattgagaaatagaaaacctcataggaaggaggaaagaaacaatcacagagcatccaggcaatgtttcacttcatgctcttgtcaccccctcactggttcgctcgtcccgggatgagaaaggactcagccacccacagtaatgttattaatggatatatggatctgtttcaccaagaagccagtgaacccatgatagcaaatcctatcgctgtagccatggcgatcttctggaattctttgttgccgggtttggtgcatcttttaaccagccacattgagtcctttacaaactgccgactgggctctacagactgcattacctgatctgtgtttgtgg

SEQ ID NO: 32634 - DNA, 1110 bp, Mus musculus
aaggattcacatttgttacatcattcttctgcagttgggaaaagcgccttaggaaggctaaggtgccatcagcttcagcagttaaaaactcaaggattcatgagtcgcggtttttctgtctatacacagttaaaacagttctatgagccagagcctgatctgctacctcctctgaaactaggagcttgtgttctgacccaaggaagtcagatctttctacaagagccgctggtaagacgtggcgcctgcctgcagccactgtcccctcgtcggtggtaaggttgatctacagctggttccgttctccctgaagctttcccagttctttctaggagtttttacttttccatgtcggttattggtgacccatcatgagattgatttattgtattttatgtgtatgagtatttgcctgcaaggacatatgtgtgttatataggcgcctggtgcctagcggcattagattccttggaactggagttgtgaaccacagcatgattgctgaaactggaacccagatcctctaggagcagcaagtgccactgctgagccgtctctccagcccctacttaggatctcttggtcaagtagtacttcactaatcctgacagccgcctcttcctaagagtcatgcctgtcacttatagacccttggttatacactgttggaagtagagatgcacagtggagcgaacagatctgcttccccagtctgcggggaggaactgggatgaccctctctgtccttgcctacgggatgcaaaatgtgagccacccacaagtgacttagaacacaggtcgagggacagaagagctgagtcttcattatgtagcttcagtgccatgagatgttccaagcgtccttctaagatgctgtgttggtgtcccacaggttccctcagcataaaccccaatccttggagtagctttcagggcttgggaactataggctgtttaacttcattccggggctcagacagtgttgctatcacagcaggaaggcacacttggagtttcattctgaagtgtgagctccttatggggccagtgctcggcaagggggaagggtgcaggaaatgccttagttcactcacgcctctccagctttgt

SEQ ID NO: 32635 - DNA, 1205 bp, Mus musculus
tggctgaccctgaggtcatggctaacactgaggtcatggctaaccctgaggttatggctaacactgaggtcactgctaagttccagcaccaaaaacttcagtttgctcctcttatactgcaggcagtgagataagaaaccaccctagttttcaagagaattctccagctcattgttgaaacagaaaaccgctgttcgatccagggtttcttttttttttttcagattttatcctcttggaataacatctctgaatttgttgtaccccagccattaggctttctggctagatgtctcttccctgatacaaacgtgtctacctatctgtgtacatcccttccttccgcagaggtcgttgttgaatctgctgagcagcgaagaggacgattttaacagtaaagaggccctcctgctcatcgcggtgctgtccaccttgtccaggctgctggagcccacctctcctcaggtacaacagtacctgttcagtcccattccgcatgcctcagaagacaaggactgtctcgtcataaaagcatacacctagggctggggacgtagctagttggtaggaccctggcttaccaagcaccacaccaatctggtgtgttggtgcctgcctgtagtccaaaggagggtccgaagctaaagagccttctgagggagctctgtggtgtgtcttttcctatggtgaccaggttggcctcgaaatcagagatccagctgcctctgcttcctgagtgctgggactcaggcaccactactgcctggcctacatagtgtttctgtcagaaaccataaggtccaccgtaaggccaagagcgtactggttttgttcactctgtcaactgtaaacgcggtttctatcagactggtcttgctttggtgctcttggccttctcagcacggtggccttccaccgcttgtgcttcttgatgttttttgctatttctgaaatggcagctttagtcgtaaaggtagctcaagttcaccaactggatgtcacatggaaagagtgaagtgtgaggagaatttaacaggatgagtcagcgaatatgaacacaatcccaaagtagacatacccacagagatgggttctacatgtgtgtgtgtgtaggcatgtgtatatagtcttaggttactctatgagcgttcaaacaaggagaaccagagaagggccattctggtgggtctgttcacttcaacagt

SEQ ID NO: 32636 - DNA, 1431 bp, Mus musculus
cattttcaaaactacaccagaaatgtttaaagttttattgtataagccaaagtgcattcttatgtggaaaaaatgtatctgtgctgaaaatgccagagttggttagaaagcttgtgttataataagacaagctgccactctcaaagactccctcacacccactgtctttgaccccaacattcagattctcatttctgagttcagtcacaattctggaggcatcctaaccaatttccaccgtcttacaggtgaagcactggatatttaccagataattgaactcaccaaaggctccttggaaaaacgaagccagcctggaccctagctctgtctggaggttctgtatttgctcctgtggagctttattggagcggtgcaggttcctaaactcaggctttcagatgtgcttttttgcaaaaggcagccatttttctgtagcaggacctgcccaggaaagtcctcctaacggaaggcacaattcagtgcgttcagaaccaggacaccaacatcagtgcaggctgtgtgacaaggggtactgttgggcacaaatgaagcagatgccccaaaggtcacattaactcaggcatttcttcctcctcttcttggctggttctctgtcctgctgtgtatgtgctgatgcagtgccctagaaggggagagtagaaattttgacaaccttgttctaaggtgatgggaataaaaacaaacaccaaactcctggaacagttgtgctttcccgtctgctgcccaggttgtgacttagaactccgtcctgagtagatggacgagatgctgggagcccggagcatcacagctacagacggcctggggcacagtgatgtacggaactccgcatcagccggctagccagattattttatataaatgtctaattttgactgggtcttgtctactgatattatttctagcttttacaaacttaaaatggaacccacattgggctcaggtgatgaatgggcctaccttgagggagggtgtaaaagccagccagaatgctgtagaaacaggaccccaggacaggggagtttgtctgctacttttcatagaaatatataccaaaagcatagcagaagtaggcaccaacctcttcgttttcgtcttcctcatcctctcgaagaaccatgtcgaggacactgcctttgatcttgaagtcccgagaagtactcagcttcatgtgctgcatcaggtttacctgggacagcagaaggtcctttcagtgtgtacttggaggaccctttgcttttaccagatgacattcaccttgaccacctctagctgtgctgcctgccacagagcttgctagactccttccagcagtaaatgagagtggaaataaagaacatttttaccttggactttttagacagttggataagaaatttttcatactgttcaatggcaaagacaagg

SEQ ID NO: 32637 - DNA, 1556 bp, Mus musculus
tatgcttttggtatatatttctatgaaaagtagcagacaaactcccctgtcctggggtcctgtttctacagcattctggctggcttttacaccctccctcaaggtaggcccattcatcacctgagcccaatgtgggttccattttaagtttgtaaaagctagaaataatatcagtagacaagacccagtcaaaattagacatttatataaaataatctggctagccggctgatgcggagttccgtacatcactgtgccccaggccgtctgtagctgtgatgctccgggctcccagcatctcgtccatctactcaggacggagttctaagtcacaacctgggcagcagacgggaaagcacaactgttccaggagtttggtgtttgtttttattcccatcaccttagaacaaggttgtcaaaatttctactctccccttctagggcactgcatcagcacatacacagcaggacagagaaccagccaagaagaggaggaagaaatgcctgagttaatgtgacctttggggcatctgcttcatttgtgcccaacagtaccccttgtcacacagcctgcactgatgttggtgtcctggttctgaacgcactgaattgtgccttccgttaggaggactttcctgggcaggtcctgctacagaaaaatggctgccttttgcaaaaaagcacatctgaaagcctgagtttaggaacctgcaccgctccaataaagctccacaggagcaaatacagaacctccagacagagctagggtccaggctggcttcgtttttccaaggagcctttggtgagttcaattatctggtaaatatccagtgcttcacctgtaagacggtggaaattggttaggatgcctccagaattgtgactgaactcagaaatgagaatctgaatgttggggtcaaagacagtgggtgtgagggagtctttgagagtggcagcttgtcttattataacacaagctttctaaccaactctggcattttcagcacagatacattttttccacataagaatgcactttggcttatacaataaaactttaaacatttctggtgtagttttgaaaatgggtcagcgtacatggaacatttgaaattctaacatcttcatttactatgagccaccctctgcaacagttccctttgtgatttgaatatcatattcattttagaatactgcataagttaaatgcatgtttcttgccgagagccccgaggttctaagctacttcccattctacatgtagagggaacaaagagtgcactcaccctgggggatcccatatctcctttccatcccagttgggttagaaggagttttacagtccatggtcacttccttcctgaggcactggtcaatgtctactgcactgaaaaaggcgactgactggggcagatcattcagacccagcttataggcaaacatgcacctgaaagaaaccaagtcttccctcaccgccatgccctgctgtgaagataggctcctcactccatgaggaatgacagagcagcgtttctcctatttcaatcacttgctct

SEQ ID NO: 32638 - DNA, 1159 bp, Mus musculus
tagacaatatatatggaatgtatattttgtatagagaacctagatgagctgggcatggtggcacttgtccttaaccccaatgccagcacgtggaaggcaggtgcagctctgtgcgtccaaggcctgctctacagagagttccagagcaagcacaggtagagaggagagagaaccactctcaaaatagcaaacaaacaagcctagtgttttgttttgttttgtatgaaaatcacactctttgtacttttttgttctttctgtcatgcttagaggtggcaatttatgaaacttgtaaaacaaccaaggtcatgggttgtggtttctattatctttgtgggactgtgtatcagtctcttgtagattgttcagaaacacttcagatgcctcttaaagccactgctgactctggtgtcacagaatggtgcctgcttagatgccgtgggaagatgctaagtctgaaggtcctcccgtttatcagttctgcgtctggttttgcagaaatgactttgagaagaagtcctcgaatcaagcagctgtcatttagcagaacgaactctggctccttctattctgtatctcagccgaaatctcgaagtgtgcaaagaatccactcgtcccagcaggagtcaggtaaggaggcctgggtgtcgagtatggctctgttgacttggaatattttgggaaaaagaagcatacaatttgatatttccccattagcagtcaataatcaaggtgatactaggtaacagtcctcggcctatagccattcctccctggactcttacagctggccgtcctcattgctttctagatagctcattcactcccacacagtgtcccaagtgagtgggtagagcagtttgtatatttactcttcattcttttatttgtgattagattgactaatatgtaagtttttacatttatactaaaaaatacagtatatttatcctaaaatcagttacttcagttgctcccatttcctaaaataagagttaaatccaagaagacagggcctagaaagatggcttagtaattaagaatgctggctgctcttacaaagaactgagattcaatcctcagcacctaacatctgtagaccagagtgaattctaggacagccagggctatataaagagaccctggactggagagatgg

SEQ ID NO: 32639 - DNA, 1527 bp, Mus musculus
ttcgggcagcaagtggataatcagagccaggcacttctcacagcaggcttacatccaccttcatcacaaaggctctgccatcaacctctaggcttccccatcttctggcccttccataaaccacaagatctggctgctcatgacactgggttaggaatatgtaaggtgagggacttgggtggctctcttatcacaaaatcatttcagccacacagagtaacaaaccctgagacccaaaagaaagccttttgtgcggacacacaagcaattttcagttgcttgtcactgccagcgtgtaacccttaagagtggaggtgaccctctgtggccatgctgtctttccttaggcctcactgagtctgctttttcctagatgaggaagtggatgtgttcccctctactgctgaagagtctccgttcagccacaccctctcccggaaacggcctttcagaacctacacgagaaagaagcttattagctagccctgcttgagcattgcgctggaggactcaaaatgaggaacgctgtgagcctggctagaccccttgcactcaggagatgtactctagagcagctttctctgggtacagtaacaatgccagactcatgccagcaatctagcattgtgcccagaacacgagtggccaggacttcatgggactgagaaagttcacaagtaaagatgacagcagcaaagtccctgtggacttaaagaaattgaagattctgcagggtatggtagtaagcctatagtcctagcacttgggagacggagacagaagattctgactacatagcatgtacaagggcagcctgggctacatgagaccctgtctcaaaaacaacaaaagacattaaagaccttaagcctttttcccatggtcatctgaagattaccactggaatgcctcatggtctgaaaattcctctctaggtcttcatatgaggccaggccctgactctttagggggaaggttggaagtctggtgggcagctagtactatatataactcagacagcccaaagatcccattccagatcttggtaattcagaggactactgccacactgtgaaatggaaaaaaaggaggtgtttaccaagccttttctctgggtacagtaacaatgccagagttcttttacacaattggtacttcataaagtaagacccataagtgaaagacgtcagcaagaagcaagctaacaataaagtcatcctggcaacttagcatttggcatttctgcctgggagtaactggctatggtccagagcaatcatactgcagggtctaccctgaaaagcagccaccgcatgacagtcttagccaggtatgtgcttgacacctgtgttgccctataatcaacctaaccaacttgctatggagtgttggcaggagcctcatttgcagtgagggctgatttggaaccttctcagtctccccagaagattcaaccctgttgtggtcccagggctctttctgttgtcagatgccaggtgaaaactcccatgtctcctttcagagaaa

SEQ ID NO: 32640 - DNA, 1201 bp, Mus musculus
cgggatgagcatcagccagggtggctgtctgggaggcaggggccggtgaaggagaagggaaagggcatgtttgacagagctggttaagtaatgtgttcatgtctacccaggacagagagccgagggcggtgctgtgctgtggggaggagggcttagctgtaagtgtccaccatgggacggctcatgtgccaggtaaacctgaatgggaaacactgtcatttacttctgagaggtacgagagagagagagagagagagagagagagagagagagagagggagagagggagagagagagagagaagggttcatttcgccttctttggagagctgaggggaaagaagttggtcaggaggaaaagggggcgaatctgaagactgtcccaaggggcccctggcatctgttgaggaacccagaggtggagctggtatgcttttgatggcctgctgggaactggcttcattctgctctgcctgccttacctctcgagcctggggaatctttccctgagtctaacctctgtcctcatgagtctgttctctccatttctccttgcaggtagattaccgtcactgccttcccccctgcctctaggtgccaagtctgcagcctgcccttcagcccccgctctagctgatttcccacccccactcccccctctccatccaggccacctgcagtcgtaaccacacactgtgttggttacagcaggcatctcccctgcccacccccatcccccatcccttaccccaagccagctctgcacactgtttcatttctgatctctccagagcctgggcagagcgtacccctgtccagcctagtgaccttcgcctgagctctggttaatatttgtccgacccaaaggcagtggggctccaccccctgtgaggatataagctggccccggggctgctgttctttcctcttggcctgagctattccgagctccctgtccaccggcatcatggccaaggggttctacatttccaagaccctgggcatcttgggcatcctgttgggtgtggcagctgtgtgtaccatcatagctctgtcggtggtctacgctcaggagaagaataggaatgcagagaactctgccacagcccccacgctcccgggcagcacctcagccaccaccgcaaccaccacccctgctgtagatgaaagcaagccttggaaccagtatcgcttgcctaag

SEQ ID NO: 32641 - DNA, 1166 bp, Mus musculus
tgcagacaaggcctgcactgaagtagtgacatcccagatcaggcaggacagagtggtagcttctccagcagcagcagcaacagcagcagcagcagtagctatacagggtagtctcgggttaccttgatgagtagttttcaccagtgggatgaggtgagcttaaatcaggggggaaaaaagtaacttaacacaccacatccaggtccttattgctcatcaggctaattaaggtgaatttgttttgagaaaaaatattaagcaaatgatgtcctggacgatgacgaagatgcttctgtgcacagtctcagagcgcagggtggaaggtggagctgtccccaaagcaagggtctgagttcttgggtgccttagctatcatcttgtcacttttgtggtggtgaagcacaggctgtctgctgagagagctgccacagccagggtctttccctaagtgacatatgtgaaagagatgagaactggaggtcacaggagtgtggcattaaggacacggcaaggttgtgatgttttagctggagtttgaagtatgaagaagagcttgactagaaagagaggaagggtatatctggccaaagaaccagaggaacaaaggacagaactaagaggctcaggtgcctgagaaaagctggctctgggtgtgaagagaagcaaccagagggtcaagttcagggatggtgttggcctgaacttgtctcagtctcactctgaaggcagtgacagccgcctcacccacacactcaggaagatctccccgctgagcacgctgacagggcaggataacaggaaccctaaagcctccacagcctgctgggcgtggaagagcctgtgccaaggcaggggctatggagagagactttttttggagtccccccaaaggtgaggaactgtgaagcccacccactcacccctagcctgggttggtgccattccttgagctaagccacatccagacaccagggccctttgcagaggagcccagatttcggccagctggccctcggtccatgtccaaagcaaacaggaagagactggagggccaagctagctctttgtttggagacgggattagccgaatggacttgtgggtctgcctgctgttcaggtagggggacatggctcccagggtgtggacttcaagcttgtaagaataa

SEQ ID NO: 32642 - DNA, 2235 bp, Mus musculus
tgtttcgtcctctgccagatgcagagccagccctctctccctccctccctcaccactgcagagccagtttagcaattctttctgtgacctcagcttcagaaaagaaattaggagcaatgcctctgcctaggtcccagacacgatccctggcctggcctggcctgtaaaggctttcctcagcatggccacatcagccatgggtacctggaaatgaagctccagagcaggtccctgccctccttcacagtgaccaagaggagtactgagccccacctgctctgcacacatcctggatgcccactcttccaagtgtgctgaccacccagagtgagccagctctttgtgggggctgccaggctaggcccaaacctcaaggtcacagtaagccttgaccttttgggaagctgtggggtgttcttcacctgcatgttctggcagatggggctgttgaaatacctcaatgcaagtgattaaccctttccagagctctttcttatttcaactcttcctttccaaataagaacttaatttatgtagttcgggttttgaggggtttgttttgtttagttattctgttttgttttgattttcaagacaagatatctctgtagccctggctgtcctagaacttgctccatagaccaggctggccttgaactcatagatctgcctgcctctgggattaaaggcatgcaacaccaacatctggctataggtcagtatttttacatggaggtggagaagtaccctcagagaccagacgaaggccttggatctcttggagctggagttgaatgggggtactctgaactgctgagccgtctctccagccccatgcactttacatgttaagaaaacaaaaaaccagtttagcagaggatagcctattcccagccactgagcactgccctcctggcagcaagtgtttgcagtttgaagaagaaacaagcgtcctttatcttcactttcaaaactaaggtcatagcttcagttgccctcagctcagtacagtcttactgtcctccagaaatgcagagtccaccctacacatacacctgtgagcactcacaccaagaagtccatccttacagtcccacggtacctctgcgttctaggactgtaggactgtgacatgggagtagggaggcccatgggtgcaggtggaggacagcaaggattgtaccgagaaaaggatgagatgatgggcatgttcgcttgcttggggataaacgcctgctggtgagtgagtggacaggagagcgtgggtccagctctgtcacgtatggagttggagtaagtgacatggccaagggatgagagtaaaggacagcctgggcaagggctgaggagtgtgcacattggagcaacctgacgtccggggagagcagaacaggaaacacactggtcagacaggaagggaccccagagccacagctctaatcctgcctggaagctgtatatgagggtatgagcagagctggagagacactgctcgctcacctcatggacgggtcatctgctcctcctcctgtcccacatccccagcttcaccatgaatcctttaacaagccctgaacttaacctaagccattcacggcgtctcttttctaggacctgttcctgctctacagcttggcctcctaaactatcagaaactataataaaacttctaaaaacccctctgtggccatgcatttcactcttcaaagtggcaagatgagaacttggaagccattggctcaaggtggcttttgtagctgtcaagttttctgggaccctagctttctcgcctgcccacagctaagctcaccaagagccaaggaatgcttttccattatcaaagtcaccccacttctgtgtcaatggggaagtgactaagaaaagtggtcttcctacttggagctgcccagccaagctcccagctgggtcagcaaagccagccctttgatggacagttccagcttggaatgggcaggctcccgactaggttgaggagtacattggtaggaccttccaaagcttggctgtctctgtcagaaggggcctcatcatgacatcccaacagtgtgacccacaaagacttccacaggccatgtctgctgctgttgctgggaaatttgtggcactgggaagaaggctgtcagggtctgattctcatcctgactgcaagaaaagcagcaaccaggggccctctcaggaaggcagacagagaccccaacctatcccctggagagc

SEQ ID NO: 32643 - DNA, 1101 bp, Mus musculus
ttgcatctactttgtctgctattaagaaagccattgtctgagattctcattctctctctctctctctctctctctctctctctcccccctccctccttccttccctcctttccttcctctttccctctcccccctttgtgctttgagacaagatctcactttgtaacctaaattctcaatcctcctgcatcacctccaaaatgctgagattacaagtgccctgtgcactttgctgtgacatagaggaagtccttggtccttctggagaggggtgttccttttgctcttgagacatcagtgacgcaaccagaggccagggttgtgtttgccttggggtcctggacctgggtggttacacaggggcttccctgggtgttctcactgactctagttaacagctggaaccccccactccctgtcttctgtgtaactactcttgggtctaaactaagagagaggctgtctttgctccactgtctttgaccatccctgacagtgctctgtagtgacaattctggaactttgattttttttttttaaaagaaagaaataagaatacatttttggtttactcccaggcgtggggttttgggtctacttcacagcagctgaccatgacttaccttatgctctagcagatggtttctgcgattgtgtgacgtttggaactttttagagggtatatactgctagggcccagataggtgggatcagtggttgttggttgttgggggttgggggggtggttggttatagtttttagtagtttgtgttcaaagaagaaacagaaagaaatttgattctgagatctctatttctctctctcccacctctatcctctctcttctatctaatgatagggggtgaaaatgaggggctaaagggtagggaaaagaaggacccacaaaagtagcaaagaccagctataagcgaaaagaaacaagaaggaattagattcagagatctctatctttctcccctctctctgttctctcctatctagtgatagaggtaaaacttggggggggggggtcgtgtaaagggtgggaaaagaactcacaatatagcaaggcccagctacagtgcttacgtggttggaac

SEQ ID NO: 32644 - DNA, 1870 bp, Mus musculus
aagcagaaccccgttgagcctttagagtcgcaccttggggccctgcacctttcccagagtgggaatggagttgggtgcacacttcctggccatcctgctgctcctgactcacggctgtgatagacatcagggcactaagccactgctccttcgcctcccccacacagctgccctcagggccagggactgtgaacgcgccacctgcttcccagggccccaccactgggactgaacacatctgacttcctctctagcaccaagggcttctgagatcctgtatcacttactgggggaaagaccagggggaaagactagcctttgagctgtcaggcatggtaagtggcaggtgagggcagggtgtacaccacctctgctagggcctctataccctctgaatggtcaagcattgtggtccgcagttgctgcagagcagtttcctagtatatacctagtcttgttgtcagaggcatctgtgcgctggatggtttaagtcacactctgtgtgcgtgccactaccaccccccccccccacacacacacacacagagttggtgcgacccccagaaccctctcgcagaggagaccaatgtctgtagactgtggcgactggatccctcctaggttatgacttttcccaagtttaaaatacactgttctcttggaagcagaaggttcagtgctgtgctgtgaatgaagaagtccccacatacacacacttgctcagaatccactaaccagtctcagattctagagctgggagcctgggctgggtgctatatgggctgagcctgcagcatgctagctgtagtgctgtgtgcttcccagcttgagtcctgcagtgaacacactgggctcccttggttgacattctacagctctggaaccctgcaaagttgcatgtgctggtgtggaggctgatgcaccgccatggggaaccgccccacgcaggcccctctccctccctcccgataggatagtgtatttccatggcttgtgatgctgatgtcctaggagaccgtgtgtcttacccagtgtgtctcagtccccagcagggcttcctgcactctgccggtgctgatgcagcatcctgtcctcacctttcagtcctctgtcagagctgcagtgatggtgggcacttggctagaggacagacctgagatcaatcctactgcattctctggaagcatctcattgctattttatgttattttattgccatttgtgtacattcatctccttttacagtggctggaatcaagcatttgctctagggggacatgaagagtcctttaatagtccttactagagacatttttttaagctttattttatttctggggtgtgtctgtctgtctgtctgtctgatggtatgctctgaggccagaggagagtatacatgccctctgaggctagagaagggtatggaattccttggacctcaaattaacaggaggttgagaagccccctaaaattgtggtgctgggaagcagactcaggtcctctgcaagagcagcagtgctctgaactggagccacctctctggccccacccatggacattttactgcctggttaagcagacttttgtcacccagggctaaggttggaaacgtgcctgcctggctccaaagctctttttttttctccttactattcaagatagtctctcccagttttacaaccctctcttttatagatgacagacagggaaactgagacttcaggggattgagcaatctcacaaactaataaagacaggcttagttctctaaggtaggcagaggagagtggaggatcctgtgtcccttcagttaattgcctgagatggagccgcccagagtgctgtcaggctgagggtcaaaagggccac

SEQ ID NO: 32645 - DNA, 1191 bp, Mus musculus
acacacacacggtgggggggggaggggtaggtcagtctgcagcagagtcttcatgctgaaccagtgaccagtgaggactgaaagggtgtgcttattttccagggactaattattccccagtagctgcaccagaccaggactatctctttgcccttgacaagaatttaaatgcagccgggcgtggcgcacacctttaatcccagcactcgggaggcagaggcaggcggatttctgtcgaggccagcctggtctacaaagtgagctccaggacagccagagctataaaaaaaaaagaatttaaatgcatgtgcacacgtaggaacacaggtgatgctgggaggagtcagagccagggttctgcccatgcgcagtaccactgagctacagtcctaccctattggaatatatttaagctggtgggaattttaaagctaaggaatgtactgttgagggttggggaagtggctcaggtagtaaagtgcttgtgagctaaagatcagcacccacatgaattctatgttgcatatacttgtaactccagaattggggttatggagacaggaggattgctggggctctctggctggtcagcctattaagtccaggagacttaacctcaaaaaaccaaggtagatggtgcctgaaaaatgaccctctgacttccctctgcatgcaattctgtgcacctgcacacacaaatgcacccacatataggaacacacacacacacacacacacacacacacacacacacacacacacacacggccggtcaccatctgctttgaggtccccagcagatgtcccacaggtgtaacgcccagtgtgctagcccagcaaagagcagagcctagcagcagctgtttatgggcatccgtggttctgggcgctacgctatcccgtcctccggagcttgccgtctgtctgggagacagacattaaacgaataattacacaaatactctttaattatagttgttataatgcttcaaaggaaaaagttcagaggcataggagccaataattagggagggaggagccgaggggcagttcctgaaggatatctgaagcagctcggatggagggctttgtgaccagggcgggtatactttgtttttttctttctttggaaatagacagtaaagaagagaaaggccctatgggtaataatgggaggggctagacagcgtg

SEQ ID NO: 32646 - DNA, 1113 bp, Mus musculus
acccacagtgaccctccccgatttgtaataggacatgatagatccccttctgcaaccttagatggaacctgccagctaagatttgggaggaaatggaccaaccacttttaatggtgttggacccaccaaaggtacaagcactaggccacttgggcatcctcggagaagtgttcctgcccacccttagcactgcagggagccatggggcgaagggtgagggtctctgctgtgggtggcttgagacagaatcaatgtgatctcagcacaggcctttgtagtctgagactgttacacatggaaatacaggccgctttcaccccgtgcaggcactgacctaaaagaccatgtagacctgggctcagagggaaggaaaggacccacagacgtgtcacaggactcaggggctggacagataatgcttcctagtcttgcctccttatccgcagcctcccaagccttagttagcttcacaagccagtgacccaggcacaggcagctcttttagtgtctatgctcaatgccgtcattgtttcctgtagatcccagcgctgtgaagtcaggggttcctctgctcttttaaaaattcccccttttcatatcttcatttaatcaccaagtttttaccatgtaactttcattggcccaactctgatacaaaggtgaatatcatggtctctgtccctagtccacaagtgatgttggacttacaaacaggagcttgtgaagttgcctggaatttgttgttttgttttgtgtttttgtttttgttgagacagggtcttgcagtgtagcccgggctgactttgaacttgtgagatctttctgtcatagcctcccaaatgctggaactgccacacctggcttgtttagaactgctagaagtagaacccggggcccagcatcactaggggtgggaggaggtgggatcgttggttgatggggatgctgtctggccggcaaagggagccttgcaaagcaaaacccaggacatgtgagaagaggccattgggagtgggaggcagagtctgggggcaggagatggagatcccggtgaggcaagttgacaatatgtcaagacatcctccaaggcttgccattccctccagtgggttc

SEQ ID NO: 32647 - DNA, 1171 bp, Mus musculus
caaacttctgtcctctgtgggagcctgctgtcagacctcctggcccagagtagccctggtgaagccatgggaccctcacttggactgaattcaagcaagaaggccaagtcatgtttacgtgacagctgtctaggcgggaatcccctaccgcactgtcacactgcagaagcagttgtccccatattggctggacctgggacagggttgagtgctctgctagatggctctccccaaataaagcatcacctgggagctagcatgcattccgtttgggtccttactgggttctctctctgcgggtctgtttccctacgatgaagatgggcccctcctgagagctatgcttggttagcttggtagtgtatcttctgagtactgactccattcttgtgcagtccagataggaccagatgcagggaactatcactgtggcctgagtagccattaccccaggcatgtttagacctgtgtcctgtctttggactataacaaatccaagttccctccttattaagtaaatgttcttgttaagtcacctgctggacttctatacaacttacaaaaccctacttagccacccccaccctctttgatccctcaggtagtgttgaccatatcctaaccagcgagctgtggtagttctacccttctactatggctcctcaaggggcagcggggctgccatctttgtctttctgaatccaaaagagaaaagtgtggagccatccatgtttgcctaaccttagctactcaaaagtggcttaaaaaaaaaaaaagttttgaatctacagagctgaaaatggagcgtggcttcagggatgggcaagttgaagtttaggcagggggtcatcatggttgacagagttcattcctcaagcagtggtgggcctggggtgaggatggaggcttcagagatggcttccctgagggaacccagcaggacagtggcaaggactgacacttggggatgccagaggcgaagggccagcagagtctgcctggcgaggaacagtgaccttccagaggaggacggaggtcacacagcccagtgcaggaggcagtggatggcccctgatcatgtggtggagatggaagttgggcagtgcctgggctgtggtctgctgtggtactagaggtcatctgcacatggggtcagggagggagcaaggct

SEQ ID NO: 32648 - DNA, 1178 bp, Mus musculus
ggtgtcgggcctgggaagggatttgtaaactgtggagcactgtgcccatgtgaatggatatgttcattcctgtctttctgttgtgaggtggttgcgcgagcatgtgtgtgtgtgtgtgtgtgtgtgtgtgtgtgtgtgtgtgtaggccacaggtggtgctgggaatcttcaatcactcttctaccttattttttgagacaaggtctctcattgaacctgcagatcactcatttggctagattagactaggtggccaacgagcctcagggatcttccagactctgcctcccagcactgggttgcaggtgcccacagctgtgcctggctctttatacgaattctggggatccaaactcaggacctcgtgcttgtacaacaagcccttgatagatcgaactatctccttagtaaacccagcccctttctgtgtactggaagctgagctcaggccaggcattcccctgatataaataagatcgtagacagcaaagttatttgtcatttaggctacacccatacctcgcaatatcagattctggacacacacaggaagagtcaccacctgcactctcccctcccccaaataagtgccccatccttcgtgatccagatagaagaggaaatgcccagttcctctctgggcatcccacatacatccatcagcctgccttcctccaggaacctcctccaaggccatctcctgctccttgcctgcttctgacttctgtcttttacacatccctgcttacctttctgcagcctgtggcagccaggctccctcagccccttcctctgttagcatctggtacctggagatccatcagcccgcagtgcacttgtcctaattacaggaccccagccttctccttcactgagccgcctcgtccacacgtgcggtctctccacaggctgtgaggctgagggcagaatgcatgatcttgtgaccttccactccatgctcaggatttcccccatctccctgtatggaagtgcactgggcccactgtgtgtgtgtgtgcctgacttctgcctgtgtgtactccagctgtccctccccctgcagacctaaattactcttctcctggcataaatccagacctgactcgggtgtgtgggtgactgcaaaataaatgttgattccagtgccgccttggcttggagagaggcagtgctgtcag

SEQ ID NO: 32649 - DNA, 1573 bp, Mus musculus
agccagacgccacgggatggagggcttcatggactcagggacacagaccgacgctgtggtggtgctgtccttggctcaggcggctgtgctgggcctggtctcagaaaatgagctcttcggagccaccataagtgctgaggccttctatccagacctagggccagaattgactgggacagccatgggggagccaggaccgccagggccggacatctatcagctggcctgtaatggacgagccctggaagagcccccggaagaggaggtgctggaggtagaggcggcctttgagaagcacacgcggaggaagacacggccccctgtgaggctggtacccaaggtcaagtttgagaaggcagaagaggaagaggaacaggaggtgtatgaggtgtctgtgcctggtgatgacaaagacccgggccctgcagaggccccagccgaggtggccagcagcggctgcgaggccctggtgcagagcagtgccgtcaagatgatcgacctcagcgccttcagccgcaagccccggacactccggcacttgccgagaactccaaggccagagctggacatggccccattcgatcctcctttcccagatccagcccgggatggcttccccgagcccagcatggcactacctggaccagagactttgcccactgaatgtagttttgagccgccccacctggccccattgagcaatcctgagcctcccaacatgacatcgacgacagaactcgtcaaaccagagcagggcttcgtgtggcaggagtccagcgagttcgaggctgacacggcgggttccacagtggagcgccacaagaaggcacagctggaccggctggacatcaatgtgcagatcgatgactcctacctagtggaggcgggtgaccgccagaaacgctggcagtgtcgcatgtgcgagaagtcctacacatctaagtataacctcgtgacgcacatcctgggccacaacggcatcaagccacactcgtgtccccactgcagcaagctcttcaagcagcctagccacctgcagacgcacctgctgacacaccagggcacgaggccccacaagtgccaggtgtgccacaaggccttcactcagaccagccacctcaaacgccacatgctgctgcactcggaggtgaagccctacagctgtcacttctgtggccgcggcttcgcctaccctagcgagctcaaggcccatgaggtgaagcacgagagtggccgctgccatgtctgtgtcgaatgcggcctagacttctccaccctgacccagctcaagcgccacctggcctcccaccagggccccaccctctaccagtgccttgagtgtgacaagtccttccactaccgcagccagctacaaaaccacatgctcaagcatcagaatgtgcggcccttcgtgtgcactgagtgtggcatggagttcagccagatccatcacctcaagcagcactctctcacccacaaggtaaggctgccagcctccgccatggcactttctttccaatgccctccaaagccctgatgggatcctttaggtgtggtacacaggtagtttttg

SEQ ID NO: 32650 - DNA, 2681 bp, Mus musculus
ttgacaaccatcaggagatggaggacttcgaggaaaacgcctacacctacagcagtgtggacagcagcgcggaggccagcaccctcactgagcaggccatgaaagagatggcctactacaatgtgctatagcaggccgctgagtgggcggggagggcgcagggtgagacccacatactgagggctgcccctctgcagcccagaaccaagctactgcccactgcctggccctcctcccccccaaccctcaaatcatttgcaccactagggatctttagaccaaatggagactctactactgtccttgcagggagctggccacaggcctaggcatcccggtgagggaaaggtaaccaggaggtccgcatctggttctccttggcctgctgctgtgcgtgggcagggggaatgccagtgaggcctcttacaggcacagacttagaggtcttccccaagccacctcaggcgcggaggcgctctccaggaagagaatgcttgagccaggccttgtctctcttctgcaccgactctggcctttaaggacatctgaacccctgcactggccgacactgcccacccccaccctggtcagacccaagaacctcttccctccccctatcactcaagagccaggcagggcactctgccttctacctcctgggcctccccttgctccatgcaggcatgcatgcggccctagccctggccctgcctgtcggagagctgaggggagtccagcctccagagcaccctcccagctggcctgcagagctcccctgccccagcctcgtttgaaagaatgtccctaatgtgcatttcaacacagttcatccaggtctgttccaagctaaggtaccaaccacagggtcctcaccaaacaaacccaggacatgccctgcatctggcaagcattaacaaagatagatggcggctccttgagccagcggggagggagggtcggggtgacatctctgggaccaagagtggctgtcctcaggggaagccaaggaagaccacccgtgggaagaggggaactagaatggttttggttttggttttttatgagcaagcaggtgtcgtggggagtgggtgagctgtggctcagccggctccggaggaagagcaacatgtttaactgaagaccagagagagggaggggaaaattctgtttgcagcaagaagggtattgtgaaagaaatttatgttttcctttccaactctcctgtctatcatctttgatggagaggggttttttttggtttctgtttctattggtttgttttgggtttttttttttttttttggtttttggttcgtccaagcctcagctttcttgtgtgctgtgtgtacttcctgcctccctttccgaaagcagccatgcctgaggggccctggcccaggtgtatcactagctgggagcctcagaaggctaaggcaggagggaagtgggggaggcagagaacctacccggccctctccagtcagctggccctcttcacctgtcccctcccctcccccctgtcctccatccataagctcgcaagcacccaaacccctgcccacaaatcccaaggcccccaaggggaggagcaggcgggactaaccccaaaaaggcatagatgaagccaccagctttggctgaaaaaccaagagggggagaccagctgaggcagagggtgttgattcgcagtgtgacagcccccaagccaggcctcagggtgactgttcaggactggggatgagggggacacagtggcccaggtgtggtttcccatggctcccggcctcccaggtgcccatcatgatgaccctcaggtggcagtgattagctatcactgtacaagacatttatttctcctgctgagcagaaggcatcacccctgcaaactacctcttcccacaatgactttctccctggtaccaaaaagcaccctgtacctcctccttcttctcttcctcctcctcctctcctgccaacgcagtggccttggtcttggaacagaagggagaagtctggcctgggtggggtctcccactgtcccccagcctgccattggcacaacccccttggggatgccatactgaaaaagcccctgccctcgccttgtgccgggcaaagcggagaggaaggcacagcacagtacacagttggagctggaggtggtcctggcacagctccagcctcacccctcccaggcttctgaaaagggtgactcagaagccctggccgaattccactctaacttattttgacatgtatacaaaccaactgtttagagattcctcttgtgcagagccctactgtgtttttatgttcctgtttaaaaagagaagtttacttagcaataattataaataaatgaatattctttagcgaggtgactgtacgtgcttcttggtgctcttggaggcccttccccccaaggaggtcccaacaaggctccctagtcacatgccagacagcatccccctctggaactacaagacaatctcagccacctgacctgccagagagttggggggtgggtggaggagaacatgctccgagtcccaagggcaggttttaggtctctgtagcccggatctacctgtgaaggcctgggacaacagatgagttctcccacacacagcttctttttcccggttgttttgagactttttacagcaggctcacactgtcta

SEQ ID NO: 32651 - DNA, 2074 bp, Mus musculus
tctggatttggggacatttgaaataaaggggctaacagtgtcagaaacagggaggcttgcaaaattgctgatggcggcttatttcttcctgaaatggccttccagggggcttcagactgaccgcctcaggctatggggtctggaaagggaacacacagaggtgacagtggcgtggagtctaagctgaagggttctgagctgaagcatggctctgaggagagatctgtccctccccgccaggctttggctccctcggcctgatgacatctgtgctggtctgccctgatgggaagacaattgaggctgaggctgctcatgggacagtcacccgccattaccgagaacaccagaaggtaaatgtgtgcatttcaaggtccatagcccactggccctgatgaccgggaggatgaacccggtctgccggtctggaggtagatagctgtgtctggtgctcagctgatcctgtggcctgtccccagggccggcccaccagtaccaaccctattgccagcatctttgcctggacacggggtctggagcatcgtgggaagctggatgggaaccaggaccttatcaggtgagctcatggggagggcttgagcaggtgcagcccacagttctgcccagcatgccggggcctcactctgccgcatcccccgcaggtttgcacagacgctggagaaggtgtgcgtgcagactgtggagagcggagcgatgaccaaggacctggctggctgtatccatggcctcagcaagtgtgtgctttgggaaacagggcttgagaccccagcaggtgggaggaagccagggggaaccccccccccccaagagtctctctcatgagtgggtagagctgcctggggtctggggcaggacaagtcctgagaaatggctcaggccaagccttccttgaccaggtctgagttggtgccctctggcagttgcttagttcctctgctctcctccttaaacctttccccagcttcttttatgaggcctgtgcccggtagcttgttactttaaactttctgccaaatttattgtgaccctctagcagtgggctactagcaaacttggacctgggcctggtggcctgaggtctaatgagcctgggaatggcttggttgatggcctccaggaggcctgagtctcccctgatgttctctcggcagtgtgaagctgaacgagcacttcctgaacaccacagacttcctggacaccattaagagcaacctggacagagctctgggcaagcagtaggggtggacactactcagctccagtgggtactctgtacatggcagagggtgggcctcacagcccctctctggtggcctttctaggggacatttttttacatatatatatgatggagatgttttttaaagtatatgagcattttccctcacggtggacatgaggcaggaacgtgtgctttacctcagacagtcagtgttctgcatactgtaatttatattgctctggaatcacatggtgccatatttagctactaaaaagctcttcgcaaaactgtcttgatgtgtttgtccccgagtgggagggagcagctggtaggatcccccagggacagggttggggtgcctcaggctgttaataggtcagccagggggttgcttctcatgagagggaacgaggcagcctgtgggcctcctgcattcttcactggctgcctgagttgccagactttgggggtgaggccctggcttcctcacaaagttgcgtgcagtgtctgctgctgagccagtggagctagctggggcctaagggcagagactcacatagaatctcctaaggtgatcccgtttctccatctagggaattgtcattctgtgatgttgtagatacttgttataataacacatgcacctttcacctcttatagtgctgacactccaacctcgagctttgtgtacactaagcaagcattctacctctgcatcccaacttcatcctggtaccaacttagctgagacgaggcctcatcagcacgcagttctagctggtttggaactttatgggtcaggctggtcttctagtcacgaaggtctacctc

SEQ ID NO: 32652 - DNA, 1118 bp, Mus musculus
gaagtaaagttggcagcaggggtctgtgctcccagaagtctggtgggagaagattggccaagcattccgtggtaacaggagtccaggagtcttatggaggtgctgctggccctggccctggccctgggaccatggcagagtggcagttttcagcctgggggccatgctatgcccgctctccccacagtccatttcgggcttcgcgcacagctgcttccagtactctatccagaagaaatggccgctctacttgagcaccaagaacaccattctgaaggcctatgacgggcgtttcaaggacatcttccaggagatctttgacaagtaacaacctctgatgcttcctgggggcaccacagccccccggcttccttgcgccattcctacttcacctggggaggttgctttcctagtgtgcgcttggttcagttgtgagtttcagggaggggtctttaacctgccaaccccctgccctctccctgagacaagcccttttgcccccaggcactataagactgacttcgacaagaataagatctggtatgaacatcggctcatcgacgacatggtggcccaggtgctcaagtcttccggtggctttgtgtgggcttgcaaaaactatgatggagacgtgcagtctgacatcctggctcaaggtaccgctcccggaggggggaaactgttggaattccatgactggaatgactttttttgttgttgttttttcaagacagggtttctctgtgtagccctggctatcctggaactcattctgtagaccaggctggtctcaaactcagagagccgcctgcctctgcctcctgagtgctgggattaaaagcatgcatcactatccagcgatttttttttttaattaaaagattccagtatgattgtgtaagcacaagggttacgtgaaagagaggctctggggaagaaagtaagacacacccaagagcgtgggcatgaactcagagtcttctggaagtgtgtgtgtgagatcccttatggaggccagaagttgatgtcagatgccttctattatgctccattattatattaatgtataataataatctacattattggctttagtatataaggccaagcatggtagc

SEQ ID NO: 32653 - DNA, 1104 bp, Mus musculus
gtggacctggtaaaaacggcagccaggtactattctgggcactttacagataacgtatttattgacaacccagcatggttggcattttattggttatttcaattcacagctctggttaaagcatggtgtaagcctcacagtcagagatgcaaggttccagaggccatgaatttaaactctgcgacaatggctctcagtcttcctactgccgagaccctttaatacagttcctcatgttgcggatccccaaccataaaattattttcgttgctatttcgttattttgctactgttatgatcgtaatgtcagtaactgtgttttctgatgatcttaggagacccctgtgaaaggattgttcaacccccaggttgagaactactgctctagagtctagactcttctccctcctccgggatgacttctggggcccccgtatggtttgagaggtagggctgtggtgggtctattgtacctctgttctcacagagttcaagctgaagaaaatgtggaagagccctaacggaacgatccggaacatccttgggggaaccgtcttcagagagccaatcatctgcaaaaacatcccccgccttgtccctggctggaccaagcccatcaccattggcaggcacgcccatggcgaccaggtaggccaggcttgggagacacggtctgtggactcatgctccccacaggaagccttggcttgaactgcctctcctttctgcagtacaaggccacagattttgtggtagatcgagctggcacgttcaagttggtcttcaccccaaaggatggcagcagtgccaaggagtgggaggtgtataacttccctgccggaggcgttgggatggggatgtacaacaccgacgaggtaaggccctggccatcctcctctccagcccatttctatctctatctctgcctagtttgttatccttgcttctgttggcctcattctcatgccaggaagaggtagaagagaccacgaggtcagaaaagagcgcctccttgcctggaccaggatgggtcatgtgaccgcctttgagccaatcactgatggccagggaggaagggctctgattgcataagttggagacagg

SEQ ID NO: 32654 - DNA, 1149 bp, Mus musculus
catcatcctggctgcttcccaggtcctactaggtctccctgccggggcagggaggggtgcatgcagccaccttgcctagagagcctgactgacttccaatttgctgcccactggtttctttcccttgctgtgcttggtgccccaggtcatcttgtgcacccttcagcgtatgcccgccctgtgttcctaccccatcccctaacatgctctagcagagggtggcattaatgctgttgcggaacacggggcttggagtcagaaatttctgggtttgcattgcattgctctccctggctccaggactattttccacgctacatctcttccctgttcgctggggaatagtgcccactgcacacactccttcgcgtagaccctggggtaaggagacgtactttagaacctgtgcacttccttgttccgtgtcttggtcctgagctacttgtctactcctccacagcacatagcgagctttactttagcccaagatgaggccggcaatgtcattctggaggatggcaagggtcgttgtccctttgaccccaacttcaagtccacggctctggtggttggtaagtggtgtcacaggctgggtgcttttgtgctccgtggaagatacccagggcaggaggaccgaatctggggtgtgtctgggctctgggcagtgtgggtcccagaggtaaggtggtgtccccatgctgtgctggttcccagagggtatcgagtgaccctgggctgccctcttccaagtccctgcttccgtctaggcaggatggatggcgctgcggtcactctgggccctgagcagggcacagggactgggccaaaggagccattcccatgggaacattctcttggcagatggtgagctgtacactggaacagtcagtagcttccagggaaacgacccagccatttcccggagccagagttcccgccccaccaagactgagagctccctcaactggctacaaggtggagttctgccttggcccactgagcagttgcctaacccttgggaggggatgctgtccccgaggttcctggcctgactgtgtctcctcccctggcctctgcagaccctgcctttgtggcctcggcctacgtccccgagagcctgggcagccccataggtgatgatgataagat

SEQ ID NO: 32655 - DNA, 1099 bp, Mus musculus
tccctctctttctctccctccctccctcttccttccttccttccttccttccttccttccttccttccttccttcctttcttcctttctctctctctctctctctctctctctctttctttctttctttctttctttctttctttctttctttctttctttctttctttctttcgacagggtcctgctctgtagctaggactgttgtgcacctcatggccatttcttgggtttttaattgccttcttttgtgggagggtagtatttcagacagggtctcatgtagcctagactgacctccagttcactgtgttgtgaagataactttggatttctgtacctcctgtgactacctcccaagtgctaggcacattctgcttttatagcaaaagggggttgtttgtgactttatttgtggtaatgtgtagacggggtctgaggagacggctcagaccgtggagtacttgcctcaaaagcgtgacaatctgagtttgattctcagaacacacataaaaatgccgagcatgatggtggcaagaagtacccctgtagttccctgcccatctgatctttcctagttgttaaactccaagctaatgagacgctgtgtctcaaaggaggtggatggtgttcataaggatgacaccaaggctgtcttctaaacacacacacctgtaattatgactagaaatacccagtcagccccatggtggtggggactctgctcaggcaagtctcctgcacctgctttgggcctggtgggcttacaccagcagtggagggaaaaaggaacactggccaatgggattctacccaagactcttttatacccaggccatggacccaggacattgagggtgccagtgtcaaggaactctgcaagaattcctcatacaaggcccggtttcttgtgccaggtaagatgccctgggaaaggtgagccatatttgcttggaaaacacctctaggtatttttaggtacaaatttattcctctagccctacaaagaagagtccagatcatgagtcacttagtcccaaccatcgcccaagttaccattggtcctagttagagtttctgtggctgggaagagacaccat

SEQ ID NO: 32656 - DNA, 1196 bp, Mus musculus
taccaggctctgtcggatagctccccagggcccagagtcttcactgaatcagagaagaggccactgagcatccaggacagctttgtagaggtgtctcccgtgtgtccccggccccgagttcgactgggctctgagatccgagactctgtggtatgagagctgactttagatgtggtcaccctgacctcaggggttgtgagtgttcagtggaggtcagctacctctgcttctcacagaacacagccacggtaccctgactggagggcagctggtaccacaggcccaacagcccagccagctgcttccagtgtctggccgagaactgggctgcctccaggggccagagggtccttgtctgggtggcagaactctgctacttaactgagccctttgtttaaaactgcaaatgtgaagccagagaggaaggagaaacagacaaggaagactacaacatagccactccagttcagcctgctgggctcttggggacttctccaaagtggctttgtgagcaagccgaagttgagaatccctccccgactggactattctaccttccgccttactctgctgctgaggctaccctttctcactgcagaatcagggccctgctccagcttcagccaaccgaggacatatctgtgaccgctgacaccctaccacctcagggaccagagggctaggctgattctgcagccctcctcaccagaccctgggctcagtcccagttcccggacttctccagcctgtatcaggctgtggcctcaaaagcaagggagtgacccccaaggggggttgtgacagaagacttgcctactgtccttttcccagtcagagaactatgtccctacccatcgacgtcttttttttttttttttttttttttttttggtttttcgagacaggctttctctgtgtagccctggctgtcctggaactcactttgtagaccaggctggtctcgaacttagaaatccgcctgactgcctcccaagtgctgggattaaaggcgtgtgccaccactgcccggccccacccatcttctaattcctacacagactcctggatcctcgttccttgtcctagctcaccgtgcccgtcactctaagggatgctgacactgcccatcacaaggaccctgaatttacatgggttttatatttttttttaataagatgcactttactttctttttt

SEQ ID NO: 32657 - DNA, 1131 bp, Mus musculus
gtagccctggctgtcctggaaatcactttgtagaccaggctggcctcgaactcagaaatccgcctgcctctgccaccacgcccagctcttgcctccacctcttgtgtgcagggatggcagggtgttaccaccacatctagtttatatagtgctcaggattgaattttgggcttctgtgcacataaacccctaccaactgaacatcttaaaaatcccccctttttgttttttctaaggttgcgtgtttgtttttgctctgcctttttagacagcctttagtaggtcattcaggctggtttgaaacattatcaagacctaacattgctatccagacagcagttggtggctgctggttgacgtgaactgacctgattgactggccaggtattgctgtctgtacacaggtacagaattagttagcacagtctaaggactgcatttgaggtttccaaggttttttcttgtctgtcactactagcattatcaatttagctcttctcataggagacttacttgcaatttgaaaaactgttgttttttttttccctccccctgtaggtatttacataaggaatttgcagagtcctggtcagttccaaggttggcagaaggctttgatgtcagcactgatgttatccgaagggttttaaaaagtaagtttgtacccactttagagcagaaactgaggcaggaccaaaaggtcttgaaaaaagctgggtttacccgagagattggtcagctccccgtttctgaagataccttgaaggcgctcagtgcaggccgctctgtgtctggcctgctgatggcaggggatgaagtctcctctaaaagtcagaatcacagcacagctttgaaagtggcgaagtcgcaccctcacagcacagacgcacagaagaaacgggaagggagggataaaagaatccaagtcttggaagagagcctagtgcctgccaccacagccttgggtcatcagcgagagcttcagaaatccgccaccagtgactccgaggccaccggaagagctggcagtgatacgttaccaagtgctgtgctgctggaagagctgaagcccggggagccgggtgaccagagcttcagcagcaaggtagtgcagagagggcatgacttctt

SEQ ID NO: 32658 - DNA, 1160 bp, Mus musculus
ctctttgtgtggcctttacaactgccaggaccctgtatgatctaaggggattgatacacactctttgtgtggcctttacaactgccaggaccctgtatgatctaaggggattgatgcacactctttgtgtggcctttatagtcctcaacccacatcatgagcacacacaataacaactaaatgctaagaggaaataatagctagtcatttatactaagatatcacagctcttcctgattttatttaaagccctttctgtaaaatttgaaattatgagggtgttgatattaaggctagttagttttgcaggttttttgatatgtttttgtttttgttgttgttttgttttgttttatttccattggctccaaagctttaccaagtgttttctcacttgtaggatcttctggatagaatgattgctgaagaggagagcctgagggaaaggctgctcaaaagcatatccatctgtcagaaggagctgagtaccctgtgcagtgagctacaagtgaagccatttcaggtctggtagaccatgcttgggagattggttttaacttaggactgcgaatccaaagcttccttgtaggagtagggctaggcagactagaggtgttgaagtgaagcagctcacgggttatcaaagactccttcatgtatttctgctttatagagcatgataatgtttttaaattaactttgaggaaaatggaggcacagatgtttgtgagaaagaaagggatgggggaacatggaagaaatggattaatcggtaaagtccttccctcacagccatgagaacctcaatgcaatcctcatatctatgcaaaaaagccaggtatggtagcatatgcttataacctcagtgctggggagtcagaggttgatctctggggcttactggctagccagcctagccaaatgcatgagcttaaaaccaataaaagaccttgtctccaaaaagaaaacaaacaaaaacaaggaagagggctggagaaatggttcagtaggtaggaacacttgctgctcttgcaaagcagctggattcagttcctagcacatgtggtgtcttacagctgccctgaactccagttccaggggatccagcaccctcttctggcctctgtgggtatcaggcgcacgtgtagacttgagcagga

SEQ ID NO: 32659 - DNA, 1197 bp, Mus musculus
aaaatatggaagattgtagtttacacttggttgcggtacaaatcatgcacagaacacatgagcctagagtcggcaccatcatacacaaatcttaccttgtggattgatgcaaaattgttatctacaccactgtgggtttagttcagtggtaggaggtgttaccagcatacgtgatgtcctagatttaatctctggtattggccaaaaagaaaagaaagatcaggtcatcaagatgggtcagtggataattgtcacctcaaagtctgatggcctgagttcagtccccagaaccacataaggatgagaagaatcaactccacaatgctatcctgtcactgtcatatgcatgtcatggcaacctctccactaactcaaacaatagtaataagttgataaaactatttgagtttaaagaaattgtaaagttcttaaaacctgagagctatgagagcgttggtttgttgtttttttttttttgttttgttttgtttttgttttgttttgttttgttttgtttttgattggtttggcttttttgaaacagggtttccttgtatatacagccctggctgaattcactttgtagaccaggctggcctcgaactccgatccacctgcctctgcctctcaagtgctggactataggtgtgcatatgacatcttgcatatgacatatgcatatgacatcttgcaggaattgtttctttccttttaccctgtgggctctggggatgagcctcagattgtcagtcttgacagcaagcttgtaccctccaagccatcctgacggcccgctctcaggtgtgaactgtggagatggcaatgttgtgttatactgtcaacgggtagcatacacatgagttttgcttggtgtgatagtgcaggcctgtaaactcagcctgtggagacttgaggcaggaagataccaagctcaaggtcagtgagattatctcaggaaagaaaaagtatgggatagtttgtgtaatgtaagtactgtactgaaagtgaaaaactggggttgcgttagtacttgaaatatagattgtactgagtgtatattgcctttgtcccactgtaaagatgaaaagtcatggaataaatctattgctaagttgtagaccactgcactgtacacttacaacttgtaaagacggtatgtatatagggtgataattgggtattttaccatagtttaaa

SEQ ID NO: 32660 - DNA, 1468 bp, Mus musculus
ccaacatccagtcctgagagtccttgtccagttaggcagctggggcttcctgtgcctggactggactgacggatacgtagacaaggagtgacatatacatttccatcagtttagatgtttgaaactaccttgggcaggttctattaactgcacctaactcagacgtgagtaggacagaaggaagctgtcccgggcgaactgaggtcacaaagacttgcttttgattcaagagagaccttaaaggctagttatgatagttaagtacaagttttaacatctggtagctaactttttttctctaccccgtaattctactatgactgctcttctagaggtcctgagttcaaatcccagcaaccacatggtggctcacaaccatctataatgggatctgatgccctcttctggtgtgcagaaataattttttttttaattctacttatttcaatactatatattagaaaatgaaaaaacgattgtggcctgctttggcatacaggggtacaagacatgaagtaattctggtaacatctaaaaatatatatatttttgttcgcggacatttgattaatgctgtagctatggaagctttgatgtcacccagaggcgtgtacctggctggcactatcccagtgagggtttcttgagttccagtatgagatggcctgacctgctgccaaaaagagtagcagtcatttctgtagtgcaatttcttgaggtatatgtgtgaacacacatgcttgtctgacctgttgagtttttctccagtctcccaaccctgtgctcattaggcccagtctgttccctgtagatgacaaccacatagagaggctgtctggtgggctgggccattcctgtcatggagtcagcaactttgcacatctacaagttatctgtgtaatcacgtccacaatgaggctctccaaacccatcactactcttccccaaagcactatatttattctgtctgtctgtgccagttctgcccacactgactgatcttgaaaacctgtcagtctgctcttcacacacatatatgttgtttttaaatgtatgaaaataaaatgtgtatagttaccttttaaatactacactgttttgtcttcaatggttgctttgatctatagattaaactcactaaaaggcgaagtgcaaaggatttagaagtttcaagagtctcagaatagtttggatttactctttttcatttggggatattttctcattttgcagctattaaagcctctgggctgggtatagctaagctgttggtgcacgtggaaggcctggcactactccagaaattagatatagatatatatacatatacatgtatatatttacatacaaaaatatttatatatatatataaatataaattgaagatatatatatcttcaatttatatttatattattatttatacatttattatttattattttttatttatttattattatttatt

SEQ ID NO: 32661 - DNA, 2778 bp, Mus musculus
agaggtcagggaggctgggggacaacctcacgctaggagactgcaggtatgagcttgctctgcggggtcatatggaccccacagtgctggtatgagggtacaggagcagggtgattctgggaggagaggggtaggcgcccattattagtggagtaaaggcgtggaaggagtccctggttctcctaagagcctaaaggctttgctgctttctgctctggctctgttctgagtgccactgggcctgctctgagtgccactgggcctgcatgccctggctaggggctgctgggtgcaggaagggcttgcttcagactccaggccagaggccacggaacacttcaggcactagcactagttctcagctgatcatttggtgttgatctgtgacaggggtagggagtgtctccccctgatctgctttcttatctcacacaccaggctccccacgagttcccattgtggggatcctggcaggattcctttctctaaaatggaaacagagtttccaagagggctgtgcttgggtgtcttgggaaggcatcctgtgctggggcccctggtgggctgaggaggttcactcgtatcccacctgcagaagtattacctgcccgctgtgtggacgaggaaggcagagacaaaattaggaggtcatgtgcttggatgaaccttcgtttttgcttcaatcaatagagaatctgtctataaatgataagagttggtaaaagcaaagttccatccttacgaaaacttagtaagccaagactagaaagaagcccgtaatctggataaagatctcgtcaccagtaagcgaaggcgcccaaagcatcggacagagcaggctctgatcccctcagtcagaaactgcccggcggcacagtgtgttggtgtcactaacccacacttcagatggaaacaagaattacaattgccactgttttaaaaccataagctacctaagaaacctgtgtgtcaactagcaaggcattctgtgagttgccctgtaacgactggttctccccaaatcaacccataaacatcagtgtaattcccacgaggttggacactttctggaactcttcaggtcctggcattcatctggaaggtgacaggctgaggatgtgaagtagttctgaatggccgaggtgatgaacggctgctgacactaaggcgggcaacaggcagtagctgtcttaacagagttctcaaacgacttggactcttctgccagcgtgaattcagctgccatgataggtcaggtcagacagacctaggcacgtagaaattcagtatatgatttcaggtgcaggggaggggaggtggatattttcatagtgctttgagacagctacctacctatgagacttctgtttcaaaaacaaaacaaaacaacctagggctagagggaaaaaagcaaaagcaaacaacaaaattgttattattattattattattaattattattttagtctcactatgtacctctggctgtgctggaactcattatgtaaaccaagctggcctggaaatcacagagattccccacctgcctctgcctcctgagttctgggactaaaggcatgcgccatcatcacacctgggaggaaaaaaatttttttgtttttttgagacagggtttctctgtgtagctctggctgtcctggaactcactctgtagaccaggctggccttgaactcagaaatccacctgcctctgccttcctagtgctgggattaaaggcgtgcaccaccactgcccagcagaaaaaaatatttttatacctgatttaggaaacccttttctagacataacatgaaacctaatatataatgggggaacattaaaaaataggttttgacacacacacacacacacacacacacacacacacacacacacacacacacacacacacaaagcttgaaagcatgctataggaaacaggttaaatcaatacagctgtgtgggtggaaacgagtctgcagtgagttctgtcactgctggagaaaagtgtgttttgacttctcagagaacgtcactagggtctgtccagcagcacccaaagactcagtagtgacaaggctgagttcttgcagggtctccatggtttatgttgccaggctcaggccacacggcttcctattcatgtcttggtgacaggaatgagatgaagagtggggagcgcttagcacagagcaggggttgcgcctacagcaagacttatttgctaccatatggtttgtaatcaaatgatagggaactgtgcagaataaagaatattctttggaggtcagagatgtgcagtgaagttacttgtctgacaggacaaattttaatcacaaacacacacttgggagtgtcttgcaatgtatccctgactaacccagacttgccatagagagccaggctggccttaaacttgtaatcttcctgcctctgctgcccacaggctaggctcacaggcatgcacaccatgccctccctgctgctgtttacatacataaatagtacttagagcagtgtcctttcaaaagttcgtcagcagagttgcctctggaaagataggcaggcctgtttcttcagtctgggtgctaaggtgatgtgtggcagagggccacatgtaactggatcaaggaaaaaagccaactcttggtaaagcctctgaactaatccttgggagaataagggccaaagccaaagcatttccttctcccctcccctcccctcccctccctttcccccaggcaggtagcacaagctagcctccaatttttactgca

SEQ ID NO: 32662 - DNA, 1743 bp, Mus musculus
agtctcggcctcagcagcagcctcctgcactgcgccctgaggtggagatggagccccggctgcaggctgggttggcctctcacctgcccgaggtcctggccggcctcagctgccttatcatcgtgctcatctttggcatcgtcttcctgttcctgcatcggtgttcgggcttcagcttccggggagtgaaagtgtacaccatggaccgcggcctcatctcctacaaggggctgccccctgaagcctggcaggaggagtgcccatcggactcagaggaggacgagggccggggcgagaggaccgccttcatcaaagaccagagcgccctttgaaaagcccactgcccaccctatcaaatcgatcccttcctcgggcactttttaattcaccaaagtatttttttatcttgcgactggatttggaccctagctgggaggcgagaggggcagagactgcttcttaccccacccttgggcctacctgtttgcctgaggtgggatcccaggagcctcacccctaccacccctccatgtggaggaaagaggaaatctttagggcagcttccttggcccagctggacttcccgcagagtgaagaggggcggcctctctctgagtccctgaccaggctgcagccctgccccttcccttccctgcccctcagaaagcaataatggttcccatccaggcaacagggaggctggccaggaggtacttgaagaaggcagccacctctccaagggcttttgcatcccctgaccctctctggctcacaggtgagcctccgaagaagctgcagtcttaggaagggaccaaagcaaagcaggcccctcccagtgtgcctgtactttcttgctctcagcctgcctctgcactccaggcctccacctccgtggaagccaggctgagctaggccagcacgggccggccgagctaaagctctgggggccttgctggtgtctgaccatcctttatggcaccctccccccttgccagggccctgttttctgagcccggggctgcctgggctgttggcagttacagtacaggagcccctgggtgggtggtggggaggcacggtggcccagccttctcctcccgcctcccacccgatgctgctttcccctgtggggatctcaggagctgtttgaggatatattttcactttgtgattattcactttagatgctgattcttttttttttttttttttgtatttttaatgggggtagcagctggacccttgaccttctcatgcccacacccaccctgcccttcccatggctgcccagccctggggtatagggaataactaagccccatgtcctgaagaggcaggccagcccggtgggctctaagaaagggggttgtggtgggaggggtaggctgacatcatctgtttcaaatggggttgtgccaagggcttatgggtcgctggctctccaagtgccaggggtgggcaggtggcaccaccaagccctttctaacactgtgccctggtggagaaagcattggcctatgatgccccccaaaccccctcttctgatgtgccttttgcacccttcccattaggacaatcagtcccctcccacttgggctcccccccccccattttcttttccttagcccttctcagtacccagcctacctgtccaggggtgccccttgctctcctgcccacccctcacggccatccaggctggttttgtaagatgctgggttggtgcacagtgatttttttttt

SEQ ID NO: 32663 - DNA, 1151 bp, Mus musculus
cattgaacgaggcattaccaatgttaggcaggtcctctgcctcagaaccacatccccagcctgaggccatggctttgatttcagcactacccaaaataataaagttaagtgatggggtcaaagagacggctgaacaggtaaatagtctgcacccaggcctaatgccggagttcaagccttggtataaacgtggaaggaaaggagcagctctgcgcagccgctctctgggagccacgtgggtaccatggcatgcatggccgtacacataccatacagacagcactcatcaccccatactgacgggatcaccccgtcctctggggatcaccactctaagcatttgggtgtgagcctggtctagtttgattttgtacatacatagtcatctatgagggatctttggtggctcttaagaagtgaacttggaagtccacagagatggaggctcccatctttcttccctcagcatcgtcctgttgtacctcattgccctctaccccccaacacaccatcttgagtaaccttagcccacttcgttcacagggccgaggagggctgggctccatctttgtctgggcctcagggaatgggggccgggaacatgacagctgcaactgtgacggctacaccaacagcatctatacactgtccatcagcagcgccacacagttcggcaatgtgccctggtacagtgaggcctgctcctccacactggccaccacctacagcagcggcaaccagaatgagaagcagatcgtgagtcttgcctggctggggctgggaaggaggcctcctgctctcctcagggccacattaggctctctctgacctcatccctgtgtagttgcgtagagtagcgtggaccttgggtaactgcgctacaagcaggagattccccagacccttgcgggctgcaaaaccatctctgagcccctgagaagtataaactccctgaaaatatcccctgtgctccgacctctacttgatcccctaattccctgagaaacttgaccctagaagaagctatgtgtgttagtaaggtagaagctggggctcgagtgtcctaactggttcactgcaccatctagggtacccaggtctgataggcagcaggacaggcaggtggctcctttactcctgccaacacccat

SEQ ID NO: 32664 - DNA, 1197 bp, Mus musculus
tgtagaacaagctgaccttgaactcacagaggtctgccttcctttgcccctacctcccaagtgttgggactaaaggcgtgtgccaccatgacatgatgagacaggggcttattatttagttcaggatgactgcaaactaatcctcgagcctcaagctgcctgagtgttgggcttagaagcatgagctaagggactttgtaagtcttggtctattttaaattttggtttaatctctgggttttcaacccagagacacatttaagctctttcttgaggtaaaaatatatacggttcagatatatgctataattttaatttcatgcctttctgtaaagctgaatgctagaatgtgaataattgccttctataaagccagatgtcaagtatttgtgcggtctgccttccgtcctgatgctcagctatttccgtgcaagtgctttgcagtgagaagctaaacaggaaaggaactgctttaggcttctttgactctggatctataacactgctgtgtctttagttaagaaatatttgctgatctgagttatttgcatggactgagataacttaacctagaatgtcggtggtaagatctctggaaagtaagttgccataattgcctctgtgtcccctgctgctgctccttcgtgaacccacatagccatctactctccctgcactcccgcccacgcagtcaccttttgttcaggccttgctttccctgcatcatcacggcagtcccggcctgggtttggtttggggttttggttttgttgtatggcactttcgtactaggaatttaaccctggaccgcacctgtgctgagcactgacttagcagggctaagcttcagccccacctaaccattctgttcaatatcagtgccttctccatgacaccagaagatgtcaacagaatactgcacatctcagggacaaaaatggaatactgttttatcgaacctaaacatcttttttaggtcatcaaaatatctgtcacttgcaagaaaactatgaaataggtcatttctcaaagacaatactttattaatgccaaatttattacctactacttggtctcaccacctgtctacttttacatttttgtgttactatgtcttgtgtgtgtttggggagggagtggtgtgtgtgtgtgtgtgtgtgtgtgcgcgtatagaaaccagaagactgagtaatatgt

SEQ ID NO: 32665 - DNA, 2514 bp, Mus musculus
acccctttctgttaaagcctcctaagtggtcattactactttgtagacattggtatttgttttacttagcaataagaatggtgaaattcaaattctcgtttagaagtgaaagctgtcaggttgatagcaagcatgcacatcaaattcaccagaagtacaacccatcggcgcagtcagaggatggagtctgatgtcttccggctgctgcctttgtgggcagagctaatccaagttactgttctctgttcaaatgaagcagcttcaggagaaaaagagcaattacttttgaattctccaataaatctggacaatgccgttagcgaagagcccttcctggtgaaggcaaacccatggtcacagcaggccatttagagactgagtgggcggggcacttaccatcccttccacaaaggatagcttcccccagctcaaaatgtaactgtttctaaactgtattccaagagtgccttaccaaagtataaatttatttcttaaaatgtgagtaataggaattttaaagatttatataatgcttttgaacactctgagaaagggttgttttttttcattgggttaatctgtatatctgaattcttgaagcttttctctagcctacagtagggtcgatctgccgagctgctgaataaccctgcttgattttagcaacaagagacaatccatgccatgcttttatcctgagaaacctggacccttaggctctgactaacaaagacagttcagctccagacactgaacttggaatcctttgtctttggattaaaagtcataaacttaaaaaaaaaaatctctttattcaaaaagatagttaaatcatgctactgagcctatgatgtcgttgatgtttggttcggtattcttgcataaaacttaaaaattaaacgaacgctgcagagtttactgatgtatatcaaaggccaataagctcttttaattggtgacagatcatgcggtatgtccctattacaaatgtaagtcttggagaagggtccttcatggtgtccacatgtgcaggctcaggtagaggtctcagtgagtggacacaggtagctgtgggtgccgagaaaggatctgccaccaccctgacattgtgttttggaacagagttttctgagaaaacattttcaagttaaaggaaaatgctaagtctggcatggtagtcaacacctataatctctgcactcagaggctgaggaagaaagatcactgagtcacggccagcctgggctacatagccccgccctgtctccaaaaaagagagagaaagaaaaaggaaaaaaaaaagaaaaagatcctgttacaaccctcatcacctcaaaaacaaggttaacagaggggtcaagtgagtctttttttttttttttttttaaagacagaggtgatggggtctctgtcgccttggctgtcctagaactctatgtagatcatgctggtctagcgctcacagagatcagaactctgtgtagatcacactggtctagaactcagagtctgcctgcatctgtctcctagtgctgggattaaaggtgtgagccattatacctggctttcaggtatgttttcttaagactgccatcacaaatgtcccggggcctcctgcaagacagtaatgaatccaggttatagtgccttcgacgtctcggttccccggaaggatgctccttccctgaatatgcagtagagctgtgccacatgccctttgaagatcttcatggctgctgtgagaccctgctttggcagcaccgagtcacctggtgagcctcaggctggcacaccgaagttgtgccgtgcttacgttatttattagctgtagccatttctgtcttggctctcacttcctctgcccttccctctgagcagccatagtgacatttactatgaatttacttcctcccaagaatttggactggccgtcagactgttgctacatacaattgcctttgtatcttcgtatgaaataaaaggtcatttgttcctgtttgtgtttatttttcttggttttattgttagttcctgttagacggagttaactagagtaagattaaatcaccgcccactcctttgtagtctttttaaaagaagagcaaaccaagcctgcctttggatcacagactatctcttttaaattttatttattatgtggatatggaggtcagaggacaacttgggagtcagcgctctgctcccaccgtgtaggtccagggatcaaattcaggttgttgggtttaacagctcactggttgtgggccgtttttgttttttaagatttatttattttacatatatgggtgctcatacactgcatgtcagaagagggcatcagatcctattgtacatggccatgagccaccatggggttgctgggaattgaactcaaagcaactagaggagcagtcagtgctctaattgctgagccatctctccagcccccagttatggactagagtcattttaacatggtgtttagccttttaaagtgtattatgcttaatgtag

SEQ ID NO: 32666 - DNA, 1200 bp, Mus musculus
cagcataggccccatctgggaggagctgagtccagtacaaggtatttccaaagacaaagacaaatgttagcatatgtaatttgaaagtatacattttcctaaagaaaagactattttgatagagaattttgatgttacattgttgaatttttttttttttgataagggggtcagagttgggtggaggtgtatgtctcactttatagtcgtatctggcctggaactcgctagaagaccaggctggcttcagactcccagcgatccaccagtctcagcttcccgaggtcagggatgagagttgtgcatcaccgtgtctggcaaaatgatccccacatttatgaagctaccgtataatggcttttccttagccatttggcatattggcttttacttcccagtgaaaactgcctgccacactaagtgtgttggtttatcaagaatcacattgggcctgaaccatatttatttgtattattttccctccaaagtgtttattgcattgattctttctacactcccaaaactgcaggagaaagctgtggcaattcaaacgaccccaacaaggaggctctggctaagacggaagtgtctctcacgttgaccaacaagtttgacgtgcctggtgacgagaacgcagagatggacgctcggaccatcttactgaagtgggtactgaagggagaagggagtgccttgaaactgtatttgctgggcctcacttgcccatcacagtcctcagcaccctgcacggcgtttggacttagtttgctggtattgtacagtcacaatcttgggaattcttccctgcccccgctccactgtgggtccctgctccttgtgcagcacccctgtggaaaagcatctgtggggtaagggtgcttcagctgctgcttagatccggtgacaaggagatagaacataccaccatgttgaaacacattcccatctcgttacagtacaaaacgtttaattgtggatgtcatccggttccagccaggagagaccttgactgaaattctagaaaccccagccaccaatgaacaggtacagatgaaggtttcacactcatcttcttaaacatgataagcttttctgtgacagttgcgttcctgaatggggtcagtgggacagggaagggattagaccctagggtgagcatgggtctaacctcgggacagtaataattagggctcatttgtc

SEQ ID NO: 32667 - DNA, 1082 bp, Mus musculus
aagacccttctcctctgctctcttgtccttggggtcgggcgccttccttcctttctccgggctgagaagaggctctttctctgacctgcagcagttctgatcagctcactgtttataagcattgctaggggttaacctggggtcatgggtatgccaggcaagtgctatatcactgagctaacctctagcccatatagtatgttgatgattacctacctgctcatagcctctgctgctgtgagagactcaggagaaggtatgatggctcccctacattttgttgctaagtgcttatcagggtgtgacacatgatacaagacatccagatcacagcttgtgcagaggagcctaagttagctaagcttcctggatccttctatttataaacaagacaagctcctgcctcgaactattcctgggggtcgatctaacattgctgggggtcatttctgttttctcagcaaactgccctatgatgtgactcctgaacaagccttgtctcatgaagaagtgaagacgaggttagacaactccatcaggaacatgagggccgtgacagacaagttcctctcagccatcgtcagctctgtggacaaaatcccgtgagtgccatcagttgtgactccaaataaagcctggctggtggcatactctgtggcctgacctcactccattttgtccatcccacagttatgggatgcgcttcattgccaaagtcctgaaggattccctgcacgagaagttccctgacgctggtgaggacgagctgctgaaggtaagactctgagagctaccgggtgcctgccctctgctgtcagatgcccagtgaccacagaccagcaggaagtgcctgagtgtcctccactgtgagcctcacgagcagctgtaactagaagacggtgccttctaagcagatagtttctgttcatcttcatctttaaaggcactgtgtacactaagtataggtagtgggaagttttcctgagccctcttttctctggagcattgctccctctgctggtggccaggtgaatagcagcgagcgcagtgctctgctgcggattccctgctaactcttctta

SEQ ID NO: 32668 - DNA, 1197 bp, Mus musculus
aacattcaacagccacctctggttagaaaatcagttatggaagagagtgaagaaacctggcaatgttatggtgggagtagtatttctaccgtcgcctaatgtgatgcctgctggccagtccgcatcagccaagatcctctccctgccccgtgcctcacctgggcagctgggtggtgtctgtgtgctcccggggctcattttccctcaagcaaaagcccaagtggccttgttggattggcctggtcctatttcctcccaatttggaggagccccaaggtctggagtttacatcaacttggaggccaggaataaagatgagagagatccaggggagaaaggctccctcatacttctatttataacacctctgcccctcctgctggaggctctacctttagtacagaggcgctattgtgtatcctgaggctctctttctcctgtacctttcacagagtttgttcttggggaaatgaggagtttagagaacgagactgaatgcatggagactgttgtttgtctgtatgtctgtgtgtagaaagtagaggatgctgcaggtatgggtttgggtttgtagtttcccaaaaggttaagtgaggacattaagtgtgagtttcagaaaactgtatactgggaatggttgagactctaatgcagagatttctgctttattgtttgaaaagtggcttcagtatggaacttaaactgatgctctaataaaatattttaggatgccaagatatagcagagcaaaggctgtcaagggatgctctttagtgcttacacctatttccttacttatttatgtgtgtatttatggctcttccgattgggcttgacgtttattttagctaaggagtagctgtatgagaaagggatgccatttcatctgttgacggaggtgacattgacctgtgaggtatgaaggtactcaggtcttgagacgagaatgtaacagagacgaatcagaaggtggcttagggagaaaaagagaaggaggcaagagagaatgtactgggtaagccagaggagtcggagagcatgaggggcaatgcaggcaaaggaaacgtcagttagggtaacggtcacacagacagttcattctatactcgtcagtcatcgatttagtcgtgtctttcagggcctttctggtggatccctttgagtcttccctgggctaccttcttcctgagcacccac

SEQ ID NO: 32669 - DNA, 1241 bp, Mus musculus
aggctattgaaaggaacaaatataatgtatgcaagtggacattgtgaatcagtactctggaaggcactggtaatgaatagtcagtaaacattagcagctgcttcatctagggtgtttatctctgatgataagttctttgcttacttgtttgttccaggtttgttccttacattggaattgtgacgatcctcatgaatgactatcctaaatttaaggtgagagcacaaccttatgtttgattagaagtgaactgatgagagtgtggcgctcgctcagcagcacacatgcggagcatgtgtgaggccctggattcagccagctcctccagggatcttttgtttacctttggagactgttaaatggattacagcatgaaaacataatgtagtttagtgattgatcctggtcacaattgagtttatgacgatgaagacttcggaggtattggaagcgtccctgacatgtgttcctgtttcactttttagtatgcagtactgtttctgctcggtttatttgtgctggtccatcgtgagtaagaagtcggactccctgttcctaggaagctgctgtgcttgttgttactgaatgttggagtagatcctgatctgtgattgcggattttcggaggacacacacgttggcacttcttggtagccctggtttgcattgctttgtgtttccacacccgaggctgtgtgggcgggtgcatgtgcaccgtggagtgcacacaaggggactgtcaatcacagggtttcatatgttgtcattgtcactctttcacatttttgtacatcagtgaattttttatattaaaaggttgagccaaagcccccagtgtttgtattttgaagccaagcttcactttaaaagtgcctacagagttctgtaaatgaaaacacagctctgcatgagttcaaacctgtcgttcctccttacagtaggaatggcacatattgaggcgatcataagtcttaacttttcaaaattttaaataaaagactttgcacattgaacccctttccctgaattctgtttgttgggaaagctcctgaaatgtgcctttcttggctggttcttagtacccattatggtttagaaaggctttgatgtggctgggcgtggcagcacatgcctgttatcccagctcctggaatatctcagcatcagaagctgaggatcaggagttcaaggccagcctgggctaaaggagaaaaagctgtagtatataaacagtccttcag

SEQ ID NO: 32670 - DNA, 1149 bp, Mus musculus
ttgtttttaatttgaatattttgatgcaaagggaagaaaaaactccatatattcaatgtcaagtcttagctatttagagcttttctttttctttctttctgtttcctctgtatttaaatgtttgttttaacacacacacacacacacacacacacacacacacgtatatatggctttttgtgtgtgtgtattcaggtacatgctaggtatgtcctcttctgttcaggtacttagccctgtgtatgttttacctctataataacttgaatgtattttctgactattgagtcatctcatagttgtctacattttttttaaaagcaaaatactgctcttttctgttatttggatgaacaagcttccacttttgttatagacccttctttccccccaaatctttatttctctaaaattccatggttataatctctgccttccattctccagtctgttttgtgtgtgcacatgtgcatgtttggctgcaagcacctttacccattgaatcattttggtggcccttccctcgtatgtgttttgtaatttcactctgatttctcaggaccgtttcctgcactggtataccttttcttcttttctccctttcccttccatgtctgttgtagtactggagattgaattagggctttgcacatgctaggcaaatgttttaccactgaataccaccctaagcccgttttctgctttttattttgagataaagccttactaagttgcctgggcaagccttgaatgtgcaatgaaaaagcgatgctgtgttttaaggggctattctaaactgatatctagttgtcttaactagggtttctttttttgtatgtttgttttttgttttttgagacagggtttcttgtatagccctggctgtcctagaactcactttgtagaccaggctggcctcaaactcagaaatcctcctgcctctgcctcccgagtgctgggattaaaggcgtgcgccaccacgccctttctttttctgtgataaataccatgaccaaaagcaacgtgaggaagaaagggtttatttcatcttctagcttatgagtctatcatagaaggaaggcagggcaagaaccgatacagaggccatggaagagcgctgctggctgccttgcttcttatggcttgctc

SEQ ID NO: 32671 - DNA, 1144 bp, Mus musculus
actctccacatgcctgggctcctgcattcctagacaccaccgacagatgcagaagtcttacctgattcaaaacacttcctgagatgcaaactttctcaagtacaggataatgtttacaggaaagatgcattgagcacggtgccttctctctgcaaagtctgtagggtcacacactgtctgtctgtgtcccctcacctctcactctgtacccagtggagagttgtgggcaagtatatctggctgtaggggtccaccccttcctctgcagcccagagaaaggcagcttggagtgatttatctttctccacggttccttctgcttctgttgatgtttcccctcaccgtcccagctgctgctcacggagtgtgtgcctgggaaggggaggagggctgggcacagcttgtgcaccacacagcctggctatgtggttgagcttcacgcctgggaatgcattgtctttgctggcccacggaagggtttggtgccgaggtctgtttcctgtgctcagaaaggagtggactgtaagccctgaggattattggtgagtctggggtagacataataagcccacagattcagctgagttctgcaggaaggacttgaccacagggaaccctgagttctggcttgttcaggagtcagtctgtggctctgcagtcctgcaattgccaggcttgtgttcagttcagtacgtggtgtccatagacggagcagaggacccacactggcttgctagtaccagcccatagctctatgtggcatcaaaattcatttgatagtccataaagtagagtctccttcagggcaaaggccctggcctgtgctcataagtggcggcacttttcttctgagcctgagccctaggatagtgttccatgccttcgggacctctgcctccttgagggttagctgccttttccccgttggtgtggctgagctatgctacggatccatctccgaggcttgacatgtctacacgtatgtatgtctctcctatacactgggttccctggaggtgaaaatggattatgaagccagctccccaccatcacgcagtaagggtttgataggcatgtataggatcgtactccagtgtgctcaggagcttggcctgctgtcagctacctattgtaatagccctgg

SEQ ID NO: 32672 - DNA, 1158 bp, Mus musculus
cctgagtcctctgcatgagttctgcactctgaccccttgccccaatcaccacacaagtaagtgttgcactctggggccagcaggccagcatttacctttttgcccctgcttatcctggctctctccctgtcctcagggcactagacttcttgtgtggggtctagccttgtgcctctcagggtttcatctcctttcagcttctttgcctcattcatcacagtttatcctgccactaacctgtcctgagtccccccctgggccccagagccctctggagcctatcacttctttgtgcagtgttttttgtttttttttttttttgttttttttttgatgaaccatgttcttgtcactctgcacttacttgtttcccatgctgccttgcacacacgcccgtcccccatcccaggctttgaacccaattcagtctgctgcctgcccttccctggcttttgcttatccctttgtctaagggctccttctatcctgaccctgcatcctacccaccagcgtatgggcaaggaacagcctgtctgacttcactctaccctagtgccctctcccctggctctcccaggttctctgctcaggaggagggaggtggcacgggaacctgtgaacagctactggggccagggattaactctaagtgccttatactctgttctgaaaggagtgaggttgcagtaaatgtcacatctctatcctcaaggactagagactaggactcacttgggggaagaggaggcacagggtgttcctggagggtttcgatccattcacacgcttgtgtagagaaggatatctttctgcctacctccaaccatttgctcttgatcctgctcaggtgtgggtccccagggaatttctgtgcaggggtccagcaccctgggccctttctagatacccctcctgagacctggaatggagtagggtctggagctagcctgctccccttgctatgcaataaaggcagtgactgtgtgtcctgtttgttgctctcatgtcacggtgtgatgattattgattaagaaaggccaggcaggctctctggagtccctcgggccaggccaacatggatctgatttttggctcatggcctgaggtacagtctcagctgtctatggtcgcagctggccagtcagtgctgaggcccaa

SEQ ID NO: 32673 - DNA, 1194 bp, Mus musculus
ctccttctgcgtctgccttccaagtgctgggattacaggagtgagccttcatggccagctgtttgttctaagacagaatttacacagttgcttatctatgttacattgtagccagctttccccatcctcattagggtgtatctattgagctttttattttcaatgcttaagattgtactaggccctcatgcacaccaaacactgagctatacaccattagaaatttacttatctttttgtttggttatttattttgattttggtttttgtttaaagagacagggtttttctggcctggaactccctctgtagactaggccagcctttacctcctgaatgctgggcttaaacgcatttgccaccatgcctggctccaaaattcatgttatctttaaaatatataatagttatttcagtgtgtgggtgtgtgtgtgtgagagagaaagagagtatttgtgtgtatatgcctgtgtttctctgtgtgtatgtatgccccctcttctccccactcttccctcccctctctcccctcctccctcttctctctctctctctctctctctctctctctctctctctctctctctctcttctctctctcccatatcacacgtatggaagccagaaggtgatttgtaggaattgactgaccttagaatgtcatgcataatgacagcatttcacctgctgagctatctcacaggcccaaactagagtgtctaccatattttccagcattgtgctcttggatcatcagctgaactccttgtctggctatgtgtatgacgatgttgaagtgaatatctcagtgtagaactttccctgcttcctgggtcatttcttcaggagcttcctgaggtgtggttaagcacaactccatgccaagccctcctggagcaactttcctaactgctatagtagaggctaagtgccgcctcagtgtgcctcactacagttacccccagaaataaagctgcactggaagtctgtatttgaaggcatgttgagggctgaagatgaagcccatttggcagaatgtttgaatggcatgcacagagctctgggtttgatccccagcactgcacaaattgttaagcccaatcctcagttagcagaggcaggaggatcacaaattcaggaccatacttggctacttagagagtaccaagagggttggaaagatggctcagcagt

SEQ ID NO: 32674 - DNA, 1311 bp, Mus musculus
actgcacaactgctgtcgattttacaatcacacagtctgcacgtagctgggaccaaatatcttcctaacctcaaggctcatccatcctggataaggccatgggactcaccacgacttccatcccacagctgggaaaaggcgctgcagtgaatgacagacgcctcacaccctggtcccgttgctgctccccatgtcctacctctccaagtgtgggttcccagtgtctagtcggccccctcgccctctgagagcagacattctggtcctctctattcctctttctttgggaccctcatgtgcacctgcccaaagcctcctccctgctcccttccaagcaccggacttgctgggtgcccccagaagctgtctctagagaccttcttccgcccagtctccaagagtgctttccaccccagtgtcctgtggggcaccatctcattaggtgtgatgtcagagtggcccaggctccactctgactcggtaaagtttgatgcgagcttggtgggtttgttgatgttctagatgggtctcatgtagctccttctagcattgaccttactctgtagctgaggtcaccctattcctctgtcctcccgccgtcacccctgagtgtcaggagtacaggtgcgcactatcacactgcggccataaggacttcttgtttgggctgttgagagatctcagtgggtaaaggcatctgctgctaacttgatgaactgactctgatgcctggacccccaaggtgaaagagggaagccatctctgcatgctgtcctctgacctctacatatgtgcgtggcacatgctctgcccctcccaactaaaaataaagtataacttaaaacctttactatttgtgtgtacagtgtgtatgtgagtgccatcagggaggtgtggagaccagagaacaactttcgagagttggtccccttctactttatgtgggttctggggaagctctttacccgctgagccaactgcctgcccaggagctttctttgttggtttttgctggttggtttgtgacaaggtcttactatgtagccctggctggaactatgtagaccagactgatctggacctcacaaagttcctcctgtctgtttcctgagtgcaccatggtagtttttttaaaaaaatgttgctttttgtttgtaattctttgtctctatagtcttatatctactttgtttgtgggtccttcctgggttgttcttttatgtctcctaacaatatcttctctggctcagctcagcctctcctggctcaactgtcaccagctgtcttttcttcatagtcggctttcatgtg

SEQ ID NO: 32675 - DNA, 1112 bp, Mus musculus
tccaccctcagggccgcgttcgcaccaagaccgtgaagaaggctgcccgggtcatcatcgagaagtactacacgcgtctgggtaatgacttccacaccaacaagcgcgtgtgcgaggagatcgccattatccccagcaagaagcttcggaacaagatagccgggtgagtgggggccgcggccgccggagagcctgcccgggccggtgcctccgctccccccagacggcccgccgaagggctggaggtgtgccttggccacagtggggttttgccgacgtggtcttagttcgggctccttacggtagctgaaggcagagctccggcctcaaaaccttactgctgtggtctctgcttcccgcattttaccactatggccgtgttgtgcaaaaaaatagcagtgttgtgtccgtacgacggataagaccagtcggggtacatgacattcggaggagggctggtgacggcgagtgaggatgtaaggagtggacatctgaacagtgctgtgtgtgtgtctgtgtgtctttccgatggtgagaccgaccttgatgtagagacaaagtcggttctggtgggaggtggtcactgtttcgcattgcttgtagctatgtcacgcatctgatgaagcggattcagagagggcctgtgagaggcatctctatcaagttgcaggaagaagagagagagaggagagataactacgttcctgaggtaagatttgtgggtcttcctctgcacctcttcctgggggctcacctgaggtgggaacgcagctggatgtcagtgaagtcttaatctatttcctcaaaatgatgagagatccacccacctcggccttctgagtgctgggattaaaggcgtgggccaacacacccagccgagggtgcctgtaatcagccgaccttgagcttctctgcgaggtctaaattcattttcacatgggagcccagtgagagtgcctcccgacgtggttagcttgacatccaagtgtgaaccctgctttctgaatgcacactagatggttctgacacaagaataaagtgggctgtggtggtgcacagctttagtttcagcatttgggaggcagatgtctgagctcgaagccagcctggtc

SEQ ID NO: 32676 - DNA, 1211 bp, Mus musculus
ccttaaaacagtttttaagtcgtttggaacaatatatttttttttctttcttggcagcttttaacattatagcaaatttgtgtctgggggactgctggtcacagttgcaaatcaaagcatttgtaaccaagagaaaaattattttatttaaaactggaccggaggaaaagtctgagcagctgctgtatatagttttaaatggtttgtggcaccttatgttgcacttatgttgggggagggttgatagaagtttttaatcacagtcacaggactttttcttttgtaactgagcttaaaaattaaaaaaaaaaaaaaaagggctgctttttggtgggggcaggtgaaggctcacaggagccctttctcttagaggggcaaatacccttccttacaacttttatttgacgaatgtatgaatcaacagttacagttgacaaagacgctactggaattgaaaacttgacttttctttttaatttaacgattacttgcctctcttagggaagctgtgtgccaaagagccagtgtcataacccctccctcctgctgagctgatgttgcattgttgcatatcccagctactctgtgggttttgtgaagctgtgtgtgaagtctctacctcattgttgtatatgcaggcaagactgcactctcctacagatgtgtggagtaagctgtggtgtaatttttttggcacataataaacacgttgcagcagagttgtagttttgtctctgtatctgggtgtgtgtgtggtggggtgtggtagcaagcagggaagattccagagaccagtcctcttttcatggattttcactaatgggataccagcccagagggatgggaggtacatgcggagacctgctcctatatgggacttgttacatcctggtcagccactctggagtgtctagtacctgggtgattacaatcagaataggaggcctgcctgtacattttacttcttggcccctcaaggcctcctccacatggagccctaggaatgctagaggcacaactcccaagatgtcaggagccatttgctggctgctttcctgtgagccctgacgtgttcctccttcctcttggacacacttgtgctgatgtaattcctttctgagtggttactattttgcttttttgattcagggtctttctttgtggccttgtcctggaactccttatgtaagccagcctggcctcaagctcag

SEQ ID NO: 32677 - DNA, 1099 bp, Mus musculus
ttctttttaagaacagtcatggcccaggaatggcctggaaggtcaacagtaggctagccctgtctgtagcctctggcactgtaaaaggcagactctgtacggcgcaaacgacccactaaaattgttccgtatccactcacactagtgggacatacctccattttttctgatgtccagcccagtcttaggactgttgtcgtggcctcaaatcccatacagatggtgtgagctgttttcccccagcaattacggccacagagtgctgcctgcagagcctggagtcagatgagctctggccttggcatctctgagactagcagtctgcaccttgcttagcttgcattctgcagccatccacatggaacctaaaagaggccaagaaaacctcagagccctttagccgtgatccgcatgcatttctgacatgagctggggtagggtggtgcctaggaatgagagaccgctggaaggaaggattgggagagaagaaacagcccgtgcttgacctctgatcatctccttccattgcttctccccaagagctgtcactttagaccttaattgggtgagagaacttggcagagattatcaacaggaagtggaggcagagtagcccagagtaacccagctgtggccagcagcgtgggctcttgggtctcctggaccttgatccgctgctctcctatgagccatattgtcactctccctttggtgtcccttaggtgccaagaagaaataaatactcctctgccctactaaaagcatgttgcaactatattaattggagtgtgtgtccacagcaaggaatagccgacagggacacggcagaactgtccaccatacacagtaaagtctgtttcctttgaatgattctgctctgtagggatctcttcaatgatctctgtgcttggtgaggccagtttggtggaacactgtctggctttgaattctttgctgatgactttaatgaaggtccactcacgtttttaaagaggggaggaggcctttgatggcagagacataaacaggaacagaacagacgagccacagttggggaggtgcagactcatccagtgcctagagcagtttgcatgcatgc

SEQ ID NO: 32678 - DNA, 1349 bp, Mus musculus
taatattcttgtcttcttttggtaggctgcaagacaacagacaatttagaggtagggataacagacgaggatggccaagtgacaatcggtcaaatcagtggcatggacggtcatggggtaacaacaactacccacagcagagaccagagccctactatcaacaacagtacacacagtatggccacaaccagcggcctccatatggttactattgacagaaatgtcggcagcttttaacaaagaccttttattttgacaacgtgctaaatgcttgtgtgtcttctgttggtcatagtttttcattctattttaaagaatgggttattaattgattagaacttgagacttggaaaaaagtaatcttattagaaacctgatgattgatgggaataaatttattaagtgaggattatttgacttcttttacatactgttttgttctatgatttggtagtgttttgagttttccttatttggactctagggattctgtattacagaaataaaaatttttaattaaaatgctggcttttgctgtatgaaagaatagcatgctcacacgtgctcacctctgaagtgtttcagaggctaggactgtcagtctgtgaaaacacacccacaattacttaaagtaattgaaccacagttcagttgaaaggtaaaacaggtatgtcgcttctgtgtttgtatgtgatcatggtgtcttgtggtttataagtgagtcagctccagaactgctttggtcctatatggaagggctcattttctgtgcagcctcctgaggcggtggagggtgggatggtagcactcaacattttgtatatcccaagatttttgtaaacttacaacaaggaagacatggatgtgcgctgtaacacaatactcatgtaaatattgttgcattttgattgttttggtattatgtattgatttttatgagattattttcattttcaaatgcttaccttcgatgcttcctcatacagttatagtaaggctgtcacttgcttcagaacaatcattcttgaaatattttcatgataacagatttattcaaataaaaaaatttaaagtccttagtatattatgtgtgtaccaagttgtgaaagaatgaataaataaattgcattaaaatgtaggcaactttaccttttagttttgacagcccatttatttatgtggtaatgacttaattggtttttcattatgctgtcctttatacagtgaataagagttaacttcccaagtttgccttttctcttagctccttgagatggactctcccaggttctctgtaatcagaatgtatcaagtccctctttttagccatccactcaggtagccatctc

SEQ ID NO: 32679 - DNA, 1345 bp, Mus musculus
gggtgctgcagtgatccagatgactgagatgtgacagatgccaacagatggccactgcagcactgcaatgcccttcacagcaagaagggggtagaataccaagatccctaacagctgcgctgaaccataaagctgtccatgtccagccagtcactcctgctgaagaggaagaaggctttgtgtcatctacatagttccacccaagaagtaaaaatgctacagtaagagtggatcaaagggatatttggcagtgtgacatttctacatttttatataaagcagatttttaaaatacaagtaagataatattttcccttgaaaatgattatcttacaaaaaaacccttgtataattaagcttaaggtctatcagtctatcagatagttgtgggaaattattaaaaataagaattcttttaagtatcaacttaagaatttttctaaataggatataaaagttttcatcaaaagtaatattttgtattttcaagatggcagggaggtgatgtgttggtggccaggatctcttgaagttgttgaagaaagggaactgttttcagtctgctctggtactatgatcttatgggtctaagcctcagttagcgggaatgcccatggaatgtgtgattctgcttaactgaagagaagtaaagactgtgtagtaaccattccttaaccagtgttgcatgccagaggtaagttagtgctttctgaccattggggcattcgcatgccttgtgctttactgaacaactgtaactgaatgtagtcatggaaggaacaagatacggaaccactcactgacattgggacatcacctggaatttttaaaataaatttatcctttttgtttacctatttgtcacctctctttttctctaaaacttgagatactactttagaacaaaagttccagctaattaaagtttagcttttatgcacttctaattttaactaatatttagagagttgggcaggggataactcagcggtatagcagttgcccagtgtagtggtgtgaatgaaaatgcccctgtaggctcatgggagggtagcactattagaagttgtggcctttgcacatcatcatgcttcccaccatgataatggattgaacccctgaacagtaagcaaaccccaattaaatgtttcttttataagagttgccttggtcatggtgtctcttcacagcaatagaccactgactaagacacctagctggaatttcattcctagtttcaaaatgccagtcattgcagcctgagtagttactgtgcactgactggcctttgctctaagtcttttgcaaaaattcttgcttgccactgcatcattgtgcattggta

SEQ ID NO: 32680 - DNA, 2051 bp, Mus musculus
cagccgcctctgtgcacttaacacacacacagatcacttctgcagtcacaacccttttttgagctgcaggtagaaagtgaggctgtaatgagcgtgcctgctagctgcagtgagctcttcaggcttctctgtgatttttaatttatctgtttccctccatcatcctgcttattagttgaaaggatgccctgagcacacacagacatctgtgcaaggatgccatgcccaaggggcagatgtgtccctcctgagtgtaaggctgaatcttacctaagacaaattgtaagtgtcaggcaggagaagctgctaagactcttgtgatgtcttagagattgctaccagacagtaaagattccaagcatggttcatctcctggggtataaaatacctgttctcaacactacttaaatactgtcagtttaggaaaaataggagcaaatgctaacataggtatgggttttgattggtataaaaatgccattcatagggacagagcctctctctgtctctctgtctctgtgtctaagtctctctccctgtccctctgtctgactctaagtctctctcctcctcctcctcctcctcctcctcccttccacccggggctgcctggcgtcggcgtccgccatcgagggacccatcccggcttccacgagtcccgcagcccccggttctcccttctccttccttctcctcccttctcctgcttccttcttccatcccggcctgcctggcctctgccgtggcccgcgcagctcgggtctctgtgtctgtctgtccccctgtcccggttctcccttcttccctcttccttcttccatcccggcctgcctggcctctgccgtggcccgtgcagctcgggtctctgtgtctgtctgtccccccctgcctccctcccttctccttccttcttccactttcttccacccagggaccaagcccgagtccaagtcccgcgcagtctgggtctctctgtcccactgtccccctgtcccggttctcccttcttcttccatcccggcctgcctggtctctgccgtggcctgtgcagctcgggtctctgtgtctgtctgtccccctgtcccggttctcccttctcctgccttcttccactttctcccacccggggaccaagcccgagtccgtgtcccgcgcagtctgggtctctctgtcccactgtccccctgtcccggttctcccttcttccatcccggcctgcctggcctctgccgtggcccgcgcagctcgggtctctgcgtctgtctgtccccctgtcctggttctccctgctcctgcctccttcttccatcccggcctgcctggcctctgccgtggcctgcgcagctcgggtctctctgtccccctgtccccctgtccccctgtcccggttctccctgctccctgcttcctgcttccttcttctccccggggaccaagcccgagtctgcatccgaccgagacgcaccatcccggcttccgtgcgtctcgctgtccccgggtctgtgtctgtcaacctcccaaataaaaaaaaaataaaaaataaaaaaaatgccattcattgtcaattgcttggtttctgagctcaaatggtctcttaacaccattttggtcatcgtattaaaaatagtgactgaagcatttaaatagttataggaatccagtcacacttttctcattggatttcatgcccagagataattctgcttgtaattccagaggccatacctctcacactgcatggtgggggttgtcactggggggcacattttggactcttgttatcttttatatgcatttttttctaattttgtccttttaattagcagttaaatattcatggtatcattactaagcatgcaaattgttgtggctttgggtcaagttgtgatcggtgggtgaacttaaggagttttggttttgtaggccgagtctatgccgtgctgtcaaagcgagaaggtcgagtgcttcaggaagagatgaaggaagggacggacatgttcatcatcaaggctgtgctgcctgtagcggaaagctttggctttgcggatgag

SEQ ID NO: 32681 - DNA, 1161 bp, Mus musculus
aacgtggatcgcgctagagaggagatcgaagctcacatcgcgctgcgcaccggtggcatcatcgagctgacagacgagaacgacttccatgccaatggcacagacgtgggctttgatctgcatcacgggtccggcgggtccgggccgggcagcctctggagcaagcccaccccaagcatcactcctacacctggccgcaagcccttctccagctatcgcaacgacagctccagctcgcttggcagcgcatccacagactcttacttcggtggtgggaccagcggcagcgcagctgctacttcacgcctggcggactatagccctcccagccctgcactcagctttgctcacaatgggaacaacaacaataacggcaatggttacacctacacagcgggggaagcctcagtaccttccccagatgggggtcctgagctgcagcctactttcgacccagctcccgccccaccacctgggacaccccttctctgggcccagttcgagcgctctccaggaggtggatctgcagcaccagtatcctcttcctgctcttcttcggcatcctcatctgcctcgtcgtcctctgtggtctttcccgggggtggcgccagcagcacaccctccaatgccaatctggggctgctggtgcaccgtcgactgcacccgggcaccagctgcccgcgcctgtctccgcccttgcacatggccacgggggcgggagagcaccaccttgctcgccgcgtgcgcagcgacccgggcggtggaggcctggcctacgctgcctatgctaatgggctagggacgcagctccctggcctgccctcgtcggacacttcgggctcctcctcgtcctctagctcctcctccagctcttcctcctcttcctctgggctgaggcgcaaaggcagccgcgactgctctgtgtgcttcgagagtgaagtgatcgccgcgctggtgccctgtggccacaacctcttctgcatggagtgtgccaaccgcatttgtgagaagagcgagcccgagtgtcccgtctgccacacggcggtcactcaggccatccgcattttttcctgaaggcagtgcgcgcgcgcgcactgcagggaaggagggtcctctctcgaccctcattccctagggtctacctgcccagacgcctctggt

SEQ ID NO: 32682 - DNA, 1140 bp, Mus musculus
gacttcacctactcatcactgtgctgacgttctggcagaagaaactggtactcgaaactatctgaaggatcagatcagccttggcctgagagtttgagctggtacagggatggcagtagcttcgtggttgaaggtaagtggaaggcgggggacagcagtatagtggtggacagaaagcaagtgatctaggccagcagcctccctgaagggacgtcggcccaaaaagctgaacttgtgactttgatataagctctataaatggcaaaagaaaagtctacactgatagcagatatgcttttgccactgtacggagaaatatacagacaaagagggctgttgacatctgcagagaaggacctaagatgctgtggctaaaggaaatcagatggcagatctaactgccaaacaggcggcccaaggaacaatgatcctggcagtcgaggacctaaagattattatgatgtcagagagaccagctttagacacacccctgagcactatcaagttatggacattacttgacccacctgggggccaagaaattaaaaggtgtggctaggtcctttgacttctatgttacaggactctctgacttggcagaagaaatagtcaaagctgcaaggcctgtgctataactaatacaggacacttcgtgtatactcctgagaagaggctcaggggcaactggttggaggtctactgggaggtagaatttacagaaattaagccagctagatatggcaacaagtacttagggttagaaatagacaccttttcaggctgggtagaagcttttccaaccaggactgagacagccaatgtgatggccaagaagatactagaagaaatcttccccaggtttgggatacccagacaagtcagggactggccaagatattagagattggttagaagttacattgtgcatacaggctccaaagctcaggacaggtagaaaagatgaacagaattctaaaagagaccttgacaaaattaaccatagagactggcacagacttggtgctccttccctttgccctatttagaactagaaatactcccacctgattcagccttacttttttaaagatcctttatggggctcccatgtctatcactgtcttaaatgatgtgtttaaa

SEQ ID NO: 32683 - DNA, 1669 bp, Mus musculus
gcccatccccccacaccaccctccgtcctcttgggcttggtgtggaaggagctaaccactagcttgccgtggtgcacacataggcctggcaggccagggcaagtccctctatggccacctgagagatggctcacgtactctttgattccttgtggtccagagccctgtgtgctggttgctgtaagacaccttgtccctgtgtgggtcttaaagaatcatcatccattgtggtcgctaagtcctgcttcctctggcatctggagttcccagactcctgtgttccctttctggatatgcttttgtatacaaatttttagcacaagactttcactctttacaaaagtgtcaacttggaaaatgatgttttaaaccacaggataagccttaaggaaaaatactttcaatctaccgtttgtgatctcttccatcagaatcatctctttctatctgtttctccctttgtgggttaaggttcacatccccatgaaaccggcttgtaactgcctcaggccagtttgtatctttgggaaggagtgtgaattcttgtggcccctatgagtgactctaggcagggccagcagttcctgtgtgcatgctagactctggggaggtgagccccatggcatgtacctcactgtgccctcagtcatcatggtgaggcaagaatgctggggactcctggcccctcaggctttgctgccattaggaaggagggaagaatgtctgctatgctgtgcaagtatgcacgcctattgtatctgacactgaccacaaggtctgccattcctttagggacaaagggtttctctttagctttccaaataaatttagatccttgctttccatcagatggagaaaggaaagatctctgctgactgacactgtcttcagagacacagtaccctcacagtccagctgctcccctctagtagcttttaataattttaataattcccctactctctctacctttgttcttctcactgttgttggagcagcttggatttagtcaaagggctcattaggacacagcttcattttgacggggcttgttcagaatttcccgcaatctctatagatctgtcaggttttcttgctgctgccctgttgcctggggtttggatgctgatctctttctgtggttctctctctctctctctctctctctctctctctctctctctggttttgtctccatattaagcttactcacttgctataccattatttaggatgtgatccaccttgggatttttgagaccagctttctcattggcctttgactcaccaaataggctagattggatgaccaacaattccagggaccagtatctttctgcttccccaggtctggaattacactttgaatgccaccgcatctggttcttttctttttttcctccttttcttttctcttcttttcttttcttttctttttggttggttggttgcttggttggttttatttatgttttcttcttgtctctggagatgaagttcaggtgaccatgcttgcatggcaagcattttacttactgacagctgttccccccggccccataccttctcctgttagatcaaatgtaccttctattaaacctgatagattgatataaatggtatcttgagttcctcatttacttgtctgctataggacagaactcagagt

SEQ ID NO: 32684 - DNA, 1405 bp, Mus musculus
ccccaatggaggagctagagaaagtaaccaaggaggtaaagggatctgcaaccctttaggtggaacaacaatatgaactaaccagtaccccacggagctcgtgtctctaactgcatatatatcagaagatggcctagttggccatcagtgaaaagagaagcccattggtcgtgcaaactttataagcctcagtacaggggaatgccagggccaagaagtgggagtgggagggtgggggagtgggtgagggagcctgtggggaacttttgggatagcattggaaatgtaactgaaataaatacctaattaaaaaagaaaagaaaagaaaagaaaaagataaagaaaacacaaatggaaatcatgaagaaaatgtagaatatagaagttggattcagcagtgaccgaccgtcggaggcggcgcggccgggaggcaacggcggactcgcgcgattggtggatccatttaattcaagaaaatggagaccgaacagccagaagaaaccttccccaacaccgaaaccaatggtgaatttggtaaacgccctgcagaagatatggaagaggagcaagcctttaaaagatctagaaatactgatgagatggttgaattgcgcattttgcttcagagcaagaatgctggagcagtgattggaaaaggaggcaagaatattaaggctctccgtacagactacaatgccagtgtttcagtcccagacagcagtggccccgagcgcatactgagtatcagtgctgatattgagacgattggagaaattctgaagaaaatcatccctaccttggaagagggcctgcagttgccatcacccactgcaaccagccagctcccgctcgaatctgatgctgtggaatgcttaaattaccaacattataaaggaagtgactttgattgcgagttgagactgttgattcatcagagtctggcaggaggaataattggtgttaaaggtgctaaaatcaaagaacttcgagaaaacactcagacaacaatcaagcttttccaggagtgctgccctcactctactgtcagagttgttcttattggaggaaaacctaatagggttgtagaatgcatcaagatcatccttgaccttatatctgagtctcccatcaaaggacgtgcacaaccttacgatcccaacttttatgatgagacctatgattatggtggttttaagaatgatgtttgatgaccgccgaggacgacctgtgggattccccatgaggggaagaggtggttttgacagaatgcctcctggtcggggtgggcgtctcatgcctccttctagaagagattatgataatatgagccctcgtcgaggacctccaccaccacctcctggtcgaggtggccggggtggcagcagagcccggaatctgcctcttc

SEQ ID NO: 32685 - DNA, 1182 bp, Mus musculus
cgccaagatgtcggaccacagggagaggctgaggaactcggcctgcgccgtgtctgaaggctgcaccctgctatctcaggctttaagggaaaggtcttcacccaggactttaccgccagtgaattccaattctgtgaattagcactccccacgctccacccccaccccagcccctatacctgttttccaccccaggctaaaggaagacacttaacccctcccctctccatttataccaaagaatccataggtgatcccctccctcatgttaaatgctcaagaggaattttccagaaggcagggccatgcaatcatcaagtactcagagggcctgggtgtccaccagcccactatagggactcagacacagagaagatgggtagtctgctggctgcagggttaaccctacacactcgagcccctcaactcagttatcaattgggcaggaaagaggtcatgggctcatttcttccttctttttaattaatgaaaggttacctcagttttccctcctttagacatggatgtagctacctttttgtatgtcgttatttttgttgaattagagtatacatggtgtgaaaaagagtatgactttgccatatgatttgcaagtgggggggaaagctactgtgagcgtgtgttttattttttaaattacactatagagtgatttccccccccccccaatgtcaagtttttaccctgcatgtactggagtatttatttcatctattaaattgttatgtttctcagatggcttttcgcagttactgtcttttcactaactgtgcatgccgcctgccatctgtgggaaggagctgtggggggaaaaaggtttacatccattggcaagtgaatccccagtgcctaaccatttccactctaaaattccattttccctctggtattattcctctgagcatccttgcaccctagaaagacaaatgtatgtgatctatttttaaaggcaatcgaatgtgattggactatgcagtgcgtgggggaggactgttagtggggaggactgttagtggggaggactgttagtggggaggactgttagtggggattttgtcttcttccctctagtttttctggaaagtaacctagctctctttgtcctccactcatttctctattataatgagccataggttcaggcttactgaaatctgattt

SEQ ID NO: 32686 - DNA, 2003 bp, Mus musculus
aaggcagaacagttcagcatttgggtggaattgaaatgtaggcctcccagccttctctgaccccaggcacctcacttacattgctaactgctggcttctctggctaggttcatcgtgggatccgaccgcgccatcttcatgctccgggatgggagctatgcctgggagatcaaggactttttggtcagtcaagaccggtgtgctgaagtcactctagagggacagatgtatcctggcaaaggaggaggaagcaaggagaaaaataaaacaaagccagagaaggctaaaaagaaggagggagatcccaaaccacgtgcttccaaggaagacaatcgagctgggagcagaagagaagacctttagcaggtggcaagcttcccgccaggtaggcaggaccagatagcccctcgcagactggtggggcaggtggtgcaggaaactgcatagcagatgacattctcatgtcctctagaaatggtctgtgtatgaccatctggtcaatatcacagttaccgtataaaaggcttcccatgtgaaggcaggatttgtgattggtagtggactggcaagtcatgtctactgtggcttcacctgactttggaaacttgatgttttgtaccttttatttctcttgagtccatgacacccccagagtaccactccctcctcagtgcacctgctgtggtcccatggcctgttgtatctgtgtattacaagctcaagtcagacaagccttgagaagcttcaacttgactgaagcgcgggtattgattgttcagtgagtgaagataactgtgccgtatgggcagtgctgtgttcagtgagtgaagataactgtgccgtatgagcagtgctgtgttcagtgagtgaagataactgtgtcgtatgagcagtgctgtgttcagtgagtgaagataactgtgccgtatgagcagtgctgtgcgcccaggatctggacagcaaactcgttatgcagagtgggcagattcacgacagtgccgtccagaacttctcatcggttctggggaatctttgtctccccgtctcctggagttgaagagggaatgcgcttgttcatcgtgtgaggaaagaaggatgcttccactgagggcccacgttctgcatagcccaacaactataaagttggcgaggagggaccagcagagtcttgcataggagtggacctcatctacagtatttctaagcggtttcctttgatgaagtgcctaaacttgtgcttttgtatggtactctcatgatgtgctgctgttcacatctgtttctgctgttcataggttgaagcttcgctaaaagaacatttctatgaggatgccatttttaagaactcacattcttttaaaacctcagttgtggtttgaaattcgaaatagtacatgtacacgtacccggctagaaattgtcactgttaagagtgtcacagtgtgaagaattgccctaccctgctgccagtactttgtcccagtgaagctactgttggtcattggtttttcaaaaataaagtacaattaccagcttccagtgataggtatattctgtcctccagtgatgggtatattctgtcctccagttggtttccgttcatgtttctcttaccaagccacacctccctccccagctcagggcgtcctggacacaacctgctgagcctcttcaaaaagaagctttttttggtcctcgcaccttgtgacttgtgatgatctgctgctgtcctgtttgagggtgctgccaatctaggagaagctgggacagggcactcatccttttggtatctgtgggcccagcaaatctgaaacaagccccgttcctggggtttttctgttttcacatggggcagttgattggctactgtcatgtctagccatgatgctcttttctcagggctgccgtttccttctggaagccttcatgatgctgacacgggactgtcatggctttgagtgtggtgtgcagcctcttcaccaggttcatgcatcacctgtgat

SEQ ID NO: 32687 - DNA, 2412 bp, Mus musculus
ggaaagagacaattgtggaaaaacaagtgaaacccaattagaggcaggaggttttacttaataggaaatactaaagttggtttcttggtattgacaaatgtatttggtaatggctgctgttagcccgataggaaatgagttaggagttatggtaatatctttctttgccagagatcctaaataattccaaattaaaaaaaatatgtgaaaggaaaaaaatattagacaaacaatgggaacggcaggtgagccattatagtatgtcagtgtgagttttaacacctgtacctggacatcatttctagtgatgagggcggggcacagctctgtgatgtccagctgtgatgctgacgctcttgtctggacagcacgtctcctgtgaatgtgactaaaggagtccttctctcccctccccttctgttttgcagcattgacaagatatctaaagtcacctctcctgtgttggtcattcacggtaccgaggatgaggtcatcgatttctcccatggcttggcgatgtatgagcgctgtccccgtgctgtggagcccctgtgggttgagggggctgggcacaatgatatagagctctatgcacagtacctagaacgactaaaacagttcatatctcacgagcttcccaactcctgaagacagcggccaaccttacctcattactgtgaagcgaggatccttgtttgcacacgctttgactggatttaacagtgatacccaataaccacagagaagggcccagcctttgtgtgttcttcttaaagagctaacacagtctgtcttttgtacgtaatctccaccttccattaggctgagcagctggattctcagctgcaagaccttgcaggagtgggaacgagagctgaccatgaggactggttcccagggctgtagactaaagtgtgatcaagtccgtctcccttgctgtctgtcacctctgattcccctaccggtgcaggatcacctctcatccatgtgccggtgtttgacctgcggcgctttcagccctggtgccatgggtgagattcatatgtgaagctatggtagtgtaactggaaactgtcgtgagaaatcctccattaacttgtattaacacgccagcctttcccacacacatgcattgaagaatgatttactggaactataacagcttcatcaactgttaccatttaaatacaactggaatattcttaaacaacaggaaactggggtttttttaagtgtaaatttattactagccaagagttttaatattttgattgtctggtctaatagagcctggccgactttccttctgtaaagtcctccttgtcggctttcttaaaagtcctgtacatatttgcaattacattgtgcacagattcttaatggatagatttcttttgtcaggctacaacaacagactgcagattccttgtttgtattgtaaatgattgaatacattttgttaatatgtttttattcctatgttttgctattaaaatttttataacatttccaagacaaaaattccaagtttctgctttgaagaatttaggtaattaaattaccctaagctgatctcttagtttaggagttatttgggttttgacactggagttgtgccaggtgaacatcagaaacaagatgcttaaatcattacactaacttgtattggttgcgggattgggtttggggtcgtttggtcttattttagggttttttttttttttgttttttttcttcttcaaatttaaaagccttaaatgtactgtaagcctcagatcgttgtacaactggattgcgttggttgccagtttgtgtgctgttgcctggatgcggcacggtggttggtaatggaataaaggacgcatggatcagaacgcgtgggcttatgtgctccttccttcatctcgccatcaaaagaaatagtaaggcgcacctttcatctcgacttaagaacatccgtggggcatcactgtggtaaaagggctgagacacagcagcagtaaacatagatggcacattcctaagtgggacatgcagtaggcctgctgcagagacaagagccgagaggactctcgtggctactcagctgggagaagacagagaacctgttctctgggaaggatgagtcatgggaatgccataggtctttttggccttttgatcacctttccagagaaaggatactagctttcacctcgaagtatttcctgatcgtactttaagaggctatagtggttacccagcgtggcacatgctttagttccagcacttggggacagtcaaggatgtgcacatccagtagcaggcgaagtaacaaagctgctgagaagtccagagcactagatggagaaaacaccccagaggcctcttttagagaagctaaccaacctaggggttctaagcacctgactt

SEQ ID NO: 32688 - DNA, 1513 bp, Mus musculus
gcaggggactggcaactataacatcgaggactttgctgacctgggcatgttccctccattttctgagtagcttcaggcaaagccaggcttctactgcccagacgctattatcatgccatagatgcccatgttcaaagagggtccccctcacccagcttgccctgctgtagaacccccagaaatctcccttattccccatcctccctggacatggcatcacctggctctaacccacagccctggcttcttgggtttgggatctttgtatttattgtactttatctgtgtgctcggaagggggccgccagggtcttaaatcccattgtgaataatctattaatggacaatttgcacccatcaagtgtttgcttgatccacaatggctggcagtaccagcaggtctgcctggtgcagaagctgggtttctttctgctttttcacggctgctgcctcggaggcttggtgtcagagtgaaaggcagtgacctctgcattctgtgctggagccaggagcacaggatgggagtctcccacactagctgtccttgacggcctggggccaggtgtgctttaaacctgagaatcaacgttgtggcttggtagatgtactgtggcgtgttggtgtgtgtggccagtgagagtgagaagccgtccccattcagctgcatttcaaaggaaagcgtgactggggcctgggagctgggctgactccctggaagccagggctggggagctgcccactctgtagtcagttctttggtcccctgcccttttacagacatactttacttcttaaagtctctagtccttctgtcctatgcgagcactcacgcttctcttactaagcctgagggacagtgtcctgattccataaaggtcactgcatcctccctgctctgcatctgagcagagctgttttctgcccagcgccttcagaaagtcagacccagtcctcctctgtacagggttaggatacctcgactctaagtgtccctgacaccttctgctcagtaacttggaaagaagatggggccacactctgggtggaaaagggtgccttgggccacctgaacctctgtcctcatcaggcaggagaggcaagggtacctcagggcagacacagccaggcgcctgtgaggccagagactctgttctgcccaagcttctacaaagacctgaattcctcagtggtcttaaggtagaactatgaactaacttctagaacaatggttctcagcctgtgggctgtgttggggatgccagacaaccatttcacaggggccgcatatcagataccctgcatattaggtagttacaaacgatacatacataacagtagaaaatcacacttataaaatagcaatgaaaatgatcttacggttagggtcaccactacatgaagaactatattaaagggtcacagagttaggaaggttgagaaccactgttctagaagtgtcttgctggcttatctctgacatcagagtccctgtgtcagtcagatttaaagagct

SEQ ID NO: 32689 - DNA, 1128 bp, Mus musculus
gctaaggaaaactcagagccaggcttcaaggccagtctctccatccaaggcacttgtacccacactgtactcagagccatcactactgaaactagaagctggatagaggtttatggacacaccacctacttttccacagggccattgctgccttctggattagtagagacagcacttcaacacagcactggcctgtctcattactgctccaggttttagtccctctccctctaccatttcaagatgactcttcagaggaaggagggatgccaggcagcagtgtataaggtggtcctgatggggagaaggtgtggtcgagacagaaaagcaccttgtagttaagagggctgcagaaataaccattttagatctctgagtgatatgaacagtcaccctcagtgaggaagggctggggagggtggagaaaggcccagggctttccaggtggcaacaggtcctctagttgtaaccagatatacccaagcaccaggttcagaaagcaagcagggggcagcaaagacaccacccaggagacaaggagggagcctatcctctcagtgttgtctggtggttgaactctggaaaaccttggtcctggtgagcttaaactgaaggccctttgccaatgaccccagcacctccctgggaggaatggcttctgttctccaacccgaaagaggatgtgggaaaggttagtctgtgggcatttccagaggaagttcatttggtccatgtcccctgcattgccttctgtggttagggatctgcagggttctcctgaattcaggtaattgggtcagcattttgggtcggaatagggaataactttgaaatagactgcctgatggtagaagtgggtgcaagcaaagagtaaactaactaactaacttacttacttaccttccttcattcatcccttccttcctcattcccttcttccctccctccttcccttccttccttccttccttcctccctccctccctccctccctccctccctccctcccttccttccttccttcctccctcccttccttccttcctttttcaatgaccacttattcgctaattcatgaatacctgttttagatgtctgtagacaggtcacatgggatgcagctcaccc

SEQ ID NO: 32690 - DNA, 1114 bp, Mus musculus
aagattttgcactgtttaaaccctatctcaaggacaaataaaacagtgaccctagccatgaacgtagatgattctgtactgctcaaggaattccttctcccccgcacttagtttcccttagacatgattgctagatgttctcttggtccatggctattggacagatgccattccttttgggataggtagggctgtgaagtcaacttgtcaatcctcctggaatgagcacccctgatgttttcattctttacaagtgtcatatactgtcagatgtgagggtatggagcctggaatacagaggaagaatcagaaaggcctggggtgccctggggctaggggggaaagggctcatgtgagtagacttcccaccttagagacccagggaagtaatgccaggtcctcaggcagccctagtccctggttgaactttgaaaatattttccctttgctctgtaagccacagtgacccagagcatcgggtcatctagattcttaccaactttctccatggcaggctttcttcgtaggccctgggaacagattcggagagccaatccccatttccaaagcccatgaacacattttcgggatggtcctcatgaacgactggagcggtaatgcctggtggcccagcttcctctgatgttctgttcttaggggcacacacaggagttgggtatgggacaggaggcctaagtactacaggggtgataccatgcagacttctgactctgtgggtgtggggcagtcacagcttccctgagtagctttctcataagtggaaggatggagctgacagaacctaaagctttatcaagccctacacactccactcactgttgccagcaccatcagctgctgatgaagagctgtacatggagggattttagtcagtggctgaattgagccttactattcatcagcccagcatctgagtcccagctctacaccctgataccatgtgtaagaggaagtgggtccagaaatctcaggagagggccttcccccattcaggcccttggtagggactgtcctgtcatccttcattgttccctagcacagcacctccaaggacctctgtcttcatactgaatacctttctgtttgttccctg

SEQ ID NO: 32691 - DNA, 1238 bp, Mus musculus
ctcctcttgggcaagggaggaaggaaggaaggaaggaaggaaggaaggaaggaaatgctttttttccattttattatgttataaactaggctattacgtttttacactgtttcctttttaaaaattcatcatagatgctcatttacaactttgttttcatttctgaagcaaggctgcatcatgctagttttcatttagagcattcatgtaatatttgggatgtgttaaaacgcacgcacgcacgctgttgctttggtttcctaagcatagacttctggccgtacttagcctgtggtttcccagccctatgatcatggtaggttacaagtgtctctgttttctataggaagtggtatactatgtccttttagtttgtttggatatttagaaggtgaacttttcaaactgaaataatattgagtccagcagcacttacctgaaggaattaagagattctcttgagcccaggtgtttaacaccattctgggcatcagaacaagcccctatctctaaaattagaaaagtaattttaaaaaactttatgttaaaaaaataaaaatatcttttgcttttctagccctgtgtcaaatcagtcacttttatcagaatctgtagcaccttcccaagtggacagtacatctgtggacaaagcagtatctgagacagaagacctgcaaggtttgcaaatgatagcatgtgtttgtttaacacttgagttttgtaggccgggcactagcatagatgtgggtatttagaacagtacctgcttattgtatatgctttgttagttttgttatgagaagagtattttaaattctcaaatatttaaattcttaaatatttaatagttgggatctactttccacttgtatataattagatcagagtaaacagaagattcaaatctgatgtaattagagtgagcaatagaagtattatactatatgttctgttgtgttaggcagttaaatcccaaaactctcctctccgagcactgggactactggcttgctgattttggttttgactgattatccgggaggcttttcttcctgcttcccaggcactcctctccccgtgtgaactacagagtagtggtcacatccagctccttgcattcataagtgcggcaccccatgttctcaccctggttccatggattcaaatgatccaagaactctgagaaacttatctgaaggcacttgcaatggggaggcatttaggaggtttcataatct

SEQ ID NO: 32692 - DNA, 1169 bp, Mus musculus
atccccttgatctccttttgttgtctaattgctctggctaggacttcgagtacaatgttgaataggtaggccaagagtggacagccttatctagtccctgattttagtgggattgcttccagcttctcaccatttactttgatgttggctactggttttctgtagattgcttttatcatgtataggttgggccttgaattcctgatctttccaagacttttatcatgaatgggtgttggattttgtcacatgctttctcggcatctaatgagatgatgatgtggtttttgtctttgagtttgtttgtataatggattacgttgatggatttccgtatattgaaccatccctgcatccctgggatgaaacctacttggtcaggatggatgattgttttgatgtgttcttggatttggttaccaagaactttattgaggattttttcatcgatattcataagggaagttggtctgaagttctctgtctttgttgggtctttttgtggtttaggttttagagtaattgtggcttcatagaatgagttgggtagaataccttctgcttcaattttgtggaatagtttttgaagaactggaattagatcttctttgagggtctgatagacctctgcactaaacccatcttgtcctggttttttttttttttggttgggagactattaatgactgcttccatttctttagaggatataggactgtttagattattaacctgatcttcatttaactttggcacctggtatctgtctagaaacttgtccatttcatccaggctttccagttttgttgagtatagccttttgtagaaggatctgatggtgttatggatttcttcaggatctgttgttatgtttccttttcatttctgattttgttaattagtatgctttccctgtgccctctagtgagtctggctaaggttttatctatcttgttgattttctcaaagaaccagctcctcgattggttgattcttttaatagttcttcttgtttccacttggttgatttcatccctgagtttgattatttcctgccttctactactcttgggtgaatttacttccttttgttctagagcttttaggtgtgttgttaggcggctaatgtgtgctctctctagtttctttttggaggcactaagagctat

SEQ ID NO: 32693 - DNA, 1149 bp, Mus musculus
acacactgcataatttctagcagccaatttatgcccatagttacattttttcctgaatccaactatgaatatcataattggaaaatggttttaagatgaaaaggaacaagaaattaactttgcaaatactttaaacccgtgctcatacagtaggcttcttgtcctgttctgccaaattttgtacctgatttcctacttctcttctctttccaggaaaacagttggagttttctgctgtggacccagttctatttccaagactcttcatagtttgagtaaccggaacaactcatatgggacaaaatttgaatacaataaagaatccttcagctgaaaccttaggagactactggggactttaaagaggaacaagtgcaatttctaagacttagaaactcagctgaatcaaacagctgtgctatgccaaagaataccaagggtttgctatttatgattatttaaaatgagaattcagaaaatgtggcaaaatggcatggttaatctgcgagccaaaggggccctgaagaatatctgatgtggtgattcacattttgatgagcaaattaaaagaatgccgttagacgcacgctgttgatttttatgggaaattcaagaagtctcttacaaggagctgaactcacttacactgaagctgatagctgcagccctctttaaattgttttcggttgaacacattcaagattgaacaaaattaaaaattcattgaaactcagactccattttctaggttgtgcataagtggagtagctttcatttggataggctccaggcaaacactgggaggttgaaactgtagcacaaaactttgtatcgatacgggtacttcatatctgctgcttcactactgactctcctgcctcgctgcagtgttcctaatctatatgctcacaaagcttatacccatgtggatgtagtatctacttatgtttgcatcttatcctccgtctaggaaaatctgctcccccttagccaatcttggacacaattatttaatagaactgtttgatcaccgatttgttcaatttagtcccatggcttagtaatgaaaatgtgctttaagcttatccttaaaaaccaaagagctttgtatcttgcaccaaacacagaagcacaagacctctctccttt

SEQ ID NO: 32694 - DNA, 1151 bp, Mus musculus
agattcatcacctgccaattgcttgctgtgcaagcaagaggacctgaggccagacttcaggatctgtgtcagaaaaacaagacagatatgctgacacacttgtaattctagtgctagagagacagagacaggtggaaccctagagcctactggttaaccaacatagttcagtgaacaagtatctgtcaatgagtgagctgtgtcaaaatcaagttatatgttcctaagaagcgatagccatggttgacctctgatccctgacttctgtatatgcttgggcttccatacacacatgagcgcacacctaaataactaaataaaacaagaacatttaaccttgtcaaagaggatcttctgacaatacctagtgaaccctaaaattcagacaggaaataaagaggagtttttacaatgtcagtgtgttgaaactatttcttgttgtgtgtctttggcatgtggaaatgtgaataatagttgcataatgagtgaaatattaactgtggagatttgagtagctctttgggacttcagtggatatttcacaatgacatgaaatggttcttctgagtagacagctgatatctatctattaaaattaatgtgacaggcaaattaggcaataacattggagctacacaacaatgtgacaaaccagaagtattctgaggctcaagaaaacctgagcatcatatcacctaagctccttacacaggtaaaaacatgaatttatacaaaaggcgaaggactgtatcctaagtctcatagatgagaattgatatagtcatgtctgagacccagctatgttaactcctttttttcccagagtaccttagagcactgagaatgttagctaatcaccagagatgttagctgtgtgctcaatgtatcttggcattctgagtcttaagagttggtatgtcaaacctatataattgtatttgttttgatatggggtctctgtttgtagacctggctgccatggaacttgctatgtagaccaggttactctcaagctcataatgatctacctgtctctgcctcctaactatattgttttaaaaaattgtagttgactaaaataccattttctctgctgtgaaggaaagtaacactctagaaatgtgcactgtggcttcatcttttatttttgt

SEQ ID NO: 32695 - DNA, 1164 bp, Mus musculus
tgggtttcataccatttgagccagtgtcatggtggtacccatactcttttgttcagctctcagtcctgtctctcttcgagaccagatgggctggttggcagcctagtgaccttatatgataatagcaggttaggaacaaatggaaaccgacaggtgctgctgtaaaaaatgtctcagtgttcacaggagtgttacacttgaatattgtcaagcagacaacctaaaagccaatcttcacacctcctataggcagattgtgtttattttcaccacagtggctgtgctctttatagctcagtttcaatgtcattggtgttttagaaagggttaagatcctatggaacaaaagagctttgggccagtttgacagttggtaccccctctaatgcctcacctaaatggggcgttttatgacgaaaaatgtgaaaatgcagtgattgttgggagttcctctctcactaattggcttcctgttcattaaccagttctggctggagttaagggacaccagatggttggtgctgattatagaagcagtcctggacagctgactgagatatgatcacttggcttttctggggaaagttgtacttttctaagttaatatagaagtctaaagtggctgtgatgtctacagttaatgtaatatataggaattatctttaaatatataattttgttgctaaaaatgtttcaggccattgtaagttatgcagtagaacttgtgttatgacaggaattgtaactcaagacattaaaaatacttaacctcccttattcagttgcatcagcacttgtatttctgtgtaaccctacccttggttgttatagaaaattgagtccctacaaagagacagactctagtgccatcatgtaacagaaccacttgagtttgctcagaattttgcgttacgattagcgttctagagtggacttacctgcttggtaacacattgaagggtcattttgggtttggacttccacactgattaattaattaatgcagttttaggtttttattcactggaatcggactgatgattagtactgtgtttccctttgaaaatgaagtattaaagcactgagaacgcctggctacctggacctcattttctcctctcaggttttatgtctgttgtgtttttcttgtcaggttaaaaaatc

SEQ ID NO: 32696 - DNA, 1191 bp, Mus musculus
atgagataggaattaaaaagtgtatgggttgtgtgtggaataatgggatagtccgtaagaggtccaaaaccttacagaaagtcataaaacctaattaaccagtaaataaagaagcaaaataattaagaaaatttttgcaagagtgtattttttttatttaaaagacagtaaaatgtaaaatagatttttttctttttagaaattacagcatcagtcagcatcctctcacagtgattcatttagcaaactgaactggtgggggaggggagagcagttgtggctccagttcaaacctgttaaaccagatttgctggcatacattatcctggtgtttgaaccagttaccttgtggattgagtttctactcagctgtcagcgggtctcagcttttccttgggttttcccagccttcagcatagattgatgctttgaggaaatgcccagccattattctgtatgtagtggatggccagccttccaccagttggctttcagtgtctgaggttcttatgtggtcatgtctgtgctattgtgtaccaaccatttcagctggaagtgttcattttaccagggttctggccctctctctgtccactttagtattgtctgtgtagttgcaaatcagacgcattctcacttgtcgtgagttcagcagctgtttcttagtcactaccctacctcccacccccattttcttgcccagatagttgcaaggcacttctttcttagattaaagcgtttcttccaaggtacccacagaaaatcttagtttcttgtttgtggatcacagttcagtctccctcctcacaccccttgttattccttgtctttgtgcccaattcagcctttggctgcatttccccagccttcctttctttgacactggtgttggggtaggaggacgtatctgtcttcttggtagtccctgcttcctcagcagctttgtgtcagagtcagtgggggaatctcctgagtgcttctttgggcagttctttggttttagctgtcatcgcttatgattatggcttcttgagctgacctctcatttatttcttggaccaagggagcttctattttccattttacccacagtcctttcatctgattttgttcaaagatctttttgtaattcttgataacacttgacttcaggagtactgtactttctgctgcttttgtttgtttgttata

SEQ ID NO: 32697 - DNA, 1125 bp, Mus musculus
atatctcactggtctccagacctggcattttggtcataacccactttggaccaaagaaatgttttgacctcttaaagaattcaggaggaagagatgctgagctcctgccaataaagcttatgagatagtacacttagctgaaggaattaaagagataataatttgggtgctaaatgagatcctggagcttttagaccatttactgtcaaccctaccctcagatcatttggcacacagctagcaccaagtgggtgcaactaaggaagtcacaacttttcatgtggaatctgagtgagagagagagagagagagagagagagagagagagagagaattcccaatgtgaagcagtcccctagggccactccagcagggcttgggaccccgagaaggcaccttagccacagtacctttctgagttcctttcagctcaggtctgaacaagggctggacctggaagcctgcaacacttcgcctgctgctccttctgtaaggacaaggcagctaagactgggttttctttgatgttcttttttttttccctacgtatgtgctcagctcatggtgatcactgaccagataactgattgagcacaaacgtctcacattcaaagaaatggagtcattcactctcattgctcgcaaatacaatatcaggacagcaatgcaaggaaaatgatctcttggttgcttttcctgagcctacatttaaggtaggcaatatgatgtttgataacaatgattcatttcagtgaacattttcaagtaaagctgtctggttcaaagcctctggcttgtgctacactctgaatactggacctcaccgggactcctttctgatatcttgttaagctgtgtcatgtagctcctgcagctttagttctgtaagacatgttccagcagttaatagatgaagcagatgttgcagtgagcccactcaaagccctggatctgggtagtagctgagttgtttaacccctgtcagctctcttggcacaccaccagggatagccctcccacactacacaggtgaagggcaggtacagttcacctactgctcatgccctcagggcagtctctcccatgcccacagcaccagctcagctctactgagctgcccagaaa

SEQ ID NO: 32698 - DNA, 1188 bp, Mus musculus
cctttcaccgtgcagcctgtgcaacaatggcacacagtaccaagaggaagtatatcatttgccaccccaccctgatatgtttcttctcctaaaaaaaaaaaatcacacttgctctcgtcatcctcacttgtgtttgcttttcatttgccttatttcccttctatgcagcgctcagctcagttccttgtagtcccccaagcagttggtaaagagtttgtttagaatcctgaatgaacaacaccctcactgcacttgtgcctgccggatctcccagggtgttcagctaatgatcagtgtcatcccaaaaagctgaaacagggtgacagcagctctgcccaacaaagggagttgaacaggctgaggccttgacttgactgtggctgtggggagaggtaagttggtttctagagcttccatagtgggacacccagacacttctgagtttcttctacctcacagagatggtgtgaggctatagaaggcctcaggatgcggccccttggttcttcatgagaaagatgaactaaaataatattcccagcctgcaagaagataaaatacaggtagagctgttttgtgcagcagttaacctacttgctctctgcctttttcttggatcctcatgcctctcactagttccagaaaccagaaggcaacctggggatattgagatgacaatgtagaggtaccaggcaaacccctgctatacattctctgaacaaatcactgaatttccaaggaaatagatccccctttaaaggatgtacaaaagtgtgtctgcattgatgtctgtactgtaaatttctaatttatcactgtattaaaaaaaacttgctatttaatttttgtattaaaggaaaataaagttttgtttattaactggtgtgtgcattggtgtgtttttgaaggtatatgggaagcatacatgcccagcactgagaaagagaggggtcagttggtttggcaaattgagaaaagctccttggctcatgctgattttctccttgtgggatttctcctgggtcatcaaacccccacaatctaaggtcaataaaagcaaggagatcacttgttgctctggacatagctatagttctcaagttgttaccccaatgataccttctctcccttggtatttccaagagtgctcatctttccttttgaagtttaaaaacagatttcttactg

SEQ ID NO: 32699 - DNA, 1240 bp, Mus musculus
attaacagtgcctttaaaatacatggactggtgcagagtcatttgttagagcagtttgtggtctttagttcaaacaaggatctagtttaattgcacacccaaactgcctttggaaatttcttgcatgtcagcgtttggttgactttacatgcaatgtgacttttcccccaaattattctcagttatctctctccttcagctggaatcctaggttactgggttatgaatgtgtatagtgattatgctcaatccatcttgttaataaataatgattgatgttcagttatgtaccttgacagtggctatacaacagcttttgctatccaagacaaaaagcactaatcaacttcaaaataattgacagaaccagaatgatttttctaccagcatatgtgtaactaggactctagattatcaaacccaaactataaaagtgacacacaggtcaactgagtattctagtcgtgtagctacttgtttttacctagtcacaatctgttctggggccggagagattctggtccagtggttaaagagcacctgctgttctttccaaggacccgagtttggttcccagcacacacagagtggcccacaatcatctgtaactccagcgacagagcctgacactttctgttccccaaggataccagacaggcatgttgtgcacagacatgtgtgcaggcaaaacacccacaaatattaaacagaaatgaataatcttaaaaataaatgtgttctgcctattcaatgatttggtagatagaggtccaagttatttaacaaactgtttcctcggtttggtaaccgacataagaccgtgtaattgcctacgacagttctgggtcagtacgtgtaaactagtttgcctggcttcctgagcagctggtgagagttaagttttggatgaccttttctagttgagttattcttgctcttgcaatagcatttggcatagcatgaacaagtgagttttcatttccaagaactctcaaatatgacatatactcctggcatgttggacatgcatacttatccccagggaaaaaagaaagaacaaagttaagtatctgaatcattaaaaaaattattctatatctacaagatggatttttgcataggatgcatgtataagcctggttttgagataagtaatttcttatttatttatttatttatttatattctttaatccttttttacagtccagaccttatccccttcctggtttgctctctaa

SEQ ID NO: 32700 - DNA, 1196 bp, Mus musculus
tcctcaccctcacaccttggttgtcccaatgctgtgacttgctttggcgacctgcaagcattatctgcagaaggggcagctaggtgtcagcactgtcactttcctaatcctgttcctaagatacaatgctttaatgtgtttatcatacacagctttttttttttttttaaagaaaaacttagaggaaaatcagcatggaaggtaaaataactatacctaaagtgttaaaggaatctgccgctgcagttttgtcagattgactgagcatttctctaacagctttggaagagtatctcactctttctgtaactctgtgaagtagaggaaaagtacaacactcgtagtaaaactaatgccacccatgaaatgtcttacttagagccttatttttttcaagattccagggaaatattaattcttactttttcttataaatcagtagcatagatgcaaaacttagtcagctgggcatcaaggctggagcttgggcttctaagcaaggaagcgccctgggtttcctggaataccttagagcctggtgctctgttaattttatgtttccaattctatttacacagatgcttgcattgggcaatcaggttggcaaactgtatgtttgggatttagaagtagaagatcctcataaagccaagtaagtatagacatttctaaaatggtctaaattgtagctttcttatgccatccttaaatcattaatttttgtggtgctgagggtcaaactcagggccttccttatacctgccaggcaagtgcactaccactgagctgcgtcatagcctaatttcaattaacttatttatactgtggtgacagaaacatataccaaacgtgatgaaatttgagaatgaatccttgggggagggtgggtgttcgagacagggtttctctgtgtagccctggctgtcctggaactcagaaatccgcctgcctctgcctctgcctcccaagcactgggattaaaggtgtgcgccaccactgcccggctgggaatggattcttaatgaagataggctggttttatactacactttttcttcttcgttctttaaggtaaatgctgttctgtttgctgtttaactcttatcatgtttcccctagatgcacaacactgacccatcataaatgtggcgcggctattcgacaaaccagtttcagtagggatagcagcatcctca

SEQ ID NO: 32701 - DNA, 1108 bp, Mus musculus
agtgccttgtcgttttgtcacgtcacatgaattttgttattttgagaatgctgcatacagttgggggcccttaagattatttattttcctcaataggattcgctggagagccatattttgtatagtctagtgaagccccccaaccctggggattaaaggtgtatgccgccattctcaagcttcatcaaggatacttaataccatatcattggctgtgtttgtttttccagtttgaaactacagcacactctcagataaaccgtttgtgtgtgtgtagacacacatatatatacatacacatacacatatatgtatatgtatatatatatatatatatatatatcttatgtaggcttgactttttgtatctctgggataaatgtttagagtagttgttgaataatggttgactttttaagaatttgtcgaactgtcttccagagtgccattttacactctcatcagcaatatatacacagtccagtgtctctgtatcattgatattatttaatactaccattatttttagttgttccaatagatgtgtagtgaaactttatcctggtcttgatttacactcactgctagtaatgctgctgaacatgtgcttatttaccatctgtattagggttctcgagaggaacagaacttacagaatgagtgtatatatatgatttattagaattgttaacccaacactggctgcctatgaatgaaaggtccaagaatccagtagttgtttagtacacaagactagatacctccactgatcttaagtacacaacacaatttcaaagaatgccagtgaaggaatgaacttgccatcaagagcaagcaggcaaagagtgcatcctcctttgtcctttctgtgggctgctagcagagggtatcatccagactaaagatggatcttcccacctcaaagattctaattagaagtggctcttcttcaaatgatttgagagagagaaaaaaatccctcacaggtgtgcccagccatttgggatttagttaattctagatagtccagttgtatactagacagtcaagtatagccatcacaccatccatatccttttggggaatatttcttggaatctttagctgg

SEQ ID NO: 32702 - DNA, 1153 bp, Mus musculus
ggctcttgacaggtctaccacacgaacacaccaaaacttgagcaccagcaatgagtcatcctcttctaggcttgcttgtgtggtagacctgtcaagagctgactctgagaaactaaatcagttttgttgttgtttttgtattaggactcttctaggaatgtgaagtctctttcctgttgcttctttgtcttgggagaagctgtgtgttcagtgctgtacacttttactagagtctgatatttaactccgaaagccacacatttgcattttagttcacattgttaaaattgttgacttttctaggtcattgagtagaagggtctatctgaagtactaattttaagtccatatacttgttttagtttgtcaaaagtagggtcacttcattttatgttctagatatgaagtgcttagcatgaagccaaattacttttatccccttatcctagggctacaacactttccaatgcagtctcttctttggcaagcactggcctatctctgaccaaagtggatgaaagggaaaaacaggcagcattagaggaagaacaggctcgtttaaaagcattaaaggtaagtaagtatgggcattttgtttggaagaacaagtaggggatcattatataaatgaacctcttaggttttaaatgtgttagtagtcctacaggctgaaactcagtttatttttcatacttacatgggatgcttggtgaaaagtcagggagtacccttcagcttttaaagcagacttagaagatgtccattttcagagtctgaaccaaaacagatctggttttcgattccttatgcttagttcctttttcaacaggaacagcgtctaaaagaacttgcaaagaaaccgcatacctctctaacaactgcagcctctccggtgtccacctcagcagggggaataatgactgcaccagccattgacatattttctacccctagttcttctaacaggtacaacaggcaataaggatgtctgagtatttagtgtaagatagtcttcaaattatatgtttataggttctgtgagtttgctttgatttatgattttgtattcacaaattaatactaaaggtgtaaaataacacaattggtatactatctaaatataaatgaataaggttagggttatattttgtat

SEQ ID NO: 32703 - DNA, 1148 bp, Mus musculus
gtccacgccatgtcggctgctcctcagggagcgagtacatggggaggtgagtgtcactgtcttctgggtactgtgtgggcagcttcccttgcagtaagcagctttctttctggtagaggttttgcttatacttgatgcatgggaatttgagaaataataaaatgacagtaaactgatttttatctcctgatgaaaatttatgataagtgaaatactaaattcatagttaattatggaataaggtttaatgaagatgaaattaaatataagagtaagagccactttcttacggatgaggtcacgcctgtaatgcggatgttaagtgtacagtagttactgtgtttgcggtaggaaacatttcatagtgggcaatatgataaggctctagtaaaacgcacattgttatcaaccggtgaagcatagtgtggccagagatcacatggtaattcttgtatttttttaaattgtattttacttttatttatttatataattaacttattttatgttaaatgttggttagacttgtaacaggaatgtccttcagtaggtttttagttctaagatgatcatggtttaacacctttaaagcagattggtaatgtatgtctattatacagctttagttgatttaacatcatcacctttgcatggttttgttgtgtgtgtatttatatacacatatatatgtatgtatatatgtatatgtgtattatgtgtattatatagtcaccaaaaattgctggaaagagattatcagaaaaatgatactaagaagaaaactataaaatatgttgaaatttgtatttgctttcatataacatttgaattattaaatttttacagcacatgaaatagattttcatctttaatcatttgaattaacaatatagtttggatgcttctttcctttctccctctcccttaccatcctctccaaggctcctttgtgtttttctttttttggtgtggtatttttgtgagtattgaatccagggcattgcacacactaggcaaatgctctgccattgagcttcatcaccagcccaaagacgctgttttgtatacaagaatctaagctcggtgaaggcaagggttatctatcatagagaacattttgtgatggttgttgtgggggcttgcttgtg

SEQ ID NO: 32704 - DNA, 1160 bp, Mus musculus
actttttttttaatgtgtgacagttggggtgaagtagggaaagggaaagtaggtaggagaaattcagagtacagaaggtcgtaggtagagagacagcgtggggttttagatgacttcaagttttaagaaattatcagatgcaaaattaagataaaatataagaataggtttcatttatgtaatgaagtaaagtcaggaataaatgtatgttgtttattctgagtttttttagtgggtgattttaatggaaatgtagctggtgttgatggttcatacctttaatcttcacacttgggctgaggatcacttggacaacaatgtgatagtatatcttaaaaaacaggaatgtgatataatgaagagaacttttgctttagaactaggtttcttgttaagcaatgtattactttcccattctattcccattcttaaagataacttacagttactctgtaactgatgagacagtgagtggagaactgaacatgtgtgtgttgtgtttgcttcctcttaggattcagtccttctccagttgcacagccacattcttcagctggccttaatgttgactttgaatctgtgtttggaaataaatctacgaatgttgctgtagattctggtggtaagaggagagtttttgttgtttttatttaaaatatgataggtgacatgttaatgtcgatcctctataggaaacatgctgcttttaacatttataaattagagaaattgatcttcttcccccaaatcacttgatgagaacttaaaagagtattaattttacctttttcttggtagcattttagagtttaggggaacttttgtttgttccactatataataagaaaacaatttcttggtaaagtgctaaattgttagtgactatttggaaagtactatagcttttggtcatgacagtttttcttctactgaaatgaacagtgaccagttggtcttacagtgtgtgagattatttttaaactgaagacatagtgcgtggtacctggtttatttagatagtttctatataacttaagtagagtatgttaaagggtttatggctacaggctttaaaaagtcattttagtactgattattattaaggtgcacctactaatttatattttgaaaactataaaactctagaatgaggattgtac

SEQ ID NO: 32705 - DNA, 1226 bp, Mus musculus
gtgtgtattcccatctagtaagtagatttggatgtgccactagtgatctggctgtgctctaaacaccctgagacaacttacggtttctgaggctgattctctgggatcttggaatagtactgtctgttatcgctaaatatttcttgatgacatcagctttaagaggatgtgttttattagtgttactatataaaacacacaagctgagtaatgtgcagtgaattgaaattcgtttcaatgggaaatccagtgtcaggctgccagcatgtagctaaagctttcttggtgcagtagaagggcagtgatcatgaacacacagcctgagggaagttcctataataatgaatgaacacactggtgtgtgtgtgtgtgtgtgtgtgtgtgtgtgttcacgtagaaaatggttggttgatttaggtgctgagaatacagtccagtggtccagcacttgcctagcactcttaattgtgaaaggaaggaaagaagagagggttagacagaaggaatgggtagaactattagtatcagaatgtagaactcttaaattccaactacatgaactagacaaaagggcaatgggttcattattatagaactggatttgttctgtgtgttcatggtttctcccccccccccccccaaacccaacaacagttaattactttctgttccagaggggtaaggggtgtgtgtatgtgagagagacagacagacagacaggcaggtgtcatgcactgaaacagcagcaaagcatataacctttcatatttctataggttggattagtatgtttctacactaataaacattaggtgtaaaagtaaatttaagatgttaaattttaaaattagagacgttctaattttctcttatctgaatttggaggcaagtctgtacaaaggattttatcaacaaacacattttaatacattttggaatgatcataatatgtaagtccctggtgataactgaataagtggtaaaataatgttgccttcacctgaggaaccttaaggtgagtgccatttggaagcacaaatgaatgagtggtaaagtgagcttctctaagagggatcatggtacagatacagcagacaaccaagagctacacagatgcaggggcttctgacgagagcctccgtatgcataggggaatgtgtgatggtcagtgctaagtagtgaatgagctcatttgaattcctgatttctgccaggcaggatgcaga

SEQ ID NO: 32706 - DNA, 2017 bp, Mus musculus
gccatgatttaagactaagatctgtctttttggtgactaacacttcagttctttcaactcctattaatacccataatcagtaacctaccaagaaaagcccgtatttggaaagtgtggagtttgtgttggaaaagctgcctggagagaagagttgtgtcctttaccatagcaacaggattcattgggggatcaaaatcataattttaaattatgcattatatttcttttctccactcctcacatatacagaaaccataattgaagttaacttttctttttaaaaaaaatttatattcagtttgcagtagacattccttaagtatttgtatttatttatgattatcaattttacataacattaatattatatcagacctccttaagaaaatgagtatggatgttcacagtatgtttgatttttatccacaagaatgaatctgattcagaatgcttttcagctgacatacagagcactaaatactttacggcaaatccataggtctgaatctcttaagaattctcagtctctctgggatgtagggcgcattataaatgcattaatccttatagtcaatcctgtgcctaggattttgcaagggaacagttcactgactaggaaaagcactacatttaaaactcagcattagtgcattgggaaggatctttactgctttgtgcttggcatgtcgttattttccatttgacattagggcctttccaaatgaatgtgaggagttgctttcacttcaagactgtccttcttttcagtaaaactttaggagatgttatggggaaagggagggaacagaaatccttgaactttttatttggcgtgtgccatgttatgatcatgtaccttttcaataaggggagatagtatctttaaagtcaatgtctagccaagagtttagttaatgaagaattaaactgcactgttgatcggtgctttctgtaaatacatcttatcgcttgggttgagaggggccttaagaaggacagttcattgtaggaaagcaattctgtacatgagttaagcatacttgttgcattgtctctgcagattctatttttgtttacaatattaaaatgtatgttagcaaatgggtggattttcaaataaaatgcagcttccacaaaacatgttacggtgttctggtttgaggtgtgttctcctttttccttccttttttttttttttttttttttttattattattattatcagtctcatcagttttttgctaataaaattatgcccaggaggttattatatcgactggtcaaataaaatgtaaaatttgtttaactatacaaaaagaataatgtctgaattcttgttaccgtctggactcgcttagacacattacttgcacttgttcactttccttcctgaggggacgccgtcagtcaggtaagttaagggagaaagtacttgctcgtcagtgcgtaagactgtgtttgctaaagaatgtctgtatcatatagtgtagtggataataaacgagcatcagagtgcatcaaagagagatcaaaagctgtatactgctaagtgtttgttctggtatggaaaaaaatcacagtttttagccattgtgtttttgttaatgactgattttcaaatttcgctattattaaaatgtttccatatgaactgagaaattgtgttttaaattaagaatccttaaattagtaaatattgatttattttggttttttgaatgggtattttaaggtatgtggcttaaattctttcatgaccttttttgatagtgtgtgcatatgaagtgctttataaccatctccattttattgcttaaatacttctggggtctgttgggtaagaattgctcacatccggtgttggtccagggagttaaattagcaggtagaataggtggctagacagtggcatggttccttggcttgctgtctgtcattcattcacaactgaatgggcatcatacccctgcagtctagactgttggccacttttgactccctgaggatcttctgtgaa

SEQ ID NO: 32707 - DNA, 1198 bp, Mus musculus
ttattttgttttcccttctaactgagattgaggcgtgctcacttgggccttccttttgtatgacttcttaggatctgtggggtgtatcatgaatattctgtactttttttttttaacatctttagccatcagggaagtacaaatcaaaacaaccccgagattccaccttacaccaatcagaatggctaagatcaaaacctcaagcaagagcacctgctggcgaggatgtggagaaaggggaacatagctggtgggattgcaaactggtacagccactctggaaatcaatctggtggtccatcagaaaatcagaaatagttctgtttctatctaaagacccagctatagccccctgggcatatacccaaaagatgttccacaatatcacaaggacacacgctccactatatttatagcagccttatttataatagctagaaactagaagcaacccagatatccctcaaccaaagaatgcatacaggaaatgtggtacatttatacaatagaatactagtcagctgtctacagccataccatcctaaacgcaccaccctatctcctctgacctgggaagctaagcagggtcgggcctggttagtacttagacgggagaatactattcagctattaaaaacaaggacatcatgaaatttgcaggcaaatgaatggaactggaaaatatcatcctgggtgagataacccagactcaaaaggactgataagtggaaaagagacactaaatcaggactaaatctctggatgttaaatccctagttcaaggatttttcagtatttatgttacttataatcattagtatagaaaacaaggaaacaaacaaatgtgtctttgaaagattatcaatagcagataccaattttgtttgtacttgaagtcttcataacgataaaacatatacataaggtcactcagtcagccaatgtttataatatgaaatggatacatgagaacagacaagtaactgaataaactagggatgagatggaatcgtgatccattctggaagtttatggtcactcaagattgctttgtactggggggaggggttgcaaagtgcaaagcacatctgggtaagaaggcatgctggaaactatccgggtgacctggtgaagaagagtcagggtaagaaaatggagacctctctaaagacagcaagaaagagtcagggtaggaaaa

SEQ ID NO: 32708 - DNA, 2888 bp, Mus musculus
tgctctttatccgcgtttacccctttctcctcccttacaccatgtcaaacaccttagtgggacatcgtcaccggacgcatttcagaggcggaaaaaaaagtaatattaaatcttttaagtgtttagctaaaagcatgaatgtgacactgtaaccaactcctaatgataacctgtgactattaaatctctctgacagtttcttttttaggtgatttccttcctgccaggctccgttgtaggggttacagagcagtcgttcccgcctcacaacctggtaaggatccatctcttcccgtaacgctcatgctcggctgcttaggctactttaatgggcagacatctcaatgtgtgtgtgtgtgtgatatctttttctgtttgtttttctttttgaaaggtggtgggaggggaatcttaatttgggccttgtccaccctggaaacagacttgtgctggtcattaatgtacttaagttgcttctggttgaaatagctgttaaatgtgtccccttgttcagagttgcgtgtacctagctcttctgtccccagtgtggacatggccttggatgacatcggttccaactgtacacagaaacctgctaatagagatacagtttggagacagtcaaacaggtgaagttgaatggaagttccgagttgtacaaggtgcaaattggaattccaattgtagagcaacttttcagaggttgacaataagtattgaggcatgcgcaaatgtggtatttttctggagatgacaagtctcctaaaatacttaatgaatgccttatagttttcagtagaaaatgcagaaatacagtctatttaaagaccctaatagttcaccacttgagaagttggaaattaacatacccatcagatttctgtgttttaattagaagacgataaatgaaatgtttctttgaggaccagcacagtaattactaatcaatgagtatgaagaaattgttgaaagtatttatttttgttgtattaaaatttaggctaaatttctgtatgattagatattgaaggttgtgaaatgtgaatgaaaacatgtaaagtgaggcttcacaaagaatcttttctccatatttctaaaacttttgtcctatttaaaaatacttgtttaaattaatgaaatgatcgatactgtttttccaaagacggaaaagtctttccttaaaatactgtttttttgtccacttgtcttaagtgtgtgttctgatgctctgaaatgcaagagacattaaattctttgtgaaacatcactgtttgataaaggatatacgtatttagcatccttgtttttctttgtgctaaagtggatacagctgttggggcagaagagacgggaccagctgctggccacatttcctgctttattttaaaaggtagtataagaaataaggaaacagaggtaatatcagggcttctgctgtcttttatttttaaaatgttcataattaagtattttccagcagtccaaagatgtaagttatcctacacgtaagatgttttattttgttacttggttatggaaatggaatcttgttcttgcacaactgtaaatgttttgttgctagataatatgattttgagacctaaattagtctctggtttttcagtctatcacattttgtaaaaatctctactgcacttgagcatgaatgggtagtagccaaactcacaacttggagtgacggacctgcttctacaagggtaggatacaagccccacaatgcagctgcatggatttcagtgcctatgaattatatatatatatatatacatagatatagaaaccaaaagtagttggaaatttatttgaaatgactaatttgtgctctttctgaagtatgttaaatgtagcttttgaaacagaagccttgaattgaaatttaatacttgaacatttttgtatatatttctttgtatataattttgtgcagaaccaatgacaaacatatggtgtcataataaaatcaggtttgttgatctttcagttatgggctcaaagaatttattcatctctaacatgatattggaaagtaatggatgaaaataggaaaaatggttgttaatatagacttaatcgaaaggttctggaagtagtaagtttgttttcctaaaaactataccatttctgtggaatattttcttaacctcagtgcttttcctgcatttgaagtgtgggcttggggaaaattagtttctgaattgggatgttttgaaattccaagtacagagtcttaggctgtcatttcataaatggcagtttggagaattaggaattctcaacagtggaagatcagagtgtcctgtttttaaagctgctttcttaggttccttatgtcttattaactgtgtttttgtttccatttcattgtttttttctagttttggtgacagtgatttttgtcattttttttgcatcaactcatggtcttgtttttacatggtaactgcatgtatgtaggatctatcaggggctttaaataaattttgctcatatttatgtgtaagcacattttactgtaaatgtttgggtttaatttacagcagttgtttatttcagtgtgtagtaaacagtatctagagtgttctgttcactacttgttaattaaaaaagttatgattaatataaaactgttgtcttactatttttagaaaacttttgtgaataattagtattttgatagagagttctgaaatacaaaatagattgctttgaaaatttcaggtttgggtgtatttactgtgatgttgagaacaatttagtatttggggaactgtttcaggttttattcttgatttgtacctgtgtaaaaatgatagaaaaccttaaaatgtagcttttaaatacctgtcttcctatggtagttaatattc

SEQ ID NO: 32709 - DNA, 1206 bp, Mus musculus
tattgtctcttcacagcagtaaaacactaatttaggtggccactaaatttgggtgctcgggtcctaacttgaattctctggaagagtagcaagtgctcctaacagccgagaggatgtattaattatgtttctgttgctaaataccataaccaagcatcttagagaaggaatgatttatttaggtttatagttccacaaaggtgtcaatcctggcagggagctataattatagtagcaatctgctagcttgctgtagctagctgtagtaggcatggcagcaggagcagaaagcagagagctttgaaggagagagaacaaaactcaaagtgatggggggctttttagctcttagagcctagtctcattgacttcttcctgcaagactgcactgcttacatttctcaatcaactagggaccgtgtgttcaaataccggagcctttgtcattcaaacagtaacagccatgttaattggtttatgttttaaagactatcagtctgacgattgaggatataatagactggagggtgagaaagaatataacatttatagtctctcgattattttcttgattgtagtgagttttgcttcactgatttggctcccgccggattgtatactctcctccctctccccccaaccccatccccactccaaggatctttggatccttgaatgaaagacacacacacacacacacacacacacacacacacacacacactagcttatttttaaaatgccttggctacctcaaaggctgggcactcctaagccttctcctgctaccccaggcccaactggggaagtggccagtggccacttacccgaaatctcacatggttggttggctttatcttctgccactccttcatcccatccttctacccagagtcattgagatctcctccattcttctctgcatcctacctgcacaactgtaagtatcctagcccatgcccagccattagccattggcatctttactgatcaatcaaaactcaattgggcacaaggaccttcagtgtctggacatgcagattccggattgaatcaaagccttagaatcaatcttcaacatatggttaccacttgggggataatctgtttccatttaatggtgtcttagtatgatcaggctgttgtaaattagagactgggaaagttaaacaacagaaatttatttcttgcatttaggggctggaa

SEQ ID NO: 32710 - DNA, 1183 bp, Mus musculus
aagaaagtgtagcaacacccactgaaattaaaacagaaagtgatacagttgagtcagtttaaataaaatgagaaaagtatgcttttctttttaaacaaaagctgctgttggatctaggtgaagaatttttttatgtatatatagaaatatctatattaattgtctagctgtggcagggccttcagctatcatttggttaataaatacattttagtatttgcatttcctactgcctgcacagtttcaggtgcttgttgtgtgaaagttctgtagatgagtgcaaatgtaacaaaatgaaattgtatgtgtacaaatgtacaattttcacttgtgaactgtaaattataaataaaaaatatttttgctatccatggagtgtaatatttatgcacaccatcaaataaagacagtgtttctatacttttattgggcaagaatggaactgaacagcaatcttaacatgatggttttttttctagtagcttcctgggacttaatgcagcaaagtttcaaacttagtttttctcaaatagaaaagcaagattaaaaaaacaaaaaggacatatgtgcttacatatagatatgtatctccagctagagtcatccacaatgtccacttttggaaagtatgtaatgaaacagtaatgcttatttaaacttggacactgatgccatcaagcaactaacaaatatatttaagtactaaaagtgattttactttttagaaaatatttttaaaattgtcaatttaatgcagatgaacacatttctattttaagttacagggattctgtataagaatgttcatatgaaaaacatggttaactttttttctttgttggttttgattgaattagatgggtaacatgagatgttaatattcatacatgtaataaactgaatgatgaacaatcttggtttgtatttcttgagtgaccttagaatgtgacccttatgtttaatgtgtgttttaaaacatgagtgcagtgccagttatgagccatactcccagatatgatattattccatttatagaagatacatatacagtattaaaacttgtgattttttttccgtgggagatggaaggcttttttcatgtgatttctttgattatagcactaaagggtactctggtttgtgaataaaattgagcaactccaaaagtacagtgtgaaacctg

SEQ ID NO: 32711 - DNA, 1257 bp, Mus musculus
ggacaaatggggggaggaggccctatgagatttgaaggaccacaaggtcagttaggaggtgggtgtcctttgagatttgaaggtcctccaggaccagtaggaacacctctgcggtttgaagggccaattggtcaaggaggaggaggtggttttcgatttgaaggttcacctagtttgaggtttgagggatctacaggtggtttacgatttgaaggaccagggggtcagcccgtgggtggtctcaggtttgaaggacatcgtggtcaacctgtgggtggtctcaggtttgaaggacctcatggacagcctgtgggcagtcttagatttgataatcctcgaggtcagcctgtaggaggacttagatttgaagggggtcatggtccatcaggggctgcaattaggtttgatgggcctcatggtcagccaggtggtggtggtggtatcagatttgagggccctttgctacagcaaggagttggaatgaggtttgagggtccccatggtcagtctgtagctggtctgagatttgaaggacataatcaactaggtgggaaccttaggtttgagggaccacatggtcaaccaggggttgggatcaggtttgaaggacctatagttcaacaaggaggtggaatgaggtttgaaggtcctgtaccaggaggtggcctgagaattgaagggcctctgggtcaaggtggtcctagatttgaaggttgtcactctttaaggtttgatggacagccaggtcaaccatcacttttgccaagatttgatggattacatggccagccaggtcctagatttgaaagaactggtcagccaggtccacagaggtttgatggaccacctggacagcaggttcaaccaagatttgatggtgtacctcaaagatttgatgggccacaacaccagcaagcatcaagatttgatattcctcttggtctacaaggaactcgatttgacaatcatccttcacaaaggattgaatctttcaatcattctggcccatataatgatccacctggcaatacttttaatgttccatctcaaggattacagttccaaagacacgaacaaatatttgatacacctcaaggaccaaattttaatggaccacatggccctggaaatcagaatttcccaaatcccattaacagagcttctggacactattttgatgaaaagaatcttcagagttctcagtttggaaactttggcaatttgcctacaccaatatcagtaggaaatattcaggca

SEQ ID NO: 32712 - DNA, 1126 bp, Mus musculus
ggtaattctcttcccttagtcttactataattaacaagccaccatggtttaattctttgaaactaaaaacaaatggaggggtaactagtgggggtaaatgaatttaacacacgatatttgaagattatttggaggatttttgtaggacatggcatagagaggaatataaaagatacttcacagttgaaagaaatagaatgaagactatcacacccaagccatagaaacacagattaggctgtgttgggaagaatatcgtgaaaaaaattggaaccctctgtagtagccgccttcctgtcaaacaaatgatagatacaaactgagcaaagaaaatgtgcacaggacctatagagttgagaggattggcccagatgctctataaactcagaatcctaaatagcagtaccttttcttatgctcaattaaatatatgttgaccaacagttgatgatatttttttttaaaggcattatattctgtcacagccttttagggaaaaggttgggtcacatgtccttagaccaagacactgatctgccattaagtcctaagctaaaaactcttgttcgtccctgttgaaatcaaactggcttacgggttaaaaatggaagaaatatcatttaggcagaggttatatgaaatcatagaaattattcatctcatttggcctaataaacagtgtgttctcttcaggatgttagaagtaatttagcataggagaaccttccattagagaatccccaacagttcagtgttcatgagaggacaggaggatcacagggaggacggcatccttaagatctgcttttggaagtctcaaatgacatttggagattttgctgattgtggagaaagagaatttaaaagagtgaaggccaatttgcttcatatataaagtaaatgcatgcacaaagtacaaaacaggtctttaacgtgaaaataaaataactaaaaacaatgtttgctaattaaaatgtgtgagccaaatgatcacattgtaaagctccttgccccctttccagtctgatagacttacttggtttttagaaaaggaaaacattgctcttgaatcagtatggaatgaaacacacttgaatatggtgagactttctctgactaggtaaga

SEQ ID NO: 32713 - DNA, 1114 bp, Mus musculus
ccttgaaaatgatgtggatgaatgggtcccccctaccaccaagaaagtatttatttcagatattcttggattcagagtcatgggtttaagaaaatgccttgatctccattattcccctgacccaaaagagttaccaaggaagaaactgataaaagtcacacataaaaccaacatttaattaagaagttaaagactatacctatagttgcaaaaccaaaagtgctcaaagcatgactataaatgatgaggctgaaaataggaaaagcccagttggggatggcttttcagaataatacttttagtgtctgatacaaaaagcacttagtaactgaaggtattttcatataaagtcacatgaacccagttcccagaaattttaagtgatggcagatctgtttggaaatgtttgctttcactgatacagagagcagtctttatgttttgaagacttacaggaagtcgttaataggagtggactgtactgaatgctgttggatctttcaaggtttccaccatggctttctttttttctccagaatactgtgattaagataactgagcacttctctttacattgactgtataaatatgttgattttgtatttaaaagtatttgttaaaatatagacatccagaagtaaagtctttataatccaaaatatcttttttgttataattttttactatttgaaaatttcacaccttatacccagatcacactcactttccagtcctttcaggtctgcctgctacctttgtgacctaacaccttcccccccagcccccggcctttccccccaaaaaaagaaggaaaaaaaagatacaagtccagtttgtgttgcctatatagtcactgaagcatggtctacactcccagtcatcttccacttaaggcaaacgtggtctttccccgctcacacccctgtcagaagccctcagttgcggagagctcctcttcagcgtctttatcacagtttttaagagaactcttccatggtttcctgtctaagctgctactgttttttgggtaggtggatggggtggtttttcacccaagcctccttatgttcctcctcctcaactgagtctgcagtcattgctgccactacagaag

SEQ ID NO: 32714 - DNA, 1175 bp, Mus musculus
atacgtctgaaaccctttacgtgtgtaaatagtagtgttggtcttttgtattttgagaaaagggacagctgcattttttttctttcctttttattttttttatacagtggattaaagtacctttcattggcaacacatatcagacccctttaaccaatattaaagactatcagaccaaatgtttatgttttccaaatatgtcttatcactggttgcagttttcaatagaagctgattgccctgtcatagccataaatcggaattatgaactttgtttcagattgggtgtactaaaacgctcctttgactatttccttaaggatatattgaaatgcccacagagtttgaattatgttctgtaggaaagtgtagacagttgttttaggatgtgtacagttgtagaaggtgccaactttaaaagctcatgtttggttcttaaggttttctttttaaaaaaaaatgcattaaagtaatttcgttacatggcctgctgtactaacatctgttattactgtcgtgagaaaatttttatttttaaaaccggtgtccatgttgtgccagagattgtaggatggaggggaggctacctttaaatttttttctttatttatcgttaaaatgtttcagcttaaattaatctttcctgagtgtttttttttctgttttgaaggcaatcccatcagttcgtctgtgcagttagtaggaggggccggactggtgatcctaggctgtgttaaccaaagcaaatgtgaaatcagctggcatcctgttgataactacttcaacaaaccatattttgggcctttgtttttgtatataaagataatgatacactcaaaaaaaaaaaaaagaaagaaaattggtttagtaacaaagaggaaaggttatcttgattcttatcataaaatgctgataaacactgtaatgcatttaaaaagttctatttctgaagaataatttcctcgctcaaatgaaaaacctttaactttttctggagggtagggaaataagtcagtcttttgcatggtatgtaaagcgctctctactgataccatttcctttttccctgccttagctccagtggcctggtaaatcactccttaccacgccacactcattccctctttcctcaatgccttttcccactcattcaatccacaaatggctcatcaatt

SEQ ID NO: 32715 - DNA, 1179 bp, Mus musculus
cccgtggtcaggaggtggagtaaccagagacatcacagacaccctggtggctatcaacatccatgacggggcccatcatttagatctccgagcccacaacgccttcgatccttcctctgtgctgttatctcgattattggaagttaaacacatgaagaaatggattttagatttctatagcaatatccaatgaacaattttttaaaattaatttttttttgttttcttttatgttccctccacccacatacccattcacttttatgtaattcacttatatgtaattactttctctcatttgtcattatatttgttgagccaaggccaagacacaagagagtgacaggggtgggcacagacatcccacccaggtgactgctccggcctcactgtctttgtgtcatcatggcagctcacaggccatcagaactggcatggctcctcactgcctttcaccagagggagagcccctctcccagcagcagggaggtctccttggttctgaggctgaagtctctctggcccattgtaagtccccactcctgccacaaaagggaaagcagaagccgggttcaaaacgctgcagctgcagctgatagaatgtggaatgccagtccaggaaaccgggctgcttcctgtgagctcactcagtgagtgattctgaactgggctgccataaagaagaaggcagagacctacctgcctgttgcttctgtctccttccagctgttgggaggtcagtgtgcctgggctggctgcttttggaaagtcctttctttatctctttcccacttggcagctctccttacttctgggacatttgccactgtggtactgccaggaaggaatctggccttgtcctgctctctttgtttccaaggccaattttatggtggtctggctacattctgccaatttaggaaaagtgctatttttgttttttggtttttttttttgttttgttttgtttttttactttaaaactgaacaaattctgttaataaaaattctttaaaaattgcaaaccatttattgaaaaagtagaatgtacttctgttcatttggtaaagaaattttatgttctagtcattgttaccagtatcattatagccttaggtgtctggattcctagcatcaggtgtgtggggactttcctgtgtggcttctagaagacaagca

SEQ ID NO: 32716 - DNA, 1099 bp, Mus musculus
caggttcttctcaacagcagccccccagtttctttatttcttagtcatgttcttaccatggcttggaaacatttctcgcttttcagaaactatccctagagccctgataagattttattttattattgctttcttggtttcgagattataatataattacaattacatttctgtttttctctttcctccctttaaattgtcccatataccccaccttgctctctttaaatacatggcctttttaaaaaattaatgcatttatattaatttatataaaattattgcatacatatatgtatacacatatatttttctaaatgcaacctgcacaatctatataacgttactttggtgaatgttcacagggttggcccttcagtattgaataaggacttgatgtgcgcatccttggggaggactgtctcttcagctctcagctctccgtagttgcctctagttctttgtgtagggtggagctttggcggactctctcaaccacttcggtgttgttcttgttcagctcatgtttaggctaaggaaagatttggtggaggacatttttacctttattttaggattttaggcttttttccacaacatctttttttatttttctaatttactttacatcccaatcgctgctccacccagtcacccccccccccacacacacacagtccctttctttacgtccctttctttactccctcttctctgagaaggtggaggactcctgcccccccccccccccgcaaacccccagtcccctgcatatcaagtctctctcttcaggactaggcatcctctcccactgagaccagaccagggagcctagttggtgtaatgtattccatagacaagcaacagctttagagacagccctgctccagttgttgtgggatttacatgaagaccaagctgcacatctagggaactaagtctagctcgtgtgtatgctctttggttggtggttccatttctgagagcctccaagggtccaggctagttgactcgttggtcttcttgtggagttcctatcccttttggggccctcattcattcccccaacttttccataagagtccctgagctccatcca

SEQ ID NO: 32717 - DNA, 1205 bp, Mus musculus
ggaagtatccatccatctcaatttcatttttattagccaactgttctgtatgcctcctctgcctcaagggaaaggagaccatagacctcctggaaaaagttgaaggtatgggcatctaaagagcccaaacatggtcttcctttctgtgtatacaagcacagtatataataacatttggaccctcataagtacagcctttactctcaagtttctgttagcatttcaggttttaaagatctcaccagagttcaccattaagttatgccatagcattctaggttttcctgggcctttccaaattctttccatgagataatttcaaatatctctaaatccattatttaggtgtacttgaaagtataacaaagtaaaaacagaattctaggcctttaggcccaggcttgggaatgtggcctttgtaaaggtatgctaatcataaaacagatagcgacattcctccacccacccgcttcctgggttcaaagagtgctcattcaaagaaagtcaccctggccattaccagaacctgcaatgcaaatgtgctattgttaggggctcttagaagctgtcttgagagttaacaattaccaggtattccttgtgactcttgtaactttacgcttccttgtgactcttaactggtatctttggtatcttccaacaacgccctccccacttccttgagttgtggtttcttcctttaaatacccccttacccagctactcggggcgccacggccctctacccctgcgtggtgtatgaccgtgggcccgagagcactcttgaataaaaatcctcttgcagtttgcagcaagaccgtttcttgtgggtgattttggggtgtcgcctctcctgagtcagaacgtgggggagtcctcacgttgtgggtcttttatactcacagaaatgacctacttctcagcaccaatttttctgttagctttccgtgttgtaacaaaatactctggacaagcaacttataaggagaaatatgtatttttgtctcacaatttcagtattgttgcacacaatactctgtaagacacaatatatcattgtacagaatatgcagcaaaaaaaaaatgcttagctcattatggcaagaaacaaaggaggcaaaggaagagccaaagccccaacacccttcaaggtaatgtcctcggtaatttgattttcttccactaaatcacaatttccaatattt

SEQ ID NO: 32718 - DNA, 1300 bp, Mus musculus
tgtggaagcttgcaggatgggtctaaccagaggaggggttttgtagatatagtcaacatttagaacagattgatggtcagccaaggccactagccttgatcatgtgagcgggctcactcaaccaactgaagcctcaagaatagaagcacatatctcggggaaaggcaattctgcttacgtctgtaacatgaaacactgcatagggtgtaccctctagcacacccctctaatgtcctacctagcagtgctaccatcatgaaaacacagagagggcgttcagaggtcgcgcagccgcgggcttggtgccccggacggcgtcccgggccctctgcctgggtcgggaacccgtgctggagtgaactgattttaacctgcggccgccgaggcctacatgtcacagccaacgccggcgccacccgccatgcccgtttgaacctccactacctccagattctgaacatcaaaaagcagagcatctgcgtggtgcatttgaggaacttggggacattggacaacccaagctctctagatgagacagcatatgaaagactggcggaagagaccctggactccctggcagagttctttgaagaccttgcagataagccctataccctggaggactacgatgtctcttttggggatggcgtgctcaccattaagctgggtgggatctagggacctacgtgatcaacaagcagaccgcaaacaagcaaatctggttgtcttctccttccagaggccccaagcgctatgactggaccgggaagaactgggtgtactctcatgacggcgtgtctctgcatgagctgctggccagggagctgactaaagctttaaacaccaaactggacttgtcttcattggcctattctggaaaaggcacttgactgccagccagattccaagacattccaacatgagacttctggtctcttagaaagtcttatatgccgggccgtggtagcgcacgcctttaatcccagcacttgggaggcagaggcaggcggatttctgagttcgaggccagcctggtctacagagtgagttccaggacagccaggatggcacagagaaaccctgtctcaagaaagaaaaaaaacaaaaaacaaaaaacaaaaaacaaaaaaaaaaacaaagtcttacaccacaagtgcgcccatgacataacagcttcaaaatttcttacagtgtgtgtgctaataacctcctgaaaaggaaaaaggctcagagggagacatgagtcgttcccactcttccattgtctctgaaaagatactctaagaagtaacttctaaat

SEQ ID NO: 32719 - DNA, 1195 bp, Mus musculus
gtcaaggctggtgacctaagtttaatgcctggaccacatgtggcagacagaaagaaccaacttccacaagttgtcttctgacttccacacatgtgctatgtcaagcgcacgcgtgcacgtgcactgtaatgattaaaacaaatctctcaaagcatggaactgtttccctgtagtgctcagcaaggctatgctgtgttccctacatagaaatgtgcaaaagaccctcccacacaggggtcactctgtcagttgctacctatagcctatgacctaaaaatatgaaatacttactctctggcatctttattttgctttggccacttgatcaactcttctagaattcaccattctggaagcaagttcaactcaagctgactttcaggcaagtgaagcagatgatgtctgtgatctcagcagctatgtgcaggtatgtatctatggccgagtctctgatgtatctatggccaagtctctgatgtatctatggccgagcctctgccatggctctctgtgcttaagtttctcacttgagttctcaaggaccatactcaggtcttaaggctcatatggaaagcaatttattgattgaactgtcttcccagtccccatttattttatttttaatatatctgaaggaaagatatattatgttcaagaggcttctacactcctatgtttatgcacaaggagactgcagccatcttttgtatgggctgtgtgccctccgcattggcctagtcctcctgggtccacattaggtgttttgttttgttttcccacttaagtcctgcaaggatttgtgtttctgatctctggctctcagtcacagggaggagctgcatgagtatcaggtaagtacttagcctttctaagacccagtgtccaaattattcagtgaggatagtaaatgctcacgttattgtgcaggctgcattaatgtgctagagtagcatccagcagccctcttgcaaaccacgcataatttcttccttttcttcctctttctcctcgacttctgagatagggtttcgtgtattctaggtaggccttgtgctccctaagtagacaaggatagccctgaactcctgatcctcctccctctacctttctagggatccatctcagggcttcaggcatgctgggtaatcattctaccagctaaagtacctcccatagttacaaattattcttacat

SEQ ID NO: 32720 - DNA, 1577 bp, Mus musculus
ggtggtgtcgcggagtgtgtgtgtgtgtccacacctaacccaggaatatcccaataactattgggggaggggggtaaagggtgttatgaatggtcaatgcctcttggcgggtccgtaggtgggtttctctggccactgccctcttcttctatgccctacccgccccctccccatcccccgcctaaaccaggttggaaagtactggaaattcaattgcgtggtctctaactttggaatttggtatccctttcagcaggagacgttaagacgatttctgcacttgggtctgtgtggacgagagttttgctcaggttagatgtagaatccgcctcagacctgcaccagtcccctacccagtcgccacctctcctccaccccccacgcacatacaacacaaccctggagagaaggtttgtacacatgcagttaaccgtaagccaccaacgcagctataaggacgcagagtcagcccgggttttgcgggcatctgagcgcactattggcgtttgattagccctggagatcaccctgctgctttgtagaggcgctggtggggcatgctcgtgatccccagcgccggggctagagggtgtccctgtgctgagctgtacggccgtgctcggaggatgttcgctgaacagtatcatgggcaattatataagctgcctcagtgatctcccagatctgtattgcaagcacccggctcttgaaagacaaccctgaaagttttactgcttggggactgtaagtacctgggagacccacttggggaatggggagctgggtaccttgtgccgaggtgcccacttctgagatgtgggctttgggtgctaaagctctgtccccaaggaaccggttaccgaagcagggactgagtgggtggagatccaagattaacctgtgaagaagaacgggtcaggactcagatttctttgagtccgtggagccctgagattcaggtgttggaggtgttgtgtgggggggtgttggatggccttccagggaacgtagttttcggaaaatcggtgttctaggcagccccaagactcttttcttggcccctccctggctttaaatccagcgtccttcacctgtttagaaacctgcctccagtcccttttagaaatgcccagagacgccaggcatccaggcccaggtttggggtgtttgtggtgggttaggaagtagagtactggcctctatggggtgcgggggtggacagaaaaaattattatacctaatgcggatgctatgggaatgggtgcctgatatggcttctgttccctcgcctccctccaggactgaaaacagtttggtttcaactgcgctcctttccacccccctccctcctatctcgctgcctcccttcgctgccgcagcctgtcgcacgttgatgggctttgatagagaaccacagtagtggagtgtttttaaatcttgtttttcgcctgtagagggaaaagctatcccagccctagcagaaagaaccctgaggaacgctgaagtctggggcttggtggccctgaactccctcccccaagtcagatgatagcgtgcatgggtggggagggttttgt

SEQ ID NO: 32721 - DNA, 1229 bp, Mus musculus
aaaaaaaaaaaacaaagaagaaaggacaggagtttattgaggtatagctaagttctggcttccctttcctttcattgatgatggttcccctctgtgctgtggttttgtgaagtggcttggagggcctggcaagactcgggaattgccaacacacgtcacttggtagctctatgcattcaaacacagtccttagaaatctgtattcaccctcttttcagtaataaaatggaaaatcgaagtctctgtctccaaaaggtttgtgtggcacttgtatagtatcttttggtcagtatcctttgtgacaatggtggcttttggcactggcatatttcttcttattccccatctgctcaacttcaggttttgtgacctgcttctgaagcccattagagcacatcagtagtgggaacatgtggggctggggaggctctgagacttaagagggtttgaagatgctcattttgcaaggttatacaagcatagctccaggaggaccttggataatgatggtacctgtagaaggtgaaagccagggatatgtggagaaaggtgagcagttcaccctggttcagtatcaattgttcttttactccttacactcacaaaatcctaaagactttctctctgcctctctgagtacctactcagtgctagctttagtttctagtatcactataggtctcaacaggcattgctaatgccatccctgcagtagactcacctgaaatgttcttaccaaagaccagtttcttctttccccataaatgttctctgtctctctgtctgtccctgtctctatctatctatctatctatctatctatctatctatctatctgtctgtctgtctgtctgtctgtctgtctgtctgtctctctgtctgtctctctgtctgtctctgtgtgtgtgtgtgtgtgtaagagagagagatgggagccagtgtgtgtgtgtgtgtgtgtgtgtgtgtgtgtgtgtgtgtatgtgtatgtgtgtgtgtgtgtgtgtgtgtgtgtaagagagagagatgggagccagcaaagctatacagctaagggtgagcaatgacacacaagagtagagcttcattaaatgttcattccatcccctttccaaagaagcagaaaggatcccatattgggtaatttatgtatgaggtgagtgacctaattcactaaatccatgggactagaatatgataatcaaggctttttgctccaccctccgccctgc

SEQ ID NO: 32722 - DNA, 1657 bp, Mus musculus
atctcatggtagtaaccttccaaagttgtgctgaagacttgtcattgtggaagagtctgaaggctctcaagtttgaagggtttgggattttcttgttgacagtacaatttgttaagaagtccttggcaggcaagatgacttgcctcagtaaaagtgcttgctacaaaagcctgataacctgattatgagttttggagtatatgtagaaggaggtaacatgttctacaagttgtcccctgacctccacacatgtgccatggcatatatgtctctatccagtcatgtgcacacagacaagtaaatgctaatactgttactactaatgataaaagtgaagacattattcactcctttggattaatttttctggagatcatctcaaatctacgtcaaactgggaaactgaattgtactacagagaggcccttgactgtcagatgcaagagtgcttttctgtaatctcagcaacttggtgttctgaggcaggaagatcacacatttaaggtcagcctggacaacataggaaggtctgtcccaaagaacagacaagacaaaataacaaacaacacttgtttgttacttcttgagacttgttaagttacaggtcctcgggatggtagagatgactcagtgtacaaagtgcatgtcacacaagcaggacaatcagagtgtggatccctagcacttatatgaaagctggccacattgttttgcttctataacacgagaactggaagaggcagagataggagaatcccagaggctccctaaccagccttaaccaaaatggtgagtctcagtgtcaatgctagactgtctcaaaaataagatgtcaggagatagataaagacatccattgtcaatcaacttctgggctttaaatatatatgtagagacacatgtcctcatatgtctgtgcacactagcatacactacgcacaacccccttgccataaacacaaacacagattcttgtccagtgcattggagagttgacctgagagtgtgtttctgacaagttccccagacatacaaatcctgatgatggaatccccttccttgccgagcagggatctcaaacttgatctttctcttcctcatctccccatgtctgtaagtaccagatgtgtatgcatctggacaccaggattgctgtggtgtctgtcgtgacagctgccgtgtgccaggcaacataataaacagtggccatcatcagcataccagggacaaactgcacttacagccggaacagtgtgctcttcaggctcccttaacatccttaaatgcattcaactttgtgacatattgtggaggagggagcaattttattattaaggtattactttaaagattttacatatttttttcatgtttgggagcaggaaatatagttgaatgatagagtgtttgcctagcatgcatgagaccatgggtttgatgttctgcactaccgaaattttaagaaatcatattcttattcatgtgtttctccttgtgacagcagtaaccagaacattaaggaggcctaaggtaatcgctaagggaatgtaaacaacacacgaccctgtagctaagcaaacacacttggtcttttctgatattgttcttctttacaactgcttggaaaatgtttttagatttatttatttttacttta

SEQ ID NO: 32723 - DNA, 1119 bp, Mus musculus
ctgttgtaataaaaacacgaagagtatggtgttttgtaactatttttataccgacatcagacttgatgttagtgcttctgaattatttagcatttttctttctcagctggcctctgcagcgaatttctcttccagggcggagggagttgttttataggaaaccaaggaagcagacagacattgactgcaggccctctgctttcccattgggagaaagacaggatcaggtatcctgttatggaccagtggcctcctattaaagggaggtggctgctacttgtctccattttccagagaggttgtgtagcttgtgtgagcgagcccagcaagaagggttgggggttgaggtcttgcagattcctgggtgtttctgactgcagagcctgtgttgtttttgttggaagagcctgcgtacaccctgctttacgctatcataagtacatggaggctcacatcacctggtggcttacagggtgccaggtcaaatcaccccctgagagtgtggaggtgaacagaggtgagatcagcctcagaaggctgacaaggaggaagaggagtggcctcgtggttcctgtgtattgttgtcaccgtctccgggagattgctggtggctgtagtgggaggctggttaggtacattctgcagttctctagggcattttaacttgagtctgtctgctctgtgggcgtgtacagagcaggtagagcccctccctcaccgtctgcatcttgggcctctttgaagagggtggtgattggcagcttcaaaccacccctaacaacgagaagcgaggaggagctgggctcttatctgctgcttctcataattgaagttcatcacagacttttagtggccatttgaaatagacatctggactgaaaagagtcctgctgcagattgggatggtctcactgctgctgctgccccagcgttatctatttctttatttcagagtcagagattagacatttttcttattctgtattgctccagctcctatttaattatcagtgacccagagatgactctatttaaagcatgttaaagtcctcattctaccatgtgtgaaacctcagctagaattgtgatatgaagtctctgggggagaggggcctctgg

SEQ ID NO: 32724 - DNA, 1156 bp, Mus musculus
gcaggaacagttgtaatcctgagtccctgcctctctctaatgccttctactggccaagaccaactaagtgttgccagctaggggaccagagtggtgtatctatctactaggtcgaccagtctctgtgataggagccaaaacatgaaggtagagtatggcagggtcatggtggccactgtaatagcaatacatgcatgaagtgtctgcagtgacagagggaaagttaagagacccagtggctgcatgtcctcactccccaaccctgaatattacaagctgcatggaagtaattaataccacatccaggaattgaatccctggacccataattacatgtacaagaatttttaaagatgtgatggcagtggttttaatgtctcataaatattcctccaaggatccttggcacagagaggagtggttttgcttctcaggcagggagccagaacagcctgtcctggagaaagagcgggagttcctccttccctcttactttggccagagctttaagcttcactgagaacttagcctgtgggttcttctctacagagcctctgtaccttggagtcccttgtaacctgtctctccagactgctgccacaacaggcacaggggctcccagtcagttgtggagagttatgctggggagagtttcccaggaaactcaatttgtgtgcctacattctggtctgagcatagcatgcgcacaaggtagaggtttttattccctcatctgcagagggcagaggaaggaactagaaggtagaaggtatgcagtagtaggcctgtggagatgatttggtggttaaagtccttgctatacaaataggcagacccggttcagctctccagaaaccacacggaagccaggcatggcagtgtgctgaaacagtgagcttcaggttctatgacatatcctgtctcaagagggaaggaaggaaggaaggaaggaagagaaggagggaggaaggcagggagggaggcagggagggagggagggagggagggagggagggagggagggagggagggaaggagggagggagggagggaggtgaacagagaaagatacctgatgtcaacctctgacttccacatgcatgggcaaacacttgtatgcacacacatgtatgcacacagaaaccccacaacatag

SEQ ID NO: 32725 - DNA, 1099 bp, Mus musculus
ccttcatgctcttcagttttctctgataaaaagtacgtgacattaataacttaaaaaaatttaaactattactggggatacttcaagccatctggtgtcttggtcctttctcaaactcagccttaatcttctccatacacatcacaggcacgcccggatgaattggcagcccctactagaatgatttaaccaattaacttactcattaactgccatggtatcttataaatgctggacaaaagatctagaataatccttattaagggatagacaaaggggatatttgaaatccccctccatcattccttttctgcttttctcatggaattcccacagggactaatacccgtgaggataaaggataaaatggcattagagtctttgaaaggaaaatgagttcaagacgtgcccattgttgatgccagagcagaattcccatgaagtgtgtgtgtgtgtgtgtgtgtgtgtgtgtgtgtattactaattattctaggctttcggctgcacttacctttctcgtggtgaattcttgagctctgttaaaacattactgtagtacatatgacaccattctctaatgtagagcagttttagataaccaggcatcatgcttcccattctatgaccaagaggaaaaaataaatagtgagtctgtggcaaaattagcatcatatctatcatttactggcaaagctgtgatccagtgatgtcatttttgaaaactccccttaaggatacgatattcaagagaaaaaaacaaaggaagttttatctctaaaggtagttcttctgctgtcgtccatagcagaaagaacttgaaagcaaggtagaaataaatttcagcctgtcagggagtgggctttccaataactcagtagcctggaagaggccctttgaaagaacagccttatacaagagggggcactgtgtataatgttgatagttttaggttcggtttctaactttggtgtaccaggaggtgcaaattcatggagaaagacttatgtgcaatggctttgccacactgagatacaaatgtcatctcccaggtccacctgaatcccggcaaacatcgctgggctcctagttacttacctgt

SEQ ID NO: 32726 - DNA, 1267 bp, Mus musculus
tgtctgttgttcactgggttgcagattcctatcactcttgacttttgaactccacatatctccacaagacaggtgttgttactcctattttttaggttggaaattaaggttaatcagcttgcccaacacaatgacaacatggtggtgtggatgctgacagtgacggtaaagctgacatttctgtggcaatcaatctctgctctcagttctttgtagggactgtgctcactgactgcctcctcaccgtacaggggcggttagcctaagtgtttttcctaagaaagcctgtgttgctagagaacggaaggattgacgaaagacgtccagtctgagcaaggcttgcactctgactcctaggatgaaagtgggaaagaagatccgaagggctgcaaatacacatgatcgccacactgcgccctgcgcctgcttctgggaggggacagtgctaggtacagtggtcttggggtcacccgagtgctggctgcctgtacttgttgcttcagcttttcctgtattgactgctcactgtctcccgtccaggcatgtggaaactgacgctcaggaggtcaagtgatttacccaaaatcataccactaattggggctctgggctacttttaagctagatgatttcctttgctggctcatctcattaaatttaaagaactattcctgcaggcctgatccgttgaacaaacagtggctcaacaaaagctgcacagctgcccttagcagctcttgctgggggcctgaggtgaggctggctaggcctgcctcagaggactcttgagttttggggttcactgtgaacttgttccttcttgctccctccctaaggagccacagagagccagaaatggcaggacttggcttctaccccttaagtaaaaccacagcagcctccacttgccttagtcagatctagttacagccagatagacatcaatttttattgctgttaattccacacaatgagggtttagactcttgatcctgagaaacaaaatatggcccccaaagggaagatcaagacctatccaaattgtcttttttttttttttttttttttgctgctttaagaaagaagcacctgccgcccccccccccaataccaggacattggaatttcacatttgtttcctttctctcattattccacatatttgaatcaaaatgatgataaattgctccattgtagatggtttcagccggacattgatatattggattaattggattaagaccaatgaggttttccaaatccccaa

SEQ ID NO: 32727 - DNA, 1132 bp, Mus musculus
tgtcttcagcttaggcctgttgctgttcaggcccagaccagacatccctctctggcttcctttattcatccccccactccagtgaaaagatgtctcctcctcccccagcttctagtgtcttggcctcatgccctgagcaatcccctgttaccaccatgtggataatgactgaaacttaagagtgtggaaattgaaagacttagcaagagtataaacacacacacacagacacacacccatccaacaatagttattaagtggaagctctgggccagacatgatcctcagcctggttgaagacccgtttaattcctcgtgggagctgagatgtcccacaacagaaaagtaaaaacactaaaaacagcatgtctgtgagcatagctgagagctatgtgagatgctcaaggtgtcacctggtgatttgtgccactgagtgacccaaccctatagacccggccatggcaccaaagggtaccagccttggggagctgccttgctttacttttcaccttcaccaaatggccccagttgactggccttcagcatctttttcttgcctgggtaccaggacaaaagttcattagtgatggtaataatactagcagtttttcagatagtgtgggaactaatcaaagcagacatgggacatatgacgttctgtttgtttttttgttttgttttgttttgttttgttttttcctgtcagagtaactatgcaacctcttcaagccaaatgcattttagtatgcacccgttttgttttgttttgttttgttttgttttgttttgttttgttttgttttgagacagggtttctttgtgtaaccctggctgtcctggaactcactttgtagaccaggctggcctcaaactcagaaatcccctgcctctgcctcccaagtgctgggattaaaggtgtgcaccaccaccgcccggcttatgcatcctttccaaaagagaaatcaagggcctttgaatcaagtgcttacatctaagtacccagctacctacttcacatcgataggtaaacatggtgtgttttggtgtttctaaggaactatctgattaaaaaaaaccaatatcctcattttacaggtgagaaacttagactctgactgcatgtcaaagctca

SEQ ID NO: 32728 - DNA, 1724 bp, Mus musculus
agggcactgaggtatctgtgggtctttctctttgtgtggctactctgttctaccctctgctcacctacctccaaaaagctcacaggcccacagagctttaaattgtattctctgatcttctcaataccctaccaacccttggtacccctctgttacaaaccattgcctctagcccccaaattaaggtcccacgcatcagaggaggagcctaatcaagacaaaccaaggctcctgaacagttaaggcgtcgccccccctccaagcacaagtaccaaatctgttttaatcagccctgattacagtgggatatgatcacatgatacaaatatccctgggctctacatgccatagtctccagtaggatgtgatattgacatatccaccatagacttgctcctcctggactgccttgaccagttcaatgagttttttatttgctttgttttggttctcttttctcttatttctaagaaccaagcaggctgatttcccgtgcacagcaagattaactaaatgactactgtttccaggatgctgtgaactggaaggtactctgtagatgtgaggtatgtgagaatgtcaggcaagtactgatgaacgtaaacattgcaagggctggctgggctggctttaagccagtggctttaatcaggaatgatttagcttggtaacttacctcgttccctcagctgttgcctttcccaggggccgaggagactgtgccttgaatgtgaatccttcaaagtagctccttgctgtgtccctgagtggggccaggtctcagccttagaaagtatagtttgtttcaatcttctgggcaacatggactcggtgcacactggtctatctcaatacctaggagagagcaggcagccagcagcaggagtgacagccagggagctgtgtctttggagatcacaaacagggtgcagccctactgggtctgaattttcacatatattacatcattgtgtcttcatagcaatgtcataataaatgggatattttaatccgtatcttacaggtgggagtaataaggctcagaatgattaagtaattgatccaaagcaataaacaataaatgggaagtctcttggctcccactgcattgtagtaagaacttataaacatacaattagcaattctttctgactacttagagctctctcctttggtgtgcaaatgagacttttgccagctaagtctccacctgactctacttacacagacacacagactgaagggagctggcgtcataaatgaaatctgccctcctctgactttggtgctcatagaggcccattagaaatgctttacagaggatctacagtcttcaatcctgatttcaagctttgcctttccactggggctggatgggaggtagcctgccaattcttggcttgaacagggtgaaaagatggcttggacagggtgaaaagatggagttgtttcttggtttctatcttccttgcaacactaatcaacctgccttgtagcaaaccagcggtttcctagcaacatccaatgatgtagcagagtggcatctattttgaatcttcccaaagtgacctgttgactctctttgagcatgagtgctattgccttagacaagtggccttgctggcagggttctgctgcagggctaccctgaatagtacctccattctgaaaatggactccttccttttcccattcctgcccttcacatattctccagacactat

SEQ ID NO: 32729 - DNA, 1132 bp, Mus musculus
aatgtatttttataagttggcctttgatcatttaattatttaaaatataaagtgaaactgtctaagtggactttgtaagaacttatttttggaggagatgctggtctgattttgtaagacagacccaagaccagctacaagaagttgtgttgaaatatgagctaaccagtacccctagagctcgtgtctctagctgcatatgtagcagaggatggcctagtcagccatcattgggaagagaggccccttggtcttgcaaactttatatcccccagtacaggggaacaccagggccaagaagtagaagtgggtgggtaggggagcagggcagggagagggtataggggactttcgagatagcatttgaaatgtaaatgaagaaaatatctaattaaaaaattgaaaaaaaaaaagaagttgtgttgagccagacatggtgtcctacacctttaatcccagcacttagaacacagaggcagacagattgtttcaagttcaaggctagcatattctacccagtgagtttcaggactgctggggccatgtggaaagatcctgtctcaaatctctctccctctccacaagaaaagaattaatgtattcattgattctgactctctccctcccccaccaatctcaatctctctctctctctctctctctctctctctctctctctctctctgtgtgtgtgtgtgtgtgtgtgtgtgtgtgtgtgcatgcgcatgtgtccgcgtgtgttctgtcccactccttccatgcagaatttaccaaagtgcggatagtaagctcagtgttttacaaactctgctagtctgcaagaaaattattttgagtcatttttgtcatctcccattagacatcaatttcctaggcaaaatggaatgtaggacactgttgtgtgagtgaaaaagcagacatgtggccagaggttaataactcccattgcccagtcatgaaagaaagaaaaatcacagtgtcacttctactcttgacatttggttctgtcatccttcgaagtcgaacaaagcatctttgtgcattataaagaggcctccatttatgtctttccaaagttctttggagatgtgcctctccattttgcatggaaaggtagatagtaagtggagag

SEQ ID NO: 32730 - DNA, 1210 bp, Mus musculus
actctttgactgtgaggacactgctccccttcccctacggtgtgactaaggacaatggctgtcatttgggaccaaggaacagtttatcgttttggtctgtggtcctttaggggagagactaacaggagccaagtgttctctgtcaggatggcccttgaggtgaaggagccacaaacatcctggggcatgcagaattggacacatgaacagaagctggggtgttaagtggacacattgtgtacagagtcagaacatgcttcccagcacacttgcaaaagaacaaacagggttgggagcatgtcgccacggctagctagctgaggatttgggggaaagcaacctagagcccccacagcctccctccttcaccagcaagtcagagaggataatgcttgcttcctgcagctacttagaagactcacagagatccaaatgcctaacagtcagccaaatgcctagcagatagccaggagcttcctctcctaactgcctcctcttcagactcttcacctgtctgtagcatatctccaataaaatcacatctcttctcaaaagccctcctggcctcctattgctaagcagtgcttgcacatatgacttagtcctcgggatcctgcctgttgaagctctcatatcctgtgttatgtctgccacccggtatatagccacactgagggatgagtgtatgtgtttgccctttcctctcttcccgtacttttactcccttgcttggagaaccctgttctctctctatgctgtagcctaccccgggtaagactgaattcaagtactctattaaattccacctaccccatcccaccccccagtttgtcagccaaggagatcctctgattcctgtcttcacttacggtttttctgtatctcttatgaaacttctgggaaatcaatttttttgtggtcaaaccttgtttttattgcctatgaagtttctagagtcaggattttgtcctcagataatccacccagcatcaggctcatcaaatgaatgaatgaatgaatgaatgatgaatgagtggcatccattcctaactagaccttccttcaatggaaggctatcactttttcagccatttatacatgctggttgttttctgtcagcttgccacaaacgtagacatatttaggaagagagactcttcattgagacaaggcctccataagattggcccataggcaattttgtggggtg

SEQ ID NO: 32731 - DNA, 1177 bp, Mus musculus
ctctatttggtcctctaaccacacacctactgtgggacagttgctggattccttagccgctgtcccattccgtgctccctctctcttctttgatcctgaaccatcatcccgagcctggctctccatcctgctgctgatcctcttgctttctgatcctgctgctttcctcccacccctggccttgcattctcttccccaggaggcatgtggtacacgcttattttgctaaaactcctcctttagctacaattccaacccgtcctctgtctgctcagcggcctcagactgctgtagcagcacatggcaagggacttctcctctacagcactccgccgtgatctggaagctgtggtttaaaggccacgagcaatttcttgggagttccttgttagaggactttacaaagtcctgatccagagcaggtgctccccacctccctcccacttgtaagcttggttagagctaatcaggctgtgccctgtttctgaactgggaaaggagaaggagatggggcgagtcagaccttgctaaatgaaaatggattgctttcttaaaacttggttcagacccactgagcgtggagagaggtgcagcaaacaagaattttgcctttaatttgcgccaacatgactttcaattccagtggaagcaacacagtaaccgaattccttcccaagatagttgggaggcattttcctccttgtgtaataagctctgctttgtccagggcaagttggttccttagcctgtttgaacatcatctcactcaagatgaaagaatagccagtagtgggaagagagccttctgctcaggagagcatagttgcagcctcagcatccagagacaatctggtttcagaactaggctgtcactagcccttgtgcgatgccagaccagttacttctcttctctgagcaccagctagtcaaatggggactcgggtctcagtcagtggcgtggcatggaaggaggatctcagccacatagcaactggggagttttatgcaaattactgaagttcagtgaggctcggtttccccgcctgcagctttgggatgagctcctatttcctaaggatataatgagagcagaaaagagctctccatggagaatatatggcactgttctccaggcagggcacgataaccaactgtgaaataaactctacgacttagg

SEQ ID NO: 32732 - DNA, 1114 bp, Mus musculus
tctgctgggagttccatggaacctgtggcagccataggacttgggtctgcctgcttgacacgttcccggagcgaaaggctgctggggtgtgtaaagttctctgccaaccttgtcctcagcttctctcaacccttcttgcatcaaaggacacttgttggtaaacccgttcttgtgacacaagctgcatggggaaatcagtatgagctcccttttccctgctaggaagacacaccgattccttcctttcttcattcatcccccgaagacatgttacgtggtggtgggtgcttttcagaaagatgaaggtgaagagtgttataagcagaaagctcttattgagtaaatgggcccttgggaaccacatgcctggcagactcctttcttctcagacctcagagtaaatggagtatcctgtgtgtgtacttgtcctaaaactcctcctgtcaccaagtacatcagcatctcttcagaaaagcatacaaatactttatactagtgggaagaaaggaagacagacggacagactccaggtcttgtatcatttcaagacacatttttgcaaccaaacaagatggattgtttggttggtgggttggttggttggctggctgactggtttggtttcatttgctttggtttgctttggtttagtttttttgttttgttttgttttgtttaagacatggccttgatgtgtaggttgtacaggttggctttgaacccgtgatcctcctaagccaacctcccaagtcctaggattacaaatatggctacccacacccatatccatgcccagcttcaaagttgttattgttgcttaatgtctattggcatgtgtgtgtatgtgcacatatagatcaaagacagcctgaggtgtcatctttagcaatgttgctgtcttcctatggcctagaactgtccacttctgtgtgtctcgctagtcagcgagcaccaggggtcttctgtctctacctccctggcactgtgattttaagtgttcaccacagcactcggctttttatctagtgccagaaatcaaactcaagtcctcacacctgttagacaagcactttactggctgagctatctctctgccaacaatgtatggatgtct

SEQ ID NO: 32733 - DNA, 1169 bp, Mus musculus
attaagggcctttggtatttcctattctgtaacctgtctgttcatatcctaggcccatttttctaccgcactgttagactttactcatttgtaggtattattcttacattaaggaaataatcctttgtgtcatacaaattatagttctccttcctagattgttatttgtcttttaaacaaaaaaggtcaagacctcctgaaactgtgatttttcctgatcatccctaacatcaccagactgtgaacccctcgaggcaaggtccaaaaccttgattatcactgtgtctcgagccctctggcagggcctggtactctaagagatctctgtggttgaactgaactgagggtctgtgttccccaccccagaccccctctccttgtggcttgggagttccatttccacctccagcagaaacagatgactttttccattgctcactacagccatgcacctgtttggcctaaactggcacctgcagccgatggaggggcagatgcagatgtatgagatcacggaggacacagccagcagctggcctgtgccaacggacgtctccctgtatccctcagggggcactggcttagagacccctgacaggaaaggcaaaggagccgcagaaggtagggttgctgcgttgtccgtgttgtgagtcctctgtgtctgcctttgaacggaggaggcctccaccatgcacgcatctgtgcctgactcacagctcatgcttcttccatcctccacaccccatgccggctgcagtccacctgtgtcttcatcccagatccgggtcagcgggacccatggtgctctgccgcatctcatttcatgccttcgaggatgctttcagggcattcacatggccagccagccatctttgtatggggtcagggggagcacttctgggaaaccctgtgggatcaagaggcacgcgtgggagtgggacatggtaggggatggtgtgtcccaggtgaaagactcttagactgcatgtttcgatggaaacatttcagatgattgccgacccagtgaccaagtcactagtatctctgacccagcttcctcatctgcagtagtaacaacaattactgtgtactcacagtgtttgcatcagaacttactaccatcatttcaccacacactttaccctcacaaccctgtgaaatgggtataa

SEQ ID NO: 32734 - DNA, 1199 bp, Mus musculus
acgttagcttcccagtaaccagggcagctcatccatataactccagctcctggggacccatagacacctataagcatgcgcgcgcgcgcgcgcgtgcacgcgcgcacacacacacacacacacacacacacacaccaaaatcttataaaggaaaaaacaacaaacaaaaacaaaaatgacacaaactgctaacttctctgcctggtctccagaagaatttgaactttccaccttgaatatagactttagttctttatgccaaaaatattccagagaaacaaaagaaagaaatgcttcacagttaaacctaaagggagaaaaacaaacacccacccatctctgcctcagagaagggctttaagctttaacatttattgagaagctgggagtggtggcatatgcatgtctttgatcccagcactggagggtgggtcagaggtaggtggatctctgaaagttcaaggccagcttggtctacagagtgaattatagggcagccagggggctggtgagatggcacagtggttaagagtcctaactgctcttccgaaggtcccaagttcaaatcccagccaccacatggtggctcacacaaccatccataacggaatcttctggagtgtctgaaaacccccacagtgtatttacatataataagtaaatctttaaacaacaacaacaaaaaaattgtagggcagtcagggctacacggagaaaccctgtcttgaaaaaccacaaatacatttgcgtatacatatattatagctcatatactaggaaatggacattttattttaagaaaatggctacagtgtatgtatagaagaattaatgatttgagagaaagatatatcaagtatgtttccccttaatagtaattaagtacaaacttaaataatggagtatcaacctcttttaaccttgtgagctagagtcactccaaaaaaataccactccaccaaggctgtggtataactccgcctgcattgttactcattacattgtaaatcactacagccctttgggaaaacaagttggctgtttgtatcaaaccataaaagttgtgaatgtcagaggctcatgaaggaataaacccataatcagaaaagttgcatgcttaccacagccttgtttacaaatgtgaaattttggtaacattccaaaggcccagtaacagaaagcattgaggtagatcatgc

SEQ ID NO: 32735 - DNA, 1200 bp, Mus musculus
gtatatacatacaacacacacagagagagatgtgctcactcacacacatgtgcacaattgggtgcatacacacatacgcattagaggaaaatcctttctgatcgattttatctgtgtgtccttctgaaccctagttcccccatctgagactcctcctccctcgttgcagtttttgcaaacatggtaggctctgggtgccatgctgatgcttgttggacattaatactcagtttacctcacaagccaaagggcagggacttgtagccacatttttcaggtgacgaaacagtcttggagaactgggaactcaggtccaccattcactgaaatcctactctttactgaacctgttacctcccctagtggacagattaacagtgttgtccttcccaagagtctcacactgctgtcccaatactcactgtaccatcttccttccctgtcacagtggactgcatggaccccacatgttccagcaggggtgtctgtgtcagaggcgagtgccactgctctgtgggatggggaggcaccaactgcgagacacccagggccacatgcttggaccagtgctcaggccacggaaccttcctcccagacacaggactttgcaactgtgacccaagctggactggacacgactgttccattggtaaataccggggaaagggttggcgagggtggagggtgggttcgactgttacaatttaacctttcagcactggtgggggtgtggccctaactgcaaactcctcctgctgtggactcatttcctcttccttgcccttacattctaatctttgatgcctttcctcttggtgagcagataatttaaaaacttacaccctccccttgttcagccttgggattctaaactgtgttgtactgggcatttctgcatagctctaaccagaatgatgagagaatgaattcaaggaggaaagattcgtgtcggatcacagtttttcagaaagttctttccaggattgcttagggcatgccatcttttgtagagcaagagccaggagggaggaggcggggatactcacagggtgtgtccacagtggcagtgttgattacttgcctggttgttgtgacaaaatacatagtcagggagcctgaagaagaagtgaggacaggctataaacccccaggcccacccacaatgacacactacttccattaaggctctacctcttagag

SEQ ID NO: 32736 - DNA, 1122 bp, Mus musculus
gacctcctgaatatttttaagatgggctctccccgtatttcattttttcatttgggtggtccccatgtttgccattccatggcttgtgtattcactcctgcttagaagccattctccccagtaccctcttatatcctgctgatgaacagaccctacagcacctctcagaataaagggaagtataccggcccggttaagtcccctgttcccaactttccacttggctaagcagcttcctggtgcatatttcatcataacagctactgcaatgatacatgaactaagaacagggtctctcatctaccagtatttttggagtaaatcgatagatgattgatacataaatcagtagacagacagacagacagacagcaatagtacctatcatttttctgaagtgaggaaaagaatgtccttacagtttatacaatcatggcttctagataaagcttctccattatagttcactcctatctagagacttttgattctcatgtgggcattggttgctttagaagacttcccgctctgtctggcctgtatgagaacacgggaaaaagaggcatagtgcgactggagatgggagcctcttccatagcccagatgaggagactgagcatgctgctggcacaggctgggactaaagagaccagtcctgagcgttcagacacagctcttatgtatgcactgagtttgtatatcagagcaatgcttgacacagatcttcacacgtagacaagaccttaaattgtcaagtaattcaaatggcctctccactggaaaaccaagcatgtgccattctgtcttttgagttaagaagtggccaggtttccttttcctgttcccacttttcacagttacatccattggcctcacattcctcataagatgcaggaagtaggggtacatcttattcagcgcacccaacattctgcatttgagtctgtgtagacatgtctgttcccatataatttgagacaagctagcaatgtctcaacctaggattctagtatgtatcagaagtgatgcagaatctgtatgcctctaacctctaatttctcaggatcctgtctgcccagataatttgtcactcttaattccccttgagggaggttggccatt

SEQ ID NO: 32737 - DNA, 1134 bp, Mus musculus
atctgtgtagtgggatcatttaggacttgaagccagtccctatcctaaaagagttcaagatgttcattgtaatggtagtggtggtggtagtttatttatacgggtgttttgcctgtatgtatctgtgtaccacatgcatacaatacatttggaggccagagagaatatagcatcccctagggctggagttacagttggttatgagctaccatgtgggtgctgagaattgaatcaggccctctgggaggtcagccagtgtccttagctgccgaaccatttctccagttccaagttcaaggctgtattgaggaaacagacaactcaacagagaagaacccgtgaaagtgccacagaagagagatctgccacagctctagtgggaacatgaggatagagtgtactataacagaaaagcggggtggggtggggtggggcaggaatggtagctcaggtgagggagtacttagccgaagctcccgggacaggcaagtcaaaggggccctggagctctcttccatccatgctttcaaggattgcatggctcccagcagatcatcgggccttcaggatgcagcgctgaggtgttcagggaaccgaggcagctgtgtggggaaatagaatagaccatcgagcgcgaagcacgtggagagtgaaatccactctgcagcttgggagcctgctcaggcactatctctgtccatctcggttttctcaaatggaagaagacagtccctacttaatgtgttagttacggggggaatgaggccatgtgtgtcaagtgcagacacagactaggacagaacccacatctttcagtgtcaggtacatcccaatccatggcattagctctgtcccatgggctgctggggctgcagcccaggaggtgggggttgggggagcagaggaaaccacagatacagtgcagctgccagtgctggctggcacgaggaagaactgtgcagctagggatgtagttcagttggtagaatgcttaacacaaagccctaggtttgatctccagcacaaataaagccagatttactgatgcacatctgcagtcccagcacttgggaggcagaaggaggacaattaagaattcagggctatcctcagctacatggtgagttgagcccc

SEQ ID NO: 32738 - DNA, 1167 bp, Mus musculus
tttgattacaactatgacaacagtttccgtgtgactagcatgcaggctgtgatcaatgagaccccactgcccattgacctctaccgctatgatgatgtgtcagggaagacagagcagtttgggaagtttggtgtcatctactacgacatcaaccagatcattaccacagccgtcatgacccacaccaagcactttgatgcttatggcaggatgaaggaagtacagtatgagattttccggtcactcatgtactggatgactgttcagtatgataacatgggacgggtagtgaagaaggagctgaaggtgggaccctatgccaacactacccgctactcctatgagtatgatgctgatggccagctgcagacagtctccatcaatgacaagccactctggcgctacagctatgacctcaatgggaacctacacttgctgagccctgggaacagcgcacggctcacaccactacggtatgacctccgtgaccgcatcactaggctgggtgatgtacagtacaagatggatgaggatggcttcctgaggcagcggggtggggatgtcttcgagtacaattcagccgggctgctcatcaaagcctacaaccgggctagtgggtggagtgtcaggtaccgatacgatgggctgggacgccgagtatccagcaagagcagccacagccaccacctgcagttcttctacgcagacctgaccaaccccaccaaggtcacccacctctacaaccactccagctctgagattacatccctctactatgatctgcaaggacacctctttgccatggagctgagcagtggcgatgagttttacatagcttgtgacaacatcgggaccccgcttgctgtcttcagtggaactggcttgatgattaagcagatcctatacacggcctatggggagatctacatggacacaaaccccaacttccagatcatcatcggctaccacggcggcctctatgatccactcaccaagcttgtccacatgggccgacgggattatgatgtgctggctggacgctggacaagcccagaccatgaactctggaaacgcctgagtagcaacagcatcgtgccttttcatctctacatgtttaagaacaacaaccccatcagcaactctcaggacatcaagtgcttcatgaca

SEQ ID NO: 32739 - DNA, 1115 bp, Mus musculus
cccctcaaaatgtacgtttgctgtaagggtcctgtgggcagagttgtcctgtgagttggcctagttgatctgtcccatactggctgcctgacattggctgagatccgccggggtcatttacttataagacagagagacagcatgtgacccaagggaccatctccttgtagctgtccagcctgtgacttcctcctctgttgtctccctccctcaaagactatatttttaggcatcagtgaataccatgagatatggggtattcttctttaaaaggaatgatcccatattcttcctggactgccaccccagagaggaaacaggcaagcatccctgagctgtataggacctcagctgtaggccagacagtgccatgtgcctcccttgacactgatgctgtcctccctgaactatgaccttggctcctttcagttggattccacctcccaggtgtgtttaaaggcacaggccacagttcctttcgcccatttaggagactttaaatataaaatgccatcctggacagctcccgctctttcgacactcattacatctatccacttgagagagtgaccgggtcttcctcactggtggaagtttgtgattctgatgggagttagcttctgaacctctaaggattgcttttgcatagttcccaccttctccaccctccacaactgccaattagtcccccagcctcagcccctcctccaagaccttaaacaagactttattagtttctgacctcgtcttttataccctgagaccccctttatggtcatctcccaggcaggcatcactagatggtattgtggtgatattgactccatagtaaaccacactttagcctttaacacttggctcagagccactggtggaaaactagcccaaggtccacaccagtgcctgactctactgaaggatgctgggcttgaaagaaaccctaggaagctaaagggagactgctgaggctggacaagtgcctgaaaataagagggattgcatggggaggggggcagatgatgaagaagagccgagtaagctgagtaaactggctttataggcttgaggcaagggaagaagaagaaagggccttacaactgtgacttaagtgactg

SEQ ID NO: 32740 - DNA, 1216 bp, Mus musculus
tgcttagcccaggttatgccgattctggggtaggaggattcacctcccatggggtcccagtctctcctctctcccgggatcttcatcaggactaaaagccctccacgagaggcacaccgtccccagctaggtcaaaaccattgtctatattttgtgagaggggacggaagtaaaaaatgaactctgtggttcaagacctttttatttagccttcccaaaacagcaaactcattttaaagactcattgctcaggtgactgaaactttatcctctccaacccatcattctcaaaaaccagccttgtgtacttgactgcccggaacagtggcgggctatgcggtttcacggtgttgtggaagatcaaaggtggggaagcatggggtgggaaccctgtgttgtgtttcagaggcctcggtggggccctgtgttgtacttcttaccctctggggaatgccaaaggcgtgagactgggctacttcctagtccctaagaaaaatgtgattgattctaagggctgatggttcagggctgactgcccgtgggcaggctcggctgtccccgcagaagctgacccacagatgtctggtggttcccagcagctctaatccactcatcaccagaaccccactgttctaaatgtgcccgtcattctgaggacttctgaacccgcagctctggcaaaggacgataatgagctgcctctggatgaccaacactggagactctggccttaccatgtggaaatagttttcctgaagtctggaactaattttgagaagtttttttctcaacacttttgtgtttctaacactgtattcttgactgtgtaaataccaacaaggctgtaaataaatgcagatgtagataccttctagaaaaaaggggggaaagcataaaaacaaaaccagaagtgatcccgtgtagccttcgttgacaaataaaagactattttgtgtttaaaggtgtgcagtggcctttgttgggagacagtggcagttaccaggagggctggaggaagacccccatcttagtcccagagtcccttgcaggtcctacctgtcatgaacagcggtgtctggaggatcacagaagaccagaggcctcacttactaaaagatgaggtacacacagaggcagctctcaccttagctagtgccaaactgccttaagctgtgtcctagcctggttcttatgctcactggcttcaaagacagat

SEQ ID NO: 32741 - DNA, 1199 bp, Mus musculus
gggcttgtgtgttgagacatagcagacatcttttaaaaaggatttacttttaaatttgtgtgtgtgtgtgtgtgtctgtctgtctttctgtttgtctgtctgcatacatatatgaagaggctggaagagggcatcagatcatctggagctggggttacagtggttgtgagctacctgcttggcattgcaggaactgaactcacccttgagctagttaagggctagggctcttaactggtgagtcatctctccagcaccatagcaggcatcgtttaaagtatagagctgattttgcaagagagtgatgagggacctccagggatccccaaaggaagaaagacacaagttcccaaatagggaggggcaggtaggttagggggggtcaggaacatggccaagctcaaatacagataggcttgaactggtgttggcaagccatgattaatcgtcactatggagtggtactatgaagccccgggaaagccaacaaaaaggcttctctgttaataaaaagtatggtctagaaaaagtatacatgggggccaaagtagaaactgggaagttttctctagcttgatgtagactttagaaacttgtaaccaccagctggtttagaggttgaaaattagaccacttggtaatgggacattgctctccagtgtaggcgtgcttataaactttaatatcctagggttgtctggtagacacaaaacaagccataaagataagcttgtattgcagatgagtaatctagaaatttctcttgtacaaattccttcccaggagagataaaagctgtacctgctccttctccaaaggtcccagtgacaaactcagataccagagttcactctgggaaccatcgtgtttttaggcttctttatagagcataggagatcagctacttacaggatgtgggtatgcctcccccagtaagccgcacctggaaagccttgaccaagtagggatgagggcttccctgtggccacataggtagagctcctccctaatgtatatactgtagccccttctcaaagccatatgcaattaaggtagaggtttgtatagcaggtggtaagaactttagagtggtaaggaactttctggaaagcctgatagagaacaggagtttgaccttgtctggcaggaggagaatacgtcacatgatgcaagggattagtggtaatatctctggggtg

SEQ ID NO: 32742 - DNA, 1145 bp, Mus musculus
ccactaaagggaagttaaagtttattctgatttcaggagaacatttttccgggctgagggtatgattcggttgataaagtgtttgttacatagtcctgagaacctgagtttaggtggtcagcacccacttaagataggctaggtgtagtgctgagggtctgtagttccacttctgggaaggcagagatgggcaaatctaaagttctcgggctagccagtctaaccaaattggtgcgctccaggtttagtgagggatcctgtctcaaaactagggtggagagaggctaaggaagacacaaaacgtcaacgtctggtctccacatgcatagcatagataggcatacctgcaaggacacagctaaaacagggtggtagtctgcgtgttgtgggctgcttttaagattttcattttcagtcatgcatgtgagcaagcacctacagagaccagaagacggcctcggatctgcaggagctgaagctatgctcaggtgtgaactgttccactgagtggtaggaactgaactcagactgtctaaggaacagcgtgtgctcctaaccactgagctcgctccggcctcttctttttgttttttaagatggtttcatgtagcccaggctggccttgaatccattgtgtagctgagcatctggggatcccaggactttcggcgtgctcgataagcactcttaactgagctgcgtcttctcaagtcagtgaagtgaaaaacctaaaaacagttgtcctaaggggctgaatttaattttacataatagtactgtaaatacttcatagacatgccagggaactttaaatggttgtttgagcttgaggtatcactctgtgtctctgtggataccaactaggaaaagtgtaggctggtatccagagcatgggctgtggtttcaggatgtccaggcttaacagctcctacttagtgcccgtgctgagtgatgggtgcaaggttaatgctaagtgagatgaaggagcggggagcactggtgcggtgctgaacactcactgtgtgctacctattagcactgtctgtatgagaagcagtcctctgctttgtgttccctccttttccctggctggtccttcttggtctcccttgctcattttatttccaagccccttaaagagctgg

SEQ ID NO: 32743 - DNA, 1193 bp, Mus musculus
tataaaattggactttatgagaaaataaaagtcatttcactctattaaaaaaaaaaaagaaaccacaattctcaccacacctgtacatgatatttcacggagaacgttagggtgagggataaagggtgagcagaaagccggatcagagcaggtggctctggcctggaaggggtacactcgctgtaggggggaaagagtctgggactcggggtctgagtgtgggaaaggctgtaaaatgaaagcgtgctcaactcagtggtgaacagcactgctcttctgagatggagaaaggtgcagagaggcaagacctgaagtgcaagtcccagcctaggctctgtggaccctggggggggggggaggagggggaggggaggggttcttttttgtttgttttgtaaagaacattagcaagaataccataagaagctgggatgtaacataaacgtaattctctgtgcactctgactgatggtttgctttgggttttgtaattccaggtttgcaccgccagcttctgttcgttacgtcctttgtctttgctggatacttttatttaaaacgtcaaaactatttgtatgctgtgaaggaccatgacatgtttggttatataaaattacacccagaagattttcctgaaaaaggtatctcgtgttaattgaaaatgaaaaaccgcttgtttactttgtctcattctccctggttaagggctcaggtactggctgcttgcgtggcctcaaacatgttcttctggagccttttataagaacacatccattcagaggccccgcctcggcctaccgtagcgctggggcctgagccagcatggattaggggagacacggcattcggcaggtctccatcagtaagatgagtcccgatggcctttctctttcagtatagccctatttatttacttaagccatcaccatggttattactttatgtgtttggatgcgtgcctgcatgtgcgtctgtatacagtgtatatacttgaggaggccagaagagaatgtcgtatcccttggaagtggagtcacagacagttgtggcagccacagacactctgggagtggaactggaagagtgcaccctgaccctagcctttatttgtttatgttttgaatgctgaagcctaagcccagggcctcagacactcagcacatgttctgcccctcagccacatccctagccca

SEQ ID NO: 32744 - DNA, 1099 bp, Mus musculus
cttcaaaatttaccattttttagttgttaaaaggtgttagttgccgggcgtggtggcacacgcctttaattccagcattcaggaggcagaggcaggtggatttctgagttcaaggccagcctggtctacagagtgagttccagggcagccagggctatacagagaaaccctgtctcaaaaaaccaaaaaaaaaaaaaaaaaaaaaaaccttagaagttgtcaatgactgtgtctttaaaccaagaacagataagaaaggcaagtaagggggctggagagatggctcagcaggtaagagcaccgactgctcttccgaaggccctgagttcaaattccagcaaccacatggtggttcacaaccatccgtaatgagatctgactccctcttctggtgcatctgaagacagctacagtgagtgtacttagacataataataaataaatcaaaataaaaagaaaggcaaataaggggcattcatgttacttatttttataatggtcattaccaaggcttttagaatgcagtctctcatttgctgtggacatgaccataaagaaaaattcccatgaggtttttcatatgctactacctgttgggaacatttgttaaaagtaaataaataaataatgtaaaaaataagtaataaaataataaaaataaataaataaaattaaaaagaatgcgggtttgactaagtggtactcaacctgtgggtcatgaccccttcacaagggttacctaagactgttggaaaacacagagatttacattgtgattcacaacagtagcaaaattacagttacgaagtagcaatagcaatgaaaataattttatggttggggaccaccacaactgtattgaagggccgaagctttaggagggctgagaaccactgctctaagtggtgaaggaagaatgagaagttcgccaagtgaaggaggggaagagctcatcacagactagggatagcagagaaggactaaggcttagtccctccagcctcctgtcaaagcataaggagatgcgaaggccgaaggagtggctcagattccagagaacactgtctgactttgatgtttagagcatagaagaggttgg

SEQ ID NO: 32745 - DNA, 1133 bp, Mus musculus
gaaggaggtactttgagaactttgaggaggtaggaatgaggaaaggattgtgagtgctggcaggacaagtaatcagatgtgagatgacgcctgcagcaggcccagcaggcttccgggaggagagggtaagagcaagttattcatcagatgtcattgtcctggaagcttctagcctccctgcaatctcggctagacctagagtgttttcaccctctgagacttagtgctgaataaactcacctttccttgttctttctgaactctggctggctagttcagctcagctgtaatggctcaaaactctccacactaactgactcatttctctcttggcctctgactgaactgctctgcttggcctcagactctagcagtctgttgtaatcttctggctcctcctctttctctggcttgtctgtcttcccctgtgtctagcttgttctctctctgcagctgtctctgtaaaggtctcctggtaagtctgcctctttgctctccctctgcactgctcgctcctgtgttgcctgttttctctctgttctcctgagagttgggcacatcctattctgtcacaccattctctgatttgtcactttgtctgcctctcaatcagacatcacttcaaacgcggtgcttcctctacaaactaacttgaccttcatttcttgggattcagtgtgtgtactaagggcacgtctgtattccagccagagggcttaaaggtgtgtgctaagactgagccacaccacaattagaaataagtaatttcagtaaataacacaatctcaggttcacagtgtgatcaaatatcctgcaatgggtgtgggtacgtcacagatcatacccacagaacttctgagcgagtagaaagctgtaactgcagtgcttctttgtgttttaaggttagccaccctagctgtacttgtagttgcttagaaactgatgaccagtcctcatccggcctataccagttaagtcagaatcctgagactgagctcagaggtcttagtctgatggacacttgttttgttgtgtaaacaatcgcaggtggatttacaggtcatctgctaaactatcccgaaaagaatttactctaaaacatctctactgccttccaggcaaacacttgcctg

SEQ ID NO: 32746 - DNA, 1133 bp, Mus musculus
tttgcatgattgactgattgattattatgttgggggttttttgtttgttttttgagacagggtttctctttgtagtcctggctgtcctgaaactcactctgtagtttcactctgagttgtttcaaactcagagatcccctgactctgcttcctaaatgctgagattaaaggtgtgcaccaccactgcgcagctagataatttttttaaagaaaaagaatgtaattgttgatttttaagacatatttgatttcaagaagtgttatgccacaattgtgcttcttagacaatgagcaaataaataataagtaaattattttacttacagacttttatacacgaaagatcatgaagtagaaaataactcaatttgggccagtaaggtgctttggtggataaatgcacttgacagcaagcatggcgatcctgactgtgccccctaggactcacatagtgggaagggaaaatcaactcccatgaattatcctctgacctctgtctgtgttctggggcatgcctatagaccagtaacaacggaataaagaataacccactcctcaacaagatgtaacctcattgcttatctccccagataaaggagaagctacaaatcatggtgtgtggttatattcctagcagtggggatgctgaggcaggaggattatgagttctaggccagcctgggctatttaatgagactttgtctcaaaaaacaacaacaacaacaaaaagagaaaggaaagacaaaaggcaatttttggtactcagagaaatcctttgaaagtaaataaatttggtagcacactaatttcagaacgtgccattgctccattaccttcctccttccccgacacttactgctcccaccctaccggtctcccgtgctggggaccagcaaggtttgtccactactcaggtgcacaaccactgagttacacttgtagccctggcttgtgtattcactggaagctgccatcaattatgaattcacaagggacattttttatcatttgataatttgatcatatttgataagaattggatgtttacagacatatttctctaagtgaaataagacttattttttgagctcttctcactttggagggaataatgttgctatgaacatttgtac

SEQ ID NO: 32747 - DNA, 1170 bp, Mus musculus
ttcccatgtaaacagtcataagcgaaaatgaggtagcgttggtggcgggccacgttagactgtacactcagcccttgttgctcatacagaccctctcagaagctgattaattagaacagaggtctaattccccactcctggtcatgcacacagctccctgccctatctcacatttataccactttgctctaggagaccgttctggcacactcaccataggggtttcagttcgtggaggtgttctgatcttaataatgttttagatacatctatcccatacacaagctatgtgatagaatgtaacaaattaccagtgagaagggatttattaagctctagatattttgaatgagagaaaaactaaggaactatatttgggggagggttgttttgtttttttgttttttgccaaactggcacaagctagaacatgtgcaaaaggctgaataagctccctgttctttttgccactggatgatggaagaatgagcttgtctaggtatatattttcttgactttcaccagtttcagaaggagtctaatttaaacatttggggtttgtttgatctgtatttattgcatcctggccataggccgggggcctgcatgttatgtttatgaacagctagaacacagccatgtggaacttaatggctcaagatcttctaaataatttaacttattttgtatgttgcaaaaaagaaaaaaaaagtttattttgcttgagagtcacatttttttataactgtacagcttttaagggatgggaggtggggaaataccctaaaataggatgtagatttttacagttgtgtttatgctagaacatctatgggagcattatgtaattaaacctcaaaattgtttaaaaccttgtgccatggtctttttcattatacttccctttagcaagagttggtgcatgtcaatcgtgcactgctgtgtggacagaccctgagattagattaatacctatttccaaagctttcatccattgcatgaattacctccctacacacacgcacacatgcacacacagaggtacagttcctagtcgtgtaaatgcatcttcaggatcagtataactgaacacgcagaccctggcaaccagcagcattactcttcccgtgcatgactttgtggtgttgtctaggctgttactgatgttgc

SEQ ID NO: 32748 - DNA, 1111 bp, Mus musculus
catgctatagccacacctttttaaatgtcagtactccccccaacccccactccgctatccggtaatttcaccattctggtttactacctggatagcacaactgtattcttataagtaattaggtttatctaaatgtgacaatttctaagtaaccttcatctgctggctactaatttggaacataattttctttgctatttctatccatttagaagcttaggggccgtgagtttcaatgtgaagagtataaattccagctaagagtttgtaaattgtcttatcttagaatctcacttcaattttaaagtagtaactaagttccaggaagcacctaatcagaacatgtcttggattttaagatgtgtttatttgggatactttattttccctatgcataaaagaaaaatattgctggaatagttctccaactactgtttttagatgagagctgaagcagaagctccaagactagcaatcaaagtaactcttgaggtaattaggatcatgctgttagtcaaagagaactgggagtgcgctgtcacataataatgtactgcacatgccaatgaggtgcacaaagatctgcaatggtgacgctgagaacacaagtgaagtgaagtttgtgtatggagagtatggcaggtcctgagagcttcaagcttcaggagtgttagaactatagttcatagttgtttaaatataatatttcttgtgacaaccaaaatatgttgtggctggtgccaatattttcgttaatgaaatgttgaatgtcgcattacagtctgatcagaattctcagtgtaataagccaggcctaagccattttatagctattggcctaactgtgtaactttttttttcaaaatgttttattataatacttgtcatttctttcacttaatatatgttaattgtcataataaaaagtttaaataagttgatgtacttagcattgtgtttgaaaacatagtttctgttacattttgtggcattatagaaagctcggaattttcaataactggtttgtaagaggtgaagatgttctgtgtcacccaggaatagactgttacttcatgatctagaaagcaaatttgtaagtagatcgactccc

SEQ ID NO: 32749 - DNA, 1099 bp, Mus musculus
caaatatgttctcatttctagagattttaaaagtggttttatgttttatcctttatgtattttttttagattttctgatttttttaaaaaggagcatatgttaattcaaaattcttttagtatcaaattttgtgtttacttgtaaaattcctaccttggaataataaaggatccactaatttaagaaacaccctcttccttctgactcctagaaagtctgttctctgggaactactgttttctagtttattatctttttaaatgttttctcaatctcttttgtcttgtctttttagacaatgaccctatcaataaacactggaagtttttggaagcctatacatctccagcaaatacattatttatcatccattttctttttttttccaattgttgaataaaataatttaaaagtgttctgtttgtttagaacaaggacaaggggacatccctacattttatacctatgaagaaggactatcccatttaacagcggaagggcaagccacgttggagagattagaagggatgctttctcagtctgtgagcagccaatataatatggcaggcgtccgaacagaagactcagtaagaaattatgaaggtgagtgttttttctcttcagactgggaaatcgtagccaagttttctcttagaagccagaagactgcagagtcattgctccagactctcatacagttttggctctgaaggagtgacatgtggcagtcctgtgctttctaaccccaagccgattgtgtgccacacctggatttaaagcacatctctcaatatttactcttttggggtaggggcgcgggtgttttcttaaaggcagggttactctgtgtagcttcaggctggccttgaactcagaaatctacctgcctctgccttcctactactgcggttaaaggcgtacacacacacacacacacacacacacacacacacacacacacacacaccacccctaatatgtgctcatgtcattctttttagaactctgttgagttggtttatgatcgaattttacacattagacagctaaagcaagaagaattaaattgcttgaggtcaaagagctgataagtggcaa

SEQ ID NO: 32750 - DNA, 1600 bp, Mus musculus
tttttgatcattgtatgtgattgtatgtgctgccgggcgtggtggcgcacacctttaatcctagcacttgggaggcagaggcaggtggatttcggagttctaggccagtgtggtctacagagtaagttccaggacagccagggctacacagagaaaccatgtctcggaaaaaaaaaaagattgtatgtgcttttaaagcctgaagaagggctagagtgttcatgttcaaacctgggtgcatgaggtaggtacagaagagtacacgtgggtcatagggtcacggctcaccatgcatgtgcacacgtgctgccagtttctcagtttcctcgtctgtaagatggaaacatagttgcttgtcagggatattacaaggcctgaggtacaagtctggagccctccaaggctttactaaatagtggcaattactaataataactgtgagccctttgtcttccagattctgctcataactgtaggcaagaacgtggtgcctcttcactccagaatggggctggtgaaaggcatttttcttctccaaaactcatttctcaagtcaaactataatgagacagcaagctgtcaccagcagaagagactatgtatgacctctattaacaaaggtgaattaactgaacgggtatttgtagtttctcatttcccccaagcttcctgtgtatgttctgagaaggcctctgagtcctgcctttgctgtgtgcgtctgtcagctgcaagattcgcctatgtggtgaaatgcacagagctcacactgggcggaagggacgtgcggaagcttagatgtctctgggattcaggagaactcttatccctgagattaaaaagcagaggcctcagagggagcagccgctagcattttccacagaggcatgggtcctctacttggggctcagccacatctcgcaatacttgtgtgctagcttctgttattcttcatgtaccatcagctctgttatgttctcctaggttaggtccttgactgtccaccctcttaacgttcgctttctgtcacagaataaataatctgaaatgaagtctgcaaagtactctcaatgatattttgtctttgtaatagttaacaaataaatctgggtttttttctatatcgctgtgattttgctcttgagtaaaaccattaatgagaaaagactaagatatttaaattgtacatgtatgtgtgttttgcctgcgtacatcatgtgcgtgcctggtgcccatggaggtctgaagaaggtgttggaaccacaggaactggagttccagttgtttatgaacggccgtgaggatgctggaaactgacgctaggtcctctgcaagagcagcaagtattcttaactgctgagccctctctccagcccagcacttgctgctcttttagaggagctggattcagttcctctgcttctgtgttgggcagctcacagctgctatatgctgctggcttccagggatctcaatagcctcttctggtttcctcagctacacatgcaaatgcagacagacgcccatacacataacaatagtaacgttttaaagtcctgcgggggcgaggggtgtgaattagttggtggagctggtctagctg

SEQ ID NO: 32751 - DNA, 1165 bp, Mus musculus
gaatctcagccatcccattccttacccctcacaatcagttcttaactatataaacttttggtttgatagcattatcgatttgagatcagttgaaattgctttacttttttatttctgtgactaaattgcctgaacacctcattgtatttgaaaaccataacagctttgaaatgccacggggcctgataatctgccagggacaggaagaggctctgtttcccgaaccatgcccttggtgcagctgatcctgacatgggagaacgaccatgtttttctttgtgtgtgcttctagcagctgttttggagaaccatgacccagtagtgttccctgtgctatttctagtgaaatggtcttagctatgtagcagcttttgattccctgcatcccctaggctgctgcttgcattctgtccttatttatagcattgagagatttcctagagcacatgctgagtaagagaagtgtgagaagtcagagggaaagtgcagctacttttagcacatggctggcttcagcacctgtccggctatacttgtgtgatatttcaagatctcagcctctgtttctacctgggactcagatcttctggtagcttaactatttcagtcgaaagagaaggtctctaaatccgagatgatgtgctactagtaataaggggaccctgtttttaagtgcatgaccaagctctctgcaagtggacatgcttactctctgcaaatggacgcgtattgcgggtgtttgctacctcctgccctcctcatggttttggttctcctgctgtggtaggatgcttggccagcattgtggcttgtcatgccagccccattgcctaccttgtcatgctcagaggtcctactgcctcagcagcacaagtttctatttccttcaataaaaggagatgaaaatattctacaggaagtgtgtcttttttccccctctcttttttgtttttccctttctcatgaagtactactcatgattcttcataaactgtttgaaagtaagttgcagttggatgccccttaccattatagatgtccgtctgtagtcttttgtttttgtcttaattagagatttattgatgtgaagagacaccatgaccatggcacatcttacaatggaaagcatttaattgaggttggcttacatttcagaggtttagtc

SEQ ID NO: 32752 - DNA, 1218 bp, Mus musculus
gtactcctcctgctccagcttgaacacgtgccgcacgaagaattgctgcaggtgctcattggcaaagttaatgcagagctgctcgaagctgcagagggaagaggaccttggacatgtggcgcccaacttctgccctgtcacccagacccggctctacctagatcacagcttgacacaagactcccatcacgtgggctagggtacaactatcaagtccaactcctacgctgaagacgactctggggaccggcaagggcaaaggacatgcccaaggtcactaagggccagagaggcaggctagaagccaggctcaggactctttccttggtgaccagacccataggggggatgtcagaacactaggaaggtgggtcatagagaaataacagattgtcactgagaggccgaggctgacactatccaagcaatcagagagatccctgatgccagcccagctaagcaacatccttgactctccttttcagtatggtgtcttggggactcggtgacattctacattacaagaattgaagtgacttcgactaggaggcctctgtgccttccaaggggctcccctctctgctctgcaccagcccgccctgggacctccacctgaatgaacctctcaagccactaggcagctttgtaaccgccctggagcctctgtcaagtcttggaccaagtaaaaataaagctttttgagacagaaaaaaaaaaaaagaattgaagtgacttgaagtgtctctagtcataagctcagagaccttccaagtacccagaacactgtaaaccttccccagtatccaattgggctggcttcagctgacctaggactggacatgaaaaggctctccagggtgactgaagtcaagtttcccaagcctgaagctgttcttggaggcaggccagtgtagcttaaaggaagaggcatggggccccccacattacctgttcacagtgaagttctcaaatccaaagatgtccaggagaccgatggaccggcgagagttcttcacttccagggggggtggcttgtagattgctgcgttgatcttctccacaatccacacaaagagccgcccatagatgccctgaaaggcacccatcagccacagggcaaggcagaccctccctgagtggcagtcaccattcctagacacactgggtctgggccccagccttacaggtgacattaatgcccccaagtcttcctgaggc

SEQ ID NO: 32753 - DNA, 1231 bp, Mus musculus
tgcattcctgaggaactcttgtttactggtgctgtggctcacaggtccccctctgtgccctccttcagcttccaggccagacttagtagataaatagtaataataataataatacaattgagttatcagccacaattccttttggaactgttacactctgcctctggtccctccaacgtggtcctcttcctggctggaggtgctggattctgactgccatcttgctccatggtggctcttctggcctgggacccggtccacaggaagggctaggagctgaattaaagatgagagcatccctcctgcacactggggcttcccttcaccaggagcaaatcacttcaacctcccgtgcctcgtttcctccctctgtagcatggggctcgagactcctgtttgtgagggactcttacaaggataagagcaaggccacaccacttccgctgtgtatcagtctatcatacactccgcacggtcacatgatcacttcacttctcgatggctattgcagaccaagactgcagtcaagaagggagggtgagcctcacgatcttgggtctcagggcctgacataggggtcttagctcagccatatccctctgaggcacagggcgagcagggaccaagtagcagacgagtcgatgcttcacctggcatctagccactgcctcccacttctagcagaactgggtcagcagccctgttcttgcttcctctctcttaagctaggccaggctggctcctggctgtgaaggaacttccggtccccaagaagccttgaagactggacaagggaggacagggtggagcagggatagccgtggcttcatttatcgtttgcacccaggaggccttgtagtcttccaattgcaggagatcagccctacagtgtattctacgtgaaccaacagggcctggccttcactcctccaggccacaatgccctggggtcaagggaaaggaactctgttatcttctcagaataaatattactgccgctctagagggatctgtctgtttcatttttcccgtaccccgcacccccccacacacaagggtaaagacagagggcacaatgggtagctgacctctggtcagaaggatgagcaaggaaggccttgggaatcacagataaaagctggccttgctggttacctagtgagtcagagcccagctctgtggaatccttcaggttccctgcttccagtcagtgtggggctggctttgctga

SEQ ID NO: 32754 - DNA, 1133 bp, Mus musculus
ttgatagatatttggacaactggtgtgaagatggggctcttaaagcctagagaatttgagtcctaccgtggtggtgctcagtctgggaggtgttggtttgcttttttgttttgtttttgttcagttgttgttttggtttggtttggtttggttttgactccatgtaacctgtcctggaacttgttctgtagaccaggctggcttcaaactcagagatccaccttcctgtgcctcttgagtgctgggattaaaagtacgcgccaccagcagctggctgagagcctgggagttaagacctgagctagaattgccttgctatgagactgtagcagcctgcagcttcagacagctcctgtgtgagtgaaaagattcagacctgcctggagacctgagctgggaattcccttcctgttgtccccaggctggccggctgttaccaggccctggacggaggcaacacggccgatgcattggtggatttcacaggtggtgtttctgaacccattgacctgaccgagggggacttggccactgacgaggctaagaggaatcagctctttgagcgagtgctgaaggtgcacagcagaggcgggctcatcagtgcctccatcaaggtaggggggctgcagggaagaccccaagccctggatgggagggagtgggactgagcttgggccccagtcagctcatcataatgacccttggctttctgggagatggagtaggtggggagcatagctccccttccccagagctgaacagcaacgcaaatccaaccccgccactatgcaatacccactacaccgttcacaccccattcagactcccttaggctcttgtgtcccagcctttgagatactttgtcaaggtataaagtgtcagaagttaaggggaagctggaagaggacagggagtctctcgtccctttaagtgatcaagagctggtcttcaggagggtcctctgctcagtcactgctgggagaaaggtgggttcattgaacccagcataagctagctttctgcggagcttggtcagctggctctctagagacatggagccctgatttgtgccttctgctgagttccgtggtataaaccctcccgtcgagctcattttcctcttatgtattcac

SEQ ID NO: 32755 - DNA, 1158 bp, Mus musculus
atagactgtagaggccttttgggtccacgtgggaagatggatgggccccctgtggtgaagagcgggactgagagataaagagactgaccaagagatgcaaacggccagcactgattcctcccttcagggatgggagactgagactggacaggaacaccttccggggaacctggcaagaaggcgtttgccctgctggccaaagctggagccaggaggcgaatgcccagcctctggcagcaggaaggttctcctcccagtgtcggcagcagcccgctgtgaccttagggccttcaagacactgggcaggatgacagcggggcttgatctgactgcttttccaggtctgggcctggtttttatggagaagtgagagagcgtgtagaaactgaaacaactctagccacccacgctcatatgggtattgagagatggcataactatttgtatggatgtgggcctgagggctagtcctggtgaggagtaaggctaactttagtttaattattgagctggtactggcttgtggacttggtggaggtgatcctgactgaggcgtccttggtgcagtgctttttgaactgggagactgagactcgaatggtgtagcagagttagaggggtccagggctctgagctagcaacagtgatgtccctgttaggaaggctggcatttgctgctcgctggtgttgtgccctgctgtcacccccctgggcatatcctggctgttctcctggagtgcagacccctaagtaaggcttgggtgggggcagttaggatgcctgacgtctgaagtgggctggagctatctgactgtgatgcctaaactgacaggaaaacggtggcacagttagcaggttcagctctaccccaagtctcattgtccctcgccttgcacatcctgaaagccttccattgcctgttacctagcatcagccagaggtacctcagcagtgtcccctgactgtctcaaggctgcctccctcgggcatactgaaggtaggatctgtcccagctggtgagctgccaggactgcaaaccccagctcaggtgcaggattctggaggcaggagataggctgtggtaccggtgtctcttgagccggtgcctctgctccataacatgcttgccgaagcactggccggtgcttctggactctg

SEQ ID NO: 32756 - DNA, 1238 bp, Mus musculus
caagaaaataaaaaacacctactgtatgtagttctgccaagatggtcaagaaccccccaaagacttgtacatttgaagacaccatgcccatcacaagagatgaatgactcagcctgaatgacccagccatagagaatgggcaattggcctgttgggtatttagctcctggctttatctcgtttgccctggacctaagatgcttagagaaaaacagaaagtgtatatttatattctagaatggtggagaatttgggcttttcttaacaggttaacagtttgtgctggtcattcatggaaaattaatatttttttctttttttacaagagttgcatgttaattgtatctttattaatttttaattaaatattgaacaaagtcattaagtactggcaaaataccatatccagatggttgactgtgagccagcacttagccgtgtcatctttgatttacattcttatattaatttcacagatggctttccagtaataaaaaagaaaaggtgtgggattctaggcagctccttgctatctgccttggtgctagctggagtcttagaagtaaactctgacctgccagtgagtgggctctgttctcatcacattcaagattttgtcttggactctgtggcccacagccaatcaaaggggtgggccatccaacaccccttcagaagcttttccagaacacccgtggaatgtagtcctctcaccagttagaggctgttgttttgctttctttgatcttcaaattattattactattgtgtctagcaaatttaactggtaatctgtaagacaacacagtttaattgactttatcagggaaagttgtcagttttttaatttttccattatgcagtatgcatagtgaagcaaatagttctaattcggatttgaatgtatacgaaattgaattaataatcacaaacagtaaatgaaagatcatatgttatatctaagctatggccccaaaagaaaagtggggtttttttccccatgtgaaattggtttttaaaaaattctcatattttcaatattcattaacaagctttagcctggcagggtgatgcatgtctttaatcacagcacttgaaaggcagagataggcagatctctgtgattttaaggccagcctggcctatatagttccaggatagtcaggaatacatagtgaaactctgtctcaaaaaagaaaaacagtgttggttcattagttagccttggaatatttata

SEQ ID NO: 32757 - DNA, 1380 bp, Mus musculus
aagctcaagtgggcaggagctgaggtgttttcaggcctgggtttgctgcaggaactagacctgtcaggctccagcttggtgcccctgcctgagatgctgctgcatcacctccctgctttacaaagtgtcagcgtaggccaggatgtgcagtgccggcgcctggtgcgggagggcgcctaccaccggcagcctggctccagccctaaggtagtcctacactgtggagacacccaggaatctgctgccaggggcccagacattttgtgacgaatggtgtggcctgaggccacttgacagactgctgcctgggcttgctcaggtccccactaatattttaatgtgccaatgcctgtggagagtctacaggcctaagtggcggccatctcagtaaagatatgggccaaggatagtttttgtacctggggcctatacccaataacaaaatctgccggtttgtcacagtggctcacctcccagaactctgagcaaagggactgtgatgccaaaccagactttggtcccttcctgagccctgctccagttgtccctaagtgccttcccttttgtctggactgacctgacccatgatgtttggactacatgtaggtgagcgcccgcattgcaaagctgactcaggtccactgggctgaaggtcccttggagcccagtgtctagtcacacctttttgctctgggcccatgaggcctacttcttccttttctcatggaatcctgggtagaatcttaataatagaaggacttagagagaaaatcaaatccaccctccttgtggggaagatggtaatatgggaccaagagcagcaaacgtgctcacctggtgtcttggagcccagcctcctgctgaggttgggggctctgccatccctcccctgctgggtaccctgttaccattcattgtctgtgctgtttcccattgtgcccagcagtagcaacaacaagatcacatgggtggggaccctaggtccggtggccagcttatggcaggagcaaagtcagtccccctttcagagcctcaggaagcttggaacacctcagtcacaagcctgtcagtttcttcctctgggatgggagtcccgcagcatcgagactggaaacgtacacatttcccccagggaccctgtcttacgatgcttttctacgtcaatgcaattgtggccatctggccacaagctccaagggacttacaagctcaagggccagagcccagagacccattttcccctccaaggagtggggcaggaagggtctcccaggcacgctgtgctcacccccagggccacatctcagctctccagccctggattctttcctgtcttcattttatgagttgttgccctttttttttttttttttttttttt

SEQ ID NO: 32758 - DNA, 1179 bp, Mus musculus
gttctggaaacagcacacgggtacttctcttcctgtcagggttcagggtgttggggaataggagttacccaaaggctgggagggaaggcagaggccagtcgctgagcatcagtctgatctcccatttgagcctgagtgcagagagctgctggagaaaacagaaccatggggctggggtggggggtgtttgatcattttttcctctggcctttggacggtgatggagtctgggaggcctgtctgaaggcagggtgctgcatgtcttccagtcaggaagtctgggagttgtgctctccttccatagcctctatcacctggcatgtgtcctgtcacctgtctgattctcaggctcctttgaagggaaattttgatccctgttcactgatggtgttgtgactggtaaatagcataacaaatgactacatgtgctaataaacggagattggtttttgggtgtctggttacatacattgtgtgaatacaagaggaggcagaaataacatgaaccctcaactttaaacctggtttaaccacttagccaaacccttagttccaggaagcacccaagcagaaggaagcctttctgtccctgtcattttcctcctctggtttctgcccccaccatgctagtatccacgctagagaggagctcggcacattcttagacagccatagcccagtggcccttcaggggatgaaagccaggttaggctgggaaggcctcacgaaaaggtagcttttgaatcaaacaagtgggaatttgtggaagacaaagcgggagggctttgccatctttgtcaaaagaagtagcctgtgcaaagaaagaagtccctggggagtgacggatattcagcctgagaggctgtctttgtggaattgggtttagatgaggcactgtggtgggggcttggtcttcagttggaggctgtactctggtgcccagccactgggcacttgtgtagagctttggcagtgtttagaagtggaggccagaggccagagggctacagagttctcccgagtatgacctctgcagggtgaggaagaggacagacagtgacctacctgcccaggagtgactgctgatttggtgccagcttctcatttgaccataggtggcaccccctacttcagcttgctctggcttctgtcagtcaccttcccagatcccagggaaac

SEQ ID NO: 32759 - DNA, 1183 bp, Mus musculus
gtatacatgtgcaggctggaggacaacttacaggagttggctctcttgccacctgggtcatgggaatttgactcaggtgtcaggcctggcagcaggaggctttacccactgaggcatcttgcaggtccccaccttgttttttgcaacagggatctggagcttgctgactagtatagacctgctgcctgcatagatttgctgcctagcaggtccacttccccagtgctggggttataggcacaagtcatggcctggcttttcatgtgagagctggtttctgtttgtgtggcaagcactgtactgacctatctccccagggccagcactgagtttcttagacattctccaggttccccccaacccttattttacatgtgtgagtgtttggcctatacatttctggtgcaccatatacattcagtgcctacccatggattccctgggactgaagttacagacaatgtgagataccatgtgagtgctgggaattgaaaccaggccctgttagatcagctaccatggctctagatgactcttaactactgagccatctctccaggccctttcttaagtggattgacaatgacagaacatgtctggatccatccttagacatgcttttgctgaagttgatagcactatttctttgttttatgtttaagtccataaattaaaagtaattgcaagctatctctgaagaatatttagagataatgatgtacttcggcaaagccattagaattcttttcatgccgggcgtggtggtgcacgtctttaatcccagcacttgggaggcagaggcaggtggatttctgagtttgaggccagcctggtctacagagtgagttccaggacagccagggctacacagagaaaccctgtctcagaaaggaaaaaaaaaaaaaaaaaaaaaaaaaaaaccaacaaaaagaattctgttgatcattgaagatttggttttgagttggagatgcagctcagttagtaggatgcttgcctggaatgctcagctctgagtttgattcttagcaccacagaaaaactaggcagggtggtggatgcttataattccagttcttgggggttggaagcaggagaatgggaagccacagtcattccctaccacataatacatttgaccccaaatgtattatctcaaaagagatttggtttaaagtaaact

SEQ ID NO: 32760 - DNA, 1149 bp, Mus musculus
gttctaaatgtaatgtttttaagtttttaattttttagggtgcagtttgtttacgtgcaggtgtggtcttgtgattgctgtctatcacaagtagagtgaagggtaagggatgggagggtaagaattttgacaagctgtggcaaaggaaactatacctttcatttttaaaaagtgtaaatagaaaagtttttaacggttttatatgaatttcactataaataagcattttaagactgacaaatgttgaactgtatatacatttatcaacttaactgcccagtttttggtgctgaagtactgtaagtagaatttatcagtagcgtcctaatttctgtgtctacacctggggagaagctgtgatgctgtagttaatcaacttacacaagtgcttacacttgtgtaacttacactgataatctcggcaggagcatccctgagacacctaccttgtggtggtgattgtccccatttctactaggtgaaagttactcacccatagatggagctcttggatagcattttattgtacaaatgtgtttcaacaaccactttgtgactgttcctagctaaggggaaatttaacttctcttgggtcatagacatctttaagaagctgattattctatgaactctctcaccaaaaaaatacacatgccaggacacgtgttaagattttgcatacaattttagggacttaagaactcccaagaccatccatgtattccaggttaagccttctgttatggtcagctcattacttacaggtgtaagtttttatcaaataaaatatcttttggatacacatggatcaggaaataagaacaaacttgaataagttatgttccatctctactatcagcataccatgtccgtgttttgagaatatagcctctctgtgctccagcaggttaaatgacaaatgagtctactttagtctgcttttaaagaatcacttgtgcatatatatttgcacacatacatgaatatcaagtaagatttattttttttcctttgaatggttctaatgccaaatagagcatgattttatgaacaaataatattcactcctattttatgtgccaggtaaggctctagccaccaaggctattacagtgaggacatgggaaatcctacccagatggagcttac

SEQ ID NO: 32761 - DNA, 1465 bp, Mus musculus
aatggaaaaaagcctgtcttctgagtttggccttctttgttagaagaggcctcctaagggaatagaaagccacagttagagttgtgtgggatttgaggtgggatctagcattaaccctgacagctgtgaccttgaggacatctcttacctcctgtttcctcacgtgttacatggaagctacagtttccacccaacattgttacagatgcagtaggataacgtgtgagatctagcccagtgcttgtcatggaggtggtccaggacatgccagctttctatgcttgggggggggggggggggggaaggacacagtctcctcttggcttttccactataaacattctcttgtgaatcttctcttccaggccattccccagtatgctattccttgtcactccagctccaatgtggtggtggagcccagtgggcttctagagttgaacaacttcaccagtcagcagctagatgacgacgagacagccatggagcaggacatagacagcagcacggaggacgggactgagcccagcccctctcagagcgctgtagaacggtcctagtgtgcagacgccggagtgcactttagagcctgcgtggttaccaaatgtccagggaaacttaaaatttgttatagtaaaaaagaaaaaaaaaaaaaagaaagaaagaaaaaagcactttgctcatatttaggctggggacctagaagcattttaacaaaattaaactcacagaggaatgtactttaaaaaaaaaaaatagaaaaagaaaaaaaaaaaagcagaggaaacgatgcaccccatggagcccggcaccttgttggtgctaagcagcgagaagagactttcctgtgagtggtcctcgactgctttccactgagcaaataccaccagagagtatgaaaaggaaaagaaaggagaatatgaagagtttgtatttttgaaatgatgtatctgaacagtttttcaaaaattgtgtttgtttttgcaaatccctggagatgttgatttggctagcattttacatttgctcagttcatgattagtttatgaatacctagggaagtcctggcattggagtccttgctggacggtagacatcagtcaggttgctgcctgggcagtttggggtggcttgtacatgtgctccttggttgtatactaatttattgtggagttccacacttgcctatttatttaatgtaaatgttttgaagcaggccgaatcccttttcctacatgtcctgggaagctggatccctggccttcccaccttcccaccccctcacccccctttaagaagacggattagagaagatttggtccggaagcagaggaaaagacatttctagcccaaaggaaatgctcagtggtgttcctgaaaatgagctctgctcattggatgctttctcgacaccgacgttgcacacccgtgttggactgagactttgaaaacaactttgacttac

SEQ ID NO: 32762 - DNA, 1177 bp, Mus musculus
gaaaaggttctatgaatttccctccttattctggggctcaaactcaagaccatgcgtatgctggacaagcacccagtgtctggataacattcccagacccttggatttttagtaagtcaaatgaactaaccaatgggaagtgctactctgggatatgctctagagcaggtcaagctgatgtgaactgagtgtgccagggattactttgaatacaaaggaaataacatcctaggaggagtgaaagaaaaaaaaagagagaaacagctggctggcctggagtaatggggggacttgaatgtgattgcatatgaattattgtaggctgctgttacataggctgtagtctatacaaccatacagagcagtctgcagtttccaattcattgttttcttagccactaatggtaggacaccccagaggtctggttcattattcccatagacagctctggttttagtacttgtttataataaaagtaacttttccccgacttttttatgcagtaaaggaaaaattggaatctaaaccaagacaacccactattgacttgagtcaaatggcagtacctattcagatgacccaggaaaagagacattctcctgagagtccatccattgctgtggtagagtcagaactagttgctgaatacatcaccacgggtaggtgtcctcttaaaacatagtaataaggtagtgctacctttgcggacttcatggggtgctcatttggggaagacatatctatatatttctagctcttttcctgttttactcagagcagattgaattatcttcggagtttccctaactttaatacccccccccccctatttccctgactttaatcaatcaatctctctctctctctctctctctcccttatttctctgactttaatcaatcaatctttctctctctctctctctctctctctctctttctctctttctcactcacacacacacacacacacacacacacacacacagacacataccaaaaaaaaaaaaaaaagcagattagatacttaagtgtggtccagcaacaaaatactaatgagatttggggactggtacctatggagaagtgaaactctttctcttacattcgtgtgtagcctgctttctgtttggatgcgttattattttgagatcctaaggagttcaggggtagtgat

SEQ ID NO: 32763 - DNA, 1186 bp, Mus musculus
taaaaagtcattttagatatgacattatcactgtcgatccagttgtcagttattaagttatcaggtctttggaaaatgaattttgtgagagaaatacattttataatgtgtcatgatgaaaaacaccattgactttgacttggagtttcaggtgtttccgagctgtggtagcagcacttgggaggcagaggcatgaggatgacaggctttaggcctggaccacatagtgagcctgcttcaaagaacgagtgagggctgactggggtggagcctagtgtggagctcttgcctcagtactcaaaagcaaaaagaacagcaaaagtcacaggaagtaacgagcagccttctgtgtagatcctgtcagggcagaagaacctcaaaggaacaagttacagtagcagagccagccctgctgctcctcacttgattgctgctgtttgcatttctttgctgagcccacattttcataggcttgtttgctattcacttgtgcttcatggagaagaaagacccagaggccatccctataggcagctgacttgtctgttgtctccttacatgactgtgtctgctgccttggctcggttataagcaaaacctacagaaataaatgttttgtggtttatctaaaaataatacagaaaatattgctgttatttttggtgaataaaatcaattttgtatagtttatttcaacctaaataaaatgtgaattttgtttaaatttcaggtgaggtgtttttggtgggtcagaatacatccttgtatattttcttaaaatggttatttcataatcagcctcatgccttttacgattcaagatgaagtattttctagcttttctcttttcttttttattttttgtttgtgttttaaagtgtagaaaaataattaaaatcaagaagttattaaatgaggactggggtggatctcttgctaacatgtgcaaggcctaaaagcaagctttaagtttgctcttttaactggtttgctgtgtatacattatagccctgctatagattgttggggctcgtgtttactgtttgttgctggttagaatattgctgggtgaatcgcataattgccatagggctattttgtgttgaagtgagttaatgttatttgacctgcaaacagcagaattggatgcatgcattgcagcactgggtcaagcctgctgtttgta

SEQ ID NO: 32764 - DNA, 1191 bp, Mus musculus
agttctcgtggaacccaagaccctcctgcttcatcttccaagtacaaggcttagagacaccttcactcctggctctgtggctggtgctttatgtgtgtatgaacttatgcaggagcaaagggctctccatgagaccaaatactcagatttcttttcaggtaccctgcatggcagcactcaataggtctacattccagccctagccagtgcctatccagataccccttaagcactgtagttttgaaatgctttccggttttccaaaggaaaatgaaaccattgtgcattcaggtgcacacatgctgttcacaggacctcagctcagggtgggggttgggaagaatgttgtagctcatacagctggtgggaagccagggtttcctcccgtggtggtttctagggtttttgtcaattaccacaaacttgatggcttaaaacaactctcatggacaactgaagtccaaaatcaaggtgacagtagggccacacacttttctttcccgttgctaagctcctagacatttcctggctgtagctgggtaaggtcacatgacctctcctctgccttccccttataagcacacctgctggatttaagacccacctggataatcaaagatgatctcatccctagatcttttaatattttgtgaccccttttccaagtaaggtcacattcacaggttctgggaattaggatttggacctactttttggcaggccaccattccaccctctgtcctttacatggtccccacctctgactggccacctgtacccaagatttttaggattgtgagtagctgtagtgagaccaagcatgcatacctgtcactccctgcttccagaagccatgcagaacagatccagtgctgtgtgtgtaaaagtgctgacctccctccaagatgaacacccctgtttcctccatccttgccctcagttggctgatgttctcctgagcagtcatcctgggtgtgcctccctgaaggacacagagcaagggagaatactgcatttatccatgaagaccgagaaatgaggtcatgtctctcccactaactaaacggtgacccaggcatcagtgtctttgaaataatagtgacactgttgcacagtctagtcatccccaggtttagcctctctgctaatcccaccaggatcacattagcactgggagccctgtcacaaatc

SEQ ID NO: 32765 - DNA, 1182 bp, Mus musculus
aggaaatgccttaacaccagagctgctgggagggagagcttccctgcaagggtggacatcagtgcactccctgggcatgtcattgttcattcataaaaacagaattggctgagtgtctgtccttgtgccagggacagttctgagagatgaggacacggtagttatagggtttgggcccacagtaacaaatggagtgtctaggcacacattgcaatcatggcctttgtccatgtatcgtgcctcagttcatctcaagtaccagtagtgtgtggatcacatgtgagaaacactgtcctgtagcaacaggggactccaggagtccctagggtctgcattgacagtggcatggagataatctgggtgggtggctgcagagcactggagggttgtcgggaatgtctatcaggacctatagcatagttttattttattttatttattttttggttttgtaacatttgatgctatatatgaaggtttatggaatcatgaacattttaaaaatatttatttatttatttaatgtatatgagtgctctgtctttacacacaccagaagagggaatcagatggttgtgagccaccgtgtgggtgctgggaattgaactcagggcctctggaagagcagtcagtgctcttagtcatctctccagccctggaatcatgaaattttaatgcttgcagaagaacttcagctatccaaattttccaagttgagaaagggcctgacaaagttgaagaggtagaatgttagcacaagcacaaataaagcttgggtcacatggtttctaaattggtattcattctacactcctatgagggaatgttctagaggtgcctgaagaacagagagaatcagtcatagatactggaaatgggggatttgggagtcagaggttaaagtacttgctggacagatgaaaactggagtttaaattcccaggacccacctggatgcagggggactgtggcagcccacctgtaatctagccccagaaggcagagatggatccccagagccagctggctggccacacgagctgtgtagaggaggttttggcttgattgagatatcctgccttaaagagaatagggaaagaatcctgacctcatctcagccccctgaaggacccccccgcccccccctcattgtgttcacatgaaaagaaaggagtgagtaga

SEQ ID NO: 32766 - DNA, 1152 bp, Mus musculus
gctgtgggctgggctgtgggctgggctgtgggctgggctgggctgggctgggctgggctgggctgggctgggctgtgggctggggtgggctggactgtgggctgggctgggctgggctgggcttgaacatgttgcaggatgaggcaaagaaggaaagctctgtgagacagatgttgggtggcagatggggaaactgaggctctgagaggtggcggggtttgtcctgagtgaagccaaagctaagcttgtggtccacaccttactcgggaactcatggcagagtgtggagctaggcttcacccgggctcagaggccacactctcgggtggggtctttcccatgctgcccgtagcacagggtcacctcccactgggcacccaggaatgggccactcggtgacgctgactgacagatcctctgtccctcttctgcagtgggggagcccatcactgtccccaagctggagcacccgacccagaaagacatcgacctgtaccatgccatgtacatggaggccctggtgaagctctttgacaatcacaagaccaaatttggccttccagagactgaggtgctggaggtgaactgacccagccctcgcgtgccagctcctgggagggacgactgcagatccttttctaccgagttcttgagtgcattttgttctgtaaatttggaagcgtcatgggtgtctgtgggttatttaaaagaaattataatttgttaaaccattgcaatgttagatgttttttaagaagggaagagtcagtattttaagctcacttctagtgtgtcctgctcaaggtggaggctgatatttatgggccttggtggtttcttacccaccccttctagcgttccccagacgacagacacttggccctggctagctgggcaagggcagtccttagtgactccagggattcttgagaggcagaggccatgtcccacccgtggctgcaggtcgggttcctcgtaccaaggggaggctgagggcacagctggccccacttggggagggtagataacatctggactgcccggcttgggtctctgctcctcaccctagccctcttctccaatctgagcctaccctggcctcctgtctcctggctagggacacggctgtcccacaggtgccgtcttgggtta

SEQ ID NO: 32767 - DNA, 1162 bp, Mus musculus
gccagttggattcagagagccaaggctcccacaccgccttgggtgatcctgctcagtttatgtttctgagctggctggagttgttctatttgtggaagctgggtcagacagctcgagaatgagcccgcccctcagatgcgacgactcacttcaaatgttggtctgtgcctttgttccaaatagcactctaccctgcaacaaagccttacctgtggtaggcatgcatgcccttgtccactttccaattacacaaatactggctgcttagactcgtgtaggggacacgagtctcttgaagatcgcttttatctgctgtcagaattctatcaacttattatgaacaatctttgaacacctcgattctttttaaatcacattttctgtaaagtacatatatttgactttgtgaccatccatgcccttttgttgtattttgaaatattaagaacatgtgtctttctaaaaaacagacatttctttaatgaacaatttgaatttatgacaaatttgttgcaaaacttactttgttgctgttgttccataagaaacactaatcaattccagggaaatggactttgggtggaagtatctgtaaagaagtaatatgttctataaattaacataacatagtatagataaaaaaatgtctgggatgtatagacctatttggaacattgtttttttcccctcccctattgtctgactttcttttccttgctatgattctggagagctctttagtttaaatataccccatgtccattgtaaaggggcctggtgtcaccatagaagccaaattaggctccacatcaatggcaatttgatttatacgaccttctcttctcgccatggcggctgttccctctcctgggccttacaagtgacatccatcacatggcagcagtgtgagagaaaaggacatgtcctccatcatcgccatgcactggtctgtgatttaatgcacattctattctgtatgcagaatcgtatatgtgcaaatgcgcagtcagtgaataacatcagctaccctgggctgctctggctttgaaaaattgttcttatcagcaggtataaatggtatctgggggtatctttgccattatccataatcatgaggttgataaaattttaatgtattcttttgacatagataatactataa

SEQ ID NO: 32768 - DNA, 2476 bp, Mus musculus
tggaagtgtctgctgcagggcatcctccccttgaacagccccacagtttgcatcacgccattttggacttaggcaaatgttctttcccaagttcactggatgcttgcatgctgcccaagttcagcttgggcttcagcttttagaacttgtgaaaacgttaaaaacaaaagaacaagaaaccaaccttggccttactgtcagtgaaacggaattgtgtctgttaactagaagaaaccctctcctggaacctctgttaggagtgtgtgcctgtgttctgtgcctattggtgggctttgaatagtgtgtcaagtaataggccactggctgagaagtgacagagagtgagtatttgggatgctgtagatggtgtaggaggagctctgagcaatgggagcccgcttttctctgcccttagcatactgctgatgtgcccaacacctagttaagagagagtggtcaggtgtgagaaggcacatcgcacgcttattgtgactttttgttccttcggtgtgcaggtggagtgtgtaggcatgacggcgagggtggtgatgcaccctccagccccgaccgagctcttgctctgctccacagaaaggtcaatgtgctgagcatgtggccagtgtgtgtagcgagtcctgccaagcgcttagccagcatctttgactttcgaagcttagaaacagctcttgacgtactccgtgttgcagtgtcgcgtgtgtggggctgaagccccctagagttgtgttgtaggaattagggaatggttatgaaaggaacctgccctcctgacttatgaggaaacacaaactatccaccagaaatgtcctggtgcgatagagattgcttctgtcccggaagttctcggtgttctgggtagttggaatgatccgccccagcttgctttctcctgtggtgaatggttcagagggcagatctgatggctccttggtctcttcaggtccctgcagtttgggaaggtggagctccaaagagccaacaaagtctctccgtgcagacagggaaggcttcgtgtgcaccttgtgagcctgcttgagacatgtttgaaaatgaatgcatcagcactgggcaagcctttgtttttagcagagcagactagaaatgaagtctacagcatagcccgatgcctgcctgagtcttttctgactcagggcctggactgtgaaggagacaggctagagaagggaggagacatgatgagtctcattaccacaactcacaggtttcacaggcctgttcagaaatgcctagagctcagcactgttcctggctacctgttagccagccttactgtttaccagagactctatcaagtgctccaactgtagcggccggtgcgtgttcctctcaatccccggcgtcagtcagatctgctgttagccacactttgatttccctgtagaataaacatatgtttcatagatcaagtaagtcagagtttacagtgcacagggatccttcattcggtgttcgtgttctgcacaccttgtgccaggcttggtgagcagacaggtctctatatcagcacatccagacagagctgcatgacgaccccacatgtgccgtgactcagtggaattggtgttgtgtgcactgtagtttgccatagcttaccacaagggcccccagagccttaggggctgaattccttaccctgtcctgcctgaggctttaggtgacctggataatgttcttctcaggctgtcagggttccccccccccttttcacacacccacctaacgaacaccgtttgctcttgaatgtttcactccactcacaagaaatgccctttaatttctactgtttacaaacaaagctctccaggtcttattctgtctctcaagtgtactggacaaaactgaccgtggttcctcaagcaatgtttggtgtcacctctctgcaggtgaccaagcccgttcctcacttcgtacatttccctctgttctctgttcaccctggagcgagagagctggaacggggactttttctttaatttgtcctgcctgcaaaactcctggaagctatgcccggcttcccgttctctgccccagctcccagacagcagaagaagctttgtcacacccaggcagagaggaagtgtctacttaggattttgtggcccgggtgttgttgcataccacagattgtctatggatcatgtagtgctcccctctcttggtgctatttcattcctgatgttagtaaaagaatgacaaaaacaaaaaaaaaaattcatgtatagccaattgattgtgacgtcacgtggtctgtgcctgctcagaaagcaaatcaatgggttcccccccccaccaccactcccagttataaataaatgctaaagacaaacaccactttcttgatcgtatttccttggtgaggcccagcctgagtagtataaagacaacagcttttggcatctgagcctctctggacaagatgaactgtgccctgcagctt

SEQ ID NO: 32769 - DNA, 1099 bp, Mus musculus
gtactcgccatgtcaaccacacagcagagtcagctgcctctatgaccgccagcctcggtttggtctgcatccctttgtacttgatgtagctactacctcttctaagcagtcttcaattcagaaaatcacaagctctcagatacaaagtaatcttttgtttggtttgggtttttttgttttattttgttttgctttttgagacaaggtttctctgtgtagccctgaaactaactctgtagactaggttggcctcgaactctgagatccacctgcctttgcctctgctggaattaaaggtgtgctccaccaccgcccagctcagagtaatcccgtccccttccctgctcagagcagagacctctcatccctggcatagcaaagaggcatctccttccaccacccactctgaatttgagctggcagcagccctgttctctaatccaaactctgctgttccagctgtgtgaccttggctgagtcttagaatgtctaaaagcctcaaagttgttgctgtaatactagactgtctcaccctctaaactgatgtggtatccaaattcaggaaatgcagattggggcagccaggaatctgtttggtgctggagcttgcaggtggcagctggaaagagtgctgatagcaagggctcctgtcacaggtccctgctctcttgtgagagctggatgcaggtggaccacctctggcaatagttgaattcccagtgctttgctagagaccacttctctcccatctcctccctctcacctccttggttcacagtatcctagctgcagccactagcagccactggaggagacgccattctctctacagcaggactgagatccaggctggctaacatggctctcactgcccccgaccccctgccgccgctctcactgccctgcccctgctccagcccttcatgggctccctcctctctgagcgcctctataaatcacctgtgcagatcccagccttgcaattacgcgtccttttacacggaatctctctggtcacagagacacagaacagaccttgatgaattgctgaagattgctatcttttgctttacgggggtcgggggtggggggtggggaa

SEQ ID NO: 32770 - DNA, 2236 bp, Mus musculus
ctgagccacctgtccattcttgagcttgtgaagaaggcttcagggtggcctttgctgactcctgcccaaggtacagacctcagttatccaacggggaagaaagcctgtcccggacaccacccacgcaggaggacaggagcttcttgcagttgggagtgagagaggccaacgtcctcagacagtgaacacatactcggtgcaccaagggtggcatctagggcacgcagtgggatggctgtgggctggtcatatctgtggggacagagctcattgacacatggttttatttttccaccacagcacactgggatgagaagtttcaccacaagatggtggacaaccgtggcttcatggtgacccgctcctatactgtgggtgttacgatgatgcaccggacaggtagacgtcttgctagacggtcaaggtggggggggtctggggtgcccagatctggcttgccccttacccctcagtgtgttcagcatcctcttctcttcatccacacaggcctgtacaactactatgacgacgagaaggagaagctgcagatggtggagatgcccctggctcacaagctctccagcctcatcatcctcatgccccaccacgtggagccgctcgagcgcttggagaagctgctgaccaaggagcagctgaaggcctggatgggaaagatgcagaagaaggctgtcgccatctccctgcccaagggcgtggtggaggtgacccatgacctgcaggtgagggccggagggtagtgtctggggcaggtttcacccagtggctcagcaggtccatcctttatccatagggcatccagacagtactgggctctgctgatgctggggagaagtgggctctgcccttgggagggaggatggactgaacatagttgaacagcgactggctgttgtctctagccaggtcctagagtgggctgagccctctcaagaaaatccctcagggacatgcgtacaggccagtatggtctcaggtagttactgacgatggctttcctctcagctaactctagactgtgtcaagttggtagttaaagctaacagggataggagggctcaggtcctggtggtatacagaggaacaaaaggaacagtggtttgcagcacttccgcaccgtgcctggagcaaggtgtccagagggtgactccagggtggtgtggatggaggttgggggtaagagcccggcacgtgtgtggcctcaccaaccacctgctcccacagaaacatctggcaggactgggcctgaccgaggccatcgacaagaacaaggcagacctatcgcgcatgtctggcaagaaggacctgtacctagccagtgtgttccatgccactgccttcgagtgggacaccgagggcaacccctttgaccaagacatctacgggcgcgaggagctgcgcagccccaagctgttctatgccgaccaccccttcatcttcctggtgcgagataatcagagcggctccttgctcttcattggccgcctggtccggcccaagggagacaagatgcgagatgagttgtagagtccaagagtgggcgtggcacggcaggaagtagccaaaggttcctgagacacatgggtgctattgtggggggagggggaggcaccaaccctggatattccacgggtggggggggttggcagtgcagatcggaattcccatatgtctgagtgggtatttttagacagaatccactcctaagttaggacatggagcccagatactatgataccaaattcaggggtgtcacagccattttgttctgccctgcaagttttagatccaatctgcctcaacagtcaatcagtgttcatatttatggccaggcattctatctgttagacaatcgagttgggggtagggcagcctagctctttttgtcaccttgccccgagccctcttcagtcttcctgttcacccctcctccactccctttaaccgcaaaactaggtgctgtggccccagactacccatccttaaaatgatccttgcccagcggtgggagctgggagacagtgcatgggaggggctccctggcatgcctgccctagaattgttatgttgggcatcacagtcatgaacttttgtttttctcccttttttagttttttcaaagatggggggaagggaaatatgagcctttgttgctttcaaaacgagaacagtttgtacaagtttttttttttgaataaaacttttccaatgaaatgtt

SEQ ID NO: 32771 - DNA, 1876 bp, Mus musculus
ggtttcctggtggggtggattctggaggtggaggggcctcccatggcctgcacttacgagagttttgtgtacttctcaaaaaatgcatattcctgccaggtgtggcttgtggtattgcacacctttaatccatagctctcaagacagtgtggtggatcttctgcaaccttgtcctgacagcaaaggtccttggccaccagacaaagttgagcctgacagcctgggtttggtgtctaaaggaaggaaactgactctagttgtctcctggcctccatgcagtcacgtcatgtgcatgctgcatggtaatagtttaactagtaagagatgtaaaaacatgcctctctttgagtttggccagcccagataactggcttagagaaggacctgggcatgggggtataaaattttctagaggtgattctagtatgcaggccaaggctggaaagcatttggtcagtgaatggctgttctggtataactggttgtttcttctgtctaccattggagagttgttaatgtgaaaaccaaataggcaggttgtgtctttggtaataccagatgaatcttgtcttccaaagggcctgctatggtgtgcttcggttcattatggagagtggggccaagggctgcgaggttgtggtgtctgggaagctccgaggacagagggccaagtccatgaagtttgtggatggtctgatgattcacagtggagaccctgttaactactatgtcgacacagctgtgcgccatgtgctcctcagacagggtaagtagctgagtccctttaagaactgggtagctaggaatgcctagggcagagagtggcatttctatagacttatgttcaggaggagttgtggattcacttcaggggctgggaaaagtagcattgttgaaatggtcatatcagttgttagacatagccttctgtgcccttcagtgatgacacgatgacgagtcagaatggccacgtcttgctcttggtccctgtcagtgccatgttctgtggtgctgtacatggttcccttggcaaaagtgtcctgcgcactgattgatttagaggcatttgtctgagaagggaacagcgctcagtgcttttggatagatgctttccccgacatcctctgtggtggagaaatgccagctcactcctaaccctggcgtcttctaggtgtgctgggcatcaaagtgaagatcatgctgccctgggacccaagtggtaagattggtcccaagaagcctctgcctgatcatgtgagcatcgtggaacctaaagatgaaatcctgcccacgacccccatctccgaacagaagggtgggaagccagagccaccagccatgccccagccagtgcctacagcataacaggtatgtctgcagtgaccttcccaggtcaaactgcttttactggtctttcctctgatgtttcagtttgtgaatagggttattttagcttaatgtgggagaatacaagttgggatgtggtgtccgattgacaagtcggtcagtgggtgaatacccacttagttcgatgtctttgctcaagagtttccagctcctcttgtgggcattggtgaaggtagtatcaagcctttgtactgggttgtattaaggcaggctgagtgggagtggagtaaatgaaggcacgcaggtgcatttctcttaccattgttattttatttggtttcagggtcttggcagctgcatctggaggcatttaataaaataaagacatttaataaaatcttgaacaaagacaaggcctgactggattgtgtccagtattcaactgagttatgttgtctatggagccatgcttattctgttggtttaagctggagggcatgagcagagctgaccagagaagtcatgaagt

SEQ ID NO: 32772 - DNA, 1876 bp, Mus musculus; identical to SEQ ID NO: 32771

SEQ ID NO: 32773 - DNA, 2234 bp, Mus musculus
agttctggaccgactcgaacaccgggcgcctccagttccggactagacacctttgagcgtttcttggtctccataatagtaatcctgtggcacagttagagggcgtgtgccatcagatctagtccagtttctttagtaagtgaagtttagcagtcccttctcttagtcgcgtgatcctgcaagtggccatagttgaaagcctacttactgactgctgccgtgttcactcgggacccggagctgcagcgtccctgtggttatcatttcatgggggaaaagtgtgcaggttgccaggtttagaaatagatggtctgtcgtttgtgcttatgcacacagatgataaacctgttttgagtcaggattcctctcctatccgaggtacaacttacagtcccagctgtacatgtgctacttggagacagatttttctttgtctcttgggtgtagattatgccgtagagcccttcgatgaagaggtgatgacgagtctgagtaggaagtgttgtctttgtccaagatgcctcactatgctgcgttctgtggcacagctgaaagcactgtggtcaaaagaaacttcctaaagatgaccaagaggcatttgtctgagaagggttgctgcttttctgtagggccattgggcttgctctgactaaccctgtcttcacctcagaggtaacttgtttcctttggttcagtttgtagctgatggcatcttcaaagctgagctgaatgaatttctcactcgggagctggctgaagatggctactctggagttgaagtccgagttacaccaaccaggacagaaatcattattttagccaccaggtagaaataccattgattgtcacctgtaaatactgtgtgtactgagatgctgtgtaaacttgggccaaccaagcagtaaatctggcctcagtgggtgtaactgctttgttagaactgcatttgggaagaacttaccttccatttaacgtgtgtgctggcgttgtggtgggcggcaggtgggatcttgagtaaatggttgcgcttcccctctacaggacacagaatgttcttggggagaagggtcgtcggatcagagagttgaccgcagttgtccagaagcgctttggcttccctgaaggcagcgtagaggtgagttcctctgctttatctcccgggggttttagactgagttgggatgtggcttctgctatagaattgtacttctgaaaacctgacatggccagtgacagtcacaggtacttgatgctctgccaaaatttccttaaaagcagagcgattgccatgcatggcgggggcccatattcttgtcctggcacgcagaaggcaggatgacggcggggcagagctagtcagggctgctgtagtgagaccctgtcttaaaccacaaacagtatgatattctggtggtcgaatgtagaaataatgcatgggtgactggctatccttagtgtggttgtgaggaaccagagtagaagggcgattcagccttcatcgctgccttgtgtgggtagtcgtggtacttgagtatctaagggatattacaatggcttaattgaagatgggtgagtgacaggaatgtactttgctttctttaaagctttatgcagagaaagtggccacaagaggtctgtgtgccattgcccaggcagagtctctacgctacaaactccttggagggcttgcggttcgaaggtgagtgtcctgagacttgatggtcatgccctcctgtggattagtgtgtgctagcatttttgttagcaaataacttgattgacagaatcatctagtctctggtggtgtagcccatccccccactgaacctagttaggctaactaggctagtagtaggctggtggatgaaggacctattgttggtgacacatgcctgtatgccagcactgggaggaccagcctgggctgtgggatgagccccgaaaaaatggtcagtgctctgacgagggaatgctgtgggtatgttgagaatgaaacgagtagatagaatcataacagggaggggcatccgctttgtgaggtttagcaaggacccttgataggtgagcaggaaagcatcctgcctgttactgtacctgggaggagtatctggttgggagttgtagctttggcagtgcaggtttcaaaacaagctagaagtcatgcagctctactaactaatgcattcactgtgtggatatagagatagcagttctaaagggaaagacatttacac

SEQ ID NO: 32774 - DNA, 2234 bp, Mus musculus; identical to SEQ ID NO: 32773

SEQ ID NO: 32775 - DNA, 1110 bp, Mus musculus
caacagcaggcttttatgcctaaagagagactgatcccccttctgcagtccacacagcttctctctgctggcctgcactgccatgggcattcacttgcaggacaactcattggtgagatttgggctagcctttggcaaaaagtcctgcctgggctcacctcctagggcattctaggtgaggagctgaagctcagggcattgtcaatcatggcacaggggaaaagaatgccaactagtgttttattcagtccaagtgtggcctgggagaccccactggcctcaggttccccatgtgtgaagggctagtaccaggctctgccccaatcacagggactactgaaagggatatgagggtgaagagaggccggatgaggcagcagcctgtgtgaggggatagggtcttagcctgagttgctgacccacatagcccacaacaaatgacagtgcaggatatcctgtcttacgtgggtatctctgcgcagtgttaggtccagtcataggtgctgcggggctgcctcttccgaccggtgggagttgatgtgtgtcctgggtgtggtgtcgaggggtggctggggcgccctcaggcctgtgaccctctgtgaagtgatgatttgtgtggcacattcattcctggaccacgtccaggtcaacctgtcgtacctgtggctgcccttgtcccgtgaagtcattatagtttattcagctgcaacaggacaaatgagcaaaagaaccttgaacgagaggtcattaaaggccttttgtgatggaggacactggctgtgttttcatttcttgtctaacatgcccaccccgacaggaagagagagctgaagcgccctcctgccctgcccagctatgggttttgtgcctccgctgtgccctccctccagaagatcccctgaggatttctctgttctgtctttcaactgtctagccttgtggccttcaggggaagctgccaagcctttcatctctcaaaaactgtctggattccatgagccctgctttgcagctgagttggagcccctgccagtcactgtcccctcagcttagcctggccctgattttggctctgtccaaattccatagcctgctctgccaggtcttact

SEQ ID NO: 32776 - DNA, 1129 bp, Mus musculus
ttctgagatagaaagcaggcatttacaacttagaacacatttcttagagctgtaaaacaattaactagaggtcataaaagggaatgaaagatttattgtaggtgctaggacagaacataaaatattgactgggcttatctatatgaaacttcattgttaacttttacacaagaattatggtttttaactttcagtgaacctgcggagctagtgacagaagagaaatgtctagttagataactactcttaatggaaattcacataaacatctgttgccatcttctttttgaatttatgtttaaacttgtgaatgtttgaattagacactacgcgagcacatagaaaataaagaactaagcgtgaacagcttggagtgagttagatagtttcaatagttttccctccatttttcttttctcttggaaataaggattagaacccctttttaaagtgtctcctttctttttcttccaaaaagtgactttccctagctgacaaggagttaaaccctcagctttaggtgctcagcctgtggagaaaagaacaaggacctcttttaagtgacaggtgtcaacttgccaagagacctgcaacttttagcctcaagagtaacttaaagtcaaaattggtaaatgttattatagaaagcacacaatctctcacaagaccaattcttgtcccccaccccgacaccccacccttccatccccaaccccaccccatcacaccaccacaccccatcaccacaccgatgctctttgctctctatcctcagctacctcccaaagagaaccagagctcagagctgatctccatccacctaggttgggcctggtcttacagtgtaagatgtcccaagcctaaagccaagctgtgacatgtggggttctcattttaccagtatttcccttttgtccctggttggattctccatgactgctactcctccatgactccaagggagatgctgagctcataatgttctgagtgtgtcttacctgactctgtgatgccagacacatcactgtattcataaacactgccatcacttagagcaatagttctcaacgtgtgggttatgactgctttcacagaggtcacctaagaccatcagaaaataaaattcata

SEQ ID NO: 32777 - DNA, 1203 bp, Mus musculus
tcaattggcaaaggtgctcccgctactcagaagtgccctctgctggacagtcctctggaggtggagaaaggagctgaaacaccatcagcaacatggctcttgtactcacatccaactagcaagaggaagaggattaacctaggcatctactacaaccggaaccccttggaggtgaactgctggtcccgcccgtggatcttgaaccgtgggcccagtggctactctgatctggctgttgtggaagaacaggacttggtggcgtgtttgtttgagtgtggggagaagaatgagtatgagcggattgacttctgtctgttttcagaccatgaggtcctgagctgtgaagactgtaccagccctagtagcgactaaagccaaatcaagacggatgagtgaggcccagcttcccacagaaaggaatggcagctacagccagggtaacagaggtctctgatgtctagagaaaactctaaaaactaataatctgctccttgaattttttcacttttcccttcaatgagcatggtgaaaattgtgccatatcttacataacgaggctcttgaactgggagtttgaatctcttctcttcccattaaaaggagaggccatgtgctcgcttcgcgttcgacaaagcctggattctgatcttgagtggaagccacaggcttgtcttttccaatggttcactgctcacctgagtattaggtgatgtgtaggtgccttggccagaagaaagatctgtgttgttgtatttttttaaatttatttatttactatatgtaagtacactgcagctgtcttcagacacaccagaagagggcgtcagatctcattagagatggttgtgagccaccatgtggttgctgggatttgaactcaggaccttcagaagagcagtcagtgctcttaactactgagccatctctcaagccccgcattgctgtatttttaataagaaaaatgcccttatccttccaataatgcctggagctgtacaaattctctgtcttagaagacttgagaaagcagaactgtaaggtcagatgctttctccagccttgatgctgtgttccaccttcccttcctcatccagaaaacagttactagggagaaaatgagaaacccatgccagctgcccttgatgatggttgataacggtgcttattgcttttgatgtcattacctctgttagagatgaatca

SEQ ID NO: 32778 - DNA, 1705 bp, Mus musculus
tactgcttgagtccgtttgttaaagttagtactcaaaatggtgcatgtattgggcatttcatatgtgtgctctcattggcccttcaccctcagctccctgcgtccctgctgctgcttccctccctctcctcagtacccctgtcctactatcatgtgttccattattgtctccaaccctaagagcgcctcagtttcccagtcggtttggtttttgatttgttctctttgtcctgatgcttaggtttgatgacaaatacaccctgaagttgaccttcatcagtgggaggacaaagcagcagcgggaagccgagttcaccaagtccattgctaagttctttgaccacagcgggacattggtcatggatgcatatgaacctgaaatatccaggctccatgacagtctcgccacagaaagaaaaataaaatagccacttgtaaaagctctccttctgctggatcatacgactcactggtgggtaggggaggagacagaaagcttaagcttggtcaagtaagaaatgttaaagatgcccctgtctaatccaccctggatgaatagagttttctagttcagatatgcagttgtccctttgatggctgtagcctccctggtctgctgagtggttttctgttgctttccttaagcgtttttgtaagagctaagcatatttttcctttgtgcttaatagtactttatgcagtctagctttgtgccatgcagcgtttgaatgctcagttcttaagaactactaaccttgctggggcacagtagtgttcacccagaatcccagcacttcccaggctgaggaagggggaatgatgtgaggccatcctgggctgtagagccaggccctggcttggggagtgggcattgttaacttgttgctgactttgtgttgacccctgcatcagcaactatttccttaaatccaggatacaacttgttaagtgtgacagctttcctttacacaccatttttgtgggtgtatatatatatttgacttggggagaattattttttacaaaaatacaaaatagctttttaatttgtttaaaatagacctgcctgttactttttgtgctcttaaccaattaaagaagccggtggcattttttagttttatattctctgttttccactcgtatgttcctgttgatttgtgccctttattaactgccattttctaaaatttttttcaataaatgaaagaagatgtgaaaatgtggagtcttgaaagaaggaacagcacacacagcacgtgctctacttgggtggagtcccctctaggctggctcactgtttgtgggcccttgagaattcggagccaggggcttagttctagtgatagcagtgacactgggcacatcacatgcattggctcgctgaagctcacccacaacagtcctaaggcaggcactgttgtcctcacacaggaggaagcttaggcatgaaagttgacaggccaccagatgttatgttccttcagagacaaatttctcaacttggtcagagaactgggcagtttgaggagtctaattctaagtctagtaccccaaattatattccctatatgaaagcatccagagagcatccagaatgttgtcctgtctagcactacacagtgagaccacactgccagatgttgaaggcttggattctgtaagcctataagcctgcctataatccttcgctaagtcagttcct

SEQ ID NO: 32779 - DNA, 1133 bp, Mus musculus
ctctccatggaaaatgtcttttatggacactcatgtgaataggagatagtggcttcttttactttgcataatgtttttctgtttctacttttaaatcctttaaccgtttatctggggtttgagactctcatgtaagtgtatataatatttgttgctgctctccacccctgctccttccccagcatctcccagacacctctgcatagtcccctctcaacttcatattctctgcatagcccactgagtccagccagtgctgcctgctgcctgggctacccactagagcttgggcagccaaggaggccacagccctgaacacagcaaactctgcaccagcagccatcactctcagctagcagtgggcttcatgagtgctccatgtgctgccatattgactggcttgatcatgcacgggctgtgtagaggcagctgcagatgctgtaagtccgtgagtccagaagatactatttcccaacaaagtctataaggttttcagcgttcactctgttgtagcatatgtcagtactttgatgcttactgtgactgagagatatagtccattgcacagatctactgtattctcttaacctcttttcagttggcggacctttggattatttctactttttggattttatgaataatagggcctacatattcatatggatctgttttcatttctcttggtaaggtacctagaagacgaattcctgggtcctgtggttactttaattggttgaattgacagtctgttttccattccactggaagtgtgtgaaagtctgcttttccacactccttgccagtgtttaccagctgccatactgttggtggagaggcatgagttgcttgctctctcccctctccgtggtgtcccacagttgccaggccatgtgctgtgaagtggcagtggacatttccgactgtcggctgccacgctcagactgtgcccaggctctcactcaggcgaggagcctgagttgctcttctgcagtctaaacctgcccagctgagtgtgtcagaaagcttttgtattggagctgaagaggtggctcatggttaagagaactggctcttcttccagaggacctacctgtgtttggttctcagcattcacacggcggctcacagtc

SEQ ID NO: 32780 - DNA, 2320 bp, Mus musculus
atgttcctgttcaggagatctggctcagcagatcactcacattttctataccttatcagtatttctgagtttgattaactctgctttttcctaagtaattttcccaaggaagaatggattttccctgcagtgattatagactagtctcccctgttcaaaggctgcatttagctcaaatcccaagaaaggagtcaagtctggatcgccctgacaaagcctgtccttcacttgagtgacctcctagtgcatcccaagctgacagtggcagtgactgggctttctttctagcttgtcattgaagcagagagccagtagggatagctagctagcccatcattgggttaaatttggaccagcatcaacccctacctttaaatgaagacccacagctctggttcccactgtagtgctccagggcccaaataattgtgaaagttatgtggtttgtgaaggggacatccaaatgacaggttttatgatgtttgtttcttctgttttcttcagttaagaaatacctgtatctcctgaatacacccacactatataaagtacttagtagggggtaccccgtagtgtgatttaagtcattggtgagattttggttggagtagctgtggttttaattaacagccttggcggtttctttcactcaaactccatagggtcctaacccttccttagccagccctttcctcaccagccgtacagtcctctttagactgagcccttaggatggatggagctggagttcttagaacgcagcaggatttgaggatgaggctgctgcacagaattttttttttttttggtggggggtgggcaggggcagagatgacagagatgcacatttcccagattgttatccatggtagcattctgaggattgttctgtggaagagacttggaggtacacagaggttaccaatttttagtcatacaggatggaggaaaaagtgccatgtccccatgagtagacagctttgtgtattggcaggattttttctgagggggaaaatgcactcttgtgtttcctaagtttgttgccaggagtgtgggaacttacaccacacgagagctgaccctagactctgaggtccctcactccctcactcttcggagtcttgggtctaggaggagttagacaaggccatgctaaggccagacttgctcatgcccttcccagtgctgcgtttgaggcacagacagttcagccttcggatgtcaagctgggccgggagcagcttcaacgtggttccagatacctgcagctgcagccagggtctctctagctgctacctgccctccaaaccgagcctcagtggagcccagcagatcccagtttgctcaggcataaccaccagcaaagcaagcagacagactatgcaagacgggaaataactagctgaaatgccaactatgtttgtttttttttctacctgataacactgtttacttataactgtataaatatagttgtcctaagagccaggagggaaacctttccacctagaaatagaatggttgtctgttggctttaggccacctgttacagctccttgtggtctgatgattgtggtttattcaacctgtttacattagaattggagaaggggccctggatcttggtgggctgccactgctgtctgtatccccttgactcctaaagagccttttgatagagggacttgggacaaggtatgccctgtcagggatgcttttaccacaaaggaatggtatggaatcaagtgggatgattgatggatgattaacacagtaccaaagtgcattcttcaatgtgtatgtgcctgttccaggcaaggcccaagttgaaaatgcagtaaagcagactcatgaaagcaaacagactatttctgatcagtctggagagctgcgtctcagtgtggcctaagctgaaggcagcaggtgtttgggtgcgctcggggctggggggtgcctgggttagtgctctcggggctgggttagaatgcctcactttggcattcgccatgagcaggaagcactggagtggggtcttcacagggaacaatgtgccttttgacgtgttctaatggacattacttactgtctcctgatctcctgtgaccactcctgttcctctgaaggtaccaagagtaaagaatgacttggggacgccattatccttgcaccttatggccactcttagcaatctggttttttaaaaatatccttctttggaaccattgctagaaagtcataaaaaaaacacctttgacatagtttcacattaaaagagaacaaatgtttacctgttccttttaaactcagaaaatgaacctgg

SEQ ID NO: 32781 - DNA, 1417 bp, Mus musculus
gtctaaactatgacatttgattgaagcagtgtggctgacgctggtcttcctgcgacctgattgctaagtgctgtcagctggatgtccaggttctcttagctgccaggtggcctagcccagactgaccactggctctcaggccacaagtcccatggattctctacaatcacagggtgtccaaaggaagtacagcctagggcacgccagggccatgactgaacatgacagtgcaaagcccacctagaagcacttcaccttgccgggatggaaagcaggactggagtgacttccctgcctgcttactgctcctcttctcccgggagccctcgcctggggccgaactgggaggtttccttactacttcccacatggcaatggcaaaacttccctaaagtcaggcaaaggacaaagctgaaactccatactgtggaaacaaggtatctagctggatgcagctggtcaattcagtcccatggacctttggggtttatttttcttagcagcttgacaccgtgtgtcttttgcatccctggtggtgcttggtgcttctgcccttctgggcttattgagaataggattatgatacggttttagggactctcaggtgggctggcctttcctgtgtgtgtgagctgttacatagtcatgtgactgtcattttcacaaaccttccagagcttttacacttttgttccctttaaaaggtcccagcaagatactccatagtcatctgatcagaatgcttctgaaacgttcgaagctagaagtagctggagcttagactcacttttctgtgccaagggagatgtcagtctctgggaattctagaagagagaacttcagatttggagttagacagaaactggttgaagcttctgaaggtgggaagaaggatgtggactcccaagcactatgtcccttgaagcagacagaacttaatttctctgcagctcatagttgactgttcgcaggaatgtttgatgtgtaaggtggccattagcaaggtggcttcagaggctgctctggcaggaactgtgtgagtctggagtgtgtgtgtgtttttaaaacatgaaatagtctcattactttatactcacacggctttactccccatcctaggcaacttagggcttttcagggctgcgggaaggcaggccagcaccccagggaggagagctggccccggctgcggacaccggaaaatcccattagagaaaacttagaaatgtctaccaagtcatgtatttcctttatgagcttagtaattattattggaaggctaggcttactgggtagctttaaagacacttatttttccacttgccacccttttatatgtcactagtgcttagaaaaacactttcagttggaattaatttttggttttggtaagaagataaaatattttaatagatga

SEQ ID NO: 32782 - DNA, 1103 bp, Mus musculus
aaaaaggataaggaaggacacttcatactagtgaaaggaaaaatctacgaagatgaactctcaatcagtttggtggttcctcagaaaattggacatagtactacctgaggactcagctataccactcttgggcatatacccagaagatgctccaacatgtagtaaggatacatgctccactatgttcataatagccttatttataatagccaggagctggaaagaacccatatgtcctttaacagaggaatggatacagaaaatgtggtacatttacacaatggagtactactcagctatcaaaaatgatgaatttatgaaattcacaggcaaatggatagaactagaaaatatcatcctgaatgaggtacctcaattgcaaaaaaacacatatggcatgcactcactgataagtggatattagcacaaaagctccaaataaccaagatatgattcacagaccacatgaagttcaagaaggaagaccaaagtgtgggtgctttggtccttcttagaaggagaacaaaatattcacaggagcaaaaatggagataaagtgtagagcagagaataaaggaaaggccacccagagactgccctacctggggattcatcccatatacagttaccaaacccagacactattgtggatgccaagaagtacatgctgaaaggagcctgatatggctgtctcttgagaggccctgccagagccttacaaatacagagatgcatgctctcagccaaccattggactgtgctttgggtcccccatagaggagttagagaaaagactgaaggagttgaagggggttacaaccccataggaagaacaacaatatcaaccaaccagaccctcccccaccccaccccccagagctcccagggactaagccatcaacaaaggagtacacatagctccagctgcatatgtagcagaggatggccttgtcatgcatcaatgggaggagaggtccttggtagattcccagtgtagaggaattgaggacagagaggtgggagtggttgggtgggtgaggaataccctcatagaagcaggaggagggagaatgggataggggttttccgggatggggggaaaa

SEQ ID NO: 32783 - DNA, 1208 bp, Mus musculus
ccagctctacatgctttgcggctgcttctgcccctggccccatacagttatatgtaacttcagcggtaagaacttttaggtttaagttttatttttcctatgtgagtaaatctagctatatagctagctcttatggttttatgttgcttaagaagacaccacagtttgatcctgtgctgggaagtaaatgtttccctcgagcagtggttttcaacctgtggttcccatcacagtttggggcttgaatgactcttctacaggggtcacatagcagatagcctgcatatcagatttacattaccattcataagaatagcaaatttacagttacgaagtagcaatgaaataatgttatgactgggggtcaccacaacatgaggaactgcactaaagggtcgcaacagtaggaaagctgagcaccactgagctagggccaagtaaaagcagattgacttagcaatcagggtggctgcgccgaataagagagtcaccctggagactgccgcttgatctggtctgtaaagatgtttttaagtctaggattgcctaaaactctacagtctctgtgtggtttgtatttttcagctgagaggggagaagttacaggaagaaaaagattgtgatgatcagatacacaagctactgcaggaggattccgaaatggggaagaggaaagctgatgagcagaaaaaaagggatgaagcagtggtgctgaaaacaagtctggagcaggtcagtgggtcacgcatgtctggtggacattgtctggagcaggtcagtgggtcacgcatgtctggtggacattgtctggagcaggtcagtgggtcacgcatgtctggtggacattgtctggagcaggtcagtgggtcacgcatgtctggtggacattgtctggagcaggtcagtgggtcacacatgtctggtggacattgtctggagcaggtcagtgggtcacgcatgtctggtggacattgtctggagcaggtcagtgggtcacgcatgtctggtggacatggtctggagcaggtcagtgggtcatgcatgtctggtggacattgtctggagcaggtcagtgggtcacgcatgtctggtgggcattgtctggagcaggtcagtgggtcacgtctggtggacatctgcctcagagagccctgccttgcagaccatggcaccaggaatactcattgattgtgcagcctaagagcagt

SEQ ID NO: 32784 - DNA, 1198 bp, Mus musculus
agcaatgttaaattaaaccacagttaaacttttgctaaaagtttggtagaaaggatatagtaaattcaaagatgtgtccaaagaagttattagagttgcatattgttgttttgcttttgaaatacaagtcttcagcctcccaagaaggtgaaattatagatatgtggcactgtgcccaactagttgtggctttgggtcataaatctaggtttattttaaaagagcagtaaaaaaaatactgagctgtcagttttggtgtcaagaaaggattgcagaagttaaggttactagcgctggggtaaagctgaagagctagggcgtggtggtctaaatagggagaggcaggcttagagggaaagtgattccagaaccctttctctcctctcccctcctctcctactctctcctccctcctcttctttctccctccccttccttctgcgcccttcccttcccttactccctctcctcccctgtgtatgtgtgttatataaaaagctatgtatttgtgcctgtgtgtgggtgcgtgcgtgtgaatgtgggtgcttcagagaccagacttgagaggcatcctagctcctgggacggtgttaccagcagctgtgagcccttggcatgcatgggttctgggagctgaactgggtcttcttcaagaacaagtgctcttaactgttgagctaactccagtctctgaagctatattttaaaatcctctcattattgttctgctttgaactataaaatagaacctattttactgaaacttgaacatttcacttaatctacttggctatatacacattttaccttgatttgaactagcctttctcttatgtattttgtttacttatgttatagaacacgtgtagcaacctagagagtgtaaaacatgttccgtcacctcacagaggaagcaggttgttggcctatttttaaatgattttcctatagcatttataagtataggtgctcaccaaatgtttattctgttgttggttatataatcctaaagcattttctttatgaacaatgatttatataacagtgcccttggttcatggtaaggctggatgcatgtttagattcctgatgctcttatgtctatttatctgctgtttcttctgacatgtgctcctgctctctctagagacagaaataggtgcagggccttatgtgtttaagagcaggcaaatgcatg

SEQ ID NO: 32785 - DNA, 1205 bp, Mus musculus
cttaaatgcaattttctttgtgtttttttggcatgttcatcaatgaaccctgtcctgaccactctgaataaaacagacttttctttccaccctacattaatttccttctgatagcatttactaccactgctcagaatatattctcacttgtttccttcttttctgctcttcctcacgattgtaattccatggcacaaggattgtatttgtttatattctagagcttaatacagtcctgatttataacctttagtaagtattgattaaatgagtattcaaattaaggtaaccataagcaggcatgaaagcacatgcctttaattctagctcttgggaggcagaggcaggtagatctctgtgtgtttaaagtcaccctggtctacaatagtgaattccagtatatccagggctacatgatgaaacactgtttaaaaaaaaaaaaaaagataaccataattttttatgcaggttgtaacatggctgtcagcggttggatactgtgaagatcccttcctacaaaactgaattaaaaagtattttccctttcttccagagtttatattcagaacgccaatcaagttaagcaagccgggagaactcagtgaggagtatggatgcctgagaaaggtacctacatgttagcatggcgcttagtttcttacagttaattgaaatattggcattcaagaatgcttatctttaattctttgggtctttaaaaatgtatgactcatagcctgtctttcttcatactattttataacagtctagatagatttaaagctacactagaagtaaatgtagctaagaacctttgagctgccttgtcgcaggtgaagtgtggcttttaggggctatcacacagtcaagaaagctgtgttccatactcagacagcccttgctaataattgcttgtgtaactttccctcccagacattccagttactgtagctgctgttatttgtatgctttttactttagtaagtactccaggagcattgtatggaggacataggatattttgaataatctcttaattataaaatatttactactgaaaaaccttttaagtatgttatcataatcttttttgtttgtttgttttattcaattattggagattgaacctcgggcatggtggctatactctgccaatgaggtccagctccagcctataactgttactttttttttctctaatttca

SEQ ID NO: 32786 - DNA, 1099 bp, Mus musculus
ttccccacaggcttgctttctagctggcagggaaatgatccaggtgagagaagactgaaactcagttcagcctgatttgtactgggccaaacttggagagtctgacaccacttggttgattttagccatatttaattaagcacagcatgattttggaaacagttttctgataacaactcagtcccatgagtttaatagagcttaagacatgtttacattgatattctttataaagtacgtctggcttctctcacatagatgagtactgttgacttagatagtgcccgagatttagggtaaagagtgacagaggtaaacataatgaacgcctgtgggcatcaggattgcctggccctaagataacttagaagtcacttaggccactgtaaggcacaagtgacatcactcaaataaggacagagtgtgtctcagcaagggatgtggacagagtgtgtctcagcagaggagggatgtggacagagtgtgtctcagcagaggagggatgtggacagagtgtgtctcagcagaggagggatgtggacagagtgtgtctcagcacaggagggatgtggacagagtgtgtctcagcacaggagggatgtggacagagtgtgtctcagcacaggagggatgtggacagagtgtgtctcagcacaggagggatgtggacagagtgtgtctcagcacaggagggatgtggacagagtgtgtctcagcagagggatgtggacagagtgtgtctcagcagagggatgtggacagagtagagtgtgtctcagcagaggagggatgtggacagtgtgtctcagcagagggatgtggatcacagatgcactggctagttttctgtcagctttacacagctggagttatcacagagaaaggagcttcaggtgaggaaatgcctccatgagatccaactgtaaggcattttctcagtgatcaagtggggaggtctccttgtgggtggtgccatccctgggctggtagtcttgggttctataagaaagcaagctgagcaagccaggggaagcaaaccagtaaggaacattcctccatggcctctgcatcagctcctgcttcctgacctgcttgagtt

SEQ ID NO: 32787 - DNA, 2457 bp, Mus musculus
gagtttagaggtaggtgttttcgatacagttcatatgcagggctctggaagttagctgatatagactaggacccaagaaacagatgtgggcaattagatgataaaggcccatctaatgacatgggacactggaggagtgggggtttccagccccacctagaggccatgtgactgtatgatattttctggctgagtctagatgtgcttttccagtaagaaagacgcagcacaacttaccgtttggtagatgactcaagccacccgtgttctccttttttcctattccagtgactgagaaagtctatgagagtgagtcctgcacagacagtgaggaggagcttaagatgaagccggcctcagcacacaaaccccctgctgccgctgtgaaaagggagcccagagaagaacggaagggccccaagaaaggggctgctgctctgggcaaagccaacagacaagtgtccattactggcttcttccagaaaaagtaaatgctacctctgaaaggactcgggctggtcaagggagaagaccaagaagtatagactgtcacttactgtgtaagtttgcctcgctccttgcctcgcctggatcagatgctgctctgccatcacgggacacgtgtaccacttctgttttcttcacccaaaaggaagtcacctggaaacggggcaaaagaacattttaaaagctgttacattgtaataagtttataaatataaagcacaatctttgccctgcctaggagaattcattcaagaatgacctgctgggccacacttgccctgcgcatgtgcctctcctggtctctgtgttctgtgagcgggaggcagtgtttttatttgatgagttctactggatgtgttcaccgcgtctccactttcctctccacactaccatacttctgtcccccgaccccacaatctgttttctgtaaatcttttaagtcttagtcagatgagaagctaaaactaaaatcttctgtaattcccgatctccgttgatgtagtgagtgactcagctccaggctaggccagtgtgcatcgtccagtcctttcatctcatccgctccctctcacttccctcagactgagatgtgctgatgaatccagcctcaccagaaatgacttaaagtcacatggtggccaatgacagagctggcatgttgctagcacagggtatgcatatactcatgtgtggtttctttcttccagatttcctatacttattacccagagagtggaacctgtacagcgagatgaaagattaaaataagaatgctttctatgcaccagataacttacctcaaggaaatacagagtccagaaatgtcagtttcctgtcctgggaaggaagggagaacttagcacacatttctacacagatgttgctcctctgttttgtcaagttcttcatttgtccagcagcacaggctccccaggaggggacagggggctgacttttataactttcagtcaccttccattctggctgggcaggaggtgagccctgtccgtgttgtgtggcagtggctttgcacactgagctgtagtgagggaacccagactccactgctggtgtgaacccaggggagatgagggatgtctgctccaaccctccgctgagggctggcttgtgtcatgtaatcagttgcctactgttggaggttggggttggggctgacttgggatttacacatctgctttagcaaccaagcctgggctacctggagaccagcagcttgggagatgagtcctggtctcctgtcgagaactggagggcagatgcttgtccatcaagctgagtaaaggttggtgtactccaaaactgttttttctaacgtggaaaagagtggaatgcctggacttaagcttacaggaaagctctggagaattccctattttcagtggttatttttgtcattgcctctagtgatttttgtaaatgggaatggaaaagtacaaggcaaccatccagtctttaaaaaatttgattatggtgggatttctaataaaaccaaatttgaattggagctctggtgcgagttggagttgtatctttcaagggagaatgcaaacctgatttctgtgtgcaacgtgtatgccacctggattctgggctgcctgcaaagctaagcagacgttgagtggtggcctttctctccaatctatgcagtgctcagccaggttaccgatgagttaaattcaagaagctgttttgaagcagagctttaaactgaatgtctgatgggtctgtcacttgacagcccggcggcaggagtacagttatccaaatgctgaccaggaacaggctggttttcagttatgttgttaaaagcacatacccacgatctgaaatgtttgctatcttcatcttttcagtcctgtgggaaatcttagctttagccaaccttacttttcagttcattaggaggaaaatctagccctgatcttgcat

SEQ ID NO: 32788 - DNA, 1148 bp, Mus musculus
taggtcctcattactgtttattgacatcatggttatttaaagattttttagcaacaaaatacaactttaattccgttatctgaaaaatagaagctatgtatagctacatagctttttaagtctttttccaagtttataacaccatgtaatttaattaataaattagtttaattatctagctaataggtaactaaataatctataactaaatatagtagataagtagtagagacgtgaattaaaaatagaccttaaatgtctgtcgccataatcatttaacttttttccatacaggtttattgtgtttaatgtatcatgattcttcagttttatttttctcaaacttaatagctttttaagaaatagacttaagttagtattgtagctgagatttgtgagtttaggtactactctcatttctgtgcagtttaacattaggaagtatattcagtcagctcatagttactggtggatcatttgtatatttatgttagctcataaatggaaaaggatgctgtttcactttatacctggagttgaattgtttttacacattattaaccttctcggtgcagttgttttatacttagaaccagaccaaatgttcaaccatttaaatcctgcctaactagctcagtgctcttgggtccttctgtgaatctttttcttcatctgtgtgatagttataataatgctatcagcattattaataacaatgaatgcagcagtgaacattctggtgttattaattgtgtaaagtgaaagtattgcttcagcacaaaaacccatgggtcagaagcatacgttgtataaactttgatgttttgctacagttactctgaaaagaccatcccaatttacagtctcactaacttgaagtgagtacttatcctctgtgcatagagagaggccattcggcttttggtctaatctcctgatgttaacagtttccaagtcattttgcttctttcaaatctgattatatctttaactttgggatagttcattggtggcttagatattcttttatttagatttttctcctaatagctattcatatttttattcagagtgtatagatgttagtgtatgccatttacaaaacagaaaatgcttgaatctaggtcttacacatacaaacccttcag

SEQ ID NO: 32789 - DNA, 1096 bp, Mus musculus
tttaataacagctcaagataggcatgccagcctgtgggtctcgaccttggaatgataactgcattgtttatctcatccctcttttcagcaatagcatgggaatatattctctttgagcaaataaatcaaaataagtaatttctggagttctgaggaaaagaattaggctggaacatagctcagtggtaaagcacgtacctagcatgcagatgaagcaaagcttacatttgatccctggcaatacaaaaagagagaaagttattattgatgaagcgaagtcaaatcataaagtggtaataaccaacaaacaatatataaaggccagtaatgatggtataaaaatgctggagacgtgcaaacatgcaccgtaatggtgggtaaactgtatgcaaggctgtttacttgtgtttgttaggatgctcagacagcaagcctgtattgttttcctttagtggtggtcactgaaaagaagcccacttctaggaggtgaggttcaattgaactgtgggctcaattcctagtggggtgttgtttcagaatcacgtgagaatgagagaagataaagaacaaaattaaaagaaacaaaaccaagattggaaagtataacctctaagaaaaagttcaaggaattaggattgttggactctgaaacaaaaagctattgagttcatttactaaaccataaattactcattgggatttttgctaaaggtatcaaagtaagaagcagtagtggcaccctgattatctctagtgaagacaccacagggaataaggttgcaaaaaaaaaaaaaaaaaaaaaaactaaaaatggccgattctaaaaacacaaaaagaagacctagaagggaactagttgaaaagtgagacaaatgggtaggagagggctaagagaaggatgatggggttactgtgatcataatacattctatacacatgtgtaatggtcagaaatgaatgaatggacaacatgaaatgtttaagaggttagaatttcctgggtggaagtgatcatgaaacctatttaaaaccttatttttgatggaatgatatttgaaatattaagggatataccaaatggcagtttaaagattcc

SEQ ID NO: 32790 - DNA, 1176 bp, Mus musculus
gaacacactggcgttcatctgggagaatgggcgggcagctttataagatagttaagatttattgcaaatataaagtatcagcatttggatatagtaacttaagagagtccaagagattggatactttgtgatgtctgcatgtagtaaatagaccccaccccccattgcttttggaattgatgcaacagagacgcaagtgggagtctcctgcggcttctgctgctgttctcagacttcccactgatatttgtaaacttgaaaaatacaaattccacttggatacatttaatttcccacctttcctgctctacctccctcctccctgtgcatcctctaccttctgtactgtgaaatgctactaccctgttacctcactgatacgagtcttaactgttcattcagatggctttaaacttagtagtgaattgtttgtttatagactgtcattttcattgttgtgagaatatttgagatgcactatatgaagtaacttcagtgtctttcaaagcccatttctggttgctggacaccactagatggcgacactgtgggcttttacaatgatttttttttttttttcctgaatttgttctagaaactgatgaggaaacagatataccaaccaaagtaatgagctgaccaaggattttgttgggggttctctgtgctctgggaaataagagtacaaaaatttgaggaaatttttttttcacactgtccctcaaagaattttaccataagctgaaaggagttgaagagagctggttgtgataactcatatgtataatctcagccctggagaggcaggagaattggctgtgagttaaaggtcagtttaggctacatggagagatctagaccaataagatagatagatagatagatagatagatagatagagcaagcaagcttaaaatagaagagaatggcacattgtctgcctctcacaaagcatttgtttagtaccaggtagaaacaaaatcagtattatttttaactattcaaaaaatgagaacctgtacattaattaagaggccaagacaaggacaaagtgaccagagtttgctttctaaattttctatcaacagaaccctaaagtagaagaatgtgaacaggatgaggaacgggccttgagagcaaaacccaaagaagccgcacagggacatgagagcccat

SEQ ID NO: 32791 - DNA, 1449 bp, Mus musculus
gcccttgtccaacagtggcccgtgcagtctggggtccacagctcttcctctccttcctgtgctccctgccttgcctaggatgaagcctccagcgctgctccctggccctgttcctggcatatggcaatgtaccccaggctcagggatctcccttccttgaggatgttcttggcatggtcctgccctacctcatgggatgggcaatgcacacactggcccttatttttccctttcaaataaaacaccagtcaggtacctttatcccagtcttaactgtcccaaatctggaaggtccagagtaagcaggattcagggagagggagtggatagcaagtatcccaagaaaccaacctgtaagtcaggtccagccagtccaagcacatggcttcccatctgggtgagcccactgtcccactcccacatgtctgggcacctgccctgggctgaggccaggctgctccaagggccgcatgagccctaatctgccacagagcaacccaggttaaacacagcccatgcacaaagccacaggctaaatcctgtggaattgtttttaatgactgaatttaaccattttcatagttggttcctggaggtgtgccaagtgcccgcttgcctcttctagacccacagcttcttgatccacttgtggtttccatgtcactaatgtagaaacatcatggactagcatccccagtctttgccctcatccagctgtcgcagcgcagcactggggcctccccctgctgcccaggggggggggggtgggcagcctcctgaaacccatctttctgtgactgtcttaggtgacgtgtagccctcttccgttttttcacccaacaacttcctctgtcctgctgcacggtccagagtctgggaccgactttgtttctttgttatttatgatcttgtttaaagaaaataaatatctcccaacctttatttgtctgaggagctgtccttactttgctgatctggctaggaacagtttattcgatttagttgctgcaagaccccagaagcccctttctccatagtctgtcagtgtctgtagccactggctagtaccccatactcctgtaagtacatcatcacctgtgttcctataaacatccctagtgaagccctgggagagatggatagacatagtgctgtgttacgaagaggattatcagggaggggagagaaagaagtctttctccacagcctatcagtatcttcctcagatctgatcctgagaagggcagatgtctttactacagccgggaaacttgagtcctgtcccatttcttcagctggccaaggggacagtctgcccctgtgttttcctttgctgatggcttctctgccaacactcaactaacaactcaagtcatcctctgagctcgagttgtatgtgcccatctgtcccacagctctctcctagggagccagagccactttattttt

SEQ ID NO: 32792 - DNA, 1193 bp, Mus musculus
agatatttcattttggatgttttagattatgtctatctctctctttgtcagacatactaccttgcacatgattatgtttcagaaatattcagaagatatttctatttttggatagttttattatttggcaatttcaaacatgaatacaatgctggattcctttcaactatgtatatattttgggaagcttatacagtagtaggtttgcatatggtttttcaaatggcctttagtgttagttgtcacattctctcctttacccttctttcccatccccccctccctattttatcttccagcttttttctttgtctctctccttccttgggtgttcctctgctccccccccccccccagtccatgagtattacttaacctctgcagttatgtggattgtagcacatatattggaaattcatatccacacataaaagaaaatatacaatatttgtcttttgggctatggtaaccttacagtgaccccccccccagttctatccatttacctgtgaatttcttttacttactcattcatttgttcattaattcattgattttgttgaggtagggtttctctgtgtagcactgactatcctggaaaagatctgctggcctcggccgcccaaatgctagaattaaaagtgtatgctaccactgcctagctacctgtgaattttataatttaatttttcttaatagctgaataatattccattgtgcatatataccccaatgtcatccattcatctgttgatggatatctaaggtgcctccaagttttgactattatgaatgaatatagcagcaatgaacatggttgagcaagtgtctctgcagtagagtgtagagtcctttagacatatgctcaagagtgctatagctgaatcttgaggtaggttgatttttagcttcttgaaaaactgccacactggctactacaggggctctaccagtttgcactctcagcatcaatgagtgagtgtccccttctcctcatcctcatcaatatgtgctgtcatttactttattattgttttgtttgttttttcgagacagggtttctcgaaacccttttatagctggctgtcctggagcttgttctgtagatcaggctgtcatttattttattgatcttgatcagtctgactggtataaggtaaaatctcaaagtagttttaatttatacttcctaa

SEQ ID NO: 32793 - DNA, 1123 bp, Mus musculus
ggtccgtcccacgatacgtgcagtacaaccggtcacagctctctcctctaacgacgcccagtcgcctttggacagcaaccagccaccggcagcgccgcctaccgcccactggctcagtaagccccgccccctcgccgcagcgcttccaccggaagtgcgcaacagccttcgcacaaaggaaactgggtaacggagtctgcggatctctcagactcctatcagagaactcgacaaccctagcaggaagagacctcttgaaggcaatgcatgctggacaatgaagtcctcaaatagtgtatcaatttgcgcttgcgcagatgcaggtgccctggtccaacttggccaaggtagggaagcaaagcatcatgggtgttgtagtccatttgcaggggctctaattggcgccttcttttggcaccgctttccgggaactgttggtgaaagagtgtttcttcctgcgtcccaggcttcccagcggcgcccgttgccggggaacgcaggcgccgtgggaagggatggcgggagcgtacagcttaggagctggcacctgcgttgaatttgtgacgaagggcccaggctcgggatgaaacaacggaaaggccaagggcctgggggcggccgtgggcgcaaaaagagaggtaactttatttctttaaggttgagaaaagcataaaagggctaaagaattctaaggagacttccacccgctccggttaaacaaaacaaaacaaaacaaaagaggacggaagagagactaactagggaaccagaaagttaagagaattttttttttttttaaagaatggaaaggaagtagcgcctgagggtcgataaatgaggcaagtgaggattaatagatacggataggagaacaacaaaattaaacgtgctctttttacgacagggatacacgtatgtgtgttagaggtattcggagtagggggaagggacataactctgtccggaaaaaccttagatggtgaaagggtgtgtgatagaggacatcgtgaaacctgtaacccaagcttactcaaaaagcaaataaaaccacttatatatatatatacccttctacttctctgattttttccttgggaagcgattgcgcttcataagaatatac

SEQ ID NO: 32794 - DNA, 1203 bp, Mus musculus
aattaaacagacaccatctttaaactgtctttcctgccaagaacatacagtcaaggacagagactaacatcttttgattttcccaccactttttagagctgggttcataataactttgaatctcaccagatttcagaaggatggtaaatcaaaaggtaaatggtatttatttgtaaaacttgaaccctcaaaggaggaggattagcaagtcagtaagaaaaaaaaatgtctcttttaatacaggaatcaacactcatgcatttgtcagtacatcctgtgagataactatacatcatatgaacattcaagttggcatgagaactgtaggatttagggaaagtaactttacatttctgacctatctcctcacctgtaaaatgagatcagatgcctgctctttgacctttgggtgtttcctgaagaagcagcatgcttgagttgaaagaaacacagctgaagtctagacagttacgtttgaactctaacttcagacctggattgttgtgtgatggatgctaggaggtggtgtttgttgttgttgtttcgagacagggtttctctatataactctggctatactggaactcactctgtagaccatgctggtctagaactcagagatccccctgcctctgcctctgtctctgcctttcagttgttggaattaagataagcaccaccaccatcagactagtttcttaaggtcacagcgtctcagtttcctgttatgaggagtatgcccttactaggagttaccatggaacttgattggaaaaaagtaaagtaataggttcactaccagctacattgtaggtgtaaggtctacacagataattatttaaggcacgaagtaataaagggtttttttgtttgtttttttctctttttggtttttctagacagggtttctctgtatatccctggctgtcctggaactcactctgtagaccaatctggcctcgaactcagaaatctgcctgcttttgcctcccaagtgctgggattaaaagcgtgtgccaccactgcctggcagtaataaagttttaagttattatccctaccaagaagtcatgtaaagattagttgaaaaaagaagaactgacacaacacattaatgaatgatggcagacagggtgtgagtgaatatataattaccccatacatagagaattttgactattttaggttgtcagtaagggggga

SEQ ID NO: 32795 - DNA, 1116 bp, Mus musculus
gagttcctctgtctcgtcttgccgattgaaggtccccgtttctccaatttctctccatcttctgggaggtagcaggaaatcagaatcatggttggtttcaaggccacagatgtgcccccaacagccactgtgaagttcctgggggctgggacagctgcctgcattgcagatctcatcactttccctctggataccgccaaggtccggctgcaggtgaggatggagtgagggtcctgatgctgtctaatctgctccctccctgggtcagactccttggcagggatgaggagcctggagctggcgggagatcagcagagccatctccctgtgctcacaaccaccccatcttggtctttcagatccaaggggagagtcaagggctagtgcgcaccgcagccagcgcccagtaccgtggcgttctgggtaccatcctaaccatggtgcgcactgagggtccacgcagcctctacaatgggctggtcgccggcctgcagcgccagatgagctttgcctccgtccgcattggcctctacgactctgtcaaacagttctacaccaagggctcagagcgtgagtatgcggcaaggacagactgactgaccttagtctgtctgtgcagctcagtggctcctttagactttccaagaaccccgggaagatcagaggtggaccctgatttctgttatctgagcaccagggctgtctccaagcaggatgtgagcccatgatggtctttaaaaccatcacggtggtagctggcctcctgggtgacacttggatggaggcttgaaataggggagggactgggccagaagcacaatggagaggcagccaccacaccctctagcccccacaaccacattctttcttcttactatgccctcctaggaggggaggggagggggtcgagacaggagtgtcaccttgcagctctggctggcctggtgttcgaacagctctccctgcctcagccttccaaatgcaggcattaagtgtgtgtcacaatgccctccccaggatcgctctccagggagaagtagagctggggctaagaatctgcctctggactcagctctgctaggaaaagcctctctgcttggtcttgggtttcacatt

SEQ ID NO: 32796 - DNA, 1161 bp, Mus musculus
ggaagggatccggggcctctggaaaggtgtgtgctgggtgttggcttttctcccctcctctcctccatgccctgggctcacacaggttctcttttctacagggacttctcccaatgttgcccgtaatgccattgtcaactgtgctgagctggtgacctatgacctcatcaaagatactctcctgaaagccaacctcatgacaggtgtgttagcgccacttcaagctggtagggggcgtctagttgtctaaagactgcatcttgttatcctgcttgcctcgtgggttttagagtttatatttcttaccattcaaatccaacagggtaaaaaccccactttgcacataaacaggcgagatcaacaaaaagactctgaagtccccctaagagagtctagctgtagtctgtctttaaaacaatgagacccctctgcggcaatggtgggatgcggctgggagagctgacagcctctccccctgcttcatggcagatgacctcccttgccacttcacttctgccttcggggccggcttctgcaccaccgtcatcgcctcccctgttgatgtggtcaagacgagatacatgaactctgccttgggccagtaccacagcgcaggtcactgtgcccttaccatgctccggaaggagggaccccgcgccttctacaaggggtgagcctcagatcccctcacagaactccagagaagtgagatgcagccaaatgtcagacagcccatagttgctgtcacctctgttttttagaagttaaaatgagcattcagactgggggttggggatgggtgggtcagtggtggagggcttgcttagcatgcttggagaccctgggttctgctccccagcacagcaggagtagggagctgggtactcgggattcttgggcatgtggccatgggttgggtggatggatgagcccagtggttagaagcaggtggtggagggacctccatgacttgtgtttgctctctctaggttcatgccttcctttctccgcttgggatcctggaacgtagtgatgtttgtcacctatgagcagctcaaaagagccctaatggctgcctaccaatctcgggaggcacctttctgagcctctccatgctgacctggaccctgcttcccagccctgccctgtctttttcttcat

SEQ ID NO: 32797 - DNA, 1195 bp, Mus musculus
agcacacttggtcttctggtaattaggctagccttatctatttgccatggtaatccttccattgatgagtcccattggccacctgatttctcttgtggtaacttttcaaacccactagccagtgagagccctgagcagaggatgacgtcatacactgcactgaattgttctcaactgttgaaagagtttttctgatttctccctccccactggacacccacatccctccccttcagtccacacaagacctggcccagggaggaaggggcagtctctgatttctgattccatttgtcacatacaagcccctgggatgacagtggcttttcctctcagggtcactgtgaggattaaataaagcagtgatgggaagctctcagagcagcacctatatgttcaatacaagcatctagtgtaccccaaacctccaggggccccagatgcttccctctttctttatacctttggggacacaactgatttccaaattcagtgtctcccctccagcccactgtggagtcttagtcctcctggaagccttgtcctttggcttaattatcaggacagtctccttagaagccctcgcctctcaacacaagcttctgtggcctgggtacggcctgggtacatctccttttataacaatacacattccacaacaaatggcctgcactggacccagccctaaagattagtgctccataaatatttgcccaaaactttctttcaaagaaaaactttaaaagatcaaatatttcagaaacaaagccttatccctgtcctagatgttcccctaaacacatacacacacacacacacacacacacacacacacacacacacacctttccttttacgaacagggccttgctatgtagctcaagctaaccacagactcgctatttggggattacagacatgtaccatctcatccatatctaaactgtcacaaagtccctgagatgtgacagaggtgttcagagatggagatcagtcagtgacaaaaacccatatgatggccaaaatgaaaactgtaacatccattagtccaggtcatttctggttcacacacctgtggttcttcatgagactcaagataaggtccaaattgtcctttgtcttcatttcatagctagaaattcagacatgacccaagaagagctaagaggcaggagcattggacgtgggaagccca

SEQ ID NO: 32798 - DNA, 1113 bp, Mus musculus
cctgtttctaccttctagcaacaagctttcaggcacacctcactgtcattcatgctcagctttttacatgattcccgggatcatgattcccaggatctaaactctgtacctcatgtttgtggagcaagcactttacccactgaaccacctctccccaccccccaccctttctctgtgtgtgcatgcgtgtgtaaacacgcagagactggttctcttgaatgtcacctgagctctaaggaccaacccttatcatcaagcttggcagcaagttcccttgctcactgagacgtcttgatgaaacgactccccacctttttatggattcactggaacttgctatgagataagaccaggttgtttaccccctgcctctgtgctccaacagctgcgataagaggtgcacaccagggctggagagatggctcagtggttaagagcaccgactgctcttctgaaggccctgagttcaaatcccagcaaccacgtggtggctcacaaccatctgtaatgataactgaatctgttctggggtgtctgaagacagctacagtgtacttacatataataaataaataaaccttaaaaaaggaggttcacaccacattttgtatgattcttgtaaattttacacatgattgaaataatttaaaatagaatacaaaatgtatatacacaaagaagcctttatccatggtgaggactttggcgggcagtgagagatccaggcacttctcactggacgtcacaagggggcgctggagaaccggggaaggcgtctttgccgaaaactgagctgctttgctttacagcagacaagatggacaacagagaatcagagcggtcacaaccaggacatcagctctagaaaactctagaaaacatagtggtgtgggtacggagagcagacccagtgatgaagagcatttgctgttcttgcagaggacctgagtttgattcccatcacccacaattagccagctcactcttgcctgtaacatagctccaggggaatctatgccacacacatatcacgtgacacacacatattttaaagatacataattttaaaatttttattagatattttctttatttacatttcaaatactatcc

SEQ ID NO: 32799 - DNA, 1110 bp, Mus musculus
ttcgggaatccgctgaggaaattcaagctggtgttcctgggagagcagagcggtgagtgcgcgactcccccgctcctggcagccggccgcggcttccccgcaccgcccccagtgcagcccttctggccgctgaggctccccgccggcctcgctcttcctaaaacccccaccccagccttttccccgggtcccccgactcctcttgtccctgtccctggctcctcctcgctaggatctatcaggcttgtagcttagatctctgatcctcgcccggactccgccgcctgcagccgggccctctcgggccgctctgtcctcctcagtcctcaccccgcccagcctcctgtccatccctttcttcctttgctctgcgtggtctccaccacccgggccggctttatggggccccacccttattccttgctctttttccggttcccattggaagtgaggtcccactccgagaagcccccaactctggagaatgggccccctcttcaaccttggatgaaggagggtgggatctgggcgttgttttcccctgaggcttggctcggagttgtactagtctctcggaaggtgagagaagaggtggtcatggagaaaaacaattcttgctcagtttacacctaaatgaagaattagttagggttagtgagctaatatattttaactgaaggagacttgaaaagaggtggcgttgccagtgatgattttggtcccttgggttgggactggttggaaatccttatttttctattaattttcgtcattgacaattcttttggctatattgatgccttttcagtctctgccagatgctatgtcatgatcagtttactttgaatttttctcatctcacttccctcttttctcgtttcaatatgaaatatttaagtatcttcatgatgatacaagcaaggattaacgggtgaaatgttaattattaatttcttcttgagaattttccagttacatatttaagatgtatgtgagaggcttagaataatgcatctttgttttgtaggattgcctttgggtaatagggtaatagatccaccatctagctctctaaattagattagaatactatttgagttaactgatttt

SEQ ID NO: 32800 - DNA, 1099 bp, Mus musculus
aaactggtatcttcttaagacagctacagaatactcatatatacataaaataaaaataaatcttttttttttttaaagaaattgttatagctcttctaggagtggcgcctgtggtgtcaactcttgttgaagttgtcaggccttgtttgggcagccttgttgggaaacttttcattactgcttcaatttcacttgatatggatctatttaaattgtttatctcattttggtaaattggtagatcatatgcctctagaaatttattcatttcttttagatttcctattgtagtggaatgcatggtttttttagcctaataactttcgtttcgttggctcaagtcccagcaaccacatggtggctcacaaccatctttaatgagatctgatgccctcttctgggtgtctgaagacagctactgtgtacttacatatagtaataaatctttaaaaaaacaaacaaacaaacgagctctgtagaaagtctcagtaacagaatagatcaaagatgggatagaatatttgagcttgaaggaaacagcaatagaaacaataacagcacacaaactcacagaaattaaacaatgaatgggtccttgaagaaatcaagcaataaataaattttaaaaatccctggaatcaaaacacaacatatctctaagtgcctacataccagagagacttcaagtaagaaatttaatgatgtgccttgagaacaagaaaccaaattctacatcagtagaggggaaaaaaagaaaacactaagatggggcagaaattagtgaaaggggaccagcaacaaacaatacacagaaatacacagaatcatcagaacaaagagtggacttttgttgtttgtttgtttgtttgtttgttttgaaaagataagacaaacctttaaccaaaatgactcacaggaaaatccacattaataaaagtagggaagaaaagggagtcattattctgtgggtcttagaagaaaagggagtccttattttgtgggtcttagatgtgctggaattagtatcgtccatgaggtcagggtgcctggtgtaagctctgttattccctgagtaggatattgacttaaagagcaacta

SEQ ID NO: 32801 - DNA, 1521 bp, Mus musculus
tctttcaaccctcctgcagaagctcactgctttggccccatactctttcattgactgcagtgtgaatattggcttgaaccttttcccttcagtaataacgtattgcaattcatcattgctgcctgtttcgtggaggtgatctattagcttcacaagcacaaaaaagtcagtgtctttattatttatattttttaaaagccaaacaattccagcatactcgtgataactttgaggattagatacattttcttaacatttttttccctttttaatgttatgataatgtacttaaaatgatgaaaatctcagcagtatgtgtgtggcttgttaaagagcagcgtgttcatagcagcgttgcctgccttcttgctgtctatcagcctttcttgcctcttccttttcgccttccctgttcttccctttctcaaacaaacaagacatggcaaaccgcagtctaacccagccctttgaaattatccatagttttacagacagctccaggctatgagccacaatgtccaaaattattcttgagcactgatataaattacttagaccttctttgagggcagaactcagctgttgctctcatgatgggcagtgctggaaagggttctggtatgtcttcaaaatgagtccacgagtttactgagtgcttacaggtaaaggaatgaatataagatgtctttctgatcagaacaggtgtcccttcacatgagctttactagactctgggagggaaaagtagccaagtacttctgaaccattttttaatacttgtttcgtcatggtgaaattatagcagttatcccaaaatgttttaattatcaaaatactgtcttttaaaaaaaaaaaaaaaaaagtaacaccttttaaagcattagatttcacttgggtttcttttccaaaaaatgctaggtagacaaggcattgtaaacatgagtttcctttaagaaccatcagaatataaatttaacatgaagaaaactgctatatctagtagaaataatatctaaagtttaacaactaaagtaccctcacagaatagcaaatacccttctgctctggacatgggttcaaatttgaatatggaaataatatccttggaagtccctagaggcaggtcagaggaagtatgcattaagagggaaaggagagaatggaaataaaagtcactataatgcagatttatgccttattttttagcattttttaaatgttgggtctttcaaggtgttttttgctttttattagatctatataaataagttaactagcaatttagttttgtatttaagctacacttaatctttttctttggtgatatttatttctttgcctttttttttttaaaaaaaacttagaatttttaggtgttttgttgaacatttagagcttcatcaccatggcaatatgtatttcccttgaaacattgcaaacaaatatactaggagtgcacccttttaatctttactagttattgtgagattgctgtgtaagttaataaacacatttgtaaat

SEQ ID NO: 32802 - DNA, 1261 bp, Mus musculus
tttatcctcttttccgtctcaaaggaagctaacatctcaggcacagacatagccaaaagtccatacacccattgccaggcactcccataagtcacatgtgaattttctctacacatagcaaacataacttcatttggctctaagtgtctgaggaatggagctcacaagagagcaaacaacaaagctacagttatctgtctggtaaggataagtcggggcaaggagcgaggtctgggtgcccaaagaatcaaataacagttggcttggtgttgtggcaggggttggttgtagtggttctagctctatgtgaaggagcttgctggataaaggcacgatggggctttttatggagtaaagtttcttgatttcaactataatgaatactttgcctgtctagttagtactggcaggacatacccttaaccaaaacatggaatttggcaccttttcctcacttgtagcttccctatgatagctgagctaaccctaaggtttcctagctgtgggaagaggtgagttctttgagacctccggccttaggaagttgcttccattaggaaatgcctttctgatcccaggagctcagctcgactgttaacatctgaagcttattctcttccttcccgctggggggagacggcattatcttgttctggggcctgacccaccttggcaccagcctggggaacccctcatgtgcctgtctataggtagcaagcaatctctccatttgatcctgttccaaactattccatcatcctgtcccaattgccaatagaaaagctaaaatccctggctcagttgctagagtgcctagtaaaattcctagcatatgtgagcgctccattggctcagcacagacactaataaagacatgattggccccagaactggctttgcttgttttgttcctccaggatgtttccttgagacaactctgtgacacagcatcttctgtagagtgcattatgagtttatgtggaattggtgacagctatgtgaatgaacaatttgggacaattcattatctatcttgctttccctggactatcaccttagctcatagaacagagatgaagttggttatctctgaagagtcaaaaagaggatctcatattctaagagtcaaaaagaggatctctgttctatgagctaaggtgatagataatccagagctggcactgcctgccaagagacttctgatgttagaatatttgtatgtgtgcatgaatgtagaaggccagagctcaacagccttaat

SEQ ID NO: 32803 - DNA, 1209 bp, Mus musculus
tccttcactcaacatctataggtgtctatgagctatgcctatccagcagtatagtgtatacttatattcctggtttatttctcatcacacatggtactggttaccaccaagtgccttgtagttgctaagctacattgatgtttcatgactttgctcatctttttgcattaaatgatattccttaagaaatttttgaggagctggagagatggctcagcagtgaagagagcactgactgctcttccagaggacctgagcaaccacatagtggctcacagccatctgtaattggatccagtgccttcttctggtgtgtctgaagacagcgacagtgtactcataaagaaataaaataaatctttgtgaagagttaaggttgtcataaaaaccaagcactctattctgtttccagagaacatctagtgtatgtcactgttattatggttgcctggctttagggaaatttaattatttaatatttatttacttatttgctggtttatttttgagatagagttctctctgtcttgctgtcctagaactcactatgagaacaacctgacctataactcacagagatccacttgcctctctctctcaagtgttgggattagagacacacctcaccgtgtttggcttatttattgattgatttattttggtttttcgagacagggtttctctgtgtagctctgactgtcctggaattcactctgtagaccatgctggtttgtttatttatttatttttaattaaaaatattttatacataatgagtgtttgcctgtatgtgcctacagaggtcagaagaaagtgttggatcccctgggactgtattatagatggttgtaagccaccattggctgcttagaactgagccaaagtcttctgcaagagcgcccagtttagttcttcttgtttttaccttcacttagttgtaactttcctgagggtgataacctcttgaccttggaatatagtttacatttgcaaataaaaaacatgtaaatgtgctatttatacttctgcaaacattaaatcattcctcagtttgtagtacatacattgcttctgtggcattattttcactttaagataagtaggagctaaaggtagacaaaacaatttgatagttggatatcagttgagggaatatattggatgttttttttgtcttccatatagagcttaatcttcacattactactg

SEQ ID NO: 32804 - DNA, 1180 bp, Mus musculus
ccctcaccataggatgaggggtgtgcacatgaccatgagctgccacactggcatcaccatacacagacaccttgtccacaccttttcccctccccagtgcagtgctgaaggagaggtgcctgaaggagaggtgcctctgttcaccagcctcccttatcaccatttgttcacctttatccaccctgggccaggaagtctggaaactggactactcacagttagtgaaagcctgagagtctcttgtcatgcttaaaacaaaacaaaacaaaaaacaaacaaaagccctatttttcttcctataagataaaccacgttttccttctcgttatcccaggaatgccctaaagtgcacccccttccctgaatattcatcagggacacacatctatctgtccagacctctttttgtaaagtactttgactttgattgccaaaacctctaaagataggaggcagggtatgcatcgtgatgctatgaaggggtcacaggcttgccaaaggacacatagctcatgagtgaaagagccaagatttagactcttctgatcctctattcttgttgctgcctcctactggatctcgagtgtaagcttgcttgaagaaagaaggggttacttgctaccccacacagaagcgtttatgaagacttggggagctccggtccatcagctgagcagatttttaagaatttctgctttgggccaagacctataatgggccctggagacccagagatagatagatccagctggtagtacagataggaatttgccacaaaagacctaactcaggacactgaaggtgacaactgcctagtactgaagataattgaggacagtatcgtccatctttcaacaaagagtcttgcttctggaaagcctgcacaatctgtccatctggctcctgtccagatccaacaaagtacgttaacggggcatggtataagcctgaactactgaaagcatgtctggactggagtacaaggtttatttgagaaccagaaactaacttgtgtcccatgtatcccagtgctttctggccatcagggcagttctacgtttgagacctagcagtgtttctttggaaggcttgatgctctgttctaaatagctttcagaaatgagtcatggagagcatacaagtagcacaaatcccttggtcaccaagttctggcatctgt

SEQ ID NO: 32805 - DNA, 1288 bp, Mus musculus
gggaaaaaaagaaaaaaaaaaattgtgaaatttggcattatgtggttccagggctcagctttcaaaattcccagtaggccagcttcaacattccatggccaaactcgcctgacctagacttgggtcccactctcagtttctcctgtgggtatttcctaatttataaactgttaatgccagccagaaggccagctaagaatataggagttgaaactagtggccacagagtcaaagagggacacagaagacaagcagcacttgctttccttaccgtggctgctgctttcggtagcccttaggtagccctgcggtggcagtgtgtccctttatcctttccagcctgagggacaattttctttcccaagagaacagatttaaaacagctttacagatagcagcagcccacaggaatctgctttgggtttgaccctagcatcctctgtcctagaccccagctcagccatcctcctcatgcatgaaagtcagactaaatgaagaataggactggcccagagacctcaggtcagccagatcaactggatctgtcttgtgaaccaagctccttacaaggtgatgcaaggctaggcctcctgcaccttggagttgtcttttatctttgaaggcccagggcctgtccccttcctgtcttcaaggcatctgcacccctctttcatagcacatgacagagaagcttgttctcatggcatggaccatccctgtgaagagagcgttgtgtatgatttttgtattttttaattcattttaacctacaggttggaatctaatttttaaattttattggaactcacattttaaaacaaataaaaaacatttaaaaataataataattataataataaacctttgaccagtgtcttccaagtagtttgatcaaataatttatagatgttttcaaaatacagcctggagtgtaaagattggaaagccctgtggccacgcttgtgtgtatgaagtgtaaatctggctttgttgttttggattcctttgggttttgctttgttttgaagatcagatagtgatcactctgaatggttgaagccaagagtttgtaactatgatatttactgtaagctgtagaacattcaacaactattaaaagaaagtttccaaaaaaaaaaaaaaaaaaccaacaaaaaccaaaacgtgtgtcttgggtgagggaggcacagacctcctccagccagtgagtccctgcgctgctcctcccccagggcattctaagctgctttttaacctgttgtgagtacacacctggagccccagtacg

SEQ ID NO: 32806 - DNA, 1214 bp, Mus musculus
ccacccttctgcctactgcatccagggctcccaaggctagtgccaagccaggacgtcagggcgagattaccatcttgtctgtgggcaggtaaggtgggcagacatagagttgtggaataacttgaaggcctggatgaaagcaagtctgtgggttagcttagtgctgactagcctttcctgggcatctctgggtagtgtaggtggccaaaagggtcatcatttcccagctgtgctatgtcacatggagctcttgggtccctgaggcacacacagtcttggtgttatcatacccgggacttcttagaccaagggtctgtctgtacccctctaactagatgtggggttgctgggagctggatacaaatagctggggggctgagaaggactcctgagtagtctaacaggctcaacctgtgtgatcttggaaattgcagggtgacctagtaggagctgccttctttggcctgggtttcccctctgatgaggggtgttggtaccacctctccctataggttccgtgtggctcgtattcctgagcagcggaccagttcattgttatctgaggtgaagaccatcacggaggctgggccttcagagggtgatctccctgactccccacagcctggtcttccccccgagcagcgggcactgctgggaagtggtgggagccatactaagtggttgaagcccccagcagagaacaaagctgaggtgagtgcttggagttgtgggggggggtagcacctgggtcaaccctgacagaagagaggcccatgaaggcagtggcggcctcttgactcagctctgaccctttaatcctgacccccaggagaaccgctatgtggtccggctaagtgaaagcaacctggtcatctgatgggctgtctagaattagacactctgccctgtcctgggaggttctgaaggcttcctgcaggagggagagctgcagctgggactgaggaccaagatgcaaaggccaagtcctggaggtgggaccgtccgccccactgaggaggcagcctgcggcacagcacgtgagcaggagatcaagagcccaccctatccctgcagtcccggttacttccatgcagggtgctgtaaccctgtgcctgccctgaacacatcataggagccctctgtcccttagaggtctggtttggtggaggagtggtatctgtacctggccccaagcttgtgccttgggaactagc

SEQ ID NO: 32807 - DNA, 1111 bp, Mus musculus
gtcttcctccaaacatgttcgccacgccagtgtgcctgccacctttacacctattgtggtacccgagcctgcgatgtctgtgggaccccccgtggctgcgccagagcctgtgggctttcctgttagaggccatcccgccttgcaggcaccatcacttgaggatgtgactaaacggtacatgctgacccttcactctggtgacgttcctgccccaggtcctgtggacctaccctgcttgcctccttctgcaccgccctccactgagaccaagccctctggggctgccagggcaactccagatgagccagccccagcgagcaagtgctgtagcaagccacaagtggtaagtcctttggaaggagactgagggagggtgcatgagagccatgggcaccaacctgacaggaactgagtactcattaggcaggcttccagaatctgtcctggaatagagttaatggcacctggctcctgttacctcaggacctgaagaggcttccggatgctgccagtgtggaagggtctgtctgtctgccccaaggtgttctggtggtggttgcaaaggcccttggaatgtttctcagagtcctgtttcttagattcccatggttctttgctagaaatgcactagaagtgtggatgcaggtgataacactgagtcaaggctctggcctcaatgcccgactcttggctggtctcatttcaggccagttcacacgctcttgccttgaaatctgttccaaaacctgggagacttagggaccagcctcactttagggatcagcagagggcttcaggggtccgactccaagcttgttctagtttctgaccttggcctttcttgtggcttaacctcctcatttataaaactgggtctgagggatgtggatgttgcagatccacccaggtggaatcctgcagaactgggagagtccgtgttttgagtttggctagtccccaggaccagtgccaacacactagtcttcagctggaggagcttcgaggtaaagtcgctagggaagtgtggtgacagaccggcttctgctgagccttggtggcaaaggcccctcagagggattgaaaacagttctgatccctgtagatagggctg

SEQ ID NO: 32808 - DNA, 1195 bp, Mus musculus
tgtgggaagatgaagttttatctctacggagtttggagaaagcggagaatcttgcccgcagagggcgcaagagcaacgtaccccgaccgcagaaagacgtggggagcggagtcttagagattagaggacgccaggccttagagggcagggggcgtggcaactggaaaaatggcgggggaagttgtgtgtaatagtcctgagtggtgggactgctaaagcagcattgggtgggttaagggacagtcagcgagggacaaaccagagggaggtgggagataggtggagcgtttgggagagtgaggggcgggacatgggcgtggtgcggcgggattcgccactgaaggatgagtacggggcgtggtctgagcaaggtggggaaccacaagcgctccggtgggcctgccccacctacgtctccctgggccccacctcttttccggccaggagagtttctgcgtgtacctgagtttcggtgtgtacctgagtttttgggtcttgggttgccatgttggagcccctgcggcagaggttcccgcgtgaaagcggggactactttatgcagagctgtccactctcagctcctgtgggtatctgaaggagtccccagggaggatcagcccgcggctttcgcagccgactcccctagagggtcgttttggtctacaaaagtcctagcatcctgtttctccttcggctcctccccgattccctccccccacagtgttcccagcctcgcgcgctcccggagcccaccccctcttttgggcgccaggccccgccccccgccccctttcctctgcctcaaagtttatttgcaacaaaagggagcagagagctagctgcttagagggagggaaagggagctggagcgggagctcgaggggaggcaggcgggccgccgggcttggcaggcggactttgagtgcaggaaccgagccttaggcccctcaccggcaggaccgcgatgtccctggcctctcccgcagaggctaaggctgggcctggggtcgccgcaggggcgagaggggccgcccaggatggaactcctgccttttgtagccgcggaaacttgatcttcgactgataaacctctgctcacgtctccgcaccctcctccacagccgccgcacgctgcgggtgcaggacccaggctctcggaccgtggccactgcgcgccctcggagtgggagtgcag

SEQ ID NO: 32809 - DNA, 2230 bp, Mus musculus
caggtgtcagcgaacatccagaggagcattggagcgttccacgtgctagcctctgagtcaagaggccgataaccctgtaattgtctcttgctcaggttcgggcggcgccgccaccacccacacagaaccaccggcggacaactgagaagatggaggacgtggagatcacactggtgtgacagtggatttaccttccgttactgctacaatcaaggccaggcttggagtttggccagtctcattttttaggcacctttgcatgatgatgactcttgaaaggagcaaaaccaaggaggattcgatgggactggttggcctgattgtgccttttttgttgtcgttttttatgtcatctctcctaccatagcacaaatcatagcgggtcctagaagcagaggggagcagctctcatgccttatagtggcccatttttatatgagactcaaggccaggcctagatccagggcacagacccagaattaccaattgtgtgaactcgtacagtatattactgtggccatgcacagggctgtggcaaagatctcatctttcctcaagtggattttgctcttctgattgttattcaaatcaagttgactgtgtaaggaaatccaggagaggctggctcctccccaggttcattcccatactgaaaatgcaaccttattgagaagaaagtggactgcctgagcttagcgccaattgcataatgcacatctcttcctcaactaacagatttaaaataacagtgtcctttgtattaatatttatgccattcatttagtattagtgggctaacctggaggggctgaggccacatctttcccatcacatagactagaagggaggctaaggaagaagcagaaatggagcttccacatctgaaatgagccactttaatgttccttttgtctttgggtatgtttcctcttggtttttacagtgtataccctctgaccagtatcctttgaatccaagtgtctggctgcattgaggacaaaggcctacattgctcagcttctctactggagaggcccttatattattttattcccaagccagagtattggcctagacatctgggttgtgattggtgcagaccagctgtcgccttctgaaagtacagcttcaggtcccactgccctgacatttgtccagagtgaagaatctatgggccctggaggaagcctgctttctgtggaaaggatacaggactgtacacctgcccaggtgagaccaaggaggctagcaccttctgcaggtcagggaagagcctcatggcgccctggcctcagcctagaaggtcaagcactctgtggacggtagatcttgacctagggaacaaagcaatgcttgccaatcctcttttaccttggctgggaaaagaaatttacagatttaaaggttgtatgatgctttgaaatttccatcccttctgagaatctctaaaaacttgaaatggtcacatgtccccgtgggatttttgactgatatcggagctgaagggattttcagtcatttgatcactttagcaatgatactctgatgaatcttctccatgaatttggatttttggtttttacatttatctgttgatctatttgaggtctttttatgtttatcaaacttattcttaagtttaaaaaattaaaagggtattttaagattttcaaatttgctgatcttcaaagtgcttataatagagcagttcctgctaccagtcctgtattctgtttagctaaccaaattgtccttggatttgagtttcccacaacctcagagttatttgaactcttttgttatattttaaaatattttttggaagagctgctaattttattttaagaaacaaagttgtaaaaatatgcctcctttttaaaaataaataaataaataacccttctctccaggccgaataacccggcgtcaccatgcacaggtcagggctcaaagggagcctccgtgcaggtgcgctttctttacagtggctgtaaaaagtttgtatttattatgtataaaatgttgaataataaaaaatgaaattaagttttgcaagtgtcctgataaagagttgattaggcaggctttgagagagaggatgcttcttgtgggccatccttaaaccacgtatcatgtgcccagagcaggaagtgagtccacccagacatcacagaccctgatgctattcttgtccagcaagagggaagaaaagacaggtcatgtatttgag

SEQ ID NO: 32810 - DNA, 1197 bp, Mus musculus
cgctccacctatcccaccccgcaggagctgcctcccacctgcctgcttcactccgacatccacagccgccccagatcctgtgctgcccccactgcctgccaagagacacttggtagaacccagcgttcctcctgtccctcctcgaaccggacccccctacccacaggccaggtgagtgacatcacggctggtgggtggaaagacctagaatgcagaggaaccagggttggaggaatgaccctgactgctggtggggacacaggtttagagagaagagagcagggccaggccagggcagagttgggtaaggggcagacgggaggatagccaggacttaaggatacctagatatgtgtagaaagagcaggggagccaccagggtcgcgagtgtctatcccagcaataggggggacccaaatcccaggacctgtctgagcggcagcctgcttaacctgcttactgtcggtcctcttcagaattccttctcctctctccagctagtctcctccttgcttccccgaacttttcccactttctatggacactccactactcattcctcccagctctcggctgtttgctctggtgccagccagagaagcgtctaaagtcaggctcctttggagttttgaagggatgtgctgtcagaggtctcttgtccttgtcactgctggacggtgttggtgaatttcattgatgtctgcagcaagccttctgtggaaggtgggaattgtgttctgatttctagctgggaacctgaggcttgggaaggactagctggatccatgcaggcgtgtgggagtgatgggaggtgggggcagggtgcacttttgtggagaaaacctgtgaggttttgtccatctagagagtagcattgagtcagaggatcttctagcccaagccaggtctgaaattatgagatgtaattgatggaagaaatcacaagatgttttttgtttcctggatccttgggaccctgtttccacagtatagattcatggttcttagtgctattgtaccctctagtggccattctcctgagtgcagaagagagagagagagagagagagagagagagagagagagagagagagaagactcagagttgctggaattcaagataccctggatttaccatgccacatcccttttctcctgccttctcctaacccagggtgtagattttgattttttttt

SEQ ID NO: 32811 - DNA, 1163 bp, Mus musculus
ccccgggaaccacttctgggctgctaatgtgcctcctagtgaggccctggagcccagcagcagccctggtgcccggcggtatcacctggaggccaagtacagagagggcaagtaccgccgctaccatccgctctttggcaaccaagaggaactggacaaggtcagcacacagagcctctgggattcttgagccttcttgtccctgcattatcccttgaacccatctctttcttcctgtggccccattcctccctctcaacccatgtcttccatccgcttagagggctgtgcatgtgtggggagattgaggcccacagggcagtagggcctgcctaaggaaagctggaacaatgtagggaggagtcaggcttggttcttggtccagtgccatgtcttcagcatctggctgcctcctcctgattcctctgtctcccgcaccctgtcctgttctttcagaatcctgccaaaggagtgaacttggtggggatgctatttcctgtcaggctcatgaaaaacagctggaccactctgacccaccccatccacgccccattctagatgaggccccatatgggccccaggccccagaagattgggagccaagtcttagaccctgatctggctcagaccgcttgcttagaggcagcagggtaacatttgtaacctgtgggcggcagtcctcagctcttcctccaagctgtcctatccaggcaggctgagtctagccccagagttgtctagaaaccaggcctccacctccccaggacccaggcgtccagcccccagttcagcccagcccagtctggcctaaaagccagaagggtggtggctcccattggtcgggagggctgggccggcagtgaggaattcaaatgtgggaggaattagctacaacccctcagctcctccctctgcccctgctacaaggcagagggagcctgagatcctccaggggctccttgtgccctgaccagcagctgtgcctcaggacccacagggtgagggcctgtggctaggaccccagcctcagctgggtagcctctgcccagcctccctggcttgccctcccctcttctttttctgactctcatgcctttcttttcttctcttctggcttctttaagccctgctctctttcagtctgaggatggtccatgcaggtt

SEQ ID NO: 32812 - DNA, 1103 bp, Mus musculus
gacccctttttagtaagctgtgaccactgtgtaatgtctaccaactgtctatttttgccatctaaccattttctaacatcagcctgtgaagtttgttctgttcggcagcctttgccttccaattatcttccagcatatgtgctgtcctcgggctggggacacttcccaggaacccagtcttgttacctcctgtcagccataggcacacgggtttcataactggaccctgtggcatggtgactttacctgagtggctggtacttttagagtaaggactcagagctcccagaagcagagacttcaaaaacaccctcaagcggactgcttccaattctgtcctttggaaagctctctggcaagacttagacctaagcatcagagcatgcgtctctctgccatgccttaaaatcaatatgcctagtcatttccttctggttccatatccctgcttcctccagccaccaaacagaaagagtgcatctacaagaagcccccacgcttctcttccagatcgaacacctttacaatgaggacgccggggcctttatgagattccctccacgccaggcccccaggccaaggctagccctttgagctgtttcagggacatgctttcctgtccggtgacttggaaccgatgccctaagcccccacctttgcgtttctccccacctgcctttttagtagtcatccatttataccgtgccctggtttcccagcctcgagggccaaaactatcagcccacttgtttctcccttctagacctgaacaagttgctgtcactcagggcctgcaggcctgccaacttctgacccctctccccttcttgacctcccttagtctactagtgtatgtgaccagccaaccgagaggcagagcccgctctcttgtcctaggggctgttgtcggtaacatttccaaagtctttgacctctgctgaccttttccaaagggtctgccttcctgcccatcagctttatcagagtgttctggccaccagctttgccgtagcaacacccaaggcaagaggtttaggcccctgggtctatgggtgaggggtagagggagcagccgctcatgctctccctttgagttgtaaaga

SEQ ID NO: 32813 - DNA, 1190 bp, Mus musculus
ttagcagtagcctgtgagcttgtagctgtttagcccagtttgcaagtaagaactaagactccgagatgctggctcgcccaaacacatgacagaggccagctccagctcctggctccagccacaggtcaggtacaggccaaggcataatggccatgtcatcttctaccacctgcaggtagagcggcgtgtggtaaaccaactggcggcagcctatgagcaggacctgctaccagggggttgcaccctgcgtatcactgtggaggattcggacaagcacctcctcaagagccctgagctgccctcaccccaggctgagaagcgtccacctacattgcgactggagatcattgataaggacagcaagacccgcaaactggacatccaggcaccactccaccctgagaaggtgtgctacaccatctagcatccacctgtctgtgccctgaacatctaataaaggccccttgctgtggcatggcaaccaatccaccttgccctcatgcctttccaaggcctagcaccctctcctgcctttcttggttgtgaggttcatagtctgttatgatctccaaggcaaggaacaggaagcctggtctgcacttcagtgtgcactccactccatgtcctcactagagcattgacgtgtggccagaagctcagaaacatgcagcggagaacaagtctggctgaagaagataggactcaggcagtggtgcaccacctctgcttgtgctgatgcggctcatcctcaggatggccccgtggcagtggggggaagccaggagccccaagcacaggtagctctgtagtttattctacagctacctctttcccatgccctacaactgtcagagtcaaggcttgtgactgagccagtgtagagcacccataggtctgactggtccctcttcctgccttcctctggggtgggaccatggtcccaggtgaacacctcagctctgagatggggctcattcagcaggctggcagtctagataacagaaggtgctgtgggagcaaggctggagtcaggctccacacaggtgggcacgggtctgccttagccctgtctcttaactgccgtcccagccaggtagcaattccatgggcctagcatacccataaaggacagcaggacacagcagggcctggcaagtcactctgcatcatctgcagaagccatcaccact

SEQ ID NO: 32814 - DNA, 1877 bp, Mus musculus
ggtctcagtgtctgcagctgcctctgatctcatctgaatctcataggtgtgaggctctgggcttctgccaaccagatgtctttttttgttgttttaatttatttatgttatgcttaaaagtgttttgtctgtatgtatgtatatcacatgtgtgcctgtgctatgtgagtgctgggaattgaacccaggtcctttaggtagggagcgtctggcagtgctcttaactgttgaattatctctccagccccttcagccagctgtctcagtgttaagagtaaactgaatctcagaggagggaaagattcacttggagggagcaatcaataactaaattgacagctcaagcctcttgcttccagttcctgattttctatgaggggaccttgtaggaccaaaaaggctaatagaatttgacacttcagattaatatggaggttggagggggacaaagttgaaaagaatgcctccccagcctgaccatagcatgtgttggatacaagacagagagggaaacgagatattctgaggtctgcttgaatggggttggaattgtattagtaaatatctcaggtcctggacctcagccgggtccagtataggtgagttgggctatgccatctttaatggcagggaagtctgggaggctggtgtggtgaaggcggcagcgatagcgaccacagctcttggtgtactgtaggaagcggggtgcaccaggaaaaagcacatggtcagccaatacagtggcgccatgtgggagcagagcatgggcctccagtagctgcagatcccttaagtaataccgaggtcggtgtgccaggagcaccagatctgcacgattcagctggtgctgagctcttaggcgtgggatcacttcctctgagctgcctgcaatgagctccacctgtggggaaagccatagctggaggtgaggagaactgcttttccacgctagaccccaccgggatctggctgatttatgccaggtattaatctaggccttcacaagtgtctcaaacgtttcctctgacctcagaaatccagtagtcagtttcagtattgtaattctattgtgtgcccatgaagaagctgagaatcagaggctatgtgtttcccctggggtcacatgactaaccaaagactaagatttggactcagacttgctgagctatggagagtttccttttagctgctgcttttgtaaccccgcaggaagtaagtgcaaaagactcgggattgtgggtaggagcagcatgccctccaggatgccagctgcctgagtggagctgcttccttgaatgggagtccctcatgaaagaggcctggtctgagcaattcctgggatagctgaagagatcagcgttggggcgataggggctgaccatttgctcatcgaagcctgccagccggatgactttttcagccactgctgctgtacgtgagtcccgctccacagtgagaaggcgacttccagggggcaaggctcgcgcaataagcagtgtagagtatccacagtatgtgcccagctccagcacacaagcaggggccttctcttccaccagccgcatcagaatctgacctatgggtcaagatggctattttagaagacattgaaaacaggtgtgcccagaatcaaacctgctgtgcttttctgaatgtggtgtttatgtgtgaggctgacaggctgctttcccctttcccacacctgtctccatccacctggccaacttgaagagaagccttccagtctcagtttagatgtttcttcctccaggaggacccaggcgaaatatccaccctaccttccaggttcccgagacattttcagtttcatgctcaaatgcacttccccattgctgattgtctttgattttggaatt

SEQ ID NO: 32815 - DNA, 1150 bp, Mus musculus
ccagctggaagatcaagcaactcggctgcaggagagcccagccccggagaagggtgaggtgctaggagacgccttgcaggtaggaaaatacagacagacagacagtaaggccatctgatagggttgattcttggtgttctctgatagggttgatccccattttgtctctttatcccaacagctggacactctaaagcaagaggcagccaaacttgccacagacaacacccagctccaaacccgcgtagagacactggagtgtgaacgtggcaagcaggaagcccagctgcttgctgaacggagccgctttgaagacgaaaagcagcagctggccagcttgattgctgaccttcagagctccgtctctaacctcagccaggccaaagaggagttagagcaagcctcccaggcccaaggggctcagctcactgcccagttgacctctatgacagggctcaatgccaccctgcagcagcgagatcaagagctggccagtctgaaagaacaggccaaaaaggaacaggctcagatgctacagaccatgcaagagcaagaacaggctgcccagggcctccgccagcaggtggagcagctgagcagcagcctgaagctgaaggagcagcaattagaagaggcagccaaggagcaggaggcaaccagacaggatcacgcccagcaactggccatcgttgctgaggctcgagaggcctctctaagggaacgggatactgctcgccagcagctagaaacagtggagaaggagaaggatgccaagctagagagtctgcagcagcaacttcaggctgccaatgatgctagggacaatgcgcagacctcggtcacacaggctcagcaggaaaaggcagagctgagccaaaagataggagagcttcatgcctgcattgaagcttcccaccaggaacagcgtcaggttcaagctcgtgtgacagagctagaagcccagctgaaagctgagcagcaaaaaacaactgagcgagaaaaggtggttcaggagaaggcccagctccaggagcagctccgggcccttgaggagtctttgaagattaccaaaggcagccttgaagaagagaaacgcagggctgcagatgccctgaaggagcagcagtgccgtgccactgagatggaggca

SEQ ID NO: 32816 - DNA, 1189 bp, Mus musculus
ggagttagagcaagagaaggctgggcgaaaggggctggaggcccggatacagcagcttgaagaggctcatcaggctgagactgaagccttgcggcatgagctggcagaggccacagcttcccagcacagagctgagagtgagtgtgagcggctcatcagagaggttgagagccggcagaagcggtttgaagctagacagcaagaggaggcaaggtacggtgccatgttccaggaacagctgatggctttgaaaggggagaagactggccaagaggtccaggaggaggcagtagagatccacagtgaaggccagccaggccagcagcagagtcagctagcccagcttcatgccagtctggccaaagccatccagcaggtccaggagaaggaagtgagagcacagaagctggtagatgatctctcagctctgcaggagaagatggctgccactaacaaggaggtggcctgtctgaagaccttggtgctcaaggcaggtgagcagcaggaaacagcctcacttgagctgctcaaagagcccccgagagctgcaaacagagcgtctgaccagctaggagaacagcagggacggccattctctagtacacacgcagcagtaaaagctatggagcgtgaagctgagcagatgggcggtgaactggagaggctgcgggcagcactgatcaagagccagggccagcagcaagaggagcgtgggcaacaggagagggaggtagcacggctgacccaggagcggggccaggcccaggctgacctggctcaggagaaggcagccaaggcagagctggagatgcgactgcagaacaccctcaatgagcagcgtgtggagtttgctgccctacaggaagcactggcccatgccctgacagaaaaggaagggacagaccaagagcttgccaaacttcgagggcaggaggcagctcaaagaacagagctgaaggagcttcaacagactttggaacagctgaaaatacagttagtgaagaaagaaaaagagcaccctgcagggggtgccagtggagaagatgcttctggcccaggaacccagtcggagacagctggaaagacagatgcaccaggccctgagttgcaggcacttcgggcagagatcagtaagctagagcagcagtgtcagcagcagcagcaacaggtggaaggcctgacacacagc

SEQ ID NO: 32817 - DNA, 1431 bp, Mus musculus
cactggaggagggtgggatgcaagaggtatctctgtcttggctagccactcataattgaggaccccacatttcttaggtgtggctggcaactcataacttaatgtaggtgtttatgagaccccaaaaaggaagaggtccagccaggggttttgtgaactagtcaatagaggttggcaacacaggacttaatctggccaagtgactgtcttttccttttcaggtgaagcattaaagagtcagcaccagtgcttacgtggccccactgcattgtcagcactgaccttgcttggtcctttccctcctgctgtccctcagtgccttctctcagctcccaggccaatggcggccagccttccccaagacaatgaggtttgcctgcaccctggcctgctacctggactttgcctggtgccttctaggcgtctttcagagatggcccaggaggcttggagcttggacagtgtgtggtcttctccctatcttgcctcctgattttttttttctccctccgttgttgttttggaaaaaagtctacttttccatctaactagattgagactggattctttagcccagtcttccttagtctctggacctagaagggaccattggagaagcaggctctgcttctctgttgttcctggtggctgggccttagcaggggtctttgctcttgaagcccaggattgggcatgacctggtaggagcctctgttcttacctatttccatatacagctgcctggaggatgctttttttccaggacagataggttctggatctcaggggtgagatagggggcagccttcaatggcagctcatacttcaccttccccagacttgcactggggtaggatatggaacgatggggaggtttttaagggccggggatggatcttttctaaatgttattacttgtaaataaagtctatttttctcccttgagtgctaagctctttgggtcagtatgaggaaaaaggggaaattgcagctctttggagcctgtgtttggtctttctggcccctgttcctaactagtattatggactgttgcaggggttcatgttattctgaatttttatttggcaagaggcagtgtctcatgctgcctgagtcaggcagagttcctgaggacagtaccagggtctaaataaaaatgagaccttgagctgctgcagctttatgagtactcagtgtgggccctgcagagacacagactgacatatacagttgtgacctgacgcagccactgttccgtccttgccttggggacagtacattaggggcaaactaggaaaacaaaatcacatgtaaagattgaagtcagtgcagatagtggtcagagctgagtggatgttgccaaagttatatctcaactaggcttcgggttaacctttttgattggtacaggatgtagaaatctgccagata

SEQ ID NO: 32818 - DNA, 1846 bp, Mus musculus
aaatcttaaaacaaaactctgggcagacccaaggtaggccttcttaccatgctggttagagtaacagctactgtatattgcgtgtgatccttaacatgctaacagctgggaaaggcctcatgtcatgtatggacagctgctagactggcttcgatacttggtagcctggcagcctgtcatcattggcctggtacaaggcatcagctacatcctgggcctcgagtaatcagaaatcacatccctggagaacccaccacccactatggacctcagggcactctccgtgctgcccacaaagacttgggtggaaaagactcaaaggcacttgggccattcaggaccaccccagctgtgtctgggttggtggggaaatgatggagaaccagccagtggggctgtcagcagtgggggctttttaaaagaaaattattttgatgaatatatttaaatttttttattgtggagcataggaattgtcccccattcctaggcctaaccttgcttgaacagggttgggcaaagctgcggtattattggttgagaggcgtcttctcacctctggctgagagcactggtgggtttgcaggaggctgggtgcttcagcctacccttccccttcccctcccttccctctgcaaggctcaagcctggtttgcactcagtgtagaagagctcagacgggtgccagattagcactgagcggtaaagggtctcttcatctctggacatgatgggtgttgtgtatgactctgttgcctttttgtctggaaactaaaggctgggggtggcaaaatcaatgacttttctaactagggaagccctgtggcctccaaattcactgacatgttttggaacagctagaaatatgagcagcatggataacctgcccctgagcagggccattgccaggcagagtataaaagcaatctatatatcattaagctgtggaagctacattggcagcagcgaatgttgcagcttcttgtgcaagtacacccttcatggaagtgttgacatgtgccaaagggtactctgcacatcacttccttcctgaaagcctaagagtgtgtatgtttgtgtatgcacagagcagacagactaatggatctctgttttctgccagtcatcagtgtgcccttgaagctaagaggggattccagcccaggaaacgtccctaggtaggcttggtcatttgtgggtttttcccaggcctgacgttaagaatggtgagtgcataggcagaatgaggcctgaataaagatgggctctgaaaggggacttctgagcaggcctaactgtagtcctggaagtctgaagaaagggggagggcatcatgggtcagcagcactgggtgtctagagaaatttggcctggcccatttgaaggcaacaagaaccaaacaggatcttgtcatcacatctgaataaagctccatgagctggctgcaaagctggacacgcatttgcctttttttttttgccacctctttcccgggccccctggggtatcttggcttcttgcatcccacctgagagccggaacctggagccattggtcctgccttctcacccatcctccctctgtgagagtgtgtgtgtgtgtgtgtgtgtctcctgtcctacggcatcaggggccctgaggccttcacccccagtctgagactagtaccctgatacccccacaactcagcctgttctcttactcagctgtggcttcctttttccctccatcctcagaggaatgagagctgagcagaaggccaagagacaggctactcttcctttggtatttgtcctcccctctccctaaggtgaaggctacgtctatgttttacctttagtcttgt

SEQ ID NO: 32819 - DNA, 1118 bp, Mus musculus
cccaggatttgggaggcagaggcaggttgatctctgagtttgagccaggttggtccccagagtgagttagccttaactatacaaagaaaccctgtctggaaaaggcaaaaaaagtgggggaggggcaggtaactataacctattcccagccttttctgccatgggtttgtagagtgtcatgtctgtcagactcaggctaggctgtttgtcatttctgagaaggtggtgtatctattttacccctccacttctcatttctgtctccagtcccctctgctctccttcttttgattttctgggttcagcttttcattccaacctagagagctgaagagaatctgggtagcttgatttttactaggctatggaacagcttaaaagtcttggcaggggctggagagatggctcagtggttaagagcactgactgctctgccagatggtcctgagttcaattcccagcaacctcatggtggctcacaaccatctgtaatgggatcagatgtactcttcttttttttttttcttcagagtatcttttcccagcccttggaatacagtgactctcttgctgggctgcatgcagccatgcattaatgtaattgttgtaagaaactgcacacacctcaggaggtccgttctagtacccatcagtcacagagttttactgctgtgcacagacaccatgaccaaggcaactttttttttttttttttactttattggatattttctttatttacatttcaaatgttatcccctttcctggtttccgctccaaagaacccctccccttgccccctcctccctccccctgctccccagccatccatgggactgtgcacagggtccccagtgaaggagctagagaaaggacccaaggagttgaaggggtttgcagccccataggaggaacaacaatatgaactcccagggactgaactaccaaccaaagaaacacatggagggactcatggctccagctgcatatgtagcataggatggcctagtcggacatcagtgagagaagtttcccttggtcctgtgaaggctctatgccccagtgtaggggaatgccgatgcactcttctagtgtgtgtctgaagacagctgcggtgt

SEQ ID NO: 32820 - DNA, 1197 bp, Mus musculus
ctagaaggcagaaagggaggcaggaaggttattgtaacccaaagcatagggaatggtccagttggtgctactgtaagtgtcttcttctggttttcctcataagtgcagggaaagctgtgtaagagatagcaagaactcaatgaaaaggaaagactatatctaggatacagtttaacgaaggataaagtgggaaagtcaggcatagtgccagctttgcaattttgatcacactagttgagttatatttacacaaaattgaaatgtgactgggtgtggtggcacatgtctttaatctcagcacttggaaggcataggcagacaaatccatgtgtgttccaagccaggtaggcctacatagttgagacctatttcacaacaaccaaaacattgggaacgtgagagaagatcaggctaaacgtgcagcattctggacaggagctgccaagggagcggctagagctgaagtgcttgtgtttgtgtttcagatggtgaccctctttcagatgtgggttgttcccctctatttcacagtgaagctgcattggtggaggttcttggtgatctggatcttcttctctgctgtcacagcctttgtcaccttccgagccacaaggaagcctctagtacagacaaccccaaggtgagaatgcaggagaggagaagaacctggctttctttcttcttcttcttcttcttcttttttttttaaagatttaatttaaaatttttgatgtattttgagtgttttgtctgtaagtgttttaagtgtaccgcttgcatgtttgtactgaccacagaggacagaagggggcactagatcccctggaactagactcctgtgaactgtgatgtaggaaccaaatttgggtctcctataagagcagcagatgctcttagtctccaagccttctctccagcccccaagctgggtttcttgaagcaaatgtgctggaacacatgggagaaagatgagtttagaatgaaaacaaaaagcctgttgttttttttgtttgtttgtttgtttgtttttgtcccagaatgagttggtgcagggcctctctaaaacaagctgatttggagacccactcccctatatccacaggttcagaataccagattttccctatccttcacttgatagtctacatcaagatctgttggtgtttaaaacacacacacacacacacagaacaaata

SEQ ID NO: 32821 - DNA, 1687 bp, Mus musculus
tctaaagttcatctataagtactttgaaggaaaagaccatagaatatcaagatttcagtcagaaaatccagggaaagaccttacaggaaaaagtatttccttattgaatgagcaaaaaaaaaaaaaaaaaaaaaaattgagcagacagagaagatagaatatcttgaaagaaaagttaaagtgtggaggccttcaggaaatagctagactgtttgattttgtctttcaaaagaatgtcttaacactcatcccagttgaccttaaacctgctcccagtgctgggcttacaggcacgagccatcatgtctgggggacaagaaattattaacgagcatttctaacgcagagcccagagcagaagaaccaaacaggaagacggctgtgggcagaaggaagaggaggaaagtgcaggagccaaggaggtaggcagccgtcctccccagcccgctgctctcctaagcccttccccggtcatagtgagccagaatcagaagatcaggtcacacgcacactgcatgtgatcacaatgtacatcttacagcttagacctgtaatcctagcactcaggaagcttatacatttgacaactaggactgctggactagtgggatacacagcaagtttcaggccagcctgaaatcagtgtttgctggtgtctatggggacagacagacgaatgtggagtgactgacatgcatttggagtttcctgggggttgatagaaaacgtcctagaaatacttagttactcagctttaatccatgtttccaaaggctaatttttttttctttttcttgagacagggtttctctgtgtagccctggttgtcctggaactcactctgtagaccaggctggcctcaaactcagaaatccacctgcctctgcctcccgagtgctaggaccgaaggctaatttatggtatgtgtataatctcagttttaaaattgaaaaactgctaggcatgatggcatacgcctttaatcccagaagctgaaaggcaaagacagtccgaacttgagttctaggaaagcctggtctacctctaagttctaggatatacagggctacatagtgagaccctatttcaaaattaattaatttttagaaactgaggccaatggtagaagctctgttgtcaaatgctcgaaggttaactgctttcctccaagtctgtcatatcgagtgggaaaatcagttactctttccactttcttcttcatgcttctgatccagattctataccttcagcctttgtagtctctcccagatagctgcccttaaactgttctttcccacagatcgttgtccaactcgagttctcagccaaataggaggacaggaaggacaagacaaagacagcaccgacctcagaccaaaagtgatgacggtggtgtgcaggctgctggacagtgtcctatttgtgcaggtgaactgcatcaatcaccatgggggtgggtgtcgttctagacaattagtgggctccaagtacaatagaagaccctgtctcaaatagttggagaagcaatacgatacgaagtatcagcctctggcctccataagtgcatgcatatggtacacacataccaatcagttttgttacacacacagttttgatttgtccaagcctggcagcaatgttctttatgctcatagctgatctttcccagtagactcaatgttctgta

SEQ ID NO: 32822 - DNA, 1328 bp, Mus musculus
agcatgctcctgatgccacctccaactcaacgccagaccctcagcgagtccctttgcgtcttttggctccccacattggcaggctccccatgcctgaggactacgccttggaggaactgcgaggccttacccagtcctaccttcgagaactgactgttgggagccagtgagcttggctcttgccaccacactcatgcccactcacactcgccacaccacagtccccagcactgttttagttgacactttgccaatctctgggaatcctccattcctttctgctgcatcttctagttattcaggggttttcctaatactgagcatagcctacaatagctcataagggcttctggaacaacaacaaagaagacaggtctccatttatcaacctcaagacctttttttttctttttcttttttttttttttttttttcttttgaaaaatggtcaataaaacctctttggcagaacctcccaaaacctagggaattcttttccacacccagcgttctggctctcaccccatgccagcatctaacctccaccactgcgatccttttgtaccgtgactgtttgacagacatctggcatatgactgactgaccttccttacagatttgtccctcaagtagatttctcagtaacggtggattttggagtcaaaagagagttggaccttgttctttggtaaatttaagatagaagggctgtctgccatagaggtagagatcttcaaggcctttactcatgccctgtgtatcctttggacaccatactatcatgcgcagtggccccaagccaccgagaaccagtctgagaagctccagattcgctcaggcccttgatcatcagtcgtcgtcgtcttcgatttgccagaggagtttagatgaagaatgtcaaggatgttcctccctgccctcccatctagccaagaacatttccaagaagataaaactgtcactgagacaggtctggatgcgccctaggggcaaatagagaaggcctttaccacattgctgctggctataggaagtcccaggtactagcctgaaacagctgatatttggggctgtcacagacaatatggccaccccttggtctttatgcatgaagattatgtaaaggtttttattaaaaaatatatatatatatataaatgatctagattattttcctctttctgaagtactttcttaaaaaaataaaattaaatgtttatagtattcctggtggtattgactttctctttgtgtttttggagactctgagaagaaaccgatcctaagttaaagagcgagcgaggggctgaggagtgagttcagagggt

SEQ ID NO: 32823 - DNA, 1186 bp, Mus musculus
aaactagtcattcgtcacctagcttctggtgagtgcaaaccaccaggtaatgctgctatgcggccgagttacacctgtgaacctgtgaaccttcgtggtagttcaagcagagatagcattcagttcaggacacagcaggcttagtctgattttctatgaagagatgaagactgcgaagagacttgttctaagcaagggtctgtgaggtggggaaagatagcactgttgtagttaacacaaatgttcttattgttcactaagctctgctcacttgtagaaatgttaaccaagaacaccagaaatagttgctcagcagccagaagccaggagttcctcacctgtgccttttcgactttgacaacatctgccttgaaattttgagaaacaacattctttgtccttcctgcccgccttagatttttgtctgttcttctacactgttgtgaatcacacctttgtacactgaagtcaatgttttatttcttcagatgccattattaatgagaactatgactacctgaaaggattcttagaagatctggcacctccagagcgcagcagcctcatccaggactgggaaacatctgggctcgtttacctggattatattcgagtgattgaaatgctccaccgtattcagcaggtacctacaactccctaagccactgtctagcttttcttttcattggcacttagagcagcgacttcaaaggaccatactttaaccgcagtgcttgagaggcagaggcaagcatatatatctgtgagttccaggacagcctgactatgttcaaaactaaagaaagaaatcatggtggcacacatataatcctagcactggggaaacgaggcagaaggatcaggaatttgaggccagcttgagctgtgttaaatgcattgagcatggaactttggagttttttatttgtgccttaccctataacctaagccagccagaactcactgtatatagcccaggttggccctttttagtatgcttattgggagtggcggggttatacatacacaacacagatgtgcaggttcctagacaagttgtggaagtgggttttcttctggagtcagactggagtcatcaggcagcaagcaccattacctgctgctgaaccatctcaatggctggctctgctgctttgtccccttgaaagtgtgagttacacgctca

SEQ ID NO: 32824 - DNA, 1183 bp, Mus musculus
tcctcttcagaatttggtatatgtagaggtactctctgtatgttgtatatattatatatttttctttactttggtggtttgagattttgtgtctaaatagaccggcctagaattcactctcccatgagttaggattataatattgtccatgaaataagctcttactaagaaagagaatgggctgcttagtagctctttttatttttttgttttttcgagacagggtttctctgtgtagccctggctgtcctggaactcactttgtagaccaggctggcctcgaactcagaaatttgcctgtctctgcctcccaagtgctgggattaaaggcgtgcgcctccaccgcccgtcttgtagctcatatttttaatcccagccttcaggaggcaggtggaagtggatctgtgagtttacggccactctcgtctatagatcaaattccaggatagccagggctttgttattacagagaaaccctgtctcaaataacctgttcagtacaggtgacctgcctgccgagtatcctgactgagtactttgttctcctcagacattatgagctcaatcagctattagaacctcgaagcataactgcagatcctttggactaccgcctgagctggcacctttgggaagtgctacgtgctcttaactatacccatctctcagaacagtgtgaaggtgtgctacaggccagttatgctggccaactggaaagtgaaggactctgggagtgggccatctttgtcttcctacacattgacaactcggggtgagtgaaagtcattgaacccgctgggaatatccagcacctcagggcagtacctaaggattgctgttcaggtccagttcagtaagtgattgcttacagtgcttctcaatttgtggatcttaatccctttgggagtcaaaggaccctttcacagggtcacctaagactatctgaaaacacagagacttacattatggttcataacagtagaaaaattatgaagcagcaacaaaaataattttatgcttagggggtcataacaacatgtgttgcagcgttaggagggttgagaaccactggcttagaacatctgttagatacagccatgtgataaatctcaaagggcctggagagatggctcatcagttaagagcacttggcttcttttccatgggatctgagttcagttct

SEQ ID NO: 32825 - DNA, 1072 bp, Mus musculus
tccagcacctacatggagagtcatggccatctttaactccaactagtgccctcttcaggcctcagtggacatattgcacatacatgctgtatagacagacagacagacagactatttatacacataaaataacttttaaatgcattttgtagcaaagtttggtcaaattagaagatctcctcttgatcatcacacttaatagccataattaggctaaggaaatttgtttaaaggaacgtcaggttgttacctaagtatcacaggtgtcacaggcacgtggagtgagcagatataccttatagttgtgcagcttatacattgagatgaacaaattgggagaaatgagctggcaaacttaaatgaatggtttttgtgctgatatattttgcaccaccgttaatgatggcctctcaagaggtactgccaaaccttaaatcattggtttttgtactttcttagttgtgaagcactggagcctgacatggacattatgtgaagccctatggggccacctgaaggagcttgacggccagctggatgagcccagcgaatacattcagactctggagcgtagaagagctttttcccgctggctgtcacataccgctgcacctcagattgaagaggaagtctccttaacccgcagagacagtcccgtagaggctgtcttcagctacctcacgggcagtaggattagtgaggcctgttgtctggcacagcagtcaggtaggaatgagattctctctaccactacctacttctccacactacccctgcctctcaattgtaatttgccttctaaatatatctaagtaagattattggttcctctagagaccatgtcttgttttcctaaacaattctctggaaccttaaatattatttatttaattaaaattttgttgatcttcttatgtgcatttgtaataaaaatcaaaaaatgcagataagtagaaagcaataggacaaaaatcacccaaattctaagacttagtcactataaacatttaaatgtgtgatctgtacttaggtggttatccttataataatgcatagagtatgcacagatata

SEQ ID NO: 32826 - DNA, 1178 bp, Mus musculus
ttgaaggagatgtgaatttgacaaatctaaatttggatgatattgtgcatatccgaaggaaagaagttattgtctatgtagatgataaccaaaagccacctgtgggtgaagggctaaataggtatgaatttatttatatacagaaattggagttttttcctgaaaacacagtctttctataaacttttattgtttgtctactcttatttgaaagtataaatggtaatgatgctctgtgactttaggactcatacctttccctaatggtaatgtgttcacatgctattttcaggaactttcaacaatggaagtttgcctttgcttaattttgcttttcagaggtagagattaaactagggcctcatacatgttgaaaatcactctgccagtgagcaccaactccagaaagttttcttgttttgttgtatttcttcttgttctgccactggtacactcaactatttaaatgtgagactaacgtttattttgttttgtaggcattctgttgccatatattgcttggatatggtgggaggttagatagctcgcactgtaaccggtgtggtgttgaaccctaacttagctttgattcacggcattcctgcttcacctcccctgtgctgtagtaacactcctgtactgctacatccatcttcctctggataagatgtgtgattggtaaaagtcacatttgcagaactccagtaaacagcttgtttgagggctgggaataggggtgaaggctggagagctggctcagaacacttgctgctcttggcagaggcctgtgtttgggttcccagcaactcacaactgtttgtagcgctggttctagggaattctattctgtcttgtggctttcataaacatgagcacacacatagagtacatacatatatgcatatatgcaaaatacccgacactaaaacaatctctaaaaatgacatttttacatctttggtcatggttgcatttaattctttttttttctttttttttttttcttttttttttttttatgtataagtacactgttttcagacacatcagaagaggacaattggatcctggtacagatggttgtgagccaccatgtggttgctgggaattgaactcaggacctctagaagatcagacagtgctcgtaatcattgaactatctctccagacctacattt

SEQ ID NO: 32827 - DNA, 1212 bp, Mus musculus
tgcatgtatatttgtatacacttgtgtgcctggtgtcttaggggaccgggagatggtatcagaccctctagaactaggttgcaaattgttgggagccaccatgtctgtgctgggaattgatccaggattctctatacaaagcagcacatcctcttaaccactgagccatctttctagccctagatttttctattttaaaacttcaattctagatagtactcacaactttgtgatattacacaaaatttttttttttgatctggttttcctgttacaggttaagaggtagtaattacatcctatctcacacagctgctataaggatttattaaatcatctggtgtaatgtcagatccttaataaaaattaactgctgtcatcaccttttctattgccaaagactaaggtatttttttctccgttatcagatttagcttcctgagcaaacctgttgatgagaacaatcagcaggatggagaagatgactctcttgtatcacgattttacactaatcctattgccaaacccattccacaaactccagagagtgttggaaacaaaaataacagtagcagcaatgtggaagataccattgttgccttgaacatgcgtgctgctttgcgcaatggattggaaggaagcagtgaagagacgtcattccatgatgagtcattgcaagatgaccgagaagagatagaaaataatgcttaccacatacacccagcaggtcagattcacatacttttttatatctttgaaacagtttttaattacagcaatgtggtcaaaagagtccacttcttatagcctaagagactgtcctatcttcctaactttgtaaattcaagtggattgtttattagtaagaccttaccatagtgtattctatggagacttaccatgttatgggtattccttttaagaagaggactctatggtaaataaaatctacaaatcttaggttaagcaaagtttagtagactatattacatttaaaatgtttttgtttttctgtttgtgggaatagagtctgggtcttgctcatgctttcttcaaacttgcagtgacccttctgcctctgcaccccaagttctgcgttgagtatgtggaggcaagttgctcagaagctcagggtcttggctttgttttaactacaacgccatactgacacataagaccctgtctcatattgttatatgaaaataaaattaa

SEQ ID NO: 32828 - DNA, 1201 bp, Mus musculus
ctatgtagctcaagctggcctttgacttctagtccccctatcttagtttctctagtgctggaattacaggcatgagtcactgccatggttaattttaactgttaacttgacataattgagaattggatctaagaatatctgtgaatgatcattgtgactatcctgattgatggggcaggatctacccactgtggacagcaccattccctgggcttgggttccttctactctcctttttctggacctagagataaacccagggtctgtgctaagtaatactcttaccactgggctgcaccctctggtagtgcaaagtcacaccttttgattaaaagtttacattcctgagggtgagtaaaatgccttggcttgatttctattccgtaagaatttccatggaaattggagaaaggtttcaaattgcattagtggttctgcttattgcaggatgttatggaaaacaaaacaaaaaaacaaaacaaaaaaaaaaacattgcagttattattgaccctgaattttgctatttcagatactggctttggtacgactagtggaggagcatttggaacatctgcatttggttctagcaacaatactggaggcttatttggaaattcacagaccaaaccaggtaagggattttgtttggaatatatctggtttatatgtagctagcatagaactttactgagtgactacagtttatctacataacttgttttcttcccctccatctcttcaggaggattatttggtaccagttcatttagccagccagcaacctccacaagcactgggtttgggtttggcacatcaacaggaacatcaaatagcttatttggaactgcaagtaccgggaccagtcttttctcatcccagaacaatgcatttgcacaaaataaaccaactggctttgggagtaagtaggacactattctttgggcttgtacttctactagtttaatatttgatttgtttgctgaatgtgttctctttgctctatgtttacttatctcctttcccaccaagtggtcaaaaccaagaaatagaagaacctgaaagtgtattgagtttagtagactagaaaagagggcagtaaatatagcagttcctagacatctagggctaaacagagaaacactgtttaaaaaaaatacacacacacaataaaacagacagagagatgtgtctgacctagaa

SEQ ID NO: 32829 - DNA, 1197 bp, Mus musculus
tggtcccgagcagtttcagtccgaccggagccctcagtcccatcccaggatcctgcagcacccagtgtaagtgtttcttgaccaccctcccatcccaccccgttcctgacgagaagctagtctggtggctgggttctgcttcctccttcacgggaggaagtatggagtccaagagaagatttggtcctagaccttttactccaaagccagatctctgcctctgcttgccccaaagggagccctggagtagccatggtgatcagggccatagggactgtggggggtgagggtggggttgcttttctgccaggagggaaggagtgggaaagaccaacttcctggggtgttgaacctggatggaggcttcctgggctggactcagtatactgagctgaagctgaagctgaagggagaaggttctcaagaccctcatattcttccaagttttgaactggatcagatagttctctcagaggggacaggaatggccatttaggctccacagaatcacagtgcttgctgacctgtggcttggctcacttagagcctgggggtggaatggctggtagcttgtagttcttctgaaatgggtcttaggaccttctcattgttcccagttgaacatgggtgagaaggaggaatgtgatcagacagggtcagtgggaggtctgagctagtctgagctagaggtccttaatttagagccttaagctgctggataacaagagactttagtccaggcatttggttctggtgtagttctgagcctttgtctcttcttgtgaatgatgggacgaataacttttccactcctgaaccttctcttcagtttccatgaggatggtgattgtgaagtaaagtcctcacagttccagtgttcaggcccctggggccctctattgtctaggttctttaaaatgtggaactagagtgtcagtgtgccatggttcctgagagctgcccctgcctgtctctgccacttctgtcccatctctcttcatcttcttcctttctgaccttctttccatttatgttctggcttttccttgtgccagctctggaaaaggctctacttccccaggctcaggtatcctaccaggcctcaagttgtgccctttgccttgcttggaccactccttacaggatgttctctgcggccttggaccctgatgggaccgtgttccggctccgcttcac

SEQ ID NO: 32830 - DNA, 1222 bp, Mus musculus
acttcgggaacaaagagctgctaataacctctcagcctgaggaaaagagattctaaccccgtctgtgatgctggaaaacaagaaaccactctggccttccctatctccacgttctctctgggccctgggagagaagagcgggaagggtatgacagggctgaccccagcactgctgacctctccccaccactcatggggatcttcaagaagcatcaccattcactgaaaggtcctaaaaaactgagctggcaggaaagctccaccacttggtgctaaaaaaaaaaaaaaggtcctgaggttcactaaggttagggttcagagcagtggctgctacctgaagaccgcagccatttctctctggtcattcatctgagtgatgtgtctagtgatctaccgtgcacacccagagtgtgtgcacccaggtggtaggtccataaatttgcccaggtgttcaagatgtaccctcttccccatcagtttcattgtgttcctgtgtgtgtgactggggaaagtacgctctatgatttctaagggctttgtttcttgaggttatccagtggaagtagtattgtgctttgtcttgacagaaaatttgtcccagaagaagcatcaagtataggatatatttttcttccccatctaaaacttctagctttttggaattatgtctgtaatcccagcatgttggagggtccatgccaacctgggcttcataatgagaccttgtctcaaaaatgaagtaagatgccaggtatggtggcacatgcctttaatcccaacacagcagagacagtcaaatatctgttgagttcaagccagcctggtctacagttagtttcaggtgagccagggctatatagtaagacactgttttagaaaaaaaaataataataataattaaaggaccctaaaatcacaggcttataagacctttccctcctttgatcagggggaaggggtcagaggtagatttccctactccagaatgggttacttggttttcctttatcttctctactgtcccaggtccccagcttttatttgtatattttatttcaaaggacaataaatgtttttcttttgccaacagtctgaggtaggtatgttgctcctggggctcagctctgcgtgggacctgaggtgaagaatgggctccagaacggaggggttaagtctccagcagctctgctatctcccttacccttgctgcctagggtttcct

SEQ ID NO: 32831 - DNA, 1157 bp, Mus musculus
tgccctcctttggaaattaatactgccatagggaagatctcaatgggagaaactgaggagaaggggaaggagagttaaagaaataagagataatgggaagaaaagagaacctccatgagctgttactctgctgagtgtttttttttttttttttttttaaagatttatttatttattatatgtaagtacattgtagctgtcttcagacactcagaagagggggtcagatcttgttacggatggttgtgagccaccatgtggttgctgggatttgaactctggaccttcggaagagcagtcgggtgctctaacccactgagccatctcaccagccctgctgagtgttttattacaccatttttcctttaattttaatgacagcctagatgaggtagctatcagcaatcttgttttaaaggtgttgaacagagagctgaacaactttcccgaggtcacaaaggtagtaaatgataacagtgataacagaggtgcttggaaggcacacattactctgtgggtgatgagaactgaacctaggtcctctgcaagagccgtaagtgctctgaaccacggggctattgccatcatgcccacatttctgttttaatcatagtaaggattaatattaatttagcactagagtaagagctttggcttcttgtggaaggtcactcgtcatatagtggtggttagggatttaaaatcccatctgtctgttacagagcttgttctcttaaagtctgtattagttactcttctcattgctgtgaccgagaaacagtttaaaggagggaagatttattttggttcatagtttgaggagataaatagtccattatgtcatggaagacatggtagtgggaagctgtaatggctggcacccaacttgatggacgaggaggcagagagattggtacagagtggaattgtgccatatgaggcctgccctttgattatgtacttcctttagctaagctttcctctagcttctgaaggttccagggtctcctgaaacagtaccatcagccagctgaggaccaagtcttcaaacctctgagcttatgctgccattttatggtcagtgtccatgttcaagaagaagagccaagccaggtgcagtggcacatgcctttaaccccagcacttgggaggcagag

SEQ ID NO: 32832 - DNA, 1198 bp, Mus musculus
aaagccaggctaaccttgaacttgtgacaattctcctacttcccaccctaccaagtagtagaattatagacatgcaggacaacgtacattttttcagtagtactttgcccctggctgagcctctttgtcttgatctgatatcttttttgttttgtttttgtttttttgagacaggatttcactgttactggctggcctaactctctctttagccctggctggccagaactctatgtaaaccatgctggcctcaaactcatagagatctacctgcccctgcctcccaaatgctgaaattaaaggtgtgtgccaccatgccttgcttgatctgatagcttgctaggtctttagtcaaaggcctaccaaggtttggatcactagtaggcaaatccgggccctaacttcttgatccaatgctcccatgctctccgggttagggaaaagcttctttagccccgagctactcatcccctgaccctcaaccttgctgtagcccattgaggacaggccaaaacccttcataaatcagattctcttctccttttggcctggctggtgaccctagatgctgcctggctgatggggcgtaggttcagtgaccgctctctctgctctgcatccgccggctcggatgatcagtccctctggaaatacccgggtttgaggaccccctttggggcttttgtttttccgacttttggaactaaaccaacactcctatccaatgggccccttctgttgcctgcctcacaccccctcctgctccctttgtcccctcagcactgtccttactaactgaagggaggggttcgggggtgagaagaatcagcctgttcactgagagctggagagaagacatccgtggtgatgggtggcttaggcccgtcccttcagccgagccacatgagtgtcctggtggtagcggaccttcttccttcttccttctgggctgggagggaaagcaaggaaaagagcattcctctttttttctttttcatgtttcttcccttttctccccatttcttctttcttgttctccccttcccttcccattatgggcttctttgtcttcaagcatttcatgctttgaaagctaccagctgtataagccctgctgcctaactccatcactatgggattgtgttctctccatggcttggccttataaagctctgccaccctagtaacctctgacttt

SEQ ID NO: 32833 - DNA, 1851 bp, Mus musculus
tcttctgccttcacctcccttcctttctttgcaatatctggctcctagagtggggcacagaggggctggcccaagggcctgggcactgtacatatctgccctgctcatccttggtccttcatcattatttattaactgaccaccatggcctgcctgtcgggaaacccttccacccatgggctgctgctgtcacatcttctccacttcagtgcatgtcttagttgctcttccctcagttcccactccacttttggggtccagcttctgtctctgctgtcccagttttgaggtttggtttttgtttctgtctcctgctttcaggctcctctctcccattactccccaacgatcctagcagttgtggggaagataggaggagtaacttctgacacctgtacctcagatctgttcatcctactcacagccattctgcctaccccagactgggccacggtcctgatctctggggtttgttctatggaagtgtggtagactggagggaacctcatcctggagctcctttggatctccagggctccattcagggagtggaaccaactcccagggaacaagtcaccagagttttaaagagagaccaggcttgtgattgatgggagagacttctcccagttggaggatgagtagatgccaaagctgtgggctgtaaggcagttgccatttctctcttgccctgcccacacctgccttcctcttacctctgctcccctatattgcaggagtgtatctcttaagaggtgctgccctgaagctccccatcagcatcagcactactggggctcagggcaactggctcccctggctatgggagccacagtcatgacacagggctcttgtggagccctgggcaaggatgttatatttgaaccaaaagacaaacagttttaaaataaaaaaataaaaaataaaataaataaatctcctgaatttcccaagtgcctgcacagcatcctccctttgtcagattccatttttgtgttactgcatagcctgggccacaggcttaaaacagacacaattggtttggggcaggggtggagaaggaagatggtatatgtatgtgaaggctgctgtgtgaccacttctccccccacacctcccatcttccagacaactctctcctttacctgtttttgctatggctgtaaaggtatttttccctctgccccattctgtcatgcctgtaccctgagttcctaatttgggcctgggttgggtgcagctggggctggtcttaggcgggtgctaggctgtagactgccttgatgccccctggacaccctcacatgggtttttctgtgttattttcataagattctttgaagtccaataaagcatgtaggagattttaacctctgctggctgtgactcttattgtgtccctgtggcttaacaaatggaattaagaggttggtgaaccagtgggttagggcacttgacttcaaaccttacagacttgagtttcattcctgagacccacatggtagaaggagagaaccaactctgaaagttgtcctctaatttaatttctatacatgtgctgtgctgcgcatgcataaggaggggtacagaaaatacattttctccccctgcctccccccagacaagttttttctgtgtagtcttgcctgtcctagaacttgctctgtacactgggctgttgtggtaaatagaattgggggtttctaccccgcctgagatcatttagttcccagataaaagacacaaaacctatagatttataatagccttaaaagcactggagctgggcagatatcaagcctctaagctattttgtctacttccctatcgataacccctagttataacttg

SEQ ID NO: 32834 - DNA, 1473 bp, Mus musculus
tctgtgtagctctggctgtcctggaactcactctgtagaccaggctggcctcaaactcggaaattcacctgcctctgcctcccaagtgctgggattaaaggcgtgcaccaccacacctggcccaatgccctcttcttgtgtctgtgggcatcagacatgcatatctaagcaaaacaccatacacattatagaacgttattacatttatttatttgtgtgcatgggtatgaggagggagggagggagggagggagtgtgccataatgtacatgtggaagttggaaaccagggattgagctcaggttgctagccttagcaacaagtgcttgtgcccactgagccattttgcaatcatccaaataaccttttgttatttggttataaacaaacatggtaagaagagtgcaaatatctctaaattacaattgaaataactgttatgcttgtttgtaaagtttttacaagtttctcttgctgttaattctttggttcagatgtgtttcagactaattattctgatgtgtcctattatctggaaattccttctttgttttcagtggctgaaagaccacagcatatgttgatgagggtttctgtggggattcacaaagaagatattgatgctgcaattgaaacctacaacctactttctgagaagtggttcactcatgcctctcctactctcttcaatgctgggaccaaccgcccacagctgtctaggcacgtatcagttatagctgctttttgttgctgttgctttcttttttattatttatttgtttgtttgtttgtttatttatttatttttggtttttcaagacagggtttctctgtgtagccctggctgtcctggaactcactttgtagaccaggctggccttgaactcagaaatccgcctgcctctgcctgcctcctgagtgctgggatcaaaggcgtgcgtcaccatgcccggctgctttcttttttaaaaaattatttatgtatattagtgttttgtctgcatgtatatatgtgcatgcctattgcccatggtcagaaaagggcattggatccctggaactggagttagatagttctgacctaactatgtgggtgctaggaattgaacccatgtcttctgaaagactagctagtgcttttaaccaccgagtcaactctacagcccctaaagctgcttttataaaaggtttgactagggaaataagaaaaagccaggtggttcatcacattaaaaacaaacaaaaacttcaattattgcctgctctgattaaataatttgtattttgggacaatctctgacttatgggaaataagttggaagtaaatgcagttaaatgagaacgttatacagttggtcgtggtatttgtacagctgactgctttagatgctgctgaacagaatgtttttgatagggaattgcatattggttatattccaagaagattgtttaaaaaaaaaaagaaggctatag

SEQ ID NO: 32835 - DNA, 1303 bp, Mus musculus
tacattcttatgtcctgacgagtgtgaggccttctgtggaattacagagtgactttcttacttgcatgcttttgtctgtctgtcctgggaatcgtggccaagaagattaccctcgtgaaggatttagtgcgctgcagaagcagcctcatcccctaaatggttacaggctaaggcaggcgtgtgctctgtacagacctgcaagcagtacacgtaaaagtaaatacaaagaaacaaaaagatttgctattccaaagaggcaacattcctatttcagggatgaaaaactcaagcatttttcagggtgctttgtagaggagataaaattacaagtttttttaaaaagattggttcataggaatacatttaaagattttaataactagttttgtaactgatcacttgggaattttaaacaaagactgtctagtgttctggagttcttcctaatagctacgttttcttcccttgcagggtttaaagactggaatgtattacttaaggacgaggcctgccgctaatccaatccagttcactctgaacaaggaaaaactgaaagataaggaaaaggcactgaaggaggaggaggagaaggagaggaacacagcagccatggtgtgctctttggagaacagagaggagtgcctgatgtgtggatcctgagaaaatcagggcctgggagacgcagcgggctctcctgcccgccgaggcagacgatttgagcatagataggatagtgggtttgcttggttatcagcagctctgcttggacgtgcctgccaggacagggagccacgacttacagtactgtttctacacagtgtaaatatcatttttaacaaacagaaaaccaaagccagctttgatattaggaatcaaagtagaggctttgggaatactaaagagccttcctgcaaattagtgaggagacttaggaagtctcgtctctccagctttccctgcctggccattctcagtttgggcaaagagatttagtttgatttgactgattgcctagaagtaaaatcaagcaattactcatcagctaaagacctttgtctagacaaacttctataggtcattttgaaataaacatttctaagtgattgtgtggtactaaacttgtcatctattatcatacaagacagtttaggggaaaaaacccaaaaacccaacattttctgttgagttcagagagacaaactttaaagacatttagattgtatagatatctagtgttaacatatgccctttcctgccccaggatgaaatcttgttaacataaaattgacagtttctttcattt

SEQ ID NO: 32836 - DNA, 1157 bp, Mus musculus
atacatcacagtgtgatacgctgtccctccatatgtgcacaccatcttgtatccatcctgtcatctgttcatgaaacttggttgtttcctccctttagatagggagaataatggctgccatgaacattggtctacaaatatctattggattcctgcttttaggtttggtggttctatacagcaaagaattgctggactatataattctgtttgactttgaggagctatatttgcagcaccattatatttctataaaagtactaaaaggccttattctgtcttcataccttataacactcgattttcatatttttgataaagcccttctatgagtggggaatttcctggtcttgtagattgacttgtttcgttaaacccgagttttggggcattttctccctttagtcatcacatcctttttttcccttatgaaactcataataaatctgctttacgtaatggtggctatgaacggccttttggcttgtccccttccatcttctgctccctagactcggtaattgatttttcaacccttgagtttgttgattcttgcacaggcctgctgtttagtacctctagtgaatatttcagttcagtttttagctcctaaatttgatgttttaaaaaatcatttttatctatgttggtagtatgatgtttgtaattgatttcatttacttaattcgcccatattttgtattagcttttagtttaagacagctggcttgttttgctctgtgactgtagtctcatgaaactttgctggcctcaaacttcctaagtagctgagggtaaccttgagcctctgaccttcctgccaatggctcctgaggattcctgcactctacctactgagctatttctctagcctgaggcagtgttaatgtgttgggccagtagggctgagacttggttgtttgaggaagtttctgcttgttttctgtcactggcatgccctgtgggtttggtactgagaattgagactgatttgtaaagagtccgttctgcagatgagattctcaggccttaactgtgtggtcctgaagcctcagtttcctcagcacatatttggattatgcatgggtaaatgtttccttgaagttctagagctgtcccagtcaccccccccccaccccacccccacccccaccccc

SEQ ID NO: 32837 - DNA, 1099 bp, Mus musculus
cctggtaaacggttactggtgtgaagacaaaagtctctcctccttagtcttagtaaaggccaccagaagcatgtttgcttacagtgacaagagcagcaacacattctcactcttttagaatattttactggttattatatattattttagccagggtctctatgttgtcctggctgtcccagaacttgctatgatcaggctggcttaaacttcagagaacctcctgcttttgcctctcaccatgcccagccttaagatttaagaaaaatgatgtgtaggcatgtgtgttggtgtcagagtgtgtgcgcattgttcggcttcccacagaggccagatgaagccatcaggtctcaagctgatctcgagctgggataatggttgttagccacctgatgagtgctgagaagtaaacttgggtcttctacaagggttcttaaccactgagccatctctccagcctgtagtaataaatattttaaaaattcccacacagggtttcttcccgccttttaccatttatgttcccggatgaaagacacacacacacacacacacacacacacacacagccttataattttaatatgccttaagcagtataatacctgggcagatgcctaccctccatgttgttagaatctacctcctttcaagttattactatgtttcatctgggctgctcttagctccaattaggcaaccctctgggccacgttctctgagcccctagcccatggtggctctcctccctcctgcatgttcttactctcccatggcagcttcttctctctcctgccttgtggtctcttcccttaggtcagggaaacctaaaccgcacctatgtttgtgcttcgcagctattgactcctggcatctttacttgccaaccagaattaactaggggcagggttcctcaggctatgtgcagattccaaatcttggaggccagcacttagcgttacaataaacagtaaaagaaaacctcaacactagcccttcatcttattcatcagctctgtgtcataatttagttcccacaagacttcagtcagcttttccttctatagacagagctgatacattgatgatattgcagatc

SEQ ID NO: 32838 - DNA, 1231 bp, Mus musculus
aaagataaaaatggccaggcagggtagccatggtagtccaggatgactggtgactagagaccctcttgcttcagcctcctgtgtgtaagggcacaggtatgtgttgccatgcctgcaattccctattttcaaaaacagttggatggtgccaacgtttttatgctctaccctctcccttttatcctccagttcttcaagtaatgtgcatttattattgctgtcacttttcacatgtgattctttaatgttacattcaggtcacttactaggatttccatcttggaattaagaaaaagtaacaaagactagagacatcaactcctgagggtgaagtgttatttgacttaaagataccttttggaaagggctggcaaaatggctcagtaggtaaaggcacttcctgccaaacctgagagtcagagtttgatccctgtgaccacattcgtgaaggagaactaactcccacaagtgcaagcataatgtgtactccctcctcacacacacacataagcacaatacagcttatattgtaattgtttataagcatcatctgttgcacatcaacattgtcataatcatggtgccatgatttcttccctctttttgagacaggttctcatatgtatgcctggctggtctggaactcagtgtgtaaagcagactggcctggaacttcaagtgatctccctgcttctacctcctcgccctgggacttagatgtgggcactggcttctaaagttttcctagtgaattatccgtaactgctttgatattgctactgttttctcctcaggacaaggttactatatataacactggggagggacagggcttccgggcagcccttgcattccctggattaacttaggtgttgtgtcagacccaggaactgtggttgataaggccagtgctggaccacatccttgctttccctactgacttcaaagtcgctcttcatggctgctaacaagtgacagacttttgcaacctctctgcctccagtctgggtgaatgatacaatatatgaaataagttgtattaagaagtgatcatcagcccataaaatacagtacagttctgattattggtaactactgccctgtcagtcaatctaggttaacttagggcaatatgaaagtcatgagtaagtttagaaacctactgggggctgaagcaatggctcaacacctaagagtactggctgctcttccagagaacccgggttcaatt

SEQ ID NO: 32839 - DNA, 1110 bp, Mus musculus
ggtttctggtggtgaaacttaagcccacacccttgaagcaagcccttctataggtattttagtgtgacagcagggttcctgatcagtgtgggcatctccagcgcctcctggtggacattttgatgcagcactgacatttttaaacatttttgtttcttttccacactgcagcaaagcaatctacagccacctgttcttagaacacagatagaaaaggaaaagccactatatattgtaaaagttacaatagaaaagaaactaaacaaagctgtaaaaagttagcatttactgaaatgtatggagatagtgagcagctagtttctaatccaggtcttctggtccaaggcagggctctttgcagatgctgcctttcctcaagaaagaatgttaaagttcatccatgggtctgagtttgggggagacagagtagttagtcagcaccctgagttctcataaggtctgtcctcactaggagtgagttctggaccctgaggaagccccaagctctccccaccaagctgaaaagtttgtttcgagcaccggatctgaggaagatgctaaaagtctttagaggtaagtttggggtgaagtggatgtgggatcgctataagggtgtagtaatgtagagaacagtgctgatgaggtgaagtggatgtgggatcgctgtaaaggatgtagtaatgtagagaacagtgctgatgaacgaacacagagggaccagtgcgctgcgctgagaatgatatgtagtccctgtatcagggatggtgttcttctacatgttttccttttcttacagagctgacagatgtccaaagctattggggtgagtagaatctatgccctctgtgaagtgataaccgtgagcccctttcacatgcttctgctcagcagtcatgcatgttcgctcaggtcttaggtgtccacatctctcctttccttgctacctaatgcttttggtccccctacagccatttcctttgtgccctcctcgcagaatcatgggacccacgtgcccattcttatcggttactgttgtaccttctcctacagtggacgtgacactgaatccacagacggctaatttaaatcttgtcctgtcgaaaaatcgga

SEQ ID NO: 32840 - DNA, 2369 bp, Mus musculus
ggaaaagcatttagtgttttggggtttttgtatttttgcttttgggttgtttatttttgttttttgttttttatttttagagatagggtttctggaactctgtaggtcaaactggccttaaacttggagagatccgcttgcctctcctgagtgctgggacaccagtctagttgtgttttggttttgggttttttgtttgtttgtttgttttttgtttgtttgtatttttgaaacaggctggccttgaactctgtgattgagaaactaactgagaactgatccagagtcccgattacaagtggacatcaccatacctggctgtgaatttgttttagtgttgtttgagatagggtctccataaatagcccaaactggccacagactcagtccatttgcctcactcccaaatactgattatagatctacctcacagtgcctgactgagctcccaaatactgattatagctctacctcacagcacctgactgagctcccaaatactgattatagatctacctcacagtgcctgactgagctcccaaatactgattatagatctacctcacagcgcctgactgagctctcaaatactgattatagctctacctcacagcgcctgactgagcacatttgacgacttttttctttactaatgtctgtggtcaaatgtaaagaacctctgaattagataggaattttttaataaatattgaattcagtaattttttttctctagttactgagatacttgtgtatcctttctattctgctcctgggtcagcctcactgagttgtctcagttgttacgtttaccactgattcctgaagcaaaactgtcatgtgttacattcagcactttatgtttgctgactctaggtttggtttttgtctctttataaacaaactacctctaagtttgcattctttgttatctgtcaaggcatatcagaaagaaattatggggaagggcttatgtatgtgtatttaggatcacaataaatcctaagtatgtatatttaggattacagtaaaaataataaaatctttggatggtttcaagaagagattgtagctttggttttaacaataaatgctaccacaaccttcagccttcagcataaaattttaagagtggtaataaaaactagaaaatgctcttgaaagggagataaagtaagataaggagaagacttcaatcaaccagtatcagttattatttaggaggaggaagaaattcagttacccattctcacagtgagttattctggtccccccagcccctcttatttcttctgtagagctaggtactgaactcggctttttacttcaagcagagacattttagcaccaagcttaaccccatttttgtgttttgtattgttattattggggtttgtttgtttgtttgttttgttttgctgacacagggttttaacacatttcccaggctggccttgagcttgctatcaagtgcaggctgactttaagctttgcctcagcatcctgagtaactaggtgtttagggtaatactgacttttcatcttagcctggaccttctctttgtgctcatattcaaattgcaaatgagtgaaccgctttggctttgctggaaaggtgcaacaaactttcatattcaactgtgaaaaaagttatagctgtgaagatggaaatgagtgtcgggggaggtgcagctggacttctgacactgcagacaagggctactcgtggcttttggtactctccaatgtactgtaacagtgaaatactgaatttccataaaagcaatgtaaaataatctattatcttacaatgatggtattttggatatattttaaataaaatgttttatttcaggatggagtcttcttactctgtagcccaggctcgccatcaaattgtagtggtagcttcctgccttagcctttcaactgctggggttaaggcataagccaccacaggcagttttccctgtatgttttaaatgtgggtactaggaaattttcagttatacattaactggcttctgttacacttctactgtcaagatgaactttctattcttgggggaaccctagaataataaagacttggccagagaaccaagggagacttgaaggtgcatctgtttataaaaggacctatctgcacactcacccccaagccctgaggttttttgttgttgttgttgttgggggagggggcgcagattgctttaaacttttattttcaatcgagtacatatgtgtttgtataagtgaggaggccagaggcctcaggtcctctgaaactggacatgggttctgggaatgaaactcgggtcctctggaaaataaagcatacccataactcctgagccatctctccagac

SEQ ID NO: 32841 - DNA, 1186 bp, Mus musculus
acctaggagcagattgtagcctcattaggtattaaaggttctctcactgtatcatcagagctgctagtcattactggcaatcagtttaaattaccagaaagctgctggaaacactcgctattcacgttgttcgtaagtgctgcttgctggcattttggtgtgtttggagccatagagagagagtgtcctgtgctgaccacttctgttgcgtccacactgcgttcatttcctgttcactactaatggtgcttctcatcctctgatcacttctctctcatgtgttaaacaagtgtattaaagatgcttcataatgccaacaacatagcaggtcagtaaacatgatcccatagtaaaatacaaggggtccccaaaattagtgattgcttcacacttactgtcctgtgggctctctggggacactgcaacagaagccacaaacttgcacaaaacatcatttgaaagttttaattttaccaatttgaagctaatttaattttattgtttctcagttataaccgtaaaccaaaaatattccaaatgtgggaaattaagttgaagggaaaggtgacttaaaactttcaaataatgtttcattagttttgtagcgtttgtgattgtaaggcatcagagctgacaactatgtggagctgtgggagctgcggtgcctttccatggaagcactctgttctcaagtgttctttgccaggctgggctctagccgctttgatcacctaagtgtctttacgctcagtcaagggaggctattaaagtggtggtaactcacatggaacaaatcaaaagaaatcagatcctcaaacagcaggtgaaatgagcaattaaaaccctgcgcgctctcctgggtgcaggtctctcttaagctgcatccttgcaggcctatgcacggctttcaacagcagggagcgaagactgggaaaggaatggcagtagcagctaaagctgaaataataaaagatttgcatcctacaactatgtgcattctatttataagactcccaaggttagatgtgagaagaaaaaagccttttgtgggccacgaatactttctcttgaggctgcaatgcttcccatgctcatcagtgctgccaggctcatcacttttaaaggacagacataagtgttacagaagaatgtatgaaatattacaatctaccacctcaaaaaacat

SEQ ID NO: 32842 - DNA, 1882 bp, Mus musculus
tagtcacaggctatacaactcatgtttttacgcatgaaactctgtttttctccacaggatggagctgtaacgtagataggatgggttgttagtagaagctctacactgagagcagtatttgatgtggcttaagaatttacatcacatggcaattataaatggcatatacctcaaaattatgcccccttgaggtcacatctaatgtcttgagcagttaggactggttgagatgtcacataagaaaaagcaggacttacgtatgtaatggctaggaatgtcactttacactgctgtgtattttctctgtccctaagacttggtctagtgccaggcatacagttggtgtctaatatttgttgatggaaagtatatgtatttagtatacgttaagtgatggtgatgtagcttgtttagtaatgtatcctatttccccctccctctcactttttcttttggatctcataataaaagacatcaacccactaattaggtcagttttcttggggacttaaaagaactaaatgatcaccacacacaagccagcccttttgaaaccctcactgctttcacgtgcttttcccacttgattggctatgtcctctgtccctccaagtgaagtctaatacctacttctaagtttatagttaacaagcagtttaatttttaagaaatcttaacttttcttgtacatgacacaattgacaatccctattcctttgtgtccttgtgtttggattactcctgggtatctttcttctggtctcttcatttaacctaagtatcattcctcagactttttgctcttaagtcactggaccgtacttttgagtaatttcaatgcagtaatctcattttagcttctcagtctgtctctctgctgtgctcacttggctgcctgttgtcgcttctgcatcttcaaggactcagtcaccacaaacctactctatgtttgtgttccttacttggttaatttcagagccgttgcaccgttcaaggctttacagttcattcctgtatcgtccacctgactattggtgtcttaagctctgccgattttctctcaacatttctatcagtgtttttcagtttttattacgatcaccaaaggattacctgtcttttcccatctctctgttggctcctatcaccagattgggctttctagaagccttcagcctaattcctgctggcaagtttcatgagctttttggtgagagtctctgcttgatatccaagaccctcctcttgtgtttgccactgttctgataagagtgttaaaacgttttccaaaagtccagagttgttggccttccaaacctttgcaaacacagtatttgcattgagagccctaggcttctttctcatctgggaaattccatgcatttttgaaatctgtgaaattacccctgtccccttcctatggtcaccactgtaactgcaacctacctctactgaatcacttattgtactgtatattttattttatgaagtgtcctttattagaatgtgagctccttaggggcaggaaaagaaactattcattttggcacctctatagcataatgtttggcacatgagcatttaataaatgtttgttgaataaaaaaaacaaaacaaaacaaaaaaaatgttctgtagatatctgttagatccatttgtttcataacttctgttagtttcactatttccctgtttagtttctttttccatgatctttgcattggtgaaaagggtgtgttgaagtctcccactattattgtgtgaggtgcaatgtgtgctttgagcttaactaaagtttctttgatgaatgttgctgccattttatttggagcatagatactcagaattgagagtttctcttggaagattttacctttgatga

SEQ ID NO: 32843 - DNA, 1213 bp, Mus musculus
actcttgatgctttagtttaaactttttgggataaatatgtaagaaagctgagaatttttaagtttacagaaagaaaggaaatgatacttcatatgtttaggaacatcaccattgaaattcagggcagtgccccctagtcaaacttgttaacgttcattttagttagatatgtgaacatttacactaagtgaattaaaggctataaataggatcatattggttggggccaaagttatggaaaagatgtttctacagagattatttattttgaaagtataggtgatgggcagtgggcatatagttaattctcaggttattatgaagaacgagaatgagagtgtgctggcaaagctttctgaacatatcacatggtaggtatgtatggaagatcatcaaaacacaaatgtgttagagttttggcttgaagaaaacattctcagcacatggctttggaacaagaaaactgggagaactgtgcacagctaagagttgaaggtgccttatcttcccgcggcggatggtaacagactcattgctcatgaacattgattgcacatgatttctctttccatgtatcagagaagaaaatggtgtgtgtgtatgtatgtgtgacatgggacgatcatacacgaattcctttatatttctttataataatgtaataaatatcctactgccatacatggttgttcacatctcagttattttctcaaactagatcaaagggaaatcttgtaagagaagtgtgtggatatcatagcttgtggtccatcaggttcagtatgtctgtgtgtgcacacacatgcacagaggagccagagctgaaggtgggtcttcctctgtcatcctactccttatgttttgaaacagtttctcactgaacccaagctcaatgattggctagggagctccaggggtctgtctcctcttggccctccccctcccctccccctccccagtactggacttatagattaacacctggcttttatgtgggtgctgggaatctgaatggaggtcactatgcttgcaggcaaggagtgtttcccagagccatctcttccagctccaggactagtattttgttagctttttacaaaatcattttgtggaggacttttaaacttacaactgcatgaaaaaggttagttttgagaatgactgaactcatacaccattgactagaccagtggttttcagcctgtgggtttc

SEQ ID NO: 32844 - DNA, 1120 bp, Mus musculus
ttgagtcagggcctgactgtgtaatccagaatggctttgaactcattatgtagctgcaagctgcccgaatttcacagcagtcctcctgcctcagccttctgaatgctgggattacagcagtcaccactgccagcttctttctggaatatgtattattgtttcattttataatgaagaaaaggttcagaaaaattaattagccaacaacacacagcatgtaattaacaacagatctatggatccagctcttaatattgatccttttggtggtgttgcactgttcacttcagtgtatgatgagagaaatacatgtggcatagtgagaaggaagtggacaggatgcaagagaagccacaacagtccaagtgagaaacctcaggtttcttaagacaactgaaaccaagttccttcttttttgtgcctatttggcaaggccctcacacaataccatcttttgtattagggctgtaatttttaatgtttatgggtgttttgccttcatgtctggctgtgcatcgtgtgtgtgcttggtggaagtggaggacagaagagaccattagattccttggactggaattagagacagttctgagccgccatgtgggtattgggaactgaaccctcatcctctggaagagctgtccatgcttttaatcgctgaagcattttctctattcctgatccagcatggcactgtgttactgaagctggtctcccacttgtttacttctgacttaattgctacattcgaatttatataccacccttacattttggttggcaaggaaaagaaatacagtgtagtgtatgtagttggcaactctgttccccccagaaagcaattttgatgaggaacactgatgtggaataagaggcagatagagacaagtagaaaggacagaatcatgtccctctgtacctctgcagtatagaagaagttctgactgagaagcaaatgcagatgacaaggggagtccagaatgagaagacatgtatgaggtcagtgcagtgatggcttattggttaaataggaagcagaagctcttagaatttttgctcatggacatggttcagaggttagatggggttctaataaactactgctggaaatcctcatctg

SEQ ID NO: 32845 - DNA, 1561 bp, Mus musculus
tggtcttttcatggatgtgaaaaaaaaaaaaaggaatcttcaaagatcatgcctaggtgatgggttatatgggtaatattagggaaaaatggatacacagatgcaggcttataatgtccattcttttttgcaggggcagttatctcttacgttctttctactgtagctacaagggataattctttctatgtgcgtgtgatgtctcttttttgtattgttccaatatctgtttagggtttccagttccttaggtttgccctttacttattattattttgtttgccgtatttgtgcttggtgacctgttcatgagagtacctgggaacctggtaagatcctttttagtagtcagtgacttagctgttatagttttgacccattatagatttcattggttgagccttctggctctcagttatgctagattgcaaagccatacagaagttccaagttatctaccttttatctcccagattccacatatctgtgttcttacactgaatttacccaatgacccctgaagctgctctgctcttattttgtaacctaaagcagtgttgaagtgccggcctgttgtattgaaagaaagaaatcagggcactcagaggtgccctgttctgcttgaagttggcacatttatcctgtgtatctttgccctgagttattcgctgagataatataaggagagttttcttttttcttttctgtagtgaaatacctcatttatgataatgtaattattagcaggtctagtctaggtacagacttcactgttgaaaccaactagtcttaatcttgggaggaccctttctttccttttctgcctcccttgcctttgtggttagcatattcacaagcaatgggagttaatgccatcaattctgctggatgctgctctaagatggtggtttaatatggaaaatacacattttttttctcctttttcctctcatggattttggttttcatttaaatttgctgctgttcattcacccattactcattcatttgggtgtattttgtgacttttataagttgattgctactgctactcttgtcttagatttcctacctcttcctacacagaaaccacccaagacccagcctggtcatactttgccacttttcccttagccctctcactttacctaccttatccttgatgagggcccaagtggcatctgcttcatccagtgttagcaggtgggggctactgaccaacatggtggggagtgggaggggttgggcaaggtagtggctgctgcaggaacccccaagctgcccagagagattaggcccgcctactttgggctgtgacctactccagcatgaggtcatagaggccctaataggtgatagagccttggatacagagagcactgtaactctactagcctcattgcagtctgtgggtcataatatttacaaatttttacttcttttttcccaattctattactgtttgtcattttatttttcctttatgttcttgccctgccctgccctgtctttaaacagcacaaagacgctctcttctttcgtctctcctcttctcttttca

SEQ ID NO: 32846 - DNA, 1502 bp, Mus musculus
ctttggggaaaatggagacttcatctttctggaccctagaagaagaagcacacaggcctagggtggtttggggctgcagcagttgatgtttattggggaccagtatccctatgccagatcttaagggccttggcccctgcatctcttgcctcagcttcattcgtcgctgtcgaactccgaagacaaaccctgaagcaggggcagggacatggagtgccggtcggggtccccggggcccccaccctgggctcctggtggagggttgcgggggctgaagagccagttctctgctagggttggggatagtcacagcttgactcatgccctggtcttcctccctagtccctccctctgattctttgtgctacaacacccccatcccgccaccttaccacaaccatgcttccacctcaccctccccttggctccttcatgaaggtcctgtacaaactctgggctgctgagcctattccttggttatgtgccctgtgccctctccctccaatggcctttccccttcctcatcttcatttcccctagcagtacctgaaagcatataggggcccctccggaaggggtttcgacccttatgggagaatctggtgggtctgccttctggcccttcttggggaggtggtgtaggtggggctgggacaggtggaggtacatcagcaacttcatgggtatcagcagatactgatgtgggggccagagttgatatgatgctaaggctaggtctaacccagttggctccttggggcaatgggtctttggtcagagacttctgtggtcccagcacacccttgggctgcagtgaaaacttgaggcaggagaaagcaataggtagtgaccgctgtaaccggatcagctggggttcacgggctgtaggcaaaagccctagctgcagccaggtgcaggagaagacctggtagatgacgtagatgctgtgggtgcttcggagccagggaagattctgttgtaggctcacctgccctggtggtagcagcaggaaagcaactttcttgcgcagacctcccatatgtaggcgaatcctgcagggctgcccatccatcattcgcatttcttcataggctgtctcggctcggccatttggtgagtattcccgtgtgcagtgggcaaagataccctcagaccctgcctgttctagaagatttggtagcagccctactgatttcagtgcccttctgccctgccgacctggcaaagccaggcgggtgtgggctggacgggactgtttcactagcacgcccagtagatcatagtaggctgcatccgacaggaaaggtactgccactacattggacccaaaacgctcctcgatgacctgcaggtggccagtttataagtcaggggctgagttaaggtcagaggttaacttgtgttgtctaaattgacctacccactattgttcactgtttaagtacattgctacagtatactaacagatctgtttcttatttcccagttccctgtagaagaat

SEQ ID NO: 32847 - DNA, 1240 bp, Mus musculus
tttcttttttctcgaaaggccctggaagcccaagtgttgattcttcgtcagtggtaacagtgccccgcccctccacaccatctcgtctggctctgtttcttcggcaacagagcctaggtggctctgagtccccaggtccagttcctcgatcaccagggcttactgcatctccaacttccagccctagtcgaaggcccagccctgcagaggagcctggtgagctagaagacaattacctggagtatctgcgtgaggcacgccgtggtgtagaccgctgtgtccgagcctgccgaacctggtctgccccttatgatggcgagcgcccccctcctgagcctaaccctcttggctcccggactaagaaacgcagtctactaccagaggaagacagggacaatgtaagggaaggagaggaggaaaacctagggagtcgagggttagctgtgggtgtaggggatacccctggctacctactcccaccccagctcaatggggtaccagggccatggccagaaggagccaagaaggttcgtctggtgccacgattggtaccacaggaaggagttagggaattgttagagggtacctctgaggacatggcaggactagagagctttgggcaagagctccaggagctggaggtggcattgagcaatggtggagctggctcagagcctcccttagagcctccactacctcctgaggaggaggaggcctacgagagcttcacctgccctcctgagccccccggccccttcctcagcagccctttgcggactctccaccagctgccgagccagcccttcactggtaagctatttgacctaagcctttgctctgtgtactcttgcatgttctcaacatgtttgtgctgatttctaagacccttttggctatgccattttcatgtatttgcctagccgtcatccattttgcttgagtcccttctatatacatatcatatcatactatgccctcatgtttgttgatatgtctttccatgcttgtgctgtttggatattgacttatgtctgtgccttgtatgtccttaaatgcatgttcttccttttcctttagtctggccattttctggggtttgtaaataggatgctctgtacttggtgaaaaatacatctgagccacatggacgatgtttgtactgtcctgtgtgaaagacacaggtgcacctctgttttgtgccattctcaccagtctgtgtatttttcaatcttctgctagg

SEQ ID NO: 32848 - DNA, 1147 bp, Mus musculus
ggtcatggtgtacaggcagataagaacctcaaagtgtaagttctacatctggattggcagacagcaggaagagagatagacactgggtctggcttgaacattggaaagctcaaagctcaatcccagtaacaatgaggcagcatctactccaacaaggccaaaccttcttaatagtgtcatttcctatgagcctgtggaggccattttcattcagataccacactctgctttcctaaatcctgtttttattaaatttatttttattttttaaaaaagattttgcgtttagcttcattcgcagcttcattgaccacttatgaactggcagctcctgaattttatagctctagtttaatttcactctgaactgaagtatgctctttttctttttcttcttttttctttttttatatttatgttttttgctagtcttataacccaggctggcttttaagttcactttgtagttgaagattatctaggacttctgtcctgcctttcttcacctcccaagcgctaggattgtaggtgtgcaccatcatccctggtttatgtgctgctggggattgaacccagggctttgtgcatggtggacaaagcactctaccaatgaggctgcattcctagcccattgtctggatatctgaagtattctttaagtgtctcaaaatttaacatgcttaaaactgttgtctgttccccttttcattgtcttcccctttcttccatcttgtttttttccctcggacttaaacagatgcttttttcgtttgagctagttggggacctgctatatagcttaggctggccttgaattggtagtcttcctgctttagtctgagtgctggcatttcaggtgtgtgttatacttgatcttatcaccttttgtgaagcataatttccctatgtattacaagacaatcagtggtgttcccaagtctccagtgttaagattcattaatcacctcttttgttcacctctggatgtgccatgccttactgttttcacttttggtttaaatccagaggcagattatcttcagttatattctagaccagctgtttgacacctgcctaatttgatcttcctccctgccctcccaagtgctgggattttaaggtgggagccattttgcctgactttatt

SEQ ID NO: 32849 - DNA, 1198 bp, Mus musculus
actcatttttttttaacctcttctgtttatttggagattggaatggagaaaggtatattggagaaaattaaacttacccaattaatgcatcattgataggtccgaccaaggcaagcatttgaatgttggctcttgtggttttcggtgaggtcctggagcttcctgtggcgacatgtgcattggctgattttggttgattcctatgacatataagccaactgctcctcaagttcattgctctttttttttattttatttttttaattagatattgtcttcatttacatttcaaatgctatcccgaaagtcccctattccctccccctgccctgctccccaacccatccactcccgcttcctggccctggcattccccttaaccctgatggtatatgctagttagtttttgtcaaatagacagactaaagtcacctgggaggagaacatctcagctgggaatatgcctccatcacatgggcctgtaggcctgtctgtggggcattgccactcaggcaggtgggcctgggctgtgtaaaaaagaaaattgaataaaccatggaaagcaaactggataagccgcagtacagcctttacctcagttcctgcctcatgctcctgccctggctttccttgattctggactctaacttgtaagatgtaatgaaaatgaaccctttcctcctctagctggctttgtcagtattttaccagagcaagaggcagcaaactagagcacagtgtatctactgccacctagtgccaaagagccttacctagcaaaaagccttccctgagaaggtcccaacatatcctcagggctggttatctttcaaggagcccatgggaaaaccatgcacatttatcctgtcaaacagggggtgcaggccaggcagcagtaacaattcttttcttgtgctattgagaagtcccagtccaactggttctgaaccagttccctgtatttatgtgtgtccctagcctcatgtctttggcatgctatgtggtggtttgggtatgtgttacagtgttcttcacactcattttctttctgggaaatcaactgcactatatttcctatatccccatagagttgtgtgtcaacggataatatagacaattggttgataatgaaactgctgcttccagacttggatctaacgaacacttcccttgtgttatttccacattgcccaacttg

SEQ ID NO: 32850 - DNA, 1200 bp, Mus musculus
tcaagacaaagctctgggaggggctgtgagatgctctctgagcaggggaaacactgagatgtgtggttggagtgaaaatttgtagctcattggtattctctgcttctaggacctgaccaacagccacttcttcttgtttgactttgaaaagaccggacctcctcgagtaggacccaaagcccaactctcaggccttaaacttcagccctgtctctacaagcgcaggtgaccgatggacacccattggaaggggagagctcagactccagtctcagaactctgaagactgtatctacccaggctatgagccaggatctggtaccaccctccttctgtaccaagaacactgtggtaaagcctccagctcagctctactctaatggagccttcttggatacagaaagcataaaattacttgggcaggctcaagaatgaggtgtttattgtgagggcatggatgtgtctaataattgtgggtcacttcagtattgtggaaactagtcggctgagaactgatggatctctgggtttgctttctcttcatctctcagaaggcacgtgggctctccgctgtgttgtcttctgaccaatattgtccacctctgctcatccatagtttctgctccttcagcttcaagactacagacaggcagtttttgccttatggcaggtcccaatgctagtttgccacttggggctgggagttatttaatttctttgtttcttggagctgggaatcatctaatttttttctgtgttgctattgttgttgttgttgttgttgttttgagacagtatctcacactagtccaagctgacctcaaacaaaacaaatggcaatcctcctgcctcagcctcctgattattgggaacacaggcatgggccaccatatttagctgaagaaatcatttactttctgaatattctatttctcatttgaaaaatgtaaccttcttgtcttacagtatgttaaatgggttcactgaggaaagctacagctagagctgggactagtaagaggtgctgaataaaccagctatggctatgtgtgtcgttgatctcactgtgtctgatcacccctactgccttaacggttgagcaataagtaatgtagatgtgaccgagaaagactgggggagtttgatataggcatgtaaacgggcttatttgctctttagagacttaacgtgtttgaagct

SEQ ID NO: 32851 - DNA, 1675 bp, Mus musculus
gcaaatggaaggctggttggggctccgaaggaaggagcgcccagaattagcttagctggtgggatggttggatgaaggtaagacagaagagtaaggtgggcgcctcggttcttgactcgtcttgcatccatgtgttttgtcctcacagctcatcgattatggaaagctgggcgacaccaacgaacgagccatgcgtatggctgacttctggctcacagtgagtgctccctacctgctagtgaggaaggaatccttagagaaccgggtacctggcagattgaaggcagggcattcttttatgtaccagacttgcgaactaccttagacacgtatttctcttatttgacttgggtaaaatgagcatccgcataacttcctgtaagtgtttctgtgtaacttggtacctgaatgggtggtgggaaagcctgtgaagatggttttgaaccctacctctgggaataatctatagttaaatgcctctacagttgtgactattttttctgattaactctccccatctaggagaaggacttgatcccaaagctgtttaaagtgctagcgcctcggttccaaggtcagaatgggaactacacaagaatgctacagatcccgaatcggaaggagcaagatcgggccaagatggcggtgatagaatataaagggaactacctccctcccctgcctctgcctcacagagacagcaaccttactctcctaaaccagctgctcctgggactgcagcaggacctgcaccataaccaggacgcaagcctccacagctcctgtacagttcaaacaccaaagacttaactggagctggagagtggtgcataggtgtggtgcccgtgttcgtgggtcttggagctcgtgtagtgtgtgaggcctggaagtagcattgtaaagccccctcataatgagacccagacctccctgctgactcacacgatcctctttgcacagaagataaaagtcttaatatgaatataagatattgactttcttgtccttccctaggatttatggaaagtaagaggcatccagatgctcagcctcctaagacagtaaattcacaacttaggttctaaattctaggtctagttttgcttgtttgttggaggggaggggatcttgctgtgtaatccagactatatccaccatgcagcagtcctcctgtccctgtgttcccaagtgttcaccaccacacagtgccagtttgctttggttttgttttttctgagacagtttctttgactgtcttagaactctgtttgtagaccaggttggccttgaactaagcgatccacctgcctctgcctcctcagtactaggattaaaggtatggggcactacctcctggctcagtttgcttatctcaacactaatttagatgggccctgtacctcttgattccaaaccatcttcctatggtgactggctgacgtccagcatagagacccaccgttggaattccttttttgcttttataagttatacatgagaatctttatgaatcctatgagactaggtttcaccttggcatcttcatacatatctaccaatgtcttttgaccatgcttaccaccacatgcatgcaccctattgtcctgcctatttcaactagtcccccttccacttgatgtctttttatgtgtgtgattatgtcctggcgagtttc

SEQ ID NO: 32852 - DNA, 1244 bp, Mus musculus
gatagaggggtgctttttggaggaaaaaccaggaaagaggataacatttgaaatgtaaataaagaaaatattcaataaaaaaggaaaaaatagaaaagaggaaaatcctttacctaattggacatgtatcagatattaatgattttacaacgtagagataacttgagattgttaacttaactgaaatatgtttatataaaaactctgttaaaactatgtgttcattttagtattttagcagattgtttttatattgttttgtgattaaaaaaataaaagaaaaattgtactgggtcaacagagttaaggaaaggtatatctatgtactttacacataacagctatatagagttagaaatagtcttattaaagaggaacagaaatagaggaagcaactctattttagttgggatactcattctcttctttgggtcagaatctggccacactagagaaatctctgcaggtctctttagttagatatttttttttaagtgggttgctaaataacagaagtatatttctcctaggaccaatggcgaggttattttcacaccgtgcttattcataaccctgtcctttggtgctgtgctgggaatggtctctagcaacgggttgtgatgacaggcaaagagggtggttgggggagacaactgcagacctgctgcccacacctcactcccagccctttctgggccaatgggattttaatttatttgctcccttaggtaactgcaccttgggtcccactttctccaggatgccaactgcactatctacgtgcgaatgacgtatcttgtgcgttttttttttaatttttaaaattttttttcttcttcttaatataaataatgggtttgtatttttgtatattttaatcttaaggccctcattcctgcactgtgttctcaggtacatgagcaatctcagggataataagtccgtagcagctccaggtctgctcagcaggaatactttgttttgttttgttttgatcaccatggagaccaaccatttggagtgcacagcctgttgaactacctcatttttgccgattacagctggcttttctgccatagcgtccttgaaaatctagtctaagtctctgggacactttacagtgtcaggtaacaataccatctcatagaatggaccttaaattcaagttttaaaaaaggtacttggttactcccataatgtgtgtgctactgtgtcaccagctacgtatgtctcagattttatga

SEQ ID NO: 32853 - DNA, 1909 bp, Mus musculus
acagatcatatttgaattcaagctcctggaaactggctcactcaactgtgatttcttataacatggtatgaggtatttatatatagctatataaataaatatataaacaaatatacatttatataaatattttttatttatatgcagagggactaagtcagacctttgcaggctccctggttggcagtttagtctctgtgagcccttgagtgcagtttagttgattctgtgggttttcttgtagtgtctctggcccctctggctcctgtaattcttcttctccctcttcttcatgattccctgagctctgtctaatgttattctcttcaagaaaaacagcttaggaaagtcataattaaacaaatatattcagtaacattaaacacattaaaggtgtatcatgtgtcaagagccccgcttgctattgagaattttatgatggaaaaggattaaagccattgtctaggttttgtaattaagaaacttgaaactgtacctacctcccaaccctgtgaaaggtggaagagagggttaatgcccattatgtagtctactgtttgtgacctagacctacctgttgagcctgtttctggttcaagcctatgaataaataaaaatgaattgtagagcgccaggccaaatttatctccacggcctcccctagcatgttacattgtctggggaccataagacagtgttagactgaagtgaaaatatgtaagtggacgatggtcctgtggtttggaacagaaggtctccccaagtccccatgtgtctagatgcttaagtccttgccaaatcattttggtcagtataggaaggctggatatactttttaatattagcaacctaaaagggaagtattacacagatgtgtctctgcatttgtgatggtttgtatatccttggaccagggagtggcaccatctgaaggtgtggccttgttggaataggtgtgacctggttggaatgggtgtgtcactatgggtgtgggtataagatcttcaccctagttgcctggaagtcagccttccactagcagcccttggatgaagacatagaactctcagctcctcctgcgccatgcctgcctggatactgccatgctctcaccttgatgataatggactgaacctctgaacctgtaagccagccccaattaaatgttgttttttataagacttgccttggtcatggtgtctgttcacagcggtaaaaccctaactaagacagcattggtttctactttggtcaaggaagaaagtgagcgtacctggtgaagacagtgacagccactgtcctttagtgtgtaccatttatgtgtgtctgaatgaacacttgaaccttttctaggaaaaagtaactttaaagtagatttaaattttttttacatctttttgtagtgttgggaactgaacccagggcctttagtacactttgagctatatcctttggctcaaataaactttgtcttatttaaaatttaaattcatggaaaagttataaaaatcgtacataaatcttcctgtgtcccttacagtttcccttgaggttaatatccaatattattgtgtagcatttgtcacaactaatgagctaatgttgatgagatataaactctctttcctcaatgctaaacttcggaatcatgatttgggtaccgtactagttggttctgtttgatttggtgttgtctctatctaaatccatcagtgtttcatctgcttcctaacctttatagtctaggatagtttaaaggagattaaacttctatacctgctagctagagagaactgccctgctctcagtactagtaggaggaaagttttatgtgctgaggcaatgaccagcagaagatcattgatgtccttcccaaggcctcaaattccagtgctatctccagatggaa

SEQ ID NO: 32854 - DNA, 1120 bp, Mus musculus
gtgtgtgtgtacacgtaccccaaagccaaaggaggctttagaagttcagagtcttattggagtacagtcagtttgagtccaatctgggatatatgagactgtgtctcaaacaagtaccagaagtaaaaggaaagtatatgttccgtttatataagttaactttaatctgaattttagtaatgtacttgtttcatcggtcaagaaacagtagcaaaggtgatgagtgtaccatgtagctctcatgtcagtgagcactgtcctcctctctcaccctgtgtgacctgtagtactatgggtggcaggaccttcctttcccagcactgcttatctgtgagggcacaggctgctggagtgtcacagtcactactataatcacttttgatttttggctcaaacctttaaaaagaaaatgtctcctccagagccctgctgtgggactaggcagcaaggcttccactaaccactcagccagactcacgcagagcttggtatgagataatgaatggaagagaggagtcatctaaggacaggaacgtggtccggcagggacagcgtcagagcatgcagttaacacctgaaaaactgttctatcctctctagagatgatgctcccataaggcatatcttctgatgcctcctgctaccccctctccctctcctcctgttagctttctcctttccccctgtagttctctcaggtcatccattactctccctctgcccttcactcagtaaggtaccttactccttccaaataagaggctcatcccatcagctccagaagcctcatacccccaccccagtgtgtttattgccacttccctggcctgagcccaatgcatggtcaggaaaaagaggagcagagcttaatttagtctctcctaaagagaaaatgggaaagaacacttaaaaatgattgacaaaaaaaaaaaaaaaaaaaaaaaaaaacttaacctaagatgcaaacgtggcacacaaggacattttcttttagataatacagtgtggcaggagagaaatgatttgtgccagcttgactctggaccttgtccactattgagcagtaaagctcaccattattgtgttaagaagcatttatttggctctctgtgcctggcct

SEQ ID NO: 32855 - DNA, 1928 bp, Mus musculus
ctccctttcttacatgatgttgctaactttgcaaaattttttaagtatcattccaaattcaccttagcattatctcttcctcagagctttctcttgcacaagatgttggtttaaatgctccactccctttacacccaaggggatcctgactgcacatcagttatagcatttataatgtgctgctattcctagtttgcaggcttgctgtctccagggtcatacactacaagtgaaataggattgttatagtcaccaccattctcagatcctccctccaacctggcatctagtaggtgttcagtatatgtcacatgttgattgaactatggattaatgaatgaaagccagggcttccaagcaagcttatttgcataacatttggcagccagtacagacaactgctaaatcacaaatctctattctctgcaggcaacaaggaagagacacctgcaattgttattcttgggcagcactgggaagcatcctttcataaacaaagcacacactgcctaccataattccagtggatttctgaaaggtgtttttatgactgaagcaaattctttcaagctgtttctgtggaaggtaaagttctcatcattcagaattgatttttagctcatcaggcacctgaatcattctatagcaggggatgcaaagtaaaataacacccagaactcaagtgagcctcttcatggagaccagaaagatttcctgaataaagtgcccataattacagttcctttgtcttcactcagtagcccaggcagctgactaacaagataatatttgccattcctacttgaggtctgaggcagagccaggggaatgagaaatgagaacattttttgacaaatagtgaatgtcaaagggggtgcaggaggatgacagaatcagtgcaatatatataaggggaaaaatcacatacagtattatatatgtacagacatatattaacatttattccagagaaagtagataagcatcttagaaaacaactctttcatttgtatgtgttggggaatggcaataaaaaggaaaaaaaattaaggctgtaatatattttctaaaaatgtaggtagatggaatagtatacataaagagacagttctatattttaaggtagattgtgaagtaaatgtaaaatagacacagtcaagaagtgaataacattacagatagttgtgctgaaaggacaaaagcttgagaaaagggcatcaggattaaatgcttgtaagcgtctctttactgtcattttaggagaatcataagaaggagagatgggaaatgcttgctgaacaccctgttaacaaagaggtccctttgctgttgagaaagaaaatggtactgttggagcacaaaatgggacctgagcatggtgagtgctcgtgagctccctacccacccccaacactgttcattattgaacatgagtattttaagtcttgaatactgatagggaacttttggctagagacgtccccaaaaatcttacctttaaattttactttgttgaatctttgcacatgccatctgcagctcgagtgatggtgcagctctggttgatggtttatatggatctctccttgctttgagaaggtgatggtatgctgtctctgttttcagtatactgtcatttgctaatgattttccttaatttgaaactggtttcctttactgtactgtgcatttagtgggtcattgtgtactccatgaaggattatttttgaactaattccttgaaggcttattttttcacatttttttctttcatggacttacattaatcatattttccaaaacatttttctctctaaaagagagcatatggatattgatacttctagtcctaaaatgaaatagatttgcatttgtggtggtttgaataagaatgaccacatagattaatatatttgagtacttactca

SEQ ID NO: 32856 - DNA, 1104 bp, Mus musculus
gtcccactgtaggtatctggcctctatcaatatattctgaactgatccctgtaattatggcacgggggcctatttacaccgaacttgacttgctgaatgagtgtaaacacaaaattgcttcaagttgctaattgttctttcctgctgtggacattggctatgacccagcaatttggctctagttcaaccatataagctctcctgttgcaggcccttgaatattacctcaagtaaaaattgctctgaggtccactgggtcttagttgcagtaaagaagattgtcttttaatattttaataaacatttgcactataaagtgggaaaagcaacttttttaatatcactgaaaacaaacaaaaaaggtgaggaagccatttgtgagcatttctgatgccattttttctgcctttgtctccaagccacactggcagcaagtgggagatgtgtgcttgatggagagctgattccttagaccacagccaagggttttcactggacgttctgtgggtagaaaagaagtgggcatccacaggagcacccaggtagacaggtggcaagctgtgtaccatgggcatcatggtgctccttggcatatggtgcttagccacagttcctcagtggagcctgtccctgccccagatgtgtgcaccctcatggactcgggaatccttcccagatgctccagcctgtgtcagccagtgatggggctgggcagaattgtccatgagtagattctttgcaggtactttttctgtcctttttttgaactttctggctgcagtttcccactctgggcactctgtgatcctcatttgtcagaatttgtaatggtttagcttcctgttttaaagcatgttgcctgtatattaatttaacctctgtgtgtttatttacaaatttaatgataataatccaactagtatatatgtacagtattttttaaataatggagagaagcaccgggaagtggtggcgcacgcctttaatcccagcacttgggaggcagaggcaggcggatttctgagtttgaggccagcctggtctacagagtgagttgcaggacagccagggctatacagagaagccctgtctcgaaacaaaaca

SEQ ID NO: 32857 - DNA, 1145 bp, Mus musculus
gtttccaatagaggagttagagaaaggactgtggagttgaaggggtttgcaaccccataggaagaacaatatcaaccaaccagacccccacccccaagctcacagggactaagccatcaaccaaggagtacccatggctccagctgcatatgtagcagaggttggccttgtcaggcatcaatgggaggagaggtcattggttctacgaaggcttgataggtgcccctgtgtaggggaacccagggcggggaggtgggagtggatgggtgggtggaggaacaccctcatagaagcagggggagggaggatgggatggggtttctgggagggggcaaaactggggaaggagataacattggaaatatgaataaaggaaatattaaaaaagaaatagaacagcgcactgacattgcagacacaaggttctgaaagacgggcagctcatgaggttttaactctgctgtgtcttgctcttcgtttaaggcataactcaatccgaagacagctcaacctgtcgaacccggactttaatatccagcagcttcagaggcaggagcagctgactgggattggtagaattaaaccagagttatacaaacagaggtcactggacaacgacgatgggcggaggagtaacagcaaagcctgcgggaaactgaacttcattttaaaatatgactgcgacttggaacagctcattgtgaagatccacaaagccgtcaatctgcctgccaaggacttctctgggacttcagatccttatgtcaagatctacttgcttcctgaccggaaaacaaaacaccagactaaagttcacaggaagaccctgaaccctgtgtttgatgaggtgtttttatttcctgttcactacaatgaccttgaagctcggaagcttcacttctctgtgtatgactttgacaggttctctcgccatgacctgattggtcaggtggtggtggaccacttcttcgacttggccgacttccccagggagtgcatcctttggaaggatatcgagtatgtcaccaacgtgagtctagccttcttccattgggctgggggagttgcttcttcttttccacagaaacagactgcttacacgtgttatttgggaacaaacgctaaaattcacattgatatcctat

SEQ ID NO: 32858 - DNA, 1154 bp, Mus musculus
ttctaacatttttttttttttagaagtagctcaagtctgtttgactgacattgaagaaagaaggagagtggggtgatctctatcaatctatcatcaaccaaagaaactccagggccacagctaagcagcagtactgttgggctctcaggcagaatggccacacagttgtggctctaactgcctacaccttttagggagtggcttccagggttgtcagaaactcacagctgggtttagaacaggaaatttcaagttcagaacctcttctgggttgccaggcgtggggggacagggagattgtttaatggctccagagtgtctgtttggaatgacgaggttaatggaggggagagtgctggtggccacaaattctcaagtgctaatagcagccgagcagcacacttacagatggttaaagtggtgaatggtgtgtcatgtctgctctaccacaatgagaagcacaaaacaaaactccctccacttcccagaacccagccccattattctatcatcatctgacttcccagagtccacctgcttcactctctcccccaattccctgatctcaccacccatatgcaaacgtacttcctgaatatacttgctagaaaaaaaaaaataaagagaaatcaggactaaaagtttctgcaggctgagagactccattgtttctgatggagcttctgcctagagagagttctcaagcccacggcgggaaagaggagcagaaggcgtccacacttccgctgtgccagaccccagcatcacagttaactcacacacgtgtgaaatggctattatattctttttatagtaaaggaaactgaggagaacaggaaggaaccatgacttcagcaagtattagtattagtgagcccaaatctgaaaacaggtctattttccaaaatccaagcttctcattttctgttatagtactctccatactttgtgtctccatatgatagttgacatctggttactgttgtgagatggggtttctatagctcaggctggcctaaaactcactctgtagtgggggatgacctcaagctgcctgtctccctgcctccacctccaaggttctgggcgtgagctaccgtgccttgcctgtcacaatcccttcgccaactctggactaaagattgtgattggat

SEQ ID NO: 32859 - DNA, 3098 bp, Mus musculus
ccagcaggtacaggacctggctctgtccccaggaaaacacacacacacatgcacacatatcaatcctttcacagctgggaaacaaggattgagtattacaaggtttcaccactcaaacctcctctctccagcctggtcttcttgcttcctccatacccctcagtccctgcagctcagacctgacagtccttcctttgcaccaattccttttcctgcctctgcatgggctttctcctccgccccaatggcccgaactcaccttcagcccaagtggcacttggacttcaaaatccctttagtgccctcaaaggctctgccagaaggttgcgtgcacctctatagttcatttatccccttatgagtcctttgaaatctgggtgaatatctcacacatggtttgtgtgtttccagcatccatctcagtgcctggtgtttgtttggtacacattaaaaaatacaagtgaaaaccagctcactctctgtttcttctccctacagaaacgatgactatggagaagaagactgcttgtgccaaggacacagtcggacaaccatgtaacaaagatctgcagtaacttttcccacctagcaacacccagatgactccagtgaagaaatactcagctgtaaccacagcaataactggccctctttccaaattggatgtggtgaatctgaagggttcatctattttcttcaggtggcccaaggtgatatgctctagagaagctcctccctcactgtcaaaagccaagttggactgtggaagagagcaagtggcatagtaagtggcttgagtgccaagatggcctttggttggatgggcatgacactggtcctgacagtggtcagtctaacatgcagtcatttgatttggatgccctggaaggacagaatatttaaatatatatccaggtgctaaataggcagcagatttcaaatcaaactttactacctgtgagctaatgactgtcttcagagaataattccaccccagaaagtgttccagttttccaagtaatggcccaagaaaatactaggctaagccagcctggaaaaagtctcatgcaaggcaggtcagttcatagcaaactcactgtcccttcccatgcacatggcagagtcccacttagccatggtcattcttcacagaacccaggttctgggattctaaaacattatttccaagtagcctcttcctttccagcagtgatattactagagtgaaacgtgccatctttgttagggacacttgcctcccagtggaatatgcatccaggaataatctttcctggacacagaagtgtgtgttatgagataagatcactgagagatgacactggaaaaaggcacagcttttgggctttcttgacacagctgccttctggctgtttccatatgcaacagcccagggtatagacttgggcagccacagaaagaggctcttttccacctcagacacataccacttttgcagcacttggggaatggaaatacctacaagaatgaaggccaagggctctccccagggtagctcatccattacccagcatcctcctggaccagtctactgccagttgtgcacctcatccttcctgtgtctgcctccaggaaatgaaaccaaaggccccagtaccccctgaatggactgggggctattacctaaaggtcctctctcatcctgggtctagaagaccctccccctgcatcactgttccacaattccattcccctccagtctctgtaacagaacccagagttgggttgcagttaaccatcctggagagcagcctctcttcatttcactttgtttttcagtgtaggttgcacccgagggatgcagcattacagcagatgttggaaagttctggcttccatatacacctagtacaagaaatcctactgccaacgccagatcttgtcgtgtcttaaaagggtggagacctttggttgtataaggcaatgttaattcattcaagcttagtgcattccctggcctcccagatccactcccatctccttccaacttcatttgaaggggttcaaagggaacctatgttcaaagttcagcctatgtctaataaaatgagaaaaacacaccttccttgcccatcccttccattcagacatccgccaccatatcagtatttagaaccaaagtatgaaggccaagtgccaacaggacagggagcagaaatattgtcactagatccaggcagatgtgcctagaagaatggtcccaaagaaactagaatggctccagcaaaagattatcaggcagccatcttattaagctttgacatgtccttggcaatgggagctcaggttggagatcctggggtagcctgttgttcccacctcaggatctcctcaccttgagctagcagccctggggtactatggaataagctactgactcaaagatagctttgtgggggcattcaggcgaagaagactacccacgtggtaaacagatggctttgtgtgtggagagctttacctagccagtacagctgtggccagaagctggctatcaatctgaattccctcagctcatttgcaactctgcctctgttctcttgtgttctgtttggtctccctttagtttcctagtaaatattccttttgaaaaatacagtcgttgtctcattaaatggggggtggaggggggtgattttctggctttttttttctaggataaaaggatactatgacatcttgaaagaaaaaaaatcctggtggaaagagaagaaacctcatcaccctggggagacctggtgctaagtgagagaaagatgctggctatcctcagtaaccaataaccagctctcctcccgggctcacttcagggatctctgccctgagtgtgtattgccactcaagtgtctcctgggatactgaacagtgtgcattcagcagaggctgcaatgtccagtatggtgtagcattggcaagtcagggaggtagagtaaacgggtgttggtaaaactctctagggatgctaactcctcatgaccgtcagtatccagttcttcacatgagaagaagaacatcattcacacataaagacaaacagagaatggcttcctgttgtggtc

SEQ ID NO: 32860 - DNA, 1146 bp, Mus musculus
ttcaaatcccatcattcaaaccagacgatacagggaccactattgccacctgcaggtcaaagtaagaataacatactggtgctctgctactgcaggggttaaagctcaccccaactccattccttataatcttcctaatgggccagaggttctgcggagcttttgttctctaagtcacacaggaggaaacagacagcgttagtcatgcatttccccagccattcagacagtgggtggcagagttgtctttaaacctggatctgtttaattttatgtcctttcggaagaactggcaaagtagctgcagtgttagcacttgctgcaggatttgctactcaatgtgcgtgtgtgtgtgtgtgtgtgtgcatacgggagggtggggggtacaagaaaaaaaaaaagagaggaatggggttccctggagctctgctatatccttgaatctcacccacaggggaccaaactccgtctcaaacaggccagggagggacactcccacgttcattcacccaattgtactcagtgtattctttcataatgacctcctcggggaaagacacaacggctcactctctgctacattgccccgcttagccttgaactcactctgtagctcaagtcatctgtgaaccccacaacccttctatctcagctttccaactaataataactaggattacaagcatgtgccaccagggtcagctgcaaagcctttcaccactggactcattccacatcattggatctttcattccgtagaccttctggtgatttcactcgtcactggacaaagcctggagatgcttttggctttcctagctagaggaggtgccaatgacatctgcacggaagaccaaggatagtggtgactggcaacttgattaaaagcagtacacttggaactcacttaggccacacagactacagcagctcagctggtttgtgtatcgggtacacatgtgcatataaccttaaagtgaactgtgaacatctcagaggcatacaatgctgaagggcaaagtggatttggaaccaaaagaaagaataaaggaagtgaagcaaacacaaatcggtggactcacaaaggttggcatgatggtggaaaggtggcattcaaaggaattcaaagcagaaatgtgactaggt

SEQ ID NO: 32861 - DNA, 1212 bp, Mus musculus
gtcttgatcttggacaacggcagttcagttatgaatgtgcagacccatgggttcaatctagggaggcatattggctgtttctagagggccctttataatgttccttcttttctagacagaagaggatatcttgctgagaaaggagctagaagaagtcgccacgactcatcacaaacagttcaacctgtggtataccctggacaggcctcccagtggtatgacccatgttactctcctttattctgggccagctccacccttggacacacctatagactagtctctagcttttgtctgttttgtctttaaggtttactccataggagattatgcctgggggctcttggtctatatagggcgtacaagaatctgagtgggaggatattgggagcagcagtttttaatgggagtcaagggcaggtgttaaatacctcttccacacgccacacactgcactgagtatagactctgagccaccaggctaattgagcacgtactctgcagtcagcacattgcacctaatatgacccctggccccttaacctcgtgtacctgctcatggctacttcttacctccaacctcttctggacagcagacttcaaatgctgagcttcagtcagctcctgcagcctcacctagcatcccaggaacttccgtgcaccttgcatcatgcattacacatctcctgcttccctgatctatactgcctatacctataagctgtccaccagtgtgacctcctcacctccccctaacagccccactttctactcaatgcttagagcagagagacagcatcccgagtctccgagagcctagaatttggcaaaaatgctatggacggcagggaagccacatgtctgcttcttgagtcaactatgacaatcagcagtgcagacttccaagcgtttatagggtagcctggtctccagcatcaggggcaaatgcagaaccatgcttcttcccctttctgcttcatttcagactggaagtacagctcaggctttgttagcgctgacatgatcaaggagcacctccctcctcctggggaggacacgctcatcctggtgtgtggcccaccacctctgatccaggcggcagctcaccccagcctggagcagctcagctataccaaggacatgatttttatctactaacacctcccacactacttagcgggtccctctctctgctttagagtgagtttggct

SEQ ID NO: 32862 - DNA, 1154 bp, Mus musculus
cccctgtaagactgatatttaatatccatttaagtcttaaacaattgcgacctttacactactctgtgccgccacctggtggcaactgtgtagattgctagttgcttcctccccattcccaccccaggaagtcctaaagttactaggaactactctggactcctacacactgagtgcgcatcggacagaaattaaagcgcacaccgcgcactaaaacttacaactagccggaaatttcatgtccaatagtcatcaagatatgattcacgtggtataaatttagccaatcaaatttctaattcctccaactcacgctcttctgttctaggctctctctctttctcggcaagatggcttctccggccgtaccggctaatgtccctcctgccactgcagccgcagccccggcgccggtcgtcaccgcagccccggcttcagccccgaccccatccacgccagctccgacaccggctgcgactcccgctgcgtccccggcgcccgtctcgtctgatcctgctgtagctgcgcctgcagccccgggccagaccccagcctccgcgccagccccagcgcagacgccggcgccttcgcagcccgggcccgccctcccggggcctttcccgggcggccgcgtggtcaggctacaccccgtcattttggcctcgatcgtggacagctacgaacgccgcaacgagggagctgcccgagttattggaaccctgttgggtgagttctggggaaattaatgttttcttcctgtgcatcttactattcctctcgttccatcgcccctgaactcttagcctgtttctctttttgcaccttcctactgtggcttgccttcccgagtgatctgaattcagccgaattgccgttaagccacagaaatgtgcaaggagtaggtataagctattgcgtagtttgtgatacttgatctacatgttattttatactcccaacaacgtggtactgagagggcatgctgccaaaaatgaaagctcaaatgacagcaagttcaaagcccttgacccgttaaacagagtacccacatgccctctcttatgcagtgacctaccaccaccccagcacaaacagaaagtgcccaccacccatgttagggaagaggatgtgtcagaagcttcctccaactcaaa

SEQ ID NO: 32863 - DNA, 1326 bp, Mus musculus
ttgtggggaagggctggtagggggaaatagcaggcaaaggagaccttgcaaaggaaggcttaatcgtgtctggtgatggaaagggggggggggtctctgagtttgagttctggaaaatactagttctgttgatgctggacttggggctaatgtgttggcttcgtgtttgctgactttgaggccatctccaaaagcaggacctggagaaacagcttagttatagaccacttgcctatcgtgcataaagccctgaattcactctccagcaccacaggagccaggtgtggtgatgcgtacctgtgatcctagcatggggctgttggagacaggaggctcaggagttcttgttcctctttagttagaaagggccctgaccctgggggattgggtagtcaggggccatgggctttgagttctcaggattatgtaacgcctggctcttctctctttaccaggaactgttgacaagcactcggtagaagtcaccaactgcttttcggtgccacacaatgagtcagaagatgaagtgagttgagaggatttaagcagcccctgtatagttcacagccattcaacccctaacttccccgaaggccccactgtgctgtgtctgtagccagagctgcagctgaagctctgctttccctgtccacattgggcctcctcaggtggtgggggttggtaatttttcctattcagcatatacttgtagcttcttaacctcctctcctgccttcccccttaggtggctgttgacatggaatttgctaagaatatgtatgaattacataaaaaagtctccccaaatgagctcatcctaggctggtaagatggcgcgggtgggagtggatagagggtctcattgtcatcagactagatctcgtctcccctttcagacatagaacatataaagcatgtgacctcgagagcctatgagattttgatgataacttgatcctagaaagtcaagaatatttattttcaattacaactttgttatgcagtttttcatattgttaattactgctaaaatgggtgtgagaaccccggcaacacccgctgcgctgttgcatttggtattggtgtcagctgccctgcgtctatgattgctgttgcaggtatgccacaggccatgacatcacagaacactcagtgctgatccatgagtactacagcagggaggccccgaaccccattcacctcacggtggacacaggtctccagcatgggcgcatgagcatcaaggcctatgtcaggtgagccctgggcacgctcaggtctaatcctgccgcttagtttctcttcaggaactttattcctctttta

SEQ ID NO: 32864 - DNA, 2140 bp, Mus musculus
aagataactctgggacagtcccggccttctcaagaggaagacactaactttgactgctttcccagcctagtctacacaaggaaactgctcccaggggcgatggtcgattaattttctccttcttccccagcactttaatgggtgtccctgggaggaccatgggagtgatgttcacacctctcacagtgaagtacgcgtattatgacactgaacgcattggaggtgagtttccttccctgctgtacacacttggagaccctaggattattcaagagaggagctgtttctgacaaagatggaagccctgggtagcttaaagaacacactcaaggttcatgctgactgaaagttgaaggtttgttcagggtggggaattgtcagtgtcccgggccatatagtcatccatatgaggccagaaccaatagttagcaagcaggtagtcagtcagggagagcagggattttggggaactgactgcttccagaaggcatggagggagttagtaggtggctagagacctctttcctcttgtcatgactaagctttctgtgttgtctcttactgcctgtcccacactcccacagttgacctcatcatgaagacgtgttttagccccaaccgggtgattggactctcaagtgacttacaacaagtgggaggggcctcagctcgcatccaggatgctctaagcactgtattacagtatgctgaggatgtgctggtgagaattggggagggaaaagcaagggagggtgggcatccctgctccgtctgctggtgacatgacagtacctgacaggacagtgcctcattgagtctttgttctgtgctcagtctgggaaagtgtctgctgacaacacggtgggccgcttcttgatgagccttgtcaaccaagtacccaagatagttcctgatgactttgagaccatgctcaacagcaacatcaatgtgagttccgtggctgcaccctgagagctgggtggagggacttctgctatgtcgtccaagttggaggcagtatagtatgttcagggcgactccacttcctaatggcttgactgaagtactactggtattgccatgacttgttaactagactcagttagaagacttgataaaatcagtttaacaaagtcagttcctacttttccccatctgtgttccccagggcacataccctatactgcacagggctatactgcagtcccccatctatgagaatcagagaggatagcagtcatgcacattcccttcctggcttctacctccaacccttgttcagtctgcctcaccagcatttatccaggactcttcgcagccaatgtccatggtggagctggctagccagcctttctgtcactgttgcactcagcctctcactgcttatcctttgacttccaggacctgctgatggtgacctacctggccaatctcacccagtcacagattgccctcaacgagaaacttgtaaacctgtgaatgagccccaagaggcacttgtgctggtcgaggttttcaccacagggctgagaccgaagtggaggcaaagggtttctttgtggtcttgagtcacggtgactcagtcagctgcttgtgactccaaataaacatagcttaccttttgtaaatgaactttatctgatgcgagtttattgtcggccaggagaaagaagcatgttcctgaactcgcacggaagccagggagtgggcactgtggggagaagctggttatgttggcatgactcacccacagtggctgctcccacagcctaggctgcggtagtgtcacccagccccacaccaagcagctttttcttggcacagtggtttacagtgatacttttttcttcttctaacttaggataatagcaaatggaatctccaagattgtttcagtttttggtttggtttggttttttctttctttttctccctttttcttccataacatcttacctggaatggcagtcaagagatttgccttgtgcagtgtggaaggacctagagatgtgctagtgagctgcaacaggatagaggatgggcacacacctcagtcctgggacccatggatccacaggagcagaaaaccttcatggtgaggaatagctgcttcaccagactgttcagtctggaaagctat

SEQ ID NO: 32865 - DNA, 1148 bp, Mus musculus
ctagtgccctgcatgtctggggcttgggaataccctttaaatggatgtcttttctctcctgggccctgctgtctgtgtgcatctccccccttcaccctcttgcttcataatgtttctcttgaacctttgttttgttcatcctttcgatctctttggcatttctgctttctccttccctcttgtggcccatgtcttacctggtctccctgtctccaccattcttgcttgtgcatgccacagcggactacatcgtcatgcagtttggccgggtagcagaagatgtgttcaccatggattacaactacccactgtgtgcactgcaggcctttgccattgctctgtccagctttgacagcaagctggcctgcgagtagaggccccccactgcctttaggtggcccagtccggagtggagcttgcctgcctgccaagacagccctgcctaccctctgttcataggccctctatgggctttctggccttaccaaccagagactggctgctctgcctctgctgctgaagcaggggggacagcaaatgggtatgacaggagaagaatatttctgtgccccaaggtcaacacacatgcccagtcctgggtcagtcccctgctgcagtggtgttatcacaccggaaagcctcttcacctggaggtacagagggagaggaagcacaagcctggctgctgtggctcagccatccactcagcctacgagtcagagacagtgggtgtcccgggaagcaggggtacagtgagtgtgtgtgtatgtacagggcactcaagctgtatgtagaaaaagctctggtggtcagcagaaagcactcccacttcaaaagggcccattaggcccaaagggggttaggagtggtagggataggtgcgtggcaggtccctgctaggattgcaggggcctggccatgtgtattagctggaggcttagaatgctagctcatttgttgctacagatttgcccagtgcttgcacacgtaagaacccagctctcaaggccaaatatctgagtggatggggatgataggagtcatccagtagactccctacatcagggctctcagcagccccagcacaacacctatgacacacacacaggatctaggtcaccattcaagtaatggtatgcttcaggaag

SEQ ID NO: 32866 - DNA, 2905 bp, Mus musculus
acctcactggttaatggcagagttgagaacctcaaattcttttgttcctactgttgcccagaaactagactctctgacctgctagggtctattctgcatgtcctttctcttcccagttccagagatgaaacccctccgagttaatgtataaggttggaaacctttcagtagggaatcaggcagttccctgttgaaagttgtctgagtttttgcacaccattctgatctgatgtggcctgtgcctggctcctctatgaggacttcgagctgtgcacagaccttagcaggaccactgcacactttgtgtctgtgtgacaggcagcccaagggttctggggctgggcttggacacgccctccattgggatggcaccactcatctggtgggcttgggaactccaagctcttgcctgtgtgccatctgtgagaagcttcttggagctgagacaccagagggaagcaaagagcatttagacattgctttttgctttgaaatagatatgtttggaaacgctaagtagaagtttaaaaagtagagtcatgtagagtcatgctttgaatatgtgggtcatgctttagatatgaagaggctatgcaggtaaggaggctggattgatgtaaatggaagtagtactttaagaaagctctagatttcccaggttggacactcgacgaaaggcacacctgctgcagcaggttctgacacacctgagccatacattgccatcagagaaccctcagcgaggtagcctttgtttacagtctagtttctagagggcagtaggacttccatgctggggctggcctatctcctgatgaaagattacagtgccatctccttcccatagttctgtgtctgccctccctccctgactttatagggagaaatctcctgacattagaggtgatagaaaccagagctttagtctagtcaggctgtttctctgggttgacaagtttaaggttgaacaggctgatttctggaatctcatgagtggaggggaccctggtggttaagagcggaactggaagcacaatggaaaactcttggactctgctctctgctttaccacacacaaaaaagagggttcttggctatttgaatataaagttggtagcaccaggaaataggctgaactttgtagcccactgtggaaaggagcagcctcagcacaaacccctctgtcgggccctgagtgacaagaccagcctcacaaggtcagattttaagactcagctcctggtgataatgccttttcttgaccactggcgctgtgaacacaggctaatggacttcagataccagggccccgggatcacctgggttagcctctcccacaggaagatcccttacccctcatcccctcttctttttggtccttggctgggtagcaaattggtgagaagagcagcctagtctgtaagagtgcagggcagctggaaccttaggcagctcctctgtatgctaccggctccacaccctaacactctccaccctctgctccaaaccagttcttctgcagagtggtgatgttagcttccccagctcctctccaagtctagctttttctgtccttctggctccaaggtgctctgtgtctgtgtgtgtgtgtctgtctgtgtgtgtgtgtgtcgaggaaagggcaatctgcaaacaatgaacagaagtttaagatcacatcagagtagggaaagacaacggaggcagtggtgaccactgtggactgtggatggtgccccttcattccatgctctttctcccatggttctgagcaggcgactgtcaaggaagtgtgttgtcagttcactggaggaggagctgagatgtgcacccttttaaatgaacatggggtggtgatggtgccttaacaatcttgacactaaggtgaagcaagcaagtaaggtgtgtgcctctgggaagacaggagtcggaagccaaggtgtgtggcaacagtctggaagagagcttttggtaatcataccgtcttcagtgacaaggcaacaatgctgtaaagtgggtttgtttggttttgttttttctttctcttttatggaaatggcaggtctatttgcctcaaacgttatgtagaagtagttctaagtttaacaagcaatagagatgactgcttagctaggatctgcagggagctctgctctgcaagcacaacacctgtctcatagatggacagcctggtttcccttctcagcagtcctggcctccccttctctgtattccttgccccagctacgatatcctcatgggatttcaggatgccaggtgccatcaaagcatgcttttttgtggtgcctagcactgtgactggggcccaactgccctgcagagttgggaccttgcactgccctagaccctggctttagatctgcttcagtctccagaacaggctatgggatagatttttctttcagtttatggccacctgcccaaattgacttccagcttacaatcttctgtcatttcaagatcgtaagaagtactgggatgggtttgagttttcagcacagaggcgagttgatctaggagcatacaactgtactgagcagctagagcatttgagcaacccatgtaatctttgtgtttccctccctgtaagaaggcctgtcagagcttgctgtaggagttagggtaaatgaaagttagtcctggctctcatcaccacctttcctagctcatcactgtgccttctttcttccctaagaaagacaatgcacccctctcttctgttctcctgccccttcgcccccactgaggtccaggtagagcagatgaggctgaaatgtagagtgttctatagagcatctcagtagcatagaaggagaagcccagctccaacctcctggaccccatactggtgaccagcttggtgaggacaggcaaaatttctcta

SEQ ID NO: 32867 - DNA, 1205 bp, Mus musculus
gagtcaggtggggagctgtgctgaatagtgggactgagtataataaatgtaagaggggagaaaggtactaagtaattacggtcaagcatggtatcagagtcacgtagagtactaccaacccagaggaacagagaaactgattcgtgtatgaggccggagaaataagggagctgggaattgactattaagatgcaggtggaatttaatatttaattaataatttggtgcttgtcagactgtatgaattttgggcattgatttttcattgcagtgtggtacaacttgtagccatttgggagtttgcaatatcattttttatctttaaaggatctcttcagataagttttgtatgtttgcctccagaggcttggatggagatgccattgctcacagtctctcctctcttagtaacagaagcttctctatctttctacctgcttgcccgtttctgagggaagctgacttggctgctagacagttgtcatgattagattctgtgcctctttgattgtttttctaaagtttttgatgtttatgttgattataatgctatttactttccattttgaaaatccttacacctggtctgatgatggcttagtgggtgaaggcacttgctgccaagccccggtagtctgagttggattccagggacccgcatggtagaagaagaggaacagtgctccatctttgccaaatgcccatctccttctctataaatttgcttattctcgacagtttatatcattgaaaccttacagcatctattcttctgtacctagactattttatgtactgtgattttggtcttacacaaatgcccatcagccagaggctcatgtggaccttatttgtgtagatcttagtttctgtgctctcttccctcaaataggctagacttctggggggaaggatccaagacttacaggaaactgcttcttggtgttaattaagctagtatgataggattctgcatattctttgccctttctccctcttgcctgccatgtaatgcttggaaccattgtatttatctatccaggttttatttatctattttattttattttggtactggtgttgcacctgagtgctgggtaagcattctgtcagtgatctgagtccctagccttttcttttttcttttgacagagggtcttgctaaatggcttgggatgatgccttagacttgcagtcctcttgct

SEQ ID NO: 32868 - DNA, 1165 bp, Mus musculus
cctgaatcttggggtgttatgtgtctgatgtatgttgtgaatctttctattatagggctactacaaagttctgggcaagggaaagctccctaagcaacctgtcatcgtgaaggccaaattcttcagcagaagagctgaggagaagattaagggtgttggaggtgcctgtgttctggtggcttaaaagccacaccggaggttaattaaatgctaacattttccatgtggtctttgcatccttccttgtctgcatgttggaaatctgcctaacattctaggaagaggtgaggtgtgggcccttgagagtcagtctgtgggaataagtgtagcccaactatgcacagttgtaaattcctacatccccgtgtgtattggtcttgatattcaaagaattgatgaatgccattactttcagtccaaagtgaagaaacctggtctcaaaaaatcccgaggaccagaaatgagatgggttttcctgaaaatctaaagttcttgaaaaaccttgccatccagattgctagcaactgcctagctttgtaagcttactgtgatggacaggtagctcaggacgactggtcacttaatactggacagattagcatggaaaacttaaggggaggaggaggtagtaggttccatccagcttcgctttgttggtggcatctaggtgttgttccaagggagcatgcctacctgcaacaggacatcactggttgggaatactgtagaaccagagctgtgacctttgaactactagaaagatgaaattttatgtaaagagtaccttggagtaaataaataaagcccaagatcctgattgtctacatctttaaatctggaagtttttagggagtaggttgtgtatgcttagtactgacgctgctttagtagacaagtgcgtagtaagaggcagtataagttgggtcactaaatacggaaaaattcattttaagatgtgttgggggacaaaagacttctggctctagagataatactgtgtgctgcccctagtccagatgatgtatctgtttatgggtggaggatgattgacatgcatgtggcagtcgggacaattatagggtccgtaacatgacaattgtgtatgtaaccacagtaattctatgtaaaggtttaggcatgtggctgcattgttatttcctaaagc

SEQ ID NO: 32869 - DNA, 1103 bp, Mus musculus
cttcagggacctcagctagtgtaattgcacaatcatagcagaggttttttgttgttttttaaaggcaacaagccacagatgcagggtgttgcccaaagtcacacagtggctgatctctgtgtcctaagttatgttttccctaccttatcagagccgtcattcctgtctgtcaaaactgatcctttttgcaaggaaaagaagagaggctaggagagaacatgggtgttgaaaggggatcatgaaacagcctcacctttgccctctccatcccacaggcaacaagatgaagttcctccacaagaagaattaaatgcctttcctggtagcagagtttagtgctttgcagagcccagggagagggcccagcctgggaccctgtgggctgctgtggctactttgcttctacaggccccactccaagccagcccacttctgccttcaccatattccaggatactgtttgtaaataatctgctgtaagctttcctgtttttgtaacaagcaaagaaaatctggtaaatatttgtatattcccaaagggccaggtgctttcttgccttgtctgagcttggatggagtcttgctgggtgctggtgactggccaattatgtgcagctgactgtctcagccaaaccactcatgtttcctcaagacttctggcctgtctgcctgaggccctgctgccagtcttgggccctggagagcaggtgctgtcttaattatgtataagaggactggttttttttttgtttttgtttttttggttgtttttaaatctagagtttctaattttttcttcttagtagttcccctatctgccaagcctcttgtttctgaaaggcaaggatcacttcgcccttttttgcaatgtagagccaggcacttgggcctggtccttgttccttccatcctctgacatggtcagtgagtcatgggaagcggagctcccgtcagtcagtggtggccatgatgcggtacagggcatttctccttccaccatccacagatgttctcaataaactgtacattcattttggctgaagagtcttattgtgttcctttcactttctacagttctctccaacccaggcgaatctagatgc

SEQ ID NO: 32870 - DNA, 1308 bp, Mus musculus
tgtccgtgcgttttaatgccatgtttgtttttacaaatccttgctggatggaggaagactccaaactggaagcaaaccccatgcttggtattttcctgttaatatattaatagagacatttttacagcacacagttccaagtcaaccagtaagtcttttcctacttgtgacttttactaataaaattaagctgcctgtgagttatcttgaagccccgtgcctggaacaagctctctctttcttgccacacagttctaacttggtgttcaagataacttccaggtgtgtttttgcttctctttcttgtggtgggagagagaaggaaggatgccttgggagtgcttgagtagcttctcaagtgtcttttccagacagacttatgaatacttcagaccctctacttcacacttgttaatgtcccagtgtagctggcttgtcagcgtgctggcctccccacttgacttttgcactgactacattacctaagattctggttagcctgtggctgcatttcatgaccagttggatctgaaatgcctgggggctcctcacaaaatgaagatttgtttcatgcactgtgatgtctgacgcaacatgttctagaacagactggccatctgctagtttacactgatacctaaacacagtctcagtgtgtgtggtcttcctcatcttcttctagtagctctaaggacttgaacatttagaataaagacattttctcttaagcccaagcctccctggatgattgacgtacaaatactgatcagccttttctgtcttgctgagaggcagttctttgaactgatgtgggcagctttgaacaaggactagagttcagattgcctctctctgagaagtctaacagttattggataactggcttttttcttcctacatcctctttggaatgtaacaataaaataatttacaaaacccaatcaatgtttctgttctccagcctttctcctttctcttgtgctgtgtgacaagcatgtgacacaaagacattggtatattgtagtttgaaaacatgttatgcaaccaaatcgtaagacactgactgtgttaagggtatgtaggtgcagagagaaagacaatgtattcctaggtacacaagtagtcagacaatctgaggacctctaatgtcacaaaccaagcatggtagtacatgcccttaagcctagcactcagagggctgagacaagagagttgcttgggattcagagtcattctgggctgtgtaatgagacccatacatatacatatacatatacatatacatatacatatacatatacatataca

SEQ ID NO: 32871 - DNA, 1909 bp, Mus musculus
aagtgtcacatgttttagtacttctggtgatgttagtgtgtgatgttagctgtggagaaaagaaatgttttggacctctgtttgatggcgggaggagtgctcacgtctgcctagtaactggtgtgtgctaggttgtctagggagatgaaggaggtggagaaagagaggcaggtgacagggataattgtgttgggttattcccagggctgagtggtggaaagcaagctcctttagagggaattggggctatgggggaggggtacagcttcttcatcctctcactaagttcaaggatccccccacccccaacttggccttggcctgtgtctttcttttcccttgctttgacctacctggatcactcccaccctaccagagatcacctcctgcaccactggatagccttgctggccgactgccccatcactgcgcacatgtatgaggacgtggcgctgatcaaggaccacacactcgtcaattccttgatccgagtgctgcagaccctgcaagaattcaacatcacactggacacttccctcgttaagggcattgacatctgacctctgagcaccagccagcagcaggacccagaaagactccctgcagctctgcctcttcatcccaaagggacctaagcaagttgtgggggacagagaggatatgtatacttactgtaaaaagaaaactagaggatttttggaaaaaaaataatctattttagagtttatttgctgacctgctttttacacactttcatgtgaaagagacagagaggggcaaggttggcgctgcttgttttgaagctggtgcctcccttgcatggccgcacgctgggagcctgtggcctcccagactgagcctgcaacaagtgtggggctgttccacatgccgccccgtcacggcggtgaggccattccacatcgtttttaaactaatgttttctatattaacattattctggctatctggctttcacgggccacgcacaggtgtgcgagtgggacatcccatgctccaatcaaagggatttttagcagtgcctctgatcaagcactgccaagtcagctccacatccgtttccccccttccccttttttgtcagtattatttgggaaggagacatgccaggacaatgtcattgtgctacatgcagaaaatcatgtttcctgttggcacaaagttgcacaggagtaaacatgagcatgtttaacaggtttgtcttttcttcacctatcttatttatttaacctgccattgtgtgttttaagtatttgtttttcttttctttttttctttaagagaaggaaagcttgtcagtctaactggctatgttattactgttcaatttatgttgttttgcaacttagaaaccagctacagtatggcccacttaataaaacacctgaaacaaatctcactggtcactggctttcatgggtgtgtgggttgtggaggtgtagtgtggccttcctgaggaccaaactgtgcatctctccccagccggctggggtctggactgtctaggacgcccctgaggacttaagtccgtgcaccttccctatctggtgcccaagactttcaaagctaattcagtcagccagtgaggaggaatgtgcaaaggttgttctcccaccgcagagggaggaaagctggccaagcttacaaagattgtcacttaatcgatgatactgggccatttcttgagaacggtaggagactgggtgggaacatagaacacaggtggccctgtctgccctctgttaacacatgcaggtgtgtgtgtgtgtgtgtgtgtgtgtgtgtgtgtgtgtgtggtgtagaagccctttctctagtgaagggtttgctctgtcaggtataacagtggaaaagccttgaccctagtaaccagctaaatttttcttttctt

SEQ ID NO: 32872 - DNA, 1168 bp, Mus musculus
ctcctatagcgttacctttcctgctattaaaaccactattgatacatttcttgaaagttttcatgttcctcagtcatcttggcattgatgttgttacatatttgtaataagcatttgtagatttttacctgaaattattctcaataagttctttcctctttgagagttattttagatttatttctaggttacatgtgcttgaaggtctgtccagtgcatttatttaagccatgagaatgggggaatagccaaggtgggcatgagcaaaggcttttattcaactcttttcacctcataaaggcaaagatttggatccagagtaatgaaatctcttgctaggatcacttgctgatagctgtgttttcgcctccttaactgagctttgaaagcttgcgttccctatcacctggcccacatgactatacactgtccctgggcttcttcatctcatccttcttagcccagcacatgtgccatgcagactgccacagctctctgcagcagtgtggttctactcactgtggtgatctgtcctacttatccatttctagaccaagaggatgctggtagagaagatgggtcgagaggccgtggagctggggcatggggaggtgaacatcaccggtgtggaagagaacactttgattgccagcctctgtgaccttctggagaggatctggagccatgggctacaagtgaagcaggtaatgggtctagcctttggtttcacttctagtctgggatgccagtggttctcaacctccccaatgctgtgactctttacacagttcctcatgtggtggtgaccctcaactataaattttttcattactacctcataactataattttgctactgttatgaattatgatgtaaatatctgatatatggggtagggtatcaacagctaagcgaatgtgagttcagctttttttttcttataaataaagtttatacatctatgttttttaaacctttgaaagtggcacctttttctaggaggcggtgcctcacacctttagtcccagcactgaggcaagaacaggtgggtctgtgagttcaaggacaccctagtctacagagatagttctaggacagttagggctaaacagagaacccctgtcttgaaaaacaagatcaaacaaacaaaatggcatctttcttggg

SEQ ID NO: 32873 - DNA, 1175 bp, Mus musculus
ttcatgtattgaatctgcagcatgattgagttactcttgcctgttatcagaagatgtagtgtcataggtctactggaatatagggtttaagctatggaatgaagagctaaccagccccctctttaaaggctttttcagaagaagaggtgtcatggtgtcaactgtgcactttgttccccaagcaccagagctctcactgcagatacactagagcaggcttcttgtcactgatcttgaatccccagcctttggaactgctctagacccagtctaggcttcttctgtatgtgccccagggcagttagctgagacatttgtaagaattacttcatctatttctaattcttagggactcctgtccttcactgcccaatggacaggatgttttcctgttagtgtatatttcagacaagagggtaaaaaaaaaaaatcagtctttttactctatcttggttagaagtgaaagaggagttatttcttaaaaaaaaaaaaaggttgacttgaattttttattttgaatctcagaaaaagcaattgaactacgtctggcaaaaattgaccatactgcagttcacccacatcttcttgacatgaaaattggacaaggaaaatatgaacctggctttttccctaagctgcagtctgatgtgctttgcaccgggccagccagcaacaagtaagtgaaccgtagagattccccaatgatcatcaggcactgttgtcactgacagccagagtctaagctagcgttggtgtacacggaagacctcgggggttttcttagtgttttattattttgtgtgcacgagtattttgtctgcatccatgcctgtgtaccacttgtatggctggaggccagaagaggacaaagatcttgagctggaatggcagatggttgtgagccgccatgtgagtacctagaattgaacttaggtcctctggatgaaaggctggtgctcttaaccactgaagccatctcagtatttaaagaatttaagaaacaagtatggataagacctaaactatgtaggtgtcagggtgtcttgtcagcttttgtctacactgtacacattgggtaactcttacaaattggatattcccgggacttgcaagcagccaggcagccgatgggttaaaatgacctatgtgaaccccatctaacagacagctatcta

SEQ ID NO: 32874 - DNA, 1200 bp, Mus musculus
atggagaatggatggacccagagaagctagcatttctggttggctatcatcacggccttttagttttggagggaatatcccttctgattgacactagtggcctccggcagtgatgacccatcagttctgttctgtattctgtctcttctttggcttgacagtaaaatcaaggataatccttttatactgagaagatgaattgttgcttctttctgttataaatgagagtagaatgtgaatagcaggtttagaaagaatactaaggtaggtgagaaaaaacagttgcttactctgcgagtcagaccagtatcatagaattcagtatagtttagtgcacaatgtgccaggcattgtttcaagggtggcagatagaagggatggacaaagtaaaaaaataatctttatgagtggagcttttattttaatgagaaaaaaggagttagtaaataagtaaaatatgtagatggaagatagttaaagatgttggggaaagaagatagaaggatgatatttggggaagaaaagttctggttgttttaaaagaaaagatttattttattattttaagtttgttaggtttgtgtgtatgtttgcgtgtgggtatgtgcacacaagtgtaggtgcctgcagagtctagaggcatcagattcccctggagctgggattatagacagttgtgaaccatctgatgtggtgggtgctgggaactgaagttggagcctctggaagagcagccaagtgcttttaaccactgagctaccatgccaccccaaattccagtttccagtagaatggtttactttattttatttatgaatttgtttatttatttatttgttttgtttttcgagagaaggtgtagccttggccattctggaactccctctatagaccaagatggccttgaatttacaaaggtctgcccgcctctgcttcctgagtgctgagtttcaaggcatatgctaccaccacccagaagtagagtaatttttaaaacgatttttcattttggataacaaatagggtctttttccctacaaagatttattttgtttttaaatatgtgtatgtttgtgtgagtgtgtatacatgtgcacaagtgccaatgaaagccagaggcttcagggtttttggagctggtgtgtagcgcttgtaagcatctgacatatatggtggaagtgaacacaggtcctgtggaag

SEQ ID NO: 32875 - DNA, 1227 bp, Mus musculus
ctgctttaagggaatactataaagtgcacacatgcatttctcacagccatgtagcttgggaaacccagctcaaagtggtttgtgcatagttttcttgtatctgcttgtagcagaaggacaaatgagctaactaatttaagcctcgtttattttggcattgatcctattaaagagagcagccctcctggcccagttacctctttttttttttttaagtttaaaaagggggggggggcggctgttaagggcactgactgcgtttctgaaggtcctgagttcaaatcccagcaaccacatggtggctcacaaccatccataatgagatctgatccctcttctggtgtgtgtgtctgaagacagctacagtgtacttatgatataataaataaataaatcttaaaaaaaaagatttatttattattatatgtaactacactgtagctgtcttcagacactccagaagaaggagtcagatctcattagagatggttgtgagctaccatgtggttgttgggatttgaactcgggaccttcggaagagcagtcaggtgctcttacccactgagccatcttaccagccctaaataaatcttaaaaagaaaaaaaaggtaatttcatgtagctgaccttttgctatggtgaccttgaacttctgatcctcctgcctatttcttccaagaactaggactcctaatcatctgttaatggtcccagttcttaatactgtcacattaacaacatcttattttggaggggatacagtgagactgtaacagaaatacaacatatgtagagataatcatctgctgaactgacaataatttgctaagccctatatgtctatatagtgttcaatgcctagtttggcgttgtccactttcccccatttctcatgttcgtgtgaagactgtttttttttcccttgcatttctgtcttttgaaaagtgctacacttgtgactctgtgtagaagaatgtgttttatgttggttgactgatctagcttggttggctttgctgcttggttatgagtgtgtggtgcacttagtcaagggcatcaactcagttactttccataaggacaatttttgtactggactcagctgaccatcctgctcacaagtacactgtagtcccagggaagtgagaaagtggggttaccagccttgttatcatagaaaatgaacagtgattcttaattgacatcatcagatgccatccatcctca

SEQ ID NO: 32876 - DNA, 1204 bp, Mus musculus
ttatgccggtgacacggccagcacgagccaccatggcccactctttccgcacaccgcatccgatttctctaaagggtgtcgcagtcgcgtggaggtggctgcagtcgcgggatcccagcagctgaccgctggccactctgtggtggctgctctggaagcccaggcccccggggcccaaagagcatcacgtcatcctttgcgcccgacgaccgcccctccccgaccgcgcgtgcgcacgcggtggcggcgggtggggggccgcggtggggcgggcggccgctctccgcccttcctcaggcttgctcaggccgcggtgcagaggacagcgtccaggatgcggcgcggggtggcccggcgcccccctgccccggcacggcagcggcggccgctaggacccggcgaggcccgggggcggcggccggagcctcggtagcggcggcggagggagcggcggctgagggcgggcgggcggccgggggcgggggctcggctccgcgcggcttgccccgctcggcccggagccatgagcggcggcggcggcggagggggctcggcgcccagtcgcttcgccgactattttgtcatctgcgggctggacaccgagaccgggctggagccggacgagctgtcgggtgagtgcgcgcgagcccgggctagggcccgcggggcccgctttgtcccgggagcccagtgagggtcgggcgagcagacgggacgcgggtcccgcgggcctgctgccccccgcgcggtggtcgccgcgtcggcaacctggggagacgcggacgctgggtgcgctcagaggtcgaggggcttagtccacaatgaagggaagcttgccttctagcacccttttgggaggaaagaagttagcccacttcctagtgagagttagtcccacccagacttttcaaaagagcaaaacaaaaacttgatgagtttatttggcctcttcccaagaagccggcgagaccagttcctcaaaaccgttataactcactcctgagcaggccaggcccgggcttttccttcacagttctgcccctcttgatcggacgtgaagtgacaaattgaaccgggttacaccaagaacgggttctctcttggcgctagaaaagaacttgtacccagggccatgcttttgttgttgttgttgttgttgtttgttttttaagttaatgtcctttaccaggcgagggtcatttgt

SEQ ID NO: 32877 - DNA, 1191 bp, Mus musculus
ggttttttggtagtatgtatgtctgtgccacatgtgtgtacctgatatccttcaagaccagaaaaacagcattacattccatagaactggaattacaaattggtgttagctacagtgttgtgagttgaatcccagggtcctctggaagaatagccagcattcttaacatctgagccatttagaacactttgagacagggtttctccgtgttgccctggctgtcctggaactcactctgtagaccaggctggcctcaaactcagaaatccacctgtctctgccacccgagtgctgggattaaaggcgtgcaccaccatgctcggctagaacacttacttttttaatcattaaagtaaatttttacacagggtgtggtggtgcacgcccttaatcccagccagggctgcacggagaaatcccgtcttgaaaaaccaaaataaataaataaataaataaataaacaaacaaacttttgctagcctttgtgttgcccattcacttttggtcactagtgaatgtggtgtcaaaaaaggcataaataaatgctttgcggcctttcctgtccctggagtttggtatcttgggtgtacgagctgcataagtaacagtaaaaataaataaataaaatagatttttgcttaggcatggcagttgaacaactgggctgctgaaaaaagagggttgtaagttgaagagtttctggtcatcctggattaaaaagtaaaattttgtctcagaaaaaaaaaatctgttagctatggcttcatttgattgtcattttggagattaagtgatgcctttttagattaggataaaactttattttgtgtgttatatatctctgcagtgcatgcatacatatgttccacagcacctgtgtggagttagaagtacacaattgagtgcctgtaatgtgggattgcaagggaagattttattttagtctgtaggttcatgctgttttatctgagaaataagtcagtttggtattggtgaatatctatgagtccttgaatgattgcacaatcagttactttcattactatgaagtttatttatactttttcgtttttttgggaaacagggtttcatgtagttcaggctgtcctcaaacttgattgatactagttaaggacagccttgtgctgatcttttataagactaatgtttttttggttttttggttttttt

SEQ ID NO: 32878 - DNA, 1101 bp, Mus musculus
cccccctggattgtaggaaaaaggtgattatgagcctccatgtaggtgctaataattgaacacaggttctctggaagaacagccagtgatactaacctgatccatctctatattttaaaattgtttttattgtacatgtatgaatgcaccacatgtgtgcagtattcttggaggccagaagaggtttgtgatcctctgaaactgcagctaacggatggttgtggagctgaaactcctcgtttccctgccttaacttgagtgcagagactgcatgcaccaccacacttggtttttgagatggtagggatcaaacttagagctggaagtaaagatgttagctactggacccagcataatacaatcaatcattcaaaggattcaggttttatgaacaatataccccagtaatcccagaaggctaaggaaggaggatgatgcgtctaaataaatacaagtctgttcgtctgcagaaatttaaagtctttgtttatttgttttaggcacacaagtctctgaatttcgtttcaacactgctccagattactatgtcagaacaactggatttacctgtgagacaggcaggcaagtttcttgaattatttccttgagtgtccaaacaaaatactgattaaaaggtttgttatggtccttgagtaatctccagtaagaatccacttacttttggtgtttatagcaacagcaggtaccttgatatttggtagtagggcttacatgaaaacaatttgagatttatttactttaattttacaagtgtgggtgttaaatatccgtgcattgtgtgttccattgcggtcaggataacagggtatgggatctggaactggactcacagttgaggtgctgttgtgggtcctgataactgaacccagatcctctgaagcagcacttgggggtcttagctgctgagccatctttctagctataaagtgaaaattggatactttttttttttcaaaaagctttatgtgtatggatgtttttacctgggtatgtatctgctgaggccagtaaagggcaccacatcctcttgaacagcagttaagatggttccgagctatcatgtggatgctgggaattgaa

SEQ ID NO: 32879 - DNA, 1121 bp, Mus musculus
ctttttggttttttgaaaagggtcttgttggtagatctggtaacctggtagtccaggctagccttaaaccctaaacttcccgagaagtatgagttacagtctttgactatacaggtgtttgtgtagttggtattttctatagtgaaagctaaaaagtgttttaaaactagggtcttgtatacctcagacaggcatcaaatacaaggtctctaacaccagcttgctgagattacatgtctgtgcagtcaggcttggaagactattgggtttcttttaaattggtctgaagaggtagtttgttgcggagtgaattgtattgaattatctgtattttatgtgtatccagtttcctgaaggattatttgaaattagattttgtggaaacaacccattttcctttgtttgacttagatgagagttgtctaggttaagattccttttccttactgtggggctttgactttcagggtacagcttactacgtgcatccatcatatcatcaaacatgactatccaagccgctggactgccattgtggacaagattggcttttatcttcagtctgataacagtgcttgttggctgggaatccttctttgcctttatcagcttgtgaaaaattatgagtaagtgtccttcctaattccagttaaatttttgagttgtgggaatataaattgcttttggtataactaaatgacgtcagtttaatattgaagtaggtttttttttgttttgttttgttttgttttttttccttttctttttgagatagggtttctctgtgtagccctggctgtcctggaactcactctgtagaccaggctggcctcaaactcagatatctgcctgtctctgcctcccaagtgctgggtttaaaggtgtgcaccaccactgcctggtggagtaggatttttattctgaatatttcttactaatcacactaattttgtgtgtgcatatatgtgttcaagtggtccattgtacatacagaggctagaagacaagctaggaacatctccctatacctgtaccatgcaggtgtctaaagttcagacttctggcaaggacatccacctgttgagccctcacacaggctcagcatacttattctaatcctg

SEQ ID NO: 32880 - DNA, 1135 bp, Mus musculus
taatttttctactttgtagaatactagcttagtataatatattttttgtttgtttgtttttgagacagggttttctctgtatagccctggctgtcctggaatatattattattttaagatatattggcttcagtatttatctatctatttatttgtttattattttaagatttatttattataagtacactgtaacttgcttcagacacaccagaagagggcatcagatttcattacagatggttgtaagtcaccatgtggttgatgggatttgaactcatgacctcttgaagagcagtcagtgctcttagcctctgagccatctccagctcaaggcttaagttctatattttttgttaattcaaaatgtcattcttttaatgattttgttcttatttatactttatttaaatgcttaggttctttgcttttatgatagcttatccttacctggtgcaattcttcctacagtgtagtttctcaatattattaaataaatgtctctttaaaggaaacacttcaagttgaagaagatgatagacctgagttaccctggtggaaatgtaagaagtgggccttacatattttagcaagactttttgaaaggtatgctcctgttcatgcatagtaacttaaatttatttttgctgcttttgctattatgaatataaatataaagcattataaggaaataatggccacattcttgttcatatagatatggaagccctgggaatgtttctaaggagtataatgagtttgctgaagtctttctgaaggcctttgctgttggtgtccagcaagtgagtctaacattgtttaagtatagacctgacactttgaagtttttgatttaaaagttttatgttcataggtgttatgcatgtatgtacgtacaccacttgagcacgtcaggcacctttggtttataagagcaaaattacaatcatgaaatagcaataataattttgtggctgggggtcataacaacatgagtaactgatttagagggtcactcaaatacgaagatttgagaaccactgccttacagactagaagaaaatgttacaaattgtgtgccaacacgtgagtactgggaatcaaaccaggcctaagggaagtagcattgccctta

SEQ ID NO: 32881 - DNA, 1099 bp, Mus musculus
tgaaatatttttatgtcttgtaagaaatgactgaaagttaaaacttggcttaaacatattaagacttttttctgtaagtctttgtctggctgctatactgagtcctgtgtgcatagttttcatctatgtctggtagcagtatctgtctgcgttttgcattcagatcttgctatccacacaaacgaatgcagccaaagaataagttgggatcatagtactggcctagtgttgtgtttttttaacacatctcccactggccagcctccaaattcccagacacaaaaattttgaaagagcttagttggggaagtctattgtaatgtcttcagatacacacacacacacacacacacacacacacacacacgcgcgcacacatgcacacatccttacttccgtcctcttttttaaggcttgctgggttcttcactatttttgtgaagtgaagttcaaaagtgatcaaaatctccaaacagctttagagctgacaagaagatgtctgattgatgatcgagaaatgcctgtgaaagtggaagctgccattgcactacaggtgttgatcagcaatcaagaaaaaggtatgtcacagacacctttacacacaactgttaaatggaattgtagaaactagcttaatagactctgtgaaaacaccttggtttttgttgtttctatacccaacgtaatagctgtttgataatgctccccctttgtattacagctaaagagtacatcactccatttatcagacctgtcatgcaggctcttcttcatattataagagaaacagaaaatgatgatcttacaaatgtaattcagaaaatgatctgtgaatatagtgaagaagttactcctattgctgtagaaatgacacaacatctggtatgttgtttgaacctgttattattggctagatgttgacttagttttctgtttgatccctatagtatgtcacaagtgacttgccttccctcaaagcaaatattccttgcaacttactgtgtaccatgtagtataaaccacttgactaatatttaactagtttatttctcacatggttctatattttatcgagagacattgtgaagtagaaaaggtg

SEQ ID NO: 32882 - DNA, 1099 bp, Mus musculus; identical to SEQ ID NO: 32881

SEQ ID NO: 32883 - DNA, 1486 bp, Mus musculus
tgtgatagaacttaatatttgttagcatgctagagtcctgaataagaattcctaatatgcatatattacaaactaaattgatagaaaaaaaatattgtagcacaaatgacatctaacctcattacaatcatattttacataatcatttaaatttgaaatataattgcatagttacacgtaagagtggggataatttttctgatttaaactctttcacaatttatattctgtgtccgccaggttcttactggagtcgcaggagaagatgcggaatgccatgcggcaaaattgttagaggtcattattctgcagtgcaaaggccggggcattgatcaggtcagtgggcctctttctgttccagcatttttgtctttttttttgttgtatttttaaatttttgatagtaagatagtagattaagctaattagaatgtaattgcaatcttgttagattttgtaatctctctttacagtgtataccattattcgtggaagcagctttagaaagactgaccagagaggttaaaacaagtgaactcagaacaatgtgcctgcaggttgcaattgcagcattgtattataatccacacctactgcttaatactttagaaaatcttcgcttcccaaataatgttgaacctgttacaaatcattttatcacacaatggcttaatgacgttgactgttttctggggtaagtaacgttaaattgtaacttcatgaggtgctgtaagtaaacacaatagataaaagtaaattaccatttttatttattgttttaggcttcatgacaggaagatgtgtgttcttggcctatgcgcccttattgatatggaacaaataccacaggttttaaatcaggtttcaggacagattttgccagcttttatccttttatttaatggattgaaaagagcatatgcctgccatgcagaacacgagaatgacagtgacgatgatgaggatgcggaagatgatgatgaaactggtaggtgaattatgttatacggaaacatcctaggaccctcatagccaaaggctccctgattcattcataggaaaccagggatagtagcccagtgactgataaacacttcttgttttctcccatttaaggtcagcgtacccataatggtggttgtggttgctaaacttgaaaattttatgtccttctcatgggagatattatttagcaatattgaagtaaattgattggaagcgctgagtttatttaggtgaaagagtctcagaaagctgggcagtggtgctgctcacctttaatcccagaacttgggagtcagaggcagacggatttatgaattccaggccagcctggtctacagaatgagttctgggaccacctaggctacataaaaaggagtttcagaaaaagccaatgtagtggcacacacatttattacaggagtatgggcttcaaatggaaaacagaaaattagaaagacaattgggttatatctcaggttgc

SEQ ID NO: 32884 - DNA, 1045 bp, Mus musculus
tgttctcttttctctctgggtttttggtttttcgagacagggtttctctgtatagccctggctgtcctggaactcactctgtagaccaggctggcctcgaactcagaaatccgcctgcctctgcctcccaagtgctgggattaaaggtgtgcgccaccaccacccggcctctctgggtttttaaaggtgggttttctataaagctctgtcttgaaatgaactatgtagaccaacaacattctactattttattgcccgttgaattttagttagggttcatggacacctgtgagtggtattttattcctggaactgttctttctttttcccaatatttataatttactaagagttttgagttaattgtcactttgctgagtagcagaacatttcattgtcatgaacaacttaattggcagaagaactggggagtgatgaagatgatattgatgaagatggacaagaatatttggagatcctggctaaacaagctggtgaggatggagatgatgaagattgggaagaagatgatgctgaggagactgctctggaaggctattccacaatcatcgatgatgaagacaaccctgttgatgagtatcaaatctttaaagctatatttcaaagtaagtcactttcatatagatagagccatttaactgaataaatttattcttgtgtctgtcccttagacaagaagtgaagcaaagtatttgttcgctttgaggtataggaattctttccacctattttggagaacgcagcttcctatgtcttttctttgtagccctggctatccttgaattcactctgtagaccaggctggtctttaacgcagataccagtaattttttaaccccctccccagtgttgtgatgaaatgcatgtgtcaacatttccctggcagtttagattattttaattgaaaaaataattaaaaacaaaatcctgttaaccatgccattgtgtgcacacaggggtcagaggactcagtccttccctaccgcctaggttctgggaatgaggaacccagggccctgcagga

SEQ ID NO: 32885 - DNA, 2059 bp, Mus musculus
accaaacaaacaaacaaaaaaaagtaaagtcttttttgcctttaaacattaaatcaaaattggctaagaactctgtatatacatcttagggagtgtatgtgtcagttaaactctccttgtaaatgtattgtcagttttttccacagaagttgatgatcagttgaccattaatgtttcaccccccccccctttttttttctagagtccaaaatgattgaaaagcatggaggatacaaattcagtgcaccagttgtgccaagttctttcaattttggaggcccagcaccggggatgaattgagtttccactttctttcctgctgtgtgagtgtagtgaagagcttgtgttcctcctagtagtggttccagatccggttcatgttaactactaactgatcaatagaaggacagaaaccccaggaggtgggagctgatcatgtaacctggcactggacgagaaactagagggatttggggaggggttaacttggggggctattttctttattttttgaagaaagtaagatcctgactctgaagcttcaagagacactgtggaaatctgaaatgaggggatgtcatgaaggcagcttttctttttctgaggaaaaaaataggcatgggctacaggactatttaaaatgtctcatttacagtataaagttcaaaggtagatgtaatttttacacctctaagtatttgtcctatttctgtctgttccttaccattgggtatcctttatatgtaaatatgataaggtaatcgatagccttattcggtctttatcattttcattcaccagattgttcctatgtagattggacatttattgtagcactacataactgattttaaaatctgtaaatgaattagcactttcatattgaaacaagcctgctagcctatgtataaaagcaaaactgtttgctgtttataaaaagggatgtaatggggtggggggcaggggtaatttcaggtttaattattaatttaaaaatgaactagcaattttgtatctggtgactttgtggtgcactcacctctggtagtgacttgaattcggtatgtaaaaaggggttagtgatgtttcattgctgctaaaaatggcaactctctctgtgtccttttttgttcctaaagctctcagtgtacaagtggacatttggatacaagaccttatgtaacaaacagaggtgatatctgaagcatgtaaattggatataaaattctactcttaaagagttgatctagagtatggctaaacatctatatatgcaatctattaaaagaacttaattcggcaattatgtcttgatctgattgcaatttattcctaattaatccttacccccattaacctgtttttatcttgtaccagatagagtgcaaaatgtatttataagattaatacctgcccattcccctctcctcatttctcctcccctgtcttgattatggtatcttatcctaactctgaagactgaaggcacatggttccctctaaaaaccactattgataccactgcagaaataagccagcaacaacagggcagcggggtgggcttctcccctctcttcctaaatgcatgttcaaagatgagaccttattgatcttaaacatctgtcagatgagtcatacattggattattttttatatacatgtatacacaatatttcaaattgaaagcaacatctcagtggattcaaaactactacatactgttgtctaaaacaaaatttataattgtacaaatgaaatgcacatattgatatttaaaatgcataattaagaaaaccctttgtgttgtgtttttcttgtgtactaagccctgatgctggcactgtttagctttccattttgcctctggaggaatcaaagtatttctcaatactaaaatgtttgcaaaaggaaagcaatctctaattgtgtgggtgcaaattgttaaccaagtgtgcttctactcctgtctcatagttacgacaccaagtgtataccctaggttgcttaagggaatgtcactattctataaaatcagtacaataaaaatggagttaggaa

SEQ ID NO: 32886 - DNA, 1314 bp, Mus musculus
ataatcggtactcaaatgtcatttgaaggatctcaggacttagaatatacatccttttatggtttttgagagtgtggctgtctggccttgtatttgctatgtagagggcaattgatgacatgatcttgacctaatccacccacaactcctatcaaaccctggcaagaaaggtacatgacaccactactttgttttggtactcttggacctttctacctccacatggccagtaatgggattatagataggcatgtgccaccatctctggttctgaacagtattattattttttgcttttttttccagatggggtttctctgtagccctggctgtcctggaactcactctgtagaccaggctggccttgaactcagaaatccgcctacctctgcctcctgagtgctgggattaaaggcgtgcgcaagcactgcccggccagtatgaatattgttatgaacaatggttaaacattcctagtgcaaatgccaccaccatcttgttcatgggtttaatcctcaaggacacaaaacacttggacccttaaaaattagaatatgggtctccaaggtgaacagcctctggcatgttggaacaatgtagcaggagatgtcagaaaagttaccacagggataactggcttgtggcggctttttgatccttcgatgtcggctcttcctatcgttaagcagaattcaccaagcgttggattgttcacccactaataaggaacgtgagctgggtgagctgagtttagaccgtcgtgagacagataaggaggtcggccagttcctcctgccttctgcaagagggttcccagactgccctttgagaataaaatgggaggccacaaccaaagtcttttggataaagcaccaccatggactatgcactagcactaacccgtttgcctgccttccttcccaaggcatagatcttacccagcatgggaaagatcctccctccctccccccttccaccatgcactcaataaaataaaatgaatgaacgaaaaaaaaattagggcatgacactggaattttaaaaaagattttatttaatgcttcagtgctctaactgtatatactgtatatatacagcatgccagaagagggcatcagatcctattaccaccatgtggttgctggttattgaattcaggatctctgtaaccactgttatttctccaaccacagatggcattttatgatcaaaacattaaatcatttttaagtttagtaaatcctatacctcagggtactcaagctgttaggtgttgtgattttatatattctatatatagtaaccgttttaaca

SEQ ID NO: 32887 - DNA, 1122 bp, Mus musculus
tcaaatcccagcaaccacatggtggctcacaaccatctgtgatgagatctggcgccctcttctggtgtgtctgaagacagctgcagtttactcacatataataaataaataaataaatcttaaaaaaacatgatgaagatcttgagctttactctcttccctagcccagtgtcaagctcttgccagtattcttgaaatggcattgagagctctccacagtgcagggaaaaggatagaactagaaaatagcatcctaagcagacctaagaggacattataagtctatattcaacccctcctactatatattatttgtagtttcatcatcttcctagatttagcagcatattttctgaatagatgcttaaatgtggcattcaaaagtgtattacagaaaccatcatggtgtgcaatcttattttagctcatatcttaatttttttctcttttaaattttacagaactatagccatctaccgaaagcagatatttttgctcttgctctcacagtcgtatgtgctgctggtgctgaaccccttcccagaaatggagagcagtggcacgagatccggcagggtcggttacctcggatcccacaagtgctttcccaggaggtgacagagttgctgagagtgagtattgtacatgggaagtgctttattaactaaacctcagtattatactaaggaggttttttgtttctttgttttagtttttttccttttcttagacaggttctctatgtagctctggctgttctgcgagcttgctctatagaccaggctgggctctgcctccagagtgctgggattagaggagtatgtcatcatatgttgctctagtttgtaagcattactttgcttttgttttttaggtcatgattcatcctgacccagagagaaggccttcagcaatggagctggtgaagcattcagtgttgttgtctgcatctagaaagagcgcagagcagttacgaatagaattgaatgctgaaaaattcaaaaattctcttttgcagaagtaaggaggattttattattgttgttgattttactctacctttctcactgattctcagattttcatttagggttttgtcagactttgtaattttgtgtgaga

SEQ ID NO: 32888 - DNA, 1154 bp, Mus musculus
ttatgttcagttcctttttaaaaaattttaatcgtgttgctgtagaaatagttcaggaagagcacttggtgctcttgttctggtctcccctcccatcccctaactcccgaaccccaaagggtctcactgtgtggctctggttatcctgggactcactgtgtagaccacaccgtcctcagactcaaagagatccgcctgcctttgcctctcaagagctgggttaaaggttgcatcactgcacccaactacacttgttcttgcacaggaccagaggtggatcccagcacctgcagggtggctcacagacatttttaactctagtttcaggggttttgatgtcctctttagtaccagacaggcacgtgctgcatatacatacatcaggcaaaacgttcacatacataaaattaaaaaccttaaaactgtaataatttaaagaagatttttaggtctgtggtgtatgtgtgtctgagagtaggtatgtgcacgggagtttaggtacccatagagacaagagacatcagatcccacagtgctggagttacacatggttccaagccgcataatgtgactgctgggaactgaacgtgggtcctctgcaagagcagtttcaatcctaaccacagagacatctctctagcccacttctcacctccattttatttatttattttttgataaggactcttgtagccaaggttacccttgacctgatcctgctgcctcttcatcccaaatgctgggattacaggcaagcatcaccactcctggctaccaagttcagccttttctaattgggtagagatgtgttcatcagcgggagtagataccattagactaacaggaaagaagctttcaaacttgttttcaagaatattccttagaacaaatcgattacatcattcatcttggatgcaattctcttgtgttttctgatagttattaaaagattgtcaaccacgaagagacccttttatatatatatatataaagtaatgttttcccctggtttggcttggttttgaatttttgttcttatttgtgtgtgtgccccacagagacagaggacaacctctggagtcagtcttagccttccaccttgttggaaatagtctttgctcattgtggcatacaccaaactagttgacctgtac

SEQ ID NO: 32889 - DNA, 2166 bp, Mus musculus
agccccgccttggatgggaggtcagctgtctcctcccctccggcagcgcattcccttggccgattgcctggtctgttggcctctttgagtcaggtgtcatggcaagcctccgctgttggtgctctgatggacaagtcactagtcactgcccttgtggatggaatctggttggtgactcttcccagcttcagctaagatacttccctccctgaccaccacacacatggcatgcttcgtttgcattttctttctcctcacctcaaagcaagacttatcctggcccagcggctcaacttagttctttgggtgttctgtccccagctgctagtctgttgaaatcaatggtgattggatagtttggggggttacatgggcacagtggaagctgacagaatgtggactggtaagatgtaaagtgtcacaggatgatggccagccttgtggctttcactagaactatgtctctctgcttttccctccgaggatgacacagattgtggtttgtatgcttcttgtttgaggaatgatttcagccctaatctggtctgagacggagatgagtggttggaaagtaagccttaccacactagttggaatctgtaaccagcagtaactccatgcacagccaagaagctttacattataaacaggaaggtgacccatgtggcacagaagaggtgggactcagtagagagcagggacccccacgggcctggtccagccttgcctcagagcaggaaggaggccattccagacatgtgcaagtctacagatagatcccagcagtcctggcatctacataaggactggatagagttccattaatctctgccttttatgactggaaaacatttgccaatggaagtcttaccaatttttcttaagattttgggctgcttaataaaagtaattttatttaatgtttatagttgccttcatacagtttagatttgtgtgcaaagtatcactgtgtcacgaaccttcttagtggataacttgggtgtaggtttggacctggccattcactcaccatgtttccttgtcagtgcagccgggaatcagaccaaggggaccagggtctcccctgtgtcttgatgatgtctcctagagacctcagtgtccttggagagaaaagaaaaagaaactccaagaaggtactggccggtgtgaaatgtctggacggaagcaagggcctgggggtccaggggagactggggtaaagggatcgcccgggccgggctgacagaacctccctccttaaacctggactgtcttacagcacagccagaggcatggcccgcagctgccacggccctccttgtctggtctcaagcctgaatactgcatgctccctttgtatgggctgtgcagaaggcgtctgcagtctgtagtgtttgtttctgcttgcctcaccggcttcagtagcactgtggctgggaagtgaaagtcctttgtagacagtggatgagaagaccgcacagatgtgaactgtgtgactcccctttaggccaatgcgctgatacttgtgggtctctcctgatactcaaggtggtttcagctaagtgtctatagaccgtgcctcatctctgtaataactacaggaaacgttgggagtgtctgtctgtgtgttcactgtaatcagccctttcctccaacgagagatgagattatttgcaggaattatgaatgaaaagcatttgaaaatgttttgggatctactatattgagaatgaacaaaatatttataattttaaaacatttttatctacacatacaatgtaatatgctctacttcttgttttttttttgttttgtttttttgctaatttttctaaggtattaaaatgttttctatgggatttttggtttctatttttttagtaaagtggactcaataacaaaattaaacataccagaatttcatacattttaaactggttacattaataaaatggagtaaagtgtgtgtgtgtatgtgtgtgtgcacttgtgtgtgcgtgcctgcctgcatgtgtgcttttgctaatcttcattttcatacagtcatgtggatgtggtttagggatactcctgaaaacactgggtttgggagttaagacctcaagaagttagctgtgacctcatgtttggtgtgagtcacagctgtgggaagccttggtcagctca

SEQ ID NO: 32890 - DNA, 1199 bp, Mus musculus
tgaactaaccagggagccattggacaaactgagacacatgggacaggccagcacacaggggacaggccagctaaccagacagcactgcttgtgagaagaactgctcctaaggtctcccagttaccataaccttgtttgctccagcctcaaactcaaggatgcttctcatctgtggtgggcctgagcggccaccgctgccaccgggccctagcaacttggtcagtgtgtgtgttttgaaatgttaatatgttaaataccaaactaatatttcaaaatatgtatatatgatttctatatcctgatttttcagatagcctgcttataatttaaaataaaaataactaaactgattcataagattttagtaataaaaggttgtttcctttttaaataataaaaactactttgtagattaaaaataaatcaaattttcaaattaaaaattatcaacacactagaaaatagaactgtattaatatataagaaattgggaaataaaaatgaaggagttttttatcatattcattttataaatttgccacctgtgaaatggtttttgcacattacttgtattttctttgtatatgaaataatttttgtactttgtagactctggagcccactgtcctctcggctctttgaagctgtgcccactactgcttttgtaactggagtcttttaacttccatgacggcaccgcctgccgtatgttcactaaccacccagaattaaatttatttcttaagaaaaagaacctctgagtgctgtgatgtcaggttggctctgcactgtgcagtactcaggagcggcatggggccaaggctccatctaaactgtgaccatttgggcctcggaagcacagagatgctggggtgtggccgtgagcttctgggttctgatccagccctgcggcatctggggaaagtctcaggcgtcctctctgcacccctagtaagctgttccaggtgccaagctcctgcctctcctgggccaccgtttcccctggcgagtggcagattatattgatttcaggcagaagacactgaagtcttcctgggtcatagacttttttgggttgaggagttggtttctgcaggggatattgtccatcatctttggagtttacctcacacagctttaaggaatgctggtccttatgtcaggcaggagcttcagctgggggctcacaggcctcctca

SEQ ID NO: 32891 - DNA, 1228 bp, Mus musculus
tctctgatataacataaacttagttaatctttaatccaaacctttgggtctctgggagttcaaagacaggttgatctccatcaaattccaggctagtatttaataagcccatgactgtaaataaacaaacattactatatggtgttaatgaaatggttaaacttggtttgacatttgcacatcttgttgtcataccaaaccatttggttttgattttcaatccttttacttctctagcaatcccagtagcggcaggtgggtctctgtgagttcaaggccttcttcctgtgtatggcaagctccaggccaaacagagctacatgataagaccctagcacaaaaaaaaaaaaaaaaaaaaaaaagaatttaaatgaacttccaaattttatgatacatcttagccaatatgtttctgcatgtttaaattcagtgatattatgctatttacacttttacattatctcccccccccaccttgtttcttacccttcttctccccaaacactcttattccctctgccattcctaaagctatcctggccttttagtcatacctcaagctgtacaagacagtagtttaccaagagtagcccgctgctatcgacacaatcgcctgcccgtcgtatgttggaagaactcgagaagtggtactctgctcctccgatctggaggattccatgggaagggagttgttggtctattcaagtcacagaactcccctcaagccggtaagaatttctgtacagcacaactctcactggagtattcctaaaactcagccaggcaacaacagtccaaggcctgtggtctcaatcccttgggagactgaggcaggaccacttgatcccaggagtttagatgccattgtgagaccagagagacagtcttcccagaattaaagggactaaaacctgggctccagctgccactcccgacacttttgtcactgtccacatgcagagtgcacaaggctgggcttaagtgaagacagcagcaggcctgtgggacgtcacattgcactgccatcttactaccatagctcatcttctctggattttgatcaataacagttttggttctaggctgctttcattctggcaatcagaatatctgtccattgttggaattagattgtaccagtctttggtattttttctgaaaagtaatctagataatgtaacagctgtagagataaaaaaggggttttgtcttgtgtggcatgggcata

SEQ ID NO: 32892 - DNA, 1374 bp, Mus musculus
cgaggagatcacagccctgaccaaataggcccagcggtccacacacacttcactatttggtttaatgtcaggtctgctgggggtaatggtggccaagatctcaaactagggcttccgtctgtgatgaggacgcctctgaagaaatctcaagctcccaattttggttgcactttacgaacatgctcacttcgttagcatttctgagccagaggctggctccctcccgtggggatctgggagctggcactgtgtacacctgtccctgactgtccacgtctcccgtgattgccagtgctaatatggctggggctgagactttgcaaggcctaatgccaaaggacacaaggcctgtgtggtgtctgccacactcagcaggccctgtagtggttctcattttggcatctggctggctgcctgccttaaacccccaccaaagctccttttcataaaggggctaccttgagagaaaatacaaacgctctcctgttgatgatttgtgcattttaaaaaatgagtttctttccctcttagcacccctccttcctgtctggttaggaagcccaatgcaccctctgaggtcatcacttctgttctatgttattatctaggactcaacgagtcatctcaaaccatattctgtgaatccatctcatggtccactcctgggctgcggaaggtacaaggcgaggttatggggctgctcttcactttttgtttttaaatgaagacctctgaaaagcacagggcctctgctccttctggctctgatgtcctgtgactgtagtgtcaccacctcccctgggagtcagaccagggactcctcagggagtgaaatgtgcttcaggacacacaggactcgagccaagctcctgatccagtcacaccccacccccgactcccctgcctcctcctactgttttaggcttcacatattttaaatgtttgaaaaagagtcactaacaaagtggattttattttaaagcagatttcttcagaagctatcatggtcccagggactaggtagaatttttaagtctaacgtgaactttagctttatcagacatttttgttactagtgcctagaacatagtaggtgctcaataaatacacatggagtaattgaatgactttctcttttggcatctgtatgtgcagaatactcaacaatgttcaaagaccttcttaactattcagaaggcaggaagtcctacaccatagttagatgaacctaactgtacctggaagttgcccatttaactaattattctgtcctgtgactgtcatccttccagttgttgtgtagcgtatggaaccatgtcatccttttactaggcaaatacacatactatctcacatagatgattatgaaactga

SEQ ID NO: 32893 - DNA, 1522 bp, Mus musculus
aaaaaggaaaaacttgttttgcttggacttccctgacaggagtgatcgacacaggaactgccccatttgtcgcctacagatgactggagcaaatgaatcatgggtggtgtcagatgcacccactgaagatgacatggctaactatattcttaacatggctgatgaggcaggccagccccacaggccatgacttggggaagactttctgttgttattctgaactacaaatacactgttgtcgtagaggagaagggggggatattgtggcacacacagaaatatcagttttcccaccctcttatttttgctattctggtatgtcccgttcttaaataaactcccatgtcttccatgtatggtgggctacagtttgctactgtttagccatatttcccacagtccacctattctatgttgctcttgagccctttgctacagatagcagcaatacttgacactactgcttttcagggagggagggactgttctggcatctttttagtaggtttaagttttagagtgttgacagttgtagccatctgagataaatgactgaaactaatgtctcagttggaacctgaggtgtgtgtgctctgcccccttgtggttcattatggatccttcagtactgtggcccaattgcttcctgatgttatgtcacttttggccttgggttctggaactacttattctttatgttgccatgatgcagcacacggattaggactgtctggttggaactttgtctcgaaaatggactgtaccggagggatcttcatggctgctttagaaaggcatccccggacctggataggtgcccgttggattttttcataatgcccatgaagcttgagttttcagaaggatttttttcttttatagaaacacacattttatatttccagattccacagaggcatccagtcctgagccagacagcgtttattttaggtaaagacgcctttctgaggcttcggtttcctcaaatttctcagattaaaagaagaggacgatcaggtaaacctcctcaccaagcagttgtaaaaccctaaactccagaccttgattggctttcttcccatttctctgcactattcaggcatctagagagagaaccgtgacaggagtgcggcctcagtgacagccacagtggcttatggaggaagaacgttaatgctaacagtgcagcctataaaagtgctagtgcatgaaataagtcccctgtaagaaatgttagcgttccatagaagtcttctcacagatttttggcaagtttcaactgtccctgttttcctaagtatagatgtacacaattgaagttactgcttattgatttttgattcagattttaatgaatatttaaataaaatccctttcaaagaaaaagatctgacttgattcagattttaatgaatattcaaataaaatccctctcgggggaaaaaaaggtctgacttgattctgcccccaaatactgaagacatcaatagtccattcactgtaaggacagggcagtgacacc

SEQ ID NO: 32894 - DNA, 2657 bp, Mus musculus
ccctttcgggctgccgtggggccctgcacacacatggtacacaggcgcaaaacagcttgtacagtcgttttagaaggctgtgggaaagactcagataaataagttctgattctatttagatatatcctgaaccaaaacttaatttttactaaattataaatttaatttacaggtgaatcagtggctaacctggctagaaactgctgaagaagaagaatcagaggaagaagctgactaaagaaccagccaaagccttaaattgtgcaaaacatactgttgctatgatgtaactgcatttgacctaaccactgcgaaaattcattccgctgtaacgttttttcacaatatttaaagcagaagcacgtcagtaaggtttccttctgcataaggtttttgtagtgtgatgtcttaatcatagtctaccatcaaatactttaggagtatccttaatgtttagatagaatattagcagcatgcaataattacatcctaagttctcaagcagaggcagtctattgcaaggaccttctttgctgccagttaccataggctgttttaagttagaaaactgaatagcaacactgaatactgtagagatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaaaatccttgagcctgggcaagtgcacaagtctttttaaaagaaacatggtttacttgcacaaaactgatcagtttgagagatcattaatgcccttgaagtggtttttgtgggtgtgaaacaaatggtgagaatttgaattggtccctcttattatagtattgaaattaagtctacttaatttatcaagtcatgttcatgccctgattttatatacttgtatctatcaataaacattgtgatacttgatgtagttgtacatgacttcaaatagtatctgcaaagtaatgaagaattcatttggttttgaggtatggatttatctccgtttaagaacttgggaaatttttaatttcatagtcttaattagtagtgattgagcctataacaccccttaattcaagcattaattttttttcacctcagaactattccctatcaatctaatgcaaactgtcaacttaatctgacctttactattacagaccttgtgtcaactctttggctctgctttctaagcacctaaggaataagcttgtctcatccaccaacctctgctgagatacctgtttagcccttgatctccatttgttctttgcagcgaaacaaccagaacaagaaactgaaaaacaaaactgctgcatggtttagaacccagcagacttttaagtcatcctaaaattggctccctcttgctgcttttcatttttcttgcccttgcgtattcagttactttacctggaataatcagtggtcccctcaccctttaaccttcaggtgtgatataaatgtcaaagaactggcctttctctgctgggacagtgagaatgtttgtgtcaaagtctgctgcaaaagaaaaaattgtattttggcatggaatccagagaacagtagaccacagaaatagactgggtggtcaagtcctgtgtccctgtcaaatatctgttctcagatgtccccagctccactggtgaccagagtaggaacagataaactcttgctgcctcccagcagaaccgtagtctgctttggcggctcttgttttgaagatttgcagtagagtagaagaaactgggaagagttgaagtggatagctgaggaggcccatcccacatctcagcctagttttagtccactatccatttaccccaccccttggtgaaagcagatctccaaggagaataatgtagatgtgtcttcagccactgctgagtaggatgataaatttcagttttgtgagcttcaatcttaagagaattgcagtaatagaaattaagagcaattcaaaattaggtttaggatctaaaatgttctggataaaagattgtctttgaatctgaagcttgattgactgcatgataactgagttagggctaacagaactaactgaaatgatctgtgtataccccactcactagaaaaactagtaatgaataaatgcttggatagtgacctgggttttttcttcatttgttacaccacgtgatcctagcattgcattgcacaatgcctccaacccattatttggccttcacagtgtggtggttgtaatgttttgtatgtaatatatatgatatactatcttctatattaaataattactatataactttacgcacattgaaaactgagtaccttgaaagcagtctctaagactgactgactgctcatggcatgggtaaactccaaatccttgaggtgggtgttgtggatcagctgtagctctcaatgttaaggtaaaccaggatattacaaagctcttaccccaccttgtcttagagacagcctgacaagagtcctggtcaagaaatagcataatagcactgaagtcatatgtatggacttcacttttcacccctacattacttggaactgggtcagaaaaacaggacaaaaagccatccgccc

SEQ ID NO: 32895 - DNA, 1171 bp, Mus musculus
gaaaagccaggtaagatattgatagtgttagggccagccttaggtataataccttttgccctttattgtttttaaatgaagctgagttcttatgcttttttttccttagcatatttccatttgacagttgtttgaaattgagtaagatgcttatccttaagattagtaaaatcacatcactttattcaacagatatgttagatattcttccctgttccaccttttctgggcaaagcaatggcttggctcatccctttggtacttgattaccataatttttatctagactttctttctccctttctgaaataggggctaagccagctctaccataaccagagtcagggactcttatcccagctacaaggacagtcgaaggatatgccacctcggttttctaagaaaggacagcttaatgcagatgaggtacatttgcctacattacttctatgcagtagtttgtcagtgcagaagtctcttgcccgatgattataaaaagacgccaaagaggacttaaagctggaattctttttccttttattctctcctctactcttatgtcttcaacttcttttctacttttctctgctttttctctctggatgtccagcgtcctatgagcgaagattatgagatatgagggcaagtttctaagttatttatatagttatcatgagaaaatggtaaagatattgagtagaataaagggtttatctgcattgctgatattgggagacttgaacggtacaaacataaggtttgtgaagtgttttgtttttttttttttaatttcagtatctactctttaaagcaggtatttttcccataagttaaaattcattatgtgacatgaaataacttttagtttttggagaattatatcactgccataatagatttgtatagaattagttgtgggttattgaaagtgtttatagttgtgttcattagttctgttaacttggttgtatgttgatttgttttcaattttagattagtttgaggcctgctcagtcgtttctaatgaataaaaatcaggtgccaaagcttcagccccagataactatgattcctcccagtgcacagccaccacgcactcaaacaccgcctctgggacaggtatgggcccccaaagtgtagtacgcttctcagtgtccctgaaggtgggtga

SEQ ID NO: 32896 - DNA, 1099 bp, Mus musculus
ggtctgtgtggaatttgcttgttaagcattttagtattaagtctcaaggtttggtgcctgggccagcagttttggcattgcctgggaatatatatattcagaagtggaaatttttgggtactaccccaaacctactagaacagaaattgggaatgggccttcgagtctgttttaagataccatctggacaattctgatgctgtttgaaaaaatttttaggattgttttgttgtggggggggaagtaaagcctttggtttggtggctccttttcccctctgtttagcggttttagggttttatggtatttgttgtgagtggatgctgtgttcaagttttttcataattgtaagccacttcatcaatgttttattaaactagcgagttcctggggaaaaccccagggcaaaacgctcagaaatggattcctgcacgaagcactagacgagatgacaactccgcagcaaacaactccgcaaatgaaaaagaacgacatgatgcaatcttcaggaaagtaagagggtaagtgccaaagtctgttctgagggaagtggtggtgaactatattctagtatgtgaattgaaaaattcaggcatgattttggcaagattcactaggcatccattacattgtagtggattcaaatatcaacaatattttaaagaatcttaaacagaagtatagcctactggtatttgacagcaaggtttatttgtttacaacctacaagttggaagtgatggcatttccattgttggtttagtgtgtaactcagtgacatgggtaatataaccatcttaactcatggtcacttccatataatgaaaacctactgctcttgagtatttagagaagtttcttgtgaaacagcgggaaagcccaaatacaattcagatgttgtaactgagaagtgattccagcatctctggatgaaaactgaacacttctataataccatgcacaagatttgcataagctcaagccagacaaaagccctactcctagccaagaagctactagcaaatacatgctgctgggagagggatccccccccccccccaccggagagtatcagttgatatgtcagccacactccaag

SEQ ID NO: 32897 - DNA, 1187 bp, Mus musculus
taggactctgtcttacttctacctcccaagtactaagagtgcaggtaaacaccattcctgtccttttttttttttttggattttggtttttggtttttggtttttagtttttggtttttggtttttggtttttggtttttggagacagggtttctctgtgtagccctggctgtcctggaactcactctgtagaccaggctggcctcaaactcagaaatctgcctgcctctgcctcccaagtgctgggattaaaggcatgcgccaccactgcccagccactgttcctgtcttaagactccattttttcaaagagtagggactatactttgggcttttcatactatatagcaccttttataccaggctctttgtgtaacttgaacaattacctgttttatcttagagaaatagagtatactagccaggcctttaatctataaaaatccccaaatttgctgtcttagttgggatttctattgctgtgatgaaaccgcatgaccaaaaggcactgttcatcattaaaggaagtcaggtcagaaattcaaaacagggcaggaacctggaggcagggactgatgcagaggccatggaggaatactgcttactggcttgctcagcctgcttttttatagaacccagaggtggcaccacccacaatgaactgggctctcctgctgatccctatttaagaaaatgccatacagccagccattttctcaactgagactgtctccttgcagatgactctagctgtgtcaagttaacataaaactcaccagtacatttgcttttgtttttatcaagtgaaagggatgattatcacatgaaggtccttagctaggacccttcaactgcacagctgctgggtcttcgctgctatgcctctcccctactgttcctctcatccaggaaatcctgttggggagatgtcattgttggaatttttaagcttagtttttaaattctattctccttgaatcatgatttttaagacttatataaagaaatatcctttcctccctgcccaaagtatgtaaaggagaatagtgatctgaataaaaaaaaaatagaataaaaataaacttgaacaataggactttagcccaaggcttttctttgctacctgaaacagtgtttaaaatttagtccattcttacccagagcacttcatatgtgttaggttattc

SEQ ID NO: 32898 - DNA, 1339 bp, Mus musculus
tctatcaattattgttttgctttgtttgtttgttggatacagtgtcttgtatttgcccttagctggccttgaactcatctcataatccaggctagcctgtgacaattgtcctgcctctattctccaactactgagatcagatgcctggtcaaatttattcataatgtcacagatattataatatgctgtatactgtcttttattggtaagatgtgcttatgaagaataagaatgctactaacatagtgcggagtgtaactctgtcatttactgtttaggtgtttgttgaaagctctgagacagtggatcaccaggcagcctttacagactcccacttgtggaaactcctggatcgacatgcaaatacaatccggttatttgttttgctgcctgaacaatctccaggatcatattcgaaaaggacagcataccagaaagctggaggtgattctggtaatgtggacgatgattgtgaaagagtcaaaggacctgcagggaatttaaagtctgtggatgctattctagaagagagcactgaaaaactgaaaagcttgtcactgcagcagcagcagcaagatggggacaacggagacagcagcaaaagcactgagacaagtgactttgaaaatattgaatcccctctcaatgagaggggctcttccacctctgtggataatcgagaacttgaacagcacattcagacttctgacccagaaaactttcagtctgaggaacgctcggactcagatgtgaataatgaccggagtacaagttcggtagacagtgatattcttagctccagtcacagcagtgacactttgtgcaatgcagacagcgctcagattcctctggccaatggacttgactctcacagtatcacaagtagtagaagaactaaagcaaacgaggggaaaaaggagacctgggacacagctgaagaagactctgggactgacagtgaatatgacgagagtggcaagagcaggggggacatgcagtacatgtacttcaaagctgacccctacactgcggatgaaggctctggggaaggacacaaatgtatgtacttgagaggaaggctctttgaaacagtgtcagtgtgtttctcacttcagcgttgattagcaatccagtgcttagctctaagaccaccttacatggactgtaagataattaaggtttctttcatttgcagtgcagtgctctaggcagtaattgcatcaagttaagtagaagagtatccaatattagggaagtctatggtaagaatgctaaggaatacttttaacatagcatacactctcactacttaagccaaacacttttagaagttttattt

SEQ ID NO: 32899 - DNA, 1299 bp, Mus musculus
gggccactgtcttgacttggaatcatgttgtgcactatggtcagatgtactgtaaagccaaggatgtgcaaagagaaacaagcaaagcctgctactatgaagggagggggacaagtagattcattgattgcggacaaatgtgcacatagccgctagtaaaactagcctcaaacaggatgctcatagcttaataataaaagctgtgcaaaggccatgaatgaatgaatcttctgtttatttcattgatacacacattacctcattgacagttctgaagcaaatgcaactgtgttgacttttgaaaagcagcaaagaggagctgaaggagttcttagagccagtgtagccctcagaggaattaggaaggtgtgttattttatttgacttttttgcaaagtattaagaaccttagggagacagcccaacatctgtttcctcgggccacgcccagtaggtgtgctcagctgctacaggtttgtgattagagccaactgtctgtaagctatggatgtagagaatgtctccctccttcactcgggccggccggcatgtaaatacagcggtcctgttgagttctcccagctgcagcttcgatgtctgccaaggttctttgcctctcattgtcatgtacatttgtgtacactaaagcttagcggtcggtctgtctgtgtactcctcggtaagactccataggatgtatttgctcgttaatgagggttctctgttcagtagcttcaagatcttttctctgtacatttattttccaaaaattgcttcaagtttgagtcttctagaatgcttgtaaagtcccgttttaattttaagagtcgatttgtagttctgtagtgtaactttgggaaccatctgcccatctatggaataaagtttctcgggggccttggcgtagactcggtgccacatgattcattgcagagcgtgctagcgtcagcaggcctcttctgctctgctaagtacagtttcaaagaatacgattctacataaactttgaaatactatctaatttataaaagtcaataaaaggttttggtaaaactttttcatgcaagatgctgtttacaacaatgaacatgccaataaaacatttgttcatgttgctgtgttatcttagtcattaacctcggggcacaataatggatctgggtacagaatggatttgtcgtctttaaatacagtgctgtgtaataagtactaagttactctgtgacgaagtatatttatagtgaagttctcagatcaaaagatgtatttaatctcctgactatctcagattcttaccct

SEQ ID NO: 32900 - DNA, 1193 bp, Mus musculus
ccgactgcttcaatacctctgaaagccagtgctcggagtgcagttcgtgtaaattaatttgcaggaagtatacttggctaattgtagggctaggattgtgaatgaaatttgcaaagtcgcttagcaacaatggaaagcctttctcagtcacaccgagaagtcacaaccaagccaggttgtgtagagtacagctgtgacatacagacagaagaaggctgggctggatgtcaggcctcagatgacggtttcaggtgccaggaactattaccattctgtatctatccagagttattaaaattgaaagttgcacacatttgtataagcatgcctttctcctgagttttaaattatatgtatacacaaacatgtggccctcaaagatcatgcacaaaccactactctttgctaattcttggacttttctctttgattttcaataaatacaaatccccttcatgcaaaaaaattaaaacaatctgtagtataaagagacaaaaaaattccatagaagcagattttccaggcatctgcagtttccctcttttagaatcggaattcgttggaactctcatccttgtctggatgggaattagctttaacagagaaactacttcaccctctcctgaaagaacaaatggaatatatgagtcttctcttggaggctctttccactcaaatgcagttctggggctgtgctagcattgatactgtaacaaaacggctgaagcaatgaacttatatatttaaaaagttaggttaattgggttcaccatttcaggtttcagtcctgatcccatggggttgaaactaaggagaggcagcacagcgtggcaagggaatgtggtagagtcaagctgctccctttctggctaacaggagagtgggcaatgtgcagtcttgtgagaatgcccaggtcctggggggaagggagtgccctggacatcaccttaaaggtggagacttctgcagctttggttttagttactcttctgggtgctacaatcaaacgcccaacaagaagccacctgagggatgagggtttattttggctcctggttcaagcagggagtccttcgtggcaggagtgcaaggttgcttcctgcagtgtggaggatcaggaagcaaagaaagagcaatgcaagactcagctttctctctttccctgattatttattctggaaccccaacccttg

SEQ ID NO: 32901 - DNA, 1109 bp, Mus musculus
aggctccctttctttaggatgcctggctctagggtgttccatagtgtcatctctcaggagatgtctagctagaactggcatttgtgaaggaaatgtctgggctttcctgataggcgccatagattcccaacattgcattcacccaagccttacactgggcctttctgtgtttccgcagacataatagtgagtaggggtccattgctcagcctgctgggtgagagcactggggaagtttttcttagatgtgaataacagcagaggcaactcgctttcctgggctctacagttttgaattccttgtcagtggatgttatgtgctcacaacccctggagtactggatctaggggagtctgtatctcaggagaagaagcaaagatctcatgttctgaaaggtttgaatgccagggtaagtctccccaactgctctgcctaaattcccaatttctacaggtgtttgattgtttgtttgtcttaaagtaatcattaaatttattcaacaaggacaataattccttggatgatggtcaggtggatgattaacggctggatagatggatgggcagatggatgtaaggatggacaaatagatgggtggtcagatgggtcgttggctaggtagatatgtgggaaaggatggatgagaaaataggtagatagatggatggatgggtgaatggcagatagactcctggaaaatggatggatggagactgcactgtcacagatgctagcaataagcagtcactgtctaaataaagcctattccaatcgtttaatactagagggaacaatcaagaaatgtcctccctgttggctgatctggagtagtctttctccatgattgttcatcttggtttgtatccttcctggtctaagctgttctggatgttgtctgatgttctggttgggactgaacagggagctcccagcatcccgtcatgtgttatgcaagcatttcataggtggaaaggctgtggcctcagtgcctcaagtggagggagcactctagcttgcactcttacctgggtatttggttctagctcatggggtctctggcctgtgcccacccacaagaaacatggccctctcttgcttgagcaaaaga

SEQ ID NO: 32902 - DNA, 1202 bp, Mus musculus
ctgttttcaaaaaccacaaagcaaggctagcaagaaggctcagcgggtgatggcatttgctgactggaacctacacagcagaaggagggagctgacgcatgaaagttgacctctgacctctacatgtctgccacagtcactcctgaaccgcagtcaataaacataaaaaagcaaatactaaagcagccagaaccaaaccactacaatgctgaactacagttctcacaagcatgccttatttaacaatgcaagatggaagtgcggggactgggggtgggataggaggaaagtgttcatgtctacaaatgttctgtgactctaaaactatgccaaaagaatattttaaaaagctaatatgaatgtactagttgtgctggctagttttatgtcaacttgacagaagcaaagtcatccgaaaggaaggaatctcaaatgagaaaatgtctccataagatcccgctgtacggtgttttcttagtgatatgggaagacccagccaattacgggtggtgctatccctgggctggtggtcttgggttctataagaaagcaggctgagcaagccatgatgagcaagctagtaagcagcaggcctctgtggcctctgcatcagctcctgtctctgggttcctcgctgtctgagttcctgtcctaacttccttccatgatgaacaatgtgtgaaccaaataaaccctttcctttccaagttgctttgggcatggtgtttcatcaaagcaatagaaaccctaagacactactgttgtagaaaaatataccctgcccatgggctaaagatagaaaggaagaaatccataattatatgggacacataggtttcctcccttatccgggaagatcatggtgacttgttttctagaggcatctgaacagaagacaatacaccaagatcatcacaaaaatcccacaacaagggcaatactcattatgatcccaagaagctaggcagaaagcccacagtccagggctgtgatgtcatggcccaacctcactgtcaacttgactggatttaaaatcaccatggagacacagttcctgggtgtttccagacaggtttaactgtgaaaggaagatccaccctaatgttgacagcaccaacctgtgctgcagggcccagactgaataaaaaggagaagggaaaatgggaagctgagctccagccttcacctctgctccctgcatc

SEQ ID NO: 32903 - DNA, 1171 bp, Mus musculus
cagaaatgtgatacggccagtcacactgtgcccagtgatgcttagctcgctgtcatttctctctcctttttattcataccagtaccctagcctatgggatgctactacccatattcagaagagtcttatcccttcttgggttaaatctcttgggaaacatcctcccagaaacattcagaaatgtgtctacagatgactctacatcccatcaagttaaggataaggatcagccatccctggggtcttaaaggagccctcactggcttggaactctctaagatcagcagggcctccaatcttccactcctcctctgctgcccaagtgctaggagtttaggtgtccatcaccataccctgtctacctgattaacagctatttccccctttaatagagaaccacagaggtaggagtggatataagagagagtgcaagctgttcattcttttgttaggcatagtagttcacatcctagcaccctgaaggcaaaggcattaagatcaagagttcaaggccagcctgggctacataaaaagttctagatctgtccgagctacttaatgaaaccttttgtagaaaagctggaatgaaagaagaaaaagaaaaagaggaagaagagaaagagctaggcgtggtggtctacttggcgaaggaggtacaaggccagcctgagctgtataagactcttgtttcaaaaacaatgaacaaatagaaaaccaaaaccaaaccaaacatacaaaactcccagagattcccatgtgtggttagatgtcacagttgggattgtcgctaccatattgtccctgtgtgtgagggtgtgaaggcactgcttaagagccactgtcttgggagagtggaaccctagtttagagtgcaggaaccaactggcagaggtattggtcttcctaataatagcacaggatccaggggaggactctgctccatagttccaagtgagaaaggcaagcaggctatctgtcacatgctgcaagcagggccagcaaggggaggactggtaggagcctgtgacagtatccagggtagggctgggaaggaatgctagataagaaggctagagaccggatgcccaggagggaaggctgctggaaggggggtgggggggtgggggggggtggagctgtgcttgaatcccagcaatgatggctagttggg

SEQ ID NO: 32904 - DNA, 1099 bp, Mus musculus
tttgctgtctgactttcctgtttctattctgttttagattttttcagtcatgagaaagtgcagctagcagaggtcagggaaagccccctcccttctacccccttgagccatttctgttcaaggtgccacagccctcttctggcacctctcctccatctctatcttgaagcatttctggatgccatgtgggttcatctatggagtttcagtatgtgttcttacagtgggtgtgggtgggtggagctggagagatggctgtgaagttaagagcgcttgctgctctcccaggagaggactggggttcttttcctactacccctgtctggcttgtaattccagttctaggggtttgatgccctcttctggtccctgcaagcacctgtgctcagctacatatacattaccatatgaacactcgtgtgcgctctcgagtgtgtgcacacatacccctgcatgtatacaagtacacacaatcacacatgcatatgtgcacacacacgtacatgaacacacacacacacacacacacacacacacacacacacaaacattaaaaaaaggaaaccccaccaagcccattatcacagtcacactagcaccttaataactgcttagcatcgctactcagagctccttgattgcctcataaaatgtttcctcttagttaaattgttcagatcagggttcaagcaagaccaacaggtcaggcctggtggctgtttcttcaaactctgtggggttgtggagatgcctgggtgggtaaagtgcttgccacacaatttccaggacctgagttctgatctttagaggccacataaagctggagaaagaggcagccccagtgcctggaaacccagcattcccacagcgatgtgagagcgggaggcaggagaacctgtaggtcacaggtcagccagcctggagcgtgcgtacaccagtgagcaagggagaaggtaaggatcttccgacccttgaactccctctgtgacgtgtgtgtgtgtgtgtgtgtgtgtgtgtgtgtgtgtgtgtgtgtgagagagagagagagagagagagagagagagagagagagagatcgcgccagagcgagctccagcgc

SEQ ID NO: 32905 - DNA, 1171 bp, Mus musculus
cccctgcctttgcttctctagtgctgggattacatgactggatatgcccagtgtccagtgctggagttgaacctagaccttgtgcatgctgtatgagtactctgcagaactacaccccaactccaatgttgcctccccctcccccccattttagaaacagaggaataggtccatggttcctctacctgatttgaggagctgagcggggaaggggagggatggggcaagagcttaaagagtctctgtccttgctctgagcacttgggtgtgttgcgtggtcattgaggtttgagaaccgtagggctggatagcattttagttttgcaagaggaggggctggtgagatggctcagcaggtaagagcacctgactgctcttcagaaggtcctgagttcaaatcccagcaaccacatggtggctcacaaccatccgtaacaagatctgattccctcttctggtgcatctgaagacagctacagtgtacttacatataataaataaataaatcttaaaaaaaaaaaaagatccagaggaacacagtggctcctgacctcatgtttctaacagagttgatttcgccattcagtctctctttacccgccagacacttgatcatggctcaggctttgaaatgcagtgaggaacataggtggaaagagataagataccttgggtggctgtcaagttaagagaagacttaactttgagggcagggacaggtttggccacatggtgagctggacgagaggtttgtaaattaatggcatttttgatggaacgatggccagaagagactttagagggtagagttgcttctgtttccaggcgcaacgcaggagagggcttgagggatgacagtgattaggccacatggctaagctggcccataagctctggagaagtggagcgggcctattacaactctgggagaatggggcctggacaggcagagcagaattgctggccaaaccatgaagggcccaagggaagttggaggctagtactttctctattgaaaattttattgagataattatagattcatgcaattgtaagaaatagtgcacaacgggttcctttgtgtgcactttgcccatttcccccagtggttagattttgtacagttgtgataacacagccaggatgttacatcagtgtagcccattcagct

SEQ ID NO: 32906 - DNA, 1201 bp, Mus musculus
tgtctcaagatctagatcaaaagcctcaagatcttgatcacaggtgtgcccgtcatctctggattgtagttcattccagatgtagtcaagttgactactgggaattgtatgctactcaaccgttactccagtctgagtgttcagtagcaaatgtgtagctaccatctggtcgtttgagttcgctgtttctggacccacaaacatgtgctatataatccctacaacatgaaattgcatgtagaaattgcaggatgcaccaagcaatcaagtgaattagtcagctggctcgcacaggcaaaatcctgaagctgcttttggtgtgtgggagattgacaaactcttaaaccatgtgggttacagtaagaaccaaatgaaacactctctgtgcagaagcaaatcacattgcaggttttaaaaaaaaaagatgtgaaaaacgtagcaaaaccgcacagtcaaaagatgttatgctaattttcacgataaaacctccaagtaggaaatctctctcttcttggaaaaggtactggaagtggtaatgtttgtgtgcatattgacttgagatgttgtagaggctctcctctgagtttaacagctacaacagccgtgatgactttcaggggacctcttagagtggacctgttgactgttggccttcccctacagaagaaggattggggtggtcattgtcccctcacctgagaccccagccttttgtgtgtgattttgggggtggtcagtgtccccttacctaagaccctagctgtttgtatgtgattctgctctgattgcatctagccccttggtcaggtgcctgcggatgtagtgtagaagatgaactggtgggcttggtctgtgtagctatgaggacgtcattatccccgctggagagggacttcatagtgcagtctctattcctccctgcatctcctgggtgtttttgttgacctggggttcctttttaaagctgtttcttagctttctgcaggggctggatggggcaaggctcactgtctggatccactatgtggatctgtgtgtgctccttacctcacttctctggagtggtgctggagggtgcaccgtgagctcagagttcacacttttgaattctccagattctattcagactaagctggcctgggttttgagtcattttaagggtggaaggacagaagccactgtctatatcacaagtctggct

SEQ ID NO: 32907 - DNA, 1200 bp, Mus musculus
ggagtttcttaaggggagtgacagtgtctctcccttactattactggaggtaaaaggacccagtgagccagttggtgggagctcagccccgtgtagtcagagaagggggtgaattggctgaggggtcatggtgacagctcatgaagggtgctgcctgccaccccatataaaatccttcatcagtgcagagccttgggacaaaggtctgaagaggaaaagtatgatggtggatgtgtcgtggtccagtttgaatgcggtatgctcaaggctttcgccttacaataatttccttcagtccttcagaccccgctgctgttagggaagaagagcaggctgttcacggcacccttatggttggttctatgtcacccccactctgttcacccacgggccatctagagctctggtctattagcactttgtcttgtgagaagaaaggcacagttgtatggccttccctcttatcccactcccaaagcgtcctccgtctcacccaaaccatgatctcagaggtttacaagtcagacgtgtcacggagctgtttggaagcagttgtctccattagtgatgagatcgaaacaccccaaaagagggctttggagtcggaacttggagggctattagacatgcttggcttgaggggggaagtgcaattacaggaagaatcagaacacaaagtagtgactgttcacagtcatagctgctcttcttccaaggggctgggggcagacgggcgaagccccttggtttgtttcggctatgggaatgtgagtgctgtcttcccagattaactctcttccttatcatcatggttcattgtgctgtggatgtccacgcatgaactgaaaccagtacaggcagtttcaaggtgacaggaatcgtattgcaagtcaggtgggaacagaaagtatagtgtctagtgtgtacagttttagctgcttctctttcagatattggctattggcggaggaaggactgaaggagagggagcatgtacagccctggttggtgagccctgttccttcctacctggcttgttttgctcctaccttggcgttgaggaaacggtggtacaactggtcatctgtgtactggactcatcaaacaccgacagagttactcaggaaaaagaacttacaacaagttatcttgtatttacactatactaggcattctagtgaactaggggtcatttaaagt

SEQ ID NO: 32908 - DNA, 1182 bp, Mus musculus
cctccctaacatttaccagagttgcagaaggctgcaggtgcgctcaccctggcaagccaagagattcggaggttctgtgcattttaatatcctgcaacgattatataattgtcgcgctttcaatgaagtcacgccagtggcctttaacaatggcctaaaagtgacactgagcaaggaatacacttccagggcactgtggcttctttagcaatggctttttgtcagcctctgctgtgactataaagcaggtacacgttttatatgctgcggaacaggaatgggaattcttttctgactctggccagggttctgccttccctgggtcttctggacacagagcagcccagatctctgatgtgaccaagttcccaaatgaaatgggtggaaaatcagtctctaagaacagaaaaggaaatgaaaataaactacccatgtgatgggtaggtctgtgacaggaaaacagttatttcttgatgttaacctgtgtggaaccacagtgtagctgactagatgtggtggagtgtacctctagtcccagctacttgggagtctgaggcctcaggatcttttgagccctggtgttcaagaccactggggtaatatagagacctcatggcagaataattaaagggagtaaggggctataactgaatcctgagtgtagccaatccacccgtgtctcttcaaggttcactgctattagggtgccctggtgggggtcgggaggaagcttcctttctggagtgtggagcagtagactgggctgtccctcagaaatgctgcccatgctggccccttgctaagtcagcagaaaggggtggcctcctgccagcacagaggcaggcaggcactgtctgctggggatgcacccagccatggccctcatcaaggcagagaatcagaagcgactctgggtgcaaatgagtaacagcgggagccagatgaaggagcgaagaggatgggggagccctgcttccctggaaacgggaagaaagggaattatcgaaactcaaaagacatttgactaccaaaagatctttaataatctggagtcactggagagttagaaatgaggtgactgccacaaagcccaagtcactgaacttgtaatgggaaggttcagagtctcccaatgcagacaccgcgctctccttccatctcaagtgctgaactggcctgttg

SEQ ID NO: 32909 - DNA, 1092 bp, Mus musculus
tctctcttgcctgggaaagctggggaccgctggccagcagcctccctgtagccatctgactcctctttaaagagcatttctgatttgacttacagcctactctttcccagggtttaaaaagatagtcccctcccccacctggttctttctcacaagcccccccctcccccccgcctcctcctcatccttttccagatagggtctgtctcctcgacactgtttctgctgtccgcctcatgctccatgctgtctgtcctatctcttccatctttagggacgaagcagatctggatctgttccagaaggtgcctcatactcaaacgaaaagagagcacagtctatcccgcttcatcttgaagggatgagaggtgtctggtccaggctcccagctatttagtcacaggacaagggtgagggcttctcttccatctttggcctcgcctgggtcgaagccatctttccttggtgctctgtgcttaagtgacccctgagaatgcatggacagagtcagttcggatcccctagagctgtctggggaaccacaagtagatgatggcgaggctgaagcaagcgccttttgtttcctcagaggacagttctccagccgcaggctctgagtcaaatttctatttaccatacatcccagcagcaatgtcctgtccacacaccagccaaaagaaaacccttggtgttaaaattcttcagaggacttttagatccaggtcttctttcggcttcgataccacagtggcgttagccatcatttttatacaaccacatgttattgaagtcacctgatggtcagttttacaaaccaggtacctgtaatttgtataattttgtatatgctctggcgtcccatggaagggtagaatacctgtgtgttggtgtcctcacctgtgacattaggatgcttgagttcctggcctcttctatgttgatgtttctgtggctaagccctgcacgtgtcatttctgaaaagccttaaatcttagagaagtcacatcgcagggtgtcagtgtgacaggctgcctgggaaccgtgagcccttttgtaagctggaagcatttctcttactactgttacttttca

SEQ ID NO: 32910 - DNA, 1153 bp, Mus musculus
ccttagtactaccttgtagccgccagccttttctcagcctgttctgggtgcccacttgctaattggccccgtatcagaagcaggacaagccaaaatccttctcatttgtgtttcaaaagcccgtttttaaatccagctctataggaagctgatgacttggtttcaaacaacctgaatcagaacccaagtcgattctttgaccatgctctcacgaacgtatccataccaaaactaaaggctgcacctccgcagcttgctatgaagagcgaattgtacttttcattgatgcctttttcaatccatgaccaaatacttagctatttgtgaatcttctgcactccagcttgaaagtgcctttggctcgagattccagcttagaaagtgccaccataataacgacaatttgtagagagaccaaaaatatttcgagatcaccataatgcctttggttaaccgggatgaataaccaaccgcaggcttgtattcatgagagcaccgagcaacgtgtggtccctgcctgctgtgagtctgcctgccaatggggaaccccaccaccactgtcctgtacagcagtgtggcagcggggagccctgcgaactcttgtgtctgtgtatgccgcctctcccggcatgtccaccaactcatcacccggctctgcatccctgggaaggaacttatgcgcaagcaccgaatcccggccagtgggcagacaccatggctctgccttcccccactgtgtccatgtccagactgtggagactcatccactggaacgacagtgtgcacttgcctgcctacacgtttggttgttggaagcctcgcattgagatgacagtgcagaacaaaaattaaaaatgggttcattagggtcattgcagttgaagtgtctctgggctgttttgctggctctggatgtccgaatgtgctgtgagggacttgcgaagagcacaccatttgcaactcggcattttcaaggacattctagccctcagccaactctttaaagtgtgtgtcagcttagagtaaaacctttttttttttaatctggaaaccccatactgtaaggagaaagaacaaaggaggcaaaaagaagccaagaaaaaaaaataggtgttttgttttgttttgtttttcttcctttgctgatgtaagt

SEQ ID NO: 32911 - DNA, 1636 bp, Mus musculus
ctacggacattttgtctcttctctctctgaaagaggtgggcagaatccacacatccatcatgttagaaaacctgtctatgagttttgtgtttttatttttcaaattaattgttttctgtgattagtttcaatgtgtaaaatagattattaactgcacttctttaaaaaaaagaacaaaaggatgtacatctcctgttacctccttgaaagaccaacttctctaggcctttttcagtgggcttatgacttcagacaagggaaaaaaaacagtaaaaacaaaaatagtacgtgcctgaaaaatgacaaaaaaaaatctttttgtaacatttaaaaaacctgaaaagcctttacttctttgatatgctcaaattttatgtaaattggtttttgccacgtgtgttccttcggattctaagcgacttcatggcttctctgttgtctcgtgtaaagtgtataggatgggcttgtggcgtaagcatttcatctggtcagtggctcttttgatactgtactgctgctgggactgggctggaacctgagcctctagagggtgactgggttcctcttgggggagattgtggagaagagggtgaggtggctcatgttttcttaaactgtttgcagaaactttcaaaaggcatttggctaaacctcccggcagtacagtattctcgtactcattaacgtttgtgtctaggtactggtacctttctgtttaaaaaaatgttctaagtgttggctttaaagtgaatttatctttagtatgatagttatatgaaaattatagggtttgtgtgcagagaatttttttataaagtgctttgtaaaaaaaaaaacaaaaaaacaaatgtattctagctttcgcggtacatatgtgtgataactttaatacccatgacagttaagtgcaattatttcatcactctaaaaatgctatttttgtgtcagttcctgcaggtgttttcatgtctttgcaaagtgacacattttgatgccttcttgataaagtggtagacattttgtagctttctagaaactttgtatccatacggtatcaatgaaaaataaagaaaatgaaagtgtgggtcagctttcttatctgcaacagtctgtgttgttgagaatgaaacctgcctttttttcccttaagttccttttctgttgttggggtggtaagtccacaccagccaattgcttgctcagtccctccttccattacgtgagtgttgggaattgagcttgggtcatcaggcttggcagccagtgcctccacccactgagtgcataatcagatgtgccctgtgtgtggcgggcaggggttagtatgtggtcagaagggggttggagctgtggctgtgtcctccgtgcctcatcactatagctttaggtatgccctgcggggtttcttaaacagccacaagtcagctgccgtgtctgtcttctgggctctgttaaaattgacaaaaatgggctcaccatgaatctcattggtagaatgcttgcctagcatacacacaggccttggggttctgactccagcccagaatacatgtggtgaagtgctccatgcccttgatcccagcatacaggaggtagagatgggaggatcaagaattcaaagccaacctcggccaca

SEQ ID NO: 32912 - DNA, 1181 bp, Mus musculus
gactttcagctagagatcattcccgcagggttgggctggaagtctcagctactgattttcttggtgaagaagggagtttgttgccattcctatttggccatccctaccttctggtaaaaggacatctgtactcatcgtgtacatagaaaagaggcccacagaagacctcggggaaggaacaatccatcaacaaatggactttttctcctcaaatgttcactaggccagatgtgttaggttttgtgtcagattttctttcatagatcctttcggttctcaggatgattttggggctcaacttgcagacttgtcaaggaagccttttgcttcctgctgccttctgcctggggccctggggcccatttttgtcattgtgagaatgttgcctggtttgggggacataggtgttgcttagcttctgggtatccttgctcccatttggaagggtccagtcacatcctttatagcccaggcacacctccagacctccctctatggggtcaacatgtgacaaaatgcatccagtttgctctaagataagcctgagctctgtctctgtctctgtacgtgtgtctcagtatgtgtgtgtatgtgtgtgtggtttggtccctgtgaaggctagaagtggggttcaggtctcctggacctgaagttatagggagttgtgagctgccctgtatggatgctgggaactgaacttgggtcctctggaagagcagtaaccagtcttccccctgggagcaggcccagggcaggcactgtggcctagagagtaatgccactgaacccaggaagacagtgaagctcggaaacagtttagcttcttgcccaaatcctctgagcagggactgggaagcacatagaagagcattctaagaggatgagaagcactgtctgtggatcaggagctcggcagcgaaggctgtctgagtctctcccactgccacaccagtacccaccagactgccgttgcctctcacgccgcatgtgccgagatttcctcccaactctcatttttcttgagttttgtaggaactgtcctgtctcctgcactctcaacatcgtatcttcagttccccccatgcttgttaaagatggctgcatactattctgtccatcgagaggatgtcttcagtgagctgggagcgtgtaatggagcaggttttagattgctttctcct

SEQ ID NO: 32913 - DNA, 1113 bp, Mus musculus
gctgctgtcctctctcttaaccccccagccaccctcttacctcctgtctgccttgcctccccaggctgtcttgcccttctccctatgcccgcccccacccgcagcacatttactgcagcagcccaacatccaatataatttaattgcttgcttcctttgcatgccgccctggcctgcctgtgtaccaaatgaagataaggggtggtgtccctgctccacaccagcacctctgtgaaggttcctggcacttagatgctttcagcaaatatttgttgagagttgaatgactgaacctggtccagcctgctaacagtgtcttcactgttacatacagggtcaccccaaagtgaggtttggtggccacatgcagtctgtatggggaagcttgtttcctctaacttgtcaccacagaagtcacctggttcatgcaggtgctcagcagtgtatagggtggggtgctggaaggttttgggggtgcttggataggatatgaggtaccttgctccttgagcatggggttgctgcattgcccagagccctctgtagcggtaattttaaaaaatgtaacccacccacactattgctggtaatgtacctgcgggccttgttctcatctcctgaagactgactcagagctccgaaatctctccacccaactcactaagttcccactggcaggtcactaccatgctagcccctcgcttccaaattcccactgcctttttggatgcacttcttgcaaacccacgctttaccactgtacctttctctctggaacccagttgagctgccgtgtgaaggaaaacaccacagaaacatagtggtaacagggcgtatcaactagcatcctaatttataagccattctaagttaaattctcgagtatcggatcctggcagattcaccatctaaaccaggggccacgtgtagctacatcatgtcctcctactgtccctgtccaaaagcgcatctctcctgcctcttctcttcctccctccaacctactcacctgcctactcacccagagattcctttctttattccttagaagtcctgagtacaggattcactcctcattcccggcagctcctctgaggaagctgaattagcatc

SEQ ID NO: 32914 - DNA, 1145 bp, Mus musculus
gatagaacaaataaatagatattgctaaggcccaggtaactgttacctgtgtagcctgccattttatgctgttacctatgttttaagaaaactttctcgtaagttattactgctgatactaagaaactttctcgtgcccaaggtgattgcatattgtgttatgctctgtgcccttggaaaccaatcactacagaagtcagttagagctgctttgtatagttagccacaataaacttggacccaaatcaagcacccagaagcacttcctgcacctgtgtgtgagcttttgtggtatttggctttataagctgctcctgggatggaacccaatgggtatgtaaggaaatggaccagaaattccttacagaacatttaaaatcatataagtagagcttacatttttttctcctctgagcttaggctggcctagcgacttgctttaaagaacagaatatggggaggaaaaaatgatgtcacagtggaaaagccaggcaagcaccaccataaccaggaggtaaggtcagcaccatcgtggccaagccatatggacaatgtatgtgctctaacggcagctacagacaaaactgcactcagccttggtgactgtcctcaaagctcatattgattgtaaaactatgagcaaaataacagaaagaaacaaactgaagagtagtctacccattaccaaccaatactccccagactaccaaaatcatgaaagcaagacttagaaactgtcaaagacgggagaagattatgaaaacacagtgacttaaacacacatgggatcatagagtggcttctagatcagaaaaagactgttagtgggaaaacggactaaatctagatcataccctcaattagttgcattaaactatgttattttcttatgatttgtgtgtgcacagtgagtgtataggccagagaatggcctcagatgtcatccctcaagtgtcatctgcctgttttttttaagacagtgtattgcagtgacctgacctggagcttgctaagtaggctaggctggctaggttgtgaccccagagataagctgtttccaccccaccagccctgggattacaaacatgtgacatctggcactttttatgtgggttcctgggatcaaatctaagtcctcagctgag

SEQ ID NO: 32915 - DNA, 1211 bp, Mus musculus
atacgtgtctttacactctgaagaagtttttctcatttgttttgtttatttgtttttgtctttctgtctgaaaggtaccacaatgtagtcttaaagaatcttatatctctatcttttatctctaccctgaatttgatttatgctcagaaactatcttttccccttttgtttttatttattaaataattgatgtgatacaacctaaaatttctgaattccagatataaaaattacactttttgaacatttgatgttacttacaattcacagacttgttaatagcctgacagtagattagcatctgtcttctcctgtcttgtcaagtctcttgctactttttactttcctaagggattacctcctgtcttcttttaaataaattcttagcaaactggttaactgttacttgcaagggtgccatcactggagtggtccagtcagctttcagtgtaaaaatctagggaatttctagctttcctatacgtatgtttctcccagcttactgtgtgcagcagttcctttgcggtgaaatatgctgcatgcttttcagctcccaaggcaatacagctgtgttccctctgcctagcactgttctgctattataagcctacagtgtggtacttgcatattagcatactagcttatgtacgtgagtgagagagatacactacagttagaaattactttttaaataaatcctgagtagccttctacattttttccaaatttcattcagatagttcactttctaagatcagctttgtcttcattcaagaaatcttgactagattaaattttaggaaaataggtctagtttttatcttccatgttgtataaattcaagttccgtaaagcttcctgtgactttcttttcatggccctttcagatttcagtaaatgaactcaaaggccacaatagagtcttctacttaattctaaaatgccacaaactttagattttttttattattgccagttcttcccagtactaagatatattactctgttgcacgacaagtcatcacatccataattccttaaagaaagttgtttttttaaatgtgtcacagtgcctgtaagtaaagaattctagaaagattggtgtgaatgactttggctaaaggtctttaagtcaaatggacctgaacactagagagagttgttaagggagagtaaggttgcgtagtagctaggcagctttctctcttcat

SEQ ID NO: 32916 - DNA, 2002 bp, Mus musculus
aaactgttgaatgagtttcaagtcatcatttctttgcatgttgttttagctttagaaagacatgcgttatagaaacaagtaatagcaaaaaattgatgtatatttattgattcaattccctttaaatcttactagtttgttactattttatccatatttttaatggcttgttcagcataacacagttataattaagctgatcaagttgtactacatttaaatcatcagcagtgtatcttgaaagtgcttaaagggttagttcatagtacaagaaattaaatgcaactttacattttaattttttgtcaattaaaatacaatgtagaagtttattttactattgtggacacaaaatgtaaaggaaaccaactttttccatactgatgtataatcttgaaaaggaaaaaaaaaaaaagcttctctgttgaagccagactttgtgtagtaaaacttttaaacattattttaaaagaaatatgtatataagtatctgtgtattctttggaatgattctgaagtctctggtctaggaccatgcctgtataaggtgtgagagaccatgatggtgtgtgagaatggaataaatgatgcctttgatttaaggtggcccatataatatacattgagtactccatgtctccaaatggatttccatgatgtaatgaaaacacactaacctttttatgatttttatacatctgccaaaatatactgagaatctgataaattgtctttgggtctctgaaaagaatcaggtgcaatgtgggcaggcctgtaaactgaaccagatatgtgtcttctattttattgctcttgtaatctaatgtaaagaattgctaactaaggctgtgctgaggaggtcaaattaatttttatttgtttagaattctgttgtcaaaagaaaggtaatgaataaatgatgctcatcctagaatgtataattttgaaattagtatggagtaaaatgtgagagcgttgagctttatcagctacacttgcattcaagtcatattgtaagagtttggagatgtatgctctttgtaatttgctacagtgtttttagttctgattatatttttcatatagattattcaataggacaactctgttaaataaattaatttcattcacctcatttggcaaaactgtattctgaaccatttagggtttttcccttatctttccttctctgaactctggcatacatatttgtacactgtaatgtcattgtaactgtttaattgccttggcaatgctaatgtatcgtaacacttagttgagaaaagcatgaccgggtcatatgttgtttgacttaagggtaacatagaataagtgtttctccagtctgccagacaaagcttggtagtgggaggggactctgacctctcccttttgtgtttgtctataggaattgattgggaaacttttgttttgtgttttttgtttgtttgtttgaagtgtaaactgatactcttttataagaagtaaatacaaacattattgggtgcctttgtttgtaaaccaaaaagtaataaatgaatccctatatttctattatagcatctattgtatttttacattgtggaaaccatccatgagttaaaatggctacgatggcaaaagtagtccttggatcttttttctttcttaggtgtcctcatctattctcatcatctttttatttatgtcttgagttgttcacacagcactttaggggaagcatataggcagaatgaacatttatttaaaagtatttttatatagtgattaataatgagacagatttttttttaatgtaaataaaaccgggagaccaccagcgtgttccaaggatgaatgacattatgttagtttataggttcttcaccagtagtagatctgacttcatttaaaggattattcattttcatagagattgagtgaagtacttggcgggggtgctgagagtgtgtcaggatggggttagagtgtaaatggctttgtaagcattcctttctaggct

SEQ ID NO: 32917 - DNA, 1930 bp, Mus musculus
acactgagaagtgagtgcatttcagtgcagcctgtccagaagggacctgcatgtgttgggagattactagtggtgatgctattcggatttctctgtcttacaggaaatttcaagagcaagaatgccctccttcaccagaaccaacccggaaagaaaaagacaagaaaggctgccattgtgtcattttctaagagtcccttgaggtttagctaacaactgccagggaagccctcatctctgctaccgtttacatcatccggtacctttgtagccttagaccgatgatcaccgtgttagccttacaccaagaagctggcaaatcctttatgtgaagctaatgtaacggtcttacccagacttgtgtaaaggaaacactaaggctgcttcagacgttatctgattcctttaaaacacatgtctacacacacagatgcagtcttcaagggcttttaatagaggtaaaccaagtttggagcctgagctgtttgctaagctgaagtcataggttggaaagtaatttttaacttctggaatcatgttgcctactgttactctaaatagaaatatagggaaggttttttttttgttgttgttgtttttttaaatgtgaatttttgcctatctttaaaactttggttgtcaactttcattaaccttaaatacactgaatggaatcaacacaagtgagacatctcagacctttcctgatgctacggcttttgtttttccagtggccaaaataccaaaatgcctgttgtatttatggattaaaaactgctgattaagcctttgttatcatgcttccttcaagatgacaatattctctgtggccaaatgtttggactggttctgcacttgggtgttttggtgaactcgctatcttttcacagccgtggtaagggtaagagtggatggttcctgtcttgtcttccttctcaagtattcctggttaagggattaaaaaagaaaacccacacaagctaaagctgtttttgtttgatgtaatataaaatatggaattgatctttccaaagtcagagatgattaatgtttttgctatatacttttatacgttattttcttatcaaactagttaacaagtatttttatatgtttgtaagcggatatgcttccaccttgtgtatatgtaaagatgagtatttaagtctcactgttcactgttaactgacaaagagaccatggcttttgcttgctggcttggtcctttttacatccactggtggccaataatcagaaaaccttcccaacagaacgcaacaggacgagagtgcgaagtcacgttcagtgtccccgctagatattgactgttatatcaagtattacgtgtaaaacctctacttgacaattagtgtaactgtggatggcttctgactttgtttttaactctgtggattgtgtttaagcaattcgaagtgcgctcctgattttgagactcagtggtattgcacagtggtcactttattgaatgtgtacaacagccccatgaagtttataaagtggacccttgtatagcttcaggtgctagaattaaagttgatctgttgtcaccagacgacgcttgacggctccttttttgtgccagggctttggtgagggaaatagacctggctggagtagcctgtgcctttcctgcaccgtgtctcagggagttctgcaggggatcttactgttccattgctttcttgaggtcagtgggttttaactttttttcctcaagtgttcttaacagagaagccccaggtgtagaggagagagggaggtgaatatattcacatagacccccagaggatgaatcctaaaatgtctttggcaaagagggccatgtatttatttaaatacaaacaaaatcacttaattttattgtgtttcaaaaatgtttacattattgtttttaagtttctggtaaaat

SEQ ID NO: 32918 - DNA, 1211 bp, Mus musculus
tatgccaaggaaaccatgagggtttcagatcccccagaactggagtaataagcagttaagacctatgtaggtgttgggaacagaacctgggtccctggaagagcagccagtgcccttgatcactgagccatctctccagccccagccccagtttcttgattgagcttacagacatcttttctgagatctgtacatggagaagataaataaccaagtgactttagagttgatttggttccatctgcttggatgtgtttgatatttttaaccttgtaattggtatgctaatatattctagctacaaaatcaatctgtgcgatgaagataaactctgaaactgtctgccattagaagattatgtctgcctctggtgctaggaatgaaatattaagacaggaatgcattgcctctcacatcaaataggaggctctgttgaggacctggtgggggctgcccttgtgagagatgatttataatgcgcaactacaccgtttgctttgttgtttttctttagttttggatacagccggacaagaggagtttggagccatgagagagcaatacatgaggacaggcgagggcttcctgttggtcttctcagtcacggatagaggcaggtcggtgcagttaatgtgtcggggacaatatgatcaaaaaaaaaaatcatcgtatgcacgtgtgaaagtgtcatatagaaaccaactattatatggaatcaatataatattgctaataaaaacctcaagttagcagtgctaggttctgtccagattgctattttatggaattaaaattttcattttttttacagtagaaaaatggcaatacagtaataaacaatataaaactcactacctttagtttcttagcataatgtatttattttgttttttagttttgaagaaatctataagtttcaaagacagattctcagagtaaaggaccgtgatgagtttcccatgattttaattggcaataaagctgacctggaccatcagagacaggtgaggaggaggcagttctgagctcgggaagctgtgtaaagaagcacttgatgaaagagtggaggacccgcgtccaagaaactcttgtgtggcgcgcgcgcgcgtgcgcgcacacacacacacacacacacacacacacacacacgtgcggtgcagcacagcaccagctcgctgctgagtctggcacactaggtcgcacagaatggc

SEQ ID NO: 32919 - DNA, 1138 bp, Mus musculus
ggagctgggccgcggtcccctgggcggtgggacaggggtctgcgccgcctgaggcctgaccctgcatagacagaggccggtgaggggcggccgggattcccacgggggacccgccacagccgaggagtcccaaggttctgcagcgtcttcgctcgcgggccgccctcctggagcagatccgactgtgttaggttggcaatcacggccccgtgacgtggtgctccgggttgtcactgtggtgtggacctcgactccacagctttgcacaccctgggtcggggagtggacgggtacggggactgagtgattgtcactagagttcacggaaggagaaggtggggagagctctacaggtcgtccgaagtcacacgcgaagaacttcaggcagtttagaagatcacgactgatttgcggaatttgtctcccttttttttttttttttctaatgatgtttgtattcatttttgtagattttcctggcacctttcgtccttttcatcttgtattgggttgattataaacagaaaccatgacggcagccgagaacgtgtgctatacgttaattaacgtgccaatggattcagaacccccttcggaaatcagcttaaaaaatgacctgggtaaatagtttcttaactcaaataggaattattttaattgatagattaaaaacgtaaaagatggacaaattaatatggtgttttttaatacatatctatatggtctgatatttaaatcctgtcaaatataattatctcaaacattcatcttttcttcatagtgaaaacatttcacattctttcatagagatttttttatttttttgagattttaaaaatatatatacagtatatagttattaattgtagtatacagtgtcatacctgaacttttttatcttgtactcagcagccattgaccaatccgcctctcccagccttccttccttcttactctcctaggctctgtgagccacggtcctttttttttctttttgttttcctttttccttcttaaataaagccttactctttccctaggtcagcctggaactcactaataggccagggcagcctccaacttatgtcaggtcttagttcagcctccaagggttacaggtgcaggccactattcacct

SEQ ID NO: 32920 - DNA, 1162 bp, Mus musculus
agagatattaataatgtttgaaagagacttcagttaatttgtattcttaccaaataagcaggctgtagactatggagcatttaatttttttttttttgtaaagttagtaactcctaagatggataatactgaaatttatatgggactcagaattaaatttagattggccaattatgaaatatagtactttctttagtctctgtaactatttaagtactgtgaaacagcaagtaagtcaaagatcataatttgataagaattgaccaataatattatttctgttttctagttaaaactttcctctagcattataaatgtgtatgtactaattacacatgcataatctgatattacagctacattaaacatctgattaatactttcgtcagatgttcccctccttggttgtggctgtgactcagtagtagagtgcttgcccagcatgcatgtggtatgggttctacctagcactataaaaaatgatttgctcttttagctgcctttctgtttctactctggttacttctagcatcaagtacaaataatgccacggaacctgccatgtaaaatgtctgataactggatccatttcactcgtgcctctatgtcataaatttattaagcttgttctctaataactatctctatttctttgtctctctaatctctttttagccaaagcagaataagtatgtttaacgtatgcataaaatataaagactaaagacaagtatcattgatctactatcatcttttattttttaaaaaagtttattatatatatatatatgtatatatacatatatatatatatatatatatatatatatatacacacacacacacacacatacatacatacatacacacacacactgtagttgtgagccttcatgtgcttgttgggaattggatctaggacctctgctcactgcagtcggcctggctccctcaggcccaaagacttattattataaataagcacactgtagctgtcttcagacgcactagagagggtggcgtcatacgggtggttgtgagccactatgtggttgctgggatttgaactcaggaccttcggaagagcagtcagtgctcttaccagctaagccatctcaccagccccaccttcttttattgtgaaggcatggtttgggtatgt

SEQ ID NO: 32921 - DNA, 1196 bp, Mus musculus
atttgttagttcacgcagcaaacagattttcaacatatatgtactatatactttgatattagcatttagataaaacataaaaaaatattttactgacttgaaataggtacagatccagaacaagagaaatttttttaggaaagtgtactgattttgtaaaatgataattgtggtaaaatatttagtatgagggtagaaaattcccagcctgtaacctgacagttacaggcagtctctggatgcccttaccttcagactctgcttcactctttgtccctgcatttccttttgacaggagcaattctggattattatttttgaggtggtgggtggccctcaaacaggggccatgcctatccactggatatggtctctatgggttctatctcgcccttgttgggtattttggctaatgtcctctctgttgggtcctgggaacctcttgggtccctggcatctggactttctagtggctatccctaggtccccctctcccactgctatatgcctcctttcaaattcctgaccctgatacttctcctttctctctcttatctgaacttgctccctttttccctcctcctcctgtctccctcccaggtccctctctccctctactttcaaagattattttcttcccccttctgagtaggactgtagcatcttcttgggtttcatatggtctgtgagttgtatcatgggtatttcaagctttgcttttttttttttttttttggctaatatccactaaccagtgagtacataccatgtgtgttcttttttgacttgggttatctcactcaggatagtttcaagatcccaaccatttgcctgcaaatttcataaagtcattatttttaatagctgagtagtactccattgtgtaaatgtaccacattttctatatccattcctctgttgagggacatttgggttctttccagcttctggctattataaataaggctgctatgaacatagtgaaattcaacacatttttagcataaagtagtctctaagtgtttgttgaatgaggtggaagctcgtggatgtttcttttaaaaggacccatccctgtgctagtagaaatttgtcagtttgcttaatgttgttacgaactttagtttttcaatattgaatattatgaattaagaaaaaatttcagtacattttgtcatgtggattgtcaagctttt

SEQ ID NO: 32922 - DNA, 1184 bp, Mus musculus
acaaggattttttttcttatgctttggtacataaaatgtctaaaatgaaaataatggattttagatttatagtcatttgaaaataagcttaattatataatatattaacaatgataatgaatatatcatcagcctcctgatgctaagatgtgtttgaagtcttgatatggcatttaacaatgagaagaaatagaagtcaagatgaaagaatatttgagaaaaccactacagaaatgatagctaactgttgttaatgtccattcttaagcattctcatttagatatggatttaaaaatatgtatgctcacacacataacatataatactaaatcaaaaaaatacttttactctgactatatgttaaaatgataacattttagatatattggtttgaagaaaatatatggcttaagttcaatgaaaaacaaatatctgtaaaaggtaaagttgtttttttttctcctttgtttagatcgatcaggaagtgtcactggatccaatgttagtagaagattatgattcattaatagaaaagatgaacaactggaattttcagatttttgagcttgtagaaaagatgggagaaaaatcaggaaggattctcagtcaggtttgttttcatatctctactttattactatattgttttcagaattgataaaagcaaaatctaaattttactggtttaagtacaagttcagaaatggcattgtcaataaatttatctttcaagtagccttcaaaacatacagttaaatgtacatgatacacatgtgttatatatcctatgctattattgacatttgtcatatataaatatatgtgaaaatcattaatttttgtataccaatgagatttaagctcagctaacatagtaataaaaatttactttttcttgactttggagatttgaaaggacttgaaagataatttagttctaactaataaaatgtgaatattattttttacctttcctacctagagcttgggtgaatatttcataaatgaactaagagttacagttctacttaataattctctataataattgaccttcctatataaagcaattttaattctgcaacatagctgctctgatcacatccaaagaccttctaggtctgtgtgatttggctgaaatgcagacatgtctttagacatctttaatctcaaacagtgatat

SEQ ID NO: 32923 - DNA, 1123 bp, Mus musculus
gaatgagaagagaactcatgctgaaggagcctggggtgctgttcccagggtcattacctaatgctcactgtactgattctcaactgaccattcccatgtgggcacgccttaatactgtgagaggatcctggctaccctggcagttctcactcctaagcactttcattacaaacaagaaactgattcttagagcttgctgcagttgactcatgctgcaaagccttcctcaaagccttcactggtgtgtaaatagtgtgtcataatgctgctttgctgggtagtgagctcttatttctcatgatgagggagggaaggctaaaactgaaaagtcaagtgacttcggtttttgaagtaaccatatttcttttatgaaaacaggattcatcttgtatttccaaatatatcttttatgtctttgtttgggggtggggtggtgcaagaaacagacctctatgcttaatacaaaaatgaattcatggtggcctttctgagtgatttctgctcgtggcagcacactgttcagtgtggttctcctggcttcatcgaggaaggactgaggacctttgttatacttagcaaaacccagatgcatcaatttctgatgctttttattgttgtgtataatctatttacttgttttatttctgcctaaagtattcaggtttgctgtggacatcagaggtctgaattctgttcttactgattttgttccatggttgaatttaaaagtatataataatgaaggagctttattctttattcaaatctgttcttattcttattctttctcaggataagtaattttaaacaattattataaatattgcatagatttgccagagaaaaaaacattgtcctgatattgatgttatcttttatgaaatgagcaccattttattttaattagagtcaagaaaaaggagctggccatcttttgccttaatggaaaatcaatgaaaccaatcccatcgaagatattgcctaaatatttagttatctttagatatatgtcttaggtgtctagtaaaattgacattttttattgttaatatctttctgcttcaagagtacatggcagagatgacacatcactatttagtaatattacagccccacagacaga

SEQ ID NO: 32924 - DNA, 2289 bp, Mus musculus
acatctcagacttcatggagttcaggacctgtggttagaagtagtttttagccctaaggttaatcagtcgtagtttggtgagcgatggccatgactcagctcaagcagtaagaagagcggcgacaaggaacaggtaaacactgctgggactggatgctccaaactctgtcttccttcaggtaagactggggtgctttcactttactaagaagggccacttgtgtctgactgggacaagagtccttgtgaatgggctcggaggtggcatcaaagtttactctagacttataaagccttgcttatttgtatttatatgggcatggttggcagttacagccctgtgttccgtggccagtaaacccaaacccatttgggtttttgaataccgctgggaatgtctaaggaaagtgatcacagcatttcccctaatggccttgtgattgtctgttctgataaccatgtttgggagaaacacttaaagctaattggtgcttctgagagcagcaatattcccatcatagtcccatgaggcagacacctccccagcctcaatgacagcctctctctctctctctctctctctctctctctctctctctctctctctctctctctctctctctcccccatccccctcccactgccccatcctgaatatcagtgtcactgctcagaagagatcctgcaacactgccacctgtgtgacccatcggctggcaggtctgctgagcagatcaggaggtgtggtgaaggacaactttgttcccaccaatgtgggctctgaagccttcggccgccgccgcagggaccttcaggcctgaacagataacagccccagaatgaaggtgacttccttgtacaactggtaggaaaatgaatgtccacatatctcagggatagaagacatactctgaaggtcacttggcctatgaatcagatcccatcttacagtttttttttaaaccttcccctagcctttccttctccctgcctgcctaccctgcctttctgctctcttctgtgatgctgtgctctagggccaagagatacagaacccatatattcatcactctaattgtgaccattctaccatatgggtttgaaagccaatgacattatcctagtagtatacactacaatgtaagagaagccataagtttaaggactgaattggttcactactggatatataaccattggatggtcatttaactctcactgagtctcaatttttccactttataaactagggacatcaacagaacctatctcttaatattaacagaaaactaaatggaataatgtcaagagcttgacaattaatacctaaactttgttctttttttttctcctaggttacacaataaagataaactctaattctattcatgtataattaaagttatgtataagaaaggctgatgaaagacacatatatttgcatccttcttagtattgaaaaacccttctccctttgacaggagctaaagctaagtgcagaataagttgcctattgtgcatcgtgttgtatgtgactctgtatccaataaacatgacagcatggttctggcttatctggtagcaaatatggtccccataaaccatcctgttgatgttgatgactctgctaaacctcaaggggatatgaaacactgcctcttgctcttctggggacacatggtaatgttgtgactcaatggaaccatatgcttaaagaactcttaatattgtcacttgtgaatgtaatcaaaattaaaaacaaatgtattttcaatatcctcaagtggagtctttgctgttacttatactgtgtttcacaagagagcttttgggggtctgtgagcactttgctgaagcaaaggcattgctgtcttagaagctgagtctctggttaacctcgtccatttattaaaatgctgtgtgtgtcaaagaagacaatgcacatttatttccagagagtgacccggttgccaaccatagagggtacctatgattcttcatttctcaggtttgcctttactcacccttgccttttctccccataaaagtccttttttttttttgtacctcttggcctacaacgacctttataagtgataacttgtttaaatggaaatcaaaggctaaccaatctagaatggtcatcagtgtcatccagactcatttttttttatgcgagacacctaaaagagtcttactcaaggtcctgagagagacatttgcacatttaacaagcatttgcttactgactgctatatatgtggccactattctagacactgggaattt

SEQ ID NO: 32925 - DNA, 1178 bp, Mus musculus
ctactgttccaccgagacagtttctatatctcaaatagaagtggtttccaggctctggaaaggaaagccctaggagagatttccataaagctgtttctctttggtgaacattttgagggaaaatggtgtggttgggaaaggctgtgttttgtgtattcctgagagattcttccccttatttccagagaggtcttctcttagatgctgtcagttgagcagattggcagccaagcagaggtgttcagagaggtttccaactaatgtagtcagaggagagttgccagagaagcagggctccttagataagtaaattgaaggatattttggggataaaaataaatcctttttgaaaatgaaagttggagagttgctgtatatacaaattgccctgttctgaacagttggccagggccaactctgcagaccaatgacataagcaagaagttctcgctttttttttttcccccttagcgcggccgactctgcaggtctgcgtggagccgcggttgcgggtctctattccgcaggatggggtttgtgaaagttgtcaagaataaggcctactttaaaagataccaagtgagatttcgaaggcggcgagagggtaaaactgactactatgctcgaaaacgattggtgatccaggacaagaataagtacaacacacccaaatataggatgatagttcgtgtaactaacagagatatcatctgccagattgcatatgcccgtatagaaggggatatgatcgtctgtgcagcatatgcacatgaacttccaaaatatggtgtgaaagttggcctgacaaattatgctgcagcctattgcactggcctgctgctggcccgcaggcttctgaataggtttggcatggacaagatctatgaaggccaagtggaggtgaatggaggtgaatacaatgtggaaagcattgacggtcagcctggtgccttcacttgctatctggatgcaggtcttgcccgaactacaactggcaataaagtttttggggccctgaagggagctgtggatggaggcttgtctatccctcatagtaccaaacgattccctggttatgactctgaaagcaaggagttcaatgcagaggtacatcggaagcacatcatgggtcagaatgtggcagactacatgcgctacctaatggaggaagatgaaga

SEQ ID NO: 32926 - DNA, 1195 bp, Mus musculus
tcaagtccaaggaaaaagtctctgaggtgtgggtggacgtgggaagggaaactgcggcttacatcacacgccagctcacctttcacgctctggggtgcatggaaaatagagacagggaggtctaggcaaagaccctgggcaggaggaagtgggctcggtggtggtagcggtggggagggctccattgcctgcttactagaagtctctccccactgtgctctgctcggtggtcatgagtcagaaatagtacatttaaaagaaattaagcagtttctcccatcctgttgcccttttgaatctcacagttgttattcaagtgaggcagggagtggtggctacctccattccgatttacaaaagttcaagtaagactgacaaaggtagacaacaggaagcacagggccaaagtgggagccccgtgcttgtcctctctgtcctctctcgtccacttagatcccttctcccctccacgattcaaaagcagcagtagtggccacagtgtgcggccctagcacaaggcagccagcacaaggcagccagcgacttactttgctagatccagtcctgatagttacgtgaggctgtgtggggagaggggcctctggatgatttgacccacagacccttcttttctcaggagaagctcttgattaagagacgggctactctgaaaacagaccccccagatcctgccctctcctctctgggactcaagtcttgcttccaccctgtaactgacaatgaattcagctgccctgggaacaggctgggactgaacccagcgtctcagagccacagtcagctctgactggagcatggcagagaaggggaaaaccttgacccagtcttctctgaagagtgtgactcattcctttcccttacagtctaacttcagtctgtctcctgggtaggagcagagaggattaaggcttgaaagggtggaatcaaacccccaccccacccccattcccatcccgtgtactttccctctgcttttactaggatatcactgacatggtgggccagtactgaccagagtgccagctgggagctgcagctttcctgccaatcggttccaacctgaatttgaagctttggagctgcaaggcagtctggatacctaagtgattcacactggggctctgtgggacaccatgtgctgtgcaacagcggcccctggtggacaagagctcta

SEQ ID NO: 32927 - DNA, 1192 bp, Mus musculus
ctatttcctctgttatgcaaatggcatgtttcaaccatgggatgtataaccctcaaccctaattccagaaggagaagacaacagaatagacctgaacttgacttacaacctggaacacaggaatagaagatgacctgttctcactgatatgtaacacaagctgggaaatgaatacttgttgctgtaagtcacagagtctttgaggttgttatgcaacacaataccaccttgtttaccagttctgaatgtgtcagctttgctgcagtcacaaagcaccccaagctagcttacaagcacaaacatttatttctcagtcctggatctacaggctagctgtggctctgtttgctttgcttggccaaatgtcttcttagtctgtgacctgagttgaaggaacagcttctgttggggctatggtgttcccatagaagacccaggagtaaaagaggcttcatcacacccacacaggtgcacttaaatcttccaaaggtagggctatgccacgtagttttatattctatcgcctggtgatgggtcagggacatctactttgtctactgagaggccatgggagtcctaggcagaggtgggaacagacagttggaagcagtgcaatgtagccacaggagacttttacttgtagaattcttctacctgtagcatttctctttccattccaggatgactgagtaggtatacagtacttaaaaagcttgggagttgtaggtcaaattagattaatttcactcactatagactttttgttttgctttttgtttttttgagacagggtttctctgtatagccctgtctgtcctggaattcactttgtagaccaggctggcttcgaactcagaaatctgcctgcctctgccacccgagtgctgtaattaaaggcgtgcgccaccacgcccagccattatagacttttaaactgtttctttcagtgcaggttccagccaaggcttcaatggcaacaagaaagagtgtacagaaaagttaactattagaagggggctggttccaggaagatgcattctagagagagtcaaaaacttctcaccttggaaacacgttcataatgttgtcacttttccaggactctaaaaggaaatggctagggcagatgcccttttttcatttttctttttcctcctcttccttctcttcttcttcctcttcctcctcctcc

SEQ ID NO: 32928 - DNA, 1165 bp, Mus musculus
tgaagcgctgtaagcaaggcagactgtatgatgcggtggtctctgcttacatttctccaccacagacagtgtctaaagatattagatcacagacaagatggtatgcttgtgtttctctcatcgagctctgctttacctggaatttccttggtacacaaccaggatatttcttcatggactcttcctgactagttctgttgctttgcatacccctactgcattccaccttcctcaaaggatcattgggtctatcttcttattttgagacaactgtattcttagtttgagtgtacagttagtgtcagatcactcaattctccatttttctagtttgaatgcatttggaaaataatctttagtgcattgatcttgtagttttttttaaaaatcattttgttaagtcatttgccattttcattatgttgattgcttttaaggggagtgaatagagaaaaaatgcttttattccatgtgtgctggtcagctttctgttactggagtaaacttataaagactagaggctggctttggtttaggttcttgtccctgatctggactcagtgggatgtggtgctaactcacatggcaggattgtgtggtagagcacactgcttgcttcatcaagtcagagaatgaaggtggaaagggaaaatggctggggtcccacatacctctcagagctgcccccgtgactctaggatctcccacaggcatctccttctaaagatccataaccacttcccagctgcaccaccctggagacccagcttggaacaggtaagcttagtaagcttgactcaagtgccatctttagctagtgtaatggctcctactgtaaaaagatttgtaggctgtgcatagtaggacacattcttaattccagcatttgatagcaagtggcaggcaaatctttgtggtttgaggatagcctggtctacagagttagtttcaaggccctgccttaaaagcaagcaagcaagcaagcaagcaagcaagcaagcaagcaagcaagcaagcaagcaaacaaacaaataaaaatctgacaaaaccaaaacaactgcaaaggatttatgaatgtgtttgctacactttccaggtcaaacatttcctagactttattgcctatcatgtattaagccttgctcagtgaactataagtaactat

SEQ ID NO: 32929 - DNA, 2206 bp, Mus musculus
gctgcctggtgcagagtaaatgcgaacatacaaaggttgcatggtaaatacttgggattttagtttgtgtctattaactgagaagcaaagacaggcaccaagaagcattaccaggccacccttagatgaccttgcatgctctgagcagaattgctcatttttgttctctctgttcagaaacaaatactcttgtttatcggaggtttttaggtcacttggagaaaaccttcagagtgatcattagccgtttaatttagaagcttggctcctaagttatcattaatgtgtgtgttggctactgtgttgtttagtaggtgacaactgtgctacagaaactgtccacacaatgcaatatgaagtcagtcagttagagacctcagccctgaatagaagagcctctgttttgtgggtctttttgtgtaatcaaatgtttttgttgatttgactgaatcataaccaaagtacaatggacacgcaggggaagaagacaagaaaattaatgaagagctggagtctcagtaccagcagagcatggacagcaaactgtcaggacggtaccggcggcactgcggcctcggcttcagtgaggtgagactgctcacgactggggcatgagcgctttccatttggtatttgggttgccagagcatccgagaaccctgagagagagagttagttttctttctttctttttttttttttcttcaagacagggtttcactgtgtatccctggctgtcctagaactcactctgtagaccaggctagcctcaaactcagaaatccgcctgcctctgcctcctaagtgctgggactaaaggcatgcgccaccactgcctggcgagagagtgctttcttgtcagctacttaaaatactcttacagcacatctctgtcactacagaatcaggaaatgttcttaagaagttaaaatgagttttctaatgttggcttagggtaaattttacttaaccttggcagacctttaacagatacgaataaatgctcataagataaaagtctttcatgtaagtttaaaactggtctctaataagtaccaatgtgtaataatgactggtgtagtgtgaatgactgacagatgctgttccaggaagagaaaagcaggaaatgtcgtcagtcgagaggagggagacagcgaagtgctcctgggaggctttccttaaagcctggagtggctgtcctcagtctttccctcagcagccaggaatcttaatttgcctatgaaatactaatactacctaatactatgaagtggacggtttggggtgtttaagataggatctcactatgtaaaccctgctggaacttgaactcctagagatccacctgcctctgcctcctgagttaagtgggctgtttttaagatagacaaaaattaggaccaatcccagttcccagtttctgtactggccagtggtgcttctctctcttccctcataggcctttggttgatgttttaggtagaagatcatgatggagaaggtgatgtggctggagatgacgatgaggacgactcccctgatgctgagagtccagatgactcggacagtgactctgagtctgagaaggaggagtctgcagaagagcttcatgctgctgagcatcctgacgacacagaagacccgaagagcaaaaaagatgcgaagagcaattataagatgatgtttgtcaagtccagtggctcctaactaccaaacacttagtctttgtattaaaagtaagccttattgttataatgcacagtggaggactgcttatagagcacagacctttgtattataatttttaaaaaggcccttttaaataactacaaagagtgtttgctttcaaatgccatgggttacatttctccaggcatgactataaccatttttgtaaagagtccgagttgtataaaatgagaaataaatgctgtactcagcttcccttcatgttagcatcatctgccctctcccccgtttgcctctgcaggtgcattatgggggatacttgccttgtttgtggcagctccttcatcttcatcttttggtttgttcctattttgctcttacataattcatctgatactgtgacgtgttcccttggttatactttgttaaagtagacctgtccgtcatggagttggctgccaccagccctgctgcagaccatcactgacagtccatgcttgtttagtctttgctcgtg

SEQ ID NO: 32930 - DNA, 1174 bp, Mus musculus
cacagctgatgaccccagccctgacctcttgttccacacctttctttgctcttgctctcttccctgaatcagaaactacaggcaagctaggcctcatggatctgcccccaggaccaggctattagttgtggggcagtcggaccaggccacacagtcttgccaggcagggcaaatggtggtgtgggtgggcagatcactctaacacactgcttgattcctgtgtgctctgtctagtgcagcagctggccctcctcccgcctaaagcccccctgtcctccaggacggtgccaccttacccccccttaagcaacggactgcactacacctttgtctaacaccttccaagtaagagcccccgcctagctggcctgctgctgtgcgccctgtagtctcagcatgcccctcctgccttcccactgccactgagttgactgcaatgccgcctgctgttgcttccttccattggcactgcggccgctggagggtggggtggagaacctgccagagatggtagacagaagttcacctttaaggaactcaggtctcagggctcaaaagaggtcgacatcaaaggtgctactgtgctgaaataccttgggggagtttccagccctttatctctattagatgatgtcggcttttggagggttcatgctgcagaactgtacagttgaggtacaagaaaagaactgaagaaaaaaaaaaacccacaacttctcatattttaagcccatttaggattttgtgctgggctgccctcacagctagctgccctgggccgtgggcatatcttctagggtactagctgcacttaccgaaggcagcttgatgccccccaaaacagcacaggccacgttgtcagtgtccagggaaagaagagttagatctcattctttcagggttttatcatagagaccggcttacagcccagagttacagagacaggcagaccctgagggactgggctcagccctccacacagcaaggctgccttagggaagagacagaggcaggtccaggagcacaacccatcaggatgcttggtacgaccccatgaagtgaatggctgacaaggacaggcaagtatggcggatttctgagtttgagaccagcctggtctacagagtgagttccaagacagccagggctatatagagaaaccctgtcttgaaaa

SEQ ID NO: 32931 - DNA, 2106 bp, Mus musculus
gttatccttggctaagtagtgaacttaaggccagcctaggctgcgaccctgcactagaagcaggaagaagcagggcctctcgctccatctcctctgtgtctcgcctcctcctcagagacccaagagtgccttggagcgtctgtactcgggggaccaccagcggggcaagatgagtgcggaggaacagctggagcggatgaagcggcaccagaaggctctggtccgagagcgcaagaggaccctgagccaaggagaaaagacgggtctgctctcagcccgatacctcagccagccactgccaggagatctcggctcagtatgttaggcggggctgggacagaggccagaacttccccgagtcccccaagcagacgcaagtcccctgccagggtgacttacttggttgaccgtcccaaggggctgcttgtccacaactccagccgcacgtgtgagctggccagaggatgaccgggaaacaaagcagtagggaggtctagcagcagaggcctcatcctttctccacgctgagtgggaggaggctctgggctcaacgaaggacttgagaatgtaggattccagtagagcagatgggaaggaacggtatgatatgcaactcaaccacacagcctcccaagcagatcccgcagccaggggaggcaactcaataaggtgctggtggtctcccacagcccgcggggctgaggcctcaggtactcaggagggctggggaaattggtgctgcccctggtggctggcgctgcacctgcccacggttgccttaggctcattgtggggacattgcatttggctttggggtttggagcccccagttccccagccctctagcctgactgctccctccctaattcattgcacaagctcctacgcttctagtgtctgcgctcattgcctctaatcctgcctgattgtctctacagacgctctgaattggtactggcccctctctaaccagccagtgctgtctctgaccaggcttgtactagcagctcttggctccctagactagcaggcatccctaggtgttgcttaccttcccactgccctgctttgtgtaggccagctgactgataattcacccatccaaaaagctgctctgtgaggaccacggtcattagcagtggtctgggcattggggatttaccgattccatccatgccttaccctggacagtaaatatcagctttagagagtgcgtagtctgaagccatttggtggtaactcctcctatcccatcatgcaattccttattgcttttgtaattcttatctagtaacttgaatagatagcaaaataaactgtattcagagggcctctctgcagctgttagtcaccaaatgactagaatagtgtctttaaaagctataaacccattaacttttaagtattataagtaaacatcagaaccctgactttctacaacctgctgtctgggatacagagagtatttccgatccacaactccaatcctttgtgctttttctttgggggaaaaaaaggcttgtgtaagtctcgtcagcgccaataaacatattgcttcccattacggattggcgtggttcttccgcagggtagtttgcagagtgcggtgaacttttgctgtttgtggaagcaatcaggctgggtttaaatgaggacttgtctctttttgagcacttgtgagcgtgtaaggaattgtgtgttttctttgtgaaccattaaatttatccctggacttcagttgcctaagtcatccaaactgtaattggaaaaccatcagcacacacaattctgttggtttgctacggaggacccgagcttgtgcatgaatgtgtggagcgtgctgacatggcgacaggatcgggtcggggtggttgtgaggtatctttggctgctggggtactgtgagatgaatggagtgagagagaggaggtgacctgaggcattaagtatcgtctcatcctcacaagagagtcctttgttcttttaaggtcagaggtctgaagtgaacaggaagccatcttggaactgcgcacacgtgcctgggtagatttttccctcctgggaagagacattgatacaaagttgccactgtgaaacagccttgga

SEQ ID NO: 32932 - DNA, 1191 bp, Mus musculus
agccaaagagacatctatactgtgcagtggagttggagggttgtgggaagctcagccccttggccactctcagccttccccaggagcctctaagggaaggtctcctccttcccaacatgagacatgtctaaacaagctctggttgtttactcctcctgactcgttctttaatacattatcagtcacttgatgcttatgtgccctgtgcactatacagctatcctgatacccagtgactaacacccaactccagttcacagtagagtaacaggtttaacacaaatgactctaaaacaatttgtattacatttatttattacacatgggggttgctgcacagcatgtatgtggaggtcagtggtgcttgcagaagtcacttctcttattgtgtgggctctagggattgagctcagatcatcatgtttggtggcaagtgtccttacccagtgagccatcttgccagccacttaggctattctaagcagaatttagagcttaagtcagtgagtgcttgagtggcagaggagcaagttcaaaactgcctttggctttgatagctaaaagaagactgaaaacagtctcttctaactacagacttattcctctgctcgtccccctacctctcagctccctctgccctgtgctctcaacctctcttctgccagtcttagcatcttcctgagtgttgaactctttcaaattgatagattagaaagtgttaccataaggttagatgttagtaacttttgttagctgtgtgttaagcacactgtatcctagtcccctactctctgggagttagattactatatacatgtaaatcagaaatgtcaaactcatcaaaggtgacttcctaggacaattcaactataagggacatttgaatccagatattggccctgttcagaggacttgcaataaattaaaaaagaaaaaaaagatttatttatttttgttttatgtttgggtagcacgtgtgtgccattaatgcccttagaggcctgaaggggatgttggtccccctgggattagagttaatttacagctggttgtgagccaccatgcagttgcaaggaagccatgtcctctggaagagcagccagtgctcttaactgctgtgcaatctctccagcccttaggactcgctttttttcttttttcttttttaagcttagttgagctaaataagat

SEQ ID NO: 32933 - DNA, 1216 bp, Mus musculus
cttcagcgacctgacttggagagtgcctttatgttgaggaacagatgtaagtggcgggaagcacacagaaagtactccctgggacttgggtgctgtggacgcagttctccatggttctcggggtgctgtggcatagtactccctggaaagactgatgcataccatgctgcagctgtgagggccaggggccctgtggccctagcagagctgagtcattccttctcttcccacctggccaaggttcaggataaccagctcctgccagatcttggacaccccgcttaggatcctggaatcacccgggttgttgttgtttgttgtctttgctggaggaaaaacagaagtgtgcttgggaaaacctgatggtagcttggctggactgtggggctggctgaggcttgccccagtagactgctgttcagaggctcactggagaaattaggctttaatgagaatgctctttcctaaactttaactggccaagccactggagcctgtgcagttaataatgtactcagagtgttgctgagctgaaatttaacagccggtttaaaaacacaaggtaggggatttaacaaatagggcatagagaacacgtgtgtcctggagtgatttccacccctgtgactttgtgctgactgggagtattggtgcctcctctctggaaggtcgttatcctgtctccttgtctctgaggagtaacagcgtacagcccatgtgcagataagccggggggctgtgtcacaactcagtgaagccgagattgaggcagctcctcccagagtgagacagtccagggaaggaggctttggtggagaagggagtgagcattcaccatgtccctgctgcggcagacacaggcagcagtacagtcttgggaccagagcggaggatgccccgagcagggtgtggctggccgcgtgagtaagcagggagagaagttactgctcagatatctgagatgacaaagtccttctgaggagtttgctttagaaaacagaaaagatttttaaaaaactgagtggaaaatttaggggacctgaaacaaaggctccctgcgttctgagctatgtgtgttggtgcaggaggtgcgccagtgggaaagcctggagttcagtcaggtcggcttcagcttagtccctaggtctcacttcatacatggtcactgactccagatgtctttacgccttgctcaaacttcctggaaccctgattg

SEQ ID NO: 32934 - DNA, 1195 bp, Mus musculus
gaaaagagacacacataagatgactgcctaactctagacgcagacaaggtgacagggttagtctccggctctgttagaggaaacccacatggctgggagtcacgtggaatgtgaatcttgacctcatattcagactcatttgtctttgtttattaagaagtaacagttctgagggcagtgggtagagagcttgtcttggatgcagcaagccctgagttctagcccctgcattgctggcctgatatagttctcagctgcatagtgaggctgactggggtctgtgtttgaatcggaaaggctgtgtgacagggaggccacttgaccccatgccgctgtgtttgcactccgctctacaattggcaaagagtaaattcttaaataattaacagaaagaaacgccctgggggaacacctatttctaattctgcaggagtgatcaccgacgtatccttcctgtctttttctcagggagaaatgtgactttcataaacttggacagtgtcacacataggctttacttatttacctgcttatctttttccttttgagtgactatctcactttgtaacccaggttggggctgaccttgaactcaaggcaggactgcctcagcctctccggtgctggggttgtagcatgtcaagttgtacgtgtagttttgttttgtgttttctctctgtgtgttaatgcactgtgtgcaatgcctggtacccatagaggccagatcccctggaactcacggttgtgagctgtcacgtgggtgctgggaactgaacctgggtcctcgaaagagcagtgagtgctcctaatcaattgtattttctccgtatgtcctgaatctctcatatgcaacctgacttcctgggctatggagtggggcatttttctaaataatcttcagtccttgaacatgcaaatatgtttgtagtttcatgggtgccggtgttgctgacatgcttgtctttgtgagtatctttgaattgcttagacgttgctttctctggaccgggatatcagcattcgataaaacgttctctattgagtttttcatccttaatgtgatggaattgggaggcggaggttattatcctcatggcaaggcttggaagctgaagtgtataggaatggcatttgtgtaagacagggtagaattgctttaatcccaaggaggaggagcagcagggcatttagattc

SEQ ID NO: 32935 - DNA, 1101 bp, Mus musculus
ttaaaaaggttcctcctgcttccacagcggagcaagggctgtctgggattgagtcacatctaactgaattgattctaagctgctctgactttgtacaaatgggaaataactcgtttctggtagcttggcttctgagtctgggaataactgctcatcggaggaaaatatcctctttaggatataaaaagttcgctagaaatatgcagaaaaaatcatgtgaaatgggctcagctgatctgaagtaatttgaggtttaaaagcaataacatgcagttttaaagataggtacaaataaatgttgggctgcttttaagttaatactaaatataaaggtagaagtcacattgtttcctctggtcagatgtattctggcaagctcacagtgatgatggtgttccaacattcgcagtttccaccagaaggactttccatgttgggttgaccttccttggatgtctgagtgagctggaaatttggagtttggctgttagggttttatcgcatgtgtgtgtgcttgagtgtgtttctcttttcaggtgtaatcctgagggactcacacggggtggcccaggtccgttttgtgactggaaataaaatcttgagaatcctcaagtccaaaggccttgcccctgacctccccgaggatctctaccatttgattaagaaagctgttgctgtccgaaagcaccttgagaggaacagaaaggtaaggcggacaacaaaccaggtgttgtgtcgagacacttgcgctgcggatcttcagaggggagaacgcacttgagtcctctcaggtggttctgggtgctggctaatagtcaacatgatagtttcctagaaataggtggtttgatttttagctcccctaaactattacatccagttggtcccaggtgctggggcttttgtgtaggtttgtggctatgggccttattctaggagtttaaattgcctctgtggatttggtgatgcatgcccttaattgttggagtttgagaccagcctggtctaacacattgtaagacaaccaacttattctgtataataataagataccctgcctccttaaaaaaattgccctaagaacttaacctaaccatagaa

SEQ ID NO: 32936 - DNA, 1856 bp, Mus musculus
taaacaaatggaaattgttcagccttattccctattttgtttggtaacgtgctcaggcaggataaggagtttaatttagacatttatggaaggtgttgtgtaaactgtcctgtatttggaaacattgtacattcacatgaaagaattattttctgtaatatactgaaatgaaaattgcaagagagaagtgtgaagttactgtggagtagccattaagaataagattcatttttaaagccaggcatggtagcacacgcctttaatcccggcacttgggaggcagaggcaggcggatttctgagttcgaggccagcctggtctacagagtgagttccaggacagccaaggctacacagagaaaccctgtctcaaaaaataaaaaaagattcatttttattccccatttcagacataattttgtttagttttgataaacatgtatatataataaatttcttggttagaagttcaaatatttttagaaaggtaatagagatgtagcaaatttggtagttaagagaaaactgacaaactacttaatgaagggtaccaagaaaggacaatcggattcagttcgctagaataaaatttttatgaactgtacaaagtgattgacagaaatgatgatgcttacagagttaaattaagagttaagagtgttatcattggaatacattttttaaaaaaaatcaaaacttgaaatatttggtgcctaacactatggtccatttgtagggaaacctgtatgagtatgtgaattttttatattaaactgtgttgtctacttgataattgaaatgaagatctaagcaccgttgtttgctttttccacaattaacatttccttaaatagttttgcagatgtaagtagcactagaatattttttttcttttgagagaaacctaattccattccatgggtcacccagacttaaaaaaatgctgtttgtaaaaggtcgtcattgactggactcgtggacctttttgtgatctgttaccgtgtatcttagcagaaacagaattaaaaatgtaatgtcacttcagtgacaagaaatctgattaatatctaaaagtatatattataagtaatactgtatagttaacaagaattcaaaaggtgatactgtctcttaattttactcaatttgtgccttctttggtcattagaatacatatattttaatgtaagttatttctttgtaaaatgctaatcttcagcccataccaaaaaaacagtgatagggaggaagaacgtagcctctgtgcactgcggctgcagtcaccatagtcagctggcttctagagcttcttaacagtcaccttaaaatacatcggaaaacgagaacgctagacaggccaagacactaatgtttatgtatatcatatttataactaccttcaagtaaaaataagtctgctacatacaagtcctgtgccagaattctttgttcttgccagtgctctaggatctgaagatgatcgctcatcccaagaacctgttttctctgaggaatccaatgagactggcaccaatgctttatattactgtgtttatgggaatgagttgttaaagcatgtgtatcttttttaagtacttttttttcaaattaaagttgtatataaagttcaaaatcttgccttaaattgtttaattctttctaagactcatgaattgtaacatttaaaaaaattcacttttgataactcagatttaaacaaacactgaagacctgctattatgatacacatttacttacacgctgttcaccagcaatgcaaacatacatgtgattactagtgtcgcctgtaagaagaaaatgctttaattatatcagcatagtgagttaagatgtata

SEQ ID NO: 32937 - DNA, 1200 bp, Mus musculus
atttgctatgtagccttgaactctgtagctgaaagtggtgttgttaagtcatgaaaaataagtgtttactgagccccatctacaagtagagttttcagtactggaaatccagtaacaaatgagaacaatgcctttctagagcgtttgtttaaatggctattcctgcctgtttctttttgtctgtctcgctatactgctcaggctgctctcatcttcagagactgagtgatcctttcactgcagccttttaagtagtagggttacaggtgcgttccaaaatgcccagctgaaaacatggcaaacaaattgtgttgctttttttaaacttgtattttcctttgttcattggagttccatataggaggacccacatagtaggagagaaccaactcccacaggttgtctgtcctttatcctccatacacaccctttcatggacttagatacactctaaataaatgaaatgaaaaaaaaatgtttttttcatttgacacagggtagccccagctgtccaaaaactctctctatagaccaggctggcctcaaactcagagatccacatgcctctgcctcccaaggtctgggattaaaggcgggggcaaccactgccctgtataactttaagttatagatataggtgggcatggcatgcagccctttggtcctagtacttggaaggtggagacagaggaatgcaaagtctccaagaccaaccaccaccctacctattcacacccagaaaaagctgtggataggagtagaatgattagcatgtaaacctagaagtaagttagagtagaagaatgccgttttattgagtccaaggttcttagaagattgtcttattgtgtcagtatgaacagcagtttggaactaagttattggtgtttagtgaaaagaatgcagcaatacctgtgaagattggctgaattcctgggtctgtatattgttaaataaagcttagctgaatattactgtggtgtagcaaaggaaagtagcatcagcatctccactactgctaaggaagagaccaaagaaactgagcaaacctcaacaaaagacagggatgtgatagaagtgacaccaagggaagagaatgttggtacttcgtgagttttaactagaaatggataagcacatagtctgttatcatttgcctgccctcttagcacaatacctgaaacagcttatattctatgg

SEQ ID NO: 32938 - DNA, 1704 bp, Mus musculus
gaagtacgccagaggcggcagctcaggtggtgcagtgggtcagctttgctgacagtgacatcgttcctccagctagtacctgggtgttccccaccttgggcattatgcaccacaacaaacaggccactgaaaatgcgaaagaggaggtgaagcgaatcctggggctgctggacactcacttgaagactcgaacttttctagtgggcgagcgagtgacactggctgatattacagttgtctgtaccctgttgtggctctataaacaggtcttagagccttcttttcgccaggccttccccaataccaaccggtggttccttacctgcattaaccagccccagttcagggctatcttgggggaggtgaagctgtgtgagaagatggctcagtttgatgctaagaagtttgcagagagccagtctaaaaaagataccccaaggaaagaaaagggttcatgagaggagaaacagaaaccccaggctgagcggaaggaggaaaaaaatgcagctgccccagctcctgaggaagagatggatgagtgtgagcaggcattggctgctgagcccaaggccaaggaccctttcgctcacctgcccaagagtacctttgtgttggatgagtttaagcgtaagtactccaatgaggacaccctctctgtggcactgccatatttttgggagcactttgataaagatggctggtccctgtggtatgccgagtaccgcttccctgaagagctgacccagaccttcatgagttgcaacctcatcactgggatgtttcagcgattggacaaactgaggaagaatgcctttgctagtgttatcctctttggaaccaacaacagcagctccatttctggtgtttgggtcttccgaggccaagagcttgcctttccgctgagtccagattggcaggtggactatgagtcgtatacatggcggaaactggatcctgggagcgaagaaacccagaccctggttcgagagtacttttcctgggaggggaccttccagcatgtgggcaaagccgtcaatcaaggcaagatcttcaagtgaacaagtcttgccagtcgcctagctgcctgcacctacccttcaagggagatgggggtcattaaaggaaactgaacattgaaaaaaaaaaaaaaaaaaaaaaagaatggtgaacttgaagtatggaacacagggtgttccagtcttcaatttataaaattcaacactctggaaaggcttcctaggagtatctttcagatatgcattgtggacaaatcaatctacattctcaaagtagccatgaggatgaggttaagagagggtgtgcgaaccaacagttttcaaatacagggaacaattattatcatcaatagatcacaactctaagctcagacttattctctagtccttgcttttccccttctagggagcatgataatatctatgacaaagagtactctggaaattatgtccctccattaattattcttacaggatgaattccatagcactaactctgttacagcactttaggcagcctgccagctcaacactatgttaatcgctatttcatttctaggcattcggcttaggcggaatcagcttaggcccagagatttcctgatacttcctgataaggtaggtttcaggtagcacagtccttccaggctgctgttaaacaaaaatgtggggagaggaggttgaacag

SEQ ID NO: 32939 - DNA, 1358 bp, Mus musculus
aatcctaatctattctggagtgcctgctactgctggactctggcctttgtttctggaaaggtgacagtttgcaggaggaaggtgtgactttcctttctgctgggacttccagcttgccctggggccaccctgcttatctgtgtcacttcaaaccacagttggagtttgtgtgagtcaacttccctttactgtggtgaaatgccccacggtaggcagggagattgactgaggctcaacgtttggaacggtttctatacctggttttccgccactgagcctgtaatgaggcaggagagtgtggtaaagggagccacccacctcatgacagcctgaaagcagaaagagggttggctgctggtcacctagctcattcctgtgaggtcccaccttctacagactccatccccttcagctgagccgtttgggaccacatcttcaagggatcatcagcttttgtgggctatctgacaagattggagttaactctcacaataacatgctaacaattgcggttccctgtgagaagtcagtgtgtgccaggctaagcagaatatcagggattagcacgttcagtcatttacagcagccttatcaagtggctgcggtgccacctcctacctaccttattccctgatctttatttctctgaagagactgaggcctggggagaataaggaattccgccaggcagtggtggcacacgcctttaatcccagcacttggaaggcagaggcagggggatttctgagttcaaggccagcctggtctaaagagagagttccaggacagccaggggtacacagagaaaccctgtctcgggggggggggggggaagaaaagaaaagaaaaaaaaagaaaaaatctagaattcccctgagctatacaacaagcaacaatggaacatgactcaggcaacatgacctgggagcctgtatgtcaaaattctgggctccatagaaaggggtatatgtgtgtatggaggtgcacatgtgtttgtgctgggatgtaggtggaggccaatgttgggtatattccactctcattgaatctagagttctctgattcaggactctggctggccagtaagaccttgggctctacctctaaccctctcccaggcactgggattatatatgtaccctgacacgctcagattttgtgtgccagggtcctctttaccaacatctctggtagatgattttagcagagcaatttctctaagccattatgcaaaatccctctactagcctggccccatctgcccattgtgttgatggaactactgagacccagcaacaagcaggatcaagctggggtgtcaatcagagcatgacttactgttgctaaaagcaaaatgt

SEQ ID NO: 32940 - DNA, 1202 bp, Mus musculus
aatgtatgcacgtgtaagcttttgccttgattgaggtcaagctgtcgagaaatggttctctttacagtggatccagtcaggattggcagcaagcacctttgcctgctgagcctacatgttgtatagaatggcaacgttgtgtagaatggcagtacattaaatgggtttttcatttacgaagtgtgctggctggttttgtgtcaacttgacacaagctggagttcagttgaggaaatgcctccatgagattcagcagttttctcagtgatggggggatgggggctagccccttgtgggtggtgccatctctgggctggtaattctgggttctgtaagcaagctgaacaagccaggggaagcaagccagtaacattcctccatggcctctgcatcagctcctgcttcctgacctgcttgagttccagccctgacttccttggggatgaacagcagtgtggaagtgttaactgaataaaccctttcctccccaacttgcttcgtggtcatgttttgtgtaggaatagaaactctgacttaagacataatggttttgagattatggttttatttatgactatggtgagccctactgaagaagcctcagcattcagatctatcgtatcctgccagttgcttgaagcatgaatttgagtgtcccttctaaataggttttcatttctgtgaaatgggtacaaagaggctatgttctagtactgtggtcaggcttgggataaactgtaaaatgaaagtggtgcttggcataacactattttacttgtttttaatcctgagagggagtctgaatgcttctgggaagaagatgtggagtccggactgacctgtcctgactatagtatgtctgcagtcctaataacagcccctggggggttcttcactcttctcagcttttgtactcagagtgatgggggctagtgaggctgccatgtgggaaatctaataaccaggggtattgggaaaattgagatccttttctgtagatgatgaatgagggcaaagagaagcagtaagtatttggggcctgaagcagagagatgaggggaagggaagttataatggaagtcttgagtcagctgacaggaatcatgagtcagcagaaacctgagtgaccaggagttgtgagtcagcagaaagtatagatagcaaagatgatgagtcaccatcattcttggtgaatcagggct

SEQ ID NO: 32941 - DNA, 1160 bp, Mus musculus
tttggccacatggctttggctttagactccaggatagaagggactactgggacaattgatgctgattagctggagctaggaaattagcagtgattaggaagagaccagtataacggaggtgaaatattaattaaaaatggaagtgttttcagagagcacaatgaagctgtgttccagagatagctaaggttgataggtcctgcagttgtacttggtaatgtgtaagagtcacccaggtggtacaggttttgaaggcataaaggggtcatggagagcagctgaggtctggcacagtgagaggccatagaaggccattggtgaaggtgcagcctcagttgtagttgacagcccaagactgaaggggtcatgcaaacgatttgaggcttggccctatgaagagaaggcactgtgaggctattgattcagcctactttcagtgggaagaccccagtgtattggagatgatcgtactatgggatgattaccaagaagcagtagcagtggagttgatcaacctgagcttagagtgctacagagggcagagctggagaagtgatgccaaccctttggagtcaagaagatcatgtgtggatctcagacattgaaacattgaagctgccttggagaccccaagattttcgagattcgagagccataggatatctcctgaggaataccataacggagtggaaccagctcaggaaaagaagtttgttgcagtcaacaaagatgaaaagagaagttggagattgcaggtcggtggtggcgcacgcctttaatcccagcacttgggagacagaggcaggcagatttctgagtttgaggccagcctggtctacagagtgagttctagttccaggactgccagggctacacagagaaaacaaacaaaaaaagttggagatctgaaagctgctttgacatcagacatggagatgcagagtttggagtttgcctggctggtttcctgttttgatttggggattacagttaagtgattggatggatctcagaagagactttgaacttgtgtttttaacattgttgagactgctatagactatggggacttcagaagttggactaaatgtactcttcattatgctatggctagataatagcccacttagacaagcctatgggggccagggagtggaatg

SEQ ID NO: 32942 - DNA, 1165 bp, Mus musculus
gagggctagactctgaagaacagtgctgaacagtcgggaaattgtagtgaatttttcctggttcttgggaatgttgcttagacctaggaaaagctaatgggggtaggacagcatgattgggtgttgatgcaaaccccggcttttctttccacagccaccatggtgcgaatgaatgttctggcggatgctctcaagagcatcaacaacgctgagaagagaggcaaacgccaggtcctcatcaggccatgttctaaagtcatcgttcggttcttaaccgtgatgatgaagcacggtgagtattggtgtcttgggtttttgacagtgctggatctgggagggaaagacagtaaccgttcaagaaaagaatgggtgtgttgatgctaactcccaaaaatttttatgtgatacggagctttcagaattctgatgcagagactcagatgagagaaaaatctaataggcaaaaagttagtgttggcgtaaaggtttaggtctcaaattgatgtctggtttgacgctggtcacttgttttataggatacattggtgaatttgagatcattgatgatcacagagctgggaagattgttgtgaacctcacaggaaggttgaacaaggtaagacatcttgcttctcaaattgcagctgtctgccacttcacagtgttgtcattcttgctctacttccctgatttaaggaattggctaaggctatgcttctgttttagtacccacatttcacttggtgtctttggttacttgttcaaattattggttagttttgtgtgggatagagctaaactctggtaacgctggagtgggaaactgctgatttcagtagcttaaactatggctcagtgtatgaataactcagtcttgtactggtggtgtgtgtggcctgtttattttcaagatggaagtctcaacacatagagaggttgatctatactctgtcaaactgctgtattaaagttacacgatgcacttgtccagtggtgtgctggcttttaataaaattgttaatcttgagtaagtggctaagagttcatggtctgttggtgtaggttgtagctgtctgagttctaggctgctcgtcagttttaattgtcatcagcatagccaaatagactttctgactccatggtttaatagcagtttggggcattg

SEQ ID NO: 32943 - DNA, 2063 bp, Mus musculus
aaaaagactggtctctgttttcctggagttcattaaagccaggtaggtcgtgagcaaagaggagtgagatagaaggcactgtagtgtgagcgtgagtgcaccttcaggaggcaccttggctgcagttttgggctgaatcctgttggatggcttttgtgtcacttctccacagtccacccacattcaactgtagtcatcttcagagagttaaatattgtctcctcaacttcatttttttttttttcatttctagtgacatttgtgctgttgcttcctggactaaaccaacatgggatcattctgaagtacattggaatggccaaaagggagataaacaaacttctcaagcaaaaagaaaagaaaaatgagtagtgtggctgccgcggagtgtgccctggccctgggcactgaagtgttacagtggctcgttgcttccctcactctgcccttgttaatagaaattctcacaggccaggctctgtgcgggctctagtgccaggtgtagctgggtacattccccgtcagtgtgacttcctttcattttgacaacttccttcctttaagatgctaagtggtgaactttactgttttgtacagtgaactgtgactttgttgatgtttgctttagctatattcaaggcagtggtctgtggctacaggaagctggttctactgtctgcttaacaaactgtctttgtgagtacagagattgggtttaccacttctgctgaggagaccacttaaaattcattcctgagtttccactgtgggagaatacccatggaataagataaaaaattaattccacaccctagtgtgtgtaagttcctcgctcataggaaatgcaacagtttgagggagcattgcccctttgttcctgtgaggactggcaggctttgactgacctctcattccctttgcactgcttcaggttagttctagtccataatggcctttgagcagcaagctttcagaagattatatttgaggattgtagcagtttctttgtttcagattgtcagctgacttaaaatgtttgtgactttcctgtaagggcagccagggataaaagtatcctttgttcaatgagtagaaaactagattatctattaatatttaagaccaggaaaaaaaaaaaagaggcttaagagtaagcctggaaaatctcacttgttttcgtagtattggctgtatttcagtgcctccagctttgcacttgagagacaagtgtttactgctgtttgactttccccttgacatttctcagaaaaatgcagggctgcagctgagagcagactgctgattggtgactctggtctgcctagcttttgcaactctttaagcttactgtgatcacgtgccctctcagtagggggcttttagagcagttgaaatctgcagaactgaacctctgagggccaaaataggacatttgggaacaactccttaacccatgaactagctgtaacatagtttgtggatccatgcactgatgctgtgaagcctgcccctgtgtgtatctgttctctcacctccctagcactgtaagcagcggtgcctcttgtagcatgtgtgtttgttttttaatgtttcatgactcccactttgattttacatgttttcttgtaaataagcctgccttcctacctggaatttgtgtgtgtgtgactaatacatgttctacgagttaactactttggcagttttaatcatttcttctttgttttgtggtaaaggggaaaaattaaaaaccagttggaacccttttgtctcactttctttgttaactctgagtttatgaatctaactagtgaccacctgttgtcattggagctcttctctaaggtacccatgtcagatggaaagggagaacactgaagaggaggagacagtggagactcaaaagatcgtgtacttaagctcccaaagcaggtggttgataatcatcagtagttgataatcatttgtctgccttttaaaatttgggtgtcataacttgcggtctcattgggaacaggctccatccacccttaagcatacttccctttctgcaagttcaagta

SEQ ID NO: 32944 - DNA, 2895 bp, Mus musculus
gctgtagtttctttcatagaaagtagctgatctgatgtaatcttttaccttttaaacaaccaggatagagaacctattggagtttgcattgttgatgacaggttcacaataaagtgacgttctggtggaggtagagtgaaatgttttttaattcagttttctcatttgatacttttaatttacaaagtaattttgttttatgttttaaagtgtaaattaaaaatgctttagtttacctggcatttgggtatgctcagtaatgcctgccagcagcacctttaatttcagctggtggcctgtgatgggttctgtttaccttttgcaacattttatagcttgtttagtgactagtgtgtagtgagtcacgatcaaggcatccttcagcttagcattttcagtactcactgctgatccttggtagaagtgcagactagaatagagctaaaaatcacgtatcaacacagaatagcacatggtattttgagtctttttatccccccccccccccctgcattttagcaactagtgtggcggccacttaatttgccagcctctccaagcctgaaaaggtccaggtgtctaagctcttctctgactgcaacgagttgaattctaatcctcacaggatggatgccagtgtcggcactttcttaattatgagtattgaaaggtgctgttttcagtctccacatgtctgctgacaagttaaagaatctagcatatcgcatttggttttacttgttgattttgagccttattgtcacaaaacagcctagctggaatattgatgccatactatattttgcatgctattttcttccctagaggcattgagggcaattgcactttggctctctcaagatgtgtcattttcagacattcttcatgtcagaagagcttttgttgtaaggagaaaaccagctcagacttttgtccctgtaggtgatggtagtggtcagaaatggcttttgctttggtaataagtgaattttattccccaagagtctcaggcatcagaagtacttggcatcttaatccaagcaaaaataagacagcttaaaaaacaaccaaaaaaaatgtgcctctggtgaattatccatcctttttttaaaatgttaaactggtctttgagaaaagaatagtgcagataagagcagccaaggacttcaaagcttgttgatcactgcactctggataaaacccttggcttcctgttcaaatagcctttccaggtttaacttctttaaggagcctcaagtgaaaaaaacaaaaacaaaacaaaaaacccagggccactgggggaatgttttatgaaatcatgtagagtgctgtagttttgaagtcatccgttttttgatgacaaagtacctgtggaaaaccagggatatttttttttcctcaacttcttctctttactccctacccctctcctccctaattctgtcttccttctctccactcttttaagattcagagggtacagaacaacctctattatttcagagtacccttgagaattgaaatgtatttcgattagttgtctttaattagctagctagagtcagttgatatctctaccaagctgaagcctagtacctacgaagctatttctttaccaaagtctcttgcttctgcttatggtcgtgagctgatcacgcagtttgctagatgatttgacactggtggtgagttcttttgaggcgtgagatttctatgtgaaactgataggtcttgatctgctttcttagatcactgattcagagctcaaagcccaggttcagggtaagaatttgtaatacagaagaagaaagactcccttcactttgcccttaacacttgcctctgttatctaagcttcgttaatagatttcttaatatcatccaatgtttggtgttatctgcattgtttttttttttaaattgtggttgttctgatgtgtgaaatttaaggaaagagccatttaataaatgccaagcagggcaatgcagccaaatattagagttgatgtgcagtcttaggtcctttttaatctggggtattacaggcagtactttaaatcagagtcttcctggcctttttccctccacctttttgtagttactcgggggcttacttgtgcagtactaaaatcaaaggagctggttcttcttttctcccaatcttttcttagtaatgaacacacctacaactagcctgccactcccaatcacacacagcagatgtcagtgctgtgctaatattagctgcatttcctgcagggcagggatgcgaccttgcacatgctaggcaagctctctaccctgagctacgtacatcctagcccttagaactaccaccctgaagcatctttgtttcctgtgttcagacgcagacgaagaccaacattgttttatatgttgaatttataaaatgctagtaatttagaaccctccccccaaatcaaggaggcaaaaaataacgcactagtcactgaagttcatcctcagttacctcgatagggtaggtagattcctaatagtgctggtgagcatcacaatgctgtgcaaagattcaagaggaggcagtcactgtactttgcctgcttttgggcctagataacgtcactgtctacaaaaagctaactgcttaggtttgaaaaggcaaccatgtagagaaaacttgacaattggggctcattgggaagttctagtgctaatgttaaaaactcaaatcagctggctatttgaagatggcaaagaatatagttctgaaattttatttttccacaacagggtgattggcagtggttgttctccctttttctgacagtgtggttcagctcctgtttcagattctgtgtcatttttcaatttacaagtcacttaagtttctacctggaatgtcaggtggcaatg

SEQ ID NO: 32945 - DNA, 1263 bp, Mus musculus
tttaccagtgattgaaagccaccatgtggatattgataattgaaccagaacccctcttagaacaggaagtactcttaaactgctaagctgtgtctcccaatttttaaggaatatgtttttgtagtgggttgggcggctgggggagataatatgagggttggggtttgtgtgttccagaggtaaccttggatgccattcacctttggtgggtgtgggtgtgagtgtgagctcattctgtagaggttggcctcaaactcaagatccttctgcctcctgagttcttggattaaaggcatgaaccaccactgtggaatacggacttttaacataaaatcaagttcattttcaaagttgagtaatgtgcaataagtcctatcagccattccttgtatgtgtgctgccccccccccccacgtgcccccagtctacccccagcttctgtttgtatgcaaattgagccaccaatcttttactttagcggttaggagtaacactggccagaagactcagcctgatgtcatgtctcagaatgctaaaaagctgattcagaaaaatctggctacatcagcagatactccaccaagcaccatcccaggaactggcaagagcatcgcctgtagtcctaaaaaggctgtcagagaccctaagactgggaaaggtaatcagccagaatgtggatgccttgtaattctataatacacacaagttggtttgacttacatgtgccattgcttcatagctgtgcaagagagaaactcctatgcagtgagtgtgtggaagagagtgaaagccaagctagagggccgagatgttgatccaaacaggaggatgtcagttgctgagcaggtgactattttttaagcttaagctatgcattaatgctgctggtaggctcaaggatctcatttacccatttccttattttatcaagaaataatagctcttggcctagcagaatggttcagtggacaagggcgtatgcatatgcttcagagcctgacagcctaagttcagtctctggtttcacatggtagaatagaggttgccaactcattcacgttgtcctctcacttcatatgtgtgcctgtgcacactcacacactaagtttaatgataaaaagaaatcagcccctgaaacctacatccaggactcggaaggctattggcaacactgctctaaagttgtcagatgctcactacttgactcgtcactacttagtctttcctcttaggcaatctcctgcatagtcgtttaagctatat

SEQ ID NO: 32946 - DNA, 1139 bp, Mus musculus
attttctcattttgcagtgtgaatgttatttgtatacaggggtgtattaatataagcaagcacctgctttatttttataggtatgaaatgcagtatgctcctcagccacctccaacagtgtgtcagttcattactgctactgaaatgacccttcagcggtatgcagcagacataaacagcagacttattagacaagtggaacgtttgaaacaagaagctgtcactgtgccagtttgtgaagatcagttgaaagaaattgagcgttgcattaaagtttttcttcatgagaatggagaagaaggctctctgagtctagcaagtgtcattatttctgccctttgtactcttacaaggtgagctagtgcttcatactagatcatcttactgtcttcatatgttttattttaatcccagatttaaaacactattatacttggccagtgtttgtcactttgagatttgaagtcttctctagtctatatgcactcaatcaaatttgttttcattgtctacgtaggcgtaaccttatgatggaaggtgcagcttcaagtgctggagagcagctggttgatctgacatccagagatggagcctggtttctagaggagctgtgtagtatgagtggaaatgtcacctgcttggtgcagttactgaagcagtgccacctggtaccacaggacttggatattcccaacccagtggaagcatctgaggctgttcatttagccaatggagtatatacatctctgcaggtgaacacttttaagtttggttgggaatatagttcagttggtaaagtgcttggctagcatgcataaagccctaactaagtttgatcctgagagacgcaaagtcaagagtagtgtcacaagcctgtaatactggtatttgggcagtagagccaggaagatcagaattcaaggtcagcctcagctgtgagactcagtcttaaaacaacaaacagcccagcggcaaaacagattatcaggcaatgggggttcccactttttggccccaaattttttataggtcaaggttagatattaaacagtcttgcttaggttcttaattcaaagagcagtttgactgttgaatgttacttaagcaattatttaaaatgttgctatggctacatgtgt

SEQ ID NO: 32947 - DNA, 1145 bp, Mus musculus
aaaataaagcaggtgcttgcttatattaatacacccctgtatacaaataacattcacactgcaaaatgagaaaattgcattctactctcaaaaaagtctcaagaaagtcaaaaagtctcaagaacacaagctatttcataagatagcttattgagtgatacaatgacttaataacttcctggaacaatcctaccatgtgaacattttcatctactaattaggagaaacgatttatcttgcaagagaaaccctgaatgagctcacattaatatcctctttctccctctgcagtactgcaggaatggagtccataacgttgcaaacgtagatattccacatatctagcactggatcaaacgcaagccctgaggagtttgagtcaggaagaggctggcttcaaacttgcaataagcaccctcttatgcaccaagatatctggtgttgatagcacaattctgtaatctcagctacttggaaaggtaacataggacggactttcccaaaagcattaaaaaacaaatgaccccctgtatttgaaagtgattgtgggctgcaggtgccctggtcattgatactgcaaggagaggatttgaaaaacttttcccgtgtttggaggatccacactcatccttgccaaaccctggtgctttcccacattgtattaaaaaaaaaaaaaatgacaaaaaaaataaaaaaaaataaaaacccacccaaaaggtacttcactgaaatttcatctgttaaccatttttttcagaaaaataaaatacaaatgcaactgtgctggttcgttttgtctacttgacacaaacctcaacatatttgggaagaattttaactgagaaaatgcccccaccagattgcctgcctgtaaagatgtctggagagtattttcttgataaatgattaatgtgggaaagcacaggtggatgagttgtatgaaaaagcaggctgagaagcaagggaggaagactacttactacatagtttctgcatcaggttctgcctctaggcttcctgccttgagttcctcccctgtttccttcatgctggactatacatggtaagatataaaaaactacttcctccccaagttgctttggttatggtctttatcacagcaacagaaagaagctctaactagt

SEQ ID NO: 32948 - DNA, 1147 bp, Mus musculus
atccggtgccttttggaggaagattggcccataatgtttacctgcttccttctctttagtcctatgcgagatccaccgctgtcatgtccatggttggctacataattggtcttggagacagacatctggataatgtcctcatagatatgacaactggagaagtagttcacatagattacaatgtttgctttgaaaaaggtaagatgaaatgggcttcttcatttatttgaaggtcaggttatttggtgttaagggcaaaagtaaaatgatttgtctttttaaggtaaaagccttagagttcccgagaaagtgccttttcgaatgacacaaaacattgaaacagcactgggtgtaactggagtagaaggtgtttttaggctttcctgtgagcaggtatgcctttcctcttttgtcctgtagtgtaactgtataatgagcaaaatccatgggaggaagtcataaaacattttcatatggaaacttgtgttgagtttactgaaaacacttctaaaaataggttctccacatcatgcggcgaggccgagagactctgctgacactcttggaggcttttgtgtatgaccccctggtggactggacagctggtggtgaggctgggtttgcaggtgctgtctatggtggaggtggccagcaggctgagagcaagcagagtaagcgagagatggaacgtgagattacccgcagcctcttttcttccagagttgctgagattaaggtgaagcccaaagatgttatgtcactcactgtccgctttttaacatagcagatgtacctaagggttgatttatgttagggttttctgggtgtgaggactccttgtcatctctattagactgtcctcccacacagacacattcacattccttagagctattccaatgaacatatcaagtgtctaatgcaataattgaataaccttttcccctgttcagtagtcagagatctcaggcttattttctgtggcccgtgaatctgttcacttaatggcggtgtaaatgtgaatgtattgattatcaaaggtagagcaagaaaccactatcttagttgggattttagttaaagcagcacacccagatgttcctgtactcactgttcctgatcacaacctcccccaggtgaactggtt

SEQ ID NO: 32949 - DNA, 1152 bp, Mus musculus
cttagtgtgactaaggcatcttatttcggcattggagcaccagggccataggaaatggctgcagataagaaaacagaaaattggaatctcataataaaacaggatctcagtgaaggagtcagggctaaggtacaaaacttagatgataggagacttaataggaaaagagtgtaggctctcaatggggagagaggccagctggctggatgcagtggcttggagagagcaaggattgaagacatattgtagagtctattgccagtatattaacaggcacccgggtcactcactacagaaagaaggaggagacaaagggcaagcaagctcaactaactggttgtcatagctaggaccatgttttcctgtttgcctgtcattgcagctgtagtgttactgaggtcttgggaaccacatcaagataaaacggtgctttgcttgtaaatgccatttctctagatggctgcttcctccagtgcttgttctccctgtagtccccagtggttatacaagctggtaaggcctaacccagactgatggacattttaattacaggtcactaagcagcttcgagtctggagagtttgttgaatgcactgagcagttggaattattaccaggagaaaatattaatctacttgctggagggtcaaaagaaaaaataggtatttgggaatggttttaatttttttttcattacaagattattcattatcttttcctaggaaatgcgtaagtttctgtctgtttatttagagtcctagactatttgtaagtttctgtttatttatttggagacctagattatgcaaagaaatagaattagggttgtgctagtaatagtttataaagcaaatgaaaaatggctcagttagaactaaactagaaagatgtgatattgatactttgagatgaatgtagacatttagcttgacaaagtaccaagcagtgttttggctgcagttttcttcttgatgagcacactgcacactgctttgtgacgttgagacgtctgctgtgttttgagagtagctgcattgtgtaaggctctcaagtacttctggagagctacacaaatgcaccagggacattcttgatgtgtataactgaaaaggcagtttccctcttgacttaatgtgtcagttttgtttccac

SEQ ID NO: 32950 - DNA, 1193 bp, Mus musculus
agctgccagaggctggataagcgtgaccaatccacaattccccgcaatcttctaaagacagatgctgtcctttggcagtgggctatttgggaagctgcgcagtttactgttctttcaaagttgcgaaccccattgggcagagctcaggacacgttccagacaattgaaggtaaccaacaatttagcattcttcaaaatttgtgatgcaggtgactttctaggtttttaactttagaaaccttggctttcttatactgaaacagatttcagagttgggttttttttttaattgaataatttctagatctttttagataagctttgttagttgaattatttgcacatctgcttttattcaaaagcttaggggattatatggacaaacggtttcctcagaaagtgagagatttttaatttttgttttaaattgatgaatatataaataggatatctggtaaattgatttattaagagttgtctctgattcagaatgttgctgtttttgttttcaggcatcattagaagtcttgcagcccacacactaaaccctgaccaggatgttagtcagtggaccactgcagataatgatgaaggccatggaagcaatcagcttagacttgttcttctgcttcagtatctggagaacctggagaaattaatgtataatgcctatgagggatgtgccaatgcattaacatcacctcccaaggttggtgttgtgaaatagtggtgctttgtaatagattgtgaaacctggtggggttgtatatggctgagatcacagtccatctggattctgtttatgtatatatgtatatatgtatatatttatgtatttaaggcatcttcatcatgattggaactagtcctgaatccttttcttttttttttttcaaaggtcattaggacttttttctataccaatcgacagacttgccaagactggctcactcggatccgcctctccatcatgagggttggattgttggcaggtcagcctgcagtgacagtgaggcacggctttgacttacttactgaaatgaaaacaaatagtctaactcaggtaatgtggtgtatttgggatgcattttaactgattgtaggaatttgagtttggtctctaatggagttatatatagctctctctccctctccctctccctcccccctcttcctccctccttccctccctc

SEQ ID NO: 32951 - DNA, 1178 bp, Mus musculus
cccctttctcctcttttatctagtgttaggatatagttagtgaagacgagtggaagaaagaacccacagagttgctaaatccagcaacagatgaagagtcagatatatttctaagttcagaagtatcgcatatattaaaaataaaattactagttactaataagctggcacgccaaattgactatagatctcaatagatgggggagcttaagctgttgtttgtatatgtgttggcattgactttaaatcaagataagattcgtcaatgctccttgaaaatctcacattagcagcgtttgagagcattcattatttataataaattcatagagctttgttaaaaaaaaaaagtaacctacatacaggttccttaaaattggtcttctgaagtgaaccttttgggtgttacgtgtctaaatcttgaagggtcatctccccagcgtgctgcatgcatatagtgatttttaaccagttccctgaatttttcttttgtaggttgttgctgtagctcatgctgtttatcaagcagtgctcagcttgaagaatattcctgttctggagactgcctataaattaattttgggagaaatgacttgtgcactaaacaatctgctacacagtctccagcttcctgatgcctgttctgagattaaacatgaggcttttcagaatcatgtgttcaacattgacaatgccaactttgtagttatatttgatctcagtgcactgactacaattggaaatgccaaaaactcattaattggggtaagtcattaattttatagactttgttattatgttattatttatttatgtatttgttatttatgtattttgtattatttctggttttgagacagagttctgctctatggcccagatgggccttgagcttcctgtgttcttggctttagcattctgagtcctgggattactgacagataccaccattcctggccataaatctatccatgcatgcttaacctctctctacccttccatacctcatttacttctttttcctcttctttgtaatagagttctttgtagactactaggcttaccctaggtgctgagattataggtacgcatcaccatgttcatttataacttcatatattttgtttgttggtggtagggtgggacagggacagagttcaacattcaataccttcttt

SEQ ID NO: 32952 - DNA, 1313 bp, Mus musculus
gaacacttggctatcatgatcactgatacacaaactttaatattagcttaaaagcaattttagtatttactttgaaaagattattaaaaatacaagatctgtgtttaagcaagtgtgagtaggacattcctaagtatgctacattgtgatgtatatcacagcgataaagatactgagctttttatccagccttggaataattacatgagtagaggaagtgtgtaattgaactcaagggcgacaaacttcatttcttgtcatgataggaacttggaatacattttagccaagttttttcttttcttttcctttaaattgtattaaagatgcctatatcagctaccaagaattagggactcagctgtgaactgtggtggtgcacatctgtaaagacagcctggattatggattattctttttgcctcatctcagtccaaaaaacaaaaaaaaacaaaaaaaccccaagcccacaaaacctcaaacaagactgttagttaacaagatatttttgagttgaaactgcattaggtagaaaatagtggtgtagagaagcctgtgagtgtttaaaaaggtgcttgttttccccatttgcaggttctatacagagtaatgagatgcgtgacggctgcaaaccaagtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattatatcatctcagtcttgaatttgctcacattggtatgtgaattactgtttttgttgtttttaaattgtttatgtctttaagttgatgtgagagaaagaaagagctttgcttcttgtgttttaagtaagggattgcattttaaagaatcctttgataattctcatttttctagtccagtatggtttttttcctagtatcaatttgcatttagtgtctggtagctcactttagtctaacttctctaactttgtatttatgacatgtccccattttcctgagactcagtagtgctcctgatatgtaccttatgggagaatgtatctatatttaaagacctgcttatatttgatttcttagaaaaaattcaaatgatttctctttaatttctctttactttattagctatatagcctctctctctgaaatctaatggaatagtgagtctttatactgagtactcagttcctgtaattagaaacacatggcctgtcttcttcactggaggccgctggttgtctcttgctag

SEQ ID NO: 32953 - DNA, 1229 bp, Mus musculus
gatgccatatagctttggctattgaaatatttgcttaaagctgtgatactaatattttctttttctttttcagaactgatagtgcatcagccgacccagatactttaaaatactcctcatctagagataggggtgtttcttcctcttatggactgcaaccttcaaattcagctgtggtgtctcggcaaaggcacgatgataccagaggccatgctgacatacagaatgacgaaaagggtatatagattttctcctgttggggcatgcttctgttttagacctgcttctcttttttttttaaccctccttccaggtaacatctgaggttcttccaggctactgtctcatttactcatccaaaatgtgcttaaagcatctgtctgaattgaactttatttctctactcatcttgcaatgaagggatcaaaatggtttggagtcaggtagcacaggggagatgagagaattaggttgtaaatgggtaagatcctgttagctgagggaatgaaacagggccctgttaatataatgtaaacattgctgttttcaggtggctacagtgtcaatggaggatctggggaaaatacttatggtcggaagtcgttggggcaagagctgaggattaacaatgtgaccagccctgagtttaccagtgttcagcatggcagtcgtgcattagccaccaaagacatgaggaaatcacagggtaagacttggagaccagggttgacacattacccctgatgtccatgagcagatgagtgcagctggcagccatttacattatatttctgtgaacttctagcttgtaagaaagggttacaagtctgggtaatatagtatttatttgcttgtttgagacagggtttctcttaacagctctggctgtcccagaactcacttcatagaccagactggcctagaattcagagatccacctacctctgcctcccaggtgctgggattaaagatgtacaccaccatgcccagcttctgaataggcagtggatatggtaagcggagtctttttaaaatttaaatatactcacaccttgccttcttttgcagatttttgagtataaataaataaagtgctttcaacattcagaatattaaagataatgtgtattcaagccaggcatagtggtacatccctttaatcccagcacttgaaaggcagagatcagtagatctctatgagttcaaggctagcatggtttgcatagtga

SEQ ID NO: 32954 - DNA, 1174 bp, Mus musculus
gagtctgtagacagctacagtgtactcatttatatacatacatacatatatatatatatgtgtgtgtgtgtgtgtgtgtgtgtgtgtatatatatataatatatatatatatatatatatatatatatatatatatatatatatatataatctttaaaaaaaagaatctggacaataactgatgagatggaatgtgcaagacagggtctcatgtgacctagtctgctcttcaaattgctatgtaggtgaggctgtccttcaattcttgatcctcctacctccacctcctaagagctaggattccatatgtgacccttactagatatttagaaggaaaggaatccagttacttgtacaggagtgttgttcatgtgctcttgcaggtattgtgagagtagttaagtggaagagtctggcctacagaagggaaaagtgtttgggagacaggtgaaacttagggtctaggtgacttctctaggaaagagctttatttatctaatgaagatagaaaaggctacatggaggtgaatttggatttacagggagaaagtttgtagtcactagtacaactgggaacctcagtcacccaacccataaaatgcaattaagagggttgtggtaaagatggaatgcaatggtagatgttactctactcactgccgtggtagacatttgacaaaagcagctcaagggaagaaggatttattttggcccatggtttcagagtgtctcagtccatcatggcaggtatggtggccaaagtagaagagtgtgataggaaggagtcagggacccaaggacctgccttcaacgaaccacttttttttttcttttttttcttttggttttgattttttgagacagggtttctctgtgtagccctggctgtcctggaactcactctgtagaccaggttggcctcgaactcagaaatcagcctgcctctgcctcctaagcgctgggattaaaggtgtgcgccaccactgcccagcaacaacccacttatggtgaattcctaaagcagtggttctcaacgttcctagtgctgaaaccctttaatacagttcttcattttgtagtgactcccaaccataaattatttttgttgctacttcataagagtacttttgctactattatgagttgtaatgtaagtatctgtgttttccagtgg

SEQ ID NO: 32955 - DNA, 1180 bp, Mus musculus
caacacacagctatgttcatcactaatgtgcactaggccatgaataatccagtaaaggatgaacaatgaagcaaatctcaatataaaaattgagaaggaacggaaagtaacgggaaacaaactgggaaacccacaattacaccgaaaactggcatgttttaccaggtaattgctgactttcaggtgtaaatcggctcttaatagagaaaaataatctccataacgtggaggaaacaacagtgacctgcgggtcgcctttccaagacagggagaaaccctaacctaaaatgcctctccagggcagctctgcatcaaccctaagagccgaccgggcgccttcacgacgttacaatgatcgacagggggaagacccaatagagtacgtgaatcggtcatttctaaccaatcgggtgtaatccagggcctaggggcgtttcctctggctctcggtccgcggcatctatgcgtcatcaccctgagtcgagagcacgattggcggggcgtttggaccatagctgcattgtccgcagcgatgagcgccgccggagccatagcggctgcttccgtgggacgcctgcgcactggtgtccggaggcccttctcaggtaccggccgttcggggtcgtggttcggcgcggggctcttcgccggtgactatttgcagtggaggtcacggatgtcacggggaggacgtctatacgtcacaagcgcgcgacatgggggtggggtttgtagtacgtctagttgattgataggaacgggtgaacttctgcaggatgccctgccggggaacaagtgattaccagcctgtgatgtgacgtcagtgcaagtgtggaacttgagtgtcctgcagtgtccctccggtctccactcgggactttctcaagcaaagtagccttccgacgacagcatcaatctgttataaatgcagattttcgggtccccctcattatccactggattgataggttttagagttttaaaaagtgtgtgtgtgtgtgtgtgtgtgtgtgtgtgtgcgcgcgcgcgcgcgcgtgcgtgcgcacaataattaaattctagagaggccagaattggggtttgaatctgcaactagagtaacaggcagtttgtgaatccctatatatgggtgctgggagcccaactcaagtcatttgcaagtgcagtacacattcttaac

SEQ ID NO: 32956 - DNA, 2476 bp, Mus musculus
gtaaaactgagatttctccgaaagccttcccaggccgagtgaataccctccaagatgccactggtgacttcaaattaaacctgacttcctttttcagatgagcaggaatcttcagatgctgaggcttagaacagctgataggaacgtggagaggccgtcctggcagaaaggcagaaaggaaatccatccccgctgtgtaccccatcacacttgaattcccacccatgcccagtcagtatcacccccttgaggagaggactaggccaggtggcaatttcagctttttggaacttttctccagccttgttcactcctccagggaaagtgaccttagccaactggttagccattagcctttagtctccacctggccccaatttctaagatttggtgacagaattgaagaggggtttaactttgcaaggtgcacaggcagttcctctgttttccaagtgttattcctcttccgtgcatggagctgttcattcctgaaagatgcagagtgattcagagctaggctgcaatatgctttttggaattggagctgggtttaaggagcaggggttttatgtatgatttcaggtgtaggtccacagcccagcctgttcctaagaacgccccataatacaaacaaaggttgggttctgattacttaagtacacatgtcaaagggctagattttgtttgcctgagtttaaaactttgtgtgtgtgttcctttgtttttataaaacattacaaagacagagtatctcttgagatctccagcatagtaaaagctgtatttaataaatacctcatcataagcctcccttatggggcgtcccttttagtggtgtctaatttgatctgctttcactttaaggtctttgtcaatgtactgcagtcctgtgatgggactgtggagtctttactgttttccactggctcctaacctttaaatttcaattaatgtttcagaaagctgccaagatggacttccctgctctgatcactgccttgttcctcaaaaatgattggcttccctctgggagcaaagcaaactcgttgtagcttccatgtctgtgtgtgtataaagggtgctttgtcagatgtgtgtgtgtctgtgtgtattgatgtgtgtgtgtccatatcttacatgtgtgaattcgtataaagggcccttggtgaggggtgtgtgtgtgtgtgtgcatatgtacatctggaggcggaactcatatcctcaagctctacacaatcatttccgtcatcttccatgaggctgttaacctgggatatttttgttcctgtgggaacatgtgctttgtaacattttcttgtattttaagatctatgagttttaaagcctaacaacaggagttttgaataaaccaaagtttactccattctcattctacaaatcctggttgctggcatttttgcctagtgccttcatgaagcattcttgtcctcactgtggccctgaggataatctgctgtcctatgtttgtaggaatggtagataaaataaacaacatattttctttattataaaacagataacaaaatatgccaattggtatgttggttttagttagtgctgctaatgtgtgcacctcctacttgaatattttaataacttggaataaccaggcaatgtctgtatagctttaaagtgcggctctctaacgggtgtgtgttaaactcctgattccgtgtcttgaaagttttagagtatggttgtcctcaaacccacagacgctcttcatcactggttaagtgatgaagagaactgcaatactcagtaaagttgctctttgtcactgcagttagaggaagtagcattttgacatcgatggatgtgttagatgagtcttgtctcctcttggctattaagaagccaaagaaaagcaggtttgtgtgttttgaacgtcaaagacaatatcttaagcattttatatcttgctaccattgaaagccactgtttgtatttattttaatattctataaatatataataaatattgaaagtagctatatatgtgttgggtgcgtgttgtgaatacatattttttaatttctccttaataacatcttgatgttctctccaagtagctcccttttgtaatggccatctagccttccacagtggtaacacacatttccagtaactatgcagtcactggtgggtacttgaagtaggtattgtcattcttcccccataggaacactgggaaattgaactttaaaagcctttgcaaacattttcacttcccgtctgctactataggctccggttctgtttttctttctcccttctctttccccttcctctcttttctattctctctcccctctgtctgtctgtctgcctgtctgtctatctgtctgtttctctctctccttctttctctctctctccctctctatttctttctggcagagcagacctgcaggttctcgcagccacgaaatgttctcatctcagtgaaggagaa

SEQ ID NO: 32957 - DNA, 1126 bp, Mus musculus
cctggacttactagtttgttcatgaatataaaagcaagccattctcattattattttttaaatgaagatgagatatttttaaagattttttaaaaaaacttttaattctctttctgcatgtgtgtgtatgtgtgtgtgtgtgtgtgtatgtgtgtgtatgtgtgtttgtatatgtttatatgtatgtgcatgtgtatctgccgaggcttgaacccagaactttgaacatgttaggaaagtaccatgcccaccccaagcctaacacttaccaattaccttgtcctagccattcaaaaatggaaatggtagaattcacaatgatgatggtgacaataatgggatagtaatgctatgagcccgtgcccctcagtacccccacttcctgtgggtggtctcctggtactctggttctcccctggctcccagccctggagtagccactcatgttttaggaaggagcatgccaaggctcaggggttaactggcccccggtcatacagtgtggctgtttcccggagtgttggaggcagatgtcgctcaccacagctgagcattggctcttaccctgtgagaaggaccttgcactgggctggactttgttctgggagcctttggcctttggccactgttcttccatcttcatttggaaacatcaagtagccaatgccatcagaggaggcaggaatgtggacacacaggaaaacactggcggactagtgagttcccacatgtgctgtagtgaagggcaggtgtgtgtggcagtcactggctccaggcctgccctgctggctgactgtccccaaaactaagctcacaagttgctctggtttctatggaactggcaagcttcatgtcttccacagaaatgcaagtttaaaaaacacagaatgcctttcttctttccctgcttttttacttgatatttccttcgagtctttccccctctgtgtaaatatttatttttaacacataggaaaggttatatgtgtggaaaatgttcaagcaaaatgtctccctagttggcatagatcattgtagatccactttaaacacctatgaataataaaataataaaactttaataaagtttatgctacacaggatcttgaaatttaatagtttcctc

SEQ ID NO: 32958 - DNA, 1132 bp, Mus musculus
ctgcaaggaagaaagcgttgagggagggtgtagagcgctgttcttccccaggagcggaggacagagaagctctggtgacctgaaagggaggctcctgcagtacagagagaaacggacagtgtggttggtgtaagagggcagagatgatagcccttggtgactgtgatgtgtgtgagctcggatgatgatgtaaagcagacataagccgtgcctgcttcccagcctctgactgcggtaggaggccagctggaggctctctgggagcagttggcagtcacagagcacatgctttgagctctcaattccaggacagctgtccattctaacacggctgattttccccttttctccagggactatttgaagaagtggtcagctaaaggaatccaggttgtgagttggactgtcaatacctttgatgaaaagaattactacgagtcccaccttgggtccagctacatcactgacagcatgctagaagactgtgcacctcacttctagactccccaggaggaaacacagttgcgaaactgcctggaggcctcttgcagggacatgagaacactctgttagcacaagccctggggaccctgtggctcatactagcaatagtcacagtgtcaccccaacaagcagaaaccaggcatggtgaccatgctccaaggaaggctccacacttgcccttaaaattctggatctgcaaaaaggcagggtggccccaccctgaccccgctgagggtacagagccacgaggatgagcagagtgggtcctgcaattagggcgcaggcaccaatgcatggggcttgcatgatcactccaagttgacattttaaatcttgccgtacttcagtaattcacttatttccaatatttgtcgtcagctttgttaatggcgacctgtaggtgtcaaacttgtgaccacactaataaaatcattgaaaggtgaacagagggcaaactgtgtactgatcttctggtcctacagtgcctgggaggcctttcctgctttagtttcaagacttggaattatctgtgtcatcttgatgtaagcacttctgaccaccagggggcagagcggcagctttcccatcgtgcttggaagcctgatcactggcaggttcttagataaag

SEQ ID NO: 32959 - DNA, 1127 bp, Mus musculus
ttgttttttcagtcttctttttctagcatgctttacataggagagaataaagggctatttaataagcaatccggatctcagagaacatagtaatactgtctagtttaaagcctgcagtaaaggtactcagatttatggctttcatgactaacactaaacacatcagccaacaatgtaccaagaaaacatgattttatgaaacagaatgtcaccatataattccaaaaagggctttgtgcttctcatgtaacattgggattgtgtagatttgaaccttataacttgaattttaaagatagtagcattttgaagatgcttaataacctttttaggaatatggagataaagattgtttttctgattttcttccatctgaagtttgacttttatacccagccagaagttacaaaatgatgacccactctgggtataagcttgatttcctttgttgagacttacccttcattgaagagaaaaagaagacagtcaaaaaaggtccaggttacaaagttctcctcataggtggaaaggtttactgcagtgttatcctctaagtgtgataaactgtgctttaccgctccgaacactcaggactccgtgtgtatcagtgtgggctcctcagtaaggaagaggagctcaaagtttgtgtgtattaatatgaattagctaacgtgaactatgttttggaaagttacaactacttttacattaaggatgagaaactggagtgtttttgatttcatggtaaaagtttgtgtgttttacatttgaatgttcacagttttctctcagagaagtgccagacattgttttgtgcttttgaagaagttttatttatatgcattatttttattgtttttactttgactggaatgtttattgtgaactgtatttatttttatactttgattttcactagttttgcttttatgtaaaagtcaaaataaacttttcatcctaaaggaaatcttgttggatctcttttagccaagggaatcagctgaggaacgaacatgtggccaaaaaacggtgactcaggtgaccgtttacagctcgagccccggataggcataggtcattgtttcacaggaagcctggctgtctgctgctacagttgataatgtcct

SEQ ID NO: 32960 - DNA, 1181 bp, Mus musculus
tgtgtgtgtgtgtgtgtgtgtgtgtgaatgggatggctcagaaggtaatggcatctagtgccaagcgaagaaaggaccaacacctgtccgttatccactgacctccgtgcacatatttacataatacgaatgggatttaagcaaggcgtggtgatgcaggcctttaatcccatcattcggaggcagacgtaaatggatttctattaacaaaataaaaagaaaaaataaaatcaaggccgatgacggagcttgggttttgccgggccattgcccgatacaactgcggaggatcggaatccggaggaagttgcccctcacaatcatggcggatgacggagcccgggatcttcagagcggaagctgcccttcacaatcatggcgtctggggcggggccgagcttccctggatgtgagaaaaggggctggacgcggaaaacaggcgatcatgtgactgggaagatggctgtctttccctggtaaggaaaaacccgctagtaggcttcggggagggctcctctcagtgggggtgggcagtcctccttgttgggatcggtggcctccgtccccgcccgggctgtcaggactacggaagagcagaaccgctgtcagtactctgctcctctcctctgttccgcagctccttcactcagacggactccatccaaggcttccgcctccttgggagacgttggcacgcctgggagttctggggaaggggatgaattcgcccggagtctgcacctgggagacctggtcgcttgttccttgagctccttagactttctcatctgtaaagtgggaccattcaccctactctatgtagggtccccagacacgcttctttacctcgttgttcaacgtagtagaacgtattagagagaggacacgcccaaaggagagagggggcagtcagtcaactcccctggcggcttgggtagactgcagagaagagccttcaactgggtcttgcaggatgcatacgagctcaccaagcaggaaggaatagtgtgtacccaagtgactggcatacgggcctttttgtgcttagaagtgaggtgacctttaggttgtcacaggtgatttgtgtcgataaagaacccacataggataagcggatgataatgtggttggacgttggagaccttgcatctcaggggcaaaatttctgcgtttgagcatga

SEQ ID NO: 32961 - DNA, 1154 bp, Mus musculus
gtaattggactgtggaccatgatggcaggcgtgagtcagaaagtggttgactgttccagtagcactcatgccactgttggctctgatgggcatctcagtcactattgtaggtgtcagggttcacatctgggtaggggtgttgaatatttgtcttccctggtagtataaatagaaccttctagaactagaaagctagccagttggtgttaaggatgcaatggtaagtgcttaggctggcttctgagcctcagtttctccactcattgaagatgtacatgccaactcttcctagtgctggttctgtgggcccttttatgatacagagagagtgcttgtcacagtacctggcagatgctgagagggtcactgtgattattgctgaccctccaggcatggccagtggggggaatcacttccactctgctggcctcaggccagatgctttcttagtgaatcccaaagcgtgtgggtcatcttggcccataaaccctgcaggccttcctgctatctgccacctgccaatccatgtgacatgctgctcttgtttgctcacccagttgactccaatgacagcttgtacgggggagactccaagttcctggctgagaacagcaagctgtgtgaggctgtgatggctcagatcctggagcacctgaaaaccctggccaaagacgaggtgggtacccgccctctccacctatgagctctggaagccgcaaggcagggcagttacaaagtggtccattgtgaaagggaaacaaatcggagtgaattgtgatccccggtactttgggcccttggccttggctgttctccgcctcgcagcgctcctcgacacccagtttcagctcattcagcttctggtacacatgagtctgctctcaacttgcaaggtttttggtttgcgctctcgctctctctctctctctctctctctctctctctctctctctctctctctcatacatcaattagaaacaaacagaaaagctgggcacagttgcatggacctataattccagcattcagaggctaagacaggatgatcactggttgtctcaaacagtggtctggggatgtagctcagtgtccctggcatgcacaaggccctggttttaatcccagcacagcataaaacagtgtgtgatcccagc

SEQ ID NO: 32962 - DNA, 5184 bp, Mus musculus
aaaaaaccaacaacaaaaaaaaaatcatgaggtcctgaattggaattcccagaagccacgtgaaagccagacacatagcacaagtgtctgtgatctcagaacgcctatgaagtgatagtctgttgcgtgacactgatatatggaggtacaaaacatatcctcattccacatagggagccaatgtcagaccaaagcaatgataccaccaaagcctgataaacagcttaattgaggttgcaggatcctgtatgggttacttagaagagcgtgatagctgaaaggcagctgcattaccaagtctaccctagcatgaaggacatctcatgaaggctagagcactggagcattctatatgacttgcaggcagttcaatagacatgcagtccttactgcttatgtagccttgaggagggaggggccttatgaacctgccaagtttcaggattgcctaagacttagtgagttgtttacttcctcggtcttaataagctcccctctcagaatgaactgcttaaagtcagaggatcagtatacaacacaggctatataggaggatcgctggaagctcgtggccagccaagcacatgcagcagaaaaatcaatagagatcttgaagtgttcttgctatcaccatgtgttgggagaaggtagagcacagattagcttggtgtgcagtgatatttgttagaagccaatgatgggctctcaggctggtcattcccgagttgggaatcatctgaatattatcacccccattaagctctaggcctcatttcctcacctgtaatgtgggaatgagtagccatattgaatgagacagttcattgcgtggctgagagtgagggaagctttggtcttcaagggcaatgacagccttttactttccacacagggaacccagtttggccagtgggatactgccggctttgaaaatgaagaacagaagctaaaattcctgaagcttatgggtggctttaagcatctgtccccgtcattcagccgccctcccagcatgactatcaggtccaacatggccctggacaaaaagtcttcagaaatgctccagcagagtctgcagcaggactatgaccgggccatgagctggaagtacagccacggggctggcctgggctttaactctgaggcccgaaaggtcttctacattgaccggaatgcctccaagtctatcaagttgcaagattaaatattattgtcttgttcttcaaactgcatttcttgatcagttgcatccgtcaagttggcttgaaatagtcacctgcagttattgaggaccaataggaattgctaaagcctcctattttctatgttaaacattccacctccgggtgacagtattttaatagtagctagcagttgttggcacgtggagggtcctgactattttccttgcattgttacactaattatggaatgggtgctgttctcatctctatcaagttcagggataaataaagtaattaaacggcctagggtcaccttccgttaagtgccatcaagagtacatcacccagagtcactcaattatcagtgcagaaagcaagtgatatgccatgacttgcaagtttgttttccttctcccttatcaggaggcaggtgtggtgcagcaggcagacgtggccagtacctctgagctggcttctttccagccgtcctccttccatctgactgctgtgcttggatttgatgctgctgtattggctggatctcaaggcattttggacagtaggtaatcctgcgtatggacccatgacagattctcagcagcatgttttgtgtttgtgttcactagacagaagaccttggacacttgtgtgatgaaatcaaacatataaggggtggagaaaaagatactttgctgcaggcaccataccctcccacccctccctcccaaatcacagcaatcttcatggagctcctgatacagagacccatgtgacatgattttctctcccaccagctattggcagtctggtatcaaggttcagagaaggttactttcctgttttggcctgatttctcacaggcagaaacactgggtggggatggaggtgtttgatgctgcactcagccaggacattcattcatccttccagcaccgtcatcagtgttgatgccttcatgctgctaagaagatgagagacaattcccagcattccagagatgggagaaaaccctctctacaactaaagaaacttccggcagtccctcagggaacctgtgatggcgtcattcagctttgtagtttttcctgtatcagcccccttggtaaggagatgcccctcaggccagccagggagagggtgaggtgtgcagtactgccaaatgggcagcagaggtgttgctgtgccccctaccttgttcctgtcctgtgggcataggccatatgtatggcaaagacctgtttacaccactttcctggaatgaacttggcttctcatcaattcagcctcaagattcagaaaagaccacttccagtcacgtcaatggcagaattctgcatttgagtcaacttccagacaaatctccctcggccttggtgaactctgggaaccatctgcataactccaatagcttgtgttccccacaagtcacattccagcctaagtgtctcagctcatcaaaaacttgcacatggcaatcttacgggtggtagatggttttctatcttatgtcacatatgccttggaagctgtcatcaaagtgtgagagccagatctttttcttagctgttacacatacctcagtgctgaaagacttgattttgtagcttggtacctcagcgttgacttaggtgctccactagcccacctttctctaagaattgaagtctgtagtctatctccaaggcactggaggtagggtcagtgatctaacacaaccttgaacttgactgattctctcaggcatttcttaccagcttggtggcacttaagcaatatccttgtccaacagtcaccaaaatctcatgattcttaacacttgtgcttgagctgatttctgtgctatatctgcttgggcccatgaggccctgccctgaggctacatgtacaaccagactaacctgtgaaaaggctctctcagacacaggtgtccctgctcttagtactacttgggttatggtaggcaggacacacacatacccagcagaagggaaattaaagtcactaatcacatgctgctattattattgttgttgttgtttttttgagacagggtttctttgtgtagccctgaagaccataccatgctagccttaaaagtcacagcgattcacctgtctgcctcctggagtgctaggattaaaggtatacatcactgctgcctggcttccagccaccactggctatcagatagatttgaaatcagatccttgataacctgagcaggttcttttcttcacagttccctaactgatacgtagcagaagatttagtgtggaagacacttgggaaggaaaaggccacaagccaagatcacaggcaacgtacagaagccatgcagcatctctttccaccagagtacccacaaaagaacttagacatggggataccttgacctagcccagagaaaccagtgagttctgaccaacagcagtcaagacagtaaaaccacaggaagtcactgtgcttgtaatttcttaaaggaataagaaccaggaatcactcacagatggacatgaggcatcctgtttttcatttcctaaaagtctctttacatgtccttctcaggggaagtagatgctgtttgtggaggcgggcttcaaagactggactgtcagtaacacttctgcccaggtcagcagactgttgcaggagccccgtggtatgtgtacccagtgtgaggataagccgaggttaacacaagcagtgggaattccccaggccagtgtaagctgcttatgctgttatcctgggcagccttgaggcaggagagtaacgtacaaaggattatttatgaatttgccagttatttttgaaagaattagcatcacagtgaaagtgacataaaataattttagtagaaacagtttggtgaaataaaggccatttgggagtatttgaacagcaccatagtgcattctgggttctggcatgttcacagcaggaggaaaggcattttttagcatctggtttttgtttttgagactggggctcatatatcccagaccagcttcaaacatgtaactggggaccttgatcagatcttgatcctcctgtctctacctcctaactactgccgttctaggtctgcaccttggcactctgtcttatgtggggtcttgtgtctgccaggcaagcattccactgactgagccatatccttcgcctcatctgctcatttttggtttggtttttgttttaagaaattgtatcaattccttgggctggagggtattctcatcagattggccccaaatgtatatacaacagtaaccctgctctttgttgttgttgttttgttttgtttgttttttcgagacagggtttctctgtgtagccctgactgtcctggaactcactctgtagaccaacctgaccttgaactcagaaatccacctgcctctgcctctgcctcccaagtgctgggattaaaggcgtgcaccgccaccacctggctgtaactctgctcttaaactagtaaagacacaagctgtgtgtgtatgtgtgtgtgagacttaataacttctactttctgaggttagtcatgtatagtatttcagataaataaaatccatgcctaaagcacaaatatagtcttttgaatgtgtgtgttttgccctgactagttttgagcaaccctgcttccacctcccaagtagctgcaacttgaagtatgtgccaccagggcagtatagcctgaaacacagctgagccaaacttggatgtattttcacaggcagtagtaggttccaggttatgactcagcagtgcttctggctagcgacagaactgcagcccaaggcaatcaagggcagttataagctcactcagaagcactgcctaagtgcccagcagtgtgtggatctggatgtgcttgctaagtcagaagtgatcagccaacagctggaaacagctgattttcatagcccaggttgaccttaaactcatggcatcctctgcttctttctcttaagtgctaggattacaggtgaacacctctatg

SEQ ID NO: 32963 - DNA, 1214 bp, Mus musculus
cagaaccacgctgagccacaggaaaacccatcgcttagtgaggcctttcagttttgctttttttcctttccaatcctgataggttattacgctgctgggctttgttttatcttggctttaagattcagggtgggctgaatgttttgacatggagggcggaagtaggagcaaaagaagtagggccacatctactactattctgagttcgagttcacctggagaggaccacgaggcaactccacccagagactgtggcagccagcttctgacagagcaaggctgaagtgcagaagcccacggcacctgtttaacagttgatagacccgaggcttggttggggaaacggtctagaaagtcacctgggaataaccccaagctgcgagcacaacttggcatgccaccatattgggactataacagccactctgtcccctcctgagagaagactccacagaggtctggagtcagttgccaaggtagcgggacaatggcagaggggaggggctccaatgtgccagctgtttcagaagttaagatctggttattgctccaccccccacagatgagatcaaggacagccaacaagtgtagacgggtgggggaggggttgtcttttgaatttgccaaatggcagagtagaagaggacactggcatttacacatccaaggatgcagcgaccatgtgagctgatgagagcccttggcaggtgctttattcataaagagctatggctcgttttttgatagataatatatatttattaaatgtattaatgtgtattttataatgtaccctcactcttccccttatcctggctgacttgcatacttataaacaaaaattgtttgagaaatttcaagacaatcagtatgtacagggctgtatataaaatatcacagactttaaaggttgttaagcatgggcagataggttttattttcaaaatgctgttcttaacaagaaaataaaggctttactatttacctaagatgcgtggtagcttgtcagtcagatactactgaggaggctttcagccacgtctgggcattttaaatgggagaatcctggcgagcagcagccacagaaccaatgggaccattaagttaatagggcactgctgtaatactttggggctttaacaatggaaatcctttctgacaactgcctcttattgggctggaaacaactcagtgctagagccttggccccactg

SEQ ID NO: 32964 - DNA, 1744 bp, Mus musculus
atgcagaagcatacactgtttctcaggggagggtgctaggaggatggtgttggcttctcctcctctttactctctctagtttccttttaaacactgccaactgatgggactggacagtctctgagtgggaaatgacaggacattcccaggagggtgtgtgctatggctcagctgtccctgcttgttctgttgtacacatagagaagctgcattgtggattatatgggaatcactttgtgatgctttctgctgttagtttttcttgggtttttgtttgttttgtttgcaaatctgatgtctcatcactgcaggtgttttgagaaggtgtgagtgagaagagaactgctctaggtgtagacccaggggtgtttctgataaggttagggatgaggaatcactgccgggccacatatcctagtaccaaaaccaggaaagaaagctactatcccagggtttcactggactgctgtccaagctggtctgtcagcttgtggtgctttccagtgttcgtcacaggcagagattggaagggtagaagggagcagtgaatactgtaaacccagctgtccaggtggggactgtaacataggttgggaactgggtttgtgcttaaatcttaatgcacagagctagtgacgtgagaatatatacttcgcatcacacagctagaggcttgcttggtaagccagaccaagaagatatgggagaagcagagaataggcagtaccttgctaatgcagacggggctagaccatcctcaggtgtttgacatgctacctcgggtctgagattgaaaccatcttgaaaggataggccttagggtcacttaggggaacgggaggagaggatcttggtgccttcttgtggcttgctccaagatagagggacttttcttttaatagtgtaggacagagggcctgaggaccagttactcttggctcagacaggttgttctggagcagggcagttgctgcacttgggattttgatctatactttgcttttaacggcctttttatttgtttgttttgaacgagtccctactggctatttgccagttgtacagtgctgtgtgctcttgggatctaaattcactcacagattttgctctgccttcagatttgcggactttgtcttcactgccttttcagtgtgctagcgtacaggtgatccagggtaggaacttagcagttagttttaaactatagcagttaggacagaaaataaagaagcagaaaccaaatccccgtgctgacgatcagcatgcctgtcctgctctgcagagagaggagttaagcctgggcctggaggacacgtttctccaaagctgaatacagttctcagatatttttactgcattttgttcttggtacagctgaactttcaagttttcaaagttcctgatattttaaaaaataaaaatgaatttgttctgtaaagtttggcattcttttttattctgccccatattaagtgtctttctatgtgtatagtatgtttactataaaaatggctttctatgtgtatagtgtgtttactgtaaaaatgcttatatgtttgattatcaaaaatccggcctcattgttcctaaaaggtaaagatactaaatttattcctgaataattaatattcaaaaactacaagtttaaaataccttgcaggatttacttcaagcacctatcatactgagctttgttaaaggcattagctggcccttgaatcatttatacttctgatttgaagag

SEQ ID NO: 32965 - DNA, 1312 bp, Mus musculus
aaagaggattgagcaaaggagaagtaataaaacacatgagacaggaaagaggggctactgggagtgaaagggtacacaaggggccgggggtggggggggaggggaggatcagcaaaaacgtggagcttgctcgtggttcccagtggcgagaggaggaggaagcccggagcggagcggggcggctggggggggtggacccgccgcggctgctgctgccaccgccgccgccgccaccaccgctcgtggggctcgtggcgtgaggaaggaggacgagtgagaccccggggcgagcgggcggcggcgccgctgctgctgctgctgcgggagggtcggcggcgggacggcgatggcggatatcgacaaactcaacatcgacagcatcatccaacggctgctggaagtgagagggtccaagccaggcaagaatgtccagctccaggagaacgagatccgaggactctgcctgaagtctcgggagatcttcctcagtcagcctatccttttagaacttgaagcaccactcaagatatgtggtgacatccacgggcagtactatgatttgctccgtctgtttgaatacggtggctttcctccagagagcaactatttgtttctcggggactatgtggacaggggcaagcagtccctggagacaatctgcctcttgctggcctacaaaatcaagtatccggagaacttctttcttctcagagggaaccacgagtgcgccagcatcaataggatctacggattttatgatgagtgtaaaagaagatacaacattaagctgtggaaaacgttcacagactgttttaactgcttgccgatagcagccatcgtggacgagaagatattctgctgtcatggaggtttatcaccagatcttcaatctatggagcagattcggcgaattatgagaccaactgatgtaccagatcaaggtcttctttgtgatcttttgtggtctgaccccgataaagatgtcttaggctggggtgaaaatgacagaggagtgtccttcacatttggtgcagaagtggttgcaaaatttctccataagcatgatttggatcttatatgtagagcccatcaggtggttgaagatggctatgagttttttgcaaagaggcagttagtcactctgttttctgcacccaactactgtggcgagtttgacaatgcaggcgccatgatgagtgtggatgagaccctcatgtgttccttccagattttaaagcctgcagagaaaaagaagcccaacgccacgagacctgtcacaccaccacggggtatgatcacaaagcaagcaaag

SEQ ID NO: 32966 - DNA, 1186 bp, Mus musculus
acactactccatgcagactttgcccagcctgtatctgaagtattccacatcacatcggaggctatcaaatccagccagaacctggaatataaatatcacagttgtataaatctgttgaattggtaggaattacatgcatataaatgtatgtaaaaatttaaatatataattttacaaaagtatctaatttgttggaaaacacattttttttctttttttttcttggatttttaaaaaatttacatttcaagtgttttccccttttcaggtctccccttcagaagtccccatcccatcccccctccccctgcctctatgagggttcttccccacccacccactcccatcctcccaccctggcattcctacactggggcattgaacaccctcatgcccaagaatctctcctcccactgatgtccaacaaggccgtcttctgccacatcacaaaaaaacagtctacaaatcaatctttttgcaggttttatagtatagcctcagttctgggaaaataccttccattgacagacaatcctaaaccaaagctgctgtgggtgtgtccaatcatcttaggaggcccagttgtcccactggtgaagtagatggccatcatctcgtcgtgttttgtgtccacacaagtgtggctgtcactggcatatctgtgaaggacaaactgcagtgtttttatgaatgaatgacctctgaggaggatttgaaaacctatctgctttgggcctcttcaacttctgaatcagtgacttggattcacccccaaggtaaaagctacctctgtttccatcctttgacttgtgagatgtgagcatccaccttcaagatcacgcatctgctagggagaaccctcatccaaaactgatcattgtgggcatttagactgtcacagccctgagatccatccacagcccagaactcccagggtgttcgctgagagcttcacagggaatgcatagaaagtcaatttcttcctctgaccagtccttcatcctttccatctttcacaagagaactcctcaataagccccttgtacaccgttctctacctcagtgaatgctttgtatttccttatttattttatcgccagcagaccccttctcaccgaaaagcttgcactgccaactgttagttctgtaacaatcactgattattcttatcatttactgcttttct

SEQ ID NO: 32967 - DNA, 1222 bp, Mus musculus
actgaaaagactaacactagtttctagggactctaaggacagattctcattactgaaacctggttcttatttgcaactgtatgatttaaacaagttatatctgagtctttccttggaagatggaatgaatacttgtctttttaaaacttaaaagcagcccagtgatacaagtgtttaaaactgtccatacttgattttacaaaagaacccagtaaatgctggttactactatgcttctttaaaccttggtgccactgatctgttaagtggcagagctaggatatgaatcaggcttcttcactgagccctctccagcaggcaactttacaaaagctgcctcttggtgtatggcacatgcctacttaaaaacttacttcctcagccaggggatagtggcacacacttttaatcacatcacgcaagaggcagaagcaggtggatatctatgagtttgaggccagcctggtctacagagtgactgtgtagccaaagctacacacagagaaaacattgacttgaaaaaacaaaaggcaaaaaaacaaaacccagcatgtctttgtttttatttattgcagtgcttttgggtcgcaccctggcctaggactgatgaaaataaaagaggaagaagaaagtgataccccaggcgtgagagtgtgagtctctgcactttccaagtgccatttcacatgcaatgatggcaagcctctccctctttcagatagctttgggataccctctaaagtatattgtcatgttcaaaattccaataaatgcctaaaactcaaaacatttcctcctcttagatgtggtggtggtggtaatgctgggggagggtgggggtggatgagtattttgtgtctgagtttattacacaggtactgattgattcctgtagcactaccattaaatgacatatactgaggccaagaaaagaaaatccagccagtttgtcaagtttctgtaagtaactggctaaactgttgactccttggcatctgttagaaaagggggccagggggtggagataggctgaacaaacatctggcaaaagcaaagagagtggaagagacttagctttcaatcccatgtttgggaattcctcctccttgggatatagctgcagcatcactcttcaccagcaggtgtccccatcggacagggcactacttggaaactggaaacttcaaactcacagtgctaagttttaaggtgactctcacag

SEQ ID NO: 32968 - DNA, 4474 bp, Mus musculus
agtgccagacctcagttttgcatattatttttcagggcaggtctgtactgtgtgtagtgctgtttacatggttgaatttaggttgtaataattattttaaaagatttacacagatatgaatatagcagtgttaactgttagccacattgcattaatttccagacagtttggagctcttggagagccaaggccaaggccagtcaagagcatttgcagtctgacaccccaccccgtccctttaagctaatttatccaaagccctgtctccctcacttcttgctcattccttctttgacctattgcatttcatatttaacttacccatcatcatgctgtacctgtcagtcaagtgagcagttttgttttgttttgttagaacacattgtactgaaaaccacttaagcattgaatgcagagaaagcagtgctacctcagttttgctggaagtagacttctttgatagttttctttgatgtttttgtattttcatgtcataagtggaaatacttctttttctccccttttcatttgccttggagccaaagtttccgttctgggtggtgagaaaagtgtgcctgccagccgacctgaaagaaagcggtggcatggagctctgcttcaaactgttttttctctagttttgttgagtatcattagcttacttgtctggcaagtgcagaagcctgaggctggcctgaactctgccaaacaaattatccacgtgtattgaatcattaaattgtgtgccctctccctctttgctgcgcccacgttgtcacttaacccctaggaattatttattgtctttttgttaatgtcaagctcggttggggtaacgtggtgactgtttaggtttacatgaccctcttctctttcccttaccccagacatgtatatatacatatataagatatgtatatattttacctttataaaatatatatatatacacatatatgtatctatatccctttgtttgtctgctaaaactggccatgaaagagggagctgccttcaatctgtagtttaagaagatgccagggagcatcataaacggaggctattgtatattaatttagactttttcactaaaaagaacatgaatgaatttgcttgccgaaggaggaaccagttctctagactccatgctcactctacaaggccagctttggtcaagctgccactggggcctgaagagctgactctgtcctaccttattccactaaagtaccatcttgataatttccccttaaaaaatattctcaaaaatgtactggaaagtgggtggcaggagcttgtacagttcagcttccaacatttcggaacagatttaaaagggaatcttttaataaataaaagttacaaaaatatttatactcttgatacaatgaaaaagtgtctattaaatatttggaatttcctcccttgattagtctaccccaaatcctgggtacatgtttctcaacctgggtaagaattgcatgctttgagttcttcatgagtcttatagctctaggcacttatctttataaaaatgattatttaaggagatgacagtcatatttcttaaagtcggtattgacacagggaacatttttgtaagcctcacaattgtccttccttgagggatgagatgatgaatatcagccacagacttacgatagtgctggaaggcccaagtggctgttgggccagatgtaccccttttttttctagccagaataagatgaaatccttgagtaagaatccaggagcccagtagtttctgagggcacagctacattataacatttggttaagatctcatctagccagttagttgttcctaattcaggattaggtagaaatctaatgagggaagaggtggagttaggtaagactttctgtcccagataagaaagggtgtatgtggggaaagtgccaagagggagtttgccaagggccccatggactcaaggaactagatcttttcctcattgggtagaggtttttttaactgctcagtttctccaatcccaatgcctgcaccccaaccccagccatttagaaattgtgattatatttttaatcatctgttgttgagaaaccagagaaaggaacagtattcagggagggactttgggttttctgtgtagttgctttgctttgccaagagattctcagtgaggtgtaaggtttgcagttaacacttctgggaaacaaaagtttctgtttcactcaccctcagataggcttgctgcttattgggtggatgagcagtggctgggagccaaattgctcctcaggttagctagctttgtggcttcaggtgatttgggaaggggtgatatcagggtgccattttggaattctgcaatgtctaagcattactacacagaccgttggaaattgcatactttgggcaaatgactttttgagtttccatggtaattctttagtaacttattagcaagctgatatgagataaaaagttactttattgaattctttcccttagtcttccttgccaaacttgaatgtatcattctcattgacgctttgctgtacttctgggggttgcttcagcagctctctcttcattgtggcagatgcgccaacatgtctgttgggtccagaagtctgtatgtacctatctgataaagaagttctcagagctgactgaaaatccaaatttcagccaacactttgggccaagggaaagataacagaaaatgtgcaaagcagtactgttcatattagaagggcagtgaagaattaccatgcacacagaattagcttgaaacagtactgtctcctagggtgtggtctccaggccagatcaggttatgggatcccatagattatgtacgtagactgcacattggtgggaagttgctaagataaagacttgtccaaaaactaacaaagcaaaagatgtgtttattggaatgtatagtctgctgtatttcaagtggggtcttcagtgcagcaggtagacctagttatacagttatgtaagggatagagaactactgttaaaaggtttttatcccctctcaccacttaatctcctatgtatgttaggatggctagtgatgacctgaacatcttggtaacagacagaggtcttacctggaggactaaagcagtacttagcttaaatacttgaaaggacaaagttatcaaaatacgttgattaggattatttaaggtcatgtgacactgatcttttcttctgggtcacgtagaggataggttcttgccacactcttattcagagtttccttggtaagctgtaattgcagcccataccagtttgacctggcccaggactacatgctggggatgctcaccaggagtcgcccctggtctcagcccctctcctctttatttcagagaaggatgcttgagcattgggcacagatgctgaggtggtttgattagctgaaaaaccaagttctgattcaggtgttggggcatcatgttctgtttctcttggaaacccagcctgctctcatagatacctacttccatcacatatcctgagcattgccaaaagaagccatttagcagctgctgtttttctctcagcacaaatatatttgctacagaagaattctcttttctctggtcctggtccccagacctcagaatctgttaactgctcttccctgctgcactgaatatggttctaggttttgaagagggaatttgaagcaataggcaatcagggcttggttgaattggtcttgcatatatcctgtcttaatcctctgaggtgatgagacactgctcatgtgaccttctacctttgtggatccctcttggtttgtgaccttcgtaccttccctgaggttgtacaaacttgacaaaagttaatacttttgtattctctgcactgttgcactcttcaaatagccccctgaatattaacttgatatacacatctttctcttttatgtctacagtattttttccttttttttttttgaaggttatctgctgttgaattcaataaatttgtttacctaattattgatatttctgcagaaaacaaaaaacagtgaatttattctgaggtaaagtttatcaacccattgggaaccttttccaatgtgatgctatgctatattaacaacttaggaaaatgacccatgtaggataggagtcttcctccatgcacatgaatgcttgcttagatgcccattactgaaatcatctttcttaccttaggtatcacagttcccatgagaaataaaaagacagttttgagctctatgttaaatacatgggtggtccctaggtctaattaggcttgcaatgattaagtttattttttaattcatctgcaaaataaagggcattggtattaggatttaagaaaaagtctgtgaaacacccatgatatctcatagttagtgcctcatagttaagcctccttaaggttcatcaaaaagatgttaagggtattgtgtggtggtggtggttgtgggca

SEQ ID NO: 32969 - DNA, 1257 bp, Mus musculus
acagtaaaggtaaggtcatgccaaaccttatagtttggggaatctgacactgttggaatgaataacaattgtcatctattgtacattcattttttccactggttcagtctgctacgttaacaatgcagtgtatacgttcaggcatacaacttcacataaacattaaggtcactagcaaatatctggctgttttggctatttacaacactagttctgctcttccataaaaatcgcattttatctgtattagtagatcttcaccaaactcttaagcaatacaatattccctctaatgctttacacacgtgtgtgctgaaaagctaccattctttcatttgctttgaagactgcattaaaccttaaggggttttttgtttgtttggttggttggggtttgttttgttttgttttgttttttgtagaaacagcaatgcagctgattctgaactcacaagtacttttaaaacccagtcctttcctccccacattcccatgcctgtgtcaacacctcgattcttcctggggaacacttgtttgaatcttgtcacaagggtgtttcatggcagtggagctgagtttgtcctctctagagtgaatggcaattcaagtatccctattagtgggcagagtacaagtcttacatagcctgtacttcaaacaaatgggaatgactcctaagcaactcgattctccctcacaggatggtattcggagatgggttacctgctcagatctgacctagagtggaagacttgggtcagtcctcaccaatgtgtctgttattcagctgtctcagtattaaattgtgaatgaaaacccagtgtttgggctcatacaggaaccttggagaagtggacccctctgtgtgagaagcctgcagtcagtcggaggaaggacgctttccaccacctgttccgtccaggcagttctaaaaccaccactagacatgttctgtggacattcgggattgggctttgatcagtcatcagtcaaatgggtcactctgaaggaaaggtttggtggttggcattataccactgatacaaagtattagcaaagtatagttcaaattaagtgacatgaccaagagcttttctcttaaaaaagatggattttattgtaaatagtttctcaaaatatttttaactggatcatgagcatggggagagaaagtttctcagctgctatgaatttccccactgtttacttctctcatttacagtggtattgcataagattacaaaatgttaggtttta

SEQ ID NO: 32970 - DNA, 1177 bp, Mus musculus
ctctctccaccccaccaccaagttagcctattgcttgtccaacaggacagcctcagtggtccccactcccaccccaggagggcactgtgtccttgagggcagagtggagtctgagacctgttggatcagcaggtggtgttataggagctgctggaatcccagcagggctctgtaattctgtgcccacttgatttctcccctcagtgttagatagcagagttcctcctgagcaaggaagagcggaagacagcacatggttccttgcttcaggagctgccttctggtgtcccctactctctgtctccatgctttgtctgcctgggacctgtacccttctgaaccatagtgtctatctacacagcgcctgttggtctggtctctggggaacagcgggtccaaacagccaaaaccaaggcccagcagaaccatgccttcttggagcgtgaactgcagcgacggaaggagcagatgcgggcagccacagtcctgcccagcgtgcagatcaaggaggaacccctgagtgaggaggaagccgatggggctgagctggaggctgaggaagaggagcccatggacactgcacccagcacttgcctcagcaccaagttggccaatgggctgcctgctgggcgggcagtgggtggggacagcctaaatggacacccagttccaggctgtgccagcaacccggttgcctgtgaactgaaggcttttgtggaagccacctttcagagacagtttgtgctcacgctgagcgaactcaagcgcctcttcaacctgcacctggcaggcctgcccccgggccatatactcttcagtggcgtctcagaccgaatgctacaggatacggtgctggccgctggctgcaagcagatactggtgcctgtaagtaaaacctgtgtctgtcaggacagggtcaatcagagcccttcaggaggacagctgggcggtcttcgccttcttaggaatcaggcatgcggagaaatctgtgtgtcttggctccatctgtctgtcttagggacagtggctgtgagcctgcgtgtggatagggtacatgttgtgttcactagatggctatgtgagtctcagggctccctgtcctcatctgaagtgggtgtgttggttttctaccacaggaaagtaagtttgatagggccctaggcactatcaacgcctc

SEQ ID NO: 32971 - DNA, 1099 bp, Mus musculus
ctcagctgacctttatatatcccatgtttcctcacagacactttgtgtatgaccacgtgttcgctgagaagatcacttccttgcagagccaacagagccctgatgaagaagaaaatgagcacctgaaaaaggcagtgacgatgttgcaggcccagctaagtctagagaggaagaagcgagtgagcgtggaggcagagtataaagtggtgctgaaggagaacagtgagctggagcagcagctgggggccacagatgcctaccgagcccgggccctggagttggaggcagaggtggctgagatgcggcagatgctgcaggcagagcatccttttgtgaatggtgtggagaagctggtgcccgactctctgtttgttcctttcaaggagcctagccagagtctgctggaggaaatgttcctggctgctccagaagcacctagaaaaccactcaaacgaagcagcagtgagacggcgctcagcagtttggcaggggatgacatcgtgaaggaccatgaggacacttgcatcaggagggctaaggctgtgaagcagaggggcatctcccttctgcatgaagtggacactcagtacagtgccctgaaagtgaagtatgaagagctactgaagaagtgccagcaggagcaggactcactgtcacacaaggctgtgcagacctctagactactgactagggacctgacaggactggtcacgcagtctgaggcgggggccagtggctgggaacccacccctgtaagcccagagtccatcagttcccccaccactacacctccagaatacaaagcactatttaaggagatatttagttgcatcaagaaaacaaagcaggaaatagatgaacagagaacaaaatacccttctctctcctcttactcgtactgagactccagttgtaactgcttgttttcgctcacttgcctccccttcagacatgtaagtgcagtctccaaagcttgacgttgctaatgacacctgcctcgttgctttgcttagttggcaaaagcaggaaaagaggtgacagagaatgttgactccaaggtccctaggaaatctcacgatacactggccgctggttggta

SEQ ID NO: 32972 - DNA, 1249 bp, Mus musculus
cctgcttttctaagggagggctcctttaggccccacataacctctgccggccgcttattatttttatttttttcagtcaatattatcagcttgaaatgttttaggacctttaataaaatacaggtctcagctaactataaaccaacctgagtgtggctaatctcacaacgattgctcttttcctcttttaaagcatttttaaatccaatttttctgcatcttaagactcttttatacgaaattatttttttcctatcaccattgttgaatccatcttcctaaaaggtgtgtttggttcctctgcccacgctatggttagccttgagtctctgccattccctccaccttttctttgtgaatttgtttttggccatgaaagataaactatttttgaattgtatactaatttcataatgtcagaaagctttggtgctgttttctctgtgtacacgggcgttctttagagtcgtggatctcacctcctgtccatctttccccaggttgctaggaagaggctccatgtttgtgttctcaccagatcagtttcagagactgcttagaattaatccggactggaaaacccatagacttcttgatttaggtgctggagatggagaagtcacgaaaatcatgagccctcattttgaagaaatttacgccactgagctttctgaaacaatgatctggcagctccagaagaagaaatacaggtaccagttctagagggtgccaggcgtgcctgttgggcatttcttgggttttgatgtatatgtgtgttgggttttggtctagtttgtttgtagcactgggaattgaatgcaaggccagggactctacctctgcatgtatcctagtgataagaatcaggagcagttttccatggttaagaattaaacacaaatcagtgggaaaccggaaaaagggaattttccatggcagcatttttctgaagcagaggacttggcatcacagagaagatagcataagtaagagacagcttgaggtaggcagatgtgaggacatgacctcatcagtgacatgtccagatgttttatatgctttaaaaaattttggtaacatatatgtgatgtaaaatatatccctttagtcatttttaagtctgtaattaggtcagcagtcatggcacgttcgtgttatccatcttccctaagaacagtctgaaatatcatcctgcactcttccttcctctagcctgtaatcactgttgtattggcatgaatctgactac

SEQ ID NO: 32973 - DNA, 1152 bp, Mus musculus
gtgcttggtataaatgaatggcagaatacagggttccagtatgatgtcatcagctgcttaaatttgctggatcgctgtgatcagcccctgacattgttaaaagatatcagaagtgtcttggagcccacccaaggcagggtcatcctggcattggttttgccctttcatccctatgtagaaaacggtaagtgtgggcaggccagctcttctcagaatgacagtctattggtatttgcgatttttatctcatgaacacctacacatggtctagtgttgcttagttacctggaattaaagataatacagctagccatgtgtagtatcaccgtggttaatgcttattgtaatacagattttacagcattctgtacgcccctggcactgtgataactcagcctcggctgcatcagtgcctctgtatctgtgctctctgcctttcaaggcagcttgaacacttatgtataagccaagtcaagcagcacattccctcttagtctgctagtagatatctgctgaatgtcatggctgctttgttttacattttgtaactcttgtctcagactctaaaaatgatgaatgttctgttttgaagacattcatgttctagtaagtagcatttcttgaataacaggctttttaaaacatttattatcatttttagaattgtttttgtgtctgtgtgtgagtagagcatctgcagaggctggaagatagccctacgtgggtgctgggaatggaacttggggtcctttgaaggaccagtgcatactcttaaccttgaagccctttatctctccaaccgttggaatacggttttgtaaattaatggtgctgctcttcaacagtattgattgaggagtgcactggaagagacaggttctttcctgacaattagcttctgatactcactgtgaacttaataccacagtaatccatagtttaagctcaggggtttgcactttaggttatcttgaagatgatggcgctaatgctcttctgtattttaataaattaatgtacatttatataaaacttgttacgcatgctaatatttttaaagtcttttgtctttttactttcgagacagtcctcatgtagcccaggctagcctcaaacttactgtgtagccaaagatgaccttgaattttttat

SEQ ID NO: 32974 - DNA, 1235 bp, Mus musculus
cttttagtgagtcattgttcaagaatttaacttaatgtttttatttgttctagtaggtggcaagtgggagaaaccatcagaaattctggaaatcaagggacagaattgggaagagcaagtgaatagcctgcctgaggtgttcagaaaagccggctttgtcgtcgaagctttcactagactgccatacctgtgtgaaggcgacatgtacaatgactactatgttctggacgatgctgtctttgttctcagaccagtataaacacgtggaggcccaagtcctcagagtcacccctgcaaccgaccctccagaagaggagatgcatccagtgatgtgagggggacctctggggactgtcattctcagtatcatgtaggaatttaaaaagccaaaatactaattctttctttgtagtgtgtaagggagtgtttttaaaaacaaaacccaactctttgtgtatttttaatcaactctttactcagaatcacgctccaatgcaggtcactctccaattatgatggaagatattttttatacttaattgctgtagggactcattcccagacaaagcaatagtcatgatgtcatggaaccgatcaatggattgtttttaataaatgaagactggcaataaagctgtccattcaattccaaatattggttataaagtagaaccattgataactttcatgtttagaaactccttctcttactattcaaaaaatgtttttaatcatgctaataaacgtttttggagatgactctggcaccatgttcttctctcagactctgcagctttggcttcatggatgccctcagtaggagcatgatgtgaaacactcaggctgagcctggaaggaaagcaaggttcagcttgggtgtggtgcagaagcccagggaattttgacacccctagaatggcctgccttactcagatatagtgctctaggaagtgcctctcagtcagtgtacctgcttctggccacaaaacagctttgttttcctaagcttccttaattcctcaggattgaagcagtctgtggctttgactgacaggattcagcctaaatagacattcaccttcttccacttccttgaatgccatcttcccagaacttggcttatccctagatccttaactgagagtaagtatgtttgctgaagaccattaccagacacctgctagaatccaaagtgctcccaataaacccagaaacacagtgatagaggagacctc

SEQ ID NO: 32975 - DNA, 2131 bp, Mus musculus
ccaatctccttggtcattggtaagattgtgtataaaatagtattttgcaagcaggagtggattggacatgttgaacatacactggtgtatatactgtatttagcctgaagactttcctaaagtattttgttctaagaactaacctgccattttctatagattttaattttttatatcttctagtattctttcatcatcacatggagaggtgcggctttacacagtgctaactacttttcagtgcttttatagcgacttggagctgctaaggaagatttgggagcttcccacctaccggcgtcagtaagagaaagcatgtgggatgtatgatagtgtcgtacagtagattcaggtccagatccatctcacgcttatttaaaactattgtttcccatggggcaggggcagggataggagcttcatagcatatatcagaggtgtagactctccccaggccattctggagaattccctgagatccccagtatccccaagggacttggaatgcctgggcggctcccaggcttttgatgccatttagcactgcctgggctctgtgactttctcttcttgtttgcggtgagaactgaaggatgtgggtacaccatctttttgccaacagtttacggtgagaatcatcactgccatgcagggcactcaggaagagctccagttgctctggacaagaaaatgaaaaggtgtcagtccctggcttggaatcagggtgtgtgcatgtgtgtgtgcgtgtgtgtgtgtgtgtgtgtgtgtgtgcgcgtgcgtgtgcgtgtgtggtggggggctttctgacttcaaggcccgaattggatgtgtgaagtgttttatgcttggtgtgtccaggtattgttcttatttgctggtggcaggcagagtgccctgaggggtctgaattaattcacacagcctctctccagattctactctggggctgacaccgacccatgcaggagagggaaaaatgtccaggttaaaaaatatggtagaagacagtggaaagtttcctgcctagccttgcaaaccctgccctgctctggcagcaccggtgtaacccacaggcagcactgggcctcctgctcaggttcactccctctaggtcttttctgtgtagtttctggaatcctttttagtttgaaacaaatgtgaaacattttattcaaattattttggagccttttttgttgttgtttttttatgtaattaaaaagatcatgtaatacttaaccagaaatgttacctacagaggcacatgaaatttggttttagtctgtggtgagccaggcacactataccatcttcagaataatccactgtgctgtgtgtcctcatcccattgagcatcagactgcctacaaaaagtttatctgacatggtccgtattttaaggctatcaggaaaacatcagagctgggacagctttggcacagcctcccagagccgagctctctgctgctatgaactctgcagcggggactttgctaggtgctattccagactgggggccgtgtttctgcgcttgcggctctgttgggttttcctgtaggcatttgtgttgtgtagctttgctcaccaactgtgcctctcaccactggttaaaattgagttcaggcccattaccaaaatgtgtttttttgtttttgttttgttttgtttttgttttgattctcttgtgattttgcaccggcgtctatttctccagttgtcttaaaagctgcatgtcatgtcactgtacacaaaatgctttggtgtcattcacgagccaccattagtgagctctgtataagtttaattttgcagtaaaaggacggcagagtatccttcctgcaggctggaagaaagtgtatcctacattttaaattatgttaggccaagtgcatgaggtgtggcactgccttctgttatttatttgtatattttattattcaaggtgtacgcacttttaagaagcagaatttatatttttatgttgaaaacgttttatttctgagacagcagttggttgtatagtatatagttggaattaagagaaaactggaaaatgtaacaaaacataataaatttattacatgatgccttcttcaagacatatttgtcttttctctcccttgccaaacca

SEQ ID NO: 32976 - DNA, 4090 bp, Mus musculus
ttcccttctgggaagagcaggacttctgaccggagcttgagtagagaaggctccagacaaagcttaggctctgacagagccagcgtcacctccacctccacctccaaacccagctcccctcgggtgaatcaggccagagcaggggacaacagagtggatggcaagcacgtccggagctcctccatggccagcctgcgttcacctagcacaagtgtgcgctctgggttgaagagggacagcaagtctgaggataagggactgtccttctttaagtcagccttgagacagaaagaaacccggaggtcaactgatcttggcaagacaaccttgctatccaaaaaggctggtgggagctctgtcaagtcagtcagtaagaacactgcagatgacaagacagagaaaggccatcagcctcccggctcacagcagccaaacacaaatgcagttggaaaggaacaacttgtctctaaggaccctgctaaacattccttgctatctgctcgcagatccaagtcttcccagctagattctggagctcccttgtctcccagtagcaggtcgaccactgagaaaggctccaaaaagctgtcttctagcatgcaaacctctgcacggccttctcaaaaacctcagtgaccttctgcaatcgggtgttttatctgtacagatgtttatttagttagaacccctcctctcccacaccaaagccctctatgcttttattttgtattttttggggtcatgtgcctgactgtgtgagagtatgagtgtgtgtgtggagttcaaattgttaaaagtgtcgccttattctgccattgaaccaaataacagccataggcaaagcattgataccaagctaactggaataattgtagaaaataatctgaatagtccctttagcaatcatccctatttctttccagaaaactcttaatgactttattggacattagggtttggaaacttgtgaaccaattacgctatcagtgtatagacagatgaacagtcagccttgggtttcatctgagcagaatttatcttcatgtggattgttgagtggcatcagaagcttaataaaaacaaacaaacaaaaactgatgctaacaacaaaataaactgagggaaaatttgctttctgcactttggccccatctaccagtctttgtaagggcaatatcttaacactaatgtttctcaggtatatatactcagctagtccagggtggatgcacgttactaatagatggattcaagaggaaggtgacatggggtggcgactatcctgctgccacaggtagaagctttacaggtaggcataaaatctttgctactttcatatctgaagtgataacctgtcttgactctttatatatgttctaagagctgacaaattttgaatagtcagaaagccagtcactaactaatttttttttttcattctcagtttgctagctaaggccattggaattttgaactgtagcagagtagttaatgcctttgaaagattcccagagaaaaaattttattccaaactgaagcctgagttggtaccattttccttccctgatgctgcttgtttctgttagaaattgaggatctcatactgcctcgtgtgtgcatgctcatgccttgtcttgttgcttggaaaagaaagaagttgcctcttgccaagagctactgatggtctgttgatgtggggtgaggctgagcgctatacatgcagtgtggatcctggtgccagtcttccttttgactgctttccagtagcttatttatgtctactctgctctgaagaggtaatctctgacccagcattcagaaacagagtctgaatgcatgtgttcccctggcatgtagttacaaattacattcttatgtatgagaagggcacctcactgaattctcacagataaagaagacacttttccaaggcttgtggaaatctcttagaaatactttgcagctcagtttttttcatatcctctttatttatttattttttagtatcaagagaatcatggttgtgattttcagaatagcgtttgtcattttgtcattagatatagcatgtgagtttgtagttactaaattctaaggctcgtggttcccaggcctcactcttcagtatttctgtgaagggactgcagtgcatatgtgcatgcagttttgattttttttattgttcatcttttaggaatacctcttgggaaatatttccagtaggttgcttaagtttattttgctgctaatgttaacattagctggtagcttgcaggttgagggtggctggaactttgagcttttgtagtatttgaggcttagttgttcagccttttgcacattaccacaatgctgtctacccagttcagtgtgtgtaagccagtacccacaacactcagtcctatactggctgcttttatactcctcctgtccccatgccccattgtggcttcccaaagcattaaagctctctctgtcctgccttggtgtgactgaggtgactgctaccttacatgtcatcatttattcagtggcacaaggtgagccctgcttgagtttagccaccaatcttgttttatttttattttctgaaaaagcacgaaatgttgagaccattagtatcaggaattgagcatttatgtgctttgagctcctgaaacagtcttagaattatagtatgataaaacaaaggactttaataacaagctgttttgccataattaagatgaatagaaactagtttaattttcacagtactatatcattttatttttgaaggcagttaggagtggatcctctttttcctgcatatcatgtttttaaaaacaaaacagaaaaattctctactggtctttacttttccatgggatctagaaatacattttttaataatataataaaatctaaaagctacatgaatatggagtttagtgcttatttcatagttagttcaatagaaaaaaatcaggaagtgtcatggcattatctaggctgtgaaactgttatgcttgtgaggttggttaacggtaaaatctaattcccgactactgggatatatttaagacacagaaaatactactttgaaggtgctgcctacagtgaaatggcttatgagaatatcacttagttcattctgttctgaggcagggttagggacttggttattaaaatctttctcccagtgatttgggcacagtgaacatgtgtactttggggccaaactcagatggtaggtcagagtttctgcttagcctggtagggcagtcattcccaggagacacacagcaccaaccaacagcgcgatgaattggtaatgttgttttgctgttaaataaaaatcctttttattcttgctctcttttcctgtaaacattgtgtgcatgaggctacatcattccttaaatcacccttccaccttgctttaacaactcctcagatgatgtggaagggcaaagctcatatgctcctgtcacttgagaccctggccaacctcatttgtattttttcctgctggcatgaaaagcagcttgagggtaagtagtgctgtgccagacctaaagagctgtgcggtgccacagttgtgcagccatcaggttgccttgatcacatggaatcctcctttaatcattcatccatttgggcccactttgcatacagaggcaagcagaaagcttgagcacttgtgtcctggaagataccaagtcagtgtcaaggagtgatcgttgtcaacggaaacaagctggtaaatcctgtccagctaacgtccggagagctaaagtgtccttgctcatcgcgggttccgactgaactgtctgacctgtgtactggttaagatgcagtacctagtccttcatgtcacattaaccctctgtatggatggatgtggagatcattgagggatgggaggcattgtcagtccctctaaacttactataataaaactaatagggttggtatgtaaagggagcagtagtggcagtttaagggaatgtggattaaagagttatgagcaaagctcatttcaaatatcctctgtgagtagatggacatgtgacatcacgtttcattttgacattactaactagctgaa

SEQ ID NO: 32977 - DNA, 1099 bp, Mus musculus
aagttctttaccctgccttttgacagtgagactatgcaatgttggataatgcaatgttggataatgtttcgtatgcattgtgaacatacctggtctctactcactagatgctgttggccccaccccacccatttgtgataatcactcgttaattgtctctagcagaaaaaaaaaatgtccctggtgagacttacttatacttagaagtataatgagttttttgagatgaaactgttataaaattgaaatatttatgaatttcttagaacatcctgcctgggtataagttgaaatttgaatttgttttttttttttttgtttttttttttgttttttgttttttgttaatgtgggcaatttaaaatgctgttgaattaattacataaataaaatataaaggatggtatctgtggatagagtacctggtgcagccttgctggtactgacggtgagctctttttggcagcctactgtaagaactccgtggatggtctctggtattgcttcgatgatagcgatgtgcagcagctgtcagaagatgaggtgtgcacgcagacagcttacatccttttctaccagaggcggacagctatcccatcatggtcagccaatagctcagtggcaggtaacctagttcttggatgttttttcacagagcaggaggttgtaattcatggtccaaaagatgtctcagaaagctttattattgaaagcttaacgagattaatttttataattccatttaatctgggctctgatataatttcagtcaaggaagtttgggtggactctgaactgccatggaccagcagcaggtcagagttcacatagaggtaggcagagcctagccaagtcattcacagtgtttatgtgttgggtaagtgcctggaggaatagtgttaactgcctgaggtgctgttctgacatctgtttagtttatcttggaacatgtcccatctgagccacatgatcatctatctatatggatgtggtcatcgcacctactcaggggggctgatgtttgttttaacattgtgaaggtttgtgaaagcattctgtaaacagtaaaggaccattagaaggaaagagctctttctct

SEQ ID NO: 32978 - DNA, 1178 bp, Mus musculus
ttagaattctgaacctgtatcttaaaactttatatcctattgtgtctgtttggatggtacacgctcctcacacttatgtcccaaactgaacttattatctttctcttccaatatttcctatcttggaaagttgtaccatcattcattgagcattgtaagtcagaaatttgggagtaaaaaatctctctcagatttctctgctgccctctataagaatttatgggaactatagaatatctttcaaagtagctttatcaccgaagtgtcacctgagtgagaacagatgaatgtgtttcaggagaaggacttaggttttgtgtgtgtgtgtgtgtgtgtgtgtgtgtgtgtgtgtgtgtttaaaactagtcaagatagccattaatctcactttgaaataagttccttgggtgataacataaacataaaagatgtcacatgtattaatgatatcaacaaaaatgctgatgcttagatgcttatattctctggagatatagacaggttccctgttttcatgaagttggcatcctagttaggacaggctaaccccaaacaagtaaatgcatttaacctcaagtagttgtcaccatgtagaagatactggcaccaactaaaatgatagggtgtgaatgagtgagggttctgggtctacatgtgaaccagagtatgggatggtgccccaaggagaaggagtgagctgtggtagcatctggggcgaggtcatgtgcagaggaggccccagtgcagattaggagtatgatgtgtttaaggtacagaatggattcttcatccctactttcaaaaacaattttaaagcatttagcctcaatacccctttgtggtaccaggcttttaagagtggagtcattacttgtgataggaagctatttgattcatggggcctttcaggcaaatagcttcagtgttactgcagtgggaaaaccactagttggtcattaggaatgattttcttggtatttttaccactctgtgtcagcatcagagttcatctttatctagatttgtcattgcattgacattgattcagcagcttctgtttcctacttattggctgtttaggccatgaaggtaagtacatttctttcttgccaccagtctattgctgtcttagttaggatttctattgctgtggtaaccaccatgaccatgaacaactt

SEQ ID NO: 32979 - DNA, 2277 bp, Mus musculus
gtatcctcgatatgatagataaagtagttcatatcatgggaggattatttccccagggagcttttgaagtttgtgacaagtcttttctgtattcaaaatttctagttttagaaacttggtggattattctgatttaaggtccttttgttcctgaacactgtactgtcatagaactatgtagatatgactgacttactatatgggaacagcctaaaaaccaggcactatgttactagtccttgtatcctaacatccgatacagtgttctctacatgtggtagcagatgtttagtagttagggacataaagaagttgaataaaatatgaagcaaactgtggattaagcatcaagataaaggttgaaacaacctagggaagagctggcctgtctctcaacaggctagagagcgataaacacggtgtgcagtagtctgtttgagggaatgagtccatgtgcactgtgttctgtttactttagccagtatgttacagagcatctaggttccatatacagcttataaaggactttgagtgtttgtgacattttaggcttaactttactcaagaattggtacttttggcctgtgacttttccttttttttttttttttaagccaccatcagagacagatatgatgcctgagggaccttttcctgtgtgtagcacttttgtacaagaactttttcaagcccagtacaggtaggagcaaatgacatgttccctcttgttttgtctgcctgatgtagttctatgttatgttaatgtgaatgttttacatttttgttttcaaagatcttctttgacatgtcctcattgtcagaaacagagcaacacttttgacccttttctgtgcatttctttgccaattcctctaccccatacaaggtaagaatatatgtgtaaaattagcagtctgctgtgatagggtacttcttcctctgtagtctccagttaaggctttttacgtatttagttaagtaataggtataatagtaatgaacacagaccttgttaaattcttgaagctaagtgtctgtcggggtgtgcaagctgagcaggcacctgatagaggcaagcccatgctatagtctttttaaactggttgtcctagagtctctggagaccctgcttgtacttacttcagactttaaagagtttgcagaaactagacagttttgaaggaaaagacagaaccaattatgactatgttatttctgaaaaatatttttatgccatagctttttcaaagttctttcaacttgtttagtagttctgttcccatttggcttccagataaagggaagtcccctatccctcatttttagatagagtcctgtgtatcacaggctggcctcaaactctgtgtagttgagagtgaccttgaactctcactctcctgacgtcaggttccaggtgctgcagtggcaggcaaatgacacagttctggtttatgtcatattgggggaaggcagggctgtgcatgctagggacctgagctgtgtcccaggcctcattttagtttttgtgttgatttcagatcaggtttgtttcacttcttctatatttgagctaaaataaataactaatgggaagatctgactttgatctgcacaggcctctctatgtcactgtagtgtatcaagggaaatgttcccactgcatgaggatcggtgtggctgtgcctctgtctgggactgttgccagacttcgggaagctgtatccatggagacaaagatccccactgatcaggtaataacctgctaagaccaaattacacatgagccattaaagtgttgcattctgcttatatggattttttttgccccattttctgctaaacatgtttgaaatttaaaacgagttacatttagtgttgagaggcagatggatggaggaaatccagactcaaagaatctaatgtatagaagactgtttcctgcttcaattaattgtgcatataaaagaaaaacctgcttttatgtaagaccttatggctttgtaaagtatgattacttagcctttcatactgctcctgtagcatttaacagaggcttgggaacccctctgcccgttttggtggtgagagtgggcatctctccagtacggtgctctgcatatagcacatgcttgtcgggcttcttctctgacccctcttgtggggtttggacccaagaccttactcctgtgagcaagtgcactgtacctgaggtatatctatctgccagcctgttttgtttccttacttaaagatcagataggggaaaattgggtttcc

SEQ ID NO: 32980 - DNA, 1129 bp, Mus musculus
aagtcccccataccctcccacccgactcccctacccacccactcccacttcttggccctggcgttcccctatactgaggtacacaaagtttgcatgaccaatgggcctctctttccactgatggccgacttcttacacatgcctctgcctcctgagtgttgggattaaagtgtgaaccaccacatcatttgtgactactaatactgtaacgtggattttgtagggaataacacccataattacttggagcccaatacagtatatgcactcagtaaatcttaacagttaatattgtcttaagtgatacacagttatgaaggggcctctggagcttctcataagattcggtgatttaaaagtgaaatcagagcttttccagcctgttcccatttggtctcagtctcttttcactttagatgtagagtcactaaaaatattacacttgacaaagacttggaatgctcaagttgtgtcatagactaatgatgttacatctctgctgttgtcaggagatgagctttgtttgtctggcttgatttggcagtttcccagatgactgtgatgtgtagccaggcttggtaagctgtgatttagatctttctaaggaaggagagtaaaggttagaggttgaagtggagactttaatatgtcagaatgtaaagaccttagagtttgtcttccagggtctgttgccagatttgtattggtaggctaaagggcatcctccacagaggaggtgagggtgagggagtagatgaaggacacagtactgtttgagcacggccgcattctggaccctgtgtgacatactgctttgtaagtactttgcctttttcactgtttccttgcccttctgatgtgtagcactcacccattctcacaaataacccctaaggcttagttaacttagtagttatcccaaaaatcagattaaaaaaaagacaaatgcttagttatttctagcattagtttagaaaactaattttactttagatactctctgtgcatttagatgctcatatttcatatatttctttaaaattgtagatacaagttgaatatcctttatctgaaatacctagaatgagaagtgtttagagtttcagatttggttttggatttagaaata

SEQ ID NO: 32981 - DNA, 1148 bp, Mus musculus
ggtggacggtctctttatggatgaaaaccaggcttgagaactgtccagcaagtttgctgtatctcagctcagagacaaacttgtctatgacactatggcagtgggggttcccctcctggctagtctttgaagctgaccttgcctttgagttttaggctccctgggtccagggccaagaggacttcccagcaagtggagtgagtcacctaagctgctaggcatggcccacaggtgcaagaggtctgggggcatctggttcagtcatgccaccagataggatcttcagctcttctgatgggtgcagtgctctgggggtgagctgtgcactgaggccctcatgatgtttcctcaaagtctccccgactctgcaccttggcccaccactagctgctgcatttgcgcttgacaaacacacttcttagagcaattctgtaagctcattcatccatgcttctgaggttaagttaaaccaactctgtttatctttattgctaatctgatttatgtctgttgtaatcggtccatttataatcacaagaactaaggttacattttccatccccgtactttctcaggctgtgtggattcccgggactcacacaggtcatacatactctggctttcagccaagggcaactgacccaacccctctgggaatccgcgctctgtccatcactcgtgtttagatgtgaggccatggctctttccctcctcctcagtccccaagggatggtcacaagttaggttttcccaaattacaaatccataaactcatattggggcagagtcacatggaaggtgacgtcacccctcacgggttcagtgttttggagcttgtgaatctgtctgctagccttttcccaggtcaggtttgggggccactgttgaagaaactgtccacttagcaatctttcagtacttttaactagatgatgacctcgtttgggggcttacctgcctttgcctttccctgtctcaggagaagggctccagtaaccacaacctactgtctgcgtcacgcacagccctgacccggctgaaccagcaggcccaccagctggctttcgactcggtcttcttgcgcatcaaacagcagctgctgctcgtttccaggatggatgtgagttccctccgactgcaatgtctgt

SEQ ID NO: 32982 - DNA, 3012 bp, Mus musculus
cttgcgccagtgtggggactttgagcagcagctggcaaacaggtaggaggggtccctgctctccttgcccgtcattccctggggctcctggctgggaggtatttgctccagtgtatgggcagactggaagccacagggctggaggactgtctgtacctagatacaaggtgtcattactgtcatcattaaacatttactgaacacctaaaagggcaaggcctatcctacttggcagtggtcacataaatctggttagatatggaggcgtcagtctgatgaggaagcagtacaccttgtttcccagttatatgtgggttaggcttctgcttatgctcagttattgggctcaaaataaatttccccatagaaagcatgttacaagtggtgactaagaccctaagacaagcccagaggatggagattaacccaggcatccttgcagtccaggccctgggtaaaattctgagtgccaaggggtgcaagtcaaaggagaattttggggactgctctaagaaaaacctattctcccctcctgcctctcctctaacgctgccagtgcttttcctgtgatccaaggttgcaccattcagacatttgcctaccatgcttcccagtttccttattcatccatcctttaggaattaagaagcctggtgtggggggtggttgttgtttaactctgtgtgtgtgctcacgtgagtgcgtgtgtttgtgtgtgtgtgtgtgtgtgtgtgtgtgtgtgtgtatgtgtgtgtgtgtgtgttttagacaggtccttaatatgttctataggcccagggtggtctagaactcactgtacagaccaggctagccttgaactcacagagagccacttgcctctacctcccaagtgctagggttagattaaaatcatacactatcatgcccagctgagaggtgtattgattttaactttgttgccattagaatgtgagtgttgtttctacgcttccctctgtcacagtgtccttacactgacattgctccaggtatatttgttaggcatctctcctcttcaggacagtaactttccttaatcttttgccttccaaagggtgaggaaggctccggttaggaagttaaatgaggagtgcccggctatgggatgagcttgtagttgcagtttgcagcctggagagaagctgaaaggctggctctgcttcatcgagagaccacacagcctctgaaagaggtgatgtcattctggaaacactgagcctggggacagtcaccatctgtgttcccatctgggccacagcttggtgtgtggcaggcaccctgtaaagcttatcttatctccccatctgtctcgccttagaacccagactctagcagagccactccccaggggcaggcactgggcaaggcagagcagccactctggataaaactgacatcagctgtcactcttaagatctttttgcaaaagagttatgggctgtgtaaatcagagctgggtgtcacctcttatcctcagtgacttgggtgagatgctatggcttctctttaccttcctggtgttctccatgttcctataaaacactggcacaaaaatccctgatatgcaatgatcctttttgtgatgctttggctgcactctgatacattaaggagaaaacatattttaaattttggccttttctagactagccttgttcaggccatgatcctttcccacaactcagggtggtggcggtggcagctgacccacagttccccaccagcccctccctctgtgactgctaagctaaggtccaggttaaggactttaggatggtctccacgtgggcgggtttattggatctcagcccattgtaagtctcggtgtgcctgcattgttaaggtccctgtagaatacttcaagtgatagttgggtttcattgtaaatggacaggcttccacggctgaggagagagattgcttgtcctgaagggaaacgaattgaggcgctaggtgagattataccgttccctcctcagtgtacacccgctgcatgcttcaggtgcagtggtatgtgttagcccttcccattaatctcggagcttgagagtcgggactgtacctcttcggtgtccccagctgagccacagaggctgttacagtactgggcagtcaagtcttcatctcactgaggcatcactgggacatcactgggatgctgtgtggagatgaggctaagatcagatgccgttagttctttggagttagaattgtgcttatctggacactttaaactcgtctctgctacagaaagcgtttctagcatgccttgttttctttatggcaagctgacatgggcaggctgggttccccaagtgtggcctctgatccttcacaaacagctgttaaactctcttgtgtgtcaggcactgtgctgggagctggggctgggtgatgaagccactttgttctgtcctcacatctgcaggagacttgagagaacctgtggtaggtgcaaggcagaggcaggaggttgccagcagggaagggacaagtgctctgagggaaggggagcctgaggacccccaggggacacactcaggatggagtgagagtgagcctgtgatgtgtgtgtgtgtgtgtgtgtgtgtgtgtgtgggcagtggatgagcagagacaacgtgaggctgtgagggatcggctctggctaccaggctttcgcatgttttagttttatcctggagagttgaggttgccttttagaaagacggctctgttagctaggtggatgaggtggagtaaggaaggatgggggagagaagacagagtgcttcttcaatccagacctggcagtgaagtctaagggaggtagtcagggatgggcctcagatagacaaaaaagcaaccagatggctggcgggcttaagcaactgtcttgaggctctggcggaggtgggagcagcttgaacgtgcaggggtttctgaggaagcccccatctgcagtgctgcccagcaagctgtggggacactttatgggttgtttcttctctt

SEQ ID NO: 32983 - DNA, 2875 bp, Mus musculus
ctagacccctctggaggaggtatcctgtcttcctgtcggtctctaaattactctttgggactgctggggtgggctgggcttccaggatacatgcctggcactggtatttgtagttctaaagagactaagccagggtattcatggcattccattactctacctcttcatttgggggaattatgtaaacacaccgagccaagtatagtggtgtacagtaataccagcactccagaggaagagataggcctgatttacacagcaagttccaggctagcctaggccacacagtagaccctgtctcaaaaataaataagctgtaagctgttccttggagagtcttaagttgggtggaagcttttactataggcttgactctttttcctactgattgatttaacatcttagcctctcttctgtcctaggaacctatccggttgcggtataagctgactttcaaccaaggtgggcagccgttcagtgaagtaggagaggtgaaagactttccagacctggctgtcttgagcaccgcctgacttttcaaccaagactcttcagtcacgcttaggccagcgtccttttactgtctggtcgggacttgttgtaatgtagtgcagagtgccaaggattctctcctgatgttaggccttgattgccaatgtgtctgttgatcatgtatgtgtgggtgcgtgtgtgttactggggtgctgggggaggagggagagctgggcttgggatttgggcagtatgggggatgctgaccacctctgagatcatctctgctgcactcatacctgcttctgcatgttggttgacaatgttgcccctgcctcgagttggagttttataagccaaagttttttccatgtattgttaatcttttcattcatccactctgtgccttgtcagcctttgaaagtcttagttgctcccaggctgctattctcagggaccttagaaagggacctggttggtcttgcgacagagagtgtcttctggggcacactcttccaagaatggccttgtcttcatttttcattagcaaatgctgcttgcagatattcagtaagaccttctaaatggaatgtttgttgtactggttcaggcaaggggcttgccatgaaaccaggagaccacacttgttgggccaatcatgtccttcactacagtgccttagatactcccttagacggaccctcttgaggccttgctcaggccttgggttctgtgggttgggcagcctgtctgggcccttactcaggacccacaatgtcatcttcattctttctgttcacaaacatctcagagctctttcattgtgaccctgtgttcgttgttgtgaatcatagttaaggggggccagccctgagccctcacaatccaaggtggggagctgcgatgcaggtagagagccatgtggtgactaagtacagaacatcattgaataaatactgtgttcagatctgcctggtgttgagtccacaggggatgcatttagaggggacaggctggcggggaatggttttctgtcaacaagtgaggacatgatgagcagtgttctgacgagctgaaggagctggagaagaggggtgggtgtttgcctcaggtgtccccagaaaggaaactcaagctactggttgactcgagagcacctactatgtgctgggttctttggcatgcatgcttcaacaagttctgcttggctgggtccatgggagaaggaaccctgaggtctgaaatgggtgctgagggctggaaagtcctggcatccagtcttgcgggttctgcctcagaaactggagggccatctctcaattatgacatgttcatctagttggatatccaacaataattttctttaggtgtatattaatattgataatttcagtagatttttaggatagcttctggctgctgtttttgtttgtttttgagacagtcactgtagccctggctggcctggaattcaccatgtagaccaagctggcctcacactcacagtgatccactgcctctgcctcctgagtgctgggattaaaggtctgcgctacaatgactgactttaaaaaaaaaaaaaataggtctcatgtagcccaagctgacctcaaactcactgtggaaactgaaagagagtgaccttcaacttctgatcctcctgcctccaactcatgtgtaccaagtcctgacaagatggaaccccaagcctgtgcatgctaggcaagcacttgtccaactgagctgcatccccagccccctggttttttgttgtctcaagctatagtccaacctgacctggaactcaaataccatgttcaaagaaacatgatatagtagccaatatacactacacacttgtggaaacaggctagagcagggcatccaaggttttttgcctttaagttcccaggaacacgctcctcacagccctgttcccagatgcagcttcaatatcacagttgccaatgcactgtcagtcacaggagggagccgggcgggcatggtggtgcacgcctttaatcccagcactctggaggcagaggcaggcagatttctgagtttgaggccagcctggtctacagagtgagttctaggacagccagggctacacagagaaaccctgtctctggaaaccaaaacaaacaacaacaacaaaaacagttacaggaggaaaaggggaaatgccaaggctttctggaaacttcccatgatgtctgccttcacatcttgtcctgtatgggtatttggccacacctagctgcaaaccacactgggaaggtatggatgttgtgtgcagtgcaacacagtataaacttggggtctagttaccatggaaggagagattcgatagtatggtacaaaattagcaagcagtcttccc

SEQ ID NO: 32984 - DNA, 1197 bp, Mus musculus
aaatgtttcctttctcttcctctgttattcccatgcccaccagccagctcattactattacacccccagatatcatttaggggatataatcctcccatcttccatcccattagaaaccaagtcgtctttcctgatactcccagcacccacattccagtgtatggcttggtagcataatgcacagtagccccagtgtggggctattggtcatgctaatcactgtgctcccactctgctggggggacaattacagctttacccactcttgttcactcctcagcttctgacaagacttctcaagagtaaccaccctgaggatcttcaggctgcaaaccggctgatcaagaatttggtcaaggaagtaggcatttctgcagttggcgctgtagatctggcatttgacagggctgatatgatagtgtgtgtggatgtgtgttaaggtgtgaagaacagctagcttggagaagagatgtcctcctcatgctgaatgggaccagcaggatggtgattagatttgagactccttgcagagcttcccggcttcttttatccatgggacgaagcttttggtgttaacagagttaggtttgggagtctgttccagaaggattgagtctgaatgtacagttgaagagtccccaggtccagagacgatattgtcacctgcaggaattctgggcgagcacctccgctcacttaagtgttcatgacttcctgaactcccagcatgcactgcctttccctttctggtgtttagttaggagttacccaggcaactcctcttacttcttctgtccatttggtttccctcaaaggaacaagagaagtctgaaaaggtgtccaggcgagtcagtgcagtagaggaagtccgcagccacgtgagggtgcttcgggagatgctgagcatgtaccgaaggccaggtcatgccctgcccgaccagcaggccctgcaggtaatctccagttgtgacctaagactgcacctactgttataagcatgatgtattgcacccatgtgttctgtggctgccattctggtctggagagtcaggtttctctgttcctttgttctccctccctccctcctatgtccaccagccactgatacattgtttatcttttattctctaagtagaatggtccttgttttacattctttcatgggcttattgaccacttttgttgcttctctagagg

SEQ ID NO: 32985 - DNA, 3698 bp, Mus musculus
ggtggaaattaataaatccaagtttggaacatgtgtggaatactcttatactcttaagtctgtttgagagtagacctaccagcaatgctgagacggaatcatcaaaagctttctggttgtttccttctttgcttattttctttcttttttcctttctttctttttttttttttcttttcctttcttttttttacttttatttttcctagaagtgacttcaactgaaatattgatgtctttggttgcaaacatttggactgcattgtgatgagtctggttggttttgttttgtttttgtttttttctttggtattaaaattgtatgcaaaatgggggtggtgagtaagccatatatttttgtgtgtgtgctcattgattcagatagttttgttttgtttttttattatttccctatgatttcgttttaatcccaaagatgccagtttctcttttggtacctcattttcacctctttgccaggctctcttccatgtgctgctgcttgggaatggacatgggaagtaacagctgtggtcttggtgtaggggttcccacctcactgtggtggtcttcgaacagtagagtatctctcacttgattcctgtgtaccctttggatccctgttctgaggcgttccactgctggtttgcttgttgacagccttcctttagcttgactttaaagccctgcctatcaccacagcctaggatttgctgctccaaggccccctgctctgaggagccggcttgccatatagccacacgtcatacactttattttttgggaagcttcccagaactccttaagcagtccaatggttgtttgaattatgcttctccattcggtccttctgctcatgcgttcagttcaagtgtcctttatcccaggttcagagatgctgcctttctcatggaagacgtctgacccagtgggtcagcaagtggtattccaacaacagaatgggataagttgctttcaggaccagcttgctctcctggttttagccctgaccttctgtgtacatgtgaactgctgtcttttctgtaagccttgattgactgaaaggagggacagtctcttggtggatgatccttgtgctgtttgctgtttctctgctgctgtctttgcaattctcctctcactggtcgcaggctctcatagtaaggtttggtgagaaacctcccagcgtcacactttggactcttaagctgttacccgccctcatcctgtgaaatgtattcgcatgtattgcctaagatgactattccttgtgagccaattaatgacaatatttatgcccttcccttctaagctgtagtttgggaatccagcccacatagacagcctcttgctttttgtggtgtattcagtgccaagttatgcatctggacaggaaaaactactctgctttttgggcgcataagtaacgtgtgaagtacagcgtccaagaaactgcctgtgttgcacctcagtgatagttgtggattttctgttcttattggcctgcagttcctggagaaggtgcactttgctccttgtcccagcctcctcctgcacttggcaggcctatcaaggaagtgaccaagtggcaggtagagcatcttcttggcttgaatactgtcatttgtttgccaatgtctctgagacctgtcttgacagtgccacatacctagttttggtctctgtgatcgggcctctggtgttcccaccttggctctgaggcccatcctgccagccctgttttctgtgtgggtcccagtgctcttcaccgcctcctcccagtactcatgccctgccattatccccctgctgcccaagggccaaactgcttctcacgcaggccggtgtcatttcaagaggaccaaagcctctgtgagcctttttattttaagtaaaatggtgctttttccttacttggagatattctctataaataatgtaaatgacacctttcatatggagccgttttgagtattgctttccagagcttgctgaatctgcttgagctctggctcctgactctgtcagtatggaaggctttgccagaagctcttagaagacagacagtgccagaagccctgggaataagtgtttagatctgtctgggtcacagcagtatttgctattttgtcactcagtcccgtgaacagtctttatatatttcttaacatgtgggatatactgactaaatctgtgtgagcattggaatactcttccctttaggtagcatcctagtatgttttttcctcaggattatttctgtacaattctttcagtcagatgagagggcacgcaggagaaggcttctggtggtatcacatgaggctgggtaagagagtcctactcacagcaaggctcctctgcttgtcatcatgtagccactgaaaaggctgttctcccatctgcaagtggcactggtggcccttctgtaggctgccatcacaggcatcatgccttccttttcctccctgaggtgacttggcagaaaaatgtgatcacataactgctgctgagcctgggtccctcagctcagagctcttagactctgagttgcaggactcttggtaagaagtattttaatccatgatgggcctttgcaggtagctttggctcttaaaatgaagtttgactgggctaaggattactttctttgcatcctgtagacatagtaggggcctgcctggtaaggtcctcagtagctccttagttgctgctttcccttatgagggccaaagagatgaactttgctacattgccaggtctcagaaaagtcgccatatctcacccagaagggaatttttcctctttaatgtgcctggaggagcattgtgagctattgcagttggcctgcccttttctttgctaggagccaagaagggagggaatagatagatgtatgccaaggttgggcttttcacccatctgccaactttctcttgcttcttgctaccattcaggcctgttcccttggaaaaggatggtccctctgtctttaaactttgtaataaagttaacttccagtcaggatcagacccgtttccttcttcataggcctagaagtagacaggagcctctagtgtgcaaatcagctggtggcttagctgccagggtgggtggctctgcttccttggtgtctgagaaccttccttacctttcctacagacttctgcagaggtatctgacaatatgtaagtactatgtttccttgtggtgtacactctgttcttgtttgtttttaaatcaaaacgcctgtttgggaggagatgaacgtatttagtctattagatttgcgctgctggatttttttttttttaaatatgtaatcttgactagctgttgtattgtttatcctgtaagattagtctatcaattaaagtttgataattaattgtgtctctctttccttccgattcttaatgcgcctatctatcctgggggcttaccaacatttagaactgggccgcgagccatcttttgtcagctgtggtctgacttgtatggtactgtgtaatatatacaagtttattctctgaacagctgacaggagatttgattgagcctgaagtatcagagtaatgagcttgccaatcagccacccttttgcttgggcagccctctgccatgcatgcttctagttagaggaaactacctccccaccctctctgtcctaactgggaatgctgtacccttgccagcca

SEQ ID NO: 32986 - DNA, 1198 bp, Mus musculus
accctccagcacttgttacaggaattggagagggtatattaattccgccatctggcaaatcagaaaggggaattgatacacttgtgagaggaaatactgtctccgcggaggctgcagttccttcatgtactgcgtcaaacagcaatcacagtcagcaccttgagcatacacctcctaaaagtggctgcaaaattactactcagggcccggcttcatccacaaacctggtggcacaagaccaaaaaatgactatatttacagtaaactcagtagtatataaagctgtgcgtgcccatggtcagctgccaggaagtcccaattcttgttctgtaaatgatctcacgcatagtaacttgccagcaaatagtaccccaaactctaaatctttaaaatctcccagtaacactgttgatgagagaaatgaacctcttcaggaagatgaaattcttggtccatctaagaacttcaacctggcagcagtctctcctccttccacagaaagtcaaatacattcttgtactatgcttgaaggccttctgtttcctgcagaatactatgttagaacaacccgtcgtatgtcagattgtcagagaaaaatagctctggaagctgtaattcaaagtcatttgggtgtcaaaaagaaagagcttaaaaagaaaaccaaagctactaaggcggtcgtcctctccagtgaagacactgaccagagtgaaagtggcatgctggacacgagcacgggacagtccagttcaggaagcctctctcagaaactgctctcaccagctgaggtcagctctcctccaggacctgctggaaaggccaccacaccgccacctggtagaggacacagagggaaacgaaaatcagcccgcacctccacactgggtcactgccagctgctttttcctccttgtgccgcactggctgttaacaggtccaagggcaaattcaccaagcataaatgtcagaacagaggcgtggttattcatggtaagagccgaaggcgagtcagattgcgtttgatgtgacagctcatcatcaccgtgtacctgtaaattctgtacagtgttaacttactgaatcatcactgccctattcaaggcagcgatcaccctcatcttcagttgaggaaagtaaggcagagggagggtacagtgtggcaccgcaggtcagtggtgtgcttgaaaatctcatagca

SEQ ID NO: 32987 - DNA, 1193 bp, Mus musculus
ttcttttgattcatctgtacccagtatcactgctttggtggattgagtttcactgtaggaatggcaggacagttctttcctcaggataaagataaggctcagtggggctcagtggggatgagaagcccttgtgtggaacaacccacagcagtcagagatgccctctctctttggatcttgtaagcaagttctgacctcctccagctggactgagagctgtagtgtttggttcccaaacaaactcagacctttccgaagatgtatgtacccagcaaccacatggcagctcacaatttcccataattccaattccaaggcatcagaagatgtatgtagtcaacagtcttgtcagtctgaaggaccacaaagttagatcctcgatagagagtgcaaaagtctttagactttgcacaaatagtagggttactggcctccctggcttccttgcttgactgggtctctcttttctcaggactcttctcaggggagctcccagagtgcacacaggagctgatgattgacgtcaccaaaagctactaccagaagtttctacccctaacacaagtctaatgtctctgcttcatatctttaattcttttgaactcttaagacgaacctggagataaagagagccgccagtgactacaagagctgtcctgtttttgacaacttctactctcccgttgttggctttttttttttttcaattttccatggctctgagcatttaagaatttaataaggctagagagatggctcagtggttaagcatgctggttgctcttccagaggacccaggttcagttcccagcactcacatggccctacgaccatctattactccagttccagaggatctgatgggtttctggcttccatggtcaccagacatatatgtggtaaagacatatgcagccaaaatatcctacacacctaatctgtcaacagttgccataccatcgtctgaggaggacagaaaggtctgttcctgacactctagccctgtggttctgcagatggttggaacctgcctggcttgggcctacagagcaacagcaccctcccagcatggagtcacatgacccaagtactgctcagaaccctgtcctatccccaggctacacagtccacacagatgacaggccactttcctgctgctaagatgggaccaataaccacaatttcttgtgccc

SEQ ID NO: 32988 - DNA, 1303 bp, Mus musculus
gcaattacatgagtgagcacctgctgaaggcaggggccaacatcacaccccgggaaggcgacgagctggcccggctgccctacctacgaacgtggttccgcacacgcagcgccatcatcctgcacctcagcaacggcaccgtgcagattaacttcttccaggtgtgctggggcaggacgctgtgcctgggggtggcagtgctgtctccctcaccagcggggcgccttcctcccctttgccctccccctgggcacctgttgagctcttcactcgctccctcctaggaccacaccaaacttatcctgtgccccctgatggcagcggtgacctacatcaacgagaagagggacttccaaacgtaccgcctgagcctcctggaggagtatggctgctgcaaggagctggccagccgcctccgctacgcccgcaccatggtagacaagctgctgagctcgcgctccgccagcaaccgcctcaaggcctcctaggtctctctccttcggactggtgccccttcactctgctagctctgagcctgcactgtaggctcctgggggctgctgttcagtgcccctggccctgggggctgggcaggagcagggccccctttgaaggggttgctgtgtgtaagttattttgtacatgtctgggtgtgggtttacatctgcttccctgccctcgctcagcccactgtatgaattgtataaatgtttctattaaattgggactgctctttccttagctttatatatattaaaatgtgtacatctctctctctctttctctttttggtcttgtatttcttaagagtcccctgcccccagaggtttttggttttttttttttttttttgcattaacagcctgagtcccttagaccgctgcccatcttttctgtcacgcctgagactagactgagccacaggctcaactccttggtcctcctttggaccctctggatgtctcagctctttgtggcatctggcctcctggcttccagagctggtgggtagtagggcaggaagaggctctcagaggcgcaggtcctcatggcacggtgagtgtgcagcaacagcctggggaatcgctgtgtgaagtactgaatgaagccagcaggaagttggcctagtgtctggcgcacctcagctgggagctccctgtagtggtgcttctggggacgggcaggacaaggatcctggctcagctgtggcagaccatccctgataggtcccacccgggctctagaacataccttgttcctcatggcccggagcaggtctcgaactgatgtccctttgtatgag

SEQ ID NO: 32989 - DNA, 1144 bp, Mus musculus
cttgacagaatcatttaactattgtgcaccttaatctgcacacctgtcatgtcagatgacaatgatttggttggcttcattggtgtctttaaggatctgtgtcattcatggcatggtgctcagggccgactgagaggtatttctgtgaatggcattgggcgaggaggagctctttttggggttcattgcttgtctttgcttgtgttgctgatttatttgtggggttacttagagtgtctcctgcaatggaagtctgccactgagtgtggccaaccttgcaaaacaactatttctccatctgcttccatgggaacagggagtggagatgccagccacagcatggccttcaagcagcaggagccctgggcattggctcttggtctttgtagcattggttggcatggaaagacagggtaataattaccaaaggacagattaggggaaacaggacatcccatttcttgtgttttaataagactaatatattctctgttttaataagactaataatatattctctattctttggctgttaggaaggcttctctcataactgtactgagaaaggaacaattttccaactacagatcctgaatggcaacttattagagtagacaaaattatgaatacgaaagtcactttttttcatcgccatgacaaagtgcctgagagaactcaagggagaaaggttcatttcagctcatggttcagtctgtgattgctggcctctattgtttctgggcttcaatgagactgaacatcattgtgggcagcatatgatacagaggctggctgcccacttcatggcagccaggaagccgaaggagagatacagaggaagaagctgaagataggccagacctttcagaggttttgctgtccagtgacaaactttgctcaatcaggctccatcttctgcagtttctaccatcccccaacactcaattatgaacctaccaatggattcaagatcattcacttcccaagagcccatcagctaatgatccaagtctttcccatgttagcatttttgaggacactctatacctaaactgcaatgatgaacatgccttaagagtatccaaaaagccatcatttgtaataaaattttccacattattaaatgtggagaaaaaagggataa

SEQ ID NO: 32990 - DNA, 1137 bp, Mus musculus
ccccttccttcttccctccctccctccctccctccctccctccctccctccctccctccctccctccctccctcccctcccctcccctccctccctccctccctcttccttccttccttccttccttccttccttccttccttccttccctccttccctccctccctccctccctccctccctccctccctccctccctccctccctcctccttctctccctccctccctccctcctccttctctcccttcctccctcccttcctcctccttctcttccttcctccctccctctcttccttccttccttccttccttccttccttccttccttccttccttccttccttccttccttccttccctcccttctttccttcatccttcctcctttcattcctttctccattcattcatccatcctttctttcccctcctccccatcttccacgtccttcttattattgttagagcttccttaccaatgtgtccaaaaatacacttgatctagtgtcgaggtctggggaagtccaggacactcattttttccccaggtatctgaaggtgttcagagcctggtggtttagacccaccctgctttttcttgcctgctcagctgcctgtacttgggcaagctacctagcatctctgtgccctggcttcctcatttgtaaaagggggttattaatagtacctccttcatgattgttatgaagatgaaatgaattaacatttgtaaaatagatacagaatgcttggcttcctgtaggtgttttcctcaaaataattacaaaataaacctcctcctttggatacatacccccgtggattgtgtcaaggataaagggaatgtttcttttgaaaccccagatatgatgtgtgaatctgtcagaggtataccgtgctaatgatcactgacctcagttttcagttctactttttgagtcagtccctgacaattctaggagggattctggccattaagaaatcaacatggtagaatggggacagtttctgactctctgttccttgctcttgagttttctgagtctttcctcatgcaattttggggcaggactgaagaccttgagtgtttcgttgctgtttcgtttccaactgtgggagaggcactaatgtt

SEQ ID NO: 32991 - DNA, 1618 bp, Mus musculus
tgctctcattccggatcattgaaacagcctctctgcatttctggaagggaagggattggaggaaaaccacgcccgattctgttcagttctattttattttggcttttgattttgttttaggtttttttttccacccaccacaagttcttttctccccctttcatagtgtgggcgaaacgctgaaaacttcgaccggtttttcacccgccatccaccagtcctaacacctcctgaccaggaagtcatcaggaatattgaccaatcagaattcgaaggattttcctttgttaactctgaatttttaaaacctgaagtcaagagctaagtagatccgtagacctccgtcctccatttctgtcattcaagcgcaacagctgtcatggtgacattttttctttttcattgccgagttacatccgtgttttcttttctgatgaggctagagtggccatgtttcagaacccaaatgtcttcaagtagtttggagcatctcaaggagatggaattatgcaggtggcatgtagaaagtgctgcataatcgagacacgctcggagtcctactatgtgcgtccctagcatgtcggctcacagacccccacgggagagaaaatgcttgcttttctccctggtcctctgcactgccatctttaccccaaccctccaggctacatcctccctacaaaatggatggatgaaccaaatgctagcaatatccttccactttccaggctgggagcttggcttgaatccaagtatatggctgctttgccctagagggaatccctccacgctgcctgttctggaagcagttgagctttgaaaagaacatgctaaaaataaatttttatttttatttttttaactcagtgttaagaagattatctaagtcctggggaaaaaagtggggggaatgcgcttttagacaagtttccatctaaaagcacttcagggtcaaaaggcaaccagcttgggtgctgtcaccttgccatagtttctaatactgtatgtctgatagcggtaccttcatcccccaaactactcaagaatgacatttggcactgttcctggaaccacatggtcactctagccaggtcccaaaggaccctgattctacattacatttcaaatgttacttgctttttatttctgtcatcattgaaatgcaaaaagaaaaaagaaaaaaaagaaaacgaaagaaaaagaaaaaaatactcactttgttacacatgctttaagatctgtgtccagatgttattaaccataatggcctgctttgttcaaccaagaagatggctatggaacccagcagacttgtgcccatggggaggggatttgtctagatgtcccactggtattggagaggtaattgtgtgctctgagaaagacgccatctccccaaaccatgatgggtgcattcttcagtatgatgttattttgcaagatgtttgtgggaatgtttatttgcacttcagtatctgttctgatatctttctcctagcatcaagatacaatacaaagaaagaaagaaagaaagaaagaaagaaagaaagaaagaaagaaagaaagagagagagagagagagaaaggaaaggaaatcctatttcaaagaaaactgttc

SEQ ID NO: 32992 - DNA, 1162 bp, Mus musculus
agagacttcatttctccctgaacagatgggcacagcaggtggccccttacccttgcctacatcttagcaccctgctcctcacacacagtcttgaggcaaattcttattacaggctaaaaaatgtctgggtcctccagtgcttctgagagatcacacagaaatgtccaaaggaccagtgtccttgaagtatacctcctcatctttaagaagactatgcctttgggttcttccgaggcaaagacccttataggtcattctttcctggcctcttagcaactcagctttaagcttaggccttgccctgcttagatcatgtgaagcaagcttgttgtcctaacaatcttacgattttagctgccaaaagagaccagagcaatcctgctcctcactctgctattagggcacctgacatctgaagagtagaagttattttctgcttggttgatcagtggtgatgcaaacacaagtcttgtggccaatgacacaggactctgttctataacaaaataaatatctctgagccacatgtccattcccaggcaagttatgtagggtctttcatttggtcaatgggtcaccaggccttggacatatgctcagaataaaaaccacagagaaatcttgggccattggcaagtgatctgagacgaccttagaaaacagtgtaggaaggaaggatggttagatggatggatggatgaatagatagatggatagatagatagatagatagatagatagatagatagataatagtatatatgtaaatatatacactacgctctacattttcaggttcttaccattatgttttaaggttcgtagttgtcagaaatagatactcaagccaaagtgtctgttcccttagcttagcttgatgggggtgggtcagagaagcttctgtggaaataatggatcatgaatcagacctcccactgcttcctcggccaccagtgttctagatcagaggaagccaagaagcagtttccatcacgtaagatccttaggaaatattttaaaattttatccaaaaaagaaataatttgtttttttttttcatccatccatttatacatcttccatccatttgagtagcatttattgaccaccaactgtgtgccaggctgggtgccaggatcctggtgaaaactatgaaagatgc

SEQ ID NO: 32993 - DNA, 1532 bp, Mus musculus
cccgctgcacaggcttggccaagtcccttcactgacctgtgccctggttttctcatatgtccaacagtgggagacaatcacatcagctttgccttctccagacccgtgaggtgagattgggaagggctagtaggcttacaggagccctggcgaggccagcacatcaaaaagccacccacattcacattctctggcagaacgtgcctcaaactagtcagcaattcctgtacacatgcaggccagcaggcagaccggcaggcaggaagaaaggaaggaagggagagagggaaggaggaaggcaggcaggcaggcaggcaggcaggcaggctggccaggttacctactacaagagttgagcagttttattcttcaagcttgccttcatactttaagctttgtatagaagcacaccaccagcatctttggagagactctggctactgaagacccagattctacgctagtgttcagcttttgagcagcatttcagagcctagctttcaccaatttcttttggggggcggctgaatctaaaatatgagttaagtagaccctaacgggctggccaactctgagtcagatcgtctgacacaattctggcaccagctaggctgtctgtggtcagcagtgagtctcagacagtatgaggaagaggtagatggtgtttagcttcttgcaatgaacactgcttccctcacatggctatttgccttctgagagcaatgtgtatatactctctctctctctctctctctctctctctctctctctctctctctctctctctctcttctctctctctctctcctcccccaacaaagtcagctcctggccacaggggtcgccattgagttgttttcttccaggatactctatctaagagccaagtctatggcattagctgtgagaagtagttaccactgtaattcacctcaaagtcgaagcataggactcccccccacacaaacacacatttctttagggcaattcttaaaaaaaaaaaaaaaaaaaaaaaagaggatgaatcttttcttctcatagaaaattggcaccaagtttcctcccccaagccagcatataacatgaactgagagctgatgtgaggcatgcagctgctccacgctgtcagcacagggctttctgaccactcaggagcttccctcggccttctggtaactggcatgtcctggtcatgtttgctgctgcttctgcttctgttttaatgtgttcgctttccatttggcagagagacaagcgagacacctccaacttcgacaaagagttcaccaggcagcctgtggaactgactcccactgacaaactcttcatcatgaacttggaccaaaatgagtttgctggcttctcgtatactaacccagagtttgtcattaatgtgtaggtgaatgcagagtccattgccgagcctgtgtgtaaggcttcaggccgaatgtctgttaccaattccagtcttccaggattcatggtgcctctattggcatccgtcatgtggagagcttgtcttagagggcttt

SEQ ID NO: 32994 - DNA, 1148 bp, Mus musculus
gaagaaaagtttgtgcaagttccatacattttttttctccaaatattttcactctgcagttggctggatgatgagggcaaacctgcaatgggggagggcaggcctcagcaggcatggatcgaggatccacaaccctggagagtcaggaagtgtgtgtgtgtgtgtggggggggggtgtatgtaaaggtggatgtcagggtagcgtcacgccactccacccaacacccacaacctaagccacagtccctgtaaataaagctgcccagctgccaggccttgagggaggctggggaacaaggaagtctcaaggccacagctttgctttcatgtaccaagctcctccatgccggagaagccaggcagaaccacttatcaagagttatttcaaggcttcacaaacaattatcaacaattatacaactcctgccaggtgcctcggggcagacagatggcacgcatcacacaaggttggtgccctttgggaagtccatccagaagcaagatcttaaaccaaaccaaaacagtagactaaaggcgagcagatagccggcatttggccgggcttcctgttgtctctttggtccctgaggatggggtgtcccttttcggggattctccacgggacaactcaagcctcctatggaagccagtaaaatggagtctatggttcagagactattcatcccagccaggcacaccccatgctgtgtgacatcaagcctgtgacttcacctctctgaacttcgatgccttgtttataaaatggggatgatgctgagattggctcacagggctgatgatttaaggagcaaattagagaaaagtatttggcataggtgtggtgaggagaaatgacctagccaccgtccctagctgctcggatgtttatctaggttagagctgcttcagaaagagatcttctgttgatggccacttgagtgtcccaaacattacaggattcttgtgcaccccagcattcagtaagctgctttaacaactctctcagttttgtggggctccttgtcttctcttacttcaacatcattttactagaacccagggagatggctcactgggtataggtacttgcccataagcctgataacctgagtccaatccctagaatccaaagaactgacttccaaaag

SEQ ID NO: 32995 - DNA, 1191 bp, Mus musculus
gagggaatccagcgacgccctcgccgccgcccgaccgtttccgggcttcccgacgcggtcgtgggctcagaggcgacaggagcgggagcagcgcgaggagcagcaagaggaagagtcgggcagcctcggtggtgtccccggggccaacgaagccgccttccggggcccggggtggtgaggaagggcctcgcggcctagctgggccccgcaccggctttgtgtcaggcggcggcgggggggaggcggagccgaaccgggcggccgctggaaggcctctcctccgccgaccgcgcgatctcggcctaggccgcgggccgctcgtggcctccggggagcaggcgccagggtgtgtgtgcggtgggggcctgggcctggggacgccgacgccggtcgtccggaagccgggaggaggcgagaggccgctcgtggactccgggcctaggccctctccccgcaaccttctcccggggcctgggtcacccccatccacggagagagactagccgggaggtgcggccgctatggacccctgaccccgcggggtcattcggactctaacgtgtggactgaccgctactgactgcaccgcctgcccccgtctcctgccggcccttagcatgagcgagtgggacccagccgggtgacattgtgccggttggcggatcctcgattgccccctttcctgtcttgctcctccctcatgaagcgattctgagtacggggggttccggattattgttctcacggacccccgcttgtggttgggggggtatttaatctgaggccttagggtccttcgttgtcttttgagtgttttgtgtgtgtacatattttgctcttaagtttataaatatacatatattgagagtgtccacgtctcctcgctgaaccttaggaatcttttgccacaatgtcctgtgtgcactataaattttcctctaaactcaactacgacaccgtcacttttgatgggctccatatctccctctgcgatttaaagaagcagattatggggagagaaaagctgaaagctgccgatagcgatctgcagatcaccaacgcacagacgaaagaaggtaagaggcacacgggccgcagatatttattggggggaggggggggcgtcaaggttggtattttaagtttcttgtttcaggcttgaactccattcttacccgttgtcatacacag

SEQ ID NO: 32996 - DNA, 1129 bp, Mus musculus
tttttccatcaggagaggaaagcctgtgtaaggtttcctattggttaaagcagcagtagatataacttgttggctaatctagcagcgttttgaagctgatagcaattgtccactggccttttatttatttatacggggttgcttgtagaaaaggtatttttgaggatttagttagtgctggaattggttttgtatttaaaaaaatgttctgaggtgaacactctgaggtgtaattccagaattagtgatatttactcaaaagttatattctgtagcccagactggcctccaaccccaacaaccccttttgagcttcccaagtgtggggaatgcaggtgttagaccacacttaactgttaagcagttcagaaaagtttcaaagtgcaaggccctgggctcttcatccgacaccaccaaaatatatgtgtgtgtgtttttctaaaaagaatgctaccatgtgtgaatgtaagtaagccactggttataaaatttgagctcttcattttaaaagtaattgggtctaggtcccatctgtctgtctgtctctctgatagtttctctgtgtagtcctgactgccctggaactcggatccacctgcttctgcctctctagtgctgggattaaaggtgttgcgccaccttgaactcggatctcttgcctctgcctttgagtgctgaaatcaaaggggtgcaccaccacccctgaaaacatcatagtactgggacttgctgcctttgagtgctgaaatcaaaggggtgcaccaccacccctgaaaacatcatagtactgggacttgaatggtggcaatgtcacagtcttctctgactctaaacttgttttgctttctttttctcagggtagtaatgctcatgggatgggctctgttagacttctaacattcattgatagtgtgagaagagagttctaaatggagttgttttatttatgttatggtcttaatttttggccttctctacttagatcaggctagcctctgactcagatcagcttgcctctgactcacagatcagcttgcctctgcctcctgagtgctggtatcaaagacatgttccaccaagctaaatttgataaaaggtgtgggatagggtttttggtgaggttttgggg

SEQ ID NO: 32997 - DNA, 1150 bp, Mus musculus
ttcaggatcccattatgaaaattgccagcggggacctgtgtcttctacaagtgactgtagcacaagctgtaagaatgctgtaaacgacttgttggaaaaagaagcatggccctcagcccctggcagtgatcctgagttggctccagaatgtatagatgctgattctgcctccaattctgagtcagagagaaacatcactgtcatggcttcagggaacacaggtggtgagaaagatggccttcggaacagcactggacttggttctcaaagcaaatttgtggttggtagcagcagcaataatgtgggccatggaagtagtactggcccatggggctttccccatggagccctaataagcacatgtcaggtctctgtggatgctcctgaaagcaaaccagaaagtagtaacaataggatgaatgcttggggcactgtaagttcttcatcaaatggagggttaaatccaagcactttgaattcagctagcaaccatggtgcctggccagtattagaaaacaatggacttgccctaaaagggcctgtagggagtgggagttctggcatcaatattcagtgtagtaccataggccagatgcctaacaatcagaatatcaactctaaagtcagtggctcttctacccatggtacctggggtagccttcaggaaacttgtgagcctgaagtaagtggtacacagaaggtttcattcagtggtcaacctcagaatatcaccactgaaacgactggaccaaataacactactaactttatgacctctagtttaccaaactccggttcagtacaaaataatgaactgcctactagtaatccaggggcctggcgtgtgagcacaatgaatcatcctcagatacaggctccgtcagttatgaatggcacttccctttctcaccttagtaatggagagtcaaaaactggaggctcctacggtactacatggggtgcctatggttctaattactctggcgacaaatgtgcaggccctaatggccaagccaatggtgacactgtgaatgcaactctaatgcagcctggcataaatgggcctatgggcactaactttcaagttaatacaaataaagggggaggtgtatgggagcctgggacagtgaattcccagagttcaccatgg

SEQ ID NO: 32998 - DNA, 2621 bp, Mus musculus
aaaggagcactaagttgggctcgccgcctgcagccagggcacctgtgggaacagctgttttctgcacattctccactttgttttccccaaaacatatcagtttgaatacttgaatcatgcaggccaatattataatgtgaaagggtatctatctatttacactcccaaacagcgccatacagctaccgtgtggaatgagctcacttgtgtattcatcatgtttagccttcggattccttctttcctccatttccatccccatccccaccttttatttttatttgtattttttgcaaaaccgttttggggctgacgtatgagcttttacctttgcactgagtgatgttctccgtctaatcggcaatatgggggcagctgttccagtgtagatgtttactcaagggtgttctcaaggcgtgcgctctctactatgcctcatgttgcctaccttagtgtggtatcgtggagttgaaaagatcaagttaagatactgacgtaggattcttaatgaaagtattgcaccagttttttcatgttgtaaaactaaagaatttcgctctacagtttgagaaactgtggccaccgctgtgacctgcagcccgcctgctgcccaggacgggccctgcactttgaacaggctttccatgttgttttgaaggttcccacggtgaaccttcttgtttacagatttttttgtttgttttttgagaaaaaaaatgtttactcttccatcatttaaaaaaaaaaaattaaaagacaaaaaaaaaaaaaaaggagggtggtttaaaagacgcttctatctctgggaaaagagcagcagttggccatgttcttctgttttctattcctgtcctaaatcaaagagcatggttctcaggaaaccagttccccggtcaaaaaatcttgtagtttcttataggaaagaagaaaacccaacttttagcactgatactacgtattgctctgttcaacattttctctgccaaaaaaagaaaaaaaaaaaaaaaagaaaagaaaaaagaaaaaaacgcgcttcgagctggagttgccgtctgctttcagatgctgtcctttagtagtgagtgatgatggtttgctaatcgctaggtgacttttgtaaccccatcagtggctctcatgtctctgctctcttgtgactgtgttcatgtttaactgttgtaccttaaagccgagatcagtaactatgcatactgtaaccaagacattgggcttacagagttgtttgttgtataaaaaattttaaatgttgttgcaaactaacgagttacaccattttaaaatttctttcctccctagcccctgttgttttgcccacaaatggtattataatgcttgcttagtcaaagagagactaaacaagggtaaacttttaacagtacagaatacgccatcatttcattgccttgattctaactgtttgtgtcctaagatgcaaaagaggtcagtggcttttaactgtttacaataggatgtgattgtaaatgtacagtttggttgtgtttgaattatgaaatcttcaaataataaaccatgactttttggctgctcaacattaattgtctcttttttgtggatttatttgtaggctcttttataatgaaagttacaaagttgctgcatgtgagagttcttctcatagagcggcagattaaaaatctaagcaaatatttgaacattttacctgaacttgtccacaatcaccctgagataatgtgagaacagtgggaactgtagcttgctcctcctcccctgagcatctgtgggagcttgttgttgcccaaagctcttctctggcttcaccttccccaccatctgtgcccatctcaagcctcagcgggaccattgggacacgaagctgactgccgtgacagcgtcctagtgttaacctctcatacctcacacagtggggatgccaccacctggactggcctctcttccctgtgcccttcgcccctcctcactgaaggagctctgggcacagaacctgtatgacttcaaatcacgctccacttgccaggtgtaagctaatgttggacaccgtaacctaagcaaatgtttaatgcattcggtgtgtgttgatgtccatactggtttttccaaaaaccaaaggtagctttgaaaaaccatgtgtggagatgtttggaccgttaagctgagtgaccgtttggggctttgagtagtatatatctgacttcatgacttcgttaattgtattgttaaaagtgtttgggagtttttttgcgcttgttatgtggaaataaagtgtttgatttaaaaaatattttaagtggttttgctttttgccttattaataactgctgctttcttatccccattgtctccaaatcccaggtgtcattgggacctccctcttagccttcccttcccacaggcctgtgtctgacagagctccccactccttggggcctttgtgagtgagcctgaactgactcgtgcagcggctcaggcctagggcagtgtgctcctgcctacacttcagccagaagctgccctgcagtctctcttcagtgtccactgatccggagctctggggtgttacagagggtgattcttagagctggaactccaataaacccaaa

SEQ ID NO: 32999 - DNA, 1144 bp, Mus musculus
cctggctgtcccattcaacacctgacctgaggagtgcacgctgagctgtatgtcggcatgaaaatggaggccatccatgggaccaagagtgcagataacaaatacaacagtccagttagctattcctctttaagtggatctacagacactgtcaaacacatgaacacactcacacaggtatacacatatgaatacacacatgcatacacacacatacacacacaggcacacatgcatgcatacacacacatgcatgcatacacatatatgcacgtgcatgaacacacacacacacacacacagctgagctggaagcagagctggttttgatcctgtaaacaaccatggatgctgcagacactttctcaagttgtgcactgcacacataaggcacagaggatagaatggtctcacagtctatttccccacctgtcttagtccttttcaagaccgatcagaactgggagtcgggacatttttccaggcccagctccaggatctctcccattcatctccccacaggtgggtgcatccttgttcgccagcaatgttggaagtggacacttcattggcctcgctgggtctggtgctgctgtgggcatttctgtcgctgcctatgagcttaatgtgagttttcccgtgacgtggacatctcccctctgttctgcagtagaaaccaggggatgcatgacaatactcacttggtactttaaagtgggtgctttcttttcgttaagcaaacaggaggcttcaaaggtgctcctggccaacaaaagttatttgtgtctctctgcatctgctaggtgggaacctataggcccacaaccccaaaattcaagaggacgaggactcaggatgcttccttgactatgtaggaagcgacaggcagcaggtgtcaaaaggccatatatgtcaggcatcagttagccatcactgggatgaaatgctcagcactgtctgccctccatgtcccaggagacacagagatagatggattcttcacgctcctctccattggaggcatctcacagagtagcttttccgagggggaacttgtgttgttcataatcacaaatatttgtaagtggtaactcttaccctgtcacagccacagacagttatgtcacatacacgctcacatgga

SEQ ID NO: 33000 - DNA, 1141 bp, Mus musculus
atccagaacaccccacccgacatcagtgctgcacacacagtcattatgtggattatttagggaggaatgttgaaaaggtctgtacttctctgaatattcctggttcatgtttggttaaactaccaaatatggaaggccaactgcacctcccagaagaacacgagtgcgtatctcagctcatggacacatgtggctgatcctcttcttcctcttagggagagccggttcccctgtgaccttcctttgctgcgctctttctagatggtgtgtctcccaggcattccaaggtggtgagggctatcctgtggctctgtgggatggaaaagaacaaagaggagcccccaagcaaagcggaacctgtcatagtttccttggaggaaaatcccttggtgaaaaccctgcttgacgtcaactgcattgtgtgcatcagctgcgccatcttcctttggggatacttcgcataactcagggtgagccaggaaacgacaataaagctgtgtctgtttactgtagagcttcagaggtgctgctgacaagccaatcggcgttctcatcctagaaggagtgggtggatggccctggggctttcctcactgtggtactcgctcctccttacagcctgtgagaagcagatctgtgggcagtgccctgaaaccgctcccactgtgaaaatcaggggctgtgtggtggcacgtgcctataaccccagccgcttctgaattaggactgcaagtttgaggccatggctgctcggccttttgactaagttcaagtgcaagtttgaggccagtttgggctaccagtttgggcaagactctgtcacacacacacacacacacacacacacacacacacacacacacatacacacacacacatgggaagtggagaaagagtgagtgagagagagagagggagagggagagggaaggagagaaactaaagcacagagttgtggcccacagccccaatcccagtacctgggaggtagaagcagaggaccaggaattctgggtcaaggccaccttgctagggctacttgaaaccccgcctcaaaatacaataagaagaattaagacatgaggacatgagggaactgtgtgcacttctccagttctagcttagtggctgaagagatggc

SEQ ID NO: 33001 - DNA, 1213 bp, Mus musculus
ggtttctgaatcacttcgcagcatctttcctgaaatacattcagacttggcaagcaaagaagtgcctggccacatcctgctggacatagacaatgacacagaaagtactgcattgtgaagaaagccacttgtcagcctttggccctccatcccagtgaacggaactgggtcaggcaagcctctgtctctgcagaccaaacagtgagaagcttttagtgggggaaggaaggtctgactacgaaggactagactcccacggcccaaggagaaggtgagggccagtcctcaaagctgaatgacctgtgtcgtaaagaagttggcttgctttatctaggatgaaaatcatgccaaaaatgatcaggacaaagaaataccgacagcaggagtattactgctgagaggtgtatgggaagctgttgccagagctgtcagctcagacagctctgattgtgactaagaagagacttacctatctatttaataaaacattaattatgcaagttgcctacttcctgctacttggactttggttctcacataccagaaggagcttccattccttcagacttgctgcagaatcattttgtattaaatagtctgtctcctccaacccccagaacctcgagcattggcgactgctggctctgtcgcctcagcagaatggatgcaagtcgtgccttgtggattgccagaatatggagagaaatataccgttctttttaaaaaaaaaaacaaaacaaaacaaaactataattgctacttgataaagagcgaatgttattctagtttcatgtttaatttgaattaaatatattctgtggtttatatgaaaacttgctaattcttagaggcaaattctgggatatatacatttgtgtttgtgcatatatgtgcatgtgtgagcttgcctgtgtgtttgtctataggaatttgaaacaataaagagatgctagcatggtagtttcagcacttgggaggcagagggctataagttcaagaccagcctgggatacacagcaagtctctgggaatgggagtggcaaagcaggtgtggtgtgacaggcagaaggaccaggtgtttaaggtcatccttaactacatagtgagttgtgggccagcatgcattctatgaggccatgtcttagaaagactgcccagctgtgaccagctgcctggacctgtacggaccatccatggttaaggcctctttgca

SEQ ID NO: 33002 - DNA, 1102 bp, Mus musculus
gacagttgtttggactatcaaaagtagaaaataaagcaggcaaggctagggctggttggagctggtttgtgaaggtcagaggattagggttttattctgtagctagtgaattttccagtttctcttgttgtgatcatgggatccacagaggttcccatggcctcctcctcaggagctggttgtatggatgttgtgtccccaggtgttgcccctgcttttctcagtacagcccagctgcctcgtgcactgcagtgtgagctcctgatgcctgatgcagggctgggctcagttcttttctgtcttcctgtcctcgaatcaatcattgctgctgcttagcaaaaatgggtaggagagagatctattgtccttgagctcctcctgtggactaccgaggctctcctcccactggggcattggagacccccccccccccccccgtgccaagtctcacatttgtttctcttctgacagaggtagaattcaatgtatcagaagcatttgtgccacttgctaccccgaattctaatcactcatcccatactggaaatgactctgactcggggactctggagaggaagcgacctgccagcatggcagtgatggaaggggacttggtgaagaaggagaggtacgtgcagagctggtcacttccacagaaataataggtgtcatgtaggaggacactcaaccatgcatctggtactggcttaatggcctcctttgtgaccgtgacctacagagtctagataattcaagaaccacattgtccaactctacaggcattaatctgtgcacaaagtagggggcgtagcctgtctgttaacatctgcaccttgtgcaccagcctttacttgatggcctatttgtgcccacggtaaaaagagtgctgtcacacacactaaatccacttacatgtgtcttgagtgttaaggaaacatagttaacgtgtggatttttggctgagaatcatatgaagacaaccacatttcccagtgagctgtggagaaacatatttttggccttgatatatttgctaactgctgagagaagccccagaatttgacagtcctggatgggagaaaatgtatgttttaaacttcga

SEQ ID NO: 33003 - DNA, 1222 bp, Mus musculus
gaggatcgtctctactaagagcttagccaggcacaagggtcagtctgtgttcctctatgcttggacatgaacgtgcatacccccccatgccagtgtgtaggctcagagttagtactgaccagtccttcagtgtccctcactaccagggtggccaccaaagcatggaaggtagtgttctctaatgagtacatttcctgaattatttggctcatgtggtgattgtatgaacttcaaagtgttaggcctactttactttctttttaaatatgtttttatttaattgacccatatataattgtatatttatgaatctaagatatgattataatgattgtatctaggtaattggaatgcttatctctctctctctctctctctctctctctcacacacacacacacacacacacacacacacacacgctcacacgttaaggtttttctcagaaacccacacaggtttccatctttgcttccttgtactaagtcattttcctcaatgacatcacaacagtgatgctgtgtactagcccaatgctgaatgctctctaagtactcgctctcttggccttcagaacaacctcggcattgggcaggacgaatccttgtgttcatacttgaggcagggaaaagggtgagggagctgcctgagcacagagccttcttcagcttcttcagcttcgatctgataggacagccacctctcaccacaccacaccctctccacggagaactggaggggcgctgtggaaaagaaggtctagagggtgggcggagcctgtggagtcacacatttgcgcatgtatttggggttacatcagctgtgtgcttaaggaaaatgagaaggaagtctgctgttcagtagcacagtgcttgtggcacggaagtgttagtcagcctcctcatctgccctcgagaaccctgttttatgatgctggggaggaacccacatcggtgcatgggaagctggagacccagtttctgtgttgactctggagaaggcacctctaaggctacactcactcagatacaaaaccacatgtaaggagtgacctttgcacatgctaaggtttttctgggtattttgagaacactcctctcacctaacttgagaacctaattcttgtttaagttatgatctcactcttcatactttatttcctcccacatttcatacatgccagagacagtccgtccctccttcccttcagcttcctgttcgc

SEQ ID NO: 33004 - DNA, 2174 bp, Mus musculus
cacaggtaaaacagggagacgtggtcttccacgtcttccacttatgtgatctgttacctagatccattgcttttccccttaaagtatttctggaatctacttccttctttccttccacctctgctcctggtttcctggtgcaaggtgaggttaggtatgatcagagttaaggcactcctctgcctcctgggcttcctcagtcattctttcttctactccataagtcatagtgaagccggaagttgtaaaaggctgtctggattgtgtccctccgtggtttaatagtttcctgttgacaatggccttacccagttttgcagggtcctgcttgttctgctataggtccccagtatcacttcaccctactctgcctccctctcagctctccttcctcagagccatcaagcatgctggtccctctgctttagactagttggtttcatgtcagtttatagaattgtacttacattcacccagaattttttttttttttccgagacagggtttctctgtatagtcctggctgtcctggaactcactttgtagaccaggctggcctcgagctcagaaatcctcctgcctctgccacccgagcgctgggattaaaggcgtgcgccaccacgccgggctaagaattctttcatgagtgcctgctttgtttatggaagttgtgttctagactatagctatagaagtaaacaaatcaaatggagctcttagaaaccagacaggaagcaaaccacatatgtgtcatgccagatatgatttcaaggtggaaaggtcagagaaggtcccactgagaagatacatctgcagcaaacacttgcagaagctgagggagtgtgccctggagacatctgaggaaacagaatcccaggcagaaaatagagcggaaatggtcccaagcctgctggacttgttttatatgcagcaatacagagtgattgggagggagaagagtctgtgcatagtaggttcttggaacttaaacaatccttaatattattgtatgtgtctgagtgctttgccagtatgtatgtgcgccacatgcatgcctgccaggtgaccactaaggtcagaagtggatcctgggactggagttacagatggttgtgagtgatggaagtcaactgggtcctctggaagagcccaagtgctcctaaccacaggcaactttccgcctcctcttgtagcttttctcttatgagttaggagccattagaggattttgagcgggagaatgaagtagcctgggtttttaaaggctgagaacagaccgtaggaagcaaggatggaagcagggagacgaagactgttaccgccaggaatatcttaagcgagagctgctggtattcagggcaggatggtcatggggcaggactgcaaagccatcccattcatgatgtggaaggtggagcagctgatagaagtgctgactgatggctgaggactctgaagattattccaggttgtttggcttagctcagatgggatggagctcccccagacacctcgatacatagcatgagctgcatggctttgggattgacctgattggggtgagtggaatgaagaaacgacatgtagagatacatactggaaaaggtggaattggatgggccgtgcttctgaaggagatgcgccagcagcctagaaactcaatgtactggctggctttatgtgtcaacttgacacaggctggggttatcacagagagatccagctgtggggcattttctcaattagtgatcaagggggaagggccccttgtgggtgatgccatccctgggctggtagtcttgggttctataagagagcaggctgagcaagccagtggaagcaagccagtaaggaacatccctccatggcctctgcatcagctcctgcttcctgacctgcttgagttccagtcctgacttccttggtgatgaacagcagtatggaagtgtaagccaaataaaccctttcctccccagcttgcttcttggtcctgatgtttgtgcaggaatagaaaccctgactaagacactcaatgtgctttgttatgtgctgctgaacaagaagtcaagttagctgatctctgtaggagaggagtctcaggctgcagtcaccccagaggaggaggcagcggctgagactttctgcacacgctgccagcatttgtacgaggacgc

SEQ ID NO: 33005 - DNA, 1153 bp, Mus musculus
gagtgtaagagccagacgatagggtaaagggctaggaaatgctgtcctgccagacctgacacaccattgcagtcattgattcacaccagctggtgtcctgcactgctccacacaggactccctctatcaacaaccagtcaaggaaggaggaggggctcacagagccctaccctttaccccaactactggctatcgatggattttgggaaaggagtgatggttgtttagagttgcagctgtgctgctgagcacatcaggctccagcagatagctcgaaacccatgctcacgcaggtggcctagtgaatcttggtggacttaaaacaaaatgaataaaggtgaagtgagagatttgttggaagtggggaaggggaggggtaatagagtgggtgagggtacccaatatgcaaggcatatgtatgtggaattgtacaaaatatattacaaaaagaattatactttctgggtaactatagaaatgtattgtttttcctgtttcataaagtattgttactttgtgtctggtagatcaatgcatactaatagtttctcgaagaatataaccatttgaaatgacatgtgttcagctttttaaattaattattttgtatttggttttgggttgctaggcaagctctgaaccacttagccattgtttttcatctccttatggcaaaccttcacttaatgggattagattctgttaatgaacataataatctctgtgtatttcagctcagaggtttgaaacagttcacatgttgctaaggattctgtgagttgcagttctttcttgaggccaagactgctgatagctccagggcccacctgagtgaccagcagacgggctagctggcagctggcagcaaagtccgttcattttcttcccattccctggctttctggagttctttcatttctgtcaggattccattgtaggaacaggtcatgctcagtgtgtgtgtgatctccacactgtctgtctgctgctgccctttgacaagaacaaaggtctacccagccccagttccaggctaggagaataatctctcgtgatgggagagactacagggttctgttgcccatggacagtaggcacacagcagcagcagacctgtcttcctttctacagtctgccccatgtccttattttc

SEQ ID NO: 33006 - DNA, 1590 bp, Mus musculus
aaaaacatgtttcatactacagatctggaaaagaacctgtggctaacaaactcacagtccacacccttcctcctctgcctctcacaacttcatcaacaactctctaaacagggtgttaatctggttttgcactcgaagtagattgttcaaaagtccttcgatttataaactcctctatccctgtgatttccaacgaggtgacctctcctgcatacttggcacaatcctttccatttttcagaagacaccaactaaaggcaaatatctgaaccatgaatagaagtctgcaaagaaagatctgtgcaggacacttggaaacagctactcaccactcttgctcttgtgagaaaccatataacactaggctgcaaaaagttcaagctgaagacttaacaccctctctgataaatataggaaagggtccaaattaagcatttcagcataaaccatggaaacaagtgatcattattttaaaaagttaaaaatgaaatacacattgccagaacatgtgacgtagaatgggattgacccaaaagaactggaagacttcaagttgcaacatgaatcaattatgggcttccccaaagccaaggtctatgaaggaagcatcttgaaggctgactgtgacattctgattcctgctgccagcgagaagcagttgaccaaatctgatgcacccagagtcaaagccaagatcattgctgaaggtgccaatgggccaaccactccagaggctgataagattttcctggaaagaaacatcatggttattccagatctctacttaaatgctggaggagtaacagtgtcttaccttgagtggctgaagaatctaaatcatgtcagctacggccgattgaccttcaaatatgaaggggactctaactaccacttgctcatgtctgttcaagagagtttagagagaaagtttggaaagcatggtggaactattcctgtggtccccacagcagagttccaggacaggatatcgggtgcatctgagaaagaaattgtgcactctggcttggcctacacaatggagagatctgccaggcaaattatgtgcacagccatgaaatgtaacctgggattgtacctgagaacagctgcctatgtcaatgctattgagaaagtcttcaaggtgtacaatgaagctggtgtgaccttcacatagacagctcacagccaacttctttaccacctcttcacctacaatttctgcagacctgtcacaagcttccatgtaaccatagaaatctgttcttgtgactcattaggtaacggacactgttctgaacaagtcagttggaatcagccccttaagagaaagagattaagttagaggatcatgtacaagctgatggtataaaagtaggaatcacgtgtatccaagccagttaggtggtttgcttttaggtaaagtcttgctcctgtgctgccttgctctgggcccttcccagcagagtcagtgctgttgtcagggaaggagtcaggagcagtcagtcacttcttgacatgtctgggaactcctacacacataagaagtaggcgtgtggcattttccaaaggtggcatggtcctcaaatgagt

SEQ ID NO: 33007 - DNA, 1151 bp, Mus musculus
ggttaaactagaaagtctacctgcctcgatgggcccagtcaagctgaaactggagaggggcgctcctttcccaccttccccagagctgctatgtgctcccaggactcagaacgtcttagccaggtgtgtggcacatgggctgagcacactgctacaaagcttggacaaaccgtccagtgagcgcctcattaaagtgcagggctgggtttggagcattctgggccagggactgggacccatgcactcccacgagttctcaggtgctctgtttgacaggtagcttaaggcctgtcactccctgtgagacccaggaagctgggaagcatgacagtggcctccacaattgccgtttctatttcctcccgttagaaacgctgcatatggtagcaatgagtactgtactcacagcctttctaaacagatccagctcgttctctgcaaaatccgtagccattttggaaactgaagttgtagcaagattcacctaaaaataaaccacataaggatcaggccacgtgtccaccacaaagctgatcactttctcacccctctctcagaagcatgggtcccgcacgagccactgcagagccctctgagccagtttctcaaaatgccactagagggcgctgcctcgcataccagtgcataaatgggtctcccatcatcttccgtgactcctttctttatctcaatatacagagactccaggacactgttgatgttgttgatgaagtcctccagcttatctacagtcgcatttcctggaaataagcaggcagggatgggagtggattcgtcgaaaaagcacacacagcctgtttcaatctctggcccctgaccacactagcagccccaacagaaatgttttggctttcttgggccaatgccaatattgtggtttctttcttcccggagtgctcaaagataagctgagacagatggtgtagtgaggcagaaaggcggacaagattgttatctcagaccactgagacagtagccttccttcctcttccccaaggcttcatgctgcaccagtggccctccacagctccctcctcctagaaagctagccaggacacatctgaaggccttgggccagcccaggcctgagccacaacagggtaagtgaggcactcacagcagaagaggcc

SEQ ID NO: 33008 - DNA, 1175 bp, Mus musculus
tttgtagaaagaacacaaggccttggcttagtttctccagggctgttgagctggtaagtggtccagactcagggcacagggtacagactgagaattaccctgtggtgattggcacagctttgctgctttcctcggcactataatgtcacctgtgttaactcactgacttacaggagttcttgggagaacatttctgtcaccattcccactttttaggttagaaactgaataagatggagacttgagtggtccgggtcaccactttgcaagtagttagttaggagggctgagaacctgtgcttatggctccagaacctccagaaccagtgggatggactcgagccgacccagttctttttacttctggagtcatcagcacaagctgaactttggcagccacatgcagtgcgtgtttctgaacatgatggagtacagacccccaccattgctcttgtgtgcacggaggtgacggtgccacctgtttttcagctccctccaacatgcagggcagcacgaggagagcaggagccatgacggatgtgcaccggcgcttcctccagctgctcatgacccacggtgtgctggaggagtgggaggttcggcgtctgcagaaccactgctaccaggtccatgaccgtaagtgctgtgtccctgctcccacagcccctgctgatgatgatcagagagtagcgatgctgggatagcaacaagagaagaatgatctggtagccctgaccggaccattcaagactctgatctcgtctttctctacctccccaaagtgactgccatttagtctgagaagcagaagcccggattctgaatgtgtgaagttacagttcacagcagggctccagcgtgcacttctgtactggtgtccatgtcttcagagtcggaagcgtgactgtaactcacgggatcctgagagttgaggagtgactaggctagcgcaggaagagtgcttgggtgcctgttgttagaaagagggctgtttagcacatgggcagggcacagccttagatccagccagcctggtacgagtgccggctgtgtgccctgtggcctccagtcattggaagggcagtagaagcaatggggtcagtaaggaaagctccttagactcacaggaagccgactgtgtccagcgtccgaatgggagagtttgtaaatgagaa

SEQ ID NO: 33009 - DNA, 2284 bp, Mus musculus
ttagacccattgcagatgaagagagggccttcccagccagcctgtatgcctgcccagggcagcccctcagtcctgtagctgagcgacagcacgccagaggggttgcactcttctgccctccccaggcagggcccacagagcccagcaaggctttgtaccctggatctgactcccaaggcacaaatggaccttccatttcagccatggccaccagagctagcaaaacccacccctgccccattcgacccatcagccctgggttagtggcagctttgtgcccgaggcagagctgcagctgctgtggggacatctgagtgacagtggggagggttccggtttaggctttacttgcacttagccagggattgtcctgccagggagagccgtgggcagacagtgcccaagctctgggcctccctgagccagagtagtctgtctgtgaccagcatgtatgtcccctccttctcccgtctccagtggctgtgagagagtgtgtttcgtcggccgcccatggcgaggtgtggatgggcacctgaacatgcccgtgtgcaaaggcatgctggaggctgtgctctaccacatcatgtcaaggcccggcgttcccgagagctgcctgctgcagtactaccagggcgtcctgcagcctgttgctgtccttgagctgctccgggtagggcccagggcgtctcagcccagctgtgtgttggggtggggggagcacacctcgggtgtcaccacctcagcttaaccttcagtgccttctggccattggcagaggggtctgctactatccttgccctgcctggctcttgattcccttctcctgtgcctgctgcagctcagccctgcagcaagctcactggcccttgggtccgtttgcacttggtctgtcttactctgcctgctgttttccacctgactcgcactcagggtcacatgctcacaggtcctcaggaatcctgggtaaataaatggaggtggcgaggaaagctgaggactgtgtgacctctgcacaagcagctacttcccagcctgggctagcggctgccctgagctctcattcccatggtgttctgggctccagcttcctaacagactaggaacttgacatttagtggtgacattcccagaacttcctagtgggaagccaccacagccattgttggctgaagagtgcctctcctccagaggtcactgtggcacccacaccttccatactttctcctacccatcttgatgtaaaccttcctgctaagccctgcctccctcaaggccatgtttggccatcttctgcctgggaacactgtgtacattccataagtgcggcaacaccagacccctgagcaagcagagcctttgtaacccacctgtctgtatctgcagggcctggagtccctcggctgtatccagaagcggactctgaggaagccagcgagtgtctcgctcttctccaggcctgtggtggagggcctgggtcaggccagtgaggctgaggcgctctcctgccacgagagcactgtcaccttctatgagcccacgctggactgtaccatccgtctgggccgtgtcttcccccatgatatcaactggaacaagtggatccatttatagacgctgccccaggccagcagggaagcctctgcttcacggctccacctggactgtccatgagccctgtcctccccagctgttcccacagcgcggccccagcccagcccagcccagcccaggtgtagcaactagcaggtgacttgagtcccctccacccgtgctgctcttgctcccaggtgcccagccttcctgcaggcccatgtcctgccctgaactcaggctccagcagtggcagcagcagggtggatgttgtttggggagcagagctgatgaccaagccctgactcacctgaaacccaccacaccattcagactctaggaagggctttgtgaagacacgtcacaggggtacctgacagaatctgctcctcttactctagggcatcccaacttggcctggactgagccccagtctcccgtggggacccctcctgccagaagccaggcctataggttttgcttttgtttttgtttcatttttctctctttccattagatacaggcccctggcatgtatttatttattttgtaattaaagtgagatgaaatgtacgttgtgtattggcctaatgattgttgtttcccaagaacttcccttctggagtcttcaccttgtgggggcagtgggggtggggaaccttagattttcatctttttgttgaaaaatgcaagc

SEQ ID NO: 33010 - DNA, 1209 bp, Mus musculus
tgcggtcacttcctcttgttgtgggaccaccagggttacctgctcagccatccagtctgagcaagtggtgtatgtacatccatcctcgtgggagtgtagacatgagaatggaggtatagaacccagaaattgaatcggggcctctccctctcatttctgagagcatatcaacgttctcatcgattcagctacactggctggccagtgagttctcgggatccagcacttcattacagacctgtccaatttgggacgaggagctgcagggcagtacccagagttttctgttggtacctttctaaaggtcacaggaagtgccgcagggaaggaaatataagcccagggcccttaactgtggcagagccaagcatggccttcatgggaggggaaggagagggtttgggtggtgtcagaaaaaaagggcacctcaaatgaatgttgtctctgacaacaattgccgcttgatgatggctgtgtagcacaggtgggccaggtccaaggccaggtacctagttgtcttctcttctgcagcttggggaaagatggtggcttggatgatgacgaggaagaggaagacctggatgaaggttcagggaccaagcgccagggtgtggaagtaaaggcccatcaggcctcacacaccaagtacctgctgatgagaggttactacacagtgcctggcatggtcagcacacgcaacctgaaccccaatgacagcatcgtggtcaactcctgccaggttaaattccgactgcgcaacacccctgcatccacccagcttgggcccactggtgagtgtcctgccacagttcaggtatggccaggcacatagccccggagctctgaagggtggcattgctgtctattgcagtcaaagtgagacttcagctccattgtcaccacccaccacccacctcctttgcaggtgccgatcactcaggaagctctagatagcataaacctttctctttgctgggagagaacggggttagaaaggccctgcccttctccaccctgcagccagctgtcctttgtacggtcagggtggatagtgtttgctgtcactttttgcccagtcagagctctattctgtgtgaagtttgaagcatgcaaaaatactgtgccaacctataggttgctatgtcagctaaagaagccctcctggctattgagcaaaagccggggaacatggcaggagcctggggcacc

SEQ ID NO: 33011 - DNA, 1187 bp, Mus musculus
tgggatgaactggaccaacacagtctggggctgctcaagcactgcccacacctttctccctacagttcctggactcgggcgctccataggcttccttcccaagatgccccgcctaaaggcgatgcacctgttcctgtggtacctggtgtatgggcatcctgccggccacactggggagcagcctgctctccacagtgagaggaaaacgggcaagcaggagtccagcagaccaggggctcagccctcctcaggagatgactgggacacctctgaagccaaaaacaacacagaaagcagctcctgggagtcagaaatggaactctccacagagataggtgagagccgcgggtctgtatgttggggtggagagtgtagggagagacagataaatgagcgccatgggcctgttggtaggagatggcagggtgagtccattttctcctgaccatactcgctacttgaagtgactcttgatgtcttgcagtgtatgtggatgagatctcatggatgcgctacgtccctcccatcccgatccacagagactttggctttggctgggctcttgtcagtgacattcttctctgcctgcccctctccatctttgtccaacttgttcaagtcagctacaaggtacctgtgattctgggtcatctcatatctacgggtagtggggcaggaagcctgtgctctgtgtgatcaagggcaagtccgtggagtttgccctgtggtgaatgagtggatgctgagatggccagtcaagggaaagcatttcaggtttgaagcgttccattgttattccacatagagtagggtagaattgataaaagaactagctgggtggatgggtagtcagtatacttcagaaagctagctagggaagaagataataaatatgttgcagcaataaaacacctttttagaaacgtgataatgtcaaaaaggaacaaatagaaatgacccaaaaccttatcacccaaaggtaatcactggtcatatttttggtacattttcttctagtctttcatgtgtgtgtgtgtgtgtgtatgtgtctccctgttcttaaaaactgaattatgattatacttaaatcataagtcctctccacttatacattatagcagtgttttctatttggggaatagaattagcagtcatccctccctgctgagaggatgccccttttgcct

SEQ ID NO: 33012 - DNA, 1138 bp, Mus musculus
tggatttccagtagctcttaaaaaacccacacaatttgtctttatgaaagactggttcttataagcagcatagggcacagtttccttcaggtaagctgggtgccagccactcatcttccacaccagtgatcttgttctcatttgccacctgttctgttcactatggcccagcggccccttgtgtccttgtccctgcctgccaagctctctcacttagccaccctcaagtggttattttccctgtaattcatgtggaacctgtcaggcccccttgtttctgaagggaaaggtgtgtgctgttctgtgtgcttagaatgttctgccctcaccccagcacctatcccagctttatccgcacccctcactaagtatcttggctgcccaggcactatcagttagttaactgtgagaaaagcgtgacatggtgaacagttaagggcatttgggtctccaaaattagaccatttgcagcaaggccattgaattgtgccaaagtcactttccatgtttgttggcagcattcttcccttaccaggagaccaccagcttcccactggtagagtctcttctttgtgctcacactgaacttctaagtcacacaggtgcttggcagagttagcacatgtagtttacttctcctgttaggccatcctacttgggttagaagttgaggcatcaaattgagagtttccggccatgctgaccttgtgaacctctcttaactgtctggttgctgccatttcataccagccatgccacctctggtcttccagagctagcctgccctgtcaatgggcagagcctgctttcttgcccttctccttcccacctgcctccctgatggctccagaggtttccatgctgtgctcccactgctgaccactgatgcttttgccgaagctttctgcccagagctattctgtctggagttagatcccatgatgtgcttgttcattttttggcttttcccttatgaactttttaaaggtagattattgttttttacttatttgtcctggcaacatatactctgttcagcatctgttcaccaaaatgatggccacagtcacaaaataatgtgcagtatcaggagtcatgggaccagtgactgggcaatcttaatgcagatgaaattggg

SEQ ID NO: 33013 - DNA, 1171 bp, Mus musculus
acgacagtgcctaggctgcctctttgagaaagttctttgattcgtagagtccatccggctttgcagagagatgagaggggatccatttggcaggtgctggtgcagctctagagtgctcccatcgcgagcactgtacatttctgtttggggtattttccacttccacagtttgacacatcagtctggtgacatatgttttctttttgctccattttgtgcattcaggatcttgacattggtgctaagaacgtgaaactctatgtcaacaaaagcctcatctttgatggcgtgttagagaaaggaggaggtgaagccccttctgattgtaccatccccgtggaccttcagagagagaggaatgagagctcagacaaggccttgagcactggctggaaagaaagcaaaggtgccctcaagatggctgccttgagtgatgctagggagcttgggctcagctgctcacagccagcggaatccttggatatgacagtttcctcacaaggagatttccttggtgaaaaggtgaattctacatctggcctgaagaacagtttgtccaagttacaggaagatgtaagactgttggcaacccctgcctctatgggtgatgggcccagtgtcccttcttcatcctctcctgggaaatgtcttcctctagaagaggagccctctttgatccaacagctggaaagtctcagaggtaggaaaatccccgaaccgaccgggaaaaccccacactggttacagccttctctagcagggatgggcaagaaacagacagtcaggaagcccaaacccctgtggctcagtcctgaaaaagatctggaacagaagagcaggtttccatctgaggatgtcatgggtgatactcctggagaggtggagaccagggaaaaaggccctcgtcgtgagcaagggaggactagcagctggaatgtcatcactgaagagagagcccccaaagcattctccaaagcctgtggcgatgacttagacatctttagccagcttcctaacagggatcgccctgctagtgggaggagggccctgaagaaggaagccagcagtagccatggtgatgaccggccagccagcaaaggtaagcttcaagctgcccccagtggaatgaaaccatttgtttccttggaccctgctttccttatctaaaaaa

SEQ ID NO: 33014 - DNA, 1186 bp, Mus musculus
gcatgtgcccctgacccaacttggaatcgtattaaatgtttgcatagagccaaaagcacaggtgtggggcagctcatgagtttggcagatgggtagcctaggctattagggtctggaggaccttcaagagccaggcttcagctttcccctgcctttcaggacctaccatcgttcacccagaatgtgcacaggctggtaaatgatctccgttactaccgactctgcaatgacagcctgccccctggcaccgtgaagctctaggagtgcctgcttgccttcctggctgctcactgccccagggatgtgcctgctgccaccaccacctacaccacctgcacctgtgccacggaagtctgtgacaagccttgaccactctctggattggtgtgccctgagcaagtggcctgcctctgccctctcctgctgcctccagcacagcaggttttggagttcatttgacactggtagagtttctacacatttggagcaggcagagggacctatggccagatgccagggaggtacccagagaccccacagcgtggttcatgcagatcgtgtgtatcagtcctgagtcaaaatggccaaggacctctgacaacagtgccaccttctcaccattccacctcccctccgctcctggcccagccagcccaggagaaattcgacattggaactgtttctgtcgatcctcctgcccctccaatggccttgaagtctctgctctttgtcagagattcacgaagactttttttgttgttttctcatcattccattgtgatactaaggagcttaatgactaaataaaatgcttaagttgttgttatataaacactagtgatggggcatctttgtacctgagcctccttaaggccggttaccacggagccagcaggggaactctgtgtgatgcccgtgttgtcttgggagagtagtgagaggaggcccaactgctgtggacatgctgcgtttccctcacactacctaaagaaacatgcccaaggcttggggagctgctctctatgacagtgagcccgcggcagaggcaggaggtatcgtcccaaggccgtcttgctgctggattcatattcctttctcccagctgagatgtgtgggactctgggacgtggctcaccagtgactggccttagggaaggagagagcacgggcacccaggcagcaggtg

SEQ ID NO: 33015 - DNA, 1155 bp, Mus musculus
tgttgtctgtgcacatgtgaatctgcctcagtgtgtgtgtgtgtgtgtgtgtgtgtgtgtgtgtgtgtgtcaaaggacaacttgtgggagtaggttctatcctactgtgtttgtgtgtgtgtgtgtgtgtgtgtgtgtgtgtgtgtgtgtgtaggtcaaaggacaacttgtgggagtaggttctatcctactatgtaggtcccagggagcaaactcaggtgaacaggcttggtgacaggtgcctttaccctttacccactgagccatcctaccagatgttgttttaggctttttgataacataaatgctgtggtgctttagaaaatggttttgtatataaccttacttcacaacgctagctgttttcttggaaagaattggagatcagatttttttttttttttttttttttttttccctgtctgaaaattagcccttgggttttctttgatagcttgtccattttgtttgttttgggctctggtgcttgctgtcatttttcacctattgctttgttaacaggttggtcaaagttactctgtatggatctcagataaaactgtacaacattgaaacagctgtgccatcagtgttgaaacccgacctcattgatgtgtaagtaaagagtagtaactgtgccttcttgagagatgttgaccctacctctagatgaactgcagcaaccaacagtagtggctgccacacataaagggaaagctctttatctgaccctagaaagacagattgttgagtatggtgtggtaaatgtaattggttgaactaaagagagcaaggatgaggctctacagggcaggcactgcaggaaacagcagagaagggctgtgaagttgagaattggtgagcactaaaggtacgtgggaatggtgtagaaacacctgatccctgtgtctcttaccctgcacagggttcacgttcactgacagttggtgatagtgggaaaccccaaccatctcacactcaaaagctgcaccaactaggggcaggggatttccgtgctttttcctctaattaactccagttctgttactacttggtagcatcatgctgaggatttaatccccacgatatcacgtctgcatctgctttccagtgccagctgctgctccagctgtgtttcttacgctgctgactgag

SEQ ID NO: 33016 - DNA, 1175 bp, Mus musculus
cacctatttgagtatgtagatgctaccagtggtaggcagtagttcttaatgtttgaaactttagttcttgttggtgttaggaattgtggttgacttctgataatgcgatgtcttcttggttacatcctttatatcgataagaaactattatttgatgatatgttgttcaacttattggcattttttttgttgagatttgtgttttgattgttttaataaaccttctcttactgtggtcagattttcatgtttcattcattttgtcttatgaagttttgtctttggtttaagcctgtaactcacttagtctgtaattttatatttggcgttttggtattatctttagttggtattgaatattaaagcatattggttttaggttttgcttttatggtgactaaagtgttttgggaaaaggagaattcattgcagtgtttcaagaggtttggtacggtgtgttgtaaaagcatgttttgaatttccaggtgatttactgagtaacctgttgcagagtcctagttcagccaaactgctgcaccagcccatccccatcctggatgtggagagtgagtatgtctgttccctggccttggagtgcctggcccacctcttcagttggattcctctgtctgccagcatcaccccatccctcctcaccactatcttccactttgctcgatttggctgcgatacccgggccagaaagatggcatcagtgaatggcagcagccagaactgtgttttgggtcaggagcgtggccgacttggggtcttggccatgtcctgcatcaatgaactcatgtccaagaactgtgtgcctatggaatttgaggaatacttattgcgaatgtttcaacaaaccttctacctcctgcaaaaaatcaccaaggataacaatgcccacacggtgaagagcaggctagaggaactcgatgagaggtaatgagaacaggcgggagtcgtgcccgggaaagggcctggctgcttgtcacaccatgtcatgtggtgtctgtaatcccctttggtttcagaatatgggctactgataaagatagaaaggtaggtgtttcagaatattcaggctgaactagaaggacttgggtggttaagggaagtgaaccaagtgtgaaagtgctggtgtagtgtgtagacctgttgtctctttccccatccat

SEQ ID NO: 33017 - DNA, 1218 bp, Mus musculus
aactccagacctttggaagagcagtcggatgctcttacccactgagccatctcaccagccccagataggaatttttcatgtctagtgtaatcataaaagaccagtacgtcttttaaaggtccatgcggtttgcttatgacagaattgtctgtcattcagtatgagtatctcttcacgtaaccaaaacttggttgggaatttatttagatttatacaaaatttgtcctgtttgtataaagacagggttgtttccagctgctttttaagttcctgctggtagaatatgagaacttgagaataaaatttgaagggttagtaaagcaaagtttcataaatgaccctctgaattctttttcaaaagtgttgcttgaggtagtctgctcatatgaggctcaacacttcacttttagttgaattttactaatcctctttgtagctcattagttctattctgctcagcatttgctttttcctgtcagttgatccagtcccctgtgacaaccccccttggactgatcatgctgaagacaacttcggaagagctagcttgtccacgtgaggacctcagcgtggctcggaaggaggagttgcggaagctgctgctggaccaggtgcagacagtgcttgggctcttgacaggtgagtgagcgctttgctggtgcctggagacaggtccactgcagagagctcaggtcttctaggtattatcgactcagtgtaaatgtgggaagaacttagttctggtttctagcactcagggccacagtctagtgcatggtaaaacctcagaggagatttataagtttattttctaagagtcttttttttttaaattggtcctcactctgaggtacatatataggccaggtagtaggaatgtgattctcatgctgatagtgtaattggcgtaggtaagtggcaagctctttaacataatttgaatttaagattagaagtaggagtagcaagatgaaaaaaattcctctgtagaatagtgagacgagtcttacccgttgccctgggttgtagttgtatgtggcatttcatctcagctatctgatcagagtctgacagtgtgcaaggggaaggagggggagaagcctatcacacagtgaggcaggaaggtagcaagaacatccccaaagactggaatgtgttgtagaaattatttaatcccaactccatgtctctaccccacctttgatcctttagttcctg

SEQ ID NO: 33018 - DNA, 1148 bp, Mus musculus
ctaaaccatctctgtcatctctccttcagggtaatgctctttccccatggcctagttctcttaatgatgacctcattcatccactgtgcatgcttaatgttgagtcatagttaacttcctcttctgctgtacctgttgatggtattgccaatatgtttgtgtcccaattctggccttctcatcttgtttggttgggtcaggtcctcagtctctgttttgtttttttttttttgatttttatttattattatatgtaagtacactgtagctgtcttcagacacaccagaagagggagtcagatcttgttacggatggttgtgagccaccatgtggttgctgggatttgaactctggaccttcggaagagcagtcgggtgctcttacccactgagccatctcaccagcccctctgttttgttttgtttttaatattttttgtattttattttttaaagatttatttatttattttatgtatacgagtacactgtacctgtacagatggttgtgagcctttatgtggttgttgggaattgaattttaggacctctgctcactccggtcgatcccactcattccagtcctaagatttatttattgttatattaaatacataacaaagatattgtagctgaattcagatgcaccagaagagggcatcagatctcactatgggtggttatgagccaccaggtggttgctgggatttgaactcaggaccttcagaagaacagtcagtgctcttacctgctgagccatctcgtcagccctgtttttttttttttttttgtttgtttgtttttttaaagataggaacttggagtgctggctggactcaaactcaggatcctcatgcatgagtgctgggtttacaggtgctcacccccacaccagctttgtgatagtgctaaattggcaacttatcacacttgagagtcacccgggaagagtctctggacaaacctgaacagacctgggattgtttagatcaagctggtcagtggacatatctgggcggtgattgtccagcctgctgtgccgttcctgggtttgtgtcctccagtgtcctccagggaaagggaactgagcaaaaggagcatgggtgcgttcatttcgtctcttcttgactgtgtgtgtgtgactagct

SEQ ID NO: 33019 - DNA, 1296 bp, Mus musculus
cggcttctggcgctagagcctgagcggcgtgggcccgccaaggaggtctttcgcttcctcaagcacgagctcacatccgagctgcggcggcggccttcccaccgcgcacgcaagccgcctggggaccgcctgccagggtccctgcgccttgaggctcccgggccactcaagcgcactgtgctcaccgagagtggcagcggctcgcggccttccccacccagcgtagggcccgtggtacccgtgccagtgccagttccagtacccgtgcctgaggctggtctggctccgcctgcacccccgggcaggaccgacggccgcacggacaagagtaaagggcaggtggtactggccacggccatcgagatctgcgtctgagccgctgcagcgcagctgctgcggggaagccgcgcgctctaacccgtactggggacaaggagcagtctctgcgcggcagtgggaaggagtagcgtagactaggaggcccagacaccccggtcggtggtgggctggtgacatagctagtaaatgaccatgcgtacggccggcctcagcctagaggagccgaggcccctgacaaaggctgggagcttgtgggccagactctgagctctggaacctgaacactcctggcgcttcataccccttggcagataaccctacagtattccatccaaacctgggcacagaaagggggctttggtgtcgggcagatatgggcatgagatcgatccttagaaactggcaaaggacaggcactgggttgataacagtggtctccaggaggtcagaggaagaggccaagccctttaaatgtagcaaaagttgtgtgcaggaacagacccgattatctagtgatacccctcacttcttcctgctgatgggaactttgaacccaggagggagagctattactgcagccacgaggcttttgggaacagagctccaatgtgtgcccctcctgggagtaagggagcagatggctggggaacaggaggctcggcactcctgtgtccccagggcaatggagtccatgcacagcccagctgctccctccagagcactccacaagcagggaaacagttgtgacagctactcctgggtttctgttgccgtcacatgtcagcctgggttctaggccagtaccctttcaggggcagagcaggtcactgaagtgaggagggagtgtgatgtgtgtctaagtgtccagacacctcaccaggcagctgccaagagccaggcctctgttttagcacactcctcagggaaccccaggaggtacctgctgttggctccggt

SEQ ID NO: 33020 - DNA, 1547 bp, Mus musculus
caaggaggttccatcttggggctggctggctagctagctacaaggggcaccaaccacccctcagcctggagccccccacctctacacacccccttactcccaccacaaagggctataggtctccctgccctgcctgagtccagtttacaaactgtggttgctccagggcctggtcctactctcctggggtgccaccacttccctagtggacacagggccacatatgccaggtaagtagcaaacccctcctcctgccaagagccgagtctcagaaggcccccatcactgccctggcccacctggggccattaggccctccttcccagccgctgcctctcctcttgccttaggcctctccaccctgatctgcaataacaaggaagcgagattccacggtagacatcccgcatcccacaagcgcccctctctgttgagatcctgtgtgggaggcttctcccttgtagtatctaggatggtagtcctcagaagagaccttaggtacgtagcccagccccattgtttagaggcagcaaccagcctgacctggaacaggactcggactgggtcagcctctgctcttgccaccgctggtactgtctctgtcggttgggttgggaccctttgccccttaggagaggtgttggttacagatgtttacctcagtttgaagaaacaaaactgttgaagaaacaaataataataatagcaaaaaattagtaacacggtagacatggaggcttagaagacaaaccacagaggaaacctccccctttacaagttttctgtgaagtacagtttgttcacgtacgcacacatatgtgtgcatctctgtctcaccccagggcaggccaaatcatctattgacacctgtcccagcctgtgtgtccctcacactgccccctgtcctttggtgcttcccaggggcccctttgagctggcttgtggggtataggagagctccccggatgggaagtgaggcctcgggttagctagaggtctcccaccaggttctgtgagcagagagccctatgactgtgatgttccctgagcccacaggacagtcctggtggctggcaacagtgtccagttctggggcagagcctgggttgttctcacgcagtagagcctcacacccctgtctcgcctctcctaccccatgtgtttgtaaatactctggcttcctttggccctgaggaggtttttaaatgtgttatttacttctctaactatgacaattgctataaaataaaaatttagaaaaatgattgtttgagctgcagggtggaaggggtacactgatcttcatttacagcacactctgaggtagcacctgcagtgtctaggcctactcggcctcaagtggactcaggccaggcctgaaggagggttatgcttcctggactttgtgcgagaggggcagagagaattgtcctggcttagaatccagcatcagcttagacttgtgcagcctggaccaaaacggaaagctcctggccaccaccttggctgtatttagtgagcgcctttgttatacatgtcagcgacca

SEQ ID NO: 33021 - DNA, 1128 bp, Mus musculus
cattcaactaccatcccctcaaattgaatccgctcttcatctttagtatatgggagtcacttatctattagtatatctattagaactgaaatggaaaaaaggaaaactatcccataaaaaggaaatttaagaatgcttcagaaataatgagggattccagccggtgtttcctttatagcttgatcaatgaataagagttcagaggggctggacagaaggctgggcagttcagagcacgtgctattcttccagaggaaccaagtttggttcttagcatccatatggtacctcacaactgtctgaaaccccacttccaaggaaccatgcatgccctcttctgtcttctgtggcaccatgcacacatgtggtgcacagacacagatgtgggcaaaaatctcagacacataaaggcagtaaatgggggaggggagttgcataggaatgattcccttagactcatgtgtgggaatacttggcccacaggaatggcactattaggaggtgtgggcctgttggaggcagtgtgtcactgtggaagtgggctttgagatcttacatgctcaagctaggcctagcacggcttacagtctctccctggtgcctgtggatccaaatgcagagctctcagctccttctccagcaccatgtctgcctacgtgctgccatgcttcttgctatgatgataatggactaaacctctgaaactgtaagcctgccagcctcatttaaatgttttcagggttgaagagatggctcagtggttaagagcactgactgctcttccagaggttctgagtccagttcccagcaaccacatggtggctcacaaccatctgtaatgggatccgatgccctcttctggtgtgtctgaagtcagctacagtgtactcatatacattaaaaaaaaaagcctcatttaaatgttttcctttaagagagttactgtggtcatggtgtctccttgtagtaatagaaaacaggggaattcaaggcttgccctatcttggcaccacagttgggaggggtcagagggagagagaagacatcctcacctatgaactataaagagagagaacagtctcgtcttaaacctgcacgtgctcatgaaatattgttcaactttgttat

SEQ ID NO: 33022 - DNA, 1115 bp, Mus musculus
ctgaccgcctccgacggagctggcccccttccttcctgtccgagttccgggctctgcagttctcgctcatgctctgtgctttcgttggggcactgggtggtgcggccttcctgggcaccgccatgttcattgaagatgaccgccggcgggctcaactccacgtgcagggtgagtgagggtcactgtaggtccaccttcacagtaccacctgcctgtctgtctgtctccgcgtatgtactctacagttctccctccactcagactagcccatccattcatgccaccagctgggggcaagagtcccagcatcccaggctcatccagcttagctttgggtctgtctggaagtggattgggctctgtctgtgtgcagttctgagggctctccatgctgcctcatctgggcccctctgcctgtgtccccttgctgcctgtgtccccttgctggctcttatcttactggccttggctctgacccctttctcgcaggtctgttgcatgagtctgggccctcagatgaccggattgtagtacctcagcgaggccgttctacccgagtccccgtgtccagcgtgctcatctgaggagccggtgcttacccggccactgatgcatcgcagctgggccttgggcccacccaagacggttcccaggcagaagccctcaccaggcccaggtccaagaaggaagccctgggatatctcccagctcccagacactacatgggcagcccagggaagagatgggagtccagaaacggggaaggggtgtcctctctactaggacagcccaaggggtttggtgctatttgtaatggaataaaatttgtaatcagactcctgactgactgcttgtctctctgtgggtgccactggcctcagggaatatccatagtcccaggacttagcaggggctgtcaggtcaccctgtgggtaagtccctgtcttctgagcttggtaatctagaaggagggctgctcttttctgagtgagctggttcagtatgactgtgactcaccgtggtcccctggaagtcgctctcccagtagttaagcctgggagctgggggcctgtggtgccctcagtgccctcggtccacacaggccttggcagagc

SEQ ID NO: 33023 - DNA, 2672 bp, Mus musculus
ctccaccctgcaagcactgccatttcaggcatgtgttgcatggtcagctaaaagtcaacttttccgttttggcgctggggaataaacttgctagaacattggacttgaaagtgtgtgtgtgtgagaccactgctcctggccaccaacccattttctgtctatctctgtaggttctcccagcctgcctttcacatttttgcatgtgttgtttatatctctatgcaggattctcctcttaaggttctcatgtcacactatgaggaagccatgggactctctggacacaagctctccttcttctttgatgggacaaagctttcaggcaaggagctgccagctgatctgggcctggaatccggagatctcatcgaagtctggggctgaagctctcaccctgttcggacgcaaagccaagacatggagacaatagctcccaattttattattgtgatttttcgccccataagggctaacagaaactgaattagaacttgtttacttatttatttctggtgctggggattgaaccccagactatgcacatgctaaggatgtatgaagtggaggcaaaaccaaggcattacctttagccagcctctagtagactgtagtgtcaagcaagtggctacttggtagttgtgtggctctgtgtatgtttgtgctgtatttggcagcccctggggcacatagaagggaccttggcttccctaccatttcacgttcgctggtgccctttccttcatcagatgacttctgtgaagctgcctatgttgagtgtgttgaactaaatgagctctgctttgggtgtccaggcctggggtttgtgccgcagttggagccagcagtgacttcactctgacttgggactgagaatgcatttcctggtggagacactcgggtgcagaaatataacagaaggtgacatacatgctgaagctgaggactaggtcgaaagttaacgacgttgcattttcagccttgggtatcctctctgcctgccaggactctagccagtgtctggtacacacttcttggcatggacacctagccataatcaaatacatagagccgttgagtgttagatcactctagttctcggtcttcctccctcacgctctctctctccagttagtacctatctgggatattggtacctttggatatgaatgtccttataagaaaatattctgaacacatgtggttttactgtatacacacggagttgtgcaatagatagtctgtcttcagtcagaatgagtaacagtctagccatgttagcgccttctaggtccgtcgttgcttggatctctgtgggtgccacatagtggcattagatgcttttactcacacattgccttaagggggatgcccaagtctccagctccttgggaccatattccaggccacagcaaacatctttcatgtgtcccctttgggcctgggtaggtctttctttggtgtgcttgtccaggctgggactgtggcttatacaggttcttttttcttggggcttctctttccttatctttaccagcatttggcgctgttgaaatcctgattttggcagtcagtgtgtataaagcaccacatatcttaatatccctttatctgaagaccatttcttacgcatggccaccttctggtttttctttgtcagctgctgtattctcgggaggcggcttcctcttgcttgtgtttcctttccttgaggagttgcttgtgttctgggcggttgcaaaaaccctcagaacagcactttgtgtatccaggggattttcaccaaacatacattcttaattttaatgtatacagttggcttttgttaggaagttttgttttgattttttgtttttaagggaaaatacaaaggagcttccagagtgggggcggggggtggggtgggggtgggggcggtagtggagaatctcaggattgatacgtttgggtttccaagctagtttaagagactttgattttcttcttttagctccatagttttttgttcttttgtttttttttgtttttgttttgttttgttttgttttgttttgttttgtttttttctctcatattgagaccactagatgagactagagttctaactggtctactctggtgtaggtagattgttctgagccctctacccaggttctcactggttgctgctgggctcctgactattgtgtgttacttataaactgtctaaaatgcacctttgtgccggagaacaagttgtattttgtttttaattataacgagccagttttctaagctttgtctactaaaacaaaataaaaacattatagtctgattttcacaaaagtatgccaactccctttttttgtgagaatatatgccattcctttgacttttgtaacatttttaaaaatccatgatatagtatagcttccaggtttttcagctcttgtatgcccattggttagtaagtctgaacacactattatgtatccatccaatctcaactgaataaagggagatgccttttggagcacttgctggtttctgtctttgtggttctcatgtgatcccacttgacatttctgtgacagagacattagttattcccacacacccatccttctttgtcctcagttaacacaatccacagcttttaacccacacaaactctcagaatgaagacactgtagaca

SEQ ID NO: 33024 - DNA, 1131 bp, Mus musculus
ggaggaaggatgtctaactgacagggactttaactcccacctcacttgtcatcctgccctcagcacctgcgcttgtcactaaatgaggagggacagtgccgggtccaacatctgtggttccagtccattttcgatatgcttgagcacttccgggtgcaccccatccctctggagtctggaggctccagtgatgttgtccttgtcagctatgtgccctcccagcggcagcagggtgagcagagcaggtctgcaggggaggaggtgcccgtgcacccaagaagtgaggtgtgtgtgccaggaagacggggttgggggggtggaggaaaggccctgttagtggggagcagggcagtcaggtacctgggcagggacctagaagggaagcagaaggctgacaggatgcaggcagaggctcctcttggggcaggggcagtggagagctgggtgctgcattcccattccattggaccctccgcgccatcattgtctgtctcctggacccatcctcctcggccttgtctttggccttttgggggattcatggcctgatcccctccttcctcccttgatgtctgatgtccctgtctgatctctcactttcccccacccaccatcccatctgtccccacgttgcccctcccctcccctcccccaggccgggagcaggctgggagccatgcaggggtgtgcgagggcgaccgatgctaccccgatgcctcctccaccctcctgcccttcggagcgagtgactgtgtgtaagtgtggtcctctcaccaccgcccatgattcatcttccatggaggggggttgctcaggagatgggacatgggggagatagcacatggctccttggggaggacaagcaaaggggaggtcaccataagaactcacttccttccacaagcaatgtcttctcaccattcttatccagaacggagcacctcccgtgacccagcccagccctctgaaccccctccatggacagatcccccacatcctggggcagaagaggcgtcgggggcgccagaagttgcggcagccacagccgcagcagccaaagagaggcaagagaaagagaaagcgggcagtggaggggtccaggaagagctggtccccgtggctgagctggtc

SEQ ID NO: 33025 - DNA, 1615 bp, Mus musculus
ggggcactgaaactaattctcttctacaggcccatgtccaaactggagtcacagcagccccgcccccacaccctggggctccccacccgccccaggtgatgctgctgcaccccccccagggccatggggggcccccccaaggcgcggtgcccccgagtggggtgcctgcactctcagcttccacaccctcaccctacccctacatcggacacccccaaggtgagcagcctggccaggcgcctggatttccaggaggagccgatgacaggattcgtgagttctcgttagctgggggaatttggcatggaagagctgaggggctgcaggtggggcaggatgcacgggttctgggtggggattgaggggtcttggaggcagggctgtcccagagggcgcccgccgacccacacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgaggtaaggtcagcgcagcagacagggccagactggggcgtggggggctgagctgggcaactgagtaagggctctggcctactgggaaacagcgattgacctgtgcttctgacagtcccctgagactcctcgaggaggccgctcctccccacacccctcaccccctggacgcattgacagagggacagctgctcgggttctaatgctcctgctctctctctttcccctccaaccagttcaatctcatccctcccagcagctccccttccaccccccggggaactgaagattgtcctggccgcgacctgagacctccatgagtggagggaagagtgatctatgtctcttccccccagcagctgggaccagtcctagccccgtccccaacccctttcccttggggagttgggggaattcctgccaagcaccttgaatgggaggggtccttcaagtgggccgggctggggtccaacgggggtgggggaggttcctgctctgccccagctgggtcctacccagtcttgtcctcccatcctctcatctattcccccccgccccctggagacggaagatcttttattttctattatttataacctcagacttgggccccctgttcttctccattaacttgagtgttctgtgtgagaccaacagacagatgcctcaaggacttttactttttattacataaaaaaattaaaaaaaaataaaataaaaaaataaaattttaaactaacttaacctgcctatgggtttgattcttaaaagtaaatttccccttccataggagatagtttggagttttgtaatctgagcctgccaaggacttgggtagtccttagtgggctgtaggacctttgggccataatacagagaacatgtgctgtgttgagggcagagaaaagcccccagaatttgggcatgacagtattgggtgagagaaagggacaaagtaaggctgatactgccctcaggacacatggcacagggaagcaggggaaactggaaagccacaaggtgttcactatgtgga

SEQ ID NO: 33026 - DNA, 1187 bp, Mus musculus
gggcttcgagatttcacacaaccacttagagctctcttagtttgtgaatgtccatcttgtgatttgctatgaagcgcttagggaaagtgtaggatatatttgacacaggtggatttaaaaaggctgaagtgggattacagaaatatctcctcttgtctcttacagaacaaatctaccagtactccaacttcaccagggccccgtactcattcaacaccttctataccggtgctgacagcaggccagagtgggctctacagtccccagtacatctcatatatacctcagatccacatgggaccagctgtacaggtaggagagagtgagcccaagaaaagtgctgattgtccagctcaggctgttctgagcacctgctgagccccagatctttctcaggcgcctcagatgtatccatatcctgtatccaattccgtgcctgggcagcagggcaagtaccggggtgcaaaaggtgagcagggttgggaagaagagctgggactgcctagtaccttttggctaacgctgcttgagctttgtactgtttactctccacccacaggctcacttcctcctcagcgctctgaccaacaccaaccagcctcagcccctccaatgatgcaggctgctgctgctgctgctggcccacccctggtggctgccacaccctattcctcctacatcccctacaacccacagcagttcccaggccagcctgccatgatgcagcccatggcacactacccttcacaggtaacgaacacctgaaatccaacctgatggggggaagcagggttattttgagtagtggtggctgtggggttggcagtgtccacttgaattcctgtaacaggacattgaacctttgctctcgggttttccctctgaattaaggtggttactgtctttaaaaccactactgaggctcatgctcctatgcacatggaagctgacaggacgttccaagcaggtctgcttagcattttgttttgtttctttagccggtgttcgcccctatgcttcaaagtaatccacgaatgttgacatcgggaagccatccccaggccatcgtgtcgtcctccactcctcagtaccctgctgcagagcagcctaccccccaagccctctatggtgagttgtggtgcccactttgtcaccaggatatatgtatccatttggtgtgctcagca

SEQ ID NO: 33027 - DNA, 1182 bp, Mus musculus
gtaactgagtcaagttgttgaaatgctgggcggtagtttgtagatgcttggtgtcgggcagggtcttggattttatcattccagtttttttttgttgttttgtttttgtctttttcaagtcagagtttctctgtgtagccctggctgtcctggaactctgtaggccaggctgactggccttgaacttaagaggtacagctacctctgcctcccaagtgctggggttaaagacattcagctggatttaatgtaatctttttgagaaagaactctagttttctttggttctaacatgtcagtttatgggttgtagctggttatcaggtgttttgttgagacttttttttttaaccagcattttagaacaggagaagttataccacttccagtctttttgaactacccagagaaaccattgcctttgtgttacttacctgccctgggcttaacacaggaaattgtgcctctaggtgaaaaaaagcttgtaaattttctatgggttttccccctatatgcactacttcctggccagcaataactatcgtgtagctctcccttttcttccagtgggccggatgtaccctccacggtctcccaagtctgctgcccctgccccagtctcagcttcctgtcctgagcctcccattggttcggcagtggcgtcctctgcctccatccctgtgacatcatcagttgtggatcctggtgcaggctctatttccccggcatctccaaaactctccctgacccctacagatggtgagaaccggttgtaaatgctggagaactgtgggtatgacttgagagcaggatctaattgcctctttttcttcagtaaaagaactcccaaccaaggagcccagtaggaatttggaagcccaagaactggcccgcatagctgggaaaggtgagggcaactttactctgtagtcccatttactcgagggagcgtttccctttggaagcagtgtagtgtccatttgcccttcgatttcatttatctgtttgtttgtttgtttaagatttattttatgtatatgaatacagacacacctgaagagggcattggatcccattacagatggttgtgagccaccatgtggttgctgggatttgaactccggacctctggaagagcagtcagtgctcttaactgctgagccatctctccagccctcgttt

SEQ ID NO: 33028 - DNA, 1200 bp, Mus musculus
cttccgaaatgttgacttcaattatgctactaaaggtatcgctctgaactgttgtgtcaagaagctgacgagagctagcccgcaggttgaacacgttgacttgatttacttttcagtagaggtgacttgagttcttgagcacatagcttgatgcctgatagagtcgagtgaatgtgtctagcggtgtaggtactccttttttcatgttttcaagtttagcttttagattagattggggctttgtttttctgttgaggaaggaagggtctttgtatatatggctagcctccttagactggcagagatcaaattgcctctgcttctgagtgctcgcattaccagcattcaccaccccatctagatagacctgtttcaatagttctccctgctcccataaactaaatctggtgtttcttagtttcattttgttaaactgcatggggtggggagtaaggatgagaagtgggcccatcacctgactctgttgctcccctctgccaacagataagttcactgactcagccattgccatgaactctaaggtgaatggagaacacaaagagaaggtgcttcaacgttgggagggcggtgacagcaacagtgacgactacgatctggaatccgatatggtatgttctcccttcctgagaacaggcgggctgagttgtggtcaacatgggttgctgatgtggacgttcattattttctgttgggctatgtttgttcacttttgttttgaggttgttcttggtcagttttcccatcctctgcattgaaaaccattaaagtttctccgtggcagcacttgtaattgtagtaaaaagtataaggtgggcatagtataacccatacctctaatccagccttggggaagttgtagcagaagaattgtgaagtcctggacaatctgggctacataacaaaaagtctttaaagaaaagcagaggagagaaatggaggtgtataggaggactattgtatatatccatgcttcttcattctgtttcttcgatgagcttagagttctaaattagtctgacaaggtgggtcagataaaggtgcttgccaccaagccaagtggtgaaaaggaacagattctcgcagatcgtcctcagactttcacatacctacaatcccacaggaacaggtccacattacggatggttgtgagccgccaccatgtggttgttaggatttgaa

SEQ ID NO: 33029 - DNA, 1182 bp, Mus musculus
ccattcccttttcctatgtggaccttatcctgatttatctgtgtgactttagttcttagctattcttcataatgaagcctttaccaagcctccatcaccatacatacatacatacttccacattttcccctcatttattttttctctgttcctgtagtaatttttttaaagatttatttattattattcataagtacactgtagctgtcttcagacacaccagaagagggtatcagatctcattatgggtggttgtgagccaccatgtagttgctgggatttgaactcagaacctttggaagagcagtcggtgctcttaactgctgaaccatctctccagctcctcttgtagtaattttgtcctgcacattccatgtctagaatggtagacagacctaggtaaacagtttgcctgtggctatcacctctgtcctttgtgcttagatcctgtataaccgtactatggtgcaactgggcatctgtgctttccgccaaggcctgacaaaggatgcacacaatgcacttctggatattcagtcaagtggtcgtgccaaggagcttctaggtcagggtctgctgctgcgcagcctgcaggagcgaaatcaggaacaggaaaaggtagagcgacgccggcaggtgccctttcacctgcacatcaacctggagctgctggagtgtgtctatctggtgtcagctatgctcctggagatcccctacatggctgcccatgagagcgatgcccgccgacgcatgatcagcaagcagttccaccaccaactgcgggtgggcgagcggcagcccctgctaggtgagtgtggacctctgtggtcctgtacacatcttgaatctttgtttgcccataagcattaaaagaagttcatggaataacttcctcacaagatgacccctcctcttcctggcacagtctctgagaaataattcattattcaagacacaatgagtttgaggtcagcctgctctaccaaatttccaggttatccagggctacttagtaatcctgactttttttcttagatttatttatgtaatttatgcatatgagtgctctacttgcatgtgtgtttacacctcagaaaagggtggaagaatcccagatgttcctgagaggacttaggccctctggaagaatggtcagtgctcttaaccactgagccatctctc

SEQ ID NO: 33030 - DNA, 1140 bp, Mus musculus
agctcctgggagagggtgctggttttagggtataaatgaagaggggaaaccaaaatggttggattgctggagatggaaggttggggaaggcagtacttatgtttgagatgaggatgggtgtcctccttcccagagtatgtggagcacctgaaggatgaggcacaagtgtgtgccatcattgagcgagtgcagcgctacctggaggagaaaggtaccactgaggagatctgccagatctacttaaggcgcatcctgcacacgtactacaagtttgactacaaggcccatcagcggcagcttactcctcctgaaggatcctcaaaggtgagagtacttggtaatcttgaggagcaagagaagtgtgaatttatcctccttatctattaggccttgatgataagtcttctacccccaggggccttttgaagtagaagggggcagggtcggaggggttgcagtgagattggaaagagcctctggtagtctttgctgggtagccattactaacaacttcccattcctctagtctgagcaagaccaggcagaaaatgagggtgaggactcagctgtgctaatggaaagactgtgcaagtacatctatgccaaggaccgtacagaccggatccgtacctgtgccatcctctgccatatctaccatcatgcgctccactcccgctggtatcaggcccgtgacctcatgctcatgagccacctacaggacaacattcagcacgcagacccgccggtgcaggtaggtaggtgggtggaggagacggctggcctccattaggtaaatggactcaacaggaattagcacgtttagctagtgtggacccagacaggtttgggtcttttccaacctctgtttgttttcttcttgtttgctttttgtttattttcctaactacctaggattgggttcagaacattaggagctgatcttacttttctaaaaagataaaaagggtctttgaagtagttgttaaattaggaggaaaggggtcctagataactggactgtattgggatatgctagagcgaaattagcaggattcatgacagtaggagagccagcaacatcttgaggacctttttatatatagagaaaaaatacaaatagctatatctgaggtgtagatc

SEQ ID NO: 33031 - DNA, 1239 bp, Mus musculus
cgcgggcggtggggaaggactcctgggcgcgtgttccatcgtccgggtcttctgcccgctaggaggtggaggacacgactctgaaccgttgcgcgaccagcttccgagtcctggtggtgtcggctaagttcgagggaaagccactgctccagagacaccggtgagccccgggagccagcctctcacccagccaagcctcaggctccggatggcagcccgggcatccgctcgccatgggtgggaccaactcattcccaaagcccggagatgtgacccatagccccgagggtgctcctgcctttgtgattggattcctgtcctctccttgaatccccacttcttggagacgtctccgatctccttggtcaccctagcttcggagcccatcactccagctgaggccgctcatttcccattcccttctctcgctccaggctggtgaacgagtgcttagccgaagagctcccgcacatccatgcctttgagcagaaaactctgaccccagagcagtggacccgacagcggcgtgaatgaggggcctaggcctgaacagtcattaaaatttaaacctggcccagctggtctcagtgtgctgtttgaagaccctgaggccaagtcacggatgtggcttttccctgactctcctccagccattgtttcagcaaatttggatggatttctttcctgagccctctaggtcccaacttaaacaatgaagattcggttcttaagtctgccaaggctttactgtcaaaccctgtggtctgtactgtcaccaaggtcagacctcaaaaagcagggtgttcctgctctgtcagccctcagaaaccctgagcattctcccaggttccctcactccaggttcctggaagtagcagagacaagatacagaatttctgtcagtctcttcacaggcgtacacactcaggaggagggatggacacaatgcacgctgatgttcagttcagctctcccacagctagttcctctccactgtggatctttgctttggttttgtctttcagacaggtccccatatgtttcccaggctgcttgtaaattcatgagcttaggggatcctttggccttagtcttccatgcagctatggctacagacgtccagcacaatgcccagtccttcccatattgtcaaggcttgtctcagccacccagtttcctgtctccatcttctcttgatttcatcacagaggttggtcaagctgggatcatagtagtcag

SEQ ID NO: 33032 - DNA, 1121 bp, Mus musculus
gcttatcaacaccacctgcgaccttaaggtcagaggttaaatgcctccctccctctccttccctggtcctggggcctctgggtggctagcaagagcagccttggaacgtggcaagcaagaacaaaacagtcagggcaggggcacttcctaggccggggaagccttgggcaatgtagttcagtggcctgggtttgattccagatctgtgattttggcctggcccggattgctgaccctgagcacgaccacactggctttctgacggagtatgtggccacacgctggtaccgagccccagagatcatgcttaattccaaggtaggagagtttcccatgtctgcgagggagtcctagagccatctcagggcctaggcacaatcccgctgacccttgggccttagcaagatgtagagagtagagttttcctcggctctgtcctctgccctttgctgtgttagatctaagttggatatggtgcctgtcccaaatactgggaatggccctgatgaggctggccgggaagctcagcacactttccccctagggctacaccaaatccatcgacatctggtctgtgggctgcattctggctgagatgctctccaaccggcccatcttccccggcaagcactacctggaccagctcaaccacattctaggtgcgagggcctgtctggccgagaggggtgggggttagcttctcagaggtgacatttctggagggtgagaattaggtaccacatatggagcctcctccagcatctcacggtatttcttcccatttgaaagctggggaaagcaaggctaagccgtacccctgagaagactgcagccagagtctgagcccagggctccctggttctccgctctctgcccttcgtcgctaccccagtgggtagatggggaggactggcggcacgtggctgggcttgggctcctggcggcacgtggctgggcttgggctcctggtcttgcttcctgacctgttgccagaaggaggactgatcttctcaccaagacaactggtttctccgcaggtatcttgggttccccatcccaggaggaccttaattgcatcattaacatgaaggcccgaaactacctgcagtctctgccctcga

SEQ ID NO: 33033 - DNA, 1337 bp, Mus musculus
tcagtgtttttccagactgccctatgtggcagaaaatgaccttactgccaggacaaaccttgatcataatggttctctgggcatttttttctccttagagcttctctgttctagcatttgctatcctgtctcccagatcccctagaacaagcctctgcttaatgaggaaagatgcacgggcttttaattccttggtataatagacaaccagaggagcccacacactgtccttgtcttgtctcagacacaacaggctggggagtgagcccccgcggggcaggttacctgtttggcagtgacgtggtcgcccagttcaatgcagccaacgacattgatatgatctgccgtgcccaccaattagtgatggaaggctacaagtggcacttcaatgagaccgtgcttactgtgtggtcagcgcctaattactgctaccggtaagctggcaaggccaggagcccgggtgagggtaggtatctgcgccaaccattgttaactctacttttcttaaatccagctgtggcaatgtggcagccatcttagaactggatgagcacctccagaaagatttcatcatcttcgaggctgcaccccaagagacacgtggcatcccctccaaaaagccagtggccgactatttcctgtgactccttggccccagcccctctggcccttggaccactgtgactgccctctgcccagtcggaggctgggtctgaggggctgcctggctttgcttgccccagggtgcggacttgctctggagaggtggagccttggctcctggcttcctctcctttctcccacttgatccatgaagttttcagtcattttttttttcttttttccttttttttcctttcttttttctttttgtttttgtttttagataaaacattttgagaaaaaaagaaaaaaattctaataaaagaagaaaaatagacttaggttctgtcaggtttgattggggtggacatggagacctgctctgcttgtccgttgggcccggagccttgaggctccatctgctaatcttctaatctttcccaaaggcttccttagtgcttcatgaaatctaggttcatggacagccttgattcttaaagcaaccattgtgaggaagcttttccatcttgaaggggacagcccagagcaggccctttcctagccacaagggcagggcaagcagctggaccttaaagctgtggctcccccagccccacccagggccaacaccattagctcaagtttcctgagcactaatgtctttggagttttattaacaaaaatactctgatcctgagaacaaattggcatggcttgcactagtaacaaggccc

SEQ ID NO: 33034 - DNA, 1457 bp, Mus musculus
ccctgttttccacctttccctgctgtgttccaggtcctggcggctgtctacaaggctctgagcgaccaccatgtctatctggaaggcacattgctgaagcccaacatggtcacccctggccatgcttgcacccagaaattttccaatgaggagattgccatggcaacggtcacagcacttcgtcgcacagtgccccctgctgtcactggtgaggcccactccctcatcttggcctggtgaggtggatgcaccatcacatttgactttgtccagggtgacgcctcatggcttttcctgctccgcatctctaatgcaggtccctttccttctgtgcttgttctccaggggtcactttcctgtctggagggcagagtgaggaagaggcatccatcaacctcaatgctatcaacaagtgccccctgctgaagccatgggccttgactttctcctatggtcgagccctgcaggcctctgctctaaaggcctggggtgggaagaaggagaacctgaaggcagcccaggaggagtacatcaagcgcgccctggtaaggcaggcaggcaggcgtggaagtgtgaacaggtgcctgggcggggtggggagggactcaagaagagaattcctctgattcctcttcccttttaggccaacagcctcgcttgtcaaggaaagtataccccaagtggccagtctggagccgcagccagtgaatctctcttcatctctaaccatgcctactaaccagagctgaactaaggctgctccatcaacactccaggcccctgcctacccacttgctattgaagaggggtcttcaggctctttcccatcactcttgctgctgccctcgtgtgcggtgttgtctgtgaatgctaaatctgccatcccttccagcccactgccaataaacaactatttaagggggagtctgttgttcatgtcttgtagggtataggggagggcctgaggaaagagccttactttgggtttcttcttcttggacagtaaaaggaagggtttttttgaccagagctttgagaaaggcatagtattatgggatgttctttgcctacatctaattgaaggtaacttttacctaattaatattcagtttaagccaaccaagggcttaatgaatacttggcaaggattgtatcagggctaacacatttatgcgtttttggggactatggagccttttggagaacgcagaatcctctcctgcagtgacataggtatacagctcaactgcagaactcttgggttccaggttgagaatggagcctcagagctgctgatgttccctggtgatagaataagaagcacatcaaaccatgggccatctgtattcttgccacattatattgagtgtagtcggtgtgctagtgcacacctttaatcccagcactcaggaggcagaggcaggcaggaggccaacctggaactcactacaaagtga

SEQ ID NO: 33035 - DNA, 1459 bp, Mus musculus
tcgggaaatcttggttctctcttaactctcgcctttgggttgctatgtggctttgagcacagatcatttctttcttgggctctttcagatgagggtattaggctctctgccctattcgtgatccttaaattctaaaatattcccggttcaattttgtttctaggcaaggtgacccatggcaacgcgcaggccagatgggtccagcttcaacatgacccgcctgtccctggctctggctttttcctttcccccagttgccagtgagcaaccccactctgagctgggcaacacccagcaacagacagagttaggaaaggtacaggaagaggcaggtctagtatagggaagtcgggagtaggggagagctctgggacaggaagtatcccaggaccctcagggagtggggcaggggaggtgggggctagtgccctggcctccagggaagctttgttaccggggagaccatgggatggtccaactaagcgctggtctctgtctgcctccctcacccaggaaagcactgccaccggcaccatgccccacccatacccagcactgaccccggagcagaagaaggagctgtctgacatcgctcaccgcattgtggctccgggcaagggcatcctggctgcagatgagtccaccggtgcggtacaggcagaagaaagggggaggagggacccaaggttggagctagcaggctgatccccttatctccccacatgaccctcctcccttcaggaagcattgccaagcgcctgcagtccattggcaccgagaacaccgaggagaacaggcgcttctaccgccagctgctgctgactgcagacgaccgtgtgaatccctgcattgggggggtgatcctcttccacgagacactgtaccagaaggcagatgatggacgtcccttcccccaagttatcaagtccaagggtggtgttgtgggcattaaggtaagagggcagactctggggggggggtaagattagaggtggatctggagaaagggattaataggtagggagggggtgaatattgggctagcaggcctagagactcaggtgtggatgtattcagcataattttttgtcagtgtttggggtgaacttaggtccttgtgcatgttaggcaagcgctctgttgccaacttaatggtttccctgtgatacaagaaggtgatttcatggtgaagaagtgaaaaggttttctcagtgtgcagtagcaccaggtccctctagtccagttaacatttctctcaaataatacacatcttttctcataaatatttgcaagccatgagaggctacagtgaaaggtgaagtttgggctgggtagaggagacaggggccataaagctgactgctggtctcctccctggcaggtagataagggtgtggtgcccctggcaggaaccaatggcgagacaactacccagggtaagaatgatctgcctgcctcc

SEQ ID NO: 33036 - DNA, 1136 bp, Mus musculus
aggggaccaggcagcctggaaaggccaagaaaggagctgcaggatggggtggggcactggcaggagactcccacgtggccctgtgcacgggtggttgcatatttgcaggtaacagcaaggcaggcaggaggaagtttgcatatgtgaatatagctctccacagtccctcacaagaagacaggcccgtcacagagactcacaaaaataagacaggtagtgtggggcaggggcatcccaccccatgtaaacgtgcaacacactcgtgcgaaggttgggtactggacccggccccagagggcctgtgatggacagctgctgttcactcaagccaaagggtaagcccctgctgcagggggcagctcgctggtcagagtatgccagcgctccagggctgtgtccggctgatgtagacagtcattccagtgtttctgggcctctccccgggctcctggccccagagacacaccacctgaagaacaggcaaggcaggccaacgtgtcagcgcccactctcctccacttccctcagagcacctggtgggctctgccactcacctatgaagtcattggatttgccaatgtcgtagtcccagactgtgacctccagggtcttagtggccagagtggagagttcaatctcatagaagaattcctgagaacaaaggcaggcggtgctttctgtgaggcctaaccacatcgctgtccccagcccaactttatttctactccctgacatttttacctcattaaattccggatttagtgtcttcttctttacacatgttttgtgcttggatttcttatccacatctggtctcaagtacctagggggtaagagaggaacgtgaagttggttagagacaggctaggccccagagcagttaggctggggtcaggcttgggcaagggctcacgtcttcacataagggtcagagtagccgttaacatccattgcagccaggtgcgcacagcgaacaatgcccaccagcagcccatgccgccgagagctgtagctgaggctcagcaggatgcgcccgcgctcttccagcagcccaggtccctgctctgcctgctccagctgccagagaagggggcagaggtgagtctacaggctctccccacctcccacccagacag

SEQ ID NO: 33037 - DNA, 1190 bp, Mus musculus
ttctagagcgatcactctggccgcagtgtggaggaggagctggagctgggagaggctgaaggcagggagtccagttaggaggctggtacctagaccaggtgagctgagagaaggtcctggcccaggctggtggctgctggggtcccaaggaggggctcatccacgatgtcacagaaactggggagcaaagctactgcttaggcttctggcttaggtagcctgtgatgcctactataacccagtgaaccccacaggtggaggagggagagccgaccagtggtggcaggtggtgcccagaggcaggaagaaggcgctggtcctgaatctggctgtaactgctggcacagagcaaccagagtgccttgctagaaagggaagagcccagcttttctgtcaggctccctgtcagactcccctcaccccatccccatcatgcctccatcactgcccctcaccccaggaacttcatggcgtgagattgaggggctgcggtgggcccccgcatacaccttgaatgcctttcagtgggcactgtgcatcttcctcgtgccgatgcctctgactagacctctttacgtttctccctctgctgcagatgtcggttggaccccctgactgccccgtgggtgggccgctggctttcccagccaggggttctggtgccagtgttggggcagccctgacccccctgcctcctcccaagatgcctccacatacaatcctgagcaccgtccctcagcagatgttcagcgatgcaggcagtggggatgacgccctggacggagatgacgacctggtgatcgacattccagagtagccacccagtgccacctgccaggcacctcacagcactcctcctgtgccagcaaactcaagcccacttcctcaagagatgtttattgatgcccagttgccatgcttcggccactgacacaatcagaaaaggcgtaaacatgcacaatgtccccgaggaaggtggcagggtcctgcccttacatcccagccccatccagggaacagttatttaaacgagtggccaaaagggtctgctacatcttcgggaggtagagacctacggtggccgcccctttagaagagcagctacgcagggctgggatttagtgaaggctctgtattaaagagttggctctttctttccttgtcctttcctctatttggaaacgtcctcc

SEQ ID NO: 33038 - DNA, 1184 bp, Mus musculus
ggtgggcagaggagtagggcaaggtgggagtgggtggtgcctgatcctacaggcagtgtgcttgaagcctacacagtggtggtggggacagatgttggctccagctcccccatcagacctcctcatctcatgagcttcttggggctggccagtgaccccaggccagcttgggcattggtgccccaaggctgaccaggagccctgcctccccaccatggtgccagggtctccctccatcaccacctataaaaggtgggaactgtgagtgtcaaatattcatctggtcccctaggggaggggaagggtgggtctagatatattatatttcagagaattatacaacccttgtgatggggccatgaactggggacaacagggcccccagacctggtggaatggcagagcaggtctggtgccaaagcaaggagaatgggaggaggccttcctccagaaggatcaggggtcttgcagtcagggtgcctgagtctcaccattctcctattgctgtctgacgtcctgtgccgtcttgtctttttttttttttttttttttttttaaattggggtcagggctggggcgggggacaagggaaggaccttggaaagggctgctgccaaacctgggagcagtcatgggagcccctctcagctatggggctggcacagagccctagggcgagcttttaataaactgttggttattctaacagaccacaggatgtctccctttttgtctaaggtatgtgtggagaatttatcagtggcaagtgatagtattacttgtgcttagttgggtgacgtgattgaagttgtagtgattttagtgggtgcacatatgactagaaggtcatcagcttaagtccttattctgctttgctttgggatcccatttgtctatcttactacacctgggctctgattggccagacgggtctactaaaactccctgtatgaggctaagagaccctggcggcatgggaatgaagatgaactgagcctgagagtgtgtgtgttgttggggttgagacccagggctttattcatgctaggcatacattcttggagtcaactttacattgctaaggccagattggccacactggaggagggagagccataccctctctgataccatctggtgacagactggatgacacagtacaggggctaggacaactctggaat

SEQ ID NO: 33039 - DNA, 1185 bp, Mus musculus
ggcctcctgcccctactcctcctgctgctactcccattgctggcagcccagggtggaggtggcttgcaggcagcactgctggcccttgaggtagggctagtgggcctgggggcctcctacctgttcctttgtacagctctacacctgccccccggtctgttcttactcctggctcagggtactgcactgttggctgtccttagcctgagctggcgcagaggccttatgggtgtgcctctgggccttggggctgcctggctcctagcttggcccagcctggctttacctctggcagctatggcagctgggggcaaatgggtacggcaacaaggcccccagatgcgtcggggtatctctcgactctggttgaggattttgctacgcctgtcacccatggtctttcgggccctacagggctgtggggctgtaggagaccgggggctgtttgccctgtaccctaagaccaataagaatggtttccgaagtcgactacctgtcccttggccccgtcagggaaatcctcgcactactcaacaccccctagctcagttaacaagagtttgggctgtgtgcaagggctggaactggcgcctagcacgggctagccacagattagcttcttgcttgcccccctgggctgttcatatactagccagctggggcctgcttaagggtgaacggcctagtcggatccctcggctgctgccacgcagccaacgccgtcttgggctctctgcttcccgacagctaccaccagggactgtagctgggcggagatctcagactcgcaggaccctgcctccctggaggtaaccagttccaattctccacccaaatttagggcactgagcactttatctcccatgactcagtaaagtttctccagtctcccagcctctcctccccttctgacctttcttcctcagtatgttttcccaagtccaatcccggccccagatctaggtttttagacaggcagcctcctctgctatggagtccagaaatgacactctttgtgttttccccagtcccctaagttattgctgtcccctgctgtgtgtgctcatcctcaccctcattggctcaggcctggggccaggggtggcagggatggaagtcatgggggttttccctctttgattttgtttttctgtctcccttccaacctgtccccttcccctccac

SEQ ID NO: 33040 - DNA, 1213 bp, Mus musculus
accttctgtttggtgttgtcactatctctttaatcctgatgattagacccaacctgtgaccccaaggacctggcactgccaagcaggaagggtgctcaggaggccctgcccatccagctggtgctccgggaggcctgactgaagactgggtgttgccacacatcctgctgcctcagtcctggggtctggagtgagactttggggacatgtgagggcaaaggagtcagactgatgtcattggacctggggtaccaggctggggagggaaggggccagctagatccttccctgaggccagctcctctctcctgtcctgctctggaaacctccacaataaaggggggccccttcagtctttttggatgtgtttactttgagacactcttagatgatggcccagggtccatgggagctggattagaatccacctggatgctttcccaaaggtggctggctcctccctgtcgttccagtgatctcgagaggctttgtggctcctcaggttcacaggcattgtctctgcccacctgctttatgtccctagctggccacttttgattgtaaccttgatattttctaccctcatgagaatgtgagcttcatgagagcagacttatgtctttcttgtctctgcctagagtgaaaactagcctggcatgtggtagctgcttaataaatattcatgggaagatggatggttttctcagagcatggtccttaggctgagagtgtgtagtgtgtgtgtgtgtgtgtgtgtgtgtgtgtgtgtgtgtgtgtgtgtgtgtctgtgtctgtgtctgtgtctgtgtcttggtcaacctgaccctgctataccctgtagccacacacacatccacacacacatgcatgcttggacgcacacatgcacacacaccccgcacaccacacaccttgcttcctggaactcctggtcctactttggcctttttcacagtctaccaccataccaacttaagggttagtgtacactgtgtactgacttaagggttagtgtacactgtataccaactgaaaggttttttttttttttttggacttttcattgctttttaaaaaatgatttattattttagtacattggtgttttgcttgcatgtccctgtaaaagtattggatcccctggaactagagttatagacagttgagacccgccatgtgggtgctgggaactataccgcgtcctgtgaaagaa

SEQ ID NO: 33041 - DNA, 1135 bp, Mus musculus
gtacagatccaccattgtcaaccagaggagtccttttaagtgaggtcccgtctttcctcagcttgtactactcccgaggattccattccagagaggaagagcatgtccacggagagtcttaagttttctggcctctacccctgccccaggacctttgcacatgatggttatgttccccagccattgcattatgggtatcttagtctaataccagccatcctgtgtgtggcccaaacctaaacattagctcctctgtgcccctgaggcctaagaagggagtatttaacaagatctctaagtgtgggcacttggagggctcacgtctcaatgctgtcatgttttctaccatcttaggaagctcagcccggagccagaaacgggaggcgcgtctggataaggtcctctcagacatgaagcgccataagaaactagaggagcaaatcctccggaccgggagagacctcttcagcttagactcagagggccccagccccaccagccctccactccgatcctcaggaaacagtctctttcccagacagcggaagtactgactggtgctgctcctgcctacaggtgcagactgttttgtgctgggcatggccagcctttcccaacccaggctctggggaacttgtaatggggaaggcctcaggctcccagcgcagtgcctctcaggagagtgcctgtgtgttctgtttagtgtctgttcgcagttttgagctggatgtgctaaatctaataaaagatgcccgatgagttgggcgtggtggcgcacgcctttaatcccagcactcaggaggcagaggcaggcggatttctgagttcgaggccagcctggtttacagagtgagctccaggacagccagggctacacagaaaccctgtctcgaaaaaccaaaaaaaaaaaaagatgccgggtgatcttctcagaggagagactgcagctcaacccaagcacgcattctcacttgggcagaggcagagctgtgttcctccacactgtaatattgaagccagaagaggcagaggctcagccagccaccatcccccacccccacccttactgctgcatcctctgatttcctagtctcggtccagacccgccagttagcactgattcagaaactgcccc

SEQ ID NO: 33042 - DNA, 1791 bp, Mus musculus
tgcagacccatctggggggggccgcccctcctatcccgggagatgccccccagccacagcctacctgctgagggggacccctgcacccaccaggcaaggtgtgggacatggctggggggggcagcatgggatgtgtgggacaagggaactcaaagggcccaataggggatcgcaggaaggccagggatgccagtctgtcactcagattagggagccttgggatccagagagggcagtatggacatgctcagtctgggtaagcaggcaggccgaagcctctggggaccagataggaagtaacggctgtgtcccaggggaaatagggaaatagttgaaaagtctggggtatggaacatgtttcttgccatttaggttgtgctgtgatccttggtgtttctccctataggtactggtgaggtttgtccaatggcggcagcggcagcagcagcggcggcggcggcagcagcagtggtggcagccccccccacagctgtgggctccctctctggggcagagggggtaccagtgagctctcagccacttccctcccagccttggtgagctccaagttgatgggggagaggggagagtggaggaaagctcttcttggtacagtctcctcttcccaccaactcctcacgactcttcatcaaccaaggagcctccagacagagaggaggaagaaggaattcactaggttttaacaatgtttctcctgctcctttcttctccctatcagagctgaccctacaaacacctgtcccctgagttgtgttgaagtcccctggacaatgagcaggggtggcagaggacagcagcagccactgccctcacctttaaccccttgccttgcctcccagggatttgtgagcctttcctagaaggtcctgtgctctcctccttctgtcccctcccctactgtctgctgccccttcctggggagttggtgctttcttttttgttgttgttttttcccaggggtagggaggagagaggaggggaaagaagattctgtcccagaggagagaaaaggtggtattgaggaggggcagaagcggggaaggcagagggatacttgagtaaggttgggtggttaaaccccaagcatcctactggagtgtctgtccagggagaagccaaggggagcatcagaaggagccactggagccagaggcagaacaagagagatggaatcttagggggccagggcaaaggaggggagccagggacaagaggtgcttcctgggggtgggggaatgcagccacagtgtctcccccttccctcttccaccccagctccagccctggtctttcttcctctttcccataacagaagctatggccctggccatgtcatcgtgttcctgtgtcccttgcatgttccccaccctcccctccctccttttgcgcagaccccattacaataaattttaaataaaaacttgtctctgagttcctaagttatcttcaccaagccccctgttgtgtgtgctcatgcctcacccctcccagggagagggaggggttctttgttgaccttgatcttggtcccaacctttcctgctctgcaaagtggtagcttctctcttctgaggtacaacctctagctgcagtacaacacaaatttagggtagggccaagaatccagaagttatggagagcagattccaggtcttcagggaatacccaatctgaacaggcacagaatacccactggagattagggatgccaagctagttattgatgctgtcctgtctacaacccagcaccaggctgcacatacagatccc

SEQ ID NO: 33043 - DNA, 1153 bp, Mus musculus
tggattggctgctgactggatctaatgtggcccctgccctctaagaactgtagagcctatttaggaaatggacaagtatttaagaatctctcacataaaatgaaaaatataattttctccacacaaaacattagtagaactgtccccattgtaatggcatgatgcagtttcccccgcatgggttttttgtttggtttcccttttcccccctgtactggaaattgaaccccagccctcaagcatggaaggcaagcgctctaccactgaattacacttcttcctaatcaggattgatgtgtgcgctcagtcactcactgactcttcacagcaactgagaaaggagctagcaattaaagaagcacaacaaaattagtgaccagaggggagaggccgcagagagatggactgtgcctcgtcatggcagtcacccactgcctttactggcatttctgttacctcatagctggagccatcccctgagtcagaagctgtggaaaaggatgaggactactgggaggtacagattagcccagagttactggcacatgggcgcaaaaaattattggatctgctgaatgaaggctcagctcgggaactgcgcagcctgcagcgcattggccagaagaaagcccagctcatcgtgggctggagggagctccacggccccttcagtgaggtaacaaccctggggacaggtgcagtgggggggtccccgtgctgtgtccactcccttcctagtgttgctgtcccactaggtggaggacttggaacaggtggaaggcatctctgggaagcaggtggagtctttcctgaaggtaaggccacctttgccctttctgcatggtgttcccccaccgcagcccaccttaggctgctatgctaacgcacgttcctcttctttacaggcgaatctcttgagcttggccgccagccagcacagcggtccctcttgacactaccttcttttaaaaatccttgtatagtgacgtgttgtgtaaatacagtttttattccatggttgagcctggtttttgaggatgacagggctggggtcagagtccataactaccctgggggtcaggatcaagctctgcaggacacccatgtaggcgccatctttgggaaacccccaaactaggccaagattgtaaat

SEQ ID NO: 33044 - DNA, 1683 bp, Mus musculus
ctacccctcgcccccctgcagtagcttctgtagcttttaggtgaagtataaacttggtagcacttcaaggttgcttgagccaccatgtgacacagaggggggcaaagtgcagtggcttattggagatgccacagtaatagagagctggccatggagctaagtctcctgaccttttttggcataaagctttttcttgcttggcctttcaggcattgtagtgtacgtttcctgggctcccacatctcgggcatggggctggtgcctcgaggaaacagtcggtctggcccttccaggaatctggagtgcagtagagggctgtgggaggcaggcagggcctaagttttcaccccaccatgctgctctgctcgcctcatctgtctccaggaggcgccccaggagctacaaactgagaacttgggaagtagttcctaggctcagctcgggcttggtggtgggtatttgatgcagagacctccaacacatctaacaactagactggttcctgccagtctagactgcagttgccttgacttcaagaagcccattagtagtagtaggacatctgatgcagtgagtcactgagacagcagaaaccctccaggcattggtaaggtgttaactgttacagaggaactggctttctgaggtacctggcatcttgggacgagtgaaatctagtcaggtggcctgagtgttcacaggtgttgggggatagatacccaggtgtcactcagttccctcacgcttggcgagttctccccttctctgataacaccaaggagggggcagaatagtgatccctgaagatacccacatcctgagctgtgtgaataccactttatgagttatgtggcagagggaaagggtaaagtgacattgaggttttgttttgttttaattttttgaaatggggaagggggtcctcactgtgtagccctgactggcctgctgcctcccaagtgttgagactaacgtcatgcaccatggcgctgggcaaaattaagaaattttgagactgggagattgattacctttgattatttgggccattgtagtcatgggtccttgctgatccctaatgagagcagaggactctgaaagctggaagtgaggcgtatgtctcagggtgcaggtgcctggagagacgggaaaagcagaagacagattcttctcagacaggtgcagtcccacagtgataacccagttaacccactttgtactgtaccctctagagtggtaagataataaatttgtgtcaagctgcttacattgtggtaatttaataaagcaccggtcggaagtgagtctgcgcccagctacgctctggagagccaccagagttccttgtcttcccggccaagcactcacctgacccaaccctgcttaggttcggaactgggtctattctgggtggtaagaccatggactttgttaagcacaaagccagtaattgtttggatgggtttttgttgttttgagacagagtctctcttggaccctggctggcctggaattgattatgtagaccaggctggtcttgaatttagagagacccatctgcctctgcctcccaagtgctgggtaaactgccttcctctccacttcctctccagtaataaaactacaatgtgctttttttgttgttgtttttttgagacagggtttctctgtgtagccctggct

SEQ ID NO: 33045 - DNA, 1673 bp, Mus musculus
agatcgagagaaggagcggcagagacaagagaaggagcgggaaaggcaggagaaggagcggcagaagtgggaaaaggagcaagagaaggaacagcagaagcaggagaaggagcggcagaagctggagaagaaaggccaaggccggaaactgtccttgcgtcgaagggcagatgggcccccggcatcccatgatggtggggacaggtcagcagctgaggcccggcaggatgcttacttttgacctctggttggatctggatggcatggccctcctccttcccctcatcgagagcagccctggcaggctctcccagctccccttggcaggctcttcctttttctgaggaaagtggcttgattcccctgactccttgccagctgctgatccgtacatggccaggacagccacagtgcaagggacagctgcattacctagggtaacagtgaccaagtctggagacccttttgtccagttaggctcagcttgggtctctgtcacacctatgaaatccttctggggtgctgtcttacactccggtggcttcccttagatggtggagctaggttccttttcctgtcttggggccctgcctgtcaccccactgcctactgggggccaaggctgttttctctcctggatatccttgtgttgtaattatgtacagaaggtcaggttggcctggggtgggtgctgtcctttcccctctccacagcgctgcttcactccagtttatttaagaggatatgctaggaagtgtcctccgtctccttcccacccgtgccctgctctctcctaactcacttgctttgtatgctcaggcctctctgctgcagtcacaaagtctgtcttcgattttgttcctttctagccatcaagcccctctctgaataagggtcttcccttgagtccaggggtggaacccaatgtttacattctcttctgtcttggtcccacctcagtggcagttttgtggcgctttgaggaaccggaaaatgaacctgctgttatatctgtctcccgccttgttatttgaagagtgctgtagagtaaggggagtgggggaggcaggcacaaagtctgactttccataggttcagtctgcaggtcttggcaggaacatctggaccactggttctcaatcttcctaatgctgtgaccctttaatacagttctttatattgtggtgactccaaccataaaattattttcattattacttaataacagtatactactgctatgaatcataatgtacgtctctgttttctgatagtcttaggcaacctctgtgaatagtattcgacccccaaaaggagtcacagtaaacgctcacttcatctctcatcaacaaacatagtggtccagctccttcctcctcagctttgcctggattctgctgctcccactctcactggcctcctgggatcctctgcacagcttgcaggactgggatcgcctttccaatggcttcagccccctggaagctgaaggaggggcctgagagtgtgtgcaaaaccaccatctttagattgggctgggttcttggtcagcagcttggtgcagttccctgggcgtctagggtagactaactgcctggggttcatcccagcaggtacacacaaccaaactgcgcagctcttgttttctgtggctagatctttgccacacaccc

SEQ ID NO: 33046 - DNA, 1158 bp, Mus musculus
aaagcgacagcctcgagacccagtcccccggattctgggagaaccccggtggggacagggcagtaatgaccgagctgctgtgtgtggtgagtgtggcaagagtttcaggcagatgtctgatttggtgaaacaccagaggacgcacacaggggagaagccctacaagtgtggcgtctgtggcaagggctttggggacagctcagcccgaatcaaacatcagcgaactcacactggagagaaggcctacagggtccggccaccggccccaggtcctcccaagatgcctcgatctcggattcctgctggtgaacgccccacgatctgtggcgagtgtggcaagagcttccggcagagctctgacctggtcaaacaccagcggacgcacacaggagagaagccctacaagtgtggcatctgtggcaagggctttggggacagttcagcccgaataaagcaccagcggacacacagaggggatcagctgccccggccagtggttccccgacggcagccatccccggcagctccggcggctccacacagacccaaggcccaggacaagccgtatatctgcaccgactgcggcaaaaggtttgtgctcagctgcagcctgctgagccaccaacggagtcacttaggccccaaacccttcggttgtgatgtgtgtggaaaggagtttgcgcggggctctgacctggtgaaacatctgcgggtacacacaggtgagaagccctacctgtgccctgagtgtggcaaaggctttgctgatagctccgcccgggtgaagcatctccgcacccacagcggccagaggcctcacgcctgcccagagtgtaaccgtagctttagcctcagctccactcttcttcgccatcgcctcacccatgtggagccccaggacttcagtctcgcagcctaccccgtggtcccgctcatccccagccctcctccacctcctctcggcaccagcccctcactgacgcctcggagcccttcacactccagtgatgggccttttggcctacctggcttggaaccagagcctgggggcccgcaggctggggagccgcccccacctctggcaggtgacaagccccacaagtgtcctgagtgtggcaaaggtttccgacgaagctctgatctggtgaaacaccatcg

SEQ ID NO: 33047 - DNA, 1114 bp, Mus musculus
tcttgaattcatagccagactgatctacagagagttctaggtaagccagaactctttggtgaaacaaaaaaacaaataaaaacccttgatcctttcagccttagtctgggagagcagattgttggaattttaggtgtccagacaaggcgggggcatcttggccaccctgggggtgaagtattgctgtggagaaggcagttctcacctcagcctgtggggcactgggcgtggttttatccaagaagggcactttgggaaagagcttatgtctgtatgatttgagggtccttcccactcagacactgggacctggtaaaatagaagagccacgggaggcagaggcaggcggatttctgagttcgaggccagcctggtctacagagtgagttctaggacagccagggctatacagagaaaccctgtctcgaaaaaaacgaaaacaaacaaacaaacaaacaaaaaatagaagagccagcaggaaccctcagagcctccagcctaggtcatcgtgtggacatctgcaaaggccagcctgccgagcaagggcggagccagtgcaggccagaggagcttcaagtctccacagctaagtgtctgtctgtctccttattaataaattgtcccttgtctgaggtttgtgtgtggttatgtgtatgtgtgtgcatgggtaagtacaaaggccagcaaggactgaagcaagtacagagactctgtaaagccctcagccatgagatttaaatgggtcccgagccttatgtccattaaataaaagacattgtcatagacaactaagctgctttcattggaggaagatgacagggctcatgcctgtagtcccagaatttaggatgaggcaggaggatcactcagatttgagacaggctcagtagtcttcaggttagtcagctgatgtcctaggccaaggtctggttgcccacaagaacctagctacaacacgaacccttgaaaagaaggtgaggtaccaaggagggaggaccagtgactgggaagcaggaggctggtgatgagtgagcctggaaagaagttgccagcttgcctggtacaggttcagaaagtctggatgctaatttgtcaagggatgttggaagaccca

SEQ ID NO: 33048 - DNA, 1174 bp, Mus musculus
acctcgcatacactttggtttgaacactaaggacctaaggctccagagattaagatggacttccattctcatcacctccctaccagctgacaagtttctcggccttgttagtttttcttgcagtactaagaattgagccaaggctttacccgtctctgtactgtagccaagcccttttctattgaggtagagtctcaaccaagttgcccaggtgggcctagaatttattctgtagtccaggcaggcagtcctttgaccttggcattcctattaattgagtgggatttcaggcctgagcaaagctacttggctttctaccttctctgtgcctcagtttcctcatttgtacagggagagcatagcagcacttacctcctggagatgtaaggactgagtgaatatgtgagttagagctatgtcttgcacataagcagtgtgtaagtagttccgtttttttctctgtgtgtgtaggtgagcggtgtatgtgaatgtgtgtcctgtgcttgtgccggagctgggcaggtacagcaggtacctgctccattactgtccacctgattcccttgacgggggtctctcactggatctggaactaggctggtggcctacaagtccaactgatcttcccctggcctcttactacagcaccaaggggtacaaggggtacaaggcacacctacctggtttttgtccttgtttgtttgtttgtttttcaagacagggtttctctgtatagccctgggcagcctataacttgccttataggccaagatggccacttgcctctgcctcctgggtgggattaaaggtgtgtgctactatagctggctccaaccattatgtttatttgttgtgttcgtgagcgtgtgtgcacgtgtgtgcacgtgtgtgtgtgtgtaggcactcaggtggaggttagaagacaacttctgagagtcacttctttccttccactaagggttctagggacagaacttggttcttcagggctacatgataagcccttctacctgctgatccaacttgctgacctctccgctcattcttatcgaatgtttttttaggctgatttcaggaattggatagagtgaaggcaaactacctaggcagtgggaaagagttcgggaaagatattgagtgtggaccttgacggcttgtgtggggaggagaggtg

SEQ ID NO: 33049 - DNA, 1191 bp, Mus musculus
cgaacctgcggcagcaccggcggcgtcacaccggagagaagccgtacgcatgcgcacactgtgggcggcgctttgcgcagagctccaattacgcgcagcatctgcgcgtgcacacgggcgagaagccttacgcgtgcccggactgcggacgagccttcggcggaagttcgtgcctggcgcgccaccgacgcacgcacacgggcgagcgcccgtacgcatgcgccgactgcggcacgcgcttcgctcagagctcggcgctggccaagcaccggcgcgtgcacacgggcgagaagccgcaccgctgcgccgtgtgcggccggcgcttcggccaccgttccaacctggcggagcatgcgcgcacgcatacgggcgagcggccctacccgtgcacggagtgcggccggcgcttccgcctcagctcacacttcatccgccaccgtcgcgcgcacatgcggcgccgcctctacatctgcgcgggctgcggccgagacttcaagctacccgccagtgccacagccgccacgcccaccgagcgctgcccggagtgcgagggcagctgagccacggcggggcagcgaggggcacttgggactggcacctgaattgttccttccatgcctgcacctgggtcggggtgctctgggactgggagatagggaatgccataccggggtccctagaaccatgcctcgtccccgactacattcccttggcccttctgagtgaataaagtattctatcctcacctcacgatgcctgtaagtgaggtgggtgggaaggggaacattaggtacggaaccaaatggggcaataaactagcctgggattgggagacacacaccaggctggctatgcctcagtctcagttctgaaaagagccataaacaagacatgtgcttggctagatgattgtgttttgcagtctttgagggtcggtatggcaaaggtgagaaatggggccctgtaaatagatttaagtacttatgtaaatatattagcgccctctccccatttaattaaccctaagccgactcactatacacacctggcttcaactggggatcctctgaatcctgaggttacaaacatgcaccaccatagctagctccaaacctcattttatctccacttttgcagacagctagtgaacggtacagcaggaactgtgccatttgtcaaggaaactgatga

SEQ ID NO: 33050 - DNA, 2145 bp, Mus musculus
gctcagccttcccctcgctgagcattggcatggactcctgcgtcatccccctgaggcacggaggcctgtcgctggtgcagaccaccgacttcttttaccccttggtggaagatccctatatgatggggcgcatagcttgtgccaatgtgctcagtgacctctatgccatgggtatcactgagtgtgacaacatgttgatgttactcagtgtgagccagagcatgagtgaaaaggaacgagagaaggtgacaccgctcatgatcaaaggctttcgtgacgctgcggaggagggaggcactgcagtgaccggtggacagacagtggtcaacccgtggattatcatcggtggcgttgccacggtggtgtgtcagcaaaatgaattcataatgcctgatagtgccgtggtaggagatgtgctggtattaaccaaacctttaggaacccaggttgctgccaatgcccaccaatggctggataatcctgagaaatggaataaaatcaagatggtggtttccagagaggaagtagagttagcctatcaggaagctatgttcaatatggctactctaaacaggactgctgctggcttgatgcacacttttaatgcccacgcagccacggatatcacaggctttggcatattaggacactctcagaacctggcaaaacagcaaaaaaatgaagtgtcctttgtcatacataatctgccaataattgccaagatggctgcgatcagcaaagccagtgggcgctttggcctcctccaaggaacgtcagctgaaacctctgggggattactgatttgtctgccaagagagcaggcggcccgcttttgttcggaaatcaaatcttccaagtacggagagggtcaccaagcttggatcgttggcatcgtggagaagggaaaccggacagcccggatcattgacaagcctcgcgttattgaagttctacctcggggagcctctgctgctgctgctgctgctcctgataattccaacgcagcctctgagcctagttcttgaaatggaatagcggttgttgggaactcggagccattctacccgctcagggactgctggccagggttgattttaagacctttccaaaggctgcttgcatggttcctccaggcccatccaaagcttcctgtatgtgcatccaggcctgtgagtaatggcgctgcggatgtgtgttcatctgttgagagcatgaggagcaaaaacccgtttcccaaagcaagaggaggctatttcagttttagggatttttttttttttttttttttgcactgagttgattcatttctgcacagggagtaaagattattaagattacatatgagaaaagtaaacctgcaacatgaaaaattatttggaccaatatattgataaatctaaattgttaggagaactcttactgatttattgtcaaatttgttattaatttttttctgagaaactgcctcttttcctgttctggacaagagttgagcagcttgtccgacaggaaaggaagactagccacctgacttggtctctgataatgatgtctctccctctaactcccagtaaggactgggagaggctgaacaaacctcagagccaggtgtcggtggccattgaatcttacactgaaacttctggagatttaattaataaagagaatttcttacagtaactaaataaaagggactttgttggaaaacttgtggctaatgtttggttctgtggatcactttcttgtttcagacaggttctccggtgccttgattttgcttctgcctccagtatgctgccaaaaccagctggaacgcggactctctttaccccttgacattacatctggaacttgcaaaatagaaagtagatgttgtccttgcccctgagtcaagggatttgggtttgcactgtcccttgagatgacaaaagaggacttggaatggatataaactctagggattttaaggtagacagaaaatggggaaaaaagtcataaaagatgacttaacagaatagaagagactgtctgaaggtgaggaggctaacaagaaagagctctgaaaggattcatcgaggtgaaggcagggagttggcgtgagaagagacgctggctaaaagcttatacacagaacaattatgtcct

SEQ ID NO: 33051 - DNA, 1204 bp, Mus musculus
gtgttgggattaaaggtatgagccaccactgcccagtgacaaatgagtttttaaaatgcaattaatttctgtttcccaggagacattccaaatgagacagagtggggctgcaaggaaggaggagagagaccggcagaggctcctgctcagttgcaacctaaagaggtggttgaacataagacttattccatggctaccaagtcctctgcaggggcacagccacctaccaaagctgccccagaccagatagcaggtgtgcagcttcctgtccaggtaccaaacaccgatattcaggccagccagcgacgtcatgtgtgtgtggactgtggacgccggtttacctatccatctttgctggtcagccaccggcgcatgcactctggtgagcgacccttcccctgcccagagtgtggtgtacgcttcaagaggaagttcgcagtgaaagcacaccaatggatccaccgttcctgctcagggggtcgccgcggccgaaggcctgggatcagggctgtgcctggagccccagtccgaggtgaccgggatccaccagtgctctttcggcactatccagacatttttgaggagtgtgggtgagttgaatggccgcctccgtctggaggtccggagcctggagttgaacatgaacttggcaactgagacaaatgagtcaagacttcttgaggatctcttgtaaacttgtaaaaaaaaatttgcctgtaaagattcatacagattaaacctgacacctcccctccccagtgttttgtgttaagaaaaaggcgggggagggctgggctggggatgtaagttggtacagtactgggttaggctggggatgtaagttggtacagtactgttttagtcagagttctcaagaggaacagagccgagaggatgactctgcacgctcacacatatggtatagaacaggtaaacggcaaaggaacaggcaagaggaagaaataacttttgacattgcctttttcttctggttcctaccaaaaggggctgcacacagtgaaggtcactgtgaaaataacttttatttctcttgtagtaaatgttgtttggaggcttgctgcctctgtgctaactgaggtctagtccaggatgcatctagcctctgtacaatctaatctagtcctagaatgttttcagcctctgagacttactgctgaataagctcaccctttctagctctttc

SEQ ID NO: 33052 - DNA, 1176 bp, Mus musculus
gggtgaaagaaaggcttgggctcaggccttggctggctcctgtctttatactcactcattaccttggtctctggatcagaaaacaccttgtcttttgaggctcttaactccttccccttcgttgaacccaacctgcagagatggtcaacagtcaggacaagggcatacacagcaatgcactcgtcttctgccagtgaatactaagcaagggaggcaaggctcaggctgaggccagagttccagagggggagtgagagcactacctgggttctgccggctcgcagaagaaggaagcaggggcattggctgagcaagatgtagtgagagaaggagagactcccactcctccaagagggaagacctctttccggagacagggtcgaggaggtggtggggtccgggccatctccccacaacccacagtatgtctccggggcctggactggcttggctgggatgggacaggaggccagctacctgggtcagggggccctagatcagggcaggagtagcttcgtcccagagatgacttagagacaggtgctagggaattgcactgagtccgccactggcggatagggggcctggggctgacagatgtaattttctcagtagccctggactgctcagcctccgagatggcaatcttcaattctaatttcatgggaggtgaagggggtggaggctgtggtgttttgttaggtgtgaagaagatatcagcaaagctttcaagctttgatcggacggaacggaagagaggggccaagccccagggactgagacggggtcgtaaaaggcttgacgatgttggaatcaccggggtctccagagcaggatctgcagttggagaaaggacgctcaggtgactaaaacattacctcagaagcctcagtttcttcctccaaacactaatctgtctctagaggagtgagcctgctcctaaaatgctgtaataggattgcctaatgccataagccctggatttgatccccagtactgcaaagcaaggccataactgctcaactccttgagcctaaatcccattgttacacagcctgctctgccaagggagccggctaagctccacccacagttctgctcctcctgtttcaagcttaaccgtggcagttccaaattcttcagtctcattcctctatttgagtccttacctggtac

SEQ ID NO: 33053 - DNA, 1487 bp, Mus musculus
aggggcaggggcaaagctccaccccctttccccataccttgtgacaaaagtcctagggctgaagtttttaagccagggttggaaggcaaaggtcacaatttcatggtcatctctgaagtcatggacctgggaatagaatccccagaccccccccccccacacacacacacatacacacacacacacacacacacacacacgcaagtatctcgtggactgtggggtcactgggaggacagaggtcactagcctctagagagaagtgtgtgcgtgtgcatgagggggttatttcagaggttatggctcatgacttaaggtgcaccaatgccccctctaagggcctctaggcccttggcctgcctccccaagggctcactaagccagaggccaaagtgcccccctccctttcgcctaccacccaagttctcatgccctccgagggctgaggaaggaggaactaaaggaataggggtttcatgtacatatttatcaccccttccacaaatcccccagaccttttgtacatttttacaggggtgcccctccctataattcccttcctggttaattaaatcctcagactggtgctgtgttcctagcctctggcctctctaacctctggtagggtgtcccagggaagagcctggagaggacaggcagggacccagggcttgaccctgggtatgtgggatccagaaggaggtagaccaacggggaaagggacctagactataagctggagggaagagcaataggacctggctgtcagcccaggcttctctagacttgttcctattaattctgtgtggcccacagctctaagaaggctcagcctttaagcttcagattccaccttttaatggctaagtccctaccaccaccccatttctaagtgccccccaggattcctgggccctgttccacagaaacctgtcccaaactaagggagggagaggtggccagagaaggccaccgtgaaacacacaccaaagaagggggttggttcaggggtgggcaacataggcagcttctttagcagcctcccagcagcagccccaggcttcccaaagcagcaggcacctccaggctgggccccaaatagaaggcagggctcagtttaacaaaaccataacgttgactttttccccagtggggcttattctgtaacatgacttgcgaatatttatataaaaatgagtgttacaatgagattaccccctaccctccggctcctctttgagtctgtgtgagttatccgtcatgggttgtactgggtcccagaatgaggaaagagtgaggacagtactgaccatgtcctgatcaagggtgccccccctacttccagatgggtgagttgtttaatgatgcgtgttggtgtttttcaaatacattcgattcaaataatgcagaaagacactgaaccgtctccaggggtagcatagccactatttggtgtgtgttctctttctgtttgttgtgtgttctct

SEQ ID NO: 33054 - DNA, 1153 bp, Mus musculus
tttttttttttttttttagaagtaccatatagatcagaaaccccttaaagatttttagttttttctgaatgaccaagccaaagtctggcataaaggtagtatccctaagtagttggctaagagatataaacaagtgaatatataggtgactgatatcttttgtgattatgttaggtggtacaattcaaacaacagtctcggcttgaagaaaaacgtaagaaagccttggacctgcacctggacttcattgtagggcaaactgagaagtactcagaccttctgtctcagagccttaaccagccaccggcctccagcaaagctggctcctccccttgccttggttcttcctcagcagcatccagtcctccacccccggtttctcgactggatgatgaaggtgtgtgtgctctttggtcctgttactcttccccaagtgccctttccagagctgaaaaacccaccctgtggcttgcagggcccgtggactttgtgaccttgttctcctgctatagatggggactttcaaccccaagaggaagaagaggaagatgatgaggagaccattgaggttgaagaacaacaggaaggcaatgatgcagagacccagaggcgtgagattgaacttcttcgacatgagggagaactgccactggaagagctgctccgttccctccctcctcagttattgggtgggccttttagcccctctcaaacaccttctcatgacagtgatacccaggatgggcctgaagaaaatattgaagaggagccatctcaggatttagaggtataaacagaaaaggtacaggaagaaagattcaaggggaaatagatgtaaagttttgctctcaaatcctgtgcataggttgatccatggttttaagaatctgggttaaggacagttggagtttcattgataggaattgatcatttgcaaaccaagttgaagcctgcaactggcaaggtttctaatataatggaaacatttattgtacttttaaaattcctagggggagggctggagagaagtagcttagttcattgcctcatctggctcataacacaaggtgtgtgcagtggtatgttacagtaatctcaacattaagagcttccttgtctagctaaatcagtgagctccgagttcattggagag

SEQ ID NO: 33055 - DNA, 1122 bp, Mus musculus
agtgaggatgaggaagatgaacattcagaggaagaaatgagtgggagttcacagtcggaagaatctgagtctgatgagtcggaggatgctcagtcccagagccaagcagatgaagaacaagatgatgagggagaggatgatgatgttgatgatgacgatgatgatggttttggagtagagtacttgcttgcccgggatgatgaaaggagtgaggttgatgggggcagtggacctcccacccccggtcctacgaccactctagggcccaagaaagaaattactgatattgctgcagcagctgaaagtctccagcccaagggttatactttggctactacccaggtacctacagattcatccttctcatatcttgacttattgtttcctgatagcaggtgtttcatttccaccatatgtgataatcccctttctattaggtgaagacacctattccgctactccttcggggccagctccgagagtaccaacacattggccttgactggctggttactatgtatgagaagaagctgaatggcattcttgcagatgagatgggactaggaaagacaatccagaccatctccttgcttgctcacttggcctgtgagaaaggtagatttcttttcttgggacctcatagccaattactggggggagcttgtttagtggtgatttcacctgcaggaaagtgaattactggtttatcttactgctgctgtctttgtagcctcattgattctagccagtatctacataaagaggacagcataggtgctgagatcttaagcattatcagaaagatgctagttagggttgtttaaccagagctccaaagtggaaacatagtctatgtgttttgtttgtttgctaaacaggtaactggggtccccatttaatcattgttccgaccagcgtgatgttgaattgggagatggaattgaaacgttggtgcccgagttttaaaatccttacttactatggagctcagaaagagagaaagctcaagcggcaggtttgatcttccatgtgatcgattcccttactgattccttcaatgttttagatcttttcctctcatgaatactttgcctcattttcctgttactcagttccattgct

SEQ ID NO: 33056 - DNA, 1105 bp, Mus musculus
tgtatgttgtttacaattattgtgtttcccttctctgtaaacagtaagttacatgagaggagagtttgtgtctgtgtgtaattaatatctgccatgccttacttttggtgaattaagccagtaactttgcctatcctggagccaagtcccatgtaggaggactctggggagcatagtgcccactctgttagcaccctaatcatttgcctttaggttctgcgaccttttttgctgcgccgagttaaggtggatgttgagaagcagatgcccaaaaagtatgagcatgttatccggtgccgactttccaagcggcaacgctgtctctatgatgacttcatggcacagactacgtaagagaggactgagggtggatcctggtactctgggttagaacctaggtagttgtcaatgtctctttcttacttttcctctgtcttcagaactaaggagacactagctacaggccattttatgagtgtcatcaacattctgatgcagttgcggaaagtctgcaatcatccaaatctatttgaccctcgacctgttacctccccgttcatcaccccaggcatctgctttagcaccgcctctctggttctaagggccactgaagttcatcctctccaggtatgtagttacccctaaggttagtggttttattatacaaactttctgtctccactctaaggcctgaccttttgtacattaactatttccctattttatcaactcagtactattttcatagctttattgttctttagtcatgtgacccttggcctaattattggcctaagcttccttctccatcaaagcaggaattataaagcctagtttacagtgtgcttgaaattgaagttaatacttttgaaaacaaaagtctggcgtacctataattatttggcaaatgttacttattccttccccgcactttttttttttttaagacagggtcttacagtggatccttggctggtttggaactcactatatagaccactctgtcatcaaacttagagagatttccctgcctctgcccctccactactgagatcaaatgcatgcacctccagacctggctctttcccacctttttaagaaagta

SEQ ID NO: 33057 - DNA, 1144 bp, Mus musculus
agccagtcaagatgaaggtcaacaggtacatgcttaaaggcataaggggatgggcttcttgaaataaatagagcaattagaatagagagacttgaaagttaggtcagtttatgaagcttccatcagagtgtgctgcagtacagggattgaggaagcaaaataactggagaattctgggaggtactcctgtgttgctggtgttttgttctctcttcttggtgctttctggttatctctgattccttgccccactttatccttaaggtggtggcttttctttcttctttttgcttgtatagattttctgtcttgccttaattttttttgttattttaaacctttgatttttcctcatagaatgctgcagccagtgcccaagcaagaaggccgtacagtggtggtggtgaacagcccacggcctccccttggccctgtcccagtccgtccccctccaggccccgaggtctcagcccagcctgctcttggtccagttcctccagtgttgccagcaccactcatggtgtcggcttcacctgccggaacaccagttgttcctgcatctcggccacctggacctgttctcttgtctcccttgcagccaaatactggtcctctcccccagggtaagttaaaaagaaaccaagtgtaatgggattacttctgggtatgaaatagtgacattgacatagttcaaggttagggagcatagtgttcaataggctagaaggaatggtaatatggagacttttcagcccagctaaggtgtttgtcgagatgtatctgacagatgtttatatctgcagtgttgccatcccccgtgggagtcatgagtgggacctcacggcctcccacaccaaccctgtcactgaagccagccccacctgccccagttcggctgagcccagctccacctccaggttcctccagcctcttgaagcccctcacagtgccaccaggctacactttatctcctgttgctgctaccaccacctcctccaccatagcaactgtcaccactacagcagtgccagctccgaattctacaccacaacgcctcatcttatctcctgaaatgcaggctcgtttgccttgtaagtcatcagggctatgtgatgagggtcctcatgctagagagctgtaggaa

SEQ ID NO: 33058 - DNA, 1154 bp, Mus musculus
tagtggtaaggtcatcaaggtaatacttgagggtgatgctgactctgcggtaagttactcatccagtgtgtttaagaccagagggagagggtgaagagatggtacagagcaaggagtagtgcttacctgtttggtgtctggccattagtgaatataaaaaagatgacagacaaatggcattggccacaaagctctcagtggcggttcactttgttgaacatgacagacaaatcatgggaaggatttagattcagaagtactttgtgggggtctgagatgtggttttgaacatgagccctgtgtatataaggctttctctgtttgtagctggagaagtggtcagcattggacagttggcttccttggcacaacgtccagtgactagtgctgggggaagcaaacctctcaccttccaaatccagggcaacaaactgactttgactggtgcccaggtgcgccagcttgctgtggggcagccccgcccgctgcaaagtaggtaaaacccaccccctgtcctgcctttttcttccttactctgtctttgtttgtgtgactctttttagctgtcagccttaatgtttcttagctttggtgggtagggccaaagggtatggttggaaggggtctttgctaaaaataggaagatgatttctagagctgttacttcctgcctattctctctcttgctcttgcctctgccttcaggctgataggtacttgtttctctcccccctccccacctacctctctctttctctctctttttctcttctcttctctcttctctctccccccctcccctctctcctcccttaacccagggaatgtggtgcacctggtgtcagcagggggtcagcaccacctcatcagccagcctgcccatgtggccctcgtccaggccgtggccccgacccctggccccacccctgtctctgtgctgccttcgacccccagcaccacccctgcccctactggcctcagccttccgcttgctgctaaccagggtgaggctcttggcctttgtatttactcagcccttacttgttggccttggtcctttcaggcatgccctgggcctactatgtgtctagccttccctcagtgttgtttctcttgccagtatctctagtatctgtctgcctcttttcctttcc

SEQ ID NO: 33059 - DNA, 1046 bp, Mus musculus
cgcttcctgttctggctgcatcacagactccgcttccagctatgactccaccatcaatgtcaggaactcctttaccctcatcatcattggtatcagctccaacttctgtgttggctccctcatcaactcaaactctggtgtcaaccccagtttcatcacctctctcaagcctggcttctactcagacattgaccctagccccaactttagcacccactcttggtggattgtctccgtctcagacacattctttgggaacagggagccctcaggggccctttccaattcagacattgtcattgactccagcatcatccctggtaccaacaccagcccagacactatctttagcaccaggaggaccagtaggtccaactcaaacattgtctctggctccagtaccccctctgcctccaagttctccagtgggcccagctccaggtcacacactgactttggctccagcagcatcatctgcttcactcctggtcccaacttcggtgcaaacacttaccttgagccctgctccagttcctgtgcccactctggatttatctgccacccagactttagcactggccccagccttaacacaggctccagcttcccaggcgtcttcccttgtttcagcatctggtgccgcttccttgcctgtcaccatggtaaaccggctacctgttcccaaggatgagcctgagacactgactctgcgctctggtcctcccagccctcttcccactgctacctcgttcagtgggccccggcctcgacgccaacccccgccaccacctcgttcccctttctatctggtaagttttacttccacaaaggaattgacagttgagttttcttgtagtgttgatagagtgactggaacaatttcaaagcttagtttactattggccagatcacatttgggtagactcctccctcatgggtgtgtattccaatatgtaaaatagaaatgttaatgtcttattttcttataggatgtttggctcaggttttggtgctagggattgtacccggcaccaaagaaaagagta

SEQ ID NO: 33060 - DNA, 2285 bp, Mus musculus
ttttttttttttttttggttttttgtttgtaaacctgtactccctgattttcatgtatttttttttccccttttttgagacagggtctctcactatgtagccctggttgtcctggatctcatagaaatccacctgcatcccctcccaaatactggattaaaggcatgtgccagcatatgtggctcagtgtctgctgttttgttttgttttgttttaattctatgtatttgtgcatgaaagtgcacattcacattccatggagctacttcaagaaactataagttagatgccctcagtttgagtgttacatatgaaaattgcctcaattgttggatatgtaggttttattttgaatattttgcactgtgctttaataagcatacaggaaagttagttttctcttgtagaggtgtcatttagcactgtgaaaacagttttagacatgataaagcacaaagttttgttgtaaactcttaagtacactaatttctttttttttcttctttaggactctctggaagaaaagcggaagcagcagcgatctgagcgcctggatcggattttccaacttagtgaggctcatggggctctggcacccgtgtatgggactgaagtcctggatttctgtaccttgccccaacctgttgccagccccattggtcctcgttctcctggccccagccaccccatcttttggacttacactgaggctgcccgtcgggctgtactgtttccccagcagcgactagagcagctgtcagaaatcattgagaggttggcagggctaagtgctgttggggagtgggtttgggggcttagttcttaggtctaatgaaggtgctaatttctatggtatttcagggtcatatcttttacaatgtttattttcttcttttcacaggttcatctttgtcatgcctcctgtggaggcacctcccccttccctgcatgcctgccacccacctccttggctggcccctcatcaggcagccttccaggagcaattggcctgtgagctctggcctcgagcccgtcctttgcaccgtattgtatgtaatatgcgtactcagttccctgacttgagactcatccagtatgattgtggtgagttcttgtctatttcaggaccctcagtacttgtttgatttggtttgagacagtcttgcgtatcctacgacctcctctgtttactgctggggctgaggatggccttggactcctctccaccaaattattcttgagtctttgtgtcaagatcattacatcaaagaaacgatgcttagaggcaacattttgggagcttttgtggaagtgatgtatatatgatgttaattgatttgtttatccagtggttgtcatgaacatctgtcattttgcttatcatttgggataataagtgaggcagcgtagtatagaatatggaagcacacctttaatctcagcagaggaaggcagatctctgagttcaaggccatgctggtttacaaaggttctaggacagcctgtactgcaatagagaaacattaaagatccaaaaacaaagcaactgggtctgaggtgcacatatgtaaactgtaatactcaggacaaagaggcaggaggattgctgcaagttcaagatcttctgcttatcattattattattatataatttttattgtttctgcttttttagaaacagggtctctttatggctctggcagtcttggaagcttttatgtctggctgggctgtagaccaggctggctttgaactcagaaatccctctgcctctgtctgtacactgaatttttgttcagcagttgagatgtaatatatgagagaaaatttctctaaaaaatacattatttgtgggaggggagagacctgggatggttaatacaggctcataatcccagcatttgagaagcacatttgtgcaagagggtaactttgaggccaaccttgtttacaaagtgggacctggtcttaaagaaaaaaaaagaaatttttcttgtgcatataatgtgtctattcatacatgaatatgcaagtctacttgcctgtgtatgagtttagaggccagaggtcaattatttttctctattactttcccatctattttctataatggattaaatttgttcctttaccatatcatgttgttatacagacaatttcatgatatatacataacacacacacctcatttcactctctctctcccccacctttatttttgatacggggtctcttagtaaacctggagctcactatttcagctagaatggctgaccctcagttcc

SEQ ID NO: 33061 - DNA, 2097 bp, Mus musculus
tgatctaccctgtggatacgggaacctaacctggctcctgtgaaagagcacttgtttcttgagtcccaaggtcaattctgtttgttctatgatgactagataaccttttaccatcctggtctgtcttttcctatggttgtaattgggccttaaattcctttctgtaaaccttgactatagatttattgataattctaatgtgaatctattctcatttcagctggcctgactggttagtacttttgagccttcttgcttataaacactaagaacacacattcctactctatcccctgatgatctgttgctctgtggcttcagccctaggttaaagaggaattaagtcccagataggaacatactataagaaagaacctttaagggtaaaaagtagggagtttaatggttttcattcgttagactagttgaaaccttgacctaagaccttcattcagctggagttgtcttgtgttactgtctgtctactgttgtgtacctcacctcagacgccttcatgcttgttttggttttttggttttgtttttgttttttttttctttcaggaaagttgcagacattggctgtgctgttacggcagctcaaggcggagggccaccgggtgctcatttttacccagatgacccgaatgctggatgtattagagcaatttctcacctaccatggccatctgtatttgcgtctagatgggtctactagagtggagcagagacaggtaacttgagaattcttagccctccagagactcacctcagcttttgtttcttttacgaagggaccttaaaaattaaaaagtcttttgtttgttttaggaataaatctccaaataccatcttttttccctttccttctaggccttgatggaacggttcaatgcggacaaacgcatattctgcttcatcctttcaactcgaagtgggggtgtgggtgtgaacctgacaggagcagacactgttgttttttatgacagcgactggaatcccaccatggatgctcaggcccaggatcgctgtcaccgaattggtcaaactcgggatgtccacatctataggtggtgcctaatgttcctcccctcccttccccttcctctatgtgtagggcatgcttggtatatttgtaggtttcacacctcacttctcatttcctaggcttatcagtgaacggacagtagaagagaacattctaaaaaaggccaatcagaagagaatgttgggagatatggccattgaaggaggcaacttcactacagcctattttaaacaggtaccaaataaaatccttctatctaaacagaaaagaacttttgttgttaaaagagttccctatttgctagacagctgctgcctttacttccacagatttttctgcattggtagttcctctcatacttcaaccctcaaagtttctggccttgaagtaatattccattggttgacctctcccctctgttatatctaatagcagaccatcagggaactgtttgatatgcctctggaggagccacctggctcatctgtgtcttctgttcctgaagatgaagaggaggctgtggccagcaaacaaactcatattttggagcaggtaacagaagaggtcactcataaaatagcactgctgctcaaatacatgttgtctttccttttcacttgagtttgtccaggagagagtacagttgctggtgatccccagattatagtcagtgttttgattcattttgatttttctttgttttttaagattataatgtgattacattatgtccccttccttttcctgcctccaagccttacttgttgtcattcaaattcatggactctcttttcattaattgttgttacatacatatacatgtaaaagtatatgtgtgtgtgtgtttgtatattgctacataagtgcaacctgttcagtccatacattgttactcaagtatgttttcaggggtaaccttttggtactagattaccaattagtgcattcttctcccccctgggaagactatttctcattctcacatcattccctagtgcttgttgtattttgtgtagggttgaagcctcgtggtctttcccctatatactt

SEQ ID NO: 33062 - DNA, 2287 bp, Mus musculus
tatgtatgccaggactccttttttttttttccccccccatctttcctggtgatatggtaatagtccctgagttctaggtccttatgtttatcaacttatattcttccctacagctgactcccattgagcgctatgccatgaagttcctagaagcttcattggaggaagtgagccgagaggagctcaaacaggcagaagtaagtcttcttatgtaggaagtaaggggaataagatagtgggaagctgttcatttccatcatgccttgctctgctcgctcttcctcttgctgacactattggccacgttgttggtaggaacaagtggaagctgcccgaaaagacctggaccaagccaaggaggaggtgttccgactaccccacgaggaagaggaaggaccaggggctggggatgagatgtcttgtggaagtagtggagccagccaccggcgcagcaagaaaatcagggctcctgagaggctggggactcgtgtcagtgaacgtcttcgtggagctcgggcagaaactcaaggagcaaaccacactcctgtcacatcctcccatcatacctgcaacacctttgtgcctccccaatgcagccctgtgagagaaagaattcccaggccagtgcctaggcctcgtcctcctcctcctcctcctgctcctcctcctcctcctgctcctcctgcttctccttctcctgctcctcctcctccgcctgctcctgcttctcctgctcctcctgctcctcctgcttctcctcctgctgcttctccttctcctgctcctctccctcctgctgcttctgttgcttctgctataacttctgccctagccacagctccaatacccatttcagccccaaatccagtaaccattcttcctgtccatatcttgcctactccacctctgcttcagcttcctcctagttcgtctcctgcttctaccccgccttctgcctgtacccctctacccacttgtacccccttacaagctcaaacctctgtattaacctcttcttcaccagccccacttgactccctttctgttcccatctctcctggggttaccaacctccccttggactcaggagaagtagggctgtgtgcacaagaattggcacctgtggagtctctagagctgcctggaatgaccaattctgaggcttccctggctagtcttgtgtctccaaaggatcttttgccagtggctgttgatatcctgcctgaatcagagaagactcttccttgtattcctgcacccagttcaaccctggaagctgagagcatccccaatggtcagcagcaggaggtgccaggtcctgtggaggggaccaataccacactgctacctggtagtgaggaattgaccatgagtctgaatgagagcaatgggctggagctcccaccctcagcagcatctgctgaaccacttgatgagcttttggagactcataggaactcgggagaaacaagagaggttcagatcccaatttccaactcagaaaagccacaagaacttgttagagctgaggttacagccccatcaacctcatcttcagccacctcctctcctgagggtcctttgcctgcccgtcctccacggcgtcgaaccagtgctgatgtagaaatcaggggtcaggggtctggccggacaggacagctcccaggtcccaaagtgcttcgaaagctgccaggaaggctagtaactgtggtggaggaaaaagaacttgtaaagcgacggcgacatcgggcacctgccagcaccctagtacctggggtatctgaagttagcgccagtccaagaagcccatcgatccacagtatgtcagggccagaatcctcacctcctagcagtgggccctgtgaagctgctcctacatcttcactgtctaccccaacccaatccaccttcatagcttgtcgtcacaatgaactggggacgactactgggggaagcccagagaatggagaaggaacagagcttgccatcactccacctgctgtgaaacgtcggagggggaggcctcccaagaagaacagatctccagcagatgctgggagaggggtagatgaggtaccttcatccatctctaaggggaaaaccaatggggttgacccagtccccggccctgaaacagtaactgttgcagaacctgacctcaggccccaatttgttcctgggccccagcctcctggaccccaaccagttcacagaccagaacccaccatcctatcgcctgtggagaaaagacggcgtgggcgtccccctaaagcaagggatttgccca

SEQ ID NO: 33063 - DNA, 1102 bp, Mus musculus
tcctgatgctacgcatgatcatggaaggccaatatcagtttacttcacctgagtgggatgatcgttcaaacaccgtcaaagacctggtgagtaggggccatgaaacaatactagggaagacccaagatgtgaccctcatgctataaagtttctctagatctccaagctgctgcaggtggatcctgaagcgcgcctgacagctgagcaagccctgcagcaccccttctttgagcgctgtgaaggcagccaaccttggaacctcacgcctcgccagcggttccgggtaagcccgagagtagcagggtctgtacccaggccttgtcctcttccctgtgctgggcgttttactggggctaatactgtccctttcccaggtggcagtgtggacaatactggctgccggacgagtggccttaagcagtcaccgtttacggccactaactaagaatgcactattgagagacccctatgcactgcggccagtacggcgcctcatcgacaactgtgccttccggctctatgggcactgggtaaagaagggtgagcagcagaaccgggcagccctcttccagcaccagcctcctaggctgttccccattgctgccactgaactcgaaggagactccggtgccatcacagaggatgaggctacactggtacggagctagggccgtatccctgggcaagccagaaagaaggactctccaggaggacatttttttttctatcattccaactgtttgggactcagaccttagccctgccttgccaagcctacaactgagaatgctgcttgtcacagaaaccagccctttacccctactactctggacttggagatcagggcagagatggaagggagcctcttcgagggttgtgcctggcctagctatcgccacctgcgctgcatctgaaataaaacctgccacaagcctgggagagccagtgccatgtctgctgtctagtttcacagggaaacccagaaggtgctcgtgaaggtgggggatgggacactgtggcccaggtctttattggggaagatgctgggatcacttggtcttggtcttgcctttgctgggaggtgtctggaacggctgctcca

SEQ ID NO: 33064 - DNA, 1220 bp, Mus musculus
ttccctgagcatctctttctgccttgatgctgtatttcaatgtgtgtgaaatccctttgtgttttgcctctttgtattggaggctaggtcttgtgatgtggtcaggctggcctcagacttgtgtagctgagagtgactgagactgatcctgccatacttgccttctaagtggtgaaactctaggctttgcaccaccttacctagcttcaaatcaaacgttttcttactaaacttcagttctttctcttatgagggaataataaagattccgtggaaatgaggttctatgtgaggaatagacagtgcttacgttggtagttagttggtagttacattggtagttacgttggtagttagtagatagtcctgtgcagggctgacctcctattcccccaagagcccttagaaaacgcattgctttggaagtttataggagcttgggtggggtgcgtgctggacgactggggaaaatactgcccatcctggtcttgcctaccacagccccttccacttcctagtttgagatgttgaatgcagagctggaagaaaatcaggaattggccaatagccgaatggcagagctggagaagctgcaggcggagcttcagggagccgttcggaccaatgagcgtctcaaggtcggctgtggttaggactggaagggctaggactaacctcagatcgatcctgctgctaacacaacccttctggacatttcaccgccaggtggccctgcgtagccttcctgaggaggtcgttcgtgagacaggggagtaccgcatgctgcaggcacagttctccctgctctacaatgagtctttgcaagtgaagacccagctcgatgaggcccgggggttgctgctggcctccaagaactcccacttgagacacattgaacatatggaggtatggtcttggaggagggctggaaatgagactagatctttagacttgagacattcctcagcttccaaggggtcttgtggacctgctgagagtcccttgggcatagattgttccttggccagaggtgagactaggggatatatctatttttcttttttttttttttttaatggtttttcgaaacagggtttctctgtggctgtcctggaactcactctgtagaccaggctggcctcgaactcagaaatctgcctgcctctgccttccgagtgctgggtttaaaggcgtgcgccatcacgcccggcttttctatt

SEQ ID NO: 33065 - DNA, 1164 bp, Mus musculus
agcaactctaattttgaaaacttggctctgagcctgtatcctcgttcatgcagtgctggttcccaccttcagaagttatgttcagaattagaggcctcaaccatttggtggccttagcctggagtctggggacagtcagacttgctccagacttactgtgtccgtttggtctaggcccggttgacctgcccctgctgtaacacccgcaagaaggatgccgtgcttaccaagtgcttccacgttttctgctttgaatgtgtgcggggccgctatgaggcccgccagaggaaatgtcccaagtgcaacgcagcctttggtgcccacgacttccaccgtgtgtacatcagctgaacctgaaactcaggggactttgaacacccgaggggctgtgccccagctccccactcccccaggggcaatggccccaacctccctttcagactccatgagcccagcccctatgtgcctagatggtttggggctactggtgcgtgcaggagaggtggggtcacccaagctgagtgccatcttttcctgaatgtcagatctgcagcctcggggactcccaggtacacagcatcctactgtaaccttggaagctgaccaaaacctgtttctactgagaagacagatacatccttacccctagaagggaattcctccaccaggaaagggctcaccacccatctgcacaagctcagtgctgaccagggacctgggcttcacattgggtcctggcccgaggagccttgcttcacttacttagccccaggcctgggcagggatttggccttccagtggagtttcctgtaccctggtgtagcttttgtgttgaagacactcttgggtgtgcaccctattcaggtcagggacactgccacctcatggtctgattcaggggcatttttttttttagccagactctttccaatctcctcctttcctcccaagtccactttaccctttctcacgcatcctggtggtcccttgggtacctggccctagccctgctttctttcatcctggtgatcttaattgtggaggtgcaacttgccaggagggaagaaacaatctagcacttgcaggcattccaggtagaagagctttgcccgtgctccagctagcctacactgatcctgcctaagcagggtcctgaacgccgga

SEQ ID NO: 33066 - DNA, 1233 bp, Mus musculus
gcgtgggagagctggtcccagcaacttgtctgctgtttgaggcagagatgatgatgatggcagggcctcatcatggccctgatggaggagagatgcccccttctcccatccctcctcgtccctagtcacctatgacaggtaggaaaactggacctgtccctcaccaggaacagcactcaggagagtaggcctacaacttgtctgggcagcacagtagccatggtcctgatggcatgagcaccagcggtgagccacccggtaggcatgagaccatgagaacctgagagctggctgtggcattggacaacctagccaggcagcgctggagaccctgccctggtagtgtgggagcagaaaagctggcaggctgaccagcccggacacctctcaggcccagatgcagggctttgagttggcccaccccaacatctaccccattgatgaacagctggagggcatgggccagtcctacagatctaaaactacaggatctccataacaccggcaacgacaggatatccaggaggaatctcagtgaagtcccaggaatgatagagtagcagaagtcaggtaggtgccttgcaacagaccaatgactcattgcagtggacatttgcaagtagagaagtgtgctgtgggacacactgtgacacactacagcttccacagtgaggtttttttttgttttttgtttttcttttagggagaggttgtaagggtggagagtggatactgggggttttgggctcatgatgtgaaagtcacaaagcaccaataagaaattaaaaacaaaacaacattttataagcacaattaatacaagatgatactttataaaaaaatcagaaaaatttgagacatggcaaagggaatcattaaaaagaacaaaacaaaacaataaggggctggagagatggctcagcagttaagagcactgattgctcttcagaggttctgagttcaattccaagcaaccacatggtggctcacaaccatctgtaatgggatctgatgccctctgctggtgtgtctgaagacagtatacccacatacatgaaataaagaaataagtctaaaaaaatacagtaagaaaaaaaaggaataaaagaaggtaaaaatataaaaacacgtgcctgtaggcctagcatttattagacgaaaagagaagtattaagaattcaagggtagtgccgggcatggtggtgcaagcctttaatcccagcacttgggagg

SEQ ID NO: 33067 - DNA, 1218 bp, Mus musculus
gcttcattctaccacttggagctcctcgcccgcctgaactatcaaaatcccgcactcgatgatgcaaagccagacgggaattgtagtcttcctcgctcccctctttatcttctgtcgagacaatggaagtgagcggggcggggactaccacaaagatggagggtgaaggagcacatgatgctatgggatttgtagtccaaccgctaatactattctcggcggatgtgtaggagaggactactacagagatggcaacctagtcgcttgcccctcggtgccggtacctggtgggttatgtagtctctgctttagttgtacagagaaaggacgctactgttgaaatatgtatcaccgtgaacacgccaaattgctagcggacggaaacggaaagtctctttgctcttggcctccttttctaaagggcttgcagggaaatgtagtcccaagttttcattctccagtggcggagaattgatgtcacctgtgggaatcagtgcgggagagagaaacatcggagtgacctgggaatatagaatgtccgccttttcggatcgtgaagatttcatattttaaaagaacgcaaaccataaccaatattgtcgcgacaagggaggcgtggttctctccgaaaagtatacccacgctgttgttccttataaagactggacgtctcgcacacgatgcttcctatcttaaacctttgcaaattaataccttacacgtggtgcgaaccaaaggaagacgaccttggaatatacaaaatctcctttccaccgtaggaagtcatcagacctaagtttcttacccgaaaggggttatgattaatactcacctccacgctgaattagcgttaaaagtattcaagaaagtaaccagttctggcacggggcgtgtggctgcagttattttttcgagctccctttcagcccagccgttttggaagcccaggaatccatcatgccggacagttagcttctgcgaaaagaaaattgacgagtaggctacccccatcttaacccccacccctccctcttcagtcctcatctgagtcttccaaccatctctacccagcactcttcccagggggcgccctctctccttttaacagaggacgcacacactgaccaaattttctcaacctgaattgtagcctttggagctgtgaagcctcatgccttgtcttttgagccttggaggcttccggtgaactctcagttg

SEQ ID NO: 33068 - DNA, 1157 bp, Mus musculus
agtcacattgtctggagacttctgcctttaccctaggcctaaagcagctgtgaccttatatgttccaccgacctttcctactgggctcactgtgggcttccagattcacccttggacggccccctgaacaaccttagaattacccccagacttgttacttctttaacttgtctgagcgttgtcatttacctgtggtctcttccactccaagccagtcccgagtcctgtgctaatgataataatgacagtagccgtgtctcagcccctcatgtgttgtcttgttcttaaccatggtcctgtaaaggaaaggtctgtcaccccatcttagcgacagaggagtggtgaggttaaatccatcgccgaaggccatcctggcaaattaagtatctggcctatgggttctgacctccttcatcctatagctgatgtggaagagcctttaccctccagcttggatttgaggtccctgacggcccctctttcccaacagcccgtgctcccacacacagctgtgtgcctcttgtgcggggaggctggaaaggaggatacagtggagggagaagacgagaagtttagtttgagcctcatggagtgtacaatctgcaacgagatcgtccaccctggctgcctgaaggtgataatcctgggaaccaaccctgcaacctggctggggtagactgtcggggagcaaggaagtaggccacactgtcccagggcatatcctggcaccttctattcattatttggtctcttgcctacagatgggaaaggctgagggtgttatcaattccgagatacccaactgctgggagtgcccccgatgtacccaggaaggacggacaagcaaggtaaagcaggggctaagatagggacagggtggaagatccggaactagctgggggcctcatccccagcttacactttccaggatgcaggtgagggtccagggcgccgcagggctgacaatggtgaggaaggcgctaacctagggggtggatggaagctgacagaggaaccaccacctccaccacccctgcccagaagaaagggacccttacctgctggccctacccctgacgatgtgcctgggccccccaaacggaaggagagggagggggggaatgagccccccaccccaaggaaaaaggtgaggagca

SEQ ID NO: 33069 - DNA, 1383 bp, Mus musculus
gtccatcccctctggggagtgggtcaagaggtactggggaggtgctgagccaaagggatggtgggagggaggggcggtgaaggtgcaagtctggagtagggaaaatgaggtgacatggtatcttgtacacaggatactgggggctgggggaggcgatggatgggtgtggggagggcagaaatcagaccaacaagggttcagggaacaaagaccagttgggtgggatggggggccaaaaagggaaaacagaggagcaattggggatccgagtgtcaagacagggggcgctacaagccaggtaatgccaggactgggggctgggagaggagcagatgtggggatagtaccctctgcgtagggttgcctctctccccttccctctacccagatttcagttttccccgaccttgactccttgaacgtcactgaaaatggcagctattgcaaggagtaggggccgcgggtctacctgctgttaagctcggtggcccaggggagtggtgaggggtagcccagacccctgcctggctctctacacaatacttgaacattcatctgtactgaagtgttacttgaaccgggggaatctcggacttgggggagtgtgatgtgaggggaccagcttgaccgagactgggctatgggtacccagtttggactgtcccacccctagctctcttgcattactgtcttgaacagctccacccttcacttgagttggggtggggaaatgtcagcttaaagatgggcaagatgggactcctccagtttggctcttcccattctttcatcgtcatggaaactcgtgtcccatttgcccagggaactgccactcctggttgccatggaaatagcagccaatggacacctccggaaatcagtgctaagactggaaacggtccctcttagttgctgtgggaacttagtaacagactcttggcacctcccctcttcccacccctttccttcttccagtgtgggggtggggtctcaagagcctgagggaggagtcaggtctaggtcccactcaacttaggccagggggaactggattgtactacatgggggtggggggaggggaatctatccacatacctcaggtaacaggaaggtgcgcgggttgggggcgggggctgggcggaccaaaggcaggagggggggcctggggttggagaaaggcttgacggtggggccgcttgcgggaggggaggaggcaccccggcgagggacaagtggggcacccagccgggctggacccctaaccccacaagtctgtacaataaggtttgctataaaactcagaatctagccggggccgctgactttttgtgtctgtctgcggtgtcgagtctgagtggtgggtagggatggtggaaggggctc

SEQ ID NO: 33070 - DNA, 1099 bp, Mus musculus
agcggctccccaataccctgtctctacatctttgctaccactgtgttatatttatatttatatctggcttatctttttttttttttgaaacaagtactccctaggtagccgctggccttgaactaagaatcctgtgcttcagcctcccatgtgctagcattgtaagagtgcacggcacactcggctctgtcttgtctcttttctgaatgggaacttttcctttttttctgtttctagtaattagcttatgctagtctgtaaccctgaactaatagattactttcttctattactttgtcctatgtatgttaattcttgttttgtgtgttttcttcccagttgttgctatatgtcataagagggcttgaaaaacaggtcactgctaatgtacctctcatgagcccccttgacgtctctgtcccagatttgtcttaatctcatagatgtctctgaagtttcccaaatggtaaggaaactgctcactatggaagcccgagaccaattcttgtctttccacagctggatgagttctatattggacagataccactgaaggaagtaacttttgcgaggctcaatgacaatgtgagggaaaccttcctgaaggatatgtgccggaaatatggagaggtggaagaagtggagatccttcttcatccccgcactcgaaagcacctaggcctggcccgtgtgctcttcaccagcactcggggcgccaaggaaactgtcaaaaacctccacctcacctctgtcatgggcaacatcattcatgcccagcttgatatcaaaggtgaggactcgctgcatgttgcctaaagttggtttctaacagggattctatatgctgatacttaattgggctcagccaagtaatcagggtcatgattaccaaaattcctgaagtcacgtctgtttcagaacttattagattttaaattttagagatacattttgagattcatttagatatttgtgtgtgtgtgtctgttttgcctgaatatatatctgtgaacagcatgtacgtcttacactcatggaagtcaaaagaaggcatcagattcccctggaactggtttaatggttgggagccaccatgtgg

SEQ ID NO: 33071 - DNA, 1163 bp, Mus musculus
ccttgtcttaatcagtcaataaaaatagaaagagggctggtgagatggctcagtgggtaagagcacccgactgctcttccagactgctcttccgaaggtccagagttcaaataccagcaaccacatggtggctcacaaccatctgtagcaagatctgactccctcttctggagtgtctgaagacagctacagtgtacttacatataaataaattaaaaaaaaaaatagaatatagacagccaggcagtggtggcgcacgcctttaatcccagcacttgggaggcagaggcaggcggatttctgagttcgaggccagcctggtctacagagtgagttccaggacagcacagagaaaccctgtctcaaaaaaacaaaaaagggagagagagagagattgtagtagacttgagacctgaagaagaaacaaaatgaccaattcagagggttgtgtttccttctgattgtggattctcatttctctccatctaggccaacaacgaatgaagtactatgaattgattgtcaatggctcttacactcctcagactgtgcccactgggggcaaggccttgagtgagaagttccagggttctggtgcagccgctgagacggtgagaagcttgtagctgccgctgtgttaggcacatgtactcgttacctggtcaccaaagcaagagccatttgggaaggccctgaagtcccctattaagtataggaagaactaagggaagatgtttaggtgtcttcagatacaaagctgcaatctcggattggggcagtagacagttttaaatcgtgcctgatcttttttccttgactccctttttctttagactgaagcccgccgacggtcttcctcggacacagctgcctatccagcaggcactactgtggggggcacccctggcaatggcactccctgctcccaagatacaaatttctccagcagccgacaagatactccatcttcctttggccagttcacccctcagtcctcccaaggaaccccctacacatctcggggtagcaccccctactctcaggactctgcctactccagcaggtatggaaaaccacttctctcgggccttagccatttgattctgggagctgcagctggaaagaacaagctccaagtgtctgtgagaaggaattggaagcta

SEQ ID NO: 33072 - DNA, 1097 bp, Mus musculus
ctgcctcctgagtgctaggattaaaggcatactttcaaggcatgtactgtttatcccagaattctttctattttctacagaacttcagtggtctaggccaactgattgccagtctccaggtctacctatatctgtctgtcctggaactctttctgtagaccgggccttcatctctatttctgtgtggtagaacatctccttcttgggtttagcatttaggcggggatcttcccaacttgttcttccagcagagcccagggctttccttccttcactctgatgttgtcactctgagcatgcacttgcttatttaacttcttgagctttcagcacctggcctagagcctcacatccagaggacttcgtcagtgctccctcctcttgaccactaactaccattgtggatttccaggtgaggatgaggacagtgactcgtcctcccagtgctctctgtatgcggattcagatggtgaaaatggcagcacatcagactccgagagtggcagctcgtcttcctcttcctcatcgtcttcctcctcttcctcctcttcctcatcagagtcctcctctgaggaagaggagcagtcagcagtcattccctcagcttcaccccccagagaagttccagagccccttccagctcctgatgagaagcctgagacagacgggcttgtagattcccctgtcatgcctctctctgaaaaggagacattgcccacacagcctgcaggtaggtggcatgggacaggtgacatgattaagatacatgtttatcagggtcttggagaatggccttggggtgctgtgtttatgtggaacagttacatgggcacagagtaacactaacgcatgactgagctcttgtgcccttgtcaagctcttgtcattcaatagttcttgttatcatatatgcatatgatgggcctcctgtagggattatttattcatacagtagggtttatcgagcattgctactggtaccaggagcagtgtgaagatgtgatgatgtgtctgacaggcactgctctcatcctcacaaagctttcggtctgtaaggagagaaaggccagttaagcaataaatgcatagaaataact

SEQ ID NO: 33073 - DNA, 1880 bp, Mus musculus
ctgctctgagtttcccatgtctgacatggacatactccattgtcagctggaataatgaacaggtacagagcccgttctgttgagggagatgacggtgctgagagtgataggagcaggagcgaggcagacagcagcccctgtgtaacacgcaggcttgtgcatatggaagcacgagtgttctaaatggaagctgaggcaggacagggtagaacttgataaaataaggctgccttgctccaggagagttgagcccacgtctcctaccttgacagttctgtctgatgaggttaaccctctggtctttgcccatgtgtttccattcccaggccctgctgaagaaccacctcctagtgtaccacagcctccagcagagccacccgccggaccgccagacgctgccccccgcctggatgagcgcccctcttctcctatccctctcctacccccacccaagaaacgccggaaaactgtttccttctctgctgcagaggaggcaccagtcccagaaccttccacagctgccccactgcaggccaagtcttctggtccagtctctcgaaaagtcccccgggtcgtagagcggaccattcgtaacctccccctggaccatgcgtctctggtcaagagttggcctgaggaggtcgcccgagggggtcggaatcgagctggaggtcgtgtgcgctctactgaagaagaggaggccactgagtcagggacagaagtagacctggcagtactggctgacctggccctgaccccagcccgacgtgggttggctaccctacccactggtgacgactcagaggccacagagacctcagatgaggctgagcgcccaagccctctactcagccacatcctcttggaacacaactatgccctagccatcaagcccccgcctaccacaccagcacctcggcccctggagccagctcctgcccttgctgcactcttcagctctccagctgatgaagtcttagaggcccctgaggtggtggtggctgaggcagaggagccaaagcaacagctgcagcagcagcatccagagcaggaaggagaagaggaggaggaagatgaagaggaggagtccgagtcttcagaaagcagcagcagcagcagcagtgatgaggaaggggcaatcaggaggcgtagcctccgctcccacactcgaagaagaaggccaccactcccacccccacccccacctcctccttcctttgagccgagaagtgaatttgagcagatgaccatcttgtatgatatttggaactcaggccttgacttggaagacatgagctatttgcgactcacatatgaacggctgctgcagcaaaccagtggcgctgactggcttaatgacacccactgggtccagcacacaaatatcctaagccacagagcccatctgatttgaaccctagagtaagacacagggctggggccttccctggagtggtgtggcaagaaatgttatcctcaggtcactcttagggctgcactggtttcctatctgtctaaattactgtgacttacttagccttggggttctccaactgccaactgtctttcctctctgccttgtgtctcttctgatagagcaggtaaggtctagatttgccttctcctgtctgtctccttactgagtattctcaccatcagacaagctaccctgtggacagggcctgggttggacaggaggtgtgggccccaagagacttgccaatgaggaatctgttcttttccttaatgccatgcactcaccaacctaagcactccaaagcgcaaaagacggccccaagatgggccccgggagcatcagacaggctctgcacgcagcgaaggttattaccccattagcaagaaggagaaagataaatact

SEQ ID NO: 33074 - DNA, 1151 bp, Mus musculus
ctgttttctctcccctctttttcctcatgtcccacaccccaacggtcccttcatttgtctgtctacctctctccctgtccctctctttccctcttcctctcctctctctctctctctctctctctctctctctcatctttctacctgcagaagaaaattatgatcatcatttgctgtgtggtgctgggggtggtcttggcgtcatccattggggggacactgggcttgtaggcccctacccttctcttccctaggaccctccccacacatcgggagcaataccccccgaccctttcaccttttccctgctccaagctcactcccaaaacagacccaggcagttccagccactctcaccctcatgcagaccctggagtccctggctctcaccttgccgcacatagatagcagcaggcgtgatcacacatgcacaccaacatgcatgccgagggcacatgctcaagacgtgtggacaccccagcgtgtgtgtacttgtgtagatgtatgtagatgccccgaccctcttgctgccaccttcatcctgtgtggtctgaacttccctctctatctggctgctgtgctgactgtagcagcccaccatggcccaacctgtcctgtgtgaatagacatggatagtgtgtgtgtgtgtgtgtgtgtgtgtgtgtgtgtgtgtagatctgtgcccatacagtgtatgtacattgaattttgtgagtgtgaaaacccaatgcaaaagcaattcctccactgaccttctctcctgtctgctacatctggagtgggaggagaattcacatcctcggaggatccagagaggcccagcgaccatgctgcacatcttatgtgatgtagaacaaactctcctgacttgcttactgccaggggtcggtcgcatcatgtcctggggactctctctctctctctcaatctctctcccaatctctctctctctctctgtgtgtgtgtgtgtgtgtgtgtgtgtgtgtgtgtgtgtgttgggtcttggagttcaggggaagcacgtggaagcctatgtgtgtaaattataaacagcctggcttagtttggatgaatgtgaattttccttaacaaatgatgtaaagggcttctgcacgaggtgtgtgtgtgtgcgtgtgtgtgtgtgcgtgtgt

SEQ ID NO: 33075 - DNA, 1193 bp, Mus musculus
ttcccagggacactctgaacagatgagattgttcagatctcagaaaacgcctttagctgactcctttaagggacactggcatctaggacactggtctacaaggtatccagtgctggctctgagtgttggtgaccttgccatccctcttgatgaggacccttcccaagatccctcctctgagtctagaactgataccgtccatgttatgtgcgctgggtggagggacagaaaggtagagtcaaccttgagacgcagggtagggactgctcatggatctggccttgctttgcttccaggcgaaagacagtgatgatgaagaggaggtggtccacgtggatcgagaccactttatggatgagttcttcgagcaggtagagcgcccgggtagccctggcccagaaccttgtcccttcccctagctttctttgccttgtgtattccctcgtccctgcacactccttggccttcacggtttggccgatttcactgaacgctggctaggtctcatctggccctccagcctggataaggtgtcactgatttcctgccccaggtggaagagatccgaggctgcatcgagaaactgtctgaggatgtggagcaagtgaagaaacagcacagcgccattcttgccgcccccaaccccgatgagagtgagtgctgccttgtggggcccagggcctagggccccacccctgttctcacctcccaatttgccttctcccccagagactaaacaggagttggaggacctcacggcagacatcaaaaagacggcaaacaaggtccggtccaagttgaaaggtgaggaccgcagttccgccactgcaaacagctctctgccccacattagatcagagaaaccgggacactggggggtcagagtcctaaacattgagaaatgtacaagcccacttttgcccacgtcctttggaaacacttgacagggaaatgagccaggcagtgtttccgcctgaattgcacctgagagccatcaatcagaaaaatacagatttccagccagtgacggtggggaggtcccgtaatcccagcaccgggaggctgccacaggaagagtgagagttccggatgcgtgtgggctgtgtagtgagactctgtttcaaagaatccaggaaggaaaggggaaaggctgagaggaactcgcttttccaagaggttttaattttgatcag

SEQ ID NO: 33076 - DNA, 1201 bp, Mus musculus
cgtaaagccttaccgctgcgagaaatgtggcaaggacttccggcagcccgccgacctggccatgcatcggcgagtacacaccggcgaccgacccttcaagtgcctgcagtgtgacaagacttttgtggcttcctgggacctcaagcggcatgcgttggtgcactcaggacagcggccattccgctgtgaggagtgtgggcgagcatttgctgagcgagctagcctcacgaagcacagccgcatgcactctggggagcgtcctttccactgtaatgcctgtgggaaatcctttgtggtgttatccagcctcaggaagcatgagcgtacccacagaagcaacgagactacaggagctgccccccagcaggagttggtgctgggactggcactgcctgtaggtgtcgtaggtgagggctcggccgcccccgtggcgggtgcaggggtaggggatgctccagcggggctgttagggttaccccctgagtctggtggtgtagtggccacacagtggcaagtggtgggtatgactgtggaacatgtggagtgccaggatgctggcgttggggaagcgcctagtaccctgggagatgcaggagaggtggggggtgaggagactgatgagaagcccccacagtttgtgtgtcgcgagtgcaaagaaactttctccacactgacactgctacgcaggcacgagcgctcacacccggagctccggccctttccctgcactcagtgtggtaagagcttctcagacagggctgggcttcgaaagcatagccgcacccacagctctgtccgcccctactcctgttcccaatgtcctaaagctttcctgagtgccagtgacctgcgcaagcatgaacgcacccaccccgtgcccatcgggacccccatacccctggaacctcttgtggctttgctaggaatgccagaagaagggtcagcttgacgtctatagatctccactacactccagaagcccatccctagtctccaaagccctgcctctgggcaactcgctcaactcttgtccactattagctgtgggcagtggaggcagatagcacttctgagggagactcattaaagcattggctttgctaccaagctgtcttctgtattgtggttcagtttaccttcagtggaaatctgggactagcatgcagtggaagggccttggtgacagacaggctctcacagc

SEQ ID NO: 33077 - DNA, 1099 bp, Mus musculus
ttcggctccccagggatctgctggaacatcagcagtcccatgaggggctaaagcaggaacaaccatgggaagacaaagagatgcctaccacaaatggacacgcagatgagaggagttggggtcagctatctaaaacagggatgttgaatggttctggggagctcagctcttctggacagctagaagatggcggctcagaggaatatcgacctttctgttgtggagactgtggccgtacctaccgtcatgcaggtagtctcatcaaccatcgaaaaagccaccaaacaggtatctacccctgttccatttgttccaagcagctattcaatgcagctgctctgaaaaaccatattcgtgctcatcatagaccccggcaaggagctggggaaggtggtcagtcatcagtgtcctcaactgctcttacgtcagccgagaatactccaaaagtggacgaggtccccactgccagcctggaccatcgtccctataagtgtaatgagtgtggtcgggcttaccgccacagagggagcctggtgaaccaccgccacagccaccggacaggagagtaccagtgttcactttgtcctcgaaaataccccaaccttatggctctgcgcaaccatgtgcgggtacattgcaaggctacacgccgaagtacagatccagggactgaaggttcacccagccctgtcaagaaagaacaacatgatccagtgggaatggaagcagcattccacggagatgaggaacatgcatgcaaacgtgaagaagaggccaccagtaacccctcaatggcagataggacagtgccacaggtgtgtagcatttgtggaatgttgtttgaagatctcaaaagtctcgaacatcatagcgtgacccacagggaaggagaaaaaagcaggacagacagcacggtgtcaccaactagaacatttgcttgccaagactgtggcaagagctatcgccactcaggcagccttattaaccataggcagacccatcagacaggagacttcagttgtggggcctgtgccaagcatttccataccatggctgcgatgaaaagccatttacggcgtcacagtcggcagtggaacag

SEQ ID NO: 33078 - DNA, 1103 bp, Mus musculus
ctttcttcttctttctttctttctttcttcttcttttttttttttttttttttttttttgtcgcgagaccctcggcggaagacttgtggtccggtgctggcctcgccctgctcgctgggtcccttgggaaggggcggggccacctcttcccgcctccgtggccgcgcagcgggagcggaagctcctggctggcctgcgtgtccgtgggattgggaggaccgccaggggatgaccaacggagtcagggaccccggcctgagtttcccacttcagagttgagttttcctaaggccggaaggaaatcagaggagtcgctctccgaggccacaccctctcgctgtcagttttgtcccagtgcgggggtagagcttgggtttcctgcagggagctgctgagctacagcttcccagattgttgaaagtgctgtctgctttgggtgcgcatggtaggcgggagctcagttatttggagccacacgtcgggaaccttgggagcaccatgccatttgggggttggagagtcccattcttctagctgcttccttgggcttgaactcaactgtgtaatagcgctgactgtcaaagttaatcttgacatccggtgataccacctttcctgtatacagagctgctgtgaagatataaaatgtggtgacgtgtgttgcaggccttggaaagacctgcaacaagtcaaaaggatttttaaacttaagggatgatctgtattttgagtttttttttttttttttttttttttttaaagattgagccaggtttggtggcacacacctttagtttcaggactaagaggtagaagtaggcagatctatgtgagttcgaggtggtctacatattgaattctgggatagatacataatcgagacttctgtctcaaaaaagaaaaaaggcaaaaaggacatgatgttggattttttttttttgttgttgttgttttttttcgagacagggtttctctgtgtagccctggctgtcctgaaactcactctgtagatcaggctgacctcgaactcagaaatccatctgcctctgcctcccaagtgctgggattaaaggcgtgcgccaccacgcccggtccgatgtggg

SEQ ID NO: 33079 - DNA, 1147 bp, Mus musculus
cttctcacagtgtagaaggggtgaccccgggggtgaagggtgatttaaaaacagctcagtagttaggatagggcttagctgagtttgtcttgctctaaggggaaattgcctttggttatgactttttatggaatggggttgggtctgcttgctgctttcaaagcaaaaaccacaaaacaaaacaatgaaaaatcacgtgttcagggctatctcagggcctggtgtgaaatgtcttctgggaaatttggggtagatcttttaaaccaactgctgggttgtccaccacttgctacaagaggaaaaaacatctacgtcagaagaacaaccaaggaaaatgagctttttttttccagaggatatagataaaactttttaaagtaaaatccttaactgtgtctgagaaattgcacacgtgtgtgtgataagctcaaaggtcagacaagggtggtcaggaaggggtatattttagtagcctcttgaatctttttcccaaaacaacaatccatgtttggggaatattaaaaaaaaaacccaaaaaaaaccaaaaaacaaaaaaccaacccttttgtagccgttggaagcttcatgtcctttcttctaacttgtcttctccagcggaagtgaccgcggtggcttcaataaatttggtggtaagtgaacagagtttccaaaattcccaactcccagcaatgctttgtctgattgttcatttgcagatgtcttagcgtgttaagtgtcaaaggtttctaaagtgtctgtagccacctccagaaggggtggggtagaatgcctcctgctgccagatgtgtgctaactggaggccagcagggataagctcttggcagtctgctatgttactaaattggttttacacaagttaatagtattatttagtaggcctcttggtgggtgttgccacatctagcacttagtgaccacaccatcctgggcaactgggggatgttctggaacatgtggtgccaacttggctttaggatccttttgatcagtgtgtccaaggtgtgtgtgtgtgtgtgcgtgtgtgtatgtatacacaatctcccaaatgttttaatttagggagagggacatgaaatagtgccctgccctgaagatggtaaagttggtgtatatatatttatattaa

SEQ ID NO: 33080 - DNA, 1294 bp, Mus musculus
ccaggaggctctcatatgggtaagaagggagcagagctggaactgagagctccagaaagagccccacacttgagatttgcaaaggtcacgggagggaaggtagaagaattgaagatgataacatgactttttttctagggggaaactatggagatgatcgacgtggcagaggaggatatgaccggggcggctaccggggccgaggaggggaccgtgggggcttcagagggggccggggtggtggggacagaggcggttttggccctggcaagatggactccaggtgagtaagtcaaaacaaaagtcaagaaaattggtcagagatcatgaggaaatcaggtttccctgggaaagtcagcttagctggttacatttttgggaaggaagaagaaaagttcagaacccagtctttgaggctgttttgctttaaagtcatttgttgggtagcagagacttgaagggtgtgcatgggtagggtagttcagtaacacgtaatctaacataactttttctttcaggggcgagcacagacaggatcgcagggagaggccatattagcctggctcctgaagttctggaactcttcctgtacccagtgttacccttgttattttgtaaacttacaattcaggatcgctcatggatatttttttttggggggggtggggcggttgtgtgtgtatgtgtgtgtgtgtgtgtcagactaccctaattgtaaccatatctctggttcccattaaaaaacatcattttagttaaattctgtttcccccagtttactttctgaagaatgggtccatgttattaatgtggggcagtattattcccccagaaattgtcttgcacagcaagaattggaataatttttttcctacctagcaggaagtaagataaatacattttttttttttcctgagacagggtttctctgtatagccctggctgtcctggaactcactttgtagaactcactttgtagaccaggctggccttgaactcagaaatccgcctgcctctgcctccgcagtgctgggattaaaggcgtgcgctaccacgccccgctcagataaagtaatcttgatgcaggagagaaaagacaatttgtcttgtgtggtttctaagaaagtaaaataattgctattttctcaggaaaaggacaatacatacagaggtctaagtggatcacatcttgcctaaatccagctgtgtctataggtcatttgacatttgatgctttgaactcaacattgtgtttcagctgagattatagaattatagaaaattaatatagccc

SEQ ID NO: 33081 - DNA, 1197 bp, Mus musculus
ccaatgggatacatgaaagttgcccattgtttgttctagactgttccacttgcttcctcagttttctaagcagggaggcaaatgtcaggaaggcccagaaacagtcctgctgtaggcttcaagggagcctcaaggcttcctaaaatcataatacaaacacactcggctagaggttagtctggaaagggaacaaccatttttccatttctaaaatacttccggcagaagtccttcttgtcctggtcgttgttcccgtctgagtaccagctccctattaccctgagggcgggcgagtgcagccgagaaaagaaggaggcggaaaagaaattgtcccagatccctgcagtctttccgtaggttgcggtacaacgccaggcaagagaagaggaaggaaattaaccagatcggtgaaggtcgagttgagggtctgctgtagcaggtggcactgcttgaaccaagggaggaactttcccccggatcagtagagatcagaaagactgttgggcgtggcataacccacaggaaaggaagaaggggcaagctgctgttttaaggaggtttacctctgtaagcaattactgtggccttgaagtgacttgaagaagatcactctccacaggactgcactcaggcccgaaggcctcttcccttatcttgagtgactactctatttcttggtccctgccattgccagggacgattgcatgggctacgccaggaaagtaggctgggtgactgcaggtctggtgattggggctggagcctgctattgcatttacagattgacctgaggaagaaagcagaacaaggagaaaatggctgagggtggctctggtgatgtggatgatgctggggactgttctggggccaggtataatgactggtctgatgatgatgatgacagtaacgagagcaagagtatagtttggtacccaccttgggcccggattggcactgaagcagggaccagagccagaaccagggcaagagccagggctaccagggctcgaagagctgtacagaaaagggcttctcctaattcagacgatactgttttgtcacctcaagagttacagaaagtactttgtttggttgagatgtctgaaaagccttatattcttgaagcagctttaattgctctgggtaataatgctgcttatgcatttaatagagatattattcgagatttgggtggtc

SEQ ID NO: 33082 - DNA, 1225 bp, Mus musculus
caggctgctggctggaagacggagaaacaccatctagaggtggatgagtggagggccacatggcccttgtctccagaaaagaaggtcttatgagcagccgtgctccaagcccaggacccagaacaggagcccagagaccaggatgaagccgagagcaacgatgtttcagccacaacaggatgttaggagggcagttttatttttgtataggcaaacctctatgaccaattggccatcatcttgtgggaagtgacaaccaatcaaatggactggaccccgggtaaagaggaagggaaccggttccttcctgctgtattcttgccctgttccttttctgggatccactccaagctgctcacccttactctttgtgagggtccaacatggcctggttgtagctcatggcatccaacaccctcgactttatgcatagaagccccagaggaacacagccacggtcatcatgagtagggcattgaggttgactactcgtgcccagcggggatcctcactgatgtcctccagccgcctggtggttgccgccacctcctcggtagtgggcggaggactccctgacccactcttgctcatcccacagaaccaaagcaggcaccggcggagcaggcctggagccggggactggacctctggaaggaatggggagcacacagttagcctggaaggagttagctcccagagctccccagggtaccctcccggggtcggccttaccttccatctccattgcacattcctggcccccgttctgcacaggagcaggggctggaccttctaactcatcagcatccaggtcctcccgctcctccttgctgtgccggagactgaaaaccaggcgatggagctgggaagttagggagaagggaccaggtgggagttctggctgtcaccccaggtccatgctggcacacagctttgtcactgtctacacacacacacacacacacacacacacaccccagactcccttctggcctgcaggcctgcccaggcccagcacactcagactcctctttccaggacagtctttgccttcacactgaaccccgagctcttcatctagcattaaagtcttcggccctgcccagtcccgtgtttcaccccaagttttaggtctacaccgagaatcatagttcttcagttctgatacttcatattcctattgtcatttgctctgcttcccaaaaatgtcaagtaaatgtgcttg

SEQ ID NO: 33083 - DNA, 1123 bp, Mus musculus
cttgtctaggcctaggtgttcagcctctgagacttgctgctaaaaatgctcaccttttcttgttctttctgagctctgaccggctggttcaactcagctgttctggctcaaactcctctccaagctcactgattcagtctggctgttctcttagcctctggcttgctctgcttggcctcaaagtaactctagcaatcttttctattcttctggctccttcttttaacccgtgactgcagagctgcccaggtcagactgcatcctctgtctgcagtgctcccgtgagcagcttccctctcctctctcttctcaggagagttgggcaggtcccattctgtcatatctttccttgatctgtcactttgtctgccactcaattagacatcactttcaaacatggctgcttccttctacaagctaactctatcttcattgtctgggattgaaggcgtgcaccaccacacctgtacctaagcttttctttgcctgatacatatgtatgtgctctatagcaggctggccttgaactcagaaatgtgcttacctctgtaccttgggattaaaggcgtatctgtattccatctggatcacacagacctagaacatctttggatgtgatctctggccagagcaaccttgttctgaattaaaatttctctagggtcagtgggccagcaaggtgcagtagccaaacctgccaacctgagttcagtttctgggctcaacgtggcaggagagcaggggctcctgcagattctcctctgacatccatgcatgcgtcagcacgtgtgtacatgtgcgcacacacacaatagtaaacgtaggaatcaaattaggttacttgcctgagccactgctctctggaaaccttaaaggcttccagttttctatttggaaccagactgttccctgccagtcacttgagcctcatcttacaccacttttctcttgattttgaataaattagttcctccacctttatagctatacttaagcttcatcaaaaacccgtctgtcatcattctgtgtctgtcatctacaagagactcgatggtcaaagttatcagtggctctagttgctttctagagatctcaggagagatgtaagttcgttaatccaggg

SEQ ID NO: 33084 - DNA, 1567 bp, Mus musculus
gtactgtggaggaattgcttcggggctgacaggtgcagtgcttggtttcctagtcaccttctctgttgatattcggcactattggtatcaatttcatggttagcatgaacttaaaacagtttatttgtatatttttctttgtatagatcaacttatgagacaaacattttcaccatttggacaaattatggaaatacgagtttttccagagaagggctattcgtttgtcaggtatcgttcaagctatgagataattagtacttgtgagtcctcttcattccttttcacttacgttattggatccttactagatgttcgtttacctatggaatacataatttgagaaaaatgccaactgaaaggtgtcaattaatgagttcctgtgttctttgcccaagttcttcaaagatgaaggcaaaacttgactgtttcctcctagattttccactcacgagagtgcggcccacgccattgtctctgtgaacggcactacaatcgaaggacatgtggtgaaatgctattggggtaaagaatctcctgatatgactaaaaacttccaacaggtaattcaatttttcttagcatcttttaaggtttccatcttacatacctacataggagctttgggaattataaaataaacagtaaaataaagcatatagctgctttcagttgattgtgtaaaatgctatttcaaaattgttttatggtattaactgaatcttaatactttctttttacaggtgtcaccaccccaataaacttagacagtgatagataacagagtcctattcacagaagggtgcttacttagtttttctcttccttgtctcccactctttcttcaaatacggtgtttgttcttgttccctaaaacagtcatttgctttttcctaggttgactacagtcagtggggccagtggagccaagtgtatggaaacccacaacagtatggacagtatatggcaaatgggtggcaagtaccaccctatggagtatatgggcagccgtggaaccaacaaggatttggagtagagtgagttgttttggtttttccattgtagaaacagatgcgcttctggcaaaagatgcgcttaacagatgagcttctgtgttctcctaggggagagtctattggaatgattgtacattaaggcatttgggctgtagatgttacagtaacaaatctcaggaaatatggtttgtaatgcttttaattatagagatggggaatgcaatgtgacctcttggtagaatttgactcatctacagttgcattttcatttaattttgtgtatataaacatctttgtctagaatatgctcagaaacatgatgtttttgtattttacctttctaagacatctttgcaagttacatgacagagcagtttgctttctgtggtgatggtggagtggatatgttgcttcactttctctcctaggctgagctacacctttattttcactgtttaattgagaatactgcaaaagtcaatgctgtaacaagagtactgcctgctaagttgtttatttttatttttgtaagacaatgttttcactgtagc

SEQ ID NO: 33085 - DNA, 1221 bp, Mus musculus
gcaatttaccgaactaagttaaacccatagtgtaagacagaaaaccaaggtagtcatctcttgggggtaaggtggtgacttttcttttttcttgttaacatttttaattaataggtaattttggaggaaaaaaatcctccaacttttcagttaaaagtattttttgggtttatcttaatttttctctgaatttctaaagaactcttcttaaacttttgttatcctcatgaagttgtattttgttgatcctgctacttttttttaatgaggaagtttaaattattcaattccctttttcttagagcagtgaaggtgtgccatccatcagtaacaggcttctttagccaaaagtgggacagaccccagcttccccaccccacctactttgttttgcagaactgaactcctaccctcttcttggttcatgttttgttttgcttggcagcgttaagatgagcccactaacaacgactgtctagtattagttcatcaagatgttttagtcaatcagtatttgtggtgtaaattattataaaatagagaatatagctattacagggctaggcatgactggataaatttatcaaagacagagacttgaaataaaagatgacaaaatagcaggttacaggtgcagctaaagaaacagtgctgataatgttttgttttttgttttctctctcagatacgtaggtaacctctccagagatgtgacagaagtccttattcttcagttattcagtcagatcggaccctgtaaaagctgtaaaatgataacagaggtaaggtcttcctggctagatgtgccacctgttaccctgatactgagcatttttagatgatacgtgagttgattctaaaattctaaagttcattttaacttaagcttcagattattctgttggagagattcctgtttgtggtgttgatgtaatccgttgatttggctagtaatctaggtatggagtaaagtctggtgtgagaaggccaagactgcactgatgttacacagccctgatggagttaccttcaggtgattctgcttgtgaacagtctgtctgggaaagatgacagatgatggtattttacatactccagtgcaaatactgataattcagtctacatttcaagttcaggtttggtatgttttgaagtcagcattcggttattatgtgtacagtggagcagcaagcatcttatgtatctttagaaaacactaaa

SEQ ID NO: 33086 - DNA, 1220 bp, Mus musculus
tccgtagaccctgaaggacgagctgatgtgcggcaggccaggagagatggcgtcaggaaggttcagaccatcttggaaaaacttgagcagaaagcaattgatgtcccaggtcaagtacaagtctatgaactccagcccagcaaccttgaggccgagcagccactccaggaaatcatgggtgccgtggtagccgacaaggataagaaaggtcctgaaaacaaagatccacaaactgaaagccaacagctagaagccaaagcagccacacctccaaatcccagcaacccagcagactcagctggcaacctggtggctccctagtgtcccctgggaccatgctgtagagacttttaagttgcatgcactgcgggacttgcagtcagctggctgccattattcatagccgcttggtatgcagtaacttggggtggaggtaaaacactaacaaagggggcttttcttccatagtctattctgtataaataataagttgcctgttccagaagtctaaccctaacccctctggttgtctgggacccctttctgtgcatgggtgcaatgatttagccatggctgtgggctatctgggtacaatgatttagccgtggctgtgggctatctgggtgcaatgatttagccgtggctgtgggctatcttcctgttagccttggactgaaggggttttaagttttgaggggtaggaagagagttacaggaatagagaacctgtttttgagacatgttgtcattttgatgagataaccttcatctcgttactgaaatatctaacttcagctagatatgagctatgcaaggagccataggaatagctatatgttggaatggctttaatgttgttacatttgaggggggatggaaaataaagtgattatataactctcaaaatgtttttttgtggtttctaaaagtttgaagagtgacagatggcatcaaggttattccagtgggtgaagcgaggatcccatataagcactcaggaggcagaggcagggggatttctgagttcgaggccagtctggtctacaaagtgagttccaggacagccagagctatacagagaaaccctgtctcaaaaaaaaaaaaaaaaaaaagctgggcacaaataacaggcctaccaacgggctcagtgagagtgctcttgtctcaaacaatgaggtagagagcaattgagggtgacagcccacattggcctcagcctc

SEQ ID NO: 33087 - DNA, 1172 bp, Mus musculus
actcatgggataaacttggcggttgccaaagttcagaagagtccagcagaacccgaagcggttaacgaaattcaacaaaatgaacttaaaaatatgtttacacaatgccagacacgaataattcagatttagattttagtcacattcctttgtcttttatttaaaaattcaaaatgaagttttcacctttcaggctattttaacctgtactgaatctagggatttcaaattctaattatgtttattggcaattgttttacaaggagtctgaaccttagcaaatttccagatatgtaagctaagactacaggcagtcatcctggaatatggaccagagtagcaaacactagaatggtctgtgcatctcacttgggaaggagcaggaaagaaaccaagctcgtgtctagagggggagacactctcaagcaggtgtggtgtggacatctgtttatggtggtagcatttttttgctctgtcagttcattcctcaatactgcttcataaaggaaattatgcatttagattttagtgatactagtgtgcattagtatctaaattaaaaaagtagtctcgtggcttaaccattctctgaagttgagaattaacaatggtaaaactgtatttttcctttgaccccactctctcccgtatatacatttttttttctctctctctcaaattcttaagtatgggcttgcccgtcataaaataacttgctgcaggaatataagatcatgtttattgactctagagatctctagaaaagtcgtttgaactctttcaagggggacatttagcatctcttgtaggttctagaactatggaaaacatcaaagtccaggttaaactggttttattcagtaactaaccaccaagaacctcttctgtaacccagagtgagaaagctgtaggcatattctagcaggtatcaatgtctctggcatcctttagagccttactctggttaactgactctcagtttaacattatgtctgttaaaactctgacaagcattccgattttgttatttattagcagtgtcaagtcttgtgactattaaaagaaccactgtaattcaaaacatcagcgtatgagaatttcttgtatagcatttaatagtaagagttgtcttcaaagaattcataaatggtaagtttgctttaaccaaacac

SEQ ID NO: 33088 - DNA, 1149 bp, Mus musculus
accctgaccaggcagctaggtctctttggaaataaccattgctttaacttctgttgtcacatctcttcatgggtcatttctttggaaacccaaacatgcattatcttcccatctggcctggcttaatacttaactactctgaagaccctaaagaaaaaaaaaaaaaaaaaaaaggctacagcattcagtttttaatgtctgggatttaaaatacagttttcatttttaaaattgaaagttcaaaacaagtgtttggttaaagcaaacttaccatttatgaattctttgaagacaactcttactattaaatgctatacaagaaattctcatacgctgatgttttgaattacagtggttcttttaatagtcacaagacttgacactgctaataaataacaaaatcggaatgcttgtcagagttttaacagacataatgttaaactgagagtcagttaaccagagtaaggctctaaaggatgccagagacattgatacctgctagaatatgcctacagctttctcactctgggttacagaagaggttcttggtggttagttactgaataaaaccagtttaacctggactttgatgttttccatagttctagaacctacaagagatgctaaatgtcccccttgaaagagttcaaacgacttttctagagatctctagagtcaataaacatgatcttatattcctgcagcaagttattttatgacgggcaagcccatacttaagaatttgagagagagagaaaaaaaaatgtatatacgggagagagtggggtcaaaggaaaaatacagttttaccattgttaattctcaacttcagagaatggttaagccacgagactacttttttaatttagatactaatgcacactagtatcactaaaatctaaatgcataatttcctttatgaagcagtattgaggaatgaactgacagagcaaaaaaatgctaccaccataaacagatgtccacaccacacctgcttgagagtgtctccccctctagacacgagcttggtttctttcctgctccttcccaagtgagatgcacagaccattctagtgtttgctactctggtccatattccaggatgactgcctgtagtcttagcttacatatctggaaatttgctaaggt

SEQ ID NO: 33089 - DNA, 1264 bp, Mus musculus
ggtttgtttttttccaagatggcagtgaggtagggcagtgagaaagagagaagggggtggacacagagaagaggaaaagaagagagtgagttttcctagttccttcctaacactaggtaacttactttaaaccagattcctgtctctgagcgtcggtcagacaacactctccagagagcgctggctcagagcaaagcagctggagctctccaggaaggcccggcttcagcagcagaagagtgtgaatgggaacgagctttagagcgccgagcgtgcagggaacggcaagctacggcctctgtgcgtgcagtccacagtcctttacaccacattgttttatagggaatttgtatccaaaaacacagtgacttttcctgaaatcaagtctggtgacacctaaagtttatatgattctctgtaagggtttttaccttactggttttatggagttttggagtttgttttataattagttatgatgtacaaaaatgtatttgatattaaaggtttaataatgataatgttgctgatcacaccattttcttagccacagctacatcttaggccagactatgaagtgccagcttcctctgcagagttatttgaagagctgtgttaattcagaacaggtctgagcgacaagttcgagatatgacttctgtagtgtcattttctacacagctgccacagacgcagtttcccacgtcccagctgtaccagccggcagaactggcctttcccagaacaggtggcggttcctggctttcagatttcatagactggtaatacctttctgaggtaggggtgccaattgattttgccaagtcatttgaaagaaaaaaagaacaaaacacactgtgatcactattttgttttcataaaggacattctcagaacacgagcatcttttaatggaataaatgcagctttgtgaagaccaccacattgtccttaacttttctcatctcctgcatctgtcatctgcaactgacatattatgggattgaggggaacactgccccatggaccctggtccagacatgaaaaaaatgctacttaaacagtcaagttttcggggtggggaaccatcttttttttttttttttttttttttttttttggtgctgcttatcaaaccctggcttctcatacatgctagagaagtgtagtctccctggagctacatccccgggctgtgcagggtgggatgtttttcattttcctcattatttaactgacttgatgaatgtactgcattttgagc

SEQ ID NO: 33090 - DNA, 1216 bp, Mus musculus
gtcctatgggttcatacacatatacctggaatccactcaagaggtggaagcaggaagaccaccaatttcaaggccagcctgggctatatagtgaggctctatttttaagtaagcaaaagcttgggtgagagggttggggacgaaggcagtagcttcatgatggagcatatgctcgccgcgtttgagacctgggtgttatctccagcatttggagaagagacagccaaacaccaactattattgtttataacctggaacactaccattctaaaccctgtttgcttttacagtcattggagacttttctgtccattttaatcttgttgctcttttttttaagcaatttattagaattattttttaagttcacaggaaaactgagtgaaaagtaaagattttctatgtaacatctccactttctccaaatggtgatgtttcatcccagagaagtatatttgtcccagttaggacatccttatggagctgaggtgactcagtggcttgctaacttaatgacatgagctctgtctcagaacctatgtctaaaggtggacgagaacagttgtcctctggacccgactagagtcacagtaactacacaggaactgtaactataaccagttccatgggctccctcttctgtcccctgtcagcttccacatggtatgtatgtgtatatatatattcaggtaccacatttccatataaaataacatgatgattatttaaaaagttgtcctgtgacctctgttcacaaggccctgccccaaatgtacatattttttaagcaaataggcgttaacatgttatccagagtccatagtatgcactgctagggcagtgtgataggaatatatttagcttagtggcagactgacagactgggttctgctccccagcagcagtgaatggaaattgctgtgttaacaacgcctactgccaaggcagagagagcactctgtgctgatttgcatcccagggttgcctttttggcttcttaggtttggtttggttttccttgttggttttcctggggttggggggttacacagggtgtctgtgtagcactggctgctctggaactcagagttcctgcctccatctcctagtgataacaattgaaggtgtaagccatcaccaaatggccagaatttgttttctttaaagatcagtttgaacactttctcatctacatatagtgtggttagtattctgt

SEQ ID NO: 33091 - DNA, 1117 bp, Mus musculus
gctctggcctagaggtgtggatttaggaagtgctcctagggtaaagcctgcagtgtgttgaggtcagtatcttatgatcggtgctagtttgagaaatgcttcttggactaagtcagtctgttctcttactgggtgagtgattccacagaaggctcttgattgttggggatgaacacagtcctgtgaggctcacaggactggagagtgatggagtcggagtatgttttggaaaagcagaaggctgaagctgagggagggcctgggcaggaaggcattttgtcttcagtattgaagagactgctgataagactctttctttttccacatttaattaaaaaaaaaaattctggatatggtggtgcacagctttgtttgatcctagcatttaggaagaggcaggtggacctcttgagttcaaagccatcctggtctacagagtgagttccaggacagccagggctacatagtgaagctctgtcttgaaaaataattttttttaagattggcttttattgttctgcctgcctcagtctggagaggctgcgactgtaggcatgtcttctgaatagtttgcatagttcagaaagacagccttagataccatattctgattggaattgtgttttgggcattatggccaaacctgtggagtggcatcccttcactaatttggtatgtgaagtataactgggacagcctggaagctgtgaaggaggatcactgtgaggtcacagagaggcagagctttggcagttctccaagggcagggaccacagtgtgcctgttgtgctgggagtggccccacacagcggatggactgtaagccctgcagcagttgcagataagcttgaccagaacaaggcaaggaaagattacaagggggagctgggaagagtggggtgaaggtctagttcatgggaaagcgatgccttgggcattacttgacgtggcactgttgaagcagagaacatagtagtgaggatgatgctggccaaggggaagtgaggagaaatgagcctagaaaaatgagattgctagtgacttgccattttgtgattctttttagcattttttatttatttattatgtgttatatgtggaggatccgagaatactt

SEQ ID NO: 33092 - DNA, 1151 bp, Mus musculus
agatggggtctcatttagcccagggctggcttctaactcaccaggtagctataattatccagtaactcctgatcctcctggctccatatcccaagtgctggggttacaggtggatgacggtacatctgctgtgatattactacttaaaaaaactcaaactatttcagttggctcctgattgtgttgttaaaacttgccctggctctttgtagcagcgcactcctgtgatgtcagcactcgagaggatggggcaggaggactgctgggagcttgagggcagcctgggctaaagaacgagactctgcctcaaaagcaagcaagcaaatgagtaaatgaataaaagtcatgattttgagcaatacagattatcttgtgttttccaataagaaaaaaagcttaattgtctgtctttgagtattgactagtagcgtcatgaacgtattttccagtgtgcctgctaacgttagaagaaaatgtcctctcggtttctagtgcagccagatcctgagagtgtggttctaggcacggatggcggacgctacgatgtgtacctttatgaccgcatgaggaagtctgtgtactgggaagaggagccaactgaagtgagacgctgtacttggttttacaagggggacacagacagcagatttattccttatacagaggagttcagtgaaaaactagaggtatgatatggttgttttatttctttgtgtacaagacaggcttctgtgacagcactcacagtggagatggctttccatacagggaaaggctggtggttcaaacctttaatcccaacactggagaggcagaggcagacaaatctacagagttccaagacagccagagctacacggagaaacccttgtcttaaaaaacaaacaaacacaccactgggtgctcttacagagggctcagggttgattttcaacactcacacgcagataatagctattggtaactccagttacaggggctctaacactctcctgacttcctaggacaccaggtgtgcacatggtacacatacataccggcagaacactcacacattaaaaaaaacagtgactcaggagtagagctgaatactgtgtttgtatatgtacagtctcagcattaacgcctgtctcctcccctccaccccagag

SEQ ID NO: 33093 - DNA, 1147 bp, Mus musculus
acacaacttataaccccctcccattcttatagtgctgagcatctcaggaaaaaaactcagtctctactgcttttgatttaggtgtgtgcttcccagcataagcatctgaagtaatgataggctgttttgatggttaatggtagcaggacctccacagagttggctcggggagcagttcttcttcatttataacatctgtattgggaagcgtagggctttttatattaagcacatcacttagaagcaggtttagtgtggtatatttctgtagtccaagcacatgggaggcagaggcaggacgatggctgtagattctggtctaactttatctagaagagatcccagtcaatctggggatgggtgttaagaccccatcttgaggaccaactgaaccccccccccccccaagatactgcttaacttaagttgggaaatgactttgctaatgagcctgtggtaatcttgtgtcttgaaggttattgtccagttccagccttcttcagtgccagatgagtgggggacgacccaagacggacagacaaggccaagagttgtaaaacgcgggattgacgacagcctcgatgaaattcctgatggtgtgtttagtttgcttgagagaaaagcctgtttgtgctgctctgtcagtgtcctccttcactgtgaggaaagatgcagttaccagaactacttcagcatgctcagaagtcagccatatgctgcccacagttctgtctttttaaagtattgctcctttttaagttttaggttaattaattaattaaaatgtgtaggagtgttttgcctgtatgtatgcatatatgcacctgtgtgctggtctggtgccaacagagatcagagagggattcagatcccctgggtgttagggttggttgtgagccaccaagtgggtgctgggaactaaacctgtggcctctgccaggacaagcagcactttgaaccactgagctgtcagttctacatttctttttgatttgaaatagggtctcactatgtagtcctggcagtcctgaaactcagagatctgcctgcccctgccgccacctcccaagtgttaggattacatgtacctcagaacacaattgtattacttttatgtctttgtttttggaattcggtttaaaataca

SEQ ID NO: 33094 - DNA, 1204 bp, Mus musculus
cttctcagagcacaattaagctggtagcaaccaatatgatcgccaatggcaagctggcaggtaaggcactttgactgcagtggtcagtgctgggctgcgctgggcagttagagacatgtctctttgtatactctacaggaaactagcgctgcttgtggggcgaccgcagtcatgttagcggagcttatttaaagcatagagggaggcgtcattgattgcagtgacagtagacctagtcctgcagtcctaggagcatctgaatcatgctctaagatatagtcatacttactaccctggttgcttaaggggtaacattgattatagagcactgtctaatactctgttttaaaattcagttcagtagcttcccgttaggtccaggttgaatacccatttgaagtaattaaatgtgctcaccctacatacaaatctacagtcaaatgtggctttacttcttaatgatttgctagagggagcactgcagggtcagatgactgttctgtcttccagagggtgttcagttactctgcttgatagacaaggctgcggacgcctgtcgctacctgcagacgtatggcgagtggaatcgggcggcatggcttgcaaaggtaggcatttccagtatgtgtcctgctctcttcatctgaagctgttccatgtttggtaactttcagttccacctctgagtattagctaatgatgcttgttggaagacagagcttgcattggtgtggtcaggtgaaagcagctggctcctgtctgctggggtctggtgcatccaggtcccacggcagcctctgggctgtggaacagagcaaagcctggctgcttgtttcagagaagcccctccctttgtttctctgtaaagggtgctctagcatggacctctctctcaggttcggttaaattctgaagaatgtgcagatgttctgaagcggtgggttgaccacctttgttctccacaagtcaaccagaagtccaaggccctcctggtcctcctctctctgggttgctttgtcagcgtggcagagacgcttcacaggtaagtcctgggagccctggctactcagggtgtgccaggtgagccgttgacagtgtcttatgctctgatggtggcggtggtacctggtgtgatgtgaacggagagtgatacagatcaggtgtgtgagacagaacctagatcgtgcaggggcatctctggtca

SEQ ID NO: 33095 - DNA, 1282 bp, Mus musculus
cccaaccccttgtgctcttcagttccttaactggggtttacagaagctcattgctgccatctacgcagactatgcccggagcctgaagagcctcggctttagacagggagcagtgcgttttgcttcaaaagctggagcggctggcagagatttgttgaatgagcttgggtccaccaaggaagagctaacggaaagttgacaggctccgcgcaggaatctgatgtcggaagcgaggggtgaggagagctgacctggctgtgctcctggtcacagctatggtcagtccagacctgcgtgagggcttggcccttgttagctgtgacaccaccttcttaagttcgaaggtgctcagcagcataggcccatacactaggagccagttctgtgtcccaggtgacctcaaaatggggacacatagtgggaaagtatatggtatttatactttggaaagtgcttttaagatctctgtgaatacttttcaatttttgtaacttaaaaattcaaaaaactgaattactgtcctttctcattagctattttgaagatgtttaagaaatctgtggcaagagatggggcttctgatggattttcagatatgtgctgtgtgtgcctgtgttgataagcagtcatttaggacacagcagggcagaagcatttgaccaaccacagcacctcttttcttgaggacgtggtggattctttgctttagacattgctgaactttgtatttggggctcatagtcttcatggagcacgtctaagcttaatgtttagcgtccgtggtctctgatggtctgaattttaactcccaggatatgttccagaaacctcatttctgaagcctctttgtacatttcccacctttgttttcttccactagatgtaattattataaattattactcagaacttaaacatctgtgactataaaaatgataaataaaggaaaatcccagccaagactttgttgtttgagtctcttctttgagatggggtcttttggccccacacagccgaatgaacaacagcttcacccctactgtatcttttcaatattgtgttttactgagaaacacaacatcaggtcaaatttagtcactggttccaagcaacttggggtggtttccagcaaccccatcttccattgttaaagtcagggaagtcagggtgcctcagtgaggtagcttgttccagaccccgtgtgggaccttggccaaaacactgggtgtgaggtgaggtaaagaaagcttagcccgtgctttgtggtgtacccagagctgct

SEQ ID NO: 33096 - DNA, 1617 bp, Mus musculus
acgctaagaaattaaaagtcgtttgaaatcctcccaggcatagagaaaggagcattatggaaacccacaaatctcttgtccaccccaaataaaactgtgcattccttgctatgtagttgccctcggtgaatgtgtgtgagattgaagattgcagaagatgtgataggtaatctcagtattcttcagtaggatgggatcacatatatgaccttggcattgggcagccaggcatatcctggtaggtggtatagccatgctaccagaggggtttgtttttgggagggggcggggggtcagcccaacatcttaccctagctctgagtttctcctgcagagaatagaggaaaatggctcactgtccctgtttctagactgatgcgcctaacctagggtggccctactgaggcttcagagcgtcttgggcatgaaaactctctcttcagctcagttgctttgtattcattctttcctccctcctccctctatcctctcctcaatacagtttttttcgactagtatgaaaccttagggttctagatgttgtcgaagatgtgtccttgggtgggactgaggagatagcccagttagtacagtgcctgagttcagttctctagagcccatgtaaaatgttgggtctggtagtgtgtgtttgaaatgcaggcactggggattcagtagaggagtacctcttgggcccactggccactggcctagccactgggcatcgagccactgagagaccctgtctaaatggagttggacagcatttatgagaacattaggggcttgctaatattttgagctcttgagtgagtgtccatcacagctcggttaggacagtcaagaaagtatcccaacttggcatttttgtaaagtctcgctgaggcggctgattctgtcagtgattttcatgtaaataaagatgcgtgcaagcctttcagggacagtgtctgacttctccaggtaggaaggtctgtgtgttccatctccttcttagtgtccccttctgagttcaggtagagtcacaccttcctccatgcctacagcgtagggctcattttgattctcagtgtaccatctttatttaaattattttcagttctctgagacttttgttacttttattacaggtaatctgagcacttttatattctaagatagaaactatattatcagatgaatatagtcactcaattaaaattatttagataaaattattgtttatgttttctttcaagcaatctatcctatttttatccatttgcaaatgccagttttgtgtggtttcttagcatatcaaaattattatgtagaagaatgtttctagctttctgaacagcaaatagtttggtgtgtaaatattgtattatttcagtgtgaataaaggtgagagagaatatgaacatttaaccaaagtgattctactgtggctgacttaaaagaacggaaggaagtgagtggggatttgacacgtttgaattacgagttattcagtgtgcgttcctctcctacgggaaccactggccagaaggcaaagtaagtctgactgcattggagattttcgttcttgtaaaaaagcccaaaataaaaatactaacaataaagctgtgtcggccg

SEQ ID NO: 33097 - DNA, 1396 bp, Mus musculus
gtgtttataagaatcaccaagaagacccaagtgaggaggctggtgtgctggagtatgcaaacctcgtaggacagaagtgctcggagaggatgctgctgttcagacactgaaggcctgcacctcagcccagcgccagcctggcatctcttgccacagtcccacctgcttctcggctcctgcagccattcaccaagtacattcgtagagctttttaaaaatattttgtggaattgtatttatgagaatcttgtggttaatataaagattttaaaatattctatgacctagccctttaattgggacttgtcctttgcagcttgcttctggagcaaggtgtgcttcatgtctccagtgaatatttagggaaggaaaatgaagaagtcaatataagtcattttgtcacagttactgttctgtgctggagaaattctgacacagagactgttcttttagaccaatggttcttaacctgtgggctcaccacactcacaggccgaatgttagatagcctgtgtgagatcaactcataataactcataatcgtagcaaaattacagttatgaagtagcaacaaaataattttatggtttggggtgggatcaccacaacgtgaggaaatgtattaaaggatggcagtattaggaaggtagagaaagaaccactggctaagacccatgcaagacattagcttatgctgggaaattcagatgggcttaaaggtgaagagcacattccatcccaggaaatgtgcctttcccacaaaccagaaccctgttactctgcttgatagtaaacctgccagtgttgtagtgtataatagacaacaggaactgtaaacattgcaaacatcaggtgttcactttgggtgtctgtccaggactgtcctgcctatgtctgttgtcttggcataattgttttccttgtcactagtgttcccttgtgccccagagttatctctgtttggatgataaaatatgcagtgatcttagtggtgtttgttctatttctacaaatataagaaacaactttctaaagaaacgtcgtaactcctgcttgatctgaggcttatccaaagaaaatagcttcctactttccattctctggaactcagacgcttttttgtggttagtgatagaagtgattattatctagtcccgtagctatgcacagccgtagtggagttggtggggcctctagcctctgcattcctcttctagttgtgggtcagagagtaggcgctgccatggtacttcagaatggagaccagccattcactttcattcttgtgctgttgggccttctgcttgttcaccaaatgcctgctgtcaaggaggcaggcagccagctacttcgtgaggcacatcagacctggtgaggagaggcttccctcaggtgc

SEQ ID NO: 33098 - DNA, 1196 bp, Mus musculus
ctgaggggggaaggagagagaaacatcaagtttcttattgttaactacactgttagctatggtttttgtggatgtttttaaacagcttgagacatctcttccctgtcgcttgtagaagtttttgttcagctgttggaatgtgtcacatatttcctgataaatggactgaatattgtttgtgtgtgtgtgtgtgtgtgtgtgtgtgtgtgtgtgtgtatgtgtagtccggtggatgaggtgggtcacattaattatttttttctctttctttttctcctttcttttattcttttcttttcttccccttactcttctccctccttccctccctccttctttcccatcctctttatttttaaagattgagtttttcaggctaactcactctttatctggatggtggtcacaaaaaaacaaattttaggacttattaactcaaacaaaataaaaacctatttagattaagagatctttttaatgtagagaaaatgacttcctgctgctgtgcctgtgtctgcttcttcataggcagagcaccctgctgatggaccagaatgtggttatggctcctttcaccagcagtactggctcgatgggaagatcattgctgtgggggtgttagacattctcccgtactgtgtgtcttctgtgtatctctactacgatcctgattattcatttctgtctttgggtgtctattcagcattaaggtaagactgctttgtatagttgtaatgaattatatcaatttatctatatttcattgtgtaataggaggagccctccttttgatagtatgctactttgctggtacaatagtcccatagctgtatattaatatgtaaaagtaacagttttaggattctggagagatgactccgcagtttaaagcacttcccgttctttcataggataggaattcagttgccagcactcttagatagctgctgacaaccacttgtaactccagccccagggaaccctgctagccctcttctggcttctataggaacttgcatgtaatatgtgtgtgtgtgtgtgtgtgtgtgtgtgtgtgtgcacgcacgcgcacgcatgcaagcatttacacataagcatgtatatactcacatgcacatggggagggggggaataaaataaacctatctcaaaaagatcacagctttagaaatgatgccattgtttgatggtaattc

SEQ ID NO: 33099 - DNA, 1177 bp, Mus musculus
agtcaggactcaatagtatagtgtagcccatcataaactgtaagaatttgctattgataatacttaaattgccaaaggctttttacttctaacatttaagaaatgaattacatttacttaaattcattgttgcaaaggtattcttgaatttccagcataatgttattagtattttgaggggagatacaaagtgagttcaagctagttcagggaacatttatttgttcttacaatttctgttgtttaaaatttcctaaaagttgtcttagatcacaagtcagcgtcatgtataacattagagataagttcttcataattatatgtagctgaacttttcttgcatataatagagaattaaagaatttatctaaagaactgcagatggttagtgcagggcagcatgtagaagttagaactttttacgtaaaaccatggggctgttatgttggagggttgaagatggcctaaataattaatatagaataaccagcatcaatgaatgaagtattgaactaaacaaattttccaaataattaaagcattctgtgatctctgaaaatttaaaatgactgtcctcccacagtgtactttgttcttgtctgtgctcaaacagaacgcttggcaggacctgcctgttgacagtgactttcatgtctttaggagtattcttttgctcctgctgtagttcagtttcccagtgctcccacaaagttactgctctgtgtcacctcttaagccttcttgctttcagttcttgtattagtttgtcaagtattcaaatttcttttttaattttttgataatatttgttaagacatgtgttgtgtacctcctagtaaggcactgtctccaaggcattagtgcaggtagcaactcagcgaagagtcagacggagatcccttgcttttgtgaagcttcctttggctgagtaagactgggaatggtcagagatagtcattaaacaagcataatgaagtggtagtttgcaggttagcagggcttattttagaaaaggtagatataaacatggtttagaaatactggtcattagctggaaaaccaggccaccaaatttgttgttagtaatctagaaagtggaaaaagatgcttgagagatgttttggcaaataaaacaacttaaaatatttactctgttttaaattatgtagatgtgcct

SEQ ID NO: 33100 - DNA, 1204 bp, Mus musculus
ttggcttgtgttttccttgccctgaaggtgaggctagtacctgcctcctttgaggacccagagttcaactcatccttcaaccagtccttttctttatataccaagtatcaagtggctatacaccaggaagcacctgaaatatgtgaaaagtctgaggtactgtctcttaaacattttttccctatattgacaaggttgtcaagaagcatgatctatcttaactattaagtagagctgattgattactctgagcatctcttactgagctttgtggaaaagattcagacctagcattttgaatcctttaataaaaaatgtaaattcaaaaagtttttccaccaggaacctgaatacagcattattagggttttgtcctgcagcctaagtcagcacacatttactgactataccttgaagtggaagaagcagacctgttgagattgttgtatagagcatcatctaacaagcactttttgaggttctccactttccatgttgtagatcttaaatgagtgagagattctaccattgtaacagggatagaggtgtgttgggataaaggaaccgacaggtgcagaggtggcactgagtcgggcatgggcagatgggtaggagtatgtgtggcctgaaggagagaagagaagggtgttgttggcagctgttcagccttgctcaacagcacggtggctgaagtacacagtgtgcttgggaaccactccttggctgtgtgtaaggcagtagaggcaatgaataagctgcgcagtttacgttaggagcaagacttctttttaaagttattttgcaagcatgaaacccttcaactctgttaatcactcagcagttctcaacatgctgccatctttgctttgtctccctcttcatgttctttgttattatgttggattattttgctccaaatcttggccactgtaccattttgtctgtaagtactttagtatatatcttagtaaaaatgtttgataatgagctaagacaatctaggaagatttaaaaacatgtgtagaatactttagtacttaagaaagatcaacttaggaggctagagagatggttcagtgcttaagagcactgactgctcttccagaggtcctgagttcaattcccagcaaccacatggtggctcacaaccatccgtatataaagggatccgatgccctcttctggtatctgaagacagctacag

SEQ ID NO: 33101 - DNA, 1194 bp, Mus musculus
gaatggtgatcagcatgtgggagtcagagagacaggtgttatgtatcaccaagtctttgttatactggggttattaagagactatgggttcggtcccggctgaagagatggttcactggttaaaagcacctcttgctcttgtagaaaacctgggtttgattcccagcacccacaactccagttccaggggatatgttgacctcttctgatctccgtgggcttcaggttcacacatgccctgtttacgtttacatacatgcaggaaaacactcatacacataaaataaatctaaaagaaaaaaaaaggagatactggttcagtgaccaggaatatgaaagctagagagtgagctctaagactggtgagcggtgggggaggttttggtgtggtggggagggaacctgttatcaatgtctatgggtccatttccagcctcctggggattgttttggcttagtggaaagatcctaagaagtacttgaaaatttagggggggggggcgtacctgtgggttacatgggtttcttaacatgtatttcttgttctacagtgtcacgagcaagagaggcagttctggatgcccagtttcttgttctggcttcagacttgggcaaagagaaagccaaacagctgcgctctgacctgagctcgtttgatatgttaagatatgttgaaactctagtaagtttaaagctacagaattttaattaaatgcttctttaaaatgtcttattatataattctctacttgcccatatcagtttgctgatgattttcactttatctcctcttatttatttatttggtcttagagtgttctatggaggtcttaggacatttacagattaaacagatctctgcctggaactcagagatctgcctgcctctgccttctgagtgctggaatttagggcgggagcttggagcagtttgaaacctcttagtgttctcttctaagactctgtatgttctggttattaatagtcatttcctctcctacttcctaaatgttctaggtcattctaggacatctatcctaggctggaccagagctcccactgtggaggtgaaggttgagggcaggcagctcagggtagaggtcagctgtaaatgaccttatatacagacatattctgtcttggaaaatttttagaatcatgcaaataggatgggtggttttgtattgaatttag

SEQ ID NO: 33102 - DNA, 1204 bp, Mus musculus
tactcacgaagagtcaactcactttactgacaggcctaagataaaacctctggtcccgaggtgcctggggattttagctctcagggaaactgaagcaggaggaggtcctctttgtgtccagcctgaaatagttggtttccagacctgagtctttacaagggcagcgcgtgcttgtgtgtgctgattactttgagctctctgtccacttggcacaaccaagaatcacctgcaagtgaggaattatctataccagtatggcctgttggcatgtctgtgtgggcctgttatgatttttggtattttggtttggtctggtttggttttggtttttttgagacagggtttctctgtgtagccctggctgtcctagaactcactctgcagaccaggctgactccaactcagagatctgcctgcctctgcctcccaagtgctgggttaaaggcctgcaccaccacctatggctttattctgaagtttgaggtgggaagaatatgggcagtgcctttccctagacatctggttctgatccatggaggacaggaggagaaagaaaggctgaggagaaagcagccaggatccccatgtttctgtgttctccctctgctctctgtgggatgtgactcgccttcacagatggagattagcctggaatcataaaccaattctttcttctcctaagctgctttggtcagggttgtttatcccagcaacagaaaagaaacaaaaatactgtgtcaaggccctggctgctgcctagtagtgggtacaggtccagcttcaaagccggtgcttgtttcttaagagcaactgagagatgaccgcgggaaggtataggaaggagacagaaatcttcacagcagagaaaggcatcccaagacacccagtaccaagagagggtgactcaccactatgtacacctaaatccacagcatcgcctgcattatcggccagcgttccctgctcagggagggtttctctctccatggctccgggccttcaatccgctcacacttggtaaaatcttgaattctcacaccttttgtaccagctgtagagctgcggggggggggggggggggcgggggcggggggggcagtgaaaggaagtgacatcatggaaatgtacagaactgcgcatgcccactttccagggtccagcgtccatcagagtgggctggtttcgtgtttctccccttcaagaa

SEQ ID NO: 33103 - DNA, 1164 bp, Mus musculus
gtgtgtgcaggtgcccttagataccagaagaggatttggaactcctagagctgggtttacaggaagttgtcagccacctttgcaagggcagcaagctctcttaactgctcagccacctggccaattcaagttaaaaatttaaaatgtttttttaaaaggtacttaaaggtccagcaagctggttcagtggataaaggtgtttggtgtcaagtccaatggcttctcaatcccctaaaacccacacagtgggaggagaaaatatggcccctagaattgtcctctgacctccatcctcatgccatgtgtacatgcatgtgtgcgagtgtgtgcgcgcacacacacacacacacacacacacacacacacacacaaatgcaataaacatttttaagaaaaagtaaaagggtatttaaaggaaatggagccaggatcagtggctcgtgtctgaggtcccagctgagcaggagtcagctttgcctacatcaaaagtttgaggcctgcctgcctgctgtatgaggctgtattaaggatttaaaaaagagggagagagagagagagagagagagagagagagagagagagagagggagagaggccctcccctgccttcagggcatctgctgatgctcttgggtcaaagcagagtgtctcgtgttcttcccaggaagggagctctcactctctctgagggattccgtagatgaaaggaaagccacttcttcatgtcctctctgtggacaccattctgctttgacatgctttttaatatacaaaaccttgggcccaagttctctagaacattttacaaatgactagattgctcacatccatttgcactcctatctgctccgtgttttcactcaaaaaggaaaaaagccagaatggttttcctagagaaacttttagtgctgtcacttgtgagcggccgagcagggtattccggtcacttcaggacccacttgactccagtttcttctcagtctggaatccaagccggtggtctctccttgggtcctgagtggtcccatcaataccactggaaaaccactcacctccctgctttatgccagacttactgtataccagagcaactggtgggagtctgacagctggccatacttagaatctggaccatcccagtccccaggggtgttcccactgctg

SEQ ID NO: 33104 - DNA, 1417 bp, Mus musculus
agtagatcagcaggtcagaggctttcaagttagatcacctcaagtcccctgagaccattgtccaaaatgagtggtgtctttagcaatgggtgacttgccttcaacctgtgagagacctgcaccctgctattcccctctctcatggtccctttatacttgaccagtgtctctgattacttttaagacagggtcagtcattggcctagaacttaataagcagactaggctagccgaggatccccctctgtctgcctccctcccatactgggcttgcaggtgtgcactcccatatctgaaggattctgggattctgggggctgagttcagatccttcagcttgcaacacatgggctttgctgactgagtcatcgccccagccctgtaactggctcaatttcaaacaccaagaacacctctcttgtctttcattttcagaataaagagatagaagaactcaccaagatttgtgacgagctgatcgccaagatgggaaaaagctaactctgggccaagtgcgtggacttggccgttgcgtgcaatacgagcgtcggctcaactgtttgtccttccgattccgtgaacagcgtctcctttcacttccgtatgcactactgtgtcctctttctaaataaggttggtttgaccgtatgcagtgccgagacctaccaggattccttgctatccgtttgcattttctagtataattcatagcaagttgacctcggagttcctgtatcagggagactgtcagattctctaatagactacaaattgctggccttggccttggcctttggcgagcagcatctgatgggacgtgaacatatgcatcgggactcttgccttaaggagtgtacaattgatccacatttgctggtttggttttttaggaaaaaaaaaaaaaaagaatgcatgtttcaaataaaattctctattgtaaataaagttttttctttgagtcttggcagcgagtgtggctgtgagttattttctgggaatggctgagtcctttccttcattaaatcatatcaggttttggtctctgcctcttttgcttattgatttaaattgcatttccttcattatcgtgtctgggtttgtaagagggagcaaatgagaaatattgattggggcttaaataagtaagtggatatattggattagcttagatttcatttttacaaagccttggccattaggaaaaaaaaaaacaaaactgtttccttttataactctgtggaggaaatagcaagctgtcagtctttctgtcctgccccttggtgcctgaccaaccctgaaacactgcctatttctttataaatggttaggaaaggcccaggaacacctggtgggaggcaggcaggcaattagccatttagcaacatgaccactaccaggctccctgatgctctgacct

SEQ ID NO: 33105 - DNA, 1198 bp, Mus musculus
gagcactgtggctaagagcatggtgatgagttgagtgttcggttttaggcgtgtacggccatagttcactgcccttcacagctatagtctgggtaacattgtaaattctttcctaaatgtttaaagaagaaaagaaaaaaagatttgtaaaaggtcaatattaaaagaaataatcttgaaggatatttttactgacttgagttttaaaagtcaaaagtggaagcaggctttcaaatgtgttagtctactgtcagtgtagcagctcctggtcccttgctggttgggagagtggtgaagatggccatagttttttcctaagcagaagtccactatttctaaaatgtctttttccaccataagttctaacttacaagctagtcttttaaagttgtagcagaaatttcacagtgattttttttttttttttttttaaatgacagctgggacaagtaagctgaattttgggttaaagaacaaccgggccgccctgcagtgttaaccaggcctttgcgagccaggcaggtcagatggagagacacttcctgtgcaggtcttgccacccaggaactcatcaaatactttaggtctgctccgtcctctagctctgccctcattcctgctgagtggaattttactcccttgtaacttttgagaagtctgtagcctttttatttatgctagtcataaatgctgaagtctgttttactcagtttttcttctcattattttcttttctgatattgggacattctattgtggtcacagtaaatgcctgctaaggacacatttagatccctcctatgaaatcgtcccgtggagcagaagcacattaggtacctggctgtcctctgcccgttgatttggctctccggtgctcattcacagttggctgatttgcaggtggcgtgggggttcttcatcttagtgtttggatttgactcactttcattcagagttggttttgtaaattctaagggagttaatttatttctgaattccttgaaaacaaggttatttcaacttaagtaatttttattgtaaactgtcgctcaagtgttgggaattgtgccctgcttaggcttcatttgagggctgtcagcagagggccaattgcacaggaaaggattttcagcatgacctgtttcttctgtattaaggacttttcagaaatccttaggcgtagcagaaccctcaccct

SEQ ID NO: 33106 - DNA, 1183 bp, Mus musculus
atttttcatttttgtcctttgtggtgttggaataccactgaccaagctagagacttaagtacagttttctgttcccattcatttttttctatttcatgtggttatttcaattttctatcagggtgatacaaaagcttgttatctttacgtagtttaatagtaatagtgaaacaactgaacgctttgcttggacattgccagagaaacacgtgttactcatgttgtccaagtacatcctaaggaatagtttggttcggaatactttggccattcatctctgttctgagatgcaaacccttttgagaaattacaccttaaaagtagccctgttgtcaactgtcctgtgccataccatagcctttatgatgtagattctatatatacctagatatacctgtattttcagtattttactatcttttactagttttctgttagtgataatgacagatcagtagatagtaatctacttttcccattccttaatcatttattattatagtaatattcctttaggaatacttaaaaacctcttttgtgggtgttagtttggtaactgcctgcattttatttgactctttaaacagtcaagtatgagattctctgcaaaaacaatgtctgttgggaagagggaaagttggagaagggtgtttgtgttctgtgctttgtggtgggggcaaattggactgtccagctgttactatcagcagaattctctcttttcctccctctcccaatataggttaactctaatcttagctttgcactgtgttccagatgcggcaggccagaaggctgtcgaacccttgtatacagaggtatacatcaagagctggtgaatgcagcacgtatgtgggctctcatgcaaatgtgccttcttagtagaaggcctggactcgctcctccttacagctgatcatagaaggttgagttaaccggactgccttttgcagttgtcatcactaacgcaaagtattttaccgtagtcatcaggttggatatgtatagtttaaaaaaaaaaaacaaccatactaatggaagcttccagagcttcataaactaactgactgaattgctgcaagagttttgatttccatgttttatgtattttgagatttatatatatatatatatatatatatatatatactacaacacttgaaatgagcctttgttcttctga

SEQ ID NO: 33107 - DNA, 1864 bp, Mus musculus
atgtgtgaggaggctctcgtgggctgcctgcgccactcaccctcagtgtccttccgtgaggcttctcgccaaagatgatagagggtgaatgatctcagtgcatatgtcatactgccttgtgggtggactctaagttggcaaaccaaggatttagggagtggcctagtcaacataattctttaagaaaggaaggagaaaagctgtgtccatagtgactgtttgaagctttatatgtttgggtggtgaaaatgtgtgtgtgtttttttttttcttaagtgactttgaaattttaaataacaatttaaaacattaaaatttcttattatcttggtcatttaaacctgctaatatgactccctttgaaatattcaatatttacacattcttatcagctaaaattatcaagtgggccattcccagatgaaaatttctaatctcatgaggtctgtggtgctgcagaatttatactgcaatgtggactgtttagaattctaaccatttatgatattctggctgtccaggtgagtggaaatttttgcatagatttgactagatgattggtgtaggtggcagtggaacagggcaagcagaagtggggagactggaggtcagctatagctaaaattgttatttctctggggaggggactttttttatctttatttttattttggagattggatttttctatgtagctatggctgtccttgaattctctctgtaaaccaggctgcccttgaacttgtgatccttctgcctcagttgcctcccaaattatagggttatgtcaccaacttgcagcctgagacacttgttttaaaaagctcagtgttttatttcagtaaaaattatttggtcataaattttgggaagaactgatttctttttttaaatcaaagttttgtaaatagatcttacttctgaatttgaatcggtggaagacctcagttcacatgctaagtcaaaacggcccttagtcacgaccttgttgtggcccctcccttgtcatcagtagtaacctatactcaagtgcctgtgtcttctcatctcacttaggattgtaccccaaagtcctacatgattggctttaaatgtccgggaaaactaatttcagtagcgtagtttgataggttaaatgagatagcatttttatatcagagacaccagaatgttggtggtcaactacctgtgcaatatttatgtcttgaaaaccagatctgagtatgcattgaacagtggggatattataaacagaagcgcctctctgaagaacccggtttccggtgttgagtgatagactggtttgagcgagtactgttttgtggtgacatcttaggtgtttcctttctcccaggctgctgctctgtggtatttccagtctcagacttgtgttgtggagtcatggtgttagtgttctgcctttttatgttctaagactacttgttagaggacggaagatttgctacagtggtctagagttaaaatgtgctctttagttgcccagcacaagaacgtaccactcaccttttgtattcataagctaatatgttagagttctatgtagttttctcttgtgcacctgcatcagaaaaccataggacaacaaggtggctaggcagttatcacccctctgctgccgtattcatcacccaggctctcttacaagttccttgttaatgcacaagcgtagggacccttgtacagactctggcagtattgatgagcctggcgctgtttgctttggtgcagcctccacagtgcgcgttcattttatcatattttggtatcggtaatttgatatatttcatggtggcaaaatattagctctattttgggactttttctagacttacatttattcaaa

SEQ ID NO: 33108 - DNA, 1243 bp, Mus musculus
atagtaagcagacatttaaaaacaatctttaattggccacagggtaaagggagacaaccctgtttttcctaatattttgtacattttaagacaatgatcaaatacagtgaacaataacaaaatcagcattattattattattattattattattattattattgcatacaaacagagcaactgccttagaagttagtgctcaaggatctatttagtaacaaatcccagagaatcccttgggtttttctacccgtcttcatggatgtgtagacaatgctgcaactgtctggcttctgagtcatcaaacactgcttgctgataagatacggacctgattccagttttctggcatactcagtgagagcaagtgggagagctcacaccagggccttgctctggatagcttctctgtggatcttcagtgggcccactgtttggaaatactcagtttgctcttctctgacctctgcctctctccttccccgactcggacagccttgtgagcatcgggaagagtgatcccccggatggcaaacagcaactttacactgcaggtagaccacatcgtagcttttgaggaagctgaaggcattgaacttgaactgggccacgttcttctcgggagcatggaggttggagtaggaactgtctttgatgcagctgatggaagaaacacccaggcctaaaaggttaactaatacaggacatgaatttcccccaacccacataaccatgctccactctaaggttctgaatcccaaatggggtgctttctactacctccattttctgaagcaacaactactactagtttccattgttaatggaaacctcatacctggccataaacagaagggaacaattacctacagtgaaaacagatcaaggttttcgctgcaacctttgccttctaggtctactctattttgcctacagggaagattacaaagtcgttgctacatttaaaagcgcacatagattatttaagaactggcaatgcaggtcagtgcttgcgtacttggctagcatctcctatgctccaggtacaatgcccaacactacccaatgaaagtatattgtaaaccatagggcggtgtaagtggtgcatcaagaagagataaaatgaagttatgtagaacatgcagctaaaaaagaaccagagaaggcagaaaagacagtgcagcagcttttcattttgtacagaacaaacttccaagagaacagaattgtcggggataagagg

SEQ ID NO: 33109 - DNA, 1218 bp, Mus musculus
gctatctctgtaattgcccagtgggcacatgaacagagtgaccacagtggcagagatggaggttatgtatgggctcaacaacataaatttccactcactgaggctaacgttggcaatggctgctgatgctgagtgccagatctgtcaagagcagaaaccaacactgaaccccagatacggcaccattccctgagataactaagcagctatctgatgccaggttgatttcactggactagtactccttcctggggtagatacttattctgtttgtggaattgcctttcctgcacagtattgcttctgaccaaggaactcgcttcatagccagagaagtacgacagtgggcccacaatcatggaatcctctggtcttataatgctctccaccatcctgaagcagctgccctgacaaagatagaatggccttttgaagacacagttccagtgctaattaggtggccgaagcctgggacactggggctgggttctctagaaagcagtgtatgctttaaatcagtgttcagtgtaaggtacagtttctcccatagccaggacctacagttccaggaatcaagaggtggaaaaggcagtagttctattcactgtcacccctagtgaccattagggaaaattttgccccctttttctgtgaccttaagttttgctggcctggaagttttggtcccagaccagatctggaagcattcctaccaggagccactaataaacattccattaaactggaagctcagacttccccctgggcttctgatgcccttaagccaaggctaggaaagaaatgacagtgttaggaggggtgactgatccagattaccaagggggcattggattcttcttcacaattgagataaaaacgatgtttggagccacgagaggtcttgagggtctctcttggttactaccatgtgttatggttaaagctaatgggaaactacaacagtctaatccaggtaggatgacaaagggcacggacccttcagcaatgaaggtaacgggtcattctgagaaaagagccaagacctgctgaggtgcttgcttgaaggtggaggaaatacagaatgggtaatagaggaagatacttaaaaataccagctaaggccacatgatcagttgcacaagtggcttataattggcattatgatgctctccaccatcctgaagcagctgccctgactgaaagatagaatggcctttt

SEQ ID NO: 33110 - DNA, 1256 bp, Mus musculus
agaatcttagttctaaatatcaaaaatagtagaaaataaaaagtgtagcttgtaggccatataattgacaataacaaaaagtcccaaatgttattttaaccaacaaaaggagtatgtttggctgctataattgaactatatgaaagatgtattatgtggtggcttttagcagcccatttaaaaaacatgtccctgtattagttttcaactataaagtttaagtaatttggcctaatcatctgaaaataatttattagatcatgcactattttttggtagtatgatttatttctgtattttaattgagtattttccctcaaacttggttattggactttatcctaaatagtaattaattgagaaattcaattttggttttcaaaattgattcttaagagaaatatacccccataagaaaataatatcacaatctcataaggatagggaatggagacttggtagtctgaaaacatacattcagtataaatatatgtagtcatttatatagtatattagataattttatatttgtgaagacaaagatctatgttttacaatgtaaatgaaaaacaggcaaagcctaatcagatatccagctggtgaagccattgatcagtgttagggatttacagtcgggagaagacgctctagttgcagaccctgagtcccctggagagagaagtagacagtagacaaacgagtcgcacatttccagaggaaacatcacaagttagatgtgaaaaatgcccgaggctcacgcagttgctggaaataatcgttacttctagatagaaagtattttggtgcttttgcaaaaggataatgtttattaagaaacttgacattttctaggtaattttgctttgcacagttaatgtttattgagctaaattaatttccacaatgcaaatcatagttaaatatgcaaggttgtataaatacagttgaaataggaattacattaaaacagtaggaagaaataaaacaaatttagaccttgaatccaaagagataaggtctacttgactttcaaatgggggaaatgatgaaaggcctcacccagtctcagaacagacagatgagtgtgataagaaaggaaggggtggatgcagaccctgacagggcagacaccttccactcctgtaataatgggaaagagcagggcttagagatgatgcagccgcgggagtcaggatgagtaaacagcctgccctcctttcctagactcatggcaatcctcctgcttcatgtgtaac

SEQ ID NO: 33111 - DNA, 1198 bp, Mus musculus
gaaaagctttgcttcctacaaacacgcgctttccctgaggcctgcttgcagccattggacacttggtctagtgtgtggatttctatgtcttctgtcgtaacagaattgtctctgtgccctgtgattgttttgggtagggacgctttgtatccttgtacagtagtcttgacgattctcctcccctacgccatttttgtttgtgtttgctatctaaaactgttatatttttctgttgtctaataaatcagagatttggaacttttaaaagttgggtgtttgtaaacattttggtagtgtcatttattgcataacaaggcttttcttaggcaaagtactctttgtcattagaggtgtcatttgactgaatgtaccatgccttatttattatatctgctcttgtaccagggggtcagccctgggtaaaggaatccacttgacttctttcagccagtttttgctcctgtttctttggaggctcagtgaggcctgggagccagctctgcagcttctcaagatgggcactgaccggcagcatctgcgtggctgctagcagtgccagtgtgggtagggctcatgcttccgtgggctgacgataccatcctctgtagacagagccaaagggcaggcccctctggacttagccatcagctgctatgtcactgaagccctccggacgataaatggtgtaccagccaggagctactggtgggattggtcttgtggtgtagtcgtatgctttttaaagtcataaccacgtgagcataaatttcaaacattgtataacttaaaaagagaatgggccttgttaaaggtgaccaaattaaagccgtgttatggacttgtgtttgaagtggtatagagagctgctgatggttccgtttggctgtccctctgtccctaaatgtgtctcctaccccttgtgtgccacctgtgcagctcaccctctcaatttgcctgtttattaaagttacctttgctgccagttttccaggtgtgttaccttggtattctcttttttttcccttttgaggtttctttattttattttatgtgtttgggtgctttgtacaccaacagtgtgcacagacaaagccagaagagggcatcaaatcccctgaaactggagctagagacccacgtaggtgctgggaattgaattctgggtcctatggaagagcagctagtgatcctaacctct

SEQ ID NO: 33112 - DNA, 1147 bp, Mus musculus
tatttttgttagctatccagaaataggaaactgaaatcagttttaaataagtcacccaactgaggaacctgctgacccagggctatcccagctcctaggacattctatgcaactccagaagacctcatctcgtgctgaatgctgagggcctcagaaaacatgcagcccatggagagcaaattccaagacagccagggctatatagtgaaagcccatctcaaacgaaccaaagtaaaagaggaggaaaagaaggaggaggaggatggagatgaaaaacaagaagaggaggaggaagaagagaaggaagaggaagaagaggaggaagaagagaaggaagaggaagaagaagaggaggaagaagaggaagaaggaaaaaagaaaaagaagaggaagaggcagaagaggaagaggcagaagaggagaaggaagaagaggaagaagacatggattcatgaccattcttctagtccaacgctggcaattacttgctggaaaagaatattaggggtcttccacatggactgtggtgacagttgtgctgttaagggtcttctctaggctcctggctcaggtgatttggatatacagctagtcttgcccccttggttcctctgtctttgttttccattaacaaacaataaaaggaatctgcaaaagttggctggtagtttttgaaatggaggcttgagacacaactgtgccctttgttctgagtggtggtgggtatccacgaatgaaaacactgctctgtgtgcccacaaagtctgggttggtttggtctgctctgtgtgtgtgtgtgtgtgtgtgtgtgcgcacgcgcgtgcaataagggaactgggccttttgaaagcacagtgacagcccatttaaaaacttctagtacaggggctggagagatggctcaggggttaagagctcttgtttttaaagccctggttcgattcctagtactcatgtgacagcttaacaactgtccagtttttgggtgtctgacaccctcttgtgacctctgtggggactaggtgtacatgtggtgcaccgacagacatgtaggcaaaacactcaaccaaaaataaatatttaaagaataaaaatgtggggttggagaggaggctcagtggttaaggtcctgagttcaattcccagc

SEQ ID NO: 33113 - DNA, 1254 bp, Mus musculus
gagtttcatgtttatgtagtcccttttctgaaatacatcctctccttctgtatatgccaacattcctgaatctggaaggagcctttctggccccaagcactgcagacaatggcgttctgcctgtaacagtctaaacttgtcattcaaacctagttatatgcttgccaaggaatcagtaaggcaacctcttgagtaaagcagtgacttagagctccttttcctgacactggggacactctctggtggggctgcactggctgtgcctatgaacactgggtgttcatatcttggaaccatttttcttgtagactgtgatgcttggaaggtgtgcctgcgacttcgagataacgggcttctggccaagccaacccacggtgatatcatcaggcttgcccctccccttgtgatcaaggaggatgagatccgggagtccgtggagatcatcaacaagactatcttgtccttctgagagtaggaactctggggagccatcttcagacagggctcttgtgaaactctgcttgcagtggccagagcctgtctcctgaaaggcatatatttcagttgatgcataatagagtgacacctaggaacctgcaggtggctgcgtgacagaaaagtgagagcgagaggcgaggcgtctctttgttgaggtttgactgtgtgggaactttctaaggagaaacggacccatctgcgtacagcctgcagatggaggcctgcagtcatttacgtgcgtctttacagtttccttgctgatgtgaatggtttgtatttagaagttatttctgagatactacagaacagttaaatcattataatcaatgaatgttaagttgattgaaggttaagcatatgtaaaatactagtttaaagtaaacttttcattggccaacaccagaatgtattatatagattctgagaattcattactaaattacactttgcttgattgcaatttgtaaaacatttattttcagtatttctttgaataaagcttaatgtttctttttacgccaacagagtattttgtatttccattttggtaataatcagtgtattatttcatcctgatgactggcatttcatcacctattgagatcactgggtgtgtttcaggccttttattctaaataaagctatgaccagtttctgtctgtacaatgatgtgaatctatttacttatttatttatatttaaattttgtttcatttttctctagtgtgttttgtgtaataacttcacaggagatgt

SEQ ID NO: 33114 - DNA, 1181 bp, Mus musculus
cagaagtacaggcagatgggtacgtggacaaccttgcggaggctgtggatctgctgctgaagtacacggacaagtgaccagccttcagagacagtggacaagggcacccctgctcccatactccatcactgtgccctcttcccacatacttccagggcaccaggccacccaaggctttgccaggacagatgctagaagttctagggtgcttgttcctgggccagagccagccatccccttcacccaccctctgcggactccttgtcaacattcctccctccctagcgtctgggcagaggtttgttcccctccctggcccatgccatgtttcccctaatgacatccaagaaggtgaaagagacctgtcaggcctccagaaaatgaaacccttgggctgaaaggtccctctgaaactaagtccctgaactcctttagtcacctttggcacgtggtcctttaattgaccatccaattggatgagatgcactgcctcctcgatgaactctctgaatgagaggagcctacagaaaccacagagctgagccagcctgcccaccacccatagccctatctggccccagtcagaatgactgatcagcactctgcctccaacccctgtcttaggaaacaggctgggataactctcaggaaactgaagagtaccctcccacagagagaaatgtccacctctacagtcaagactgaaggcacagaaagctccttagagttgggatggacagacttaaccatgttgtctccagtgtacagaacaagctaatggctcaataaacttgaccccaacagccccactttgactcagcctttcttagtaagggtccagagtagtaagagaatggagacccccagcagggtcttagattccgacgcctctgaacagtagagaggaacttctcccctgccctgacctctaagaagttaagaaatagactggcggggctggtgagatggctcagtgggtaagagcacccgactgctcttctgaaggtcaggagttcaaatcccagcaaccacatgttggctcacaaccatccttaacgagatctgactccctcttctggagtgtctgaggacagctacagtgtacttacatataataaataaataaataaatctttaaaaaaaaaaagaaagaaagaaaagaaaagaaatagactggcagg

SEQ ID NO: 33115 - DNA, 1099 bp, Mus musculus
cactcctgccttactcctgggtggtgaaggtagaagctggccagcaccacgggctcccttcatgtaggtccatggaacttgttctgcccacacatgcagatgtgtattctcagaaagccttactttaaaaaaaaaatttttttttgtagcaggaaagttttctaaatttgtatgcagaaagttaaataaaatgaaggcccacattaaacaggacatgctcactcccccagtttctagatgggtctcctatgcagaccaatggccatattttattatgggttcatttagtgttcacagcagttagaactcacccctggatcctgcaacccatttccactgatgtggttaaaattacttgaatgatggccacttaaaacgtaagccaggggccagggctcagggacgctccgcccatacaacccatgatgctgccccttgccatgcccatgctgctggtcccacccctgcccctggtgccaggcctctgaaggaggcagagaaagatactctagaattgcagactgatggagctcctttaggctagataggatagcctgacgtagcatagtctcattggcaaatgaactgcatcgtcagtgtttgggggcacccaggggtcagggacagatgagcccacaggccgtgctagggccacgtgtgccgtcccagccaggcagcagcagcagcagcagcagcagcagcggtactgtttgaggcagtgtggtgaatggcgtggtgagccagaacccatcagggctgcagcctgtaggctgcccatgctgggtctgctcgttagcaccacgcaccatcgcctgcctccccccctgacaggccgtgactgtcttgcactacagccactctagtctcaggaatttgcttgttccttttactgtgtaaataaagcttcctggtccaacacccggctgcctgcgcatggctgtgtgctttttgttgggggcagtgaaccagcagctctcctgtcagctctggactgggagaactgcgggacggacttctgtccccatgcctcagagagaaggcgaaatgctgggtggctgtgggagtaactgctgcccatagccacagccgccatcgcagg

SEQ ID NO: 33116 - DNA, 1189 bp, Mus musculus
agatttcactgtctgctggctgagcccaaatggctgttacctttctcctaaagaaagaccttgatgggaaccttttgtttcaactttaatttgtccatacaccagaagaaccgaggctcaagttctgatgtataaggcaatgtttctctaaaaccagacccaaagtacaggaagccccgctcctataaccccaggttgggtagcctggtgggtccctgtggtggtggtcggggcccagctggccttgggggcactgagaaagcaaagtagaaagctggtggaggcatgacctacaagccctgcctggtggatcacagaggaaggtagttgagagggcgtgggatgcacaccccagtgccctggttcccagaaagcccacagtgagggattctgttatctgaaagaactttatggtccctaaagctattcccactcccccaccccccaggaaaggagaggctgggctctgtcccctggtctgcttcacacaggctgttaaggccaaagcacagaacagttgccagctgcctctcctgaggactgggacctgagctcctggtggcaggtgtgtgtcttaaggctgatgtgtggccggcttgtccgtagactagctctcttgagcctgctggcggaaggacaaacaggaacttgctgagtgacagcttcatctttgcttcctgcctctaggagactgttccctgggcggcagtactccaaacccggggtgggggttggccctttgcagtttcctcaggcttttcttgatgtccctgtcccactaaggcctcagtccaagcacccagcaaaagcagccagaaaagatggtggtagcttttctgcctagtgtgttcatttgctttctgatgttcttttcatcaagtaaagcaggttttgtctagaaggtttccagtcagctttcagcagttgtgtgacccagacagacccattcatccaccccattcactggcccccagacctctggtcttggatctcctggaagaaggttcacctgggaggtccactctgtctcctgtgtgcgtggcagcacaggcagcaggcagactggctcacccgagtgccacaccccagagaagctgagggtgggcttcaccactcacctgcctaggcagcctccaccaaagccgactgggcctcttagcacgtgacatcccgttcactccagaagcca

SEQ ID NO: 33117 - DNA, 1198 bp, Mus musculus
caaaagcagtgtctgctgccgtcatggcttttttgcacagtctgcagtgtatcactctgtctgagctagcgcctcttcataactatgctacctaggaacacctctgtcctttccactgcagagcaccctgagaccattggccacaggcattcagggcttgtgggttcatggtgcccgctgtctgcacactgcctcacacagagtcggccccagttgcgctcacattgtgtgtctgtctcccagggtcttggggacctgctccagcaggcgggatctaggaaccatcttggattcctctgtacttaggagggacctgctccagttctctatcactcatttaatctgtttctttctggcaaactattgtgctggacagtgaaagcatagcccatcctctcattggactcatggggagggtagagggggggcagatctgtttgatgcagatcctacaggtgcaggatccagtgttgaactagatggctgagggccctgatctctggaaacttctgtctggtatggatagacaataaacaacccagactatcatgtcagacagcgttgtgaagacaagaaccatgggtgatacaatagaggtggtgggcacaaaaacagaaaaggcctttccataaaaggtggcatgagaaacctccagaggctggcaacagctaaccatggctgggcacagtacccagcagagaagaggcgctgaatgtccactcgtgctagttgaactccctccagaaccgggaggctcctgcctgatcccagcccctcttacgagcaagtggtcacctggatgctgatcgctcatctttgggagtagcaaaacccacttgtaagatgtcttctaggatcccaacagcgtggctctttctcttcctcagcaatgtctggttggcttgaggaagtgaggtgatggcatgtcagtttcaggagctcgggattttctgacagtcatccaagcgggctgttgcttccaggccagtgggtcttggtgccagccctgaatgtacatgggctcactaggtcttctagccatctgtgtggtgtgataaggtatctttgtgggagtagccctggggtttgagtggagagatacggtaactgtatccagaatctagccatgtcacctgaatatgacagaagtgtccagtgtggtgtgaacgtacaaattgtttctagactggacctgggg

SEQ ID NO: 33118 - DNA, 1192 bp, Mus musculus
ctttatagaaaagaaaggctggggaaatttcatagtggtcaaggtacatgccgtgcagagcccagcacccttgggaggagctgagtgtggtcttgtgcacacctgacactccagctgggtttggggagagagtagagactagagaatcactggactgtgctagctgctagccaagttaaaaaaaatatgaggtggaggtctggggagatagcccattggttaagagaacttgttcttacagaggagacctgagtttgatttcaggcacacacacagtgactcaaaattgtctatatctcaagctctggggaattcagtgccctcttcgacctccctgggcactgtgcatgtatgtgatgcacaggcatacatatgagcaaaacactcataaataaatcaactaaaagaacataaaaataaagatgggatggaaagtgacagaggacgctcggtgcctttctgtggtctgtgtactcacacatgtgtgcatcctcatacacgtgtgcatgcctcatacacatgagtacatgcacattttaagaaaaagcaattgcaaaaagaagcggctgcagcagaagagcctgcagcttttctcctgtgctcaggggtcagctttcctgacatagctcctctacaactctggccagcctgctaggcttgtgctgttggtaggccaagtcctgccagctgtgcgggttggagtgcttggcatatggccttcctgtttccttagagaaagatgtgtccatgggtaccatagagctttggtgggggaatctatgcttcaggaaaaccatccacagacacctggttcccttcttgtccccaggttctgtaataagccatcttctgaaggtcactcagatcacggcccaatgttgacataataggctcgatctcctggggaagagaaaaaaataggaattccccctgggagcatgccaggaaggcattcacatgccacttggtgattttccattcctcacttgaaaggcagtggtgctctggggactccaggatccttgggagtgagtgcctcttcctccctaggacagttccctagatgagagcccctggaaagttccttatcaaactgggagcacctttggcttgccagacctgcactgtgtgggcatagtcttagaatccctgtcttctagggcccacagcctctaggcagaaggaaagcagc

SEQ ID NO: 33119 - DNA, 1163 bp, Mus musculus
ctgtgtggttcatcctcctatccataggtaaagtgatgtgctgaccccccccacacacacacacacatatttgttcacacattctcactgttgtataaagttcacacttgtgaactgggtgcactgggaacattgaggagcattttatgacacaataggaatggcataatgtaggccatgtgccattgagatggaagctcggggagtccccacctggcctgtgaaacatagatttttaaggacctgaaaagcaaagagattgttttctgtaagttccctgtcctctgtttgcccaaagcggaagcaaaataaacccacgagcttcgtcttaagaatcagttttgtggcatccaagaatctgcatctctactgcctacctccaagttctacctcctccctccagctggcaatcctggaaccataccttggaaaatccctagtacagaaaatcctgctccccctttagcctgagtccacccacagacattggtccccaggtacagaaagcagatccccaacacaaacgtgtttttcagtgttgttctttcagagttacactgatggctgccacctctgagagattgctctgggcactttgctgggcctgtgtcttcttctctcagcagctgagagagaataggaaacgtggagaactatgattcaaaccaagggccttgccctttctcactctatcaagtgactgttgctcctctgaatccatggcctttgtcactttggaaagagttccagttgtttacgaagaagtggtaatgttgaatggcagggcggggcacttgctgtcttctgctcagagctccttgtgctctatgaagttggggcttcacacatagggctgttgccattacaagttagcttctgtgcctgttcttttgtgcggggatctgacccaacgacttgctttctgggccctcagtgaagggtggaagcccaagagctaaacatagcactggttgtctttacttgtttgtatttgtacttttcaaagtgacaagattggaaaccattagaatctgtgccgcagacaacacaagtggccacatggatgctatcgatacgcaccagcagtgctttccttttgcaaactagcctttatttacctctatctagttgtctgtctgcttcatacatagccaatcaaggcc

SEQ ID NO: 33120 - DNA, 1197 bp, Mus musculus
atgtctcttccaagccctgtagggtttgctcaccagctctgactcctgaggtgggattgggcagtgaacctcctgttcacctagttcccaggaaggctggcaaaggccttgacccagtcaaggaaagggagaagacagagtgggcctggatgagctcccgttggcccaagggtgggctgcagtactgcagcaaagaacgccatgccagaatagaaggtgagaccctgtgtggagcagtggtaagccacagctgaatgggtgtaacttgccttggggagatacctgtccattcttttagtttgtgtgcattttagacatactcttgtgtgttgtagagaagactgcaggaagtcacaattatgtgacatggtttgctgctacataagtgcatggccagtagtctgctctcttcccctgcagagcttcctggctcgctagcttcctgctgggctttgaaccaatatgacatgcctgacccaacccagtcctctccctgtatttggaagagaacagccaagcacagccactcctgtccagcttctgggggaattaaagttgggaagggacctatgatgttggtagctgttgggctttgagtacccctggagacagaggccgagtttttggtgttgagctggggttgaagagaggactgagccccgatgctgccgccagagaggatggatgcccgtgtctcagttcgcctttgtttagtttgtggggcaggccccttgctgctggtgatgccagggctggatcctagctggttatgtactgtgcttctggagaaggtggtagtcttagtggtacccatagtagatagactgaggagaggaaaaaggacaggtactctgtctgggtggggtctaaagttctgtcccaagtagagtaagaaacaagctttcactcagttcatgttgactcagttcaggcctcctcctgtggagagttgtacgactctggaaggcgttgcagagagcagtggccaaggacaggaaagcacttttccatttccttgtgggaaagtggtgctgtgctcaacagcctggattcacctggttcttcggtgtatcaaatgtcacatgatcctgcgcagtagagggtatcgaccacaggaggctggcttttcctgtggttactggtgatggcatggagctgagaacagtatgtagggtcactcaagacatgtcagactct

SEQ ID NO: 33121 - DNA, 1214 bp, Mus musculus
gtgcgattcatggatgtactagtgaatttaggcagagtgacccctcagtgtagtctgttcttaagataaatcagatcagagactgagcacaattagtctataaatagtctgtacgtcagaaacttacctctgcactatcatgccttgaaacttgctttttcaaagggaaacgaatttagcagcagccttcaaagaactttctatgatgagccaaattcatctttgccagaaaagaaattttgttaattccaagaagcctaattggaacaagtcagacattccttctctcatctgcatggttttgtaagatgagaagagagggctttgtttcaacttttttctactagcctgatacgtattgtcacttaaaatggttgcctttttaaaatgtaggaatactaatccccagcgagtactcatctggatcaggcccttgtcttttggtgcacgccagcgatgctgcgctgcatgcagtcatggagggaggccacacaccagcagatggcagaagggagaagccaggcctgagtctgtagtgaacagatcccagacacagtggatttaactaagttcctatggaaaggatgtaatgtacttaggtgtggcggatcctgggctagagttgtggaggaaagacgtttttgagaaaatatccaggaatcttggtgactacagagctacttcaagtatgaataaccatacttcttttttcccctaaagttgccatttaggggataattgcaaatgtgcggagaccattgggatgcacttacgcttttatttaattactgcttgttttctagttttgcccagaatgtgtgaaaccactaaaaaccatttttgagtatgttgggctgctggattggaagtggcaagacctaccatatatggcaatcaatcagcccatgatgcttggcgctgaactgccttccttggactagttaaaacgcgtaaggatgaggataccgttaaaaggtttcaaaggagtcatctcgtttgatagtgatagttactcaggagctccagtgcgcagtctcagacagtggatacagtcttagagacgagatgctgaccgtcctgctttgattgtgccccagggtctgcattgtaactgctatcctggttttctgggctcacaccacttccgtttgatttgaatgtcgagggtcactttatctgcagtgcgttccagcttttatcagctacctgctagc

SEQ ID NO: 33122 - DNA, 1492 bp, Mus musculus
tttttggaaatttatctttactatttttggaaatctccaaacaaaagtagaataatccaataagaaatttacatgtgtcttttaagaaatatatattttctaagttgaagggtattttttatttcgggggcatattttcagagatggaattatgtagctattattttaataacaatgtcctaattatttatagcttcctgcctgacataactcacttcaagaagtacacaatgtcagaacatgggattaagtgggcctgtgaatattgtacgtatgaaaactggccgtctgcaatcaagtgtactatgtgtcgtgcccagagacccagtggaacaattattacagaagatccatttaaaagtggttcaagtgatgttggtagagattgggatccttccagtactgaaggtggaagtagtcctttgatatgtccagactctagtgcaagaccaagggttaagtcttcatacagcatggaaaatgcaaataaatggtcatgccacatgtgtacatatttgaactggccaagagcaatcagatgtacccagtgcttatcccagcgtaggaccaggagtcccacagaatctcctcaatcctcaggatctggttcaagaccagttgctttttctgttgatccttgtgaagaatacaatgatagaaataaattgaatacaaggacccagcattggacttgttctgtttgcacatatgaaaactgggctaaggctaaaaaatgtgttgtttgtgaccatcccagacctaataacattgaagcaatagagttggcagagactgaagaggcttcttcaataattaatgagcaagacagagctcgatggaggggaggctgcagtagtggtaatagccaaagaagatcacctccaactacaaaacgggactcggaagtgaagatggattttcagaggatcgaattggctggtgctgttggtaccaaggaggaacttgaagtggactttaaaaaactaaagcagattaaaaataggatgaaaaagactgattggctattcctcaatgcctgtgtgggtaagtttctgggtttttgtttatttgtgtgttttgggttttttgttcatacgtttgggcttttttggccttattttgaataagatgggaaaaggcattgaaatggcttgaaaataagaggaagatcagtattacttcgcatttgacttatttggtgtgatagttcatgtatgcatgcataaagttctgtatctgtgaccttgtctgccttgtaccaaagtgtccacatttacttgtgaacatgctttttaagttaaagagactgttaacacatctgtgagaaagtatatacttggagtttgaaattgtttctcttatttattgtaacaagatgtgacagagcaacaccagctgctgtttctgaatgtttgtaaacagtgtgagcatcttgtgatgatagaggctttagtcagaagttaaaaatatcataaaaatgtgtgactccaag

SEQ ID NO: 33123 - DNA, 1157 bp, Mus musculus
gttatgtggactaggctaggtctaaatgtgtgtgccaccactgcctggtgacattcttctttagtaacatgagagttacagttggttgttcatgcatggcaaaaggctagccatggggcaagcttcactcccagcttaaatgtagtcggcttttatttatagtttgagttgaaaagttttgttgttattacttaggcgctcattaagctcttaggctcactggatcctcctgtctgagagacctaagaactagtactatgcagtccacaacatcatgcatgcgctcttatgaaccctatcctgaaaagtttgtatgtacatgttggggtttggggccagagttagatttgtggaaaagatccatgacttttcagagtttgaaaaattgtaaagctgacttcattcatgtctcacagatgtgatttaaaaggatttttgggaagattggtgtcatgtacttactgtcttttgtgcttctcatattgcctagagcacacaccacagatatcctgtgagtgtgaaaattaaatgatcaattttaagattggtttctttaataaagaggggactgttgtgttataccaggtataaagagtacttttatctcgattcctaatttaacatggcaattaaaatgcctttcaaacgcacactaagaatatttttagctaattttagcatttacttggaagaatgtttttttctgatacaacttaggaaacacagaaaaagttggtaatttgttttactgtacttattaaaagctagtgtgtattatctccccctcaaggctgtttattatccatgctgctcagtaagtactttctttacttaacattaatttgtgtgatggttaataacatagttaaatgggaatagaaggtttatggctttgaaaatggtatttattttatattcctattctaattgttttattttagcatatttaaaattgtataaggtttctttttaacaactatcactgccctgcctgtgtagtgtccccccccacccccccagtagaccatgttgtatggagatctgtctgcttctgtttcccaagcgctgggattaaaggtatacactatccactttctttagagacattgtttctctagcataggctagcctgaaaatcattgttgtagtccagactt

SEQ ID NO: 33124 - DNA, 1192 bp, Mus musculus
aaaagacattcatggtctgtgataaacagacacagatattaaattttaaaatctttgttttctacaacttactctagaatgaatatatttctgtgttaaacatttttggaaaacaaaattggaagggatttggaatttgaattatttattacagaaccacaatgtatttcacttatttagaaagtttacactaagctgggcgtggtggtgcatgcctttaatcccagcaccctagaggcagaagcaggtggatttctgagttcgaggccagcctggtctacaaagtgagttccaggacagccagggctacacagagaaaccctgtctcaaaaaacaacaacaacaaaaacaacaacaaaagaaagtttacattaataaattacatataaatattcttataggtaatatttttagcccattaaatattttgtaattgtgtagacatgaaaatgaatgtattatttaaatttcttatagagctagaggaagaatctcccattataaactggtctttggagttggctacacgtctggacagtagactatatgcactttggaaccggactgccggagattgtttacttgactcagtactacaagctacatggggcatttatgacaaagactcggtgcttcggaaagccctgcatgacagcctgcatgactgttcacattggtgagccgacagccttccttgtttcagtgtagaactgcacttgccagtagtgggctacttttctcacatataaatttttttaatgtgtacaggcattttgtctgcatctgtgtctgtgcaccttgtatatgtctggtaccaaggaagccagaatatttgatcccttggagctgaagttacaggcattttgagctgtagagtgctaggaatccactcaggtcctctggaagagcagcaagtgctctaaactattgagccatctcagccaggtgtggtagtgctcacctttaatcctagcacttgacaggtagaagcaggcaaatctcttgagtttcaggccagcctggtctacagagtgagttctaggacagccagggctacacagagaaaccctgtctcaaaaaacagcaacaacaaaaacccaaccaaacaaaaactattgagccatcttcctagcccttacataaaaaagttttaaagatttattttatttctctcccctctcccctctctctc

SEQ ID NO: 33125 - DNA, 2870 bp, Mus musculus
gtatcagctagttacatgttctattcatagtcttttgtgaatcattgcctttttgtttttaaagatggcctattttgagcctttgtataggtacattcctgtttttgtgacacaaaagaaaaaaaaaactttaaactgtcccaaacagaaaaataatggctatcagaaatgttttgttttagtgtgagttatcgttactgtatttgtttattgtaaaggtggacattttagcattcagtgcagttttcaataaagtaattaaaatttcttttaagtcctgacatttaagtacatctcacctctgtaaaagctagcccttgagatgtacatttacatctcgcctatgtaaaagctagcccttgacactgtcagtcagtttcgaactcttgtggtgacagtgtcttatctcacagaagtccaaattaggtaggctatcctaaagatgaggcagtgctttggagtgaagtcaattccagaaacaaaactggttaatttttagagttttgattttaatatgcccaaatgtagatgtgaactctttgtttgggggagggagggtaacctaatatttataaagtgactgaaaacttccacttgtacttaccttctgaagtagcactcaatgctcacaattccaaggttcctgttcctgagagaatgaagtgtcttacaatgtaagcctgtctggctgccttctttttaggagggtgctctaccttaactgcgctataaaatgagctcacgtggagtaccttccgtattacagatcttgtcagtgactgtggaaaaagaggccccaaccatctacacagcagtacttaacatttgttatggctagtgtagtaaacctaacagtgagaaacagaaagtcagatctgaatccatggtgtgcctaggttttgtttaattagattgtggttgctcaaacagtcctttagaaatgattataaactgactccaaagaacgacaacatcaggataaaaacaaagtactggtttcaccctagaaaaagaaccataaagtccacgtagttataaaagtattactgtccagtccatctgaaaatccctatacctgccacccagccatgtatcatcttttacaaaggacggcattacactttcttgggacaataattatggctgttggtttagttcaagagcttaacatagcgctgatttcccaaaggggttggccatttcacagccagcagtctgctagagaaactaatgaaagccccattcctatcttaagagtccaagaaatggagccttctttaattctttcccacagggaagaatgggtacctatcaaattatgtgtggtcagggtcactggtcataaataaataaataaataatataaatacagagggaactcaggaaaggacactcaagaattgacaatatgcagaacaaggctcaatcctgagcctgactctgtaccacaaggtttgggtacaacacagatgcacctagagaccagtgttaccctctcagctctctgtggcttatttgggaggaaggttttgcttaactggatctctgcctcctgaaaaatcaactctacacatggagatcagctattctagatgctatggatgctaagtacttagaatgacagccttctattgacttggttatcattcactgatcaaaatgaaaacgaaatagtcaatttgtagaaaaacactaactactggaacagtaacatttaccagtattgttaccacaattcatttatatggagtcacctactgtgaaaattactttctggttttagcatgcagcataaatgatctttcatcctgagaacacctttttattaagtgttcacaagagagagaactaaagacataacagctcataagttttttctttttagtattccagcaaacttaaaagttgtatacacttcaataccatctcatcagaaaaacaagatttaaaggtttcacagccttttcattaaaggggaggagaagaggaaatgtgtgtatttgctactttgcaactgcttgccacatcagtctaagtgcttatcaggacactacatgttgtgtgcctgaggaggtcagaaatgtttacccagtactaacatatacctgaagtggtcaattaacactctccataaattttttttctaaaaagtatggttttaactttaaataatgctacaactaaccaacatgcaaaaattctcagactacacagaaactgatcatacaatgcattgaccaccttactgcattttaaaaatctttattctgtactgaactgtattcccaatcagcctaaccaaaggcctgcccctaatacagggtctgcttagagcagaggtgacaaagacaggaagtagctgaagactgtctgcatggccgcctgggaacagaacaggttgagtccaagtaactgtcacataacccacccagggatgagtgagcctgctccctttccatccatccatccatccagggtagaagtgcacaaatgcaccgcccagagtcgagtaagaaccccctttacagggcactcttccaaacaaatacctaaataatgaaaggggcaaatcggaaaaattgaaaacaacagaaactaaaaccctcttcaaaaaacaagagacaatgtttatgttaagttcactccaaaaacttgctagtttttcttgtagtttgttcctaagggtttgattttttttttttttttttttttttacttttattgggcacaacaggaactaaattattaataaaataaaggcttgtttatttttatcttgccgtggataatttgtacaaagtttccaaatctctaaaacaatgggaaatgggtctggtgtggtgggagcaggatgtcaggtgctaatgaga

SEQ ID NO: 33126 - DNA, 1219 bp, Mus musculus
cagggaaacatattggtgatgtctggacctgaggaaaggacatgtgacattcattacattctaaatgggtattggtttgaaagtgcccatgataaataataatttaaaagaatcctctggggctggagttggctagtcaactaaggtatgtgctgttcccagcatccatactgggcactttacatctctctgtaatgctagctctggggaggcagtttctcaattgagatttcctcccttcagataactctagcttatgtcaagttggtataagactagccagcacagatgccctcccggcctctgggtacctgcacttacacgtacaaatataaagcataatttaaagtcttttttttaaaaagcctgtggcgtcttgacagtctgaggagacacattctgctttggtatggtaactcggtagcacttgccagcaaagatgataatctctggccagtcatgggataaaggggacagcatacaagatctgcaggcctttctttctcacttggacattctatctctgcacaggtcgcacagggcaggcagttgctgttcgagccaaggcctttggattcagcgtcatattttatgacccctacttacaggatgggatagaacgatctctgggcgtgcaaagggtctacaccctgcaggacttgctatatcagagcgactgcgtctccttgcactgcaacctgaacgagcacaaccatcacctcatcaatgacttcactatcaagcaggtaatgtgaaggcaaatgagctcttcttagcttcactgcagagtcaaatagcacctgccacgggcacagcagactacagggaagtgtccctgggacaaatcagtaatagagcttaggacccagctggcttccattcaccccttcgggcagacaagcacagctccaacattttgtaccttatggccctgtcaagaaagagaatacttctggcctacttttacggtcaagacttccaacctcttcccctgaactgctgctgcctatggtggggaaacagcagagccgcagagctccaagcttgcccagctttgtctcggaagcttctgttccagagattctccctgctactctaatgagataaagatatagccagcttctctttccttctgcagatgaggcaaggtgcattccttgtgaatgcagcccgaggtggcctggtggatgagaaagccttagctcaggccctcaaggag

SEQ ID NO: 33127 - DNA, 1117 bp, Mus musculus
gccagtcttagaatttagacatgtgggacggccttgagcagtgtcttgtacctgggagcctaaactccattttggaaggaatcctcattaagcaccgtgcctttggcttccttcccccaaattcccctaggtattgaagaaatgagccatggctccaagccagtggtcaacctaatccccacctctgagggccacgtgcgtatcatgctaatgtagtttacagtgggatgtacctaatatattaaaaatggttcagtttgtcagaattgttgaaagagatgggaaatctgctggtagctgtctgtgtttgggcctctgcctttgattttgtgttccctgatatgcagatgacgtgttcccagttctcctcacacctggtgccaggtggctcctgtcacctaccctgccacccctgtttagcaccctttcccagccgataggtctctacacacacacaccccaccccaccccctttagtttgccctgctattagcagattggccgctgggattcatacctctagccttaacaagatgtaccacggacccacctcagcctagggaaagaacaaagaatgggattcaccaaagaaaaaggagaccaagtcaggaagggaaacgatcactaggcaacctggagtctgttacccgggtaacagatacatgctctgatattgcagatggacatcttagttggtggctctcagccactccagatgcactggatgatggctcttgtccccggtgctgtcccccttggcgaggtggggtaaattacacctaaatctatgcctaaacttctgactttgtgcaatgaaccaacctgttagcccctttaaagccaagctttttacagactgtgagtgtagggggttcttacttgtgtgtcctggtgctgccagcccctctacccacgtcttggagtttggccctcagtagagagcaggcagggctgatgtcactcaggctcatgtgccacagcctgagtgctcatctgctgagcggatggtgctccatggctgattgactccaggatgaatccaggtagagctgtgtgagatcactgccacctcacttgcccctctgtgacctgggcacagtagccatctccagcacct

SEQ ID NO: 33128 - DNA, 1177 bp, Mus musculus
tacgtccagcctccatagtgttccttcagagaaccacttcacccacccccacaagttctaaagatgaggcctgacatcttggatctttccctgggagagatgatccccagggaaacaggccttgtattgtggtttgctgaactcactagtgaactgtgaagtcccaaagatgagcctgttttctgtctcagtgtctcgctcaaaagatcagcaaaatcaagccctatataatcttccaaatgcacactggtttttttttttttttttttttttttttttttttttgcccccacagcaagcagagacaaagactggcaacatcctgtgagccactaccccatatcttcaactcccagagatggttgctcccaaggtcaaggttgaaggcaaaaccctgattttggactattgagtagggaaaggtgtgatgttgcctggtttggctccttccttctgatgggtccagcaggatctgtgtgaatcagaataggtgctggcatttcttggatccaagcaaaattcaaaatttcccctgaatgctctggcttagactcctacagcttgttcgttctcgttcgttctctctctctctctttctatagacaattttccacttgcctgatatgaaattatatgttatcttttatgaagctttctgtagttgtcttcctgtataagccagcagaagaaaccagcatttgccaacatctggctctgtgttgcacacactgtcttgtgtgtcttgtctacctgcctgcatgtcttttatctatccattcacccaccacctcattattttatttaatgacccagtgctcaagacaggtgacattgtgaacctgtgtataaaatctttctttttacattttatttttatttcatgcatatgagtgttttgtctgcatgtggtgtatgtatgtctgcatgtatctatgaatgaaagaatgaatgtcagtgtcatatagtgccctcagagggcaggaactcttgaaactagaattacaggtgttagtgaactaccatgtgagtgctgggaacaagcccaagtcctttgaaagaacacccactgctcttaaacactgagccatctctccagcccaaatcttttttttttttggagacagggtttctctgtatagctctggctgtcctggaactcactttgtagaccaggctg

SEQ ID NO: 33129 - DNA, 1101 bp, Mus musculus
gagatgggaaagatcaacatgcgttagttagttagtagctgtgaccacggggaaacccaaggtgagctgttcccacttacttaccaggctcacaggatccccggggactggtgagacagctctgtggataaaggtgatgggagttggcttcctagagcccacatggcacgtggtaggaagtcctttggcaaggtagcctgtgccctccatgtgggcatatgcacattcaccccgtaaataaacgtagtaaaatttttaattaacaagagggtgactaggtaaaggtgcttgccaccgagtgtgaagatcttgagctcagtccccagaacccgtatgaaggatggagaaactcccgggttttcctctgacctcaacttgtagactgtgtcttgcgtggatgcctgcttcctacttttcaaattaatactttttttatttttttattcttcttaaattttttaaagagcacagtcctcacacgggtctgagctcatggtcagggtctaaggcacgcatggcacccgtcatgctatcctctcactgtcggacttaacagctgagctggcctaccttcagttggaaccctttactttcttctggaggacagaggcttgcattgctaagttgggaaattgaggactgttctgttccaaatgatacagtctgatttgggttcgtggttagcagcagagcaatctcaaacactgtagacagaaccaacagttgaagaaagacgtttactgggggacaaggaaacactcatgcagctgacacagacaaaaagaccctttgtgacgcctagcagttttcttcgccacatttagggttgcccagtctgaagataaacagggtggtccgaaactacgtatgacacccacggatccagcctcggacttgctgaatcagtccatcagctggtgggagactaaagttgccaagctttggtctgaagtcaggaagttgaggaagaagctggccttggagattcatcacctttattaccttggacatagtggaccttctccctatctgttgcctaccaggagtctaactcctagtctttcaccataactggaaagagagaatggaatgggtcctcgt

SEQ ID NO: 33130 - DNA, 1128 bp, Mus musculus
ctttacaagttctgacttctgtttccttaagtagacttatggaagcttgatttacctgccccttagtgaagttaagcagagtgtaaaatgccttcatggtagttgaatttacactctgttaaaatgatttgtgcactttgcagaaagccatgatattagatgcataaatattcagcagtgttaactcaggggaagattttatttgacaggatcgcagcaagtgctgaggtacagacaggttcagaaccatttagcatggtggccagtaatggacagagaatgccagctagggttttaaaattctgcctaaaacgttggaaatcaacaggaaaaggtgtaagtgcttctttgctggtgtagagtggaagtggttttcattgaagaagagctgtggtttctgttgggctctgtttcatttgagagaatgcctggttaataaaatcactgctgagggtagacctttgtcctgattttggagctgattatatgcaaattagtaaccccgacaattatttggatcttctgtcaatgggaacacacgatcctctgagaatggaccagtgagggagtccatattgggacatttcagggaaatgaatagactgctggttcttcacgcactatggtgtttacatctgtagtggcattcctggttgtcagcatgactatatctggaatgaactataatccagaattggaaggctcaccagtgaatcctaatctggaggctgggagatacaagtttctgacctggatcttggcatggagatcttgagacatagtggctatgaatcccagaagattaagactgggagatctctgagttcaaggccatctgggccacaccttctgctggagacctacttaaggatgtgaagaaggaagatttctctctcccctttgtctgcttgcctctttggactgagcaactgctagatccttggacttccattcacagctgctgctgaccattgttggggcgttggactacagactgtatgtcatcaaccaattcccttactatatagagactacccataagctctatgactctagagaactctgactaatacaacatccaaacattgatttgatttttttatattcagtgagctgtttcaaaaatga

SEQ ID NO: 33131 - DNA, 1174 bp, Mus musculus
agcactctggccaggggagatgctttctccttctgtccagatcagattattttattacatgaacatgaaaaccaggagcacacacataatcagggagtcagcaggttcacacactactatctcattaaattttcaggcaaaagctgcaaaaattaattggagacgtgtaatagtttagaatgtgaaccggcttacggtgatataaattacaggaggagaagacagctttatatactgagagaggcaaaactggtttcctttaatgagaagagataggatgcggagctattttttcattaccgatgcgctctaaagtgtttggacttcgctgatgaatagagttaattcgccgctacacttccaataattcatgttgcacagtttaatgacttctagataaaaacaggattgaaatgttaatttctctgaagaaatcggggcactcttgaatatcagacaaccccccccccatcctcatgcatgcgtgcattaaaccgctagttaatttcactaaacaagtatccaggacgtgcttcttgccttcttgctgcggtgatgttggtatttcctaccttcgtctgcccttttctcagtctctacacatgtgagattgactgtcttatgcaagaatctgtcaagaggagcccgtctctgtaactcaacctgtcagtgaccgcaggccacccgccacctctcttctgagcacagagaacttacttttagacttgattggctgttgttagccatgaatttaaatatctagcttgtctgctagtgattggtctatattgggctcgtggaccaaacatggtttggtctcatcgggaagacatattttctttaataattgtgtatgtgcgtgtttgtgcctgtgtaggcttcagtcacagcatgtgtgcctgaagctgttggttctccctcttcttcctccttcatttttttttttcttttgagacagggtctcatgtatcccaggctggtcccaaattcatgatgtagcagaggatgacccaatgttcctgccatgtgccccctttcatcaggtgccttcaaggtagcaagtctctggtatcccacatcggtggaaaattaacttggctgtaatcagcaccatctagcttctagtttctggttccttagaaatttcatgattcttttaaggtaacctttctcg

SEQ ID NO: 33132 - DNA, 1160 bp, Mus musculus
ggatttcatggaagtgaactgaagaggtcttagcacctggtacagttagggaaatcctctcctcactgtcatcacctgtagcagccacaggacctgcagggccatgagttcagcataggaggggctgctccatctggagacaaagctgcccagggtgccagcacctgtggtcaataataatgaaaacttggtaggcaacaaagaatatagaatgattgttttctttgtgagaattaggggatgggatgcgtccttcctttgcagcagcctagtggtcttcacccagccatggcaggtttgggatgtctccgggttcaagtctaattcttgcccacttttgtggaggatatgctggtaccatgatgcgatgcgtcagccgcctgctcctatgatgggtgcatgcagtagagtgaacacctgctaacagtgtgcatccttcgtgtccctcttgatggcttgagaccccacaatttgcctgaaacttctatctgtatactaaagactgttgacttatgaagaaaaacaattattttcaatctgctcagagccaaggactctggaaacacagtcattagagggctgccttgtgtgccatagggtgagagagagcctctcacaaggtggttagggcacagagctagtcaaactgccgcagggtaccaccctcgtagctttccctgatttttttgtttatttctcaaaggctacatctccaaatacatgacctcatctgaatttaggatcaagcgtccaacatttgacctacgggaggggaataccttcaactcatagttagcagggcctgagtgaggtctcttgcagcctccatctctccccagcctgggagaggatgaggacatgatggggctttatctgagagaattgggggaaatgctggtgagcacccaccactagacatgaaaggctgttagattcaggtcactgggtttggactcctgcgttttatggcaaagtctaaaaatgcagatttgtaacaacgaacgttaatgaattcagactgtttgaatttcacgctgaataatggctagaattatcagagcccacagcttttgagatctgggatcgtgcaatcttttctcaagattaaattgatagaatgatgtaatactgagttacttttattaacagccctggccgta

SEQ ID NO: 33133 - DNA, 2264 bp, Mus musculus
agagagacagagacgtaaacattttgtattctaccaagcgaataattgaaaatgggaagagtttctctggcacaccaggcaggacaagccatactacacggagatgagctgttttgatcattaatacttgatcccctcctgtgctcagagactaaagaatcttgaacactgactaaagaggagggaaggtgttagaggagataacccacgagtataggaggagagcgaggtgtaggtaactagtgctgccaccgcaggaggaggatggtcctttggatggaggctctagacctttcaaagctgtgcatgtccttctgttcctgacactcaagagactagaatgactacattatcctaccatacttgggatactgggtgcttggtttgtaagatagtggtgatacagtgggcagtgaactgcttctttgcctgttagcccggcctccttgttttaaatgaggaatgctttgttagcgacctagagcatcttcagatgctaggagtggataggactgagcatcttgctgcatgcctttaccctagcatccctgaggtagacagtcccttcctgacccccgcattgttatggtgggggacatcatggctggctgaggggctcgttagtgactttatggcttttgttagagtgtggtggttttttttatttgtggtgatactgaccaggttaactggtgagtttgcggggagagggcagacaggttaagattgtcggcaagggttcatgtctgtaaagtgtggctttcccctttctagcaggagggtgttttccgtgtgtgagcactgtagttgcatagcaacccccactggtggaattccatcttcatggaaaagccacagagaaagacacctggccattcttccaggccagatgttggctttttcctctcatccacaggactggcttcagtaccctgcccctgctgctgctctgcctgcttgagcagcaagcaggtcaggtgcctgcgatgctaccatgtatttccccctgctctacctgggtaaaatgaatgtgagtgctgtttaatgcaatacctagcttcatattgcatttgccaagaaaagtgcgattttattgaacgttaggattgaattcttaactgggtaatcaatttcagtagtgagttaaaatgccttctattaatggacagcggcagccgttcatcagagttccagtagattagcagttgtcagcatttatgctaatagcacttataaaccaggagcttatgaaatgcactttataattctgtatctcttagaacacttgctaacactttttgcttggaggtattgattgtttggttccttggcgtgctatgtggccctgtaaaggaagccaagtgatattttcatgccgatgacactaccacctttctggttctgcactcttggctttgtgtcagagtggatggaaagggtccatttgttctggtgctctactgtttaatttgatcagctctgcggctacagcaagacaaatagtatttttaatgaaaccatttaataaccctggtagctttgagttgaaggcattgggaaaatgcaattaaagaatggctggatgtaaacagatcagggctgtttcctcgctgactccatccattgcatttgcagggcttcatcactgtaaatggttgcaagccgacaaagctgcacctcctgaaaaagacggacagcccatcgcgtgagctgtagagtttgtggacgcatttctatcggtgagttactgtaaaatatctccaggtaaaagttgttttctaaaatcccctttggaaggtgttttcaattagcagatgactatggatcgctggcagcctctggatgcttcctcgggatgtctcatggcaggagcatattgattgtctttcaattaattgcatctggtattttcatttatcaaaagcaaaatacatgtaattaactctgaagcaatacagtccagtggcaagagatccctgctgctgctgctgctgctgctgctgctctggagataagtcagcggaaattatcttacaaggaaactctaggatggtaggacttttggacgtattaattaaagagaataaaaatgaattagggagatggtttcttgccatccagttactttgtaagatgggagatggacggcgttaaagggtcgtggccggctggcaatggcggccggcatggcatggcttatgcttttggagttccagccttggggatgtcttgtgcatctaatgactttttttttttcccctgag

SEQ ID NO: 33134 - DNA, 1196 bp, Mus musculus
caagtctaatactggggagctccagggtttttttttatccgaagtggagatgcctgtgtttctaaccttactggttagagtaaggtacttcagtgcgtactcgatttcactggttggtaacattttaacatctctgtaatcgtggttattaaatcaatccacgccatatcttgacagctgtttttcctcgcttgtggtttataaagtcattctggtctaagttttactttatggtgccagagactgaacctggagcttctcatatactacacagtttgctcttctatttgaagatagggccacaacaactaagtttgtaatcctcctgtctcagtctcctgcccagctccctgctatctctggactacatacactgcatggatggtcatctccctctgcctcccaggccctctagcttcccccaagagtctgttggcttggcttcggcctgtggaagagcctgattccaatacacatctgtttgtaatcaagtgagttagagaaatcaggttgtttttttttttttttccgttctggacaggaggctaaatttcttccctaagatttcaggatgcatccctccaaaactgagaatcctctaccaggtggtttcaggatcttccctgatgcaagagcgatggctagtattgcatcaagggtcaccgcagttgagtcttttatcgaagtatgtgcttttatcgcagtgtcctgccatctggcaatgaaaatggagtggatgccgcctcaaccttttagagtgtctgcactgtattttaactgggaagttacatgcattttctctacttaatactttaaaaagcctcttgggtactgagagaggcttgtaagtacagctgcctgtgacctactctggaacgggaacttcgcattgagaaatcccactttatttaatggcagccttgttagaatcatgtgttgtttagcagtgtccttccaaagggacctgacaagctgttgagccaaaaaaaaaaaaaaaaggctgtactaccctgacaaggcttggaatgagagagtcaaatgccctgtgggctgctggccttaatgagcctcgaagccatggggaaacctgggagtcgttacccttgtattctgatcctttctctgggatgagatcataagttgtttgtttgtttgtttgtttgttttaatgtattatgtatatatgggtgtgtgtg

SEQ ID NO: 33135 - DNA, 1198 bp, Mus musculus
agggtagctgctttccggggtggttttaggctgtgactgtgagagagccattgtggccatgacttgaactctcactgatgaagcctgggtacactggaaagacacccgaggaaaagggaaggggctagcctgctggaataagtgcaaagtggagtctttgggacctaacgacttcctgagtttgtgattgactgtgtttatgaagtctggcgcacacctatctgcttccacacagacatcttaatagagattaagtacagaaggaagccgatgcatgggcagagatactcccataagcaatattgtagtgttagacagtctaattatgttctgtacacgtcccaattaaacagacgtcactggaggaactatctcttagctttttggaaaagctttataatttagtaagtcaagtgaaaagagatgtccagtgtggggtgtcatatacggttaagtctttagaaaatgctttcctgacctgattaaaatcaggtagatatactactgtgtgctgtagttccaggagagcctggagcttcaggggcagctggaacaagaggtgggccattcctagggtcagagtccttttctcctagtgggttgggccacgtgattgacttctgctgtgagtggataagtgcatcatctccagatgtgttccaggtacttcctggggaagctgggccaagataccacatccctggctttatggtttcatgcagggtgtgggtgggtgagggttcattcaggtttgttaaagttcttgggtggccctcgttgtctctctctctctctgaagtaaggagcgttaggtaagatgagtctggagagaagtagtgtttgggagtttttggctgtgagttcccacttcatttgaagatgatggtgggctgctgaggtagctcaattgatagagtgcttgcttccatcgcagctccacataagcaccgggaagagtggagtcaaaagaatcggtcttcagctatatagtgagtgacacagatagcctgggttttactggatagctccagctagcctggaacttgctgtgagtagctccggtggctgatctcacactcagaacaattctctttgcctcggcctcctgtgctgggattaaaggataccacaccctcccagctgaagttatttcctataaaagccattgctgtgcctgggaaaatgaaccggtgttcac

SEQ ID NO: 33136 - DNA, 1239 bp, Mus musculus
aatggaatatgtgtcatggagttatgaaaggttttttttttttatttttttaaagccctatctctgagttcagaaaattatatttaataatcgccaaaaacttcagaaccagttttatagtggctcttttgatcatgatttaatgaaaagtatccaaaagctatcagtgtgactctaatgatagtcacaaatgaatgtttgggcctaatctggagtttgcttttagatgtcattattaatgtggaaggcctaaattatggctgctcttgggcattcagaacttctcctatgaaaagaagggccttgcacattgtgtggaagagggggattcacagatgaatatagagtctaaagtggtgaaagagcctggccattgtttgtgcggaatgttgacaaagggagccaaggggcagttttccccttctgcaggagaacacaacagggatgggaaccagcctggcattcatctgccttggtcaggcatggaaatttggccagcttcccttcctgagtttttcttagaaggtggtcttactggactccaggagaatacatgctttggttcttagcagtctgcattctttttgaggaaagattacaagggcaaatagaagcagtttccgagaaaagcattaagaatgacaactccctcacccccccccccctttcaaatgtgatcttaggagaacactatctatacagtgccagacactgaggcaactgaaatcccaggaaggacctgactttgtgtttaattcctccctgtgctccggctttgcctttagggaccggatcctatacttgactatttgctatagggcctgcctgtttgtggctcctgctgttatttctgaaaaggcttctttgagtcttcattctcagagcctttcctcgcacttccacgtgggacccatgatggctcaggtgacaggcattcctggtacctcgtaaaaatctccatccaaactggaaccatgtgggtaattgtctattcccagggctgcgtctacctggtatttagcaatgtgcactcataattttgaggccccctggcagtttccatccaccaagcttggtcccctgtgggtgcttagaagtgcccggcttgagctgtaggcctaacgtagatttaacagttggctgctagagtggacttaaatttcatagaaattgtgataaaatggttgggttctgactaatggggcaagcagtcatgctagttttaaaaggaattgtgac

SEQ ID NO: 33137 - DNA, 1159 bp, Mus musculus
taatgggactttaaaaggatcttgtttttataattacttcatctcaaagagtacttcttaatagcaattacagagtaatattttaaatgccaattcaacattttcagccccagcaactttaacgtgaaaacaaggtttcctttttagtgttccaaataacaactgtatcttaaagttggaacattgaatatccttttgtctggctctgacacactcctggaaaaacccccagtgccctttttatagccccccaaagaaaagttaatgagctggtaggtttcaagctagaagcaggtcctccctcttgcaaaatatgcttaaagtcgccattgaagttgaatgttagccgtgaatgtacttgcctttaatgaaaccagtttaatcgttcacacttgatcaagtataacatgaccaaacaaaggaaataagccagcatatttctgtagtgcattgaggggtttagtgtaagtgttgatgatgggtcgcccctccccccactctgccccagttcaagggagagcgggttgaaagctagggggatttatgacactgattggtttttctgtgccccaggggtaggggacacgggtacgtctctgtggaaagcagctattagagggaatccaaagatctcaggtttgcagtgagttccgaacctgacaaggtgcgtttttggtttcttgtctggggagatacttaagctgaaggagtataatgcccgcctccctcccccgtggtaatggcaccttaataagggagagtggagggcggtgtggtgtgccctgctgaggggagctcgctgccacgtgagttatttacggtttcatttgggagctttgaaactgggctcttgaatgggtgttcttgtgggggaggggcagggtgaattaccttttcttagctgtgatttaaaaaaaacaaaacaaccccccccccaaaaaaactcaaccctttgtcccgcaaaatgcatttccttgctgagcttgagttgcaatttatgtgtgggatttagtcgtcaatttaagtgaagaaatgtctgtaaaatttaagtgtgtcatttcagagttaagaaacttaaaaaaaaaaagaaaagaaaaatcatccaccaaaccccaaacactgcctctgtaaaaaacctgtgacatacttggtgaaatat

SEQ ID NO: 33138 - DNA, 1246 bp, Mus musculus
tccatgcttgatcagccccagctcccactcaactttctccatgacatattctttgaccatgtttttgtgactgctcccagtgcctttttccagtgcctctgctgggaaggcaggggtctttctctggtttactcaacagccatagataagtcagatactctaagaagtgcctgttgtttccagcccctccctctattccctcacctgtttgtttttaacctcagcagtaacgctgaagaagacatagtcctccaaaccaacaagcagatttactcccagcttttgagagcgactgccaacagaaactcaactctgctggaaagaattgaagtcgtcatctgtttgctggagcagcttgcctccggtagcagccgatcgagtggcagtgctgtcccctgactgcagtggtactggaggactgtcttgtcagtgccttcccgtcctggagctgtctgtctgtccactcggtgctgagacttattaaatatgaggacatagcgtttaatcaggtccacagtggatacttgcttcccatggcaggcagaggatgtggggtggttcggcttcttgtgaaggtgagaaactataatggaaccgaaagctttgtaaatgtatttcctcgagaagtacatggttccttagtgataacacctcctgcgatgtcgcgagacttaaaatattcttgacgttaaaacacttaggtgtaagatgcgattattttggataaaatgttactctggccaagggaactcttattcaagtgatttcatggattcaaatggcatgtagaaacagtgcgcatcagcgtctacttctaagtgacacaaaagtgtcccctttccaagctgtggtgtgcgcgggaggttttgacgactgagaattgtgcaggtctcctttcagtgcatgctctgaagagactccttctctgactgtgtatgacattggtaaagaataggtactatcactttctcattttaaacttgaaactgtgaataaggtaagagaattattttgaataaataagctatttatttaaaataccttggtagttcccacttgcattcttcacactgctgtgatttgatctgcttgcttatgatatcaaacctttacaaagtacatggctcctaattttcaaggcaaaggtttcccctacattcctgctcctgggacattctgctgtgccctgctgctctggggatcttgtccagtgcccactgcatgtggggccgtcaagctgtcacta

SEQ ID NO: 33139 - DNA, 1116 bp, Mus musculus
gagtcctgcgcagtctcagcagaggaactctgacctgctcacaaggtcagcagccaggtgtctccagccttgcaggcaggtctctgtcagagctatcagaccctgcggttggaacaggagaacagggggaatataaactctggttcttgcctctcactgggtctgtaacatgctggctgacccttctggagacttgcctggggagctgctgggctagagtgctggcatggctgtggctttcctcggaggttaggagctgggcatcttcttttcccttagcacattgaatgggtgaagagagaaggacttccaatgcttttcaaacgatgatggataaaacagagtatatttgttatgagctgtagcttctcaaggtggtattggcgtttgtgatttgcaaacgtgtgtgctaaagtcttctgagcttctcctgccctaagatgctcttattgccagaaggctctctagcttttacattgtaatgttcctctggaagctgctccttaaaacagccctgccttttggactgaggcctcctagactgtagacagaccctgggcagagccacgagcagctttcagaagcaggcagggaatggtagagaccctcagcaagtttctggctctccactttttgcaatatggaaatagacagctgttttgattagctttgactgtcaacttgacatagcctagagtaacccgaggaatcgcagtcgaggaattaccgagatcagactggactgtggatatgtctgtgggggattgtctggattgataattgatgtaggagggtccagcccactgtgggcggcaacattctttggtcaggtggtcctgggttgcctaagagagctagctaagcctacgtctgtgaaaaagtcagctaggagcattcctctacagtcagtttcttgcttcaagttcctgctcttactgccctcagtgatggactatgacctgaagtcaaccccttcctccctaagtcgggttttgtcagagagcctatcatagccacagaaatgagtctagagcatctttctattaatttttaaatttttttattttttatttatttttattttttacttatttactttctatcttgctcactgcc

SEQ ID NO: 33140 - DNA, 1175 bp, Mus musculus
tcagaatagagctagggagtttaagatggttcatcgttaccattccttgctgtttgctttccccctttgcccatgtggcatgtatgtttcccacataaacccgggtctcacatgtagctgtagctggcctgggcttcatagagagccacctgcctaagattaaaagcaaggagcgccatacccagctatacatgattcttcttttctttttggtttttttcaagtcaaggtttctctatgtggttctggctgttgctatacatgattaacaggcatggtctatatagggagtcccaggtcagccagaactacacagggaggccctgacttgaaaacgaaacccaaagaatcttgggtaaagaaacacagagcaggatgacgtcattcagaatgtaaagaggggggggggcagacgggtctggagggaaagggttctgaacgttgccactctgcactcaggacgcgacggcagaaagacaagctttggctttgcaaagtggaaaattggtgttgtacttctttccagccgaataacgtgaagttgaagtattttccttttaaaacagcaaacagatgtttcagaagacagtgatgatgaagtggatgaagatgagatctttggcttcataagccttttaaatttgactgaaagaaaggttagtttcactgagtggcttttgaagcctgggatctgcggtaaggacggagtcttctgtgtcagactgtgatactgtcagggcaagtgctccttcctgctctgttctcagtgtggagcagtcttgttaggagtgatttgtaccagcttaaagctgatttcttcaggtggcatggtcactaacattgtagtgtctggtgttggggcagcgctaccgacgctggatctgtttgcgggatcctgcagccggtctctgctctcagtacagtgtgcatacagagggagggtttattcagcagcttccaaagttgagagccggcccttaacatgggttttgttatctctctttattgactcagaaatgagttctgataaatctatgccagccgcttattctctgagaagaaggtgcaggccacaggccaccttcagttttcaaaggaacattccagttaattccaactggttttgtgaggtgtagtaagattgctgttccagtgtgtgagtgtaaattataaac

SEQ ID NO: 33141 - DNA, 1100 bp, Mus musculus
aaaaaaggccctagaccaggccagagaggagatatggaacgacttctgagaagctgcggagctaacatcggcaagttaggaaatatgtcatgagctggatcaagcctgggatgatgatgatagaaatctgtgagaagttggaagactgttcccaaaagctaataaaggaaaatgggttaaatgcagtcctggcgttccccactgggtgttctctcaacaactgtgctgcccattacactcccaatgctggtgacacgacagtcttgcagtatgatgacatctgtaagatagactttggaacacatataagtggtagaataggattgacgttctgcgatgtcggtgaggccattcaagaagttatggaatcctatgaagtagaaatagatgggaagacatatcaagagaaacccatatgtaacttaaatggacattcaattgggccatatagaattcacgctggaaaaatggtgcccattgtgaaaggaggggaagctacaagaatggaggaaggagaggtgtatgccattgagacctttgggagcacggggaagggcgtggttcatgacgacatggaatgttcacactacatgaaaaattttgatgtggggtatgtgccaataaggcttccaagaacaaaacacttgttaaatgtcatcaacgaaaacttcggtactcttgccttctgccaaaggtggctggatcgcttgggagaaagtaaatacttaatggctctgaagactctgtgtgacttgggcattgtagatccatacccaccactgtgtgacattaaagggttatacacagcacagtttgaacacactatactgttgcgtccaacctgtaaagaagttgtcagcagaggaggtgactattaaacttagtccaaagccaactcaatgtctttattttctaagctttgttggaacacattataccacaagtaatttgcaacatgtctgttttagcagtggacctgtataataccgttacccatgtttaaaggagtttgatcaaaggcaaactgtctacatgtaattaaccaaggaaaaggctttcaagactttaatgttaactgtttttcccatctaggaaatgct

SEQ ID NO: 33142 - DNA, 1125 bp, Mus musculus
gggcatagccttcatagctcaggccgggagccagctgcctccatctgagaaggagagacctagctcttcctgcactgtccacatagggagcttaagctgcctgcgagatagaacgaagaagaaatgtctgcaggcagaccccgtagttggcttctgtaccccaccctttaaggatgtcccctcagcctccctgtttctcaggttgtacaccccttgtgctgagtgtgaatgatggaaatttttacctcaggaaaacactctgtgatcacaggagctaactcatgtcaagcagggtgctcagcctggttacttctcacttcctgggcttggtcagtctttgtcacaagagctatcctgagccttgaaggatgcactttctgtctctgggtgggaacccccccctccccccccccccaccccatgtctcagtcattgctaagcatttcctaggggaagatggccaagctctgacttgttttctgttgctcctgctgctcttcctgctgctcttcctgctgctcctctgctgttcctgctgctcctgctcctgctgctgctcctgctgctgctcctgctactcgtgctactcctactgctcctgttactcctgctactcctactgctcctgttactcctgctacctctgctactcctgttgctcctactgcttctgctgctcctgctgctgttgctccttttgctcctgctactcctgctgttcctgctactcctgttactcctactgttcctgctgctcctgctgctgttgctcctgctactcccgctgctctcactgtcagcaaagtgtctctctgtgccactgaccttgcactatgttctagttatttcttctgtcactgtgatcaacaccaagaccaaaagcaactaggagagggaaaggtttatttcatcttacacttcagtcaacgttcattactgaggaagtcagggcaggaattcaaggcaggaacctggaggcagggactaaagcagatatggtgtaggagtgcagcttattggcttgctcatctgcctttccttatagctcaggcccacctgtttagggttggcacagtccacaatggtctgggccctcccttcaacaaatgagctaccaagaaaatg

SEQ ID NO: 33143 - DNA, 1150 bp, Mus musculus
ccggtttctgtaaccctagcacttgggagtgggtgggtacaaacaggtgcattcctggagcccagtgcccagcccattgaattgagtcaaactccagattcagtgggggacgttgccttacaatgatagtagaggaataaatactcaaggctggacatctacccatgcacttgtgcatgcacctgcatacacacacacacacacacacacacacacacacacacacatacacacacacacacacacacacacacacacacacacacacacacatatacacacacacacacacacacacacacacacacacacacacactacagatatgtcccttttctttggatctttggaagctagaatattcaatcctggacagctcagagggcagcagccagctgctttaaaagggttctcaatttttcacagtcttcgttgttccatagattatccagtttgtagtttcaggacttcaatttgttttatattatttaaaaaaatagacatttgttcttgagcatgacgagccatttgggggataagggcttggcagctctttctgtgtgggtagcattagtaagtgttccaggggttagcagctgtctccaataggtgggggtcatcctctgccccatttggttcctaaatgcatgttgaaagctccttcatggaaatcatttcatggtaaatgtggctagaaatagtgaattcaactatatcactattatgtatgttagcgctcagtaatgaagtatttagcaagtgaaccttttgaaatcgggctgagttttcttctgagatgtatttgcagagaacctcacatactctgtgaattccagacaaagtccgtgttgttatgagagctgaatctgctgttctgtttgcagtggacctcctggggctgttgaagtggagatccaacaccaaccttctgcagcagaacttgaggcagttgatgaaggtggacggtggtgaagtggtgaaggtaacgagggctgcggctgcggagggaggcttggtcttgtgttttctgcctgttattatgtactgactggggaagtgccaggttctggttataattgcttaacaatgacttaggtgtgtgcgcagtgctgctgaactctctttggaagggctaagcagcttaacttgg

SEQ ID NO: 33144 - DNA, 1210 bp, Mus musculus
acctttggctatatgtagggaccccttctgcatgcttgtctctgaccaacagctactgtgtccagagagggaggctcttctctgtccagttccgactctgggctgccgaccgaccttgtcatcttttttgatgccattggtaggcctatggcagggagtttgcaggaactgtgatgagctggctactcagagaggctgctggcagggatactaggctgttagcagatggcatgaagttttgacctttgcagtgatttacaatctgaaaactatggggaatgtaacaaggttgtacaaacccaaaccatcagagttgataaagatcttgtcatgtccaggctcgagttcttgatggaaacagtagtttatctcttgctagttgtcccattttctcggtgtagtggaggctgggtagcatagtacagatttctgtctctccgagcctcagctctcctgctagtttttctggttttaaagcataaagcacaggtgggtagttggagctggcactagtttgggaagaggttcttgggacttgtgtcctcactcttcaaaaggaatatacgatgctttgtgttgtctacgagggcctttgggtgctctgtgaaggctgaacttctcaaaatctgggcccaatatctgatgcagccatccctgtgctattctgcctgtgactacttcacccacttactcttttttttttttagttaagtatttatttcatttacatttccaatgctatctcaaaagtcccctacatgctcccccacccactcccccacccacccactccacgaccaatgggcctctctttccactgatggccgactaggccatcttctgatacatatacagctagagacacgagctccgggggtactggttagcccacttactctttaaaaaaagttttccctcctggttttgagatgtaacttatatatcataaaatttctccttttactctgttcagttcaatagctttaatatatttatagaattgtggcacagtcctcagtatgatctaagaacagtttctctacccacaatagaagttcaagcctgtcagcagtcacttccctgagcctctggcactacggtctagtttctttccctgtatttgcttcttgtggacatttgctataaaggaattgtgcagtgtagcttctgagtccttaatggacagagtgtctgtgctgtcaattcccca

SEQ ID NO: 33145 - DNA, 1146 bp, Mus musculus
ttttctcagcggacatggtgctccgtgacttatgtacattactcgtggcctctgacgcttggttcgtaagaatgagtctgacgtgtccttatgaaaatgtggaagagacttgagaagggtctctgagtggagtgggtgacatagggcctctcccagctccagtcttcttctggttggcccagggtgacctccttttgtgtggaaatcagtcatgtggaattttgcttcagtcacctgttacctgaataaaatctggtaaattactagtttaattacttaattcatacatttattgaggcagggtttcactctgtagttcagctgggcccaggactccctttatagtgcagacagttgtcctgcccaggcctcctcagtgttgggattagaggtgcataccacaattccttgactggggaaaggtgggtaacgtcagtgttgccagagaccatgtctctgggggaggtaggatgcaggtacagttcagtgacctcttgtgtctttgcagttccttcaggacaccttggatgccctcttcaacatcatgatggagaactcagagagtgagacgtttgataccttggtgtttgatgctctggtaaggggcctccctttcatcctctcagagggtgaggtgttctttcatgctgcagcctttgaagggggaagggacccatcccagtcaccttgaaagagagtcaatcaaaaaggaagcccggaggagtgcaaatatactttgaatgtgaaactatagttatgttaataccctctctagggtagacagatataaatctgggaatggcctctgcctggaccatttccagctcgtttcctgatatcacagtggataattccaaaatggttttccttgtcccactcacgagaatgttttggttatgttgataggtctttattattggactaatcgcggataggaaatttcagcattttaatcctgttttggagacttacattaagaaacacttcagtgcaacattagcctacacgtgagttctcttacgttatttcaaaccactgctttattctccgatgtttgcaatcattttccactgtgactttggcctatgaccatacgtttctccactcaaaactctgagtttactggcatactttgtattgttattg

SEQ ID NO: 33146 - DNA, 1100 bp, Mus musculus
tctaatgaattattagagctcaaaaataaagcctgatgtgtagagagcaagcactaagcagttgttggggttcatttgctctgttcaacttactctcttatgttgggatttaatgacatgtattcaaattttgtattgtgtaattgcattgaaaacttaaaaaaaaaaaaagtcatgctatttcttcaagaacaccatacttagaagttagtctgtaaaatgagtccagggccccatctgtggttcttaggagactttgtgaaagcctgttttctctgactgtgtagctgtgaactcaaggtccagggatgccagcttatgaagccagtgggtggcacaaccctgtgttgggctgcatatcccttcttgccctgtactgcatgcttatgagaggtggtgggtagagtcactagcaggggtaggagttgtagaagctacttaagcttgcagaacaagctgtgtagagccttttattagtcttctgttactgtttactctgagccctctgttggctcgggggagatgccctgtaggtttgaatattggacattttcttatagactctgggaaaggaacaaattggggtgccttcttgccttattgactaagcaatggctattcagggattgtagatgtggccagatgcctaagcacgtagcagagtctccatatgtagctgatttcaaatttttcctgtaagcagggctaatcatctgttttgagagtagctttcatactttaactcaggaaacgaaagcactactgagttctacctgtagtatcaaatgtctggtgtgtgccttgctcactggtggaaaaataagatagaagagttggaatccctggagtatagctcagtagagtgagtacttacgtagtgggcctgaagctcttagttttagttctagcatcttagggcctgggtgtgatgggttactctctgtgggaggagtcaggaggatcagaaattcaaacttacaggctacgttagtatgaggatagcctgaattataggagaccccacttaaaaagaagtggtgtgtggtgtgtgtctgtatttaggtttggagaaattaatcaacgggagagtttaaagcctc

SEQ ID NO: 33147 - DNA, 1120 bp, Mus musculus
gtttctgttaaaaaggtacttgtataggtgcaaagaaatgagcggaaaaacggggggtggaggttcgcgttgtcacgtgaaatcaagagagaactcttgattatacggcagatttttaaaaatgcctaaaaccacctgattcacagcttctccctaagtatgccatttaatacaattttctgataggctaaatggaggcaatggtaagtttggccattggtagcagctaagggaaacaggcagtttctctctgcgatggtcagatctcacacagtagtgacaaagcataaagaactatataaaacacctggctgcactcgcttggggataaagaacatccctggggattgagctacaaaaagaaaaaaaaaaaaaaaaaaagaaccagggctttctgccgcagcctaggcacccgtgatttataggtaactatattacccattgtgtatctctgtctgtttcccaattcttgccagattcatcacttggcctttgggtacccaaagaataaaaacaagttctaagaaagcttagtgtccaggagctctgaccctgtcagcttgcaatgattgaaggcatatcatgactcggggtgggggtgggagtggttcctggctgctggccatttgggaaatgaacagtaaacatgtcgtccatctggagatgaagaggggtctaaatctgtggtgtcaatttgacactgagatgtggtcacttggcttagcgctacagcacacaaaggcagatatacatagagtcacatttttcgagattattcatggtctccgaccacttgaaaaaaaattgtgctttctccggaattgaatgtgctgaaaactgcactcgcccctgcttatttcataatgaaaggtaaaaatgaagtcctttgccaacacaaggcttgctttctcttctcatttaaaaaaaaataataaagagccaaaaataatgagaagttctactgtctacaaagacagcctgccgtatggaacactggcatctcgatacaaattcttaggtaagggggcgctgtcgggggttagagtttttccttatctttgactacgtaagttttatttcagactttataccccataccagtgaactgcaaaggacagct

SEQ ID NO: 33148 - DNA, 1164 bp, Mus musculus
agacatggtttttgtttttaagtgcccaggtccacattggaacagtacgaatgtctttgtaaatatctgtttatatttggtgaccccctaagtccacacacagattttcagttgcatttttactcctaatacgtttttcttccatactgaaaattcttggggattagatgagcaggttgttcccagtattgcaggccagggttctcttcattcagcataaaccatgccatggtaccttatgggcatgatacactctaaggagcgtgtgtctttagagcttacttcttggtgcctttctgctagttccactgtgcctttaagctaaagtaacattcaaacatttctatgaacatattttatgtgcaattttactcccaggatttaaagaatagcatgggaatgtgtaaatgctgcctacaattcttcatttgtaaatagcttgtgtcggtaatttcaagtgcagtgggtatagttggaacacaattctgaaccccttggttgcagctgtgacagccccttctgcaaggaaacttcaatggggtcccccaagcccccgcagaacctgaagtagggaagagccatgaggtgttggcatctccttcttggtgatggaggccttttcttcttggcacccattggctcagtatttcagcatattaagcaaagaaagtcactgtactttatacagtatgatatatacatgtatataggagtgtgtatgtgtgtgtgtatgtgtgtttgggtgtgtgtgtttatgtgtatgtgtgtgtgtttatttatacagcttttgctcagtacaaagacaacaggaaatccaaattcattctgagtgtgttttcagtgtgaatcccaagcttttgttttagaatgtattgactacctgaaaaggattccgtaaagctaagcagcttataaataaaaggcaggaggcgagtcaggagactgcatggatgttatcctcagtggccactgggggctcccttcatctcttctcatttgcaaatggagaaacctgggcagtactgagctcagttctctccatgacaagcaggagaagccaaaacaaaacaacaataacaaaacaaaccaaacaaaaaaccatctctttattagatatcttgggctatggtgttaagctctgatgttctagtaaaagatcaaatt

SEQ ID NO: 33149 - DNA, 1113 bp, Mus musculus
tgtgtgttcctgcatgcatcttgagtgtgtgctcatgtccaagggcagtatgtacacatgaaggctgaaggacctgatcaagtagtactgctagggctctagtaccttggtggtttttaagataaggtctcttactggcctttagctcactaatttagctaagccagctggccagcacacctagaagaagcaagcacacactgccacatttggctttttcatgtcagttctaaggagcaggctcaggtccttgtgcttgtgtagcaagcatttaaccaaagcagccacctctagcctggtgctttgttaggattcagacatcattcctgatgggtcacaatacatccaaagacccctgttgcctctctctttgaaccatgcctttcctcgtagaagtctgtggttaccagatagcctggtgcatggtgcctgactttacatatctctgcctggggaaagagcagtagctgccctgctaagacattgctttagatacctatttctttcagatttgctctagagcctctgctgccgaagaagatgcactccaggtcccaggacaagctagacaaggacgatccagataaagagaagaaggacaagaagaaggagaaaaggaacagcaaacaccaagagatatttgataaggaattcaagcccgctgacagctccctgcagcagtctgaggctgtgatcctttctgaaacggtaatttaactgtagatcggaagagctctgcaggggtgcctgggacccacctaggctctgcatcttaccgagagggctgtcagttggattttattgaatttttgcaaaatatagcaacttaaaagcccgaggtcttttcatctctgacctcaaataacccaaccgtcagagacacagagcagtgctgtcttttctctgagggcacatgctgtcttggcctttatcctcttttagaggggctggataggtcagtcccctacagggacctcatgtgtctaggctccttatagctccgttggacttggtgcccttgtgtcctagcacctcagagaacagaagcatagtgctttcacaagctgtactcactcatggatagcaaatgtcttccctaccccttcctgacta

SEQ ID NO: 33150 - DNA, 1152 bp, Mus musculus
catactcctgtttcctagcaacagccacctccactgcccagcaaaacaccacctcctccccctccgaagacgacccgaaagcagacctcagtggactctggaatcgtgcagtgaatcctgggaggagaaggctaacctcctgcttctctcctacatctgccgtgcctgccgatgacctcctccgggccctgggatgcttcgccttagtgtgattggcttttcttggaaagaggtccatcctagccacgggaccagaggcctgaagtgtctcagcacagtgggaatggagccaagtcatacatagtctggattggtttttttttttttttttaagttggggactcagagcatgtcagcctttctgatagcctcagtcttgccctgaaactctttccttttgtgccaaatgacttatattcatttgcagagagcttgtccagtgtgagtcagccaagcgggagggatgaggcaaacccctagccctactcccgtgagaagctatgcagtagccttgtaaggatcctcactcggcctctccaacccagactctagctcacccccaagggctgactgctcaacccctatccttgatatatctgcagtgtgactcctggggtggagtgtcacttcagctgacatcaagcagctaagtgtaccccttcagagaagatctcaatttcccgtggcataatttaaagtaggaatatctcttgattactaaagagatattaatatacggcgtagagacaccattatggatactggatcaaatggaaaattaatatgagcataggaaggtgaattttcattctttttaaaatatgagccccctataccaccagaggtggttttaattgggtggcttctctgtgtgtacagaatatttgtatatacggtggttctcagagctccggtgagtgtctgtcacccttgcttactccagcgggtctctgaaaacgagctccagtgtgtcttcatgtttaactgctggaaatatttgttttctaaataccgcaaaattgttttccagatttccaaggtcctgaaaatgttggtggacaatgattcgtttgtttaaaaaaaaaactaactttgtataacctaatattttatttgatcatctatatttttttattcactctgatcatgata

SEQ ID NO: 33151 - DNA, 1085 bp, Mus musculus
gatggaatgaaacagggaggtcaccatggcacccttcaaagattgccgggccttgtaccttaatgatctttaaaggatcagcagttcatttactgcctttgtgatgggcattcttcagtagtatgaactggaatgtttttgatatgcattatgattgacatcctggaattataatttgttagtatgtattctttttccataggaacaaagtagccaaggcattgccttgaatatcatagataactcttagcaaattaatcaatataaaatttgttattttctctttttatatttttgcttcttttttttttttcctgatggatcttttagatttcactaattttgtggttgtcttctcattcccttacaaaacaccccagaactctaggtaccgaaagaaaaccaatgtaaaacagccaaggcccaagtttgatgcatctgcagagaatgtcgggataaagaaaaacgagaagactatgaagactgcctcccaggagacagagctgcagaatccagatgatggagccaagaaatctacatctcggggccaagtcagtgggaaaagaacatgcttgaggtctagaggaacgactgagatgccccagccttgtgaagcagaagagaaaacaagcaaaccagctgcagaaatcttgataaagcctcaggaagagaaaggagtctctggagagtctgatgttaggtgtttgaggtccagaaaaactagagtcgctttggacagtgaacctaagccaagggtaactcgtggaaccaagaaagatgcaaaaactctgaaggaggtaaggacccttgctgtcttatattgtgtgagacccagaacattctaatctttatgcccaggttacaaaggcaaataaggacatgccagcagctcctgctatgctagtgggaaagccatcattcgggccacttactttcttgtgtctgttttggtaattccactttgaatagtgaatttacctattgagggtttcattccagaagagctagctatttatatctaataccattttctgatgtttgtgatgtggcttatcttggttatagatgacattttcagcctctct

SEQ ID NO: 33152 - DNA, 2249 bp, Mus musculus
ctagaagacctggatggcttccaagaactcttccaaacaccagctggtgctaatgactcagtgactgttgaggaaagtgcaaagatgtctttggaatcttcacaagcagaaccagtcaaaaccccggcaagcacaaagagactctccaagacagatctcagtaaggtggatgtgagagaagacccttcaatacttgggaaaaaaacaaagtcaccaggcagagccccaggtacaccagcaccagtgcaggaagaaaatgactgcacagcctacatggaaactccaaagcagaaactggagtctatagaaaatttaacagggcttaggaaacagtccagaacacctaaagacatcactggtttccaggatagtttccaaataccagatcatgctaatggcccattagtggttgtcaaaaccaaaaaaatgttctttaattctccacaaccagaaagtgccataacccgaaagagcagagagagacagtctagggcaagtataagtaaaatagatgttaaagaagaacttttagaatcagaggaacacctacaattaggagaaggtgtagacacatttcaggtatccaccaacaaagtcattagatcatctaggaaacctgcaaagcgtaaactggattcaacagctggtatgcctaacagcaagaggatgcgctgttcttcaaaggataacacaccatgcctagaagacctgaatggcttccaagagctcttccaaatgccaggctatgctaatgactctttgaccactggaatctcaacaatgcttgctagatcaccacaattaggaccagttagaacccaaatcaacaaaaagagtctgcccaagatcatcttgagaaaaatggatgtgacagaagaaatttcaggtctctggaagcagtcactgggcagagtccacaccacacaagagcaggaggataatgcaatcaaagcaattatggagattccaaaggaaacactgcagactgcagcagatggaactaggcttaccagacagccacaaacacctaaggaaaaagttcaaccgctggaagatcacagtgtcttccaagaactcttccaaacatcacgctactgttctgatccattaattggtaacaaacaaacaagaatgtccttgagatctccacaaccaggatttgttagaactccacgaacctcaaagagactggctaagacaagtgttgggaatattgctgtgagagaaaagatctctccagtgagtctgccacagtgtgctacaggggaggttgtacacatacccatagggccagaagatgacacagagaacaaaggtgtgaaggaatccacacctcagacactggactcatcagcaagtcgaactgtcagcaagaggcagcaaggggcacatgaggaaaggcctcagttctcaggagacttatttcatccccaagagctctttcaaacaccagccagtggcaaagacccagtaactgttgatgaaactacaaaaatagctctgcagtctccacaaccaggacatatcataaacccagcaagcatgaagagacagtccaacatgagtctcaggaaagacatgagagaattttccatacttgaaaaacaaacacagtcacgaggcagagacgcaggcacaccagcaccaatgcaggaagaaaatggcaccacagccattatggaaacaccaaagcagaaactggatttcataggaaattcaacaggacataagaggaggcctcggacacccaaaaacagggctcagcccctagaagacctggatggcttccaagaactctttcaaacaccagctggtgccagtgaccctgtgagtgttgaagaaagtgcaaagatatctttggcatcttcacaagcagaaccagtcagaaccccagcaagtacaaagagacgctccaagacaggtctcagtaaagtggatgtgagacaagaaccttcaacacttgggaaaagaatgaagtcactaggcagagccccaggcacaccagcaccagtgcaggaagaaaatgacagcacagccttcatggaaactccaaagcagaaactggatttcacaggaaattcatcaggacataagaggaggccacagacacctaagatcagggctcagcccctagaagacctggatggcttccaagaactcttccaaacaccagctggtgccaatgactcagtgactgttgaggaaagtgtaaagatgtctttggaatcttcacaagcagaaccagtcaa

SEQ ID NO: 33153 - DNA, 1100 bp, Mus musculus
agactttgtagtatatggctttaattcaaggacttggaaggaggtaggagggtcacaactgcttccatgcagaattggatttggatattaaacaagtacagtagaatctattacttcattagtgaatcaagataataagtgactgtttcagaaaaaatattgcctgtattcaggtccatgtcacacatgttggcaggctttagaggacccttcttaaggatacttcacaatggctcttctctgttaccaaataatatttaatagatcataaatagaacagggtcgagatcatctaggaactgcttggtagaaaagaagctaaattattggttcttatatacttcctaaagataaaataataagctgatactaggtggtgaaaaatgatacatttttttatgtatatatttttctttcttataggagaaaaagtgctatccagtactcggaatgcagcaaagcagcagtctgatagatattctgcaagtcctaccttaagacggcggagcatcaaacatgaaaacacagtgcaaactcctaagaatgtccataacattactgaccttgagaagaagactccggtctctgagacagagcccctgaagactgcatcgagtgtgagcaagttaagaagatctagagagctcagacatacccttgtggaaactatgaatgaaaaaacagaagcagtccttgctgagaacaccacagcaagacatttaagggggacatttcgagaacaaaaagtagatcaacaggtgcaggacaatgaaaacgctcctcaaagatgcaaggaaagtggtgaattaagtgaaggttcagaaaagacatcagctaggagatcaagtgccaggaagcagaagccgacaaaagacttactaggaagtcagatggtcacccaaacagcagactatgctgaggaactacttagtcaaggacaaggaaccatacaaaacctagaggaatccatgcacatgcaaaacacatcaataagtgaggatcaaggaattacagaaaagaaagtgaacataatagtatatgcaaccaaagagaagcactcgccaaagacccctggcaaaaaggcacaacctctagaaggg

SEQ ID NO: 33154 - DNA, 1206 bp, Mus musculus
tggctcaaagaacagtgttagccaagactcatcagggcatgtagaacagcacactggcagaaacatagtagagcccacttctggggatctctttaagaagtccaggtctacagggagcagttacagggaaccgaagtcttctcctacacagagccttagcaatagcaacgaaaaggaatctccctttgagaaactttatcaatcaatgaaggaagagttggatgtaaaatcccagaaatcttgtaggaaatcagaaccccaacctgaccgtgcagcagaggaatcgcgggagacacagctattggtgtcaggcagggcaagagcaaagtctagtggaagcacccctgttactgcagcctcttcacccaaagtaggaaagatctggactgagagatggcgcggtggaatggtgcctgtccagacttccacagagacagctaaaatgaagacccctgtgcggcattcacagcaacttaaggatgaagactctcgtgttactggcagacgacattctgtgaatctggatgaaggtgaaagtgcccaggcagtccataaaacagtcactcctgggaaactggcgactagaaaccaagctgcggtggaggctggggatgttgccagccccgctgatacaccagaacattcctcttccaaaaagagaagtattcctgcaaaggtagaggctccatctgcagagacacaaaagcggctctctttaactcagcgccttgttccaggtgaaaagaaaactcccaagggttccttcagcaagcctgagaaactggccacagccgccgaacagacttgctctggcctacctggtcttagttccgttgatatcagcaactttggtgattccattagtaagttattttatgtagatctactttccctaataggttactatctatcttatgtattatgagttaataaagtgtttgtttagtgtaaccagctgtgtgctaaagaacccactaagtactctgatacaggaagaagcaagctttatcggatgtatgggtactaaagactttgtcatttataaagaggcgtaatagagtaggtgcaacgagtgcaggagggaaccatatcacagaaactacttcaggaaaagaaaatgtgacttttcttttgcaatataagggctttaatcataatagcttttcatttagtgccccattttgaataccagttatatattgtggg

SEQ ID NO: 33155 - DNA, 1111 bp, Mus musculus
ggagtgattgtttgtaaccaagagacagggtcaatattaggctgtcttgaaatctcctctgccaagtttatctttaggcagatacttaggaaaagggtggaaaacagccacattctttgccaaaatatcatgggaatgctctgtagcccagatctataatgtggcaagggggtacctggtgggtccataggtatccccaaggtatccccctgagcaatcacaccatacaacagatctggtgtaagggagtttctctgggcgaggggatgaggatatggagaaggggtagaggcagagagtagacctgggtcttagtttcccttcatagggacaatggcctggttggctagggctttctaggagcatagtagaaaagaaccatgctgtgtatatagaagtcaagtctcactgtgacctctgggtgcttgctgtgtggctagtgcaagctagaggtcagatttcccattgtattaccttgtcattaccttgaatttgaggagccatgtgtaggtaatagtagctgtgttgggaagggtaaccccctggatttggggtgtatcagatggtatttcattatcctcagttgattcaaattctgacctccgggtttatgtgccatttgttctcatcagatcggttctgagcacctagaagccctttctgtgctatcacaggatccccgctttccctctgctacctaactaggaaccgtactccagggcagcccatagggagatgaattttccccaacaggacaccagcaacatggtacaggccgaaggagaacaggaaaaaaaaagagtattgatgatattttgtgttacaaatatgtaaaaataaaatgaagatgttctagattctgggcatgcgctgctatttggtttttggcgccccttgactgaatttttgttttgtttttgtgaaaataattttaatgttatgatcatggttttctttgtcagtttgtaagtgaaattggtttctatgaggtaggaggaaggtgatttcaagtccagaacccaggattctcttgagtgtaggcaggattaatacagcactggatgctgccattgacaaagtcttttctttgagtcttaaaatatctgctttg

SEQ ID NO: 33156 - DNA, 1171 bp, Mus musculus
aggctctgtgaccacggctgggcaaagggtgggtttgtcccatgggaaagggtcctgtccaaacctttgaggagggtttctcatgcacatggaagtgcagccgaggccatagtgggaatctctggtgcaatggtacagcttcaggctcataaaggtacaggtgtgcaccacttatacctggtgtgagcacctctgggaatcacagagcctcagacatcctaggcacgggctctgtcaatggagttatgttccccagccttagcagtatttccgggccctcagctgctgacctgcagagtctgttcttgactctaggagccagggtccctaccgactcaggagtcagtggtgggtgcttatgtgaacataggaaagcaactgtgaagagagcagacttgaggaatgtccagcctgttgtgatgtgacgggaccaccagctcacatggtgtctgtttatgctgtgtctgattctctgtgacattcattcccgggaatttttgaacctttaggcactcagccatgaggaacttgccaaatcgtgtcaccgtctgtacctgcggcagctgaaccatttgcttggatgcatggcctgcccagaatggccagcataatgttggtgtacaacctgtgttctaggacttctggacatcagggcatggtgagggctggtcaggccacttccctcatctaccctctctttggacatctaccaccgagtagatacaaaaatctagagaagagaagtggaaggcactatggtccttccctgtaagtattttatgtttttctttatatacatatgtaaccttttagccttgtttctggctttttcgttaatgtatgtaaaaatattaaaaggccctgtatattacattcaaaactatgtcagctacccggcttttttctatttattaaaacttttcaagcagtaaaaacattttacttgttaatgaggggaatgggagagttaatgacacagagccccgatcctccacgatgcctcttcctaaccatgcgcggcaactctcccaccccatgtcgtttaatttcttcgacggggttcagtagacacatgcaaacagatttcagatcatccctcagtttaatagcatctgatatttgggtcaaagactctctctttggagagtggcatagtatctagagcgaaatg

SEQ ID NO: 33157 - DNA, 1180 bp, Mus musculus
gtttactgtcctactactctttgctgacagtttattcatcttttaatcttaaagccagactttagtccttaacaaactcaccattatcgaaccatttctgggaaacattaggaagcttttgccaggatattggatagatcttggctcatatatgaattgattgtattttgttgctgagtttaatctttgactggttgatcgattgattaattgattgattgattgatgattaaggcagggtctttctgcatagccctggctaacctggagctaactgtttagtctaaaaagctagccttaaactcatggcagttctcctgcctccattctcaagtgtggaaatacagtcatgtatggccaaagatagcaagcttctacaaatgtaggtacaaaactttgaggtaaggagggcatgaacacgttctctgcagacggtatttcgatcatggttctgccttccctcatatactggaagcaggttgtcctataggcccaactgtggtctctgtctctgcagtgagttctactagcaacttaggaggttcacacaggctctcctcattcaccgtctcatctaaggctttgatcaggatcactctgtccctgtgattctcatcttggtgtctcaactcctttgagggtcaaatgacccattcatggggatctcctaagaccataggaaaaacagatacttatattttgatccctaacaataacaaaactacacttatgaagtaggaacaaaaataatgttatggttgggggtcaccacaacatgaggaactgtattgaagggtctcagcattcacaagtttgagaagcagtgttctaggacttgcttatagatgcatacactacagccattttctccaagccatctggctttaggaactgtgacccatcactgtccccgacatgcttccaaatcatcttttcctcttgtctctgagttcttccatcaatgaccttcccaatagaccttcccattttttagatgaaaaaagaaataaataaaaagaaactagcttagggttagctcagttggtaaagagctcaattcacaaatgtgagggcccatgttttatcccccaggacggacacaaaagtgttgggtgtgttgttctatgcttgtagttcccatgtcactggggaagcagtgacagggtgaaccccatggtct

SEQ ID NO: 33158 - DNA, 1183 bp, Mus musculus
gtgctgactttggagagaagaggtcagccagtacacccagggagccccagccatctcctggcagagtaggtaccaaccaccacagagacagttcttgggcctacaaaacatagttctgggatcttttgtagggcagccctatagagctgtgccctttggttaattccagcatggccctagaattacaagtccttggcctctcggcttgctgcaatttgcagatggtggttgctgggcctgctcactgggggccccatttgctagtggtgagttttaatttctaacacataaaaatgggggatactcttttttttttcaaccatcatagagcatctttattttctttctcttctaatctaggacttctttttacagatttattgagatgtgttcacatagtctaaaattcttctgtttaagggtaagtattagtatagtttgtgtctattgctacagtgtaatactagaatattttaacagtctccaaaacaatggtcccagggtcgattgagcccttatgtcctctttcctctccagtcaccaggcaggcattggtccttttctgccattgtgacgttctattttggatattctgtgtacttggagtcatgcagtatagggatatttgtgacctttttcctcccctgccaagtatgatgcttttaaggtccagccatgtcatagtgggtaagtagtttgtttctttttatggcaacactcttcatgtgaccagatcatcttgcttatgtcattggatagccatgcaggtgtctcagccttctggctgttgtaagtgaagctgccaggaacattcctgtgtgtatatgttttccttcttcttggttatgtatgttgttggaggactaccggatcataagataattccacactgagaattttgagaaagatgcagcattctaaactagctgagccattttgcattcctgtctgtagaggggccatgctccaggtagaggggccgagctccctttcttcatatgctcaccagtttctacacattgtatcttttttattttaaccattcccaagcagtgcaaagtgtctgttcattgtgttaaacgggagtccccctgggaacagcaaacaggatgccggtgagatccatagctacagaaggctgcagggggaacactctcataaagtaccattgctaaagcacact

SEQ ID NO: 33159 - DNA, 1109 bp, Mus musculus
ggtgcttaccccacctgatttaacttgcatccacatccagatgccccgtggctccgggagctgaggactgtgcttcacggattcttggttcaggacttaacagactgtgtgaaggactgcacttattgtaaggtggtacatgtggttttcaacaggcataaaaacctgcttctcaggatagaatcgttagcccagtaaagccacatccattggagatgctctaagagctctttttttgtttgtttgttttttcgagacagagtttctctgtttagccctggctgtcctggaactcactttgtaaaccaggctggccttgaactcagaaatccacctgcctctgcccctctgcccctctgcccctctgcccctctgcccctctgcccctctgcctcctgagtgctgggattaaaggcttgcaccaccacgcctggctgctctgagaactcttgaccaccttacccctctagcacaccgcaggatgtgctttctctcctgttaggcagggcagtactgtggcaggaatgaggttgggctccctcggcccctcctctcagaaggccccaagtgctgtccactctgtcctctgagtggtggtggcagtgattgcccctcctcatatcctcagctgtggaggatgtcagggtagctttcatgggctccaccgcagcttagtcaaactttgcctgttacagagccagaggtccaccctcatatcccttggctgatatcctagatggtatcctagatggtatcctagatgatatcctagatgatatcctagatgggccatgttggatatgaggccatgcttaaagactctggcgactgtttctattgggtaaaggtgccctaacatgtggcctcctttattgaaacaacataaccaaaaactcgcagaataaagcagaatctgctccagcccctcccccagagcaccaaatgcagcacattttgcagccaagaattcagtgtctcacccccagttgtatgctctgagtgaccctttgtgttcttggtgtgggtctttgtttttaatatcttcatccagctctgggcccgtgacacctggcactgtgtatcaggagaaccctgtgcacccaaggtct

SEQ ID NO: 33160 - DNA, 1172 bp, Mus musculus
gagcccgggcctcaggcactccgtgttgactgcactttcctgctcgaccactgagcctttcatacagtggtccatcccggacaggaatgaaaggtacctttgtggcctcttgagtctcccccacccctgtagcaggccatggatctggtgtgtctttctgtctcctttcctagtcttggctccctggccagggccttatgggagcttggggtagaagttatcgttgttggtattcttgtgttattgctgaacttgaaagtcagagtctggcctaaggggatggctcatttgagaaagtgcttaccacatctctcaattgctgttctgctgctatgaggagacaccatgaacaaggcaactgtgatagtttgaataggaatgccacccccccccacccccgggttcatgtatttgaatgctctagggagtgacattaggaattgtggccttattggagtaggtatggccttgttgggataggtgtggccttgttgggaagtgtgtctctggaggtggctttggggtttgaaaagcacatgttaatcccagtgctttctttcttcttgttgtctgtgggtctagatgtagaactctcagctatttatccagtgctatgtcttcctgcctgtcgccatgatgacagtggagtaaacctctgaaaatgtaagcaagttccaattaaatgctttcctttatgagttgccatggtcacggcacctcttcacagcaataaacgttgactaaggctgcagcttataagataaagcatttaatcgagggctttcttactgtttcagggggtgagtctgtgaccatcgtgacaggtagaatgacagcatgcagggaaatgtgtcactggtgcagtattagaaagcgcttacatctgaaccacaaacaacaggcagactgggagagactaggtatgggcttttgaacccttcaagcccactccgagttgactcacctcctccatcaaggccacacctcctaatccttcccaaacagtccaccaactgggaaccaaacctttaactgtatgagtctataaaggccctttctattcaaccctctataccaaacaaacaaggacctgagtccacgctcccatagcccacattaaaaagctgtacagtggcatgaacttgtaaccctagtgctgggaggagatagag

SEQ ID NO: 33161 - DNA, 1154 bp, Mus musculus
gccatgacgccggcctcaggggtcggtgggcacagatggccatggaggccagcctcgggaggctatggggagacgaccgtggacgccggcctcgagggtctgtaagaaggtaaggccggggcagaggtatcgagccatgtaaggaagatgcggccacaggtctttggagtctggggtgtataacgatcttaaatgcatgtctcactagcgtctgtacggagtgaagaaaaaggactgtagacactaggcagcgaccccgggattccgctaggagttggtaccacggggtgaggtgaggtccatttttgtgaaaggagagagataggggggcatggcagttgatcttgaggccctgtggggtaaatcaggtcccagacactaatgtgggagcccatgcaatataaagggtctttcatctatctccctggcacccgtataaggtggaaggagaaccatgcagggttatcagtctccgggggcccatgctggactggactcaggacgggatggagcaccgagtgctctggataccctgtttgtggtcgtaggtgtgctagtctgtccagtccaatctctggccaggtagacgtcggtcagccctggatctccacctcttgttgttgagcaagaggaacttatttgtcatggggtctcctgaagcgctacagtagtggcggttttctttttttaactgagtagtgttttctcttcccacactgctctttaaagtcacttctccagactttgttttttgatgttgtcccatccagccaagtcctgggatttcaaacacacactgtgtgtgtgtgtgtgtgtgtgtgtgtgtgtgtgtgtgtgtgtgtgtgtgtggtgagcataggcctgcctgttcgtgctcctgcacgtgtggaggttagaggacaacttagcagagttggttctttttaccacgtgagtcccagggatggccatcaggcttgacagcgaatggctttacctgctaagcagtctcatccacccacttacagtttatttttgttttttgaaacagaatttcatgtacctcagattggcctcaaactccctatatagctgaggctggcattgaactgtttgtttctgagacaggatttttctgtagaacagccctggttttgtgcaccaggctgacctcc

SEQ ID NO: 33162 - DNA, 1760 bp, Mus musculus
ttctctgtgtagtcctggctgtcctggaactcactctgtagaccaggctgtcctggaactcagaaatccccctacctctgcctcccacctcccaagtgctaggattaaaggcgtgcgccaccaccgcaccggctctttttgtggtttttttaaaccttttttaagtaaaactttcagtgcatttaaaattttaatttgcaagtcttttgtatgtatgtgtgtgtataatattattaaaattttaatttgcaagtcttttgtatgtatgtgtgtgtgtataatatcatgcgattacctgtatttttctttttaattgtatgcgttcaccgctttctgttacttcttaatccatctttttgtcagctagacagagctttgatattgttggatttatcagtgatggttgaaaagggcaaaggcagtcattggcagctaggacttgtaccaacaagagtcacgacccaatcttatccaaactcaagcttgaagaaggaatgttggggagagataattaggaggtggcatttcaaggggtttatttcgtgtgctgatgtttggatttgaggtcttaaggtatggcaaaatgtatgtgttgaaacttgtagcttgtgaggctttatgttcagctctgcaaaattccatgaagccctgcccctgttttgtctttctgcagtcctgggcataagcagtcagatgtgccctagacattaagtctgaggtcttttgacctagcaagcagtactcagagagtctaggggacagagggcagggtggagataggctggccaggcggagcaggatggctctgtttgagtttcgtgtttttaatctaataacccccacccccacccccatacagtagtgaactgtagacagtttgctgcattatttttatgtatataagaattagattttgctctgagtcaggtcagctctttggctgaaagtcatggtttcattgtgtggtaaatgagtcctgcatacctgaaaatgggagcaaactgagctcacagggagattagtaattgtgatgctgatgcccagatgtgcaggtggctgagggagtgattggctctccttcccctgctggagagtagacaaagactcaagaaacaaaatggccaggccaggggacttgcaagtactgagcttaggaatgctcactcactgctctatttgggaaaattttgtggtgtgcagtaacctgcagccagcctctgctctctgtccctgaacatgctttctgctagtgaacactgcatgacattacaaccttttcatgtttgtgcttggtagactgagtccttaaggctggctgttaactccctttcctaggccttgcacaggaccaagccaaaaagcagtgatacttaacattattgggtacttggtgttccagaaattgtgcagaggcactacctgtgccagttagttcagtctttacccatctgaaggctgttcatcccagtttcagatgcataaacaaggcaccaaagagtggtcagttcagctccatagctatactagagcagagatggggtatgaaactatgctccctgtctcgaaggcctgcgtgctttactgtgtgctgtgttttagccagccctggggaagcgccttgtaggagccagctgtctgttagccgaaattgtacctccagcaattgaacttaaccctttgaaaacacaggagaatagcttgccttaaaaaggattgtttatcagataaaataaggtcagtaataagagttcaagtgttat

SEQ ID NO: 33163 - DNA, 1113 bp, Mus musculus
ggaaatctcagggtcgttatggtaatctagctgtgtctaaagtacaggaaagagagagtgaagaggactttaatttttaatttcatagtacttggaattgaacacaggaccttgatgttttgggacaaggaacccagaatggcttgcattttgggatctcgcccccaccttcctggtgctaggattacagacctgaactactatcccagcacctgcagagaggctttcctgaagaaaagtgagtgattttatgtgactcctcactgcagatattgttagctagcataacactggtggcattgctctacatacatgtggtcctaaaatgtcagcacttactaggtagctaattgaatgccatgttgagggggccttgcagggaatcagttatgagtcttcctagactgacccagtacagacgtcctgtaatgagttgtgagtatggctgacatggcatggttgatgtatgaaaggagcaaagaaaagtagaaaacatgggaagacttggagcaggaacatttgaacatggcctgggcaataggtcagagaaagtaaatgagagaataaaatgaaattataagtctgtacaaaaacagtaagagttaaaattgtatgatcaaacatgtttaaaaagcaaagattactctggctggggtgatcccacatgggctgggatctgctctggtagaatgttacatatatgaaaaatacatgcttaatgttcaagagtatagtaagaatgttgatgttattgtagacaatggacttcatgattctaatttggcatccaattagctagcttgtaactaactcgcatcttaagaccacaggtattacagggcagtaccactgctcctttgctgactaacaaattagacttgccatgactgctgtatttcaaagtcactgatagaacttctaagcagatagtaagatgattcagtaggtagaagcgtttgctaccattttttggataaccttagttcaatctccaggccctacatggtggaaagagagaagggacgaaacaagtcttctgattttcaatgaacaccatgtgtacacacatgtgcacgcgcccgcgcgcacgcacacacacacattttaaaaagg

SEQ ID NO: 33164 - DNA, 1194 bp, Mus musculus
ttctgcaatgacgtgctatcattatatgtagcctatgtcttccagatggtcttccttagtaaacaaatttaggcttcaagaagagctgtccttctcagcactagtttgagtaaatgcttcgtgttggcactagcttgcttccagtctgccccatgcagagccagcagccatcacaagttcctacacagagaagaatttcagaagccctagagaagcttcaggaaaaggaaatgtatctcccagcctaaagcatgagagggcgtgggcatggagatgagcgggggtccagtagtcgtgggtgagacctccccctgccctgggtcccgggtgaaggtggagggagggagctgttagctgctgcagacaaagctagtttttctgtggaagaagcagtgacactctttcattcaagtcactgtggaaaatgaccactcgctacaaaaggcaaacgtctttgctgtctggtcttgtccagtagtcccattgtgtacctgtccactggattgttggcttaaggtccagggcagtctagcagtcctgcagactctttgccttctgacgagcaggcccttcccaaggtgagcagagcactatgcctctgctccatacacccctgcagtgtggacagataggcaggtggcacgtcatgttcccatgtatactaaggtattggtgccctgcgtggatttgaaggcccgcaccttgtgggcactgatggtaggggaagacaatcagaaagctagggaaatgaggatggcaccgagcccttcagggtctctgagcccctgctgactctaggatggtagtcttctgatttagcagggtaactgaaagtgctcactttggttttgggttgtttttttgttttgttttgttttcttcagtttttgaagagccagaagatcccagcagtagatccttcttctcagaaataatctcatctatatctgatgtcaagttcagccacagtggtcgatacatgatgaccagagactatctgtcggtgaaggtctgggacctcaacatggagggcaggcctgtggagacccaccaggtacatgagtacctgcgaagcaagctctgctccttgtatgagaacgactgcatctttgacaagttcgagtgctgctggaacggttcagacaggtgaggctgccagcgtcctagcacgccggcacccgaaagtgctggttc

SEQ ID NO: 33165 - DNA, 1254 bp, Mus musculus
ccttggctcatgccattgccatgattccgctgggtattcagtgtccctcttttgtctcctaaacagtgccattatgacggggtcctacaacaacttctttagaatgtttgatagaaacactcggagggatgttacactggaagcctcaagagagaacagcaaaccccgagccagcctgaagccccggaaagtatgtacagggggtaagagaaagaaagacgagattagcgtggacagtttggacttcaataagaagatcctccacacagcctggcaccccatggagagcattattgctgtagctgccaccaataacttgtatatattccaggacaaaattaattaagaaaactgactggaggaccaagtgttgtcttgcatatgtacgccggtcaattagttttcctgtcaaaaaaggcattgtcctctccattgagaatagtggcgcacttctacttccctaatagatacaggagaagaagggctctcagctggagtcggaagagatgagtgccgctgctgaagggaaaacctgctcgaagctgaattggtggactctgctcaataaaggccattactcaaatgtatttatttaagtctgagccttcctttccagtttatagaccaaaaaactaacatctgagaggaaaaaaaaaagctcatcaaatctctctccagctcttccctctgtctctgccatccatccctgggccttatcctggacatggtgtggccaccacccacgttcctctctggccctggagccccagtgggctgcatcaccctccgctggtgcatggtgcgtgggtgcccgagcaggctcaggcagctctactcacccactgcactgccgtcacatcttctgtggagctacttaataaacacaacacactgtgaagtgtttttaaacccaaatgccactgcagtctttatttgtttcagttgcacataattattcaggatatttatactttggaataaattgaaaacttttttctttttttcctttagcaaaatggtcaagtttgtacagaacttcaaattctaaatgtaactgtcccaaattgccacttggtttctgtagaaactccatctgggaaagccaaaattgagtcaacctctggaaaggaaacatgcatgaaagagcaacagaagtgctgctctccggttaacacctagcttaaagtagggcccagggtcgtcacaactaatgtgtatatactttctttttaaatattgataaaattatatgca

SEQ ID NO: 33166 - DNA, 1346 bp, Mus musculus
aagagctagcatggtccttgggtgtttgcactatgtgtgttaatttgttctgtaaatgcggtgttcctgatttagtgagacagaatagactcttgtcatgacctataattatacctatgggatcaattaataagcatgtcagactgatgcctattgtagcatttactagtaaatttctttgaatattagatataaatagtaaatttctttgaatattagatataaatagtataaataattttaatatagtagcaatggtgtatttaaaactgatctgtaatcataatccagttaagacactttacacttcaaaagaacaagtaagtgatattaaaatcattaaagggttttccccaaaggaatattgtggccttataatcctattacatagcagaaaattaaagggtgcgtgcgggttatctgtaaaggcctctaactttgtgaactgagtagcaagtagaagctaaggttacccacgaaccccactttgcagttccccctcgtcctgctttgcaggatgaggattctcgccttgctgtccaccattaccttgggtggtcagttttgttgcaggcacctttatcactctgctgaattctcttgtttgtatttaaatcttatgtgctctgaaaatcagctgtctactttaaaagactggaaatgaaaaacaaaatctttgccaaatccactggagaatactatatttgcatatccattaatcaggatccaaagctgcttaaatcgggcgtcctcccagtcttctcttttctatagcatggttttaaagcctgcctccttgacatgctgtatatatcctgttgtatttgtttcactgtcccacacttaactcaggtgtgctaaaataaaagtgacattttaacagtcttttgtttatatttacataattactagacatagcctatatccctttcatttggagcaagatcctacaggatgtaatagtcaataggtgttttcttgcttcattcagtaaagtatttttgtaagaaattagatcgctgtactggctagttttatgttaacttgacacaggctcaagttatcacagagaaaggagcttcagttgagaaaatgcctccatgagattcagctgtaaggcattttcttaattagtgatcaagggggaaaggccccttgtgggtgggaccatctctgggctggtagtcttggttctataagagagcaagctgagcaagccaggggaagcaagccagtaaggaacatccctccatggcctctgcatcagctcctgcttcctgacctgcttgagttccagtcctgacttcctttagtgatgaacagcaatgtggaagtgtaagctgaat

SEQ ID NO: 33167 - DNA, 1156 bp, Mus musculus
gaagaatgtgccatttccagaattctaatagataggcctgctaaacattgtgttctttcttggtgcagtttcatcttagaaggaatatctcaaatgcctcataccaccagacttacacttcactgaggtagaaagcccttgaattatttctattctctgtgcacatatgtgttacaagtccaaagtagttagttcctacccacttctcacttcatccaaccagcataatgtcatcaatagagggaatcagtgtactattttgtagaagagatagatgattaagatcccttcaaatgaggtctggtattgggccttagtggaaactgaacatttgacaatgggccaccaagttaccatgtgacccgagctgcctatcatgagtggaatgttatatggcccaccaagtgattgtgtacagcaacaatccactatcaagtgaaagggctatctatatatctgatcaggtccaagtaggtcccgaaggcacaagcaagttacatggccaaatgcccatggtttctattccttgaacccatggatccctaacaatggtatatattttgtttgtttgtttgttttgtttttcgagacaggatttctctgtgtagctctggctgtcctggaacttactctgtagaccaggctggccttgaactcagaaatccacctgcctctgcctcccaagtgctgggattaaaggcgtgctccaccactgcccggcaatggtatactttttaaatcagcatccaatatatggtatagtttctctcataaccagaatccatgggttcaagaatcgaggggtagaaaaaggagtagttacaacaatcacccctagtgacccactaggaatttatttgcattctgttcctatgacctttttctacttgcctaggtgtgtgtgtgtgtgtgtgtgtgtgtgtgtgtgtgtgtgtgtgtgagtgttgggggtgggggaacttatgccaggtgtcaaaacaaccattccattggactggaagctgagtttcgggtgcccttaaatgaacaggctaagaaaggaatgacagttttaggagggtgattgatccagattaccaaggggaaattggattgcttctccacaatggaggtgagaaagattatgtctgtctgggttcaggagatcctttagggt

SEQ ID NO: 33168 - DNA, 1191 bp, Mus musculus
gctggagcaacggaggaggtgcgcctgggctgggatagcatcaggattgggagacctccccatgatcaaccatgttggtgtggttttgtctccagcctcatcaggggactgatggcttcagttcctacccaggctgggtcagcatccctcgtgtggaagcctttgcttgcacatctctcgtggcctacagttctttgagaggcccaggctcttgcccagtcattcagagactccttgtgggatttgcacagcatgatagttagtgggtatcctttgagcagttgactgtcccctgcctctccccaaggcctgcctgcattttccaagtgccttgagctctttgcccataacacacacacacacacacacacacacacacacacacacacacagaggccacatacctttctcctcctctgcccatccctagggcctgccatcatatctaaggaatgctcttagaagtgaccagccacctgtgagcttctcctgtcggtggcacactgacaccactgacacacttccttcccttgggtttctgtgcctagcttgtcagccccaccgttctcaacagctattctcctctgccctgtagctctactggcaacccagctgtgtcctgttatgggcaccctccagccagccggtatggaccacatccacagaaccacagggccccaaacctcatggttgggtttggccagtgggggatcccagtggatttgtacgcacaggttaaagtgaggatggactctctatgtccttagcttctgtgagcttcctagccatatcccacatgctgcctttgacttcctcttctttcccttttagttatagtttttcttactgtccctcccctgtcctgtcaggatcagggatcctggccacatcaggcacatgtccctgaaacctcccactcctcccccctgaagcctggctataaataaacctcttgaggccacaatcaggaagtctgcctctgtttgtctgggatctaaccggggacacactgcccacaagtagcattcatggtagcctatggctggcagcatagcagacaccctgaagtcagtttcctcttccacagtgggttgtccacctttgctgagagcatgcggtgtatacaaagaaccggtgacttctctccattgtcctactacctctgttttatgcccccttgctgagcagctc

SEQ ID NO: 33169 - DNA, 1165 bp, Mus musculus
cctctctgtaaggctggagatagcagatcaactttcctttatgacgttagtagctgcatctttctctggctgtctattgagggctcaccagtcttgctgatttttttggatcctcaggtttcttctgtcctctggtgttggctgtattcagggttaaatcacacagagcctttcttgagtgttctatctcaccctcctgccttcaccgctttgtcccacactaagctgatgtgtgagagcagctgagcagactgtgtgtcctctgcagggagaaggggttcacctttttctgagcaccctgagtcagtttgaggttttgctcacgtttgcataaaccttgggagaacctcatcaggggcacctttgttgacttaatatgtagatggaataagcaggcaccaggtaagggtcagcttccgacagaaggatgaatgccttggtgtcttctgagccagctgtcctgccacactttgccaagctccaagcatgtgagagaacacagcacctctgtaccctgctacctgcagcgttgccatgttctagtgagttttcctctgtcctaacaaggtttctacatcgtgaccaaaagcaacttggggaagaaaggatctgtgacatcttatagctcacagtccaccatgaaggaaaaatcaaggcagaaactcacggcaagaattcagaggaggaactgaagcagaacccttggaaggatgctgcttacttctgcgatccccgtggcttgctcagttttctgcccatgcatgtgtggtccactcacagtgggctgagtccttcacatcaatcactcatcaagaagatgcctcacaggcttgtataaagaccactctactggaggcgtcttcccagttgaggctccctcttcccagatgaccttagcgtacgtccagttgacaaagaaacctaacctgcactctctctgttgactactgcgactgacactaggaagaaagcagcatttcaggaagactcttgaagaaatgacctcggagcgcttcccattcagcagccctttgcagcgaacgcctgggggcatctgttttgtgtgcacaccctgtaggcttggagaatatggagaccaggccaacctgcctcacttgggctgtgactcatttgcttgtcttattcctgatgatggcctttgctg

SEQ ID NO: 33170 - DNA, 1891 bp, Mus musculus
cctggccttccgaatcgcacctggggcaggtaaacctcacgcccatgtacacaagtgttgtgtcgtgcagtgacgtggtggtaaatatggctcctccttgctctcctttctgcagcttttcctggtgtgtttgatcctttaacaaacgattaattccactacagggaagaggtgccagcgccgcgagaggatcctcgagaggcctccctgtagcagtgtatccaactcatcctcctaacagctgcatcggaaccgcccaagcctcacctgctagacggccggccccacacttcgcttcagcctccggacctccggaaagcctcacatacctcactgtcgtgtctgtcacgtgacattgtagacatattgggtgtaatcaagccacagtcctattgccaaaactctaacagacagcagagcgcctgtattttagacttcacagttttccatttttaacaattgtctgtggaggaagcttctccatttagagccccaggtgtccagcgtccctctctgccaggaggagtgtgccgggcactagcccaggcagccaggctgccacgtgtgcccaagcccgaggcccgaggtctgactctactgccatgttacgtggcgtgagaatcacactgcagctgctttccatttttatatatataaatacatataaatatatactttttaaaaataatttataaatcttaccaaaacttatgctgaatatactttccagtatgagtgcacgagtgtcctgagcaggcagaaccgcagtctagatgaatggcgactccatcagcagtcggcacctgttcctgagacaaggcctagccagtgcccagggcgaggggccctgtgatctgcctgtactagcagtttgtcactcttctgccttttctgtgtaatattaagaactgaatgtgaagtttatagctagcctgggtgtaccttttaagaattttgtaaactgttttgtctgtcttttgttaccgttttatggtgccaagtagcctacattaaaaccataatcttgtgggagaattagaagtagcctcgtccacttcccacagattgcttctagcatgggctgtgtgtaaacctggcagaaaagcgacgggtgatgctgggcacagcctgttgcctggactagcacccagcactgagaaccacggaaggcgcctgcggagcctgctgaggaaacacagcgtgcttttattgatttacttctgaacactacagttcctggatggggcggaggcgcgagttaatgtcggtttccctagaaatcactcaaggccggcctgtgtccttgatgccagggtcgggtctgtgactgccatggtcgctgcttgccaatgtgccatgtccgcagcggttgtccgtgggttccagctgtgggtccttcccgtgaaggcctctggaagtgactgctcggttcctaagcaataaaattgatcatggtgaaaacagttcctgctgcttattctcctgccttccctctcccttgcctttgaaatgctaagtgccaggagtggccccctttgtgcgggtttgctctggcccgttctgattctgggaatttcagagttccaatccgccacagggcaccaagccctcagaaaaatcacctcttagacttttttattattattattactgtagtggaaaaggccatccattccctcactctactagagggaattaaacaaaagcttttctttggcttcgctcaaaacctttatcaacatttctctgctctgaactttggctgagaaaccacacagaaaccacacattgccccatttaagacggggaaaaaactcttgcttccttttaaagaaagtcagtgattcaaaagaagctttgactttgctgatggagccaaaacagcaaaaca

SEQ ID NO: 33171 - DNA, 1270 bp, Mus musculus
tttctgtctatcactgatttgcctaatatgtttttaaaatggcttatttatttttattttatgtttatgagtgttttgcctgaatgtgtctctctgcaccacatgtatgcctggagcttacagaggccagaagaggtttcagatttcctagaactggaattagagacaattgagagcggctatgtgatttctgggaattgaacccaggtcctctggaagaacagccagtgtcctttaattcctaagctatctctccagcccctacgaatccattttaaaaaatcataaatacttcttttatttttttcaggaaaataccaaatgaccgatgacgccagtgcagtgggagggctgggaggacccgggggcccaggattaggggcccatagtggcttccacggagcttttggcagtggtcttagaggctatgttagtgatcagggctgtggctgtgatccaggcagcggggctcgtggaggtaaagctgaagacaaggagtggatccctgtcaccaagctgggccgcctggttaaggacatgaagatcaagtccttgggggagatctacctgttctccctgcccattaaggagtctgagatcattgacttttcctgggtgcatccctaaaggatgaggttctgaaaatcatgccagtgcagaagcagactcaggctggccagcgggccaggttcaaggctttcgtcactactggggactacaatggtcacgttggtcttggtgttaagtgctccaaggaggtagccactgtcatcggaggggccatcatcttggccaagctttccaccatccctgtgcagagaggctactggaggaacaagatcagcaagctgcacactgttccatgcaaggtgacaggccactgtggctctgtgctggtgtgtcttatccttgtccccagaggcactggcattgtctctgatcctgtgcccaagatactgatgatggccagtatagatgactgctacacttcagtcagaggctgcactgccaccctgggcaactttgccaaggccacctttgatggcaccttcaagacctacctacctgaccccgacctctggaaagagactacgttcaccaagtctccttatcaggaattcactgatcatcttgtgaaaacttacaccagagtctctgttcagaggacccaggctccagctgtggctaccacataagggtttttatacaagaaaaataaatgaattaggtctgtttaaaaaaaaatcatagacattgaatttcatcaaat

SEQ ID NO: 33172 - DNA, 1602 bp, Mus musculus
gactagaaaggggatgggctagaataagcaaggcacaggccaagaggaactaggtaggcgagggggcggggcggctagacgatgggagggtcgcaacgaccaggttcagacgcagagggcggtgcggggtccttagagcgtgtgtgggcggctctggaggagccctcctctctggtgaggccacgccttggagtgcacgcacctctacctggctcagggatgctgcttcgtccccggaggttgcccgctttttctccgccgtcgccagctagccccgacgctgagctgcggtcggccggggatgtcccggtgactacgtctgatgccttcgctacttcgggcgggatggctgaacccggctcgcccaaggctcccgtgtccccggactcggcgcagcgcacgccctggagtgcccgagagacggagctacttctgggcacgctgctgcagccggccatgtggcgctcactactgctggaccgcaggcagactctgcctacttaccgccgcgtgtccgccgcactggcccgtcagcaagttcggcgcacgcccgctcagtgccgccgtcgctacaagttcctcaaggacaaactccgagactcccagggccagccgtccggacccttcgataaccagatccgccaactcatggggctattgggggacgatgggccgccgagggttcgccgccgctctactggccctggacgtccccagcgccgcggccgctcgtccctctccgcgttagcacccgcacctgcaccggtggagcaaggtaggagcagccatgtgggcaagaagggtctgggtctcctggggaggggcggagccctgagttgggattccgtacgttccgcgcgtttctctcgtagaggccgagctgccgctggctgcggaaaatgacgaacctgcccctgcgctcagattcagttcttccacgacgaagtctgcaggtgcccaccgcattaccagctctcctcctcttacgagcaccgacactctgcctcctgagccgggccataccttcgaatcctccccgacgccaacccccgaccacgacgtggagaccccgaatgagcctcctggcctttcccagggccgtgcttcttccccgcaggttgctccccagtcgttgaataccgcgttgctgcagaccttgacgcacttgggcgacatctcaacagttctgggccctctgcgcgaccagctgtcgaccctgaaccagcacgtggagcatctacgaggttccttcgaccaaaccgtttctctggcggtggggttcattctgggcagtgcagcctccgagcggggcatccttggggacttgcgccaataaagctttgttatcagtcctcttctccagaaacgactcccagtctaccccgacccctgttactgtccccatccccatctcaaacctaggttcttaccaaaataaagattgtgttttctacttaatcctgtgaatgaattcggactccaggtcgcggtaagaatggaaccctaagggtagaggctaaaagacacagcccctcgccccacagttgtgcatcttttcggtgaagatttggcggagtggtacacagttgttacctgatgttt

SEQ ID NO: 33173 - DNA, 1161 bp, Mus musculus
cttctgtgtgtaacagagaagacccatgacaacccatggcttttcccaggccttggacatcacaattcttttcctcagctaattccggcctgttacacacatatgagcagttactcttgggaattgtctgttaaatgacaccagttattcccttcctgttgcagctgacctttggatacgtgtgcctctattctcatgtcttttaaaaatgcccgtgccaatctaacagagttttactctgattggttcctctgtgcctgacccctggtttagcatttctcactgatgtttcgttacctatgtggctgtctatgcctttaaaccaggcttgatgaggcatctgatgggctcaagctccacacttctctctggccccgtgattttgcttctctgccctgcccactgaggggtctgtgctctggcttcttgactgcacagggtcctcagtgttgagggcctttgccctctgccccacgtgtgactccatcctagattatgctatctagatccaagtgagttattttatttttatttttttctgagataaagtttttctgtttagccccggctgtcctggaactcgttgtgtagaccaggctggcctcaaactcaaatctgcctgcctcccgagtgctaggattaaaggcttgcatcaacactgcctggcttttaagtgagttcttaataacagatctcttttcccctgtggcctgtatctactggctgctcatcatctttatcctttgtttctaagatgagatcttgaacttattctgcttaaaaacgtgccatcctacctgagcaaaggtgtcttaggcctttaattccagtacacaggaggtagagacagatgaagttctgtgaattggaggtcaccctggcctaaagaacaaatttcaggatattcaggatacagagaaaccctgtcttgaaaaaccaaacaaaacaaaacgtgctgtctctcaatctttgatgtgtctggctttctcttagcaccaacgaacccagtacccttcatggtgcagtgctgagcagtattcccgggatttcagaatgttctagaactcacctgagcccttagaatgtagccaagtacaatcacaaaactaaattttactttatttggcataggatctcactctagtccaggctgtccttgaa

SEQ ID NO: 33174 - DNA, 1201 bp, Mus musculus
caccccttccttgtcctcccttgtcacacttaatacactgtaagatgctggttcaattttgtttggtatttttccctatacaggcatgctgataagaggacagggctagcatctgctatgcacatgtgttgtttagaagccagagagtgacccgtccagcaggtccagttattcgagggtctcaaggggaccttctcctaataaccaaatgggggggtagagagagacgagggtcttgtgcaaataacgacacggaaaccgttctggattgcatcaagaccccaatgtattgtgaaaggcccaaggcttaaatgcacaagcaaaaggggaagtacagatacttatcagcaggaggggtggggcaatacaagcaaaaggagaagtacttatcagtgggaggggggcaatagaaattctttcttttggcagctacaaggggaagcaggaacttggtggtatcagggtgtggtcaggacatcggtgatgacttagagctggaacatcctgtggttattctcggaatcaatgcgtcggtggcccacttttgacccccttttcttctcggggggtgtagtggctattcctggttgtcaacttgactatatttggaatgaactacaatccagaattggaaggctcaccagtgacccttatctggaggcttggagatccttatctggatcttggtttggagatcttgagccatcgtggctatggattccagaagattgaatctcagagtttaaggaacacgcctttaatctgggctacacctttcatctgggattaaaggtgtggtggaacacacctttaatctgggctacaccttctgctggagacaatataaggacattggaagaagggagtctagctcttgctcttgctccttcgcctgcttgctgcgtgagactgagtaactgctagatccttggacttccattcacagctgcgactgaaccattgttggaaattgggctgccgactgtaagtcatcaataaattcctttactatctagagactgtccataagttctgtgactctagagaaccctgactaatacagaagttggtaccaggagtggttctagagtaacagaagtacaaggatgaatcttttaaaatactggaattggcttgttgatccaccagcactttcaactattgaaacctctccagattctctccctactgggagctcaga

SEQ ID NO: 33175 - DNA, 1200 bp, Mus musculus
cacatggatttttccggcgtctcggacacttgcgtgagcatgtcctgcaagtacaggtgccgctgcacatccccatcctacagaagacacgcgtcaagagctgtgggtggactccggcatcgaagccacgccctacagctcggagccacgccccaacccatagagctgtgtccagccccttgatccggtccacaggtccggtccccacaagccccgcccacagcgacagtcttgcttctaggcccctccctgtggggctcaggacatcttccgcccgggttgtcacgcacctcgaagaattcgtgatcccgcgggaagcgcacggcacgcggcgcgaatcggaagggtgcctccccagccgcagggttcctctccacgggcagcggttcggctgcccccggctccccggccaggcgggaatatagtgcagggggaagcaacatcaccacggccgccgcggcccttcggccaccgtcggaggggtggtgacggacgtgacgtctactaacttcctgtggcgaccctgcggggcgggacgcgacgcgcggaggtgagtcagggctgggtctgtgttgtggcgggaactggtcggagaagggcggggctggagccgggcgcgggatcgggtaccggagccaggctggcctgcagcggggaagagcctgattctcttgggcctctgccgccggcggttccgtccgccagcccgggcttgtctcgctccacggtgcgactgcctctctggctctttcagtcctctccaggagtccaattggaggcagtggccttgggaagttcgtggttagtgtgactcctctcttgacagccccgcggtgactgcggtgctggcctgcgggttttctgcatctgctgctggtgctcggggttcaggggtgaagggatcagggcctgctgcagtagagacaggtgtggaaagaaaccctaacctaaacaaaaagacgatcgaaacgtgcggctgacactttgaggggctttaactttgctcctctaccaaagtaggtcaccctcccccagtatgaatataagtgtcaagaaagaagggacgctactgtttaatagatacaaatgaaagccttttgggattattctccctctctctcagcccaggccttgctcggtctgtttctctttctctctgttctggattcttccaaatgtctctggatgttttctctctta

SEQ ID NO: 33176 - DNA, 1448 bp, Mus musculus
ttcccaactcagaccctcccagatccataagcatgagtttctggtactcttgttatcactcctgattgtgtcctgcatggtttacaatcccctgtcccgagcttagcactgtttctggggaatcccatatttcatgggccacaggtaggcctactgcagaatcaccgtcttgttgatgagctcagagaacaggcaaggagggagacacaagagcaccttggagatgcaggcagtcagctgagggcctcaatgggaagattcaaacttcatctctctcttcctttcctgccaggatgaccggagagaagggatgactgcatttgtagagaaaaggaaggccaacttcaaagaccactgagaactggcagctataccgtttgccaccctggaaagctcagcctgtcctttgagaggcaaataaatgatccaaaagggtagtagtgtcggccacagttcccaccgaaggcttcagggctgtggccacagcttgggtactcatggcgtggcctgcagccttcaccagttgttggaagtcaggctcaccccgtcttctgaatcagaaacctgggaagctttcaaggtgtcttgatttttttttaacttcactgtaagggcaggtgcacgcttgggccagccactcccctgtgcattctccgcagctcatagctcaagatgtgagcttcaagagggaagtggccctctctgctgattcccaactcaagaattcaatgaaagtaactacttcacagtttagtttcgactcacctgtagttgtctctagagagccaatgtggttttttaaaattattattgctattttcttatggctaaggtttcactgtgtatccctggctgcctggaagttactatatagaccaggttgaccttgaactcacagagaccagccagtctctgttttccaagtgttgggattaaaggtgtatactaaccatgccgtaactatttgtgtgtttttaacttcatcatcttaaccacatacagcgtcaaacactttagaatcagtgtgcagccatccccaccatcatgctctggggctctggtctctagaccttcatcttcccaagctaaaactgtctctgttagacactgactcccaaccccacttcacagcctctggcaccaacccttttactttatgagaatgggatgactccaggtgcctcaagggtgaaattagaagccaggcagtggtggcgcatgcctttaatcccagcacttgggaggcagaggcaggtggatttctgagttcaagcccagcctggtctacagagtgagtttcagaacagccagagctatacagagaaaccctgtctcaaaaaaaaaaaaaaacaaacaaaaaaacaaaaaaaaagtggaattagagtaattgttatggtgcttgtataaagcaatgcacagtattccccccccccccaacacacacacct

SEQ ID NO: 33177 - DNA, 1103 bp, Mus musculus
gtcagttgtcatgtaaagaatacctctggagcagggtataatggctcatgcctttaatccaagcatttggaaggcagaggcaaatggatctctgtgagattgagaaacagcctggcccataaggagggttccagccaaccagggctatgaagtaagaccctcacacaaagctaaacaaaaccgtcttgcactttaccgctttatgctttattactgtatctgtgatcgcgtcttcccgtagtttttcccctggtcaagaacgaaagcatacggccatcacaggggaaagggcacagccatgtctcccagtctggcttcgtaaaccgggcacccgccaagggcacaccaccaaagtgatgcaattaacagactactccaagaaccgcagcccagcaccccacgctgccccaccccgccctctgtaccagcccgctcaggtcacgggtccaccccttaagcttccgtcttcatcccgcctgggatctggggcggagcgattctgcaggcggggcgattctgtgggcggaacacatcgtctctccgccatggcggccctgcgtgctctgctgcccagagcctgtagctcactgttgtcctcagtccgctgcccagaactacggcgcttcgcctcgggtgagtgcggacaccggcggggtgcgtcaccccacccacgttgggtggtttctccacccataacctctgggtggtccctaaaccccggcctgcacgcatcctcacttgatcctggcccttctctcctaactctagatcttttgtctgaccccctacttccacaagcatgcactcccaacacttgactctgaagtacctggaccctggattcgagtacgcatccccacactaaacccagatttcctgcaagtgaccactgactctagcttggtgatcttccttctgagcctccaactccagcgctcgactgaccccttcccaattccttaccccgttccccgctcctcagtctgaccttagtctcaccttacaagcccagccagatcctagcacctcgaagccatgtctagtgggagggctctgggtgtaatagcttctcaacgctcgaacttttatgagtgtcagctggg

SEQ ID NO: 33178 - DNA, 2219 bp, Mus musculus
ggggaagtggttttgtttttcttatctgttggagtctggcttggtctgatcatggatgccccgttaagtgttgtacgcataaagcagttaacattgcccttgtgtagagtacttctcattttttaaaaaagatttatttattatatgtaagtacactgtagctgtcttcagacactccagaagagggtgtcagatcttattatggatggttgtgagccaccatgtggttgttgggattcgaactcaggaccttcagaagagcagtcagtgcttttaaccactgagccatctctgcagccctagagtacttctcatagtgcatccagttctcaacctgttccacccattccatgtcctgtctctgctccttctatccctagtccatggctttcctctctgggtcctttgggccttagggcccatggttgccctttgtcctgttattggaggcgttcccagggttccccacagctgttgtccaggactatggctaatgaatcttcctttgatcattaagggattggtgtcaggtgccctagactggtaggctaaatggtcctgtagaactgagaagaccgtgaggcaaggagatgacacagcctatcctgacctggcttggggatttgggagaaggtgaagaataaaaaggcttaaagactattgggggttaggttggccaaacacagggagggcgtggtgaatgagagaatatggagtaagggtgctggggagccaggtgtgtgtggtagatgtgaggagtgtgctaggtaggtcaggctcttggatatttttgtagtctggtctcattgtcgtcacagcagctgcagaggacaggtctgttgctcctggttacagcggagacaggacatttagactattaacttcctcatgttgtagctgccacagggcttgcacatctcctctggagatggttgaggctggagaggttggtgtagcgagcctatctagtgagatattgtctcaaaagggtggagctccagagggagctcgaagagtttgcagagacgcttgtcccagcttgtcccatccttgcacagcatggtactgtcactagccccaggtttggcatggctgagggcaagccctcctgcttgtatttgttatgtttacacttttgaaacagctctaggcttgcttctgtccagtccagtccagctctctgcttggctactcatccttcaggtctttaaggcttgccctagcccccatcccagcagtttgtcatgaagcatgttatatcataaggacacttcctgctttaatgtcaccaggctgcccttgcaacaccatggaagaaagccagtactctaacaggtttttactgtagtctacagcttgaggactgagaaagcacagatctttcaagggcaaaagtctttgttgttgacactcagggacacatttcagttttcagaggagtgactttgcgggacgggggacaggcttgccaggaggatctgagctgctagggatgggttggggctcttccatgatggagactgccttgacagacctaggactttaaacttacaatctgggcacatcccctcactggactcccccattttccttttgagacaacatctcactctgacccaggctggctttgaaatttctattctgcctcagtctcacaagggctgggcttatagtatgtgcctgtctggaggcctgggggtgatagtagtactgggtatcaaacccaaggcttcctgcattcaaggcaaccattataacattgagttacatgtcaaccccttttatttgagatagtgtctctcttagggtagtttctaatgcctggcttcccctggcctctatcatccttagctggtatcacaggcctgttctaccaggagcagctggatttgcatttagtcttacaactatgaagcccacttcactctcattgtattaatgggaatgtagtcggtatttataacagttacattaaaatgtcacacttgaaaatggaggcattacaggtgtgtgtgtgtgtgtgtgtgtgtgtgtgtgtgtgtaacacttgaaagttctaaggcaggcccgggaactgataggggacaactcaatttccttacattgatttatatgagtatacgagggagaaagacgactttttttagactgcctcatgaagctcaggctgaccctgagttcctgaccctcttgcctcaaatctctcatatgctaggatt

SEQ ID NO: 33179 - DNA, 1227 bp, Mus musculus
tcaagctgaggaagacgcggaaagtgaaggttctcacaggcacaggtgagtgtggctgcacggtatggtatgaggcccttactctgccttctgttggggacaggagtgagacacagaaggaaacctgtgggcaggacactgtggaagtttctagggtggaaggaccttgtagtttaggctttggagggtggtcctagctctggacagtgctgggtggctatgatgcttgtgttctttctgaacatgccctggtccctagatttcagggggtggccctagtggtctctcagggccgggctgtcttaggggcccctttctcatcagatcctctgtcctcaggtaatgtcaatgttatccagcctgattatgccatggcagcccgagacttcctccggaccttccgcagtgggctgttgggccaggtgatgctggaccgtgacattatacctgcttgctgatgacgttaacccctggactggctggctggagtatggtctcctgcatagtccatgtgactgcagctggagtgtttaatgcttaggactgttcctccagttcagaagctctctgtgctggtaactgaggctcaggccccagctccaaagggcgctatgttctcttgtctatcagagcctggtcagtcctggttactaccatgagaccccaggagtgctgtgtatgtggcttggtcaggaggttttctccatctcaagtaagagacaaatgctatctcagaggagtctaagttataatctgtaatttaaaataaaatgggttaaaaggcccactttaaaaaaaaatctctctctggcttctcttattttactttatttatttttttgtcattttcagacaaagtttcatcatgtggcttgggctggtctcaaacacattccttctgccttagcctcttgagtgctggaattatacaggtgtgtgccatgacaaccgattaaaagacctattttctgatggcgttttcattgtgcacttagtatggtgagcccataagttaaatctccttctatcaatgaatgctgaggagtggtagattagaggcctggggttcctaagtcagattctcaagtgtctcaaagtcctgcaatgagggaaaagcctgttaccagcagagggctttatttcacaaggaactcttcactgataaagtgcacagacacggacaggaggtctgcagcagagaagtccaggaatgtcatctccccttgc

SEQ ID NO: 33180 - DNA, 1466 bp, Mus musculus
gcactgacttctttccacactatcaggcagatgttcaaggatgagaacaagaaagctgaggagttcctagaggctgcagctcagcagcacgagcagctgcagcagaggtgccaccagctacagcagaaacggcagaggtaggcacggagctcctgtgtcctcatttctcccaggaaggtgaatggcagctgtttcccctgttctgccggtatgtctcttcatattttcttgatttttctgctttcattctcgtccttcacgcttcccggacaggctgaaggaagaactggaaaagcatggggtacagatccttgctcatagtacgcaaaacgaagaagacagctcatggaggatggtaaatccgggaacagaagggaaaggaaaaaagtggtattctccagagtatagtctgtggaaagggcattcctctgaggaggcacagctgaggcagaggtgtaaactcatggtagcatgggcacagaaaggtagaaaggggtggtaggagcagggaaaaatgcctgggcctttacctcccacaggccagtcctaaacctgtagaagtccacgaggagacagcccaagaccaagagcgcccatcaagcaggacctaataccctcctcagcctggaggacttactgacttcagacatcacttgcggatgttttgtgtagcctgcttcatctgagtatgtgccgagtggaagaatgggtgttggggccaagcccctcaagtctttgaacctggagatgtcttggctcaattttgagtttcacctagcttagggtccacactgcagacccttagtaaatgctttccctgtctcttgctcaccactagtatctgacacacgcttcttctcttgagcagaggatgctgatctgaaccttctcacaggatctgaagccacttggtaatttagttccctcatgtaggcccagaatagcatatactttgaaacaaaaggaagacacatcaccagctcttaattctcactataaaccacctcattcttcaagcaaaataaatgaaatttaagtctgcatgtggtctatattgtgtgtgagcaatcccaaactgttgccaggaacatcttaaactaaaaatgctcttttggttggggaggacataaatgggcagaccttccccattcatctttggttctattgggtccttgtttggttgctatttgttttgtggttttcctggtaagatgcaaatgaatgtatatttaccttaaatatggaaggggacaaaaaggaaagattctgtcaaatccagctcagtgaataaatgagttagcagggagatttacaagagctatctatatcttttaaaattctgcctcagtcaggttcttttttttttctttttcatcttacagaatttagtggaatgctagaagaggattttgtaagggtctcctgagggtcttttgatacttcccttccatgcagaagtggatgct

SEQ ID NO: 33181 - DNA, 1219 bp, Mus musculus
gcaaagcctttaacagtgggttaagcctgaaacaacatcaagtagttcacactggagagaagccctacaagtgtaaagagtgcgagaaagccttcacgcagattgcaaagcttacagagcaccagcgagttcatactggagagaagccctatgagtgcaaggaatgtggcaaagcctttcgcaatttttcagcgttcaattaccaccacagaactcatacaggagagaagccctatgagtgcaaggaatgtggcaaagcttttaccaaaagttcagatctcaaaagacatcacagaattcacagtggagagaaaccttacaaatgtaacgagtgtggcaaagcctttgccatgaatgtaagtctgagagagcatcagagggtgcattctagagagaaaccctacaaacgtgattagtgcagcaaagccttcaaccactgttcacacctcacactgcaccagagaattcacaccggagagaagccctacacgtgtgaagcctgcggcaaagccttttccaggtggtcaggcctcaaataccataacagaactcatactggagagaagtgttcctaatgcaaagactatggcaagctgtgtgtgtgtgcacatgtgtggacacatgtcactatgtgtggaaggctgaggttaatattgaattcctccattgctctaccttcttgttttttaaattacattaagtgccaggcagtggtggcatacgcctttcatcccaggacttgggaaacagaggcaggcggatttctgagttcgagtccagcctggtctacagagtgagttccaggacagccagggcgacacagagaaaccctgtctggaaaaaaccaaaaaagaaaaaaaaatacattaagcatgttgttttgtgtgttcatgtgtatgtatgtgcatgcatgtgacatagttggggggttggttacatccttccatgtggtcttggggatctaactcaggaggtcacacgaggtcacagttcctttatctgctgagccatcttactgacctcaccttattttttgatacaaagtctaattttttttaaaaggatgtatttttatgtgtataatgtatgaatgtctgtgcatcacatgcactgcccacagaagccagaagagggcatcagattccccggcagtggagttacaggcagttcttagagccagttggttgccgggaagcaaacccaggtcttctgcaagagc

SEQ ID NO: 33182 - DNA, 1094 bp, Mus musculus
tctgtggctctgctaagtggttctcagaagcctttagttcccgcttccaaccgtcaggctcctcgtgtttctatacatgggcagccagaggcgacattgtccctctgcatttttttggttttgttttgttttgttttgttttcaagacagggtttctctgtgtaactctggctgtcctggaactcactctgtagaccaggctggcctcagactcacagagatctgtctgcctctgtcccctgagtgctgggattaaagatgtgtaccgataccaccgtcaccccacccccaccccccagctgtccctctgcatcttaaagaggcataaccacaagtaatctgacccctgtgggtttccatggggcatccagagagctggcgatccagcctttccgtgtgaaacccccacagctgaaagccacagactgagattcattagatctgaggagccatgttgctaggcagagggtgctcaacgcctatgagcttggtgagaaatggctgcctggcccctgagtgctgtccgtgaggaactttgaatgggaaatctgttatttgcttttgctgtttcctgagggtagtgtgtacctcaggtgtgcagacagcgtcagatgccttttgtttcgttcgtagccctgggtcgtaggtgtaactgttggttttaaagaagcgagttgtttgacccaggtgacaaagttttccagaagtgggtctggttttcttcactttctcttcttaaaggtctcatagacccggtacaggcaaggatgaacttgaacttcagatctgcctgcctcccaagtgctggagttgcaggcttgtaccaccatgactggctttaatgtgtctatacctttttaagctaattgacacccagcaccatctttggctcttagctaacttccggcagcatggcctctttataggaggttgttaggaaccatctggtgaagtgtacagtgtagctccatcttacctggggagcatatgtcagtgacagaagcccttctgcagacccacaggctgaaggaatgtgtggcacctgtgctgaacgtgttgacagaatgtgcccgcatgcaccgtcctgccaggaa

SEQ ID NO: 33183 - DNA, 1100 bp, Mus musculus
tactcagaggacgaggacacggacacagaggagtacagggaagccaaggccaggtatgtgcccctaatgtatacttgggttccctcataacccccattctcccatccactccctctccagctcgaaccagtagtacataggacaggataaggaatagataagacctggattcaggaacttgtgttctgatgactagttatgtcctcggtgtactaaggcccagcaagtgagctatctatctgggatccaggaggtcctgggcaagacttgtcaggctggtgtttgaggggcatctccctcctgaagtcccatcagcaccaaaaccaaaaccaagaaggtgggttcttgctaacccagccctaagcatgaagatggagactacctgccccaccgagtgccacttttcctatagcatcactaacccatttccacgcactgttcctgggaagtagcatcaaccctgtgactggaagggtggaggagaagccgcctaatcctatggaaggcatgacagaggagcagaaggaacatgaggccatgaagctagtgaacatgtttgacaagctctccaggtatgtgttatgaggaaggcttgtagctagaagacatgcgaatgattgttttgtgagcccaaggagactggcttagaggtgaggatcctggtgaggctgtattggacatttgagataacttgccccagaggtaagcctctggcaaagagaagaaggtacagtcagcattgagccctgtttctagatgacaagaaggtgaaggactgtctaacgtctcaaagctagttaggtggtggttaggattggggcctagttaatagttaacctagtccaagtagcagcctagaaatgagcaagagccccctgccctgcacacaaggtcccttccccaagcactgtgctttccctcaggcacagagtcatccaacccatggggatgagtcccaggggtcacctcacttctctgcaagatgcgatgtgtgagacaatggagggacagctctcctcagaccctgactcagatcctgactgaagatgccagcggccttgctccccttcagaactggtgctgcttccagacatgtcctg

SEQ ID NO: 33184 - DNA, 1178 bp, Mus musculus
tacagcatatgtagctgttctcctacaaaaggttgaaaccatttactgaattacaagtgttcttcatgttagcatttccgtgcctggtctccttgtgcatgggcagtcccctccgtgtgtttgtgtgaagtgctaatgtgagttgttctacaaaagcttacaggcacctctgaagccccattggcagctttaatattttcacactatttaattctccacggccccgtggaggtcaagtggtcgtggttttggtttatttctcagttggtattggtttagtagctctgcactcccgtcttctctgctaactgcctgttactgtcttctactgtgtccttcatacttcctggctcactgcccctagagggcgtggagctagatcctttgccagtctattactttaaagatcttttaagttggaagacgattttacttcttgtgtataggaaaccattgaagatgttgaagagatgctcaacaatctccctggtgtgacgtccgttcacagtcgtttctatgatctctccagtaaatactatcaaacaatcggaaaccacgcgtcctactacaaagatgctctacggtttctgggctgtgtggatatcaaggacctgccaggtaacccagggccctcacagttctcagcgttgagggagtccgaggctgagcatagcagccatggcgtgctgaagggaataggtcttagctctgtcaggtgttcatcacttttaaggtggaaagtttaatgtaatgtacattttagattttatatcatatttgtctctagcgctgagttaaatcctatgcaagctcatctttctcggtccctttactccgctgcaggcccatattagtagctaagtcagattgtagtgaagggtgacgggcatgtgagatcccatggctgagacctctgctcaaaaggagttcatacctgtgggaataaattaccatctttcaagaatctgagggtggaagaaaaagtagcctgagagtttgggtaaaaatacaaggagagtgtgtttgaaagaaaatttgaccactttcttgaagctgttggtggaaaggagactggcaactcctaaaaatgcagataaagcttcgattactctctggtaacaggaagacattaggaaagcgagcagtgcagccaagagaggagaaaatctgaagaactg

SEQ ID NO: 33185 - DNA, 1298 bp, Mus musculus
gacgtgggtgcagccgcgagtgctggatttgcagcaggtaagggggctgggcccctgccctttgcgggtttaccaatgctgtcctagttttatgtggacagaagccatttaggaagcggacgctgtcgcacacaaggtgggattactgctgtggaggcctagcaaagcagccctctgaggtctgcgccctgcacttccaggctggctgcgctgctgatgcctcctaatcctgaaattgctgctccagcagacgtgttcctggttttgtgacttgatcccatgccctatcatgtttcccggacatttaatcctgtgctttcctcattcttttttctttcatgggagattttagaatgtcctcgtgatcagatttggcacagtgactccattacacacctccaccttcagctccattgcccttagcttttcccagaaaagaactagaggctcagccctcccagactcccttgcagctgatacccatgtgatcccgatttgcctttagatcaaggggatgaaggaccgtctggagctttggtgcactgatgtgaagagcatggagatgctggtggaacaccaggctcaggacatcctcacctagtgccccggtgtcctgcagaccctgccgcaccttgcaaggcaattctgtggcccccgaaaccatcagcagagatctgtattcacttgggatggagtttaggatcctgctcggagtgggaactgttcttgctataaaagcagagaactgtcgctggtgggggggtgactacttggagaaggctcctgtgtggggtcttttgtagcctgcaaggggtgggaaggggggctccaggcctaggtgatgagaaagggcacgaatgggaatggggacagggtagtctccacccagctccacctgagtggactttgtccagtgtggtctgagtgctgctctaataaatgccttggcattgttctcttggtgcttctgttctttgccttagctccttagccaatcctgtgtctgaaagaaaaaagaaatgagcatgtacgctgggactcagggtcggtggggacttgccttactcctcccctatcaccatgcacaggaccaccaccaaagaagtaagttctgtattgtcagacagggaggcattagttcctttttgcagtcgtcttcagagcattctcagactcaggcatccacactcaccacccagcatcactaaggcaccggatattaggagtgccgcgctcaagaatctgcacgagcagtaggcagatggacatgtttaatgaaatctctcagggatgtgcaa

SEQ ID NO: 33186 - DNA, 1236 bp, Mus musculus
tgaaaaagccgcctcccaaaatgaggcctgtgtggttgctcttgctttcttttcatctgggtgggcccactacacagtggggagaggcagcctgaggtctgaaggaccccactcccagcccaggaaggtaatggtgctctgtggtactgagagtgtgtctgcctttccccaaccctccctaggttccttcctccacaccctggaaggccccagcttccgggcttcccagcggatctatgctcaccgtgtgttaccccatgtcctggtcttcagtgtgtccattgcacgcttgaccacagggaacaaacccatcacagtgccgttacgggcagacttctcccccgaaagcccagacctggacctgcgtgtggggcctgacttccagggactccggtaagaatcacactgggtaaatctaggtagcccagagagcagagcgagccctttcttaagactcagctatgcccttgcaggtacctgcatggccacgtacttaaccctgagcagcctggagagccacagcaggaagtgcatatgctatggatgcctgtccccccagccttgacccttggggaagaggagaaggacaggacctgggagtttctgactgttgtgggtagcagccaggctgaagcccaggactgctttgctgaggccctacagctgcagaccaggggtgttctgtatacaatccatgcagactcctggggccggctctgggcaggctgtggcctggatgtggctgggcccctggccctgcgccaggcccttcgtggctctctctactacctgttcagtgagcttccccagcctggcactcaaggattcatcagccatgggcttagccccggaggactctccaatgggagtaaggaggaatgctactggggccatatcttctgggatcaggtacatcctaccctgcactggttacacagggggagttgcatgcaaagattccgggcattgcctttgcactacctgagatcaagaccaaacatgggagctctagataggagggcttcctggaagagatggttggtttctcagaagaaaggtgtgtaggaatgtggtagaaaagagtggtccaggttagagcaaacagaaggcgcaaaggctgagggtctgcaacatttgaaagcagagaaggggcctcatagctggctaagaacaccagagcctcagagtgagccaggtgcaagcctggagcttacaaaaggactggaaaaaccatag

SEQ ID NO: 33187 - DNA, 1197 bp, Mus musculus
gtccttaaaggttgcccatagaggaattcccactgtagttcccgaatagcactgagttcttggtttctcataggactcctctcccctaggaggctctcagagggtgctgctgacccagaatggccactgaatctctacctgcagcctttatttatgctgagactatggttaggaccctgccagaggccaaactgtgcctgtgaaggaactaggtccagccgagggatatgtctccttgagccagagtcctccgtcaagatttagagtttagcctgtgctctacagttgctccgggggagggggggtcccctagacaccatgaacatgttaacatcttgtttctggtgctgccctgcaggcccgagaccagaagatggctgggaacttggaggctgcaaggcagtatggctccaaagccaagtgctacaacatcctggctgcaatgtggacattggtgcccccattgctgctcctgggactggtggtgactggcgccttgcacctgtccaagttagccaaagactctgcggctttcttcagcaccaagtttgatgaggaggactataactaagagttccgagcctgtccctgaaccgaggacaaccatgtcaggtcagctgtgcccaacaccagctcctgggagttacagcctactatagcacctcgatccctgcccagccgtgacctcagaggcggccctcttgtccacgatgtgtatttgatgctgccccactcagatccctcagacttaacttataacctagagggtcctcagtgcttggctttgtccctttccccacttaccaggccgagcctctgttcacgattaaaagtggcagattccagaaatgtgtgggctcttcctttcctggtggtagttgtgtagggagccccagcaccaactcatctggccaaccccagttatcttattctgttagcttggctgtccgactactgcttttgcttagcggcctgtggcttctggggtggaggagcctgagtattttaggatgaagttcgggaacgcaggcctttgattcccactgccctgtggtttgatgggctgtgtccgagaacatgtgagggtgtgccctgactcctcatccgccacagtggtcttcttggactgtgcggaaggcagacaggggccatttcctatgcgggactggatactggactcacagcggacagcaacat

SEQ ID NO: 33188 - DNA, 1110 bp, Mus musculus
aatgccacaaactgggtagcaataatcttcattgccacctcaggaagggaagcagagttgtcgggtggagggatggttggcatagacaagccggaaggtgtccaaaggtagagtcatcgtggcagccatagcaggcgagtgtcagagaacccagctgtggcagaatatttgttcccactgtgaacccggagattatgttgtttcctggaaaactctgtttcaagtttgtggtgtgactcagccttcacacacacacctttaatccaatagctttctgcttgaatattataaacaggattgaataaaatcaatcatgggtcaacaggcatttgttgacccaaacaattgacaggatgtgaacagaggggggaaaacagatcaagagaaagtcaggaggacaaatgggaagtagaagggagggacattcagtttgaggggctgggggggggggttgttttttgtttgttgttggtatttttttgcttgttgttgttgagatgtgaggaaagagcgggctcttttgggacattggctgaggaggaaggtcagttgggtgttttctctgcctctctgacctagcaggttttcaccccagcatctggctcctgagtctttattggtaaaattgaacaattaagattttgtttaaaaaacaaacaaaacaaaacaaacgaacaaacaaaaaaacaccccatccaataaggtataaatgacatccctgtcacaggtggggatctgaagatcaaatctagatcagttatcgcatccctcaggtgagttaaggaaacagtaggatccatctatgttcacctaagaggcatccatagaaggcaacggatactaccccctgatgctttcagaggtgaggtaaggtcttcatgtattaacttggctgtgaagtgccttagagtggggtgtctcctgctgggcattatccctctaaaggatacccagaaattcaagttaccacatatcagttgtgagggagaaagtaaaagcttggttacccatagttctctcagatcaagatgtctgatggggatgaaggggacatggcaggcataaatgacatcagtcacatcctctgttccctcctcaggagagcagcag

SEQ ID NO: 33189 - DNA, 1208 bp, Mus musculus
gtaaacataaggaagtaggtttctgagaaacagaccccactggaggaaaaaggccggcccactgcgcagcaggctccggactgcccagtttgaaaagccttctcattccttccttattctcactctgcagcttcaaaagccgagagatgcctaaggagcagcaagaggtggttgtactggggtcaccccacatctcaacttctgcgacagccaccacaatcaacatgcctgagatctccacgcctgaccatgtggtctggtccctgttcaatacactcttcatgaacttctgctgcctgggcttcgtagcctatgcctactccgtgaaggtattgtatgggcctcaaccttgacttacccaggtggtacctgggttgtgtgtgtgtgtgtgtatgtgtatgtttgtgtgtatgtgtggagggaatcccaggaggtgcctggggatccgtgggtcaaggtatctccatcatagcctaaagtttgaaggaagtctccttacttcctgattcttggaatgccccccccttttaaaaaagatttatttatttattataagtacactgtaactgtcttcagacacaccagaagaaggcatcagatctcatagatagttgtgagccaccatgtggttgctgagatttgaacttgaaagaaagaaagctaaattcaagacttcaaagccctagccagaaagtttattcaaggtccttgactcttgcggcttgctagttaggagggctttttgggcttagagcaaagaacaaaggctgtaaagtcatcctaggtaccaactagccattgagacaagaaaggcacgcaaggacaatctccaggacaagctctgatgagtaatgggccacctgctgatatggtttgggcttagccagatgtcctgccgaccaagataaacaccctccctttagagttactatcacatacagctctctgatgtttaaattgcccatttgtgtgtaactgtgccaatcctccccctacccccactcctttcctatataaacccctaactttagagcctcgagaccgacatcccttatctcctgtgtgagaggacctcttggaagagcagtcagtgctcttaaccgctgaaccctctctccagccccctggaaggttccttaaccctgaagattaacactcctggctggatggaaagttcactaggaactaacaggaaacagtagagtaag

SEQ ID NO: 33190 - DNA, 1193 bp, Mus musculus
tctttaaaacacaagaagtaccgttcatcccacctgtctatgaagccaggagaactggcgttcatagtgagaggctctctgggcactctttattgctgaataaagaatagagggttctttggggcctggctgggaccttgataaggaacagtgaggttctgcagctgtgagcgtgagcttggttgactccaggacccctcactcttaaacactgaggtttgggccttgggacaagtcctgacttgggctcctggcctggaagttcccctgattcacaatccttcctgacatcctgccctggagtaatttgatccgcaggctttttagatccccgcccctctgaacccagagcagtttcatcaagccaaaattcaggaaaaggaaacttctgagaaaccgaaactgccgcagaaagggcagacccgcagcgcgctccatcctttgcccttcagtgctgcctttgctccgcaccatgaaccacacttctcaagccttcatcaccgctgccagtggaggacagcccccaaactacgaaagaatcaaggaagaatatgaggtggctgagatgggggcaccgcacggatcggcttctgtcagaactactgtgatcaacatgcccagagaggtgtcggtgcctgaccatgtggtctggtccctgttcaatacactcttcatgaacttctgctgcctgggcttcatagcctatgcctactccgtgaaggtgagtgtgctagaatggggggagtgatggtgtaaaaaggtgtgtgtgaacctgaagctccatctacccagatggcaccgaggtatgagtgtggggtcctttgtttaaaataagtttgtgttcattcttctgtggtgtgtgtgtgtgtgtgtgtgtgtgtgtgtgtgtacacgtgtaggcttaaaggctctctgggggcagacacagggtgaggctgcctggggattctggagtcagactcttccaatgcagagatgcctatagcaccttcactcaacagactgggattctagcctgtgtggaaaatgttcaggagattcatggggaacaatagcctacagtggggtgaacaacaagtgctagggcctcctggatgatcagaggatgtaaaatgttcctgacctaagatggggagatgcagtccacagggagtacgtcaggaaaactgtcagagcatctgcctatcagctcc

SEQ ID NO: 33191 - DNA, 1774 bp, Mus musculus
catagccagataccaaggactacagtttgtaagtgcccggtgtgggaggcggcggcttaaagctaccctttgccccaggccctacccctgagccatcggccctgcccgcaggtgtacctgtccttcatctaccccaatgaccatacccgtctcactcacatggagacagacaacaagtgcttctaccgtgagtccccactatacctggaaaggtaggtgggggcgtggcctgtcagaagcgagaatgaggagcctcgatgaggaaggtctctgatgcactttctccctcaggtttgggttctataaatacatgaaaatggacaaggaggagggagaggaagatgaggaggaagaagttcagcgtagagccttcctcttcctcaacccagatggtgagtgtctcggtcctgctgcactcccagcccaaatgccaggtacttgagcttaccagaccctctctgcagacttcctggatgaggaggatgagcaggatctgttagacagcctggagcccaccgatgcatctgtacagcagagccacaggacccccaccccagcagcctccactggaacgacagccagcccgaccccacctacaactagtcctctggacgagcagaccctcagacactcccgggcactgaattgggccccacgccccctgcccctcttcttggggcgagctccacctccccgaactgtggagaagtcgccttcaaaggtgtacgtgaccagggtccgacctggacagcgggcttccccgagggcattgcgagactcaccctggccacccttccctggcgtcttcctgcgccccaagcctctgcccagagtacagctgcgggtacccccacatccacctcggacccagggctataggaccagtggccccaaggtcacagaactaaagcccccagtcagggcccagaccagccagggaggccgggagggccagttacatggacagggactcatggtgcccacagtggacttgaactcctcagtggaaacacagcctgtgacttccttcctgagcttgtctcaggtatccaggccacagctgccaggagagggtgaagaaggggaggaggatggggccccaggtgatgaggccacatcagaagacagtgaggaagaggaggagccggccgctgggcggcccctgggtcgctggcgggaggatgccatcaactggcagcgcacgttcagcgtgggcgccatggacttcgagctcctgcgctctgactggaacgacctgcgctgtaacgtatccgggaacctgcaacttcctgaggccgaagcggtggatgtagtggctcagtacatggagcggctaaatgcaaagcatggcgggtacggggcagacggctgcttgaagagaaggcatgccggtgtctgcagggatcgcagaacttccttggctctcagcaactctctgagccccttctccctctctgtaactactgtcttacttatccaggttgaagggctctctggagcccccctcaagactgacttcatctctcctcactgccaattcccacatctgccaccttagacctagacccagggatgaacccaaaccatcggggacagtagtcaggagtagccagattgtgggcagacaaccttttcaggaaccagagacactaaagtgtcatgacctctacctgtggagcactgcagggtcccaactaggggactgtgtctagttcaagggagcctttggcctcctaggtctcaggcttcaaacttgtttctaccccattttgag

SEQ ID NO: 33192 - DNA, 1246 bp, Mus musculus
ctattgcctgcagcattttgccctgtgcatcaaactcattgctgcgtggtttgtgcctgatgtgccccagaaagtgaagaatgaggttctgcaggagaagtatgacagaattcgccatagaatgcggtagggatgtagaggctcacctggctggagcaggtctctgcctggggacaggcctggcctccgacccataccaaccctatccttcctgcagcttcagttccaggagcacggatgtatagacgacctggggcaggtggagaaatgccactttccaggagcctggactaggaataagtccccacctctacagcttgcccctatccataacaatgtgtatgtatgtgttgagggaggctgtaaaatggcccatgtatatgtaggatcctggatggtctacatatatgttaatacatgaagatcaaaggagggcctagactatatgtaggtgtatatgggcatcctacgaagcccatgtgtatatgttaaccacgggagacttgtatatgtagggatcattgaaatccatgtatatttagggtatttatgaacggcacagatgtgcctgtggggtttgcttcaactttcctacggttcagattggtacagacctgacttgagactcttgaatgaccctagtacctatagaactgcaggttgctcataaaacccccatgcagtaaaattagcctaaatgccatggacctcctggcttctgggcctcagatcctgctctgtggcctcctgctttgtgggaagccatggacctcctggcttctgggcctcagatcctgctctgtggcctcctgctttgtgggaagcctagagagtaacttctggatcccctccctcccagttaacctggatccgtacagcggcaaaactttttacaagcaaaataaacctgtgtgtattgatttctgagcctcatgatgtagatccagtttctagagattatttcttccctgggctagattgagatgggatgaattatggcagcctggggccacctggctcttctttggtttgcctcattgtctttggtttttgtttggttggttggttggtttttcaagacagggtttctctctatagccctggctgtcctggaattcactttgtagaccaggctggcctcgaactcagaaatccgcctgcctctgcctcccgagtgctgggattaaaggcatgcgtcaccaccgcccggctttgcctctttgtctaagcgcggggcaccttatgg

SEQ ID NO: 33193 - DNA, 1167 bp, Mus musculus
caggttttggtgactgtgtgagtaatagggtgaacattgacctcaagggaaaggtctatttattcagatattcctggtctactgagaagaaatagaaaatagtactcctttcaagatcgtagacagccaaggatgccctcaacttgctggctacttcaaaaactgtgaagatcagagcagtacagaaaccatggagctaaagtaatttctaaggtcttcggaaatgagctggggattagagcttagtggcagaatacttgtctagcatatgtaagaccagaggcccagttctcattaccagaggggaagttgggggaagccttccacatttactgttaaatgtgaccatatctacctgtgttggaaggtagtacccctctggtacccacgggaatggtcagtcagcttgggagtgcaggtgagccccgctcctgtgctgggtgactaggtatcacgtgagtgcttggtgatctctgctctgacactacctgtgtgtttttggattcaggcgtgcccacactttaactgtgctgttcatcctcacctgtgcgctgggctacgtgactctcctagaagaaacccctcaggatacagcctacaacaccaagaggtaactgcttctgttcagagggtgtgatgtcctgtggagctctggccagccggggctctgcattttccttgtgtgtctgattgactggctttcacaccttcccctgaagctgtgtggtattccttgcccaggactgtgggaactcgtcacctttgagtggtagggatattttgctttagccttcagggtgactccctctagctggggtgcagaagccttgtgagatcgaccacatcatcacaccagcagctcccctcagacgtaaggattctcagattgtctgggatctagagccaccagcagtgaaccctgtgatggcacttacatccttgttgcattcaggttccgaagctagtccctagcatgtagggacaagttactccagagtactgacagacttttctgttgctcctctggttctctgggctgcatgtctgccctgggaaggcaggtcagttactgttagttactggttctgtgcaggtcctgcttgctctgggagggctagaggggaggcccgagagacctagtgaggtttccaggctgctttggttgct

SEQ ID NO: 33194 - DNA, 1112 bp, Mus musculus
agggagtgagggaaatggcaaggcaggaagcccaggacagcctggccccagatgcacccccacaatggtgctgcctgtccgtcccaacccatggcttgaaccagacctcctgttagagctcaatgccaagtcttggggccccttcatgttgtctgtaaaccttcaagttagaacggtagctgttcatctgctacgtttacggggggacctgctgaggctgggggcggaagtcagggattgtgtttgaggggtgctgtctgtagggaaggagtggcaaagcctgacgggcgctgtctggccctcagacgctcatgatccgtgactggtggatgtgcatgatcatcagtgtgatgttcgagttcctggagtacagcctggagcaccagctgcccaacttcagcgagtgctggtgggaccatgtaggtgcagcgggcaaggcacagcctgggtgggccccgccgtcatctcaggccccgtggttaattcctctcctttcctgacccagtggatcatggacgtcctcgtctgcaacgggctgggcatctactgtggcatgaagaccctcgagtggctgtccctgaagacatataagtggcagggcctctggaacattccaacctacaagtacatcttgggagttatagaagggaaccacagagcattgggcccgcaaggacaaggccttgctacttgggagggtggcaagcaaaacattagagtggtagagagtgactgctagtcctccatctggctccctggcttgcttctctcaagaggctgtgggcctgatctatccacctctcctacagcctaggttgtccttagacttgctctgtactctagaatgactctcgcccccaactcccgggagtcataatgtgtacccctatgccaagtttctctgctacctataagatttaagaaagaaaaattgtacctgaaatggtggtatatgtctttagaggccactgcttggtaagctgaggcaggagaattccttgagtacagaagttcaagtttagtctaggcaatccagggagacttctctccccccaccccccaaaaaaaaaaaaacacgcacacacacaggaaaagtgggagctgaggatata

SEQ ID NO: 33195 - DNA, 1330 bp, Mus musculus
tgtactctctgtgagtctctggttctgcctggcagatgcaggtgcttgaggtgacctgtcctgcctatagctgaccctctacttgctattgctagaattatagcacatgtagcctcttgtagaacgaaggtagccaggtgtctgtggggcctatgctggggctgctgcaggaacaggtggtgaggtagctctgctgccccacagggacatcaccatgaggtacaaggagacccggcgacagaagcagcagagtcaccaggccagagccgtcaacaaccgggatgggcaccctgggccagatgatgacctgctagggactggaactgcagaagaagaggggaccaccaatgacggtgtgactgctgaggaggggacctcagccgcgtcatgagcctcaccctcgtcactggccttgtgccaaggggctgtcccatttctcccttcctcgtgctccctgcttcagaggcaggggtggggggggcatccacactccaggaggggcacctgagaatacatgtttgtgtgcaggtaggtgtatgcacatattggctcctgacactactttggggccatgagctgaacagtgagcctggaacttgctctagagcaagagtcctttctacctggtcaacaaaggccctggtccatggtctcccttgtgctcaatctcagcaccggctaggggaggtatcttggtatctcggtactctttctccactctttatggggtaggcagaagccccatgagaccctgtggtcccacccacttacagcagcataagtgaaggatatcataataccaacatgtctgcaaagtggtgggtctagagtcagcactgagccatttcctttggagccttcctttaaccacgcaggactataaactgaatggtgtatacatgacagtcacagattggccttttgcggccagagagcccaacttggagacctgtaccccaggtgccagggtgctgtcaccatggctcccttgagcaaatggaacaaataaagtgatgatgaaggtgcatagcctctggctgccctttgccccgtgctctatgccttgcagaggaggggagtgtgtgtgtctgtctgtctgtctcctgggcagctacccgtctactacattgtttctcactgggtgtggggctggtgatcgctgaagaataaccacgagaaatgactgtgagccttgctttacggtcacagccattgggaatgcagtagcaaaccatttgtctgccaacaagttcaattttcccacgaatgcaaatgtgcaagtcatgcccttagcttactaaggcaacgggtcgtgtctttggatttttga

SEQ ID NO: 33196 - DNA, 1257 bp, Mus musculus
gttcccatgggcatgtggcttgtcctaaactcacagagaccttcttgtctcttgtttcccagggctgagatgaaaggcgtacatcagcatgcttggccaaatgcatgcagcaacacctgagaacctatcccatggagttggacatggcggtgcacaccttcagtcccggcattcaggaggcagaggtaggtggatctctacagttggggtctacatagtgagttgaaagatagccagggtatgcagaaagattctgtctttaaaaggaagaaaggaggaggggggaagaagaaggagaaggaggagaaggagaataaggaggaggagaagaaagaagaaaggaaaaaagaaagaagggaagggagggagtgaggaagaggaggaggaggaggatggaataatgagactatggttgatcttttatttttcctcttatcaaaagatttaactttgctctttgtctcgggcctgagttcgtaggcgcagccagcctagcgaggtcaacatgccggtcgccagaagctgggtttgttgcaaaacctatgtgaccccacggagacccttcgagaaatcgcgtctcgaccaggagctaaagttgattggagagtatggactctggaacaaacgtgaggtttggagggtcaagtttaccctggccaagatccataaggcggcccgggagctgttgacgctggacgagaaggatgcctctgtttgaaggcaatgctctcctgcggcggcttgttcgcattggggtgctggacgagggcaagatgaagctggattacatcctgggcctgaagattgaggatttcttggagaggcggctgcagacccaggtctttaagctgggcctggccaaatctattcaccatgcccgtgtgctcatccgccaacgtcacattagggtccgcaagcaggtggtgaacatcccatccttcattgttcgcctggactctcagaagcacatcaacttctccctccgttctccttatggtggcggccgtctagggcgaatgaagaggaagaatgccaagaaaggccagggcggggctggagctggtgatgatgaggaagaggattaattaatacttggctgaactggaggattgtctagttttccagctgaaaaataaaaaagaattgatactaaaaaaaaaaaaaaaagatttaactttaacttttaaaagatattttagacttattattttgtgtctacatgtggtttatatgcttgttatatatgtctgctcacct

SEQ ID NO: 33197 - DNA, 1193 bp, Mus musculus
ccttacccggttagagttaatgacatggcctgatggccttgtaggtcctcagcgagcaccaagccacaccctgcgtgactctgggctcaaagatcttcacggacaacactgactggtccattgactgcttcccgctctcagagtctgagcctgatgttcaccctggtgaacagcagtgtcgaccttcatcaccacagaagggtcgggcaaaggatgctggggccaggcgcaagaagccagggtaggcgcaagcttctgattctgcttcccaaaacttgtccctttcttccctaggcgtcgccttggacaggactaccaccctggctcatgctatcttgcattatgcccagctttggctggaactgactaggatactcctcaggtctttcccatatctccaggccaggtgttcgtcagcacaggcactccagcacaagcggactgagggcctcacgaactcttcaccccacagagacccgggatatcttgccactcctaagttcccgaaagcttcttccctctggggaagtccttacacagcaggaaggtgtgaaggctgagacgtcagagctcctgcccgtgatcccagagtgtccctccagactgtgtcttggtgaggactcactgggtaggcaggagtacaaggtccaggtaagtgtgatgctgtggccggagacactttgatccgctagcccacatggctcttaggccccagtgttttctgcaggtgtgccggaaaagcgtggacctgagttgccccatggtggccctgtcagtccagaacacagccgagagcagatacggcttccgcttcctctgctaccctcccatcactgaggaattgtgtcggcggttgtaggtcagccaggccaggcaggcagtgacaacttcataatttattgaaccaaccattgcttgcaaagtaaagcacatttctgcatacctgagagttgaaaatgattcgcttggcttttacagagggtatatggtgtcccaacagaaaggaactgcccccacataaggaaacctgcaaatcttcccaggatgcttgcgcaattttgaaccctaggataagcaggctcagaatttgggccatatagatgacccagagtcctgggatatctaaagggtccagccccagctccacctacttcactgtggccccacctaggccaagagatatcagcaaggga

SEQ ID NO: 33198 - DNA, 1214 bp, Mus musculus
aggctgaacccgtctctcctccacaggccagacaggtcgatttgtccttgtgcagcgtcttagggagaaggaacgacagctgctgccacaggagtgtccagtgggagcccaggccacttgtggacagtttgccaatgatgttcagtttgtcctgaggcggacagggcctagcctgtctggaaggccctcctcagacaactgtccacccccagaacgatgcccagttcgtgccagcctccccccaaagccatcggcgataccaggccgtgagccacgcaaagcactgaccttcaaccttagatgtcccaagctggtccccagcccatctattcctgagcctgcagccctggtaggacccataccagacggctttgcagacctgcaggacctagaactcaggatacagaggaacactgaggagctaggccatgaggccttctgggagcaagagctgcaacgagaacaagccagggagcgcgagggacaggcacgcctgcaagcactgagtgcagctactgctgagcatgctgcccggctggaggccctggatgcccaggcctgtgccctggaggcagagcttcgactggctgctgaggcccctggtcctccttcagccacagcgtctgctgctgagcgcctacgccaggacctagccacccaggagcggcatagtctggagatgcagggcaccttggccttggtgagccaggctctggaggctgctgagcacgctctgcaggtgagcccagatctggacccctgtcaacttcgctacctgctacacagccagtctcaactctccacctgctgcacaggcagtttggggatctgttagagaatcagaccagggagcatactgtatatggaaaagaaggttgtggcctcgtccctgaaggtcctctgtacccccaggcccaggctcaggagctggaggagctgaacagggaactccgtcagtgcaacctgcaacagttcatccagcagacaggggctgcgttgccgccgccacctccacagctggatagaaccatccccagcacacaggtcagagtaattctgggaagaggtggtggggctacccccagatctatctcggctgacctgctttccccacaggaccttctgtctccaaatagaggagaactccagggagtcccccagagccacatcctagtgtccagcctgagtcccgagggtatgtttctctccctacc

SEQ ID NO: 33199 - DNA, 1170 bp, Mus musculus
cggggtgggggggcgtttatgataccataggtaggacagctgacctgtaacattcccgttgtgttgtgcagggactattagtgtccactctggaaacagagtagtttcagtgtctgttctgatcatatttcacatgtcattgaacttgttacaggaggtgggaagggttgctatctgacttctgttttttagctcctgtttctcttcagcgaaattctgtgactcaatccagagaagagtccaggctcagagacaacccgcagcctggggcactaccctcagagagtgcatctggtggattcgtgggagacagacaaccaaactcagggctgagctgtgggaatagaacagctctgtgctgtctccctgcccgcattgcccagacacctgtgaggtcagatccctcactgactcctcgctcaggtctgtctaggaccctttcagatgagaacaggcccagccggacacacagcagcagcccccaactcaatggctccaatgtacgggttagttctgcctcgactaagatcgtgactcattctagctttccatcgaaaaatacagcttctgggcttcctcagagaacaggtcccaggagacctgatttctccaagctacccaggataccaaagatccatcgggatggcaataagagcacgcaggaccaggccccagccagcggccacattgtcgagctccctagcacttgcatcagccgcctgactggcagggaaggccctgggcagccaggacgaggccgagtcgacagtgagccaagcagcaggggtccccaggagactggctcacacacaagtggttctcgacctcctgcgcccagctcccatggcagcttagcccatctagggccctcaagaggaaagggcattgggtctagctttgaaagtttccggatcaacatccctgggaacactgcacattgcagccagctgtccagccctggattctgtaacacgttccggccggtagacagcaaggtgcagaggaaggagaccccgttccccctcttctccatcaagaagccgaaacaactcaaaagcgaaatctatgacccctttgaccccactggctcggactctagccctcctagcagcagcccagagagtcttggtccaggcctcctaccctctgagatcacaagaactatctcca

SEQ ID NO: 33200 - DNA, 1202 bp, Mus musculus
attatacagtcgtcatcttcttgtgattcttctgtgagacattgctcagttacctgtgacattcagtttgtataatttagaaatgagtgacgccaaaagtagtgggtggcgtagctggtccttgttcatattcctgccatgctgtaagttgacattgaagccagcctgtgtgctgtgctaatggacagttcattggccctccctctggggcacagggtctgcgtacccattctttctgaggcagagactgctgggcgtagttctctagaggctccaggctcacaccttgagaccacatgccctggaggaagttctttggcctctacctgagagcacagtggcgatctcttctgttgaggctcatccatggaaagacactctgtggttctgaaactctgtaggtttctaggaagctcgggggacctttttgaagtcactttggcagcacagatagctgtcactggtgtccgtctgctggtgtggtagaatgttgtctctgaaaaaagagactaatcttggggccctcttccattttttttttttttttttcagaaaagctgcagcgttagtacagagagcccctgtgacaatcacaggctgtcctccgggagtgtgtcagtcacagctctcttgtcccgcctctgaacacaaacgccagctctacagtgggtttcattattgctgccatttttgtgctcagggctgtctgggacacacatactaccccagcacaagaaggggaggggtatttcccccagctacataggccaggctgctcccctcttctctgcagctctgaagtcaggcaggtcatctgttggacatgctcagactggctcttctcacagtggaactgacaaaaagcttcaacaggaagaacaaacctgccttaccacatcctgtgtttagtggcaatccttgcagcctggactaggctgcctgccattgtctgctgtctctccttctacagacctgaccactaagcaagttcacctgggagctctcctggacaggagtcaggagttaaccaaccagtttgtctcctgccctattgatctgtctggtcacatatttctagcagggtgaacacactgatgttctgttatagccagtgctgtcttccaaggtcctgtatgtctggacccccactcctcccatagtgccttcctgactctggcctaccaattctatctacatggcta

SEQ ID NO: 33201 - DNA, 1187 bp, Mus musculus
tttggtgaaattgctatgtacttgataatggcctacttcctccagttatttcagtattttgcaacattattagtcataataacttgacactatttaactcttcttcaggctttccttcagtctgaagagttccacgggcactacatatgtttggtgatcatatatacatgcaagtaaaacagtcatacacaaagaattataaaattttaaaaatatataacaagctgggtgtagtggaatacacctttaatcccagcacttggaaggcagaagcaggtggagctctgtgagttccaatccagcctagtctacatagtgactaggccagagctacatagtgagacctatctcaaacaaacaaacaaacaaacaataaatatcaatatattagcaaatagaacccactaactgtcagttgggcacagtggctggtcttgtactgaagctggtgatggaacaggccttgactgctgtgtgaccagagtcacatggctggtgggaacagaccagagggaagtgaagaaccctgtcaccatctggctcctgggtgcacagcccagcatacataatgatggctttgataaatgtgctaaacacagcagttagtccctgagctctggtaccctggagggttctaaactagaactcaaatcttttgaggactggccctcctggcacctcattagagtcctataggaaggctctgttgtgggtccctaaatgtacaaagtaggagggggagggaattgtggtgaatagctcaggtgtcttctttttacgtgtagaaaaagtgtggattttcttgagattggctgaaacataaacatctaaacataccaactggaacctaaacactaactggcattactgagtttgcatcctctgaacctgtactctctgagaaaataatcccttgccatcacagtttgatttgcaagcagtcctgcttgatcacaggataaaagtggcaagcaatgcttgtgttggagtggaaagaccatgctgggaccctttctacttggggtgtgtactagggccatctgagaagcctcactgaggggctttcaggaggtagtgcaggagttaatttaacacggctggaggggtcctgagtctgccaactttcacattttatttggaattttcaaatttagcctagctgaagcaatttgttacaggattttctg

SEQ ID NO: 33202 - DNA, 1167 bp, Mus musculus
ttgaaaaaaacacaaacaaacaccccaccccaccccaatgggagatagtcagagactctaaagtatcacagagtagcattcagggattggtctttttaagtatttcaggacacaacacagaaccattgacgttgctgtaaagcataagtctctaggtataaatcttataaaatatggtggactttgtgttgtgaaaactagaaagtgctgataaaggcagtcagcaaaaaccctggatacctcaagtcagactgcctcacggaggggaggctcagcatacatagtgagggagctaacttcccaactgacaggtccagtgtagtcagaatttcaacaggattctctaggtacagaaagactgattctaaagtttatatgaaaggatgaaggaaataaagtagccaaagcagttttgaaaaagaagtctcaaagttaggtgtggtagcacaggcctttaattccagtactcaggaagcaaaggcaggtggatttctgtggatagaggtcagtccagtctacatagtgagtttcaggccagccagggctactttatgagactgtatttcaggaaaaaaaaaaaaagtagaaaaaggcaagtctgaacttgccaagctccactgggcttctacaggttctctgttgctgtggtcagcagctacagtgtatcagcagggaggcttgtacaggttctctgttgctgtggtcagcagctacagtgtatcagcagagaggatcagggacctctgggaactgagcagagtccagctgccaaccccatctttccaaccgtggtgctgaaccattgaatgtttctggacaaggaatgaactttgacccaaactacactatagattaaagggaattcaaattgtagcaaagatctaaccatgagaggacatgctgtgacattttagaaggaagcacctttgtgacaacctagggttagagtcagagtttctaagacatggaaccaaagttaaatactgctcagtagtctgggctttgtgggttttttaagctttgacttccactagggcagcaatctcaacctgcgggtcataacccttgggggttgaacaactcgccttacacaggggttgcatatcagatatttacatcacgactcataacagtagcaaaattagagttatggagtggctcgaggtc

SEQ ID NO: 33203 - DNA, 1236 bp, Mus musculus
cggttgtgcctgtgcatgtgcgtgcgtgcgtgcgtgcgtgcgtgcgtgcgtgcgtgcgcgcgcgcgcgttaatttgaaaactaaatagaggtctatagaaaggcagagaaggagtgctgcccactgaagggttggcactaccctttagcaatgtcctcatgtacctgaggggcttggacttgggcttggggatggagcatcatgggcttccgggtcattctgtgctctcatcctcatagcctctctttgcccaggtccccagtctcctcctaccccactggcacctggccaggagaaaggtggtaccaagtacaactgggacccttcggtgtatgacagcgagttgcctgtgcgctgtcggaacatcagtggcacgctctacaagagtaggctcggctcaggtgaggcagtgcttggctacaatcattccatgttaagtaagactttgttcttttgtgtgaccctcttagtaaactgggccaaggaagcctgtcatgtgcaaatatggtagaggagaggagacagatgtgcaaggactgtcagccctgcgttcatggatccagctcagaccactcatgacagaggatccctgaagtgggctaatgctcactggagacccagcacagctcacagtgaccatggacagtggatttgagatgacttgccaggcagtgtattgggtgactagaggccatgcagggcagagaaattgaaaaggcagtggaaggaactgatgtcatcaaggcaagacagcaacaggccttgatagattctaaggaccgaacctttcatttcaggtggccggggccggtgtatcaagcagggagaaaactggtacagcccaactgagtttgaagctatggcaggaagagccagcagcaaggactggaagagaagcatccgctatgctggcagacccctgcagtgcctcattcaggtgtgtgctgggactacatcagccttaggacctggaacatggcacaagtactcacactatgaccagagcagttcagctgccctctagatgttcttgtcctagctgtgtgctggcattgactcagagaattaccatggtgggggagaaggggcagatggggtaacagtaggcacagaagagagacacctcagatacatgggaagagaggtagagagtcaagagcagggtccagccacacctgccttgcttttgctccgatttcattgtaaggaaggaaactttttctttaggtttattat

SEQ ID NO: 33204 - DNA, 1149 bp, Mus musculus
tattagagttttagttgtatatttatatatcagaagatttctaatttcttcttgtaagtttttgaagtctgataatatccaggtagctcagtgctagctgagttcctaaattaggtgtgccccatgtatggattggttatggacaggatctagacaggtacaagggtacaggttggtcagggctggattaatggggctggcaggactccagttggcatctttgggtattttccttatgccaaaggcttccctgggtattgggcattttagaatgctgggcggcagacagaactgatagagattggcaaggccaactacaaaggatccatagtagcaggcagcaggatacagaagaacctagagaccctgtggcaggaagcctcagggacctgacacatctttgtagagctgctctgaagttgctgctggtagacctgccccgaggagtgaagttcatgttgcaggagcggctgtggcaggctgatgtgtttttcaggaggaagagtttctggggaaggatgtcatggagacctcagacagtggacacaagactgtaggatggcctgagctatggcagtggagagggatgaggctggagtctgccatgtcttgatcgacaaggaggtgtcctagacctatgggacttgcagcttctttgcaaagggagaaaggccagtggtggagtgggaatgggtggttatggtggacgtttttgctgcatgtgaaaggctttggtggggaagggtagagattccccttttctgggagaagcaagtattttagactggactagagatgtcagctgagcattaacagaagtattaaaatgtctgggtggacacgggcgctttaaggctcacaagtaagatcattgccttttgtgctctcccatcaccgtgtgtgaaagttccaatctgttccattcttttgtagaagtgaccacagtgactgtggccaacgtggggtcctctgcagataacgtcttcacaacatcagtggcaaacgcagcatcgatatcaggacatgtcctggtaagctgttcttgggtgtagttcagcgtgcctggcaactctctttagagccagcccttgactttgccgcacagtccatgagggtgatcctcattctcaagaccctctcgggttagat

SEQ ID NO: 33205 - DNA, 1111 bp, Mus musculus
caaaggccagttcaagtgtgacatgagaggggcaagagagtcatccaaggcaggcaaccttgcaaaggtaacgatgcagaaaccagccttgctttatattgtgacatgagctgctccgtgctgtatctcctagtcttcctatgcagatatcccctccttctccatcacttagttttccatttttctccttctgttttctcacacaaagagcacccgattctcatgttttatgacaaatggagccttgagctgagctgtatcaccctgtacaggtgataccacaccaaactgcctcctacaatcccaccacacaccccaccctttgaccttcctgagtgttgaactccctaccaattggagctcttatatgttttatgcttgtacatgcgaatccttggaagaccatcattttgccatgcgtcttgtttcgttctttccagtgtgaagctgcaggcttggcattgggcttttattcagggcacatcagagctgaagcttaactctgggtgggtgttcagaccgttggcactggaacgcagtggtggagaacccttgcttccgcgtgttttctgctgtacctacctacctgaagcctagatccagtcacaggagtgagggaagcttcctagagctttaaaaaaaaagatatatatatatatttttatgtgtatatatgtgattgcaggtgcctgcaattcctcttggagctagagttacacatggttgtgaggacctcacataggttcttgggtcctctgaaagaacagcatgctcaaaatttctgagccatccggatctcttcccagagttgttgttcttctttttctaaagttaatttatttaatgtgtgtggctgctttgcctgcatgtatctctatgtttgcttgatccccttggagtcagaaaaaggcttcggttcctttggaactggagttatagggagttgtaagccacttatgtgggtgctgggaattgaatctaggatctttggaagagcagacagtgctcttaactgctgagccatctctggtccctttcctggagcttctttctctttctttctttctctctttctctctttctctctttctctctttctctctttctctct

SEQ ID NO: 33206 - DNA, 1152 bp, Mus musculus
accgtgtgactatcaacagatacaaggcagaaattcactgtggatataaaggaataaatatttttttggtgtgacaaaggttatagctaccctcttctggtaggacttttctttcttgcttgcttacttgctttcttgctttctttctgaacaaggatctcttatgtagcctaggctaatcttgaatttataatcctgcctcagtctctcaaatgctaagattataatgttttgtatgtttgttttaattctgagataaggcctcactatttagttttgacctgtttggcctggaactcatagccatcttcctgactcagcctcttaattgttggattagtggagatagccataatcccagactggaaactgggtgttttatgtgacttaatttcaagaccattttctcccctagaactccctttttactgtaaccaggcacacaacaacagcactcccatgtttgtggcagctgttaaacaaagcatatagtagggatgccctgcaggtgaggctgcacgtgtagtacaatcacatttctgaaatttgcttcattaaggaacattgggaaactggatggatggatggatggacaaacactggtctgagctggctaagaccagtttctgttccatattgctagcactggaccctgcctgcatatcatctgagctcagacctcctcatttagcctgggactcagccatggtgaaatattgactacagcaccttctggctgcccgggactcaggttagccacaggtgtgtgtgtgtgtgtgtgtgtgtgtgtgtgtgtgtatgggtgtgtattcacccagggtaaactgacattatgccttggttgtgtctggtgtaaaccaggtatgccatgggtgtaccaaggtatacttcaggtatgccttggaggtgctgaggagaactataagtgtgcttgggatgagctgaatgtatgctatgaatatctggagtctagcgcatgccagaggcatgctatgaatgaatatgtggtaagctgcaggtgtgacaagatgtaccctaggacacactgggtgtgtcacagctatacctggtttaaaaaaaaaaaaatcccatcaaagccaacggactcaaagttccagaaagccaggaatttgagaactggggaagaaaagc

SEQ ID NO: 33207 - DNA, 1099 bp, Mus musculus
cactggaaaaacaggaaacagcagggccctgtcctgtaccctctttattccccaacctcccggctgaggcccaatctctttttcctagaaacaacaaagtgggtcagaactggagaagctcatgagcaagatcaggagggccgaggacagctataccagccaacacacttcaccagagtcagagggggcgccgcacctgtaatgggcccaacccaaatgcatggagtattatttttatatgtgtattattttataccaaggacatagatgggctgggtgtaactggcttacctgccctccaggcagagtcctgtgtatgagcctagctacacctgtgggtagctcttttaccacccgagccctacccccaacccaatactcttcttccaaaaccaaggccagcctcagccaaacctgtacctggcagtgccagtcccttctcaacctgctgccaaggccccaggactctcccggtgggcaaggcctcttcccctggtcttcttggtgcacatgaaggtccttgttccttacaatgctgggccccgactctgcagctctcccttgtgttgcttgtttctacattcacgttttcctgcatccgctgtaccccaattgcaggatgggcctgagccctcagctgaccagcctggtgtccttgcctacatatttgcccactcccttcacgctgctagcatcccaggaacaacctggtcaggggctccaggacaggaggccttgggtgacctgctggtatagagtatgctgtattctttcttctttgagacctaagaatgaaccagacataggttctgacttcaaatgtcccatcccacccaaagagcctgtgataacagatgtctctggctatttccaccagcctgttcgctggtgtctggtgcgtttcccagctctggatggagccccagacccagagatgagagtggggactccacagctatgtcaataaaccagatgtctcctagcaacttagatatctgtttcttggggtagaagtgctctgacacccaaactgcctcttcttcctgctccttttctctgggatagtgcattggccctgaactctgaatcgtcatcctgc

SEQ ID NO: 33208 - DNA, 1867 bp, Mus musculus
gcccaggctgtggcctgtgctgaggcgggcgtgacgctcatctctccctttgtggggcgcatccttgattggcatgtggcaaacacagacaagaaatcctatgaaccccaggaggaccctggtgagctaccctttcaggtcacagactgggtggggtgggggaccaagtgagggtggggtcagacagctcaggacggctctagggcctttgtggaacatgcctgggtctcctccaggggtcaagagtgtcaccaaaatctacaactactacaagaagttcggctacaagaccattgtcatgggcgcctccttccgcaacacgggcgagatcaaagcactggcgggctgtgacttcctcaccatctccccgaagctcctgggggagctgctcaaggataacagcaagctggcgcctgcgctctctgtcaaggcgggtaaggccaagggtgaaggttggctagccctgaggggagacgcttagcttaggcctgagggacagtggtgagtccacgggtgaggcaggcatggagagctgtggtatcccccagcccagaccagtgactcggagaagatacatctggacgagaaggccttccgttggctgcacaacgaagaccaaatggccgtggagaagctctccgacggcatccgcaaatttgctgctgatgccataaagttggagcggatgctcacggtgagttcctgagtgggtgggcagctctgggccttttctttcacccaggggcagagtttgggcagagttgaaagttactgtaggagcctggcatggtggcacacgcctatagtctcatcactttggagagtgaggcaagaaggtcacattcagtagcctgggccaggaatggtaggtagcataggcctttagtccaagctcctgagaggcagtggctgtcctaagaacaacaatgatacacaaacacacacacacacacacacacacacacacgggggggtgggggggtttcaggagaggatatatgtgtggtgggggaggggatatgaatacatgtgtgaatgttttttttcttgggaccttggtgggtcttggctggggccctcccatgactctggctctggtcatttccaggaacgaatgttcagcgctgagaacgggaagtagtgcaacacccgaggccccagtcctgcaccgaggctgaccccagacctgcactgcctttgagctgggtcctaattgcacatggcttgtgacgaatgaatcttgcattttttagtgatcggagaagggatggatcataggattctgattttatgtgaaattttgtctaattcattaaagcagttgcttttcctatgctgtttcatttcaccgtctttgtcaccacccgcctaagtaccagttgccccggtgttggctgtgactgaggctgagactaggagatgaaccccaggccatcagcatgatgtcagcagttgtggtcctcacctccatcttctaagtcacagctgggacgtgagatggcagaggtcattgtttttggtgctgggactctatccaactctggcatcctgctccctgaaatagaagtagtcccccccccgcccccccaatcacccaagaggctagtagtaccttggcgtccacctagcctatgccaggctggaagttaagagactggctcagggtcttaactaaagctggagctcctggcccatcatggagtccctatgccctgcctgttcttacagggagcactagcagagtttggagacgaatgctgggctctgctcctggaggacaggcaacggctgaccagagtgctacagagccaggcctttccactgcccaaggtgtccagcattgtccttccctcatccaagtgttctg

SEQ ID NO: 33209 - DNA, 1624 bp, Mus musculus
gtcattccctatgctgctacaacagttctctccttgcctgggtgatgtgtgctaagtgtaagaaggcaaacacatcctggaacctcagccccttacctggacatcatgggaccctccaagggaatccttccagaggatacgaggatacctgcccatctcattttggtcacatataccttgatgccgtagtggcttagtccctaaaagatgtcagctttgcctttaccccatctccccctgcggatttgatctgcctggtccctggggttggtcctttgggcagtagggcattggactgggtaaagccactagctggtctgacacaggccctgcccttgcagccttcagtgtacgagctcatcagagcacctggctttgcccgcctaccattgatcgttgaggactttgtgaaggactctggtgctggcttcagtggtgagttcaagttggtgccccttcacttagatgggcgaggctacttgctgtgtgttcacagatccctaatgggtgggagtgggtctgggcctggtctttgtgtgcctaaggcttgtgccttttgccttagccagtgagcccgacgctgtgcacgtggtgctggaccgccatctggtcactggccagaacgctaactccacagttcctgctgtccagaacctgctcttcctctgcggcagccggtgaggctcccgggcaagggtttgggcgggttcccgctttgtgactggctccctctgctggacagttttgtctgtgacactctgtctgctggtgctgagcctggaccatgtattcatcctataggaagtaagcttggatgcagtcctggtggcctagagacaaggactgaactcaccatggtctcctgtactgacactcgatgggacactcaagcctccatcaggaccttgtggaatgctggaagcctccagggattaatacttgtggactgtcagtcctaatgtagactaggcaccctttcctccatcccagcacagtgtcttggctggccaggcagtccctgagaactccagattgacgattccaagaagaattgcccacgggatgtagtcagctgtggggtctcaggatggggcgttactcttctgtgggctttcggctatttctgtcccttccactgttcatgggaatcgtgtggatggaccacaggctggagcttgctatgaacttcctttctcgtctttccttttttttttttttttttaaaaaacttgtttatttttatatttcctatgcaatggtgttttgtttgagcatatgtctttatgagggtgttggataccctggaactagaggtacagacagttgtgagctgccgcttgggtgctcaaaattgaacccaggtcttctggaagagcagtcagtgctcttaaccattgagccatctctccagcctcccctatcccctcccccttttttgagacagggtttctctgtggccttgcctgtcctaaaactcactctgtagaccaggctggcctggacctcagagatccaccggcctctgcctctgcctcccgtaggctgtgattaaaggcatgtgccatcacctggctgtgaactcatttttgttgttgtttgttttttttttttaaagaagacttac

SEQ ID NO: 33210 - DNA, 1099 bp, Mus musculus
cccgtgttccagaggctctgggctcgctgccaggtgccccacttctcctggttcctggtcgttttacgcccagtatccaacacttgccttttgccaccagagggagcacttctctgctcctcaggtcatcctggggtcagagtcacttttccccctggggttacagaagagcctcggcaagtctccatgcaggtattgacagggtagtaccaagggtggcgggaggtggtgcctcagcagacaggagggcactgaaatggttctctgtctaggtagtgcatatggctggactagagctgagaacccttctggaagaatcagaggcatcagtaagccctctgctgtgcctttcacagagcggcccccccagcttcctacaacctgtcactgtgcagttgcccctgcctcctggcgttacaggtgaagctgcacgccacaggactaaaggtgggtgcttagaggggggaatagcattcagaggggcttcagccttctgtcattttccatccaggcttcagtctagaccgctcccacctgcatctgctctaccgaacacccctgacaaccacctgggatgatatcaccactcaggtggcactggaattcacccacctgtatgcacgcttccaggtcacgcacttctcctggtcagtgtcccctagcttccgcaggaccccttctgcccttcctctgtatggccacacctcaactctggcacttccaggtactggctctggtataccaccaaaacctgtgtggggggcctggcccggaaggcctgggaacggctgcgactgcaccgtgtgaatctcattgcactgcagaggcgccgagaccctgagcaggttctgctgcagtgcctgccacggaacaaggtggggcagcaggaagacagaggggtgacctgaaggccaggctgggtacaaagctttggcctctgatccctggtgggtgccccacaggtagatgccaccctgagtcggctgctggttcgctaccgtggccctgaaccctctgagactgtggagatgtttgagggtgagaagttctttgcagcctttgagcggggcattgatgtagatgcaggtaggtctctttt

SEQ ID NO: 33211 - DNA, 1184 bp, Mus musculus
ggggtttgaacgctacgcccgtgcccgcatggatttcgggagactctcgtccatgttgcagaggcccctggcacttgaaaaatccctcgtttttgttgtggggaagacatgacagggaaatgtcttccttccggtgcacccttttcgtcaatgggaggcgtccccgtgcgccgccgtacgcgtcccgggggcttctgggtagcggtttacccccgcccactgcgtcagcgtcttcctttcgccgccggacgccgccgaggtcgcacgcgtgaggtctgtcccccgcagccgagtgagtagcctggccgcctgggccgcgaacagtggtggggactgcggggttggatgacggccgggaggcgagggtggcgcagcattctgtgaccggaggcctggcgcctcacgtggcctcacttgctgcttaaaatggagggggaagcagaaggcctctcggataacctcaccactgtacccactccctgccccatttagcatgcgctacgtcgcctcttacctgctggccgccctcgggggcaactcctctcctagcgccaaagacatcaagaaaatactagacagcgtgggcatcgaagcggacgatgatcggctcaacaaggtagcatgctgcttgcttggacccgctggatccaaatgtctaccagcggcggtccttatcctattatgtccggattttacttttaagaaaaattgtagataacctgttgaaaaggatggatggaggaggcctacacccatcttagtcatagttttctctttagtccttgtgcaatcgaagaagtcagtcgtgataatcgtgcttttatagaagtttaatacaactcatgttgtgtgatcttattttttgagacaaggcctcaccgtgtagctctggctaacctggaactcactgtgtaaaccagttttctaacttttttttttttaaactagctttgcagtaaaggatgtatgtgtgtagatgccaacagaggcatctgtgtctccttggacctatagtgctgggactctaggatatgttagagtccaagtctttagcagtggagctatctcatcgccccttaagattcttctagaaagggttcccactccacccacctaggttgtacatagaacctaaacttcacagaacggtagaattttagtatctaaaacttcctttgccaaaa

SEQ ID NO: 33212 - DNA, 1535 bp, Mus musculus
tgcctccaacatctataaagtggaggtaggtgggttctcagcaaggggcggggctaggccggactggtcttcaggcagcctggcccaccacccttctctcccactagggtggctgtatcactaagctggagaccttcattcaggagcacctgcgggtcattggggcggtgggcattggcatcgcctgtgtgcaggtcttcggcatgatcttcacctgctgcttgtaccgaagcctcaagctggaacactactgaccacgatgatgtcaggccgggcggccagccttgcactactgaccacgatgatgccaggctgggcggccagccttgcactatgtcccagccccactactgaacactactgacttagactgctgactgccagaggtagctaccctcatgccatcgccatgaccccccctggcatgccacctcaggggcatgcaccttcaagtgcctttcactgcacaccaaagtcccaaagctcgaagcagcgtacttgccccagcattaagaaggggggggggggtggggggttcaaatgccagtgttgggctaggcctggctagtagaatagggtttagattatttgacagaagtgcctcttatgcagactgcttccctttgggtagctgtgatctgcagtaagtctggggagaacctgagtacaccactacacgttgggtaaaagcaggtggggcctttctggttggattaggcacccttcatgcctgctaccaggaactctcagatctgcttgccccaaacaaatggtgtaagctgagggaaactccaaccccacacttgatgctctgtcctctccacacaggcctcttgctcctaacagctcagccctggccttttctcactactgatagcatcatgtaaatgctccatgttcctgtacactgtctccttttggagcatctctgaatggagcatggctgttttcatctcactgctgtattccagatgctgcccacaaatgctcctgctatgtaacaggtgctcaataaatgtaaatgtataagcactcgaatcagcttgctgacaggaccttatggtccagggtagctggagtactcacaagagtcaaggttggtgaagcccaatggcaattacagttagggtgagcactggtagctggaacatccccccagcccactgtggcctggacttgtccatgctcaaggaagagtctgtaggccttgctagggtcagagggcaagggaggcaccagggcctgttggggatgccctggctcctgtttctctggctttagctcatctaagcagctgagaagaggtcctaagctgattttgttccccacagtcttctgtgccagctggaggaggccactatgggttctctggactctagcctaaggcaaagcctttttcttttttttttttttttaaagatttatttattaatatatgtaagtacactgttgctgtcttcagacactccagaagaggatcttgttgcggatggttgtgagccaccatgtggttgctgggatttgaactctggacc

SEQ ID NO: 33213 - DNA, 1180 bp, Mus musculus
gcagggctcatggtcccatttctcctgcaggaatcgcggcgggaggcatgttgtcttctacccaactctgaaggtatgtgccatgtgctttgactgtcaactataatgctgtggtgggagtgagttttggccagatgacatcagtggtatcaatacttgccatctgcatttgaggtctgttctgtgggcttgattccaggtcacacattgcccccatgtctagggtaatttgggatatattgtgggggtagtaaggaaatgggtggagcaggtgcctacacctctgtctgcccccagtctctgcaggtgcggctggagctagccagggagcttggcgtcggggtctccatctgggagctgggccaaggcctggattacttctatgacctgctgtaggctggaaagcaacccccaagtgactggacttttctaagccatggagtgactggtgaaatataggccttttctctgtttaccatgagacagctgctatgggtccacacgcatgggtgtctcctagtccaggatttgaatcggaatcctttctactcactactcactgctgcctgctgtgggccaggtgaaaacgcaacccccatcccctaggacagcctggctctggactcaggcctcgagtgcttttcaaggcctgtgtgggatgtgggtttggaagatgtgaacaatcacagactcttctaaacagcccttctcagcatcacccttaagcctgacaggccctgccttcatactatgatcacctgcctaccacaaacacgggtatattcaaggtacctgatacctggagcaggttctacacctacccccactgggcttgatgtgaccaggttgtgcgatcatgttggaaactggcccagagaagctggacttacttctgtgaaacaccatgggccatagccctgactgtccaccagataacaggataggatcagcccatggggcagcagaaggacctgtgggctgagtgggacaggtatcatgagatcagaagggatctgtctatcttagtaaacagcaacaggctgatccagtgctggggagatgtccaagacttctaaggcaccaacaggtgaagaatggctgacctacttatttcttcactccttcattccaagtgccctcatcccctgctggatatgatctcaaggtagtgatctctggt

SEQ ID NO: 33214 - DNA, 1116 bp, Mus musculus
aggccaatctacagagaaagatccaggagagccaagcttaggcagtgaaggagttggaaaacagaaagccagtgacgatgtaatagtacaagggggtcatgttctagttcctgcaagcacagaactcagcagcttcagccatgtggctctggctctagagttaagaatggaaggaactactgggaaaattgatgcttgttagctggagctaaggaattagcagtgatcaagaagagaccagcatcactgaggtgaaatcttctggaaagtgttttctgggagcacaaagaagctgtgttccagagatacccaaggttgtacctcttgctgcagctggacttggtaatgtgtaagagtcactcaggtggtactgcttgtgaaggaatgaagggatcatggagagaagctgaggcttagcactgtgagaggccagggaaggccattggggaaggtgaagcctcagctgtagttgatggcctaggactgaaggggtcatgcaaaggatttgaggcttggcatcctgaagagagcccatgagaggctattggtgaagtctagttggagtggaataccccagtgtattggagatgtcagtaccatggagtgatcaccaagaactgcagccgtagtggagtggatcaacttgagcttagagtgctacagagggcagagctggaaaagtgatgccaggccttaggaggagtccaaaagttcaagtggaatcccagacactgaaacaagaagctgtaacattgaaattgccttggagactcaaagatgttaaagatgccagagccatgggatacatgctgaggaaagctgctaacagggagtggaaccagcccaggagaaagcagtttgttgcagtcaacaaagatgaaaaaggagtggagatctgaagaccgctttgacatcagccatggagatgcagagtttggagtttgcccagctggtttcctgccttgctttggggattacagttaattaagttgaatgaatctcagaagagaccttgaactttgggcttttaacattgttgcgactgccctagactatgaggactttgaaagttggactaaatgcattttgcattatgctatgtttacctatggcccc

SEQ ID NO: 33215 - DNA, 1153 bp, Mus musculus
ttaagatttattttatgtatgtgagtacactgtagctctcttcagacacaccagaagagggcatcagatcccatgacagatggttgtgagccatcatgtggttgctgggaattgaactcaggacctcaggaagagcagccagtgctcttaactgctgagccatctctccagcccaggtcaagcccttgtgtattgagaattctgcatcatctttcccctcagttcatttagagagctgccaagtggtgttaaggggtcgttctggaagagcttgaagcagccctgggccattttgggcctcagggttggcagaggcaaggccagcttctgcctggttgtgtctttatgctgttgtgtagctagtccacagacagtggttacattcatcatggtccaggagacaggataggacaattgttaatgaacttaacaggatgtcaaggccctgggagcagtggctgtagccctctgttactgtgaagctggaatacagggaggccagagctagcttaccttctctacctagtcagccatcttgggggaaatgggtggggccgacacagaacaaatttatcgttttcatagtggagtgcctacccctgtcatctagtaggcagaggtctaagatgctacaagttgtgtcctatgcatgtcacaggcacaaagcagagaacactgcaggtctctgtcactgagctgtggtgcaggaactttaagccaacccttggcacctcaaccttgagcactgtgaagcacaggcaggtagaggaaccaggctggagagaactgccctgtggaaacaggttcacaaatatagacgtgggccccaggatattgatgaagagaacccattacagagctgagaggctgtgggaagttcaaagactgactattgtagactgtaagcagaaaccatagagaacactgaggagtttgaggtaggagattacagtgggtgttgggatagaagaagggctagagttcagaccagagaggaaggaagttgggcaggatgcaagtgtgagctgctagcaaggcctccctggccatcttccctaatagtcaccatgaagtcctgtgacagacacctgagtgttgcctgctgtgctccatcagggatcgtggctcagatgtctctgttacattgctgccc

SEQ ID NO: 33216 - DNA, 1144 bp, Mus musculus
cctgccatgctgcactggggtctgagctgctcccatctgagcccaggcagtctgtggggactctgcagggaagcaggctccagccctgggactgggtcccatccaagttaagaaacagccgggctgtgaagattcaaataccttggaaagttctgttttccactgtagttggcacagtgattgaagataactagagtaggtggggacagaggtacacaggtgacaggcagaaaataagactctcaatcttcccagttgccccctgctacacctgcaagtacctaggccacgctggactagatttccagtttccagagagaagctagccccagaaagagccagtatgtcctgcctcagttttgtacatttcatgggtcagtcagggcaggcctgggggccaggtggctatgtaccacagggtgtactttatatgtagcgtcagctgtggtgcctgtgtctcctgattagagtcttggtctttcagggggtagtgactgcagcgactagcctcatcaccaccctggcccagaagaaccctgaggagttcaagacctctgtctcgctagctgtctcgcgactgagcagggtgagtccacggcggcgcacacagggtgggcttgattttctttgcttgcctgaatgtactactttacatttagaagcaggatatgttgcccacactgtaaattccagaataaaaattgcccctgcctgggactgagagttggctcaggttaagagtactggctgctcttccagagccctgggttcagttcccagcaaccacatggtaatgggatctgatgccctcttctggcatgcaccatatacactcattaatttaattaacttattaaaattaaaatttgcccctgccagtccttaacatgtttctttctctgttggttgagatccagctggctggtgcactccccactcaccttcactgcagctatgactggccctagctttgttagcggctctgtgtggcatacttattttatatgtgtctttctgtcagccttgtatgtgatccctttatttttgtttgaagtagccgttgctgcttttctgatcctgcagagaagtggctatcgatggaatgcagtgtagtcatccctgttccctcaagccctttgttcct

SEQ ID NO: 33217 - DNA, 2179 bp, Mus musculus
tgtgagtggtgaggccaggcctcaaaagtacggctaagattagcccggggctcagtgccactcaccctgctgctctctctctttcagatgtatagactcaccttgcgtaccagcaaagacaccgtctctcagagactatgtgaattgctgtcggaacagttctagtccgcagaccagaagatcaggctctttgtttgtgcgtctctcttgtctctctcgtttgtctttgtaccacactgcagataaacaccccttgtctgaaaactgccattcacggcacctccaggcctatgcccacagccagcccctgggtgtggagggaatgcaggactcagtttgagaagggctgcagcaggcctgccccgtcaaagaagggtgcctgagcctgggaaatcagggcagtcctgtggttcaacctacaaattaaagggaaattagaagtttgaacgaaagtggaaattttgttcaaattttattaaaatgccactggctcaatctcagaatccagaaacagcgccatgtgcttttagggttaacccagggctgcgtggctctgctggatggtgacagcggtggcttagaggtatgtgacctcatgggctaggcagtgtccatggagtttgctggagcactgcctggtgtataactgtttgaaactccatgccccacgcatggcagggtcccgtgcctaacaagcccagtgttcttggagggacagttgaaacattttaccacttttttgagatcttaggtttgcagcatggtgggcaattcctcttgactttggaagacatggatatcacccatctttgtttttaatgaatgtcctatccctatggtacattctggggacctgaaagctaagtgggcgtggggtggtaaggtaatgactgtgagacatgcttctctccagagggtcttgattggtgcccagtgttacatcctcacttctgtgaagcccttgtggctgggtggaaaagagagacctaagtgtggcagtggagtgacagtctggggcgagaatggcaacccaggcaggtgctgcgctaaggatgcactggactccctagctcatgggccatttaaccctttgtgggcattggactgtatgtacggcccatcaggggaagaacataggcagcgtcaggagctcaggcttggggccttgcactatgtcttgcagtaatgcccaggattgctatagactgagctgtatggggtcatctgtacgtacacagcagtgttgtgtcccttgcccactggagcactaggtgtggtcagttatgcacgggtcttttttttttttttttttgcctcagcctcaggctgccagcctgccatgtgggtttgaggactgcagcagggctctaactactcaagctcccgcagccccactctgtatagcccaggcaggtagtttccgaacaccaccacctgtgtgctgatccttgcgttccacgaagcccttggtctgcctatcgtgttgtgacccacactgccatggcacaggcttaggttccagatgatctagctgtggccacaatgagcctccgaatccccttgctccgtagctgtccattgtgtgcagtccacgcagtattgcatggaccacgtgggtagctcaacctgtgtggctgtggcttgtgtaccacgtgctgcccagtgatggtgtctgtatcagtaatgtcccagcccacgggagctgctggggcacaggcccactctccgtgactaccgggcctccattagtccagtgtgcttgttctcagaggaaaaaaaaaataaatgctaggacaggaaactggaacatgtgtgtggtttttgtggggagtgtcctgcatagtcctgagtccattccttgaggaattgagtacagcttagagccaaggaccctggcatgctacctgtctctcaattgagaagtacctcaggaagtgactgtcctgacccctaagtgtgtggctgcagttccacggaaatcctgtacctggaggctttggtctaagcacagggcctgagggctcaggacttcagagacggcccttgcctggagagtatggaagatggtggggttcaccacagactgcaaaatcctgggtgggagcagctcaagggctgctggtctttctgtcctagccccaccaaggacatgggcctccccactctcaggtcctgatag

SEQ ID NO: 33218 - DNA, 2164 bp, Mus musculus
ctgtcctggaactcactctgtagaccaggctggccttgaatttagagactctcctgttgccttacaagtactgggattaaagtcaggcaccacaacacctggctgaacccactctttttaaccaacctcaacttttgttttcagggatgcctgctgtctgcagccctggcatggtgccgatggccatgcccccaccagctgtggctcctcagccccgctgtaatgaagaggacctcaaagctatccaggacatgtttcccaacatggacagggaagtaatccgttctgtgcttgaagcccagagagggaacaaagatgctgccatcaattccttgctgcaaatgggtgaagagtcctagacccgcctgtggcccttggcttcacaccactgacccttggacttgtccacccagggctccccagggtcaccatccccacaagattccaatgaaagaccatccacataccccttccttggacatctgcgccgccccttcctacatatttcggggatgcatgtggatttttggttctaagcaggcagtcctcttcattgttgctgggggacagagttaggggacagttctctcctagtctctagctgggtgatggtggcatggccctgttattgcacagatcagtggtcctgtttggggacctgcatctcctgtcctcaccctattctggaaagcattcttacagaaagcaactgcctctgccaagatactagaaattgtacagcatccttctgagttgatggatggatggcatggagttactcagtccagctgggatggttgttgagggtgcactgagttcatgtgcacttacttacaggttatttttagaactttcaagctaaaagctccttccctcttctgatgttgtatgtgaacatgggcccctcagctagtcctggccagtgagatatgcttcccagccatatccagtgggtctctaacctcctgtctagcttatctgccactgtctggctaggcttcagccacagaaatccaacttgaatacagaaggtatccagacctggtgcttggttggccaggccccacattagccctcactgctggaggctgctttccacatcctcttgtttagtaccagcatcatgggtcttactccaggggctgttcttgttgatagaccttcatcacagagcccagagtcaagcgaaggagatgggtgggtgtggcactatgtgcttactactaaaattcaagcattgtgacactactgacctgcagtatactctgtggacccatactgtagcttggcttgagtgataaaaattcatgcttaaattaaactttcataaaggtagaggtgcctgtacctgaccagtggatattgtatagtgtattttaggttgcaaacctttgagcccgtgacctggccatacatgtatttagggagaaattgagtggtgccttgtgctaagatacagaccgtgaaagctttctcagaaccagtactgtcacaaggtgctgttaggaagctccagcattgccacagggttatggtgggacagttttgccttacattgccgttactttttgttttctgagaatctgcacacccggtttggatatgtgatccaccaataagggcatgaaggtgactcctagcagtttggactgttgtgaaggacttcaaataagaaaattagtgcttcagtttttggtctttgcctcctaaaaacgcggtaaaatatcctacttgctgttatctacaggggtgctttttgtcaaatgtattgtttataagtatttatttttgtaagcctaaaggcagtatgtggtgatggtgagcatgggatggtggtaacaagcacttttctttagttgtaggtctttaaaccttttaactgcaaaatggagaagaaagaccaatgtttattaaatagattcaaccacttactttaacacaaccaggcactggaagcctccattctagactgttgatcggccttgtgcttggtaagcagatgccctcttgcagggtggatgagtcaggcaggcagaacctccttaagtggtccacttagtgttaccagcagactgcagacactgcagagcaggaacctcactcagtacctgtctctaggtctcaggtgtggcggctgtgtgcatccgcatctgccttacggagg

SEQ ID NO: 33219 - DNA, 1193 bp, Mus musculus
aaaaaccaaacaaaccgaggtactgctgccatcctgtgtgtgagtagggtgccagctcagggccttctaccccttctcaatcagacaccaaaccaagatcagcctcagcctgatgcagcagagaagtactgggcagtgcttctgggcagcaggcacagctgaccagtgcaggctgacgccctggatcctgagctctcgtgtggaactggagctgctgctaagtagtaataaaacaacccgggacagagctaaccacatcgttctttaaatatatatatatatatatatgtatatgtgtatagaaatagccaagagcaaggagccgaaacacaaactctagctctgccccagcggccccaccccacacccttttccaaaaacaaccaagaaaagaaagtttataaaaatatcttgcaggaattcttttaaagtttacagtagcttgccagtgctgcatccactggctggctctccactgtccccagccccacagcggctctgtcctcagagggaacctgggctctggacccaccctgcccaagtcagacagacagaacaaacagacagacagacggcaggagggtgctgctgctgctactcctccttccctgaacagagaacagagacataaagaaactcaataaattaaaacagcaaataaataatactggtctcagcccagctccctggcagctctggagcacccaggtcttttatctccacttcagcccatgagaaccatcacagctggagctctgcagcctggcaaggtggagcaatggatgcagatgagaagaggtggccctgcgaggccaacatgtggaaaaggcgaggtgagtggcccaggaggcctccagatgcggcgtggaggacaatccattcccactgcttcacccaccatggtcccctaccctggaagatggtggacaggttgtccctgctgaggatctggtcactgggatccagggtggctgggcgagaagaggaacccctgggcggcaggccctcctcccttgggccatgcggagctgccaggggacaggcagaggtggtggatagtgggctagcctctctgcccagcagcagcagcaggaggagggtggtccgcagcagctgccttcggtcagccagtgtccacacgcagcacagaggatggcctcgtggaggtgacatgttaacttttcgggataatt

SEQ ID NO: 33220 - DNA, 1368 bp, Mus musculus
ggcagctccgcatggcccaagggaggagggcctgccgcccaggggttcctcttctcgcccagccaccctggatcccagtgaccagatcctcagcagggacaacctgtccaccatcttccagggtaggggaccatggtgggtgaagcagtgggaatggattgtcctccacgccgcatctggaggcctcctgggccactcacctcgccttttccacatgttggcctcgcagggccacctcttctcatctgcatccattgctccaccttgccaggctgcagagctccagctgtgatggttctcatgggctgaagtggagataaaagacctgggtgctccagagctgccagggagctgggctgagaccagtattatttatttgctgttttaatttattgagtttctttatgtctctgttctctgttcagggaaggaggagtagcagcagcagcaccctcctgccgtctgtctgtctgtttgttctgtctgtctgacttgggcagggtgggtccagagcccaggttccctctgaggacagagccgctgtggggctggggacagtggagagccagccagtggatgcagcactggcaagctactgtaaactttaaaagaattcctgcaagatatttttataaactttcttttcttggttgtttttggaaaagggtgtggggtggggccgctggggcagagctagagtttgtgtttcggctccttgctcttggctatttctatacacatatacatatatatatatatatatatttaaagaacgatgtggttagctctgtcccgggttgttttattactacttagcagcagctccagttccacacgagagctcaggatccagggcgtcagcctgcactggtcagctgtgcctgctgcccagaagcactgcccagtacttctctgctgcatcaggctgaggctgatcttggtttggtgtctgattgagaaggggtagaaggccctgagctggcaccctactcacacacaggatggcagcagtacctcggtttgtttggtttttttttttttaaattaaaattaaaaagtttaaaaaaaaaatcaaagccagaaatggagttagcagagtgctctgcagtgggttcctcttggaggtggcgagggcaaggggcccacaccactgcctgctgcccaccaaagcccacatcacttccctcatcttcagcttttgtctgtgttccgttctgtctggctgagccagtccctcccagctggcccaaggtgcctggcatagcagcaggaggggctgggggcaggtttcatgcatgcctttgctcttcccctcatgtacagattttaatgcttctattacattcaaccaccacaggctgggatttc

SEQ ID NO: 33221 - DNA, 1119 bp, Mus musculus
ctcagcagtgagagtttggggagagtctgggagtatttggctaggctatgagggccatgctagcttgtgccctgttgtcaaaggggctcctacagtgatgggaaaagaggtcattaagcttagagttagtgctttgagtaggctgcagcatggatacttgccctgaccagggacataggagcccccagtagcactctcctcttagcttttagctgtgttctacctaaataaatagtgtttcgcagaactggcctgagagggcttgtatctttaaggtcctcaggcccctgcctgcttgccatactccctggttattaatattcatcccttgagtgttgttattctccaaccccagaatgtgttagcatctccttccttaatgttagccccagacctctagaggttaacttctggtccctcattgctaaatccccactctatctggcccctcactgtttacctagctggggctgttcaggtggcagggtgggatgcaagcacattctctgtctctctagagacctaagatgtccacactcagtgttccttacttctttggagtatatgtactttgtctcaagactcttggatgcctcccccaccaccctcagaccttagtgttcttaagtcctttgtcttcatgacttgccatgtatgtctcccccaagtctgagcatttctctcctagagtgctttgctttctgagcatctgtgttgggtcagaggctgaggaagttaaatggggctttgtggggagggtgcaggctaagcctcactgcagggcaagaacagatgggaacatagcatcttatcatcctggtcccagaaaaatgctgctagcatacttcccaccaacaatatcaaagccattctagcctcatgattgacaccacattgtcatagagattcttgttattaactctgcaaatttcttttgctcttcattggtcagactttcaataagggttggctaacacctggtgctagggatgtcaaagagttcagtgttatgggatgtggccagctagaatagaagatgtgacatttcatagttggggtcttagaggactgggggggggttgccatatgggcagggtgggcagaacactgtggcagcag

SEQ ID NO: 33222 - DNA, 1532 bp, Mus musculus
ttgtgtatcttagtatatgattccttgtgagaaggtgtccagcctgcccacggtctacctgaagctaggaggcaaaaactatgaactacacccagacaagtatatactcaaggtgagtcggtgtgggcggtggcagtgtgaagccgggacaccttgagtgaagtgtgggtaccgtgtgatcacatgtgcccattctggccttacaggtatcgcagggtggaaagacaatctgcctgagtggcttcatgggaatggacataccccctcccagtgggccgctctggatcctgggcgatgtcttcattggttcctactacactgtgtttgacagagacaacaatagggtcggctttgccaatgctgtcgtactctaacttgctccttctccactgtcagggaactggatcagagtccagtagaggaagccagccagccccatccctccacctgccccactcacacatagtcacactcgcttagtgttgctggacccttgggggagacctggctggagcttgtccagctgttctgttctgtggttcctcaccctgggttcagattgctgccctctgcctgtctgaaggaggccaaggcccacccagtacacgaggctgccttcaaaggcccctactggtttaatagctgctgagatggattgtcttgtcctgccgccctttgctgtgtgggcagtactctgaagcaggcaaatgggtcttaggatccctcccagaaacctgctctgacccagacccatcacccagcttggggatggcaccacgttctactgcccctccaactctggcctggcaaaggcctgaaggtgagcaggaaggagcaagaggacagaagcaaaactatgaacctggggggttacctagggcttgaccccgccctcctgggaaggcatgcctcagcctggggtagaggtaggatgactgactggttttggctggcctctgctgccctcatcctgggctaggcagctgggagccaaagttgaaatacaaataaagttgttttgggccttgatctctattggtgtgctctgtactgtttctgaattgggaccttggcgacggagctagctagaccagtagaacccagtactactgagggctaattcggggacacgctggctgtggagaatattggggggggggggggtagggagtgtgctagagcccagacttggctttcagcaccaggccagtgaacagaggggactcctgaggctctggcttgctatctggccttgtgggcaagatgagtctgaactagaactggcaggttctgggacctcaggcagtagtcaggccggatgtggccttggctggaggccatggagcgggcctagaattctgtgttaggtcctgtgttgaatcattttcagaggtggccaggccagcacctgctgtgctttgccagggaagcagcctattcccagaagaaacggaataagccttgatgggaatcttgggctgcatacattcccttttcaacagtcagtcctttaagcctgggtcagaaaagcc

SEQ ID NO: 33223 - DNA, 1126 bp, Mus musculus
gatcctcctccccctaccttgaaccctcaagatgaaaggtgagttctcttctgccccatgtgggtgggagagggtgggatgccaaggacaggggtctcattctctcccacccatagaaatggtgctacccagctcatgtctgggcctttgaatccggggacttctttaagtccgtctcgttctgaatcaagaagatgctgcaatcagaaccactacactacctgcctcaggaatctgctccaaggtgagctggggcaccctttggaagcttgccaagcccactccccaccccaccccccgccccacctcatttgtctttattctctttgcaggtgaagctgaaagaacagatggtgtcaacattttgaaagagcagactcatagcacccacccacccctgagaatccatcttcatggccaactctgcctgacccgggagaccaccacccacatcatcctggagccaagcctctaccccgggatgacttcatcatctccctcctgtctttttcttcttcctcctttcctgtaattctgtttctttccttttgttccttccttgcttgagagactcaaagcacccgtgactctgtttccccatttacccccttttgaatttgcactaagtcgattgcactggtttggagtcccggagatagctttgagtctctccgtatgaatgtatacagcgagtgtgtaaacctctttggcaatgctgccccagtacccacctgtcgtccatctccgtctgagggcaactgggtgtggccgtgtgcttgaggcctcgccttcccctcgcctagtctggaagcagttccatcataaagtgttcaacatgccctacttcatcctttgcccctcctcaccagggcctcaccagaggtcctgggtccatcaataaatacagttacagtcattggtctcgtggacttcaatataatgcgactcatggggggaggttgggggggcaggggaaagaaatgagggaaggggaataaaagggatagggtacaccatccatgatgaaggggataatgaaatggggagggcctctaggatggaatggggaataggagatggcttatgaaaaggtgggtggcactgggataggaggctcatgggatgg

SEQ ID NO: 33224 - DNA, 1155 bp, Mus musculus
aaagagccattgtctgacctgtgatccattgagattggggaaacacaggtgtgtgtcaccattttgtagaggcagtggatgcaaggcaagcctgataactaacaaccccgtgttagttactgcactcattcctgggacaagatatttcgcaaaagcaacttacaggagggtttactctgattcaccatttgagagtagagtccatcgtggtgaggactgaagtgtggtgggagtacgaggcagctagcagcactcagctaagaagcagagcaagatgggttctggtgcttccctttgcttgctttttttcatttcagtgcccctgcccagggaatggtgctacccacatttagggtgaatctgttgatctaatctgaaaaaaaaaatcacctttcagacttgccctgagatttgtttctgtggtgattctaaatcccagtaggttggtaatcaagattaactactgcatactacaaagctccatccagcttttttgaagagctcccacgatgctggtagctgttcctgcttctttcccagtgcctccaggcagcacctgcacttcatatgcaatttcctattactcggtcactgatagagaacaagtcttggatccgcttccaattgttttggatccgcttctaattgctttgcttgtcatgcgggtgacctgcagcctcctatgaggaatggaagcaccgaagcagacaggacttggagcaatcatcctggttattctacttgacctagaggagagataaggtttacaagttccatgctttggtggccattaggtcatgatgatcagggaattggaaggaaagcatttgggggggggaatggtggtacgaggaggttagagcaaaggtttatctcttccacagtgcacagcacagaggggaaaggactatatctctcatgcagtgcacagcacaaggtgtgaagagacctatgtcccataaggatgttgggcacagaaataaacccatgggctgaagggagctctatggtggatgagccccagatatcactgtcactgccaaaagggcttgaggagggcatgacctggagatcacatgtggactggatggtgcatggttgtccattcattgaggttcatctgctagggttcctgcttggcactcactgatgggt

SEQ ID NO: 33225 - DNA, 1106 bp, Mus musculus
cagcctggaacagatagaagtcctttggtgctgctggtggtgatgccagaactacatagagctcttctacccactctcagtcccctgcctccctttgttcctttttctgggtaccaggactccctgcagcacttatctctggcagactgctgtggcgggctgggtccacacagtctccctatggggtctcacgagacattggccttcctagaggagggcaagtgcgggatagatggggaaggtccttgccttctagtttccttgcctgagaaggagccatgtagtctggccctggaaggggcccagctgggtggcccagcccaatctcttgaacctcaagacagcagtatattctcccatggccatgcctgggccattcacaccactgcccctagcctgtcagttgggccccagagctaggcatttgctttgctgcctatttttagatgctatgacagtggcttcctgagacgaggggccttgtgaaaggaaccatgcttcctgcccaaggcgaggattcctgcccctctctccagcttccttcctgagcttcctttggtagactgtaagtctttacctctcctaggaaggcctgagcaagatccattgtctctcagagaggaatctggccttgtccccatcctctataccccagaccaggcccaggaccccagctagaaggacagcacctaagtcagcctctacctaaccaatgcccctaaaaccagtctgagcctctttactctgacttatcccagctgcccagggtcttcacaacctctgccatcacaggagaggttcttgggcccctcagcacctccgaattgcttaggtgggtgagcactttgtggtgcaccttctagcttgcatcatgtactcaggaggctttgagtaagccccaaccctgtctgcctctgcctttggttcttctcttgcggcccaaatggtaactcaaaggaacaagctgctgttacagccagcctccaggagcattttggggtgctttgtggtgaccattcatacctaccaagctggtttcaggagccctgtcccttcctagagaacttcatatgggtagcaataggaatgcttcagagaagccccta

SEQ ID NO: 33226 - DNA, 1945 bp, Mus musculus
ccctggtggaggttgggggctcatccctcctggattggagtgtgaaaaacgaaattaagcacttaaagaggagtctgagaaactgagaaagaaggggtggagggagagggagatggtgatcaggaaagtacccctccccagcttcctctctgagggttaagcagcggacatgatcctagggtagaagaaggcagatgggtccataggtcttctttcctgaaccagcctgcttgcaaatttctcccagagctttcttgagcttgtgttctggcctggatccccagagtgaagagcagatacttttttttagacccaggttttggtttctatttgctgtttctgctggggagtgccactgacccttcaagaagaggagacctggcgctggggaggagactgccttccttggtctgttctgaggcccagcttctgctcccaggtacctgcttctctctgcggggcctggtggcatcacatggtcacccctgaggacttggtgtctccaccacagagttcccagtatcctgcctgaagcagtctctaatcaatcccaggactgttgggacagggtacctgaggagagcccaccagcatcctgagtggctgggcctcactgtggccatttctacggtaaaaatgttgcatagttggtcaatctggaacagtaggggggggggatgtttcctgctgattttggagacaaggtttcatatagcccaggctagtctcaaactcacatgaccttgaattcctgatcctcctgcctctacctctcaagtgctgggatgacaaacaattgccaccaaaccctacgtggtactggggattgaacccagggctccctacatgcccaagtactcttatcaactgagccatatttttcagaccaaacttcttgtatgtgtcttgcgctattggaggtacacttgaattctgttctggagttacaaccaagaggagctggtgggacccagggctcagtggcagtggctcagacaactgcttggcatctggctccacaactggaagtgagggctctacatgataagcattgtaggcttccattggccccagtactctggcctctatatgacactgttcctggttttcatttctttctttcttttttttttttttttctagctggctggaggcgtgatcctaggtgtagctctgtggttgcgtcatgatccacagaccaccagcctgctgtacctggaactgggaaacaaaccggcacccaacaccttctacgtgggtgagtaccaaggagacgggttccagtcacagtgcagaacagtcagggagggcttccaagaagaggctgatggtccaaatctggtgggtgaggcgttagagctgggagtggcctaggcctagtatgagctgggtagggaggctgcctataagaggagaatgagttggctgtggtgctgctggtgaccccacagatctgagactagactaggcagaaaggaagcaacggggtggggcaggggccttgtaggaccttgcttattttaacatgggcatttctagtgaacctccctgggcagggtggggcaggatgcctgggctagcaacagctgaggctccaggagtcctgagttgggaagggctggagactgggccgacagtgaatgactcagacaccccaccccaccccacccccaccagcacacagcccagactgttacacctgccttatttggctgcctgtaggggctgaacaccctccctcctaagtaagatgatggctgttgtgctgtgtggtcctatgctctggtccactacactgtgctgaaggagaaaactttcctctttcctccctggaagagggacctggtgtcctgagaactgaagaagtatttggagatgtctttacccttccaaagctcctaccttcatcagggctctgatgtggatcttccttctcctcctgtgg

SEQ ID NO: 33227 - DNA, 1569 bp, Mus musculus
tagaccatctctattactggggtaccgggtcctcacagcttgagttaacccctgcaacatcccagaaaactgttctcttgagtggtccctcataccctggtgaccctagggtgctagtgaggtaaaaaaacactcccctgtgacaaaaggctgcaggcagcaggtccgtgtgtcttaaatttgttttggggtggaagataagctgtgatacataggtcctgtcactgagtagggtggtggctgtgacttagccactgatggttaaccacgctcttgccatccctgcagcaagattgtcatcagaaaatcgatgagctcttctctgggaagctgtacctcattggaattgcagccattgtggtagctgtcattatggtaagcacagggtctctggtgggtgggtgggatccttcccagggccttaggtgctgactatgcccctccctcctgcagatctttgagatgattctgagcatggtgctgtgctgtggcatccggaacagctccgtgtactgaggccctttgcattgcaccagaggatccctggagtgaccagaggccaccttgggggacatggcctgtgtatataatatttctgtatcactctgctacacttagtctttttacttttgagttttttgttttgttttgttttgtttttgttttagtttttttttttgtcctgaacttttcctgttaccttttgggagctgacatcacacatgggtggcatatgtgggatgtaggggtggagctggccctggcttgcagggccctgtacgtctgggacccctggagagttctgcctgctgagccaaacctcctctacagctacttgcccagaggctttgtagcctagctagagggccatgcccacccactcaacccactgtgggtcacattgctcacatctttttaatctttgttcctttcctgcctccatttcaagagctgggtttgtaagccctcttatgccttcaatgcacttattctttctaacgtgtcaccttcaactgtaattaaatcttgaaacagtcatttaataaaggaggaaaaaaatcaggcatgctaatgggactgccagacctcttcctgtgctagcggtgtcagagacctggctcatcagctctgaactttgccaggcacagggtgagcaggtccaatagaggctgtggaacacagtgggtggggagggctgggaccctgggagcactccatatgggtcctccctcatttgtacctccttatactgggagctcaatgctgactttacgccagccttgacctcatttccactcatctgttggacatgacaggtcaggctgagtcgggtaggaggagccacctaagcagggaaattcagcacagaatgatggagataagctgcaagaacaccctccttttcagggacaagacagtaaaggttagcccattaccccatccatctcaagaaaagattccacggagctgggtggctctggcttgtgtctcaataagtaaaaggcaagatggcagttcacttacccctgtgaactgaggatcaggctaagcaacctcccggacgccagg

SEQ ID NO: 33228 - DNA, 1159 bp, Mus musculus
catactcatggaaactggatgctctagtcaatgataacttggtccaggaaaaaatttaaaactttctagaattcaatgaaaatgaaagcatagcatacccagacttaatgggacacaatgaaagcagtgttgaggacaatagcactaagcgccttcataaagaaactgatcctatactagcaacttatagcacacttgaaagctctaaaatgaaaagaagtaaacacatccaaagggagtaaatggcaataaatagccaaactcaagattgaaatcaacctattagaaacaaacaaaatacaaaaactcaacaaaaccaagagctggttctttgaaaaacaccaacaaggtagataaacccttagccaaactatctaaagggaacagagccagtattcagtttaacaaaatcaaaaatgtaaagcgagacattgaggaaattgaaaaaaacattagatcttactacaagagacttaacaaaactggaaaatctagatgaaatggttggctttccagacagataccatgtactaaagttaaatcaagatcaggcaaactaaaacaagaacaaacaaacaaaaaccaaccaaacaaactacaaaaaaaacagcccagcgccagatggttttagtgcagaattctaccaacattaaaaaatgagctaatactaatactcaaactatcccacacaatagaaacagaaggaacactacctaattcattctgcgaaggcacagttactctgacacctaaatcacacaaagactcaacaaaacttcagaccagttttgcttttgaatattgacacaaaaatacacaataaaattcttgcaaattcaatccataaacatatcaaagccatcatttaccaggatcaagtaggcttcatcccagggcttcaggaatggttcaatatatgaaaatccataaacatcatccaccatatacacaaacagaaaaaaaacatgattatctcattagatgctgaaaaggcctttgatattaaaattcttggagagagcaggaattcatggcacatatctaaacataataagagcaataaatagcaaactgacaaccaacatcaaattaaatggagagaaacttgaaacaatcccactaaaatcaggaacaagtcttcccactctctccctgtctt

SEQ ID NO: 33229 - DNA, 1132 bp, Mus musculus
aaccaacaacaactctacacattaaaaactcaggatagggttcacaagacccaaggggaaaaaaaaaaaggtctgacaacattatttactaactcatgattaaaacaaaacaaacaggaaaacttctggaacattaaatactcaagtaagtgatcacaagaagtaaaaatatcactggacacaaaagtgcatctgagaaaattctttattaacttgtgatttaaaataaagaaaaagaaaagaaaaccaaacaactggggatcattaaaaactcaggtaagtgatcataagaaacaagaagcaagaaataagttacagaaatctgacaacattctttaccaataataccaaacaaaaaataagcacacacaaaaccctctagaatattaaaaacttaggtagctgatcacaagacacatgaagcaaaaaagatattacatgaatatttcactacacacaaaaacctgacaacattctttaccaactcataatacaaaacagaaaaaaaaagcatacataagacatctggagcatcaaaagctcaggtaaagatgacaagaagcaaaaagaagttacaagattatatcactggacacaaaaatgcatctacaaaattccctatcaactcaagataaaggaaagaaaagaaaaacctaacaactctggaccattaaaaactcaggtacatgatcacaagacacaagcaaaaaagaaattacatgatttcactgacacaaaaatgcatctgacaaaattcctcatcaactcaagatggaagacaagaaaaacccaacaactcagaaacattaaaaacttaggtaagtgatcacaagacgcacacacacacacacacacacacacacacacacacacacacaccccacaggaagttacatgattatttcagtagacacagaaacctcacattccttatcaactcaacataaaaaacagaaacaaagcaaacacaaaaaccctctgaaacattaaaaaccatggtaagtaatcaaaagacacacacacaaaacaacaagaagttacatgattatttcactagacacagaaacatgacaacattgtttaccatctcataatacaaaacaaacacaaatcctttggaatattaaaaaat

SEQ ID NO: 33230 - DNA, 1105 bp, Mus musculus
ctaataacttacaaaacatgcacagagctagatgctaagaagagccctgacaatactacaaaccagtatctatgagagatttctatacgtaagttacctcaagctacaagtgaaagcaaagacaggattgttaatagtctgtccaaatattgaaggaaaattccagtttagttaatttacaaaagctggacgaatcctgccctccttttatacctcgctgtcataatgaactgaacataaatgaaaggaacagaacttcaaagaccacacataacttcacaaaagaaaaatagcttgggaataaataaaaaaaaagcttaaaaccacttaagtagcattaaaaaatctggaggcagaaaagaatctaatgtccacagttataatataaataattgaaaatatagagctttaaacaaagaaaatatggactatacagagaaacaataacaaagttccttcccacagaaagccgaaagaagtatagacacactgtacttaacttgacaaaaaaataatttttaattaggctaggaatgtttcagctggaaaagggtcttgatacttaagccctgtgacctaagtttgagctccgatcccatataaaggtataaggaaagaactacataaaatcagcccctaacctagaaatgggcaccatggcatgtacagtaatctcattgataataaaataaaattagtctaagttatgctgaaagataaaaagaaaatgataaagaactaaagaaaacaaagaatatgaagaatgagataaaattagaaaatggaattaaacaaattctagaactgaaaagtattaacaaatgaaaaaatccattagagggtttcatcagcagatctgaatgatataagaatcagtggacttaaggatcaagtctgagcaccagggggggaaaatgagcatttcaagaattctatggtaaactaccaagtatgctaatatctttgttggaaatcccaaaaagtaggtgaaagaaggagcaggaagaagaattgacctagtggctatgcctccccaaatttgattaaagacaaaaattactatgtacaggaacataagcaaaaggacccagaaatgataactgag

SEQ ID NO: 33231 - DNA, 1668 bp, Mus musculus
aaggccagtagtcctgggagcacatcaggttctaggacccagacacacaccaggcctatggtcatgctctctgctaggacttccaccaaggatggcactagacttctacagatgtgggtgtctaaattcttagatgcctcaaccctgactccaactctgctttgaccagattatattttttgcttaagcctatgatctctctatctctaccttaggtcttttaactcagccccaccgtgggctcctcctttcctcctttcccaccttcctagattggcttgttcccagctgctgcatttggaataagttggcctagaaagagtcttggtgtgttcttgggtagagacttgactggataaagactgtccacctactcaggttccaggagtgctggcctgagaagagctgtggtacctggaaagatggtgacacactaggcctatagagaccaagaaagcatcattcatgtctctgaggttctgttacagatctgttatcagatttggcctagtactctgagcagagtcgtctaagtggcttagggctgcttctagaacagatagacagtaaatgtctggctccaggagctttgagtatactaataccagcacaggtggccttttgcccccaaaggtgtggttatagggcatctatggactgaactatggtcatgtatcaccagtttccaccctcccttgggacctcgttggtgctcacagtagctaggagatgtgagacacatctatcaaggtagatggtttgttgagagcgctactctcattgtagctgcttctgtgtctggaggttgctccatggccagaagaataaaatggaatggataccaatgagaggtgagtgatcagggggataagaaggctgactggtctttctaggcgtaggcaattccctgaggcctgctatggttgccatggtgctacttactatccttactcctaagcaggcactggcatatccaacaccagccacaagacaccagtgtttacactttgagttgtctcatgccgtggacttgatggagagacttaaccatagtgtaagctatttttctaccctctgacgccagcctatacctgcctagcctgtctggactcctgttcccacacctctgttcccgcttgctaatgcagccagcctgtaaggctatcttaggagggagagtgacccctgcttctcaataacattctcgctctctctaaacccatgaaccctctctacatcttacaaaccacgaggcactgctaacctcgtttaagtttgggtggtctgggaagatagtgggcatgccttgtttgatcataatcattcctctgacaagcctgccttcccccagggtggcctcaacttggctatctggttacttaagaaacccccagcactgtgagtccaagtttcttcagtcattgtaaagtcaagcctgaaatctaggcataggccagaagcgttatgactacacaaggttaaggacatgaattttagtagaaagagtggaagagtctcagaatgcgaatctcaggaaaactaagagcatggcattaacatcctggcacagaaacacttttctagaggagtgccccgtggggcagtggtcagaagcagtctgagtgacctgcctccaccacatcgctgcctctcctgagttttggtagg

SEQ ID NO: 33232 - DNA, 1182 bp, Mus musculus
ctgcttagtgctacctacttcaatgaacctagttctgttggggcagcaagtttaggccctaaagcaggataggtaagaaccctgcctgagagtatgtgtttgtagagagctctatgttctctaagcctcatctttcacccttcttacctgcctacaaccccacaacataaatacctcctaactaccttgcaaatgcagcctcatttctgcctcagttctccagtagggcaccataagccactgttaggacagagtaatacttagagtttgattttatatgagggcttacagccagagtcctcagagagaagccaggtagaataaaagtgatccctgaaaacatcttgaattacacccttccccagtaatctctctcagagccctctgatctcttgcttctaagttgttctcatgtccccaaagaagaaaaagctctcaggggacctgccaattgtctctggacttctggggcagcagctccatgtgtgacgagattacgtaggcagaatatctaagcagatggtgaagccaggattatggagctagaaatgcttggctgagtagagacttagactagacccctatctcttgcacgcgccggactcgccagcagtaacaatgctgcaacaggatccttctgcacacatttattgggagagcttgattgcagaggcgaagagaccccgagcccagaactggtgctgcttatataggcctaggagaggcgtgtctcacacctggattggttatgcactaagcctcatttgcatgttcctcatctgattggctactctctctctgtacctcacagagcctcattatcatacctcatttgcatgtctcacatctgattggttatactctcaaagcctcattatcatgcccgggccaggcagtgtctttgcaaaaaattttactgcatgtgtacacattggttgtttgtccaaacttatgcgtggtggccagcagtagtgagcgccactctgcaacagcacatgtggcttcccacacctatctacttccccccattctcttccatgtttccaagatgtcacccagatcacccatagatccagccatgggcttatcgtcagacctctgctaaccagtcattgccaaggagatgcgtctcaggtatggcttttgccaaggacacctgaactctcctaaaaggaatacaaa

SEQ ID NO: 33233 - DNA, 1205 bp, Mus musculus
ccacccacgtgtctctcccctctaccagtttctgtggttgggagtacacatatgcacacaccttctctaagcaggaagctgctctttgccaaaagtgaatggaattcagatttccagagggtatccttggtctcaagctccaacagccatctgacgaagaaagatgctagtgtgcgcgctggggctgtgaagagaggggcttccgtgtccattcaaatctttctgggccccaagaaaaaccaacaactggctgtgctctccctagccccacccagcctcagtcacattccttcccttcctgagcccaccctgggtggccccacaaaccagcttccactcctcccttcccactagtggggagacctaactcatgtactcatcgaacagccaacagtgaaaatgaaggtcacactgcaagcccagaacagcttaaaagcagagaagggtcctccccaatgtctgttctcaccccagtcagaggctattccctttttctctgtctagcagcccctaggactaagcgttcataccttcctgtgcttgcttccaggaaatcctagcctacttctgcctgtaacattcttggtccgggaaatgaagaggctgctgtttgggctgctgtagccttcgctactagaatgttccaacatattagggatctctatccctacctaagccttccaagccccaggatccagcatccctgggacttgtacatttatacatgctgacatggttttgataatgagtcacagtagggatcagcagtgacaaggtagactggctggtcctaagcctaagtttctgggatttgtacttgtccagccagggagggaacatgtggagaaccttctgcagctgtcagaaggaatgagtgactatggtggacattttggttctgtgctcagcaagatacctagggcagagacttggctcaaaggctgcaaatcaaatcctttgatttcaaatgagactattttcaatgccatagtctcctggaagcaggattatttctcctgagatcagttctggaggcgattgaggctttgccatatgggcattgctctctcacctggttctggttgctaccaggtgctcagcttgtctaattacagttgactgtctctactgtctatggctctaaggcccagtctgatcctcttgcttggtcaaaagtagtgttgtcctagtggattttctgggtg

SEQ ID NO: 33234 - DNA, 1197 bp, Mus musculus
tcccccttacaacatcctggaatcccagccacgagaaaaacagcactgtcacctgctcacttgaatgtgcatatataagtaaaactgctactcagagttgcaacatatcgtaacaagccagtcctgtgcagacatctgcaagactacggcacctacctgtacataagacacacgtacaagtatacaagaatgtgtgccacccatgtccaaaggaggcacagagacatgtatctttgcttatataaagtctctgggaagacctagcagaactaaaaacatttaggagaagaaacttgggaattagggttggggtaggagacccttagttttgtgtttttgtttttctttgccatattcctttctgtaccctaattttcactgtttgatttgtgcatgtatacacaaggatgtgtggtgcatttgtggtattttttttaacataatactagtataaaaggtttgctctgatgtgcagtgcattttactgtgatgtttgcttttttagcacaacattaatactttacaaaagtcttgtttggacatagcaggtgtagttccagatcgggattggctgtaggcagccacagtatgcatgctgggtggacagcatgccttggagctgggagtctctggttcatgtcactctggagcaggggctgctctagcacaaagaaggttttgaaaggcaaaggcagagccagagtcagggcaggctctgggcaggctccaagagagccagcaaccctctgctgaagggtaccctgaaccccattgcacaggcgggcacctcctgtgaagtgagactgctacacaagtctcgtcattatagacttttgagtggagtgattctgaaagaagagaatgagtacggcgtgtcctactgtgcctcattaaatatggaagtttttatgtaactttcctccatttcaggtaatctcaaatttgataaatgaagaatgacagcagttcatctttcagttcatttgtgcctctattgatctaattgaatgttttctatacaaatttatttttaaatctatcttagatcttagtctacaaccacatttcatattgccaaaactgcattagggagggccaagttatcttcaccattgaaacaggtctgctagtttggctctgtctgtcctgtggaaatgacacaatgttgacctaagaggggggtcctcacttctccct

SEQ ID NO: 33235 - DNA, 1189 bp, Mus musculus
agtgtctataacctagaaccccagtcatgtgctgccagacctggattttatgtgtgtgcttgggatctgagctcaggttctcatgatttccagcaatcacgattcccagtaagtactgtagctactgaaccatctccccagcccaatatcaacatttttttttttattattattatatcagcaaagtattcctcccgcttcagggtcttaaggttagccactctgcctgacttttattttcctgtaattctcatatctcactgcaagtgccttttctaacctgccatatcaattagtctcctcagctaattgctacctcagtctcagaagcatgggctacactgtggtattcttgttccttgggcgtgtccacttaagttagctgcctgtctcctccactagaagggaggtcctgggtgagcgtgtgtgtcttctctgtagggttagcactctgtaggcatctcacacatttctggtcagtggcttcattgatttgttaaatgaaaggaaagagcaggccaggaaagtgttcttccactttcagaattcagtgagaaagtaagtggtgaagatttcttaactgccaccttggtgttatttggtgaaggatgggggttgaggggagaggggtgctctgtgttgtagtatgtttcacagcctaaatggcatttacctagtccaagtagtcccctcacagttgtgataacaaaacctgcctcccaaggttaccacatagctcttggggtgggggtgggggggcactccctgccaggtctgccttagactagttgcaaggagctagaaagcctttcagctttaaacacagggtcctttaaacacagcggaccctggcctttatcctgcaatgcactaaatccatgcccttatggtccctatgaagacgaccctggcctatgcctgtataatagaagcacctccatctctgctcattggtgtaaatatattttgacaggtaatcctgtcctcacaatgcatggggttccattaaaatctttacaacattcttaaaacaaatcaacaaacaaacagaaccctacttattgttatgttgatgaatgtcttgtctgcatgcatgtatgtataccatgcatgtgcctggcatccccgaggacagaaggaaggatcaatcccctggaaactggagtttcagagggttgtaagccgccac

SEQ ID NO: 33236 - DNA, 1759 bp, Mus musculus
tctgactttgtgagaatcaaaatagagactgcagatgagttatgggcgtatttattcctcagaccatctgtgacctttcctgggagggtctgagaaggcttctcagaagtttctttggacttttctttgaaaactgctgaactacctgaaagataaggttttgcagcaaaagaattatttgggtatatacagtatacccaaacaaacaaatttttaaaaccccacatttctttataacaatagtgatgtaaaagatgtaagaagtgcactcagatacaaattagaatagcaacgagattgtctggtctttttttaagacagtgtttttgggaaaactgtaaattcccattggagataaaggaaggtatttggatgtgcagagacatttgttttcttggaaaatttagcgttagaatcctcagtattttgcaaatctgtaaatttagttagattgcagtcagacttctagctggaggatttaacatctcttcctcaaaaatgtatgtgaaagagaaagatgtacaaatgccaagtgaactttgaaaaacattccatggcttagcagccagaagggtggagtgacagagacccagaacagagctcagtgagctcagccccgagtctggggaaggtgacatgtgatcaaagtggcaccacatatcagtggaacctccttggaagatgttaaaaaacaagtaaaagagaaacatcctgtgaactcagagtccttagaaagggggagctccaaactgtaagtaaaaggtagttgctatttattaagaaaaactacagagaatattttctagggtagggtggaagtcttaagtaggataaatctcaagactcaaatttatgaacttgaataggtgcaaaaattaaggatttctatgaaccaaatccatcatggccagtgccactagttccataattgaaagacatgatttgcctttttatcccttctcatgcaaagttctgcccatgacaaattacaagataaccagaacactaaaaccagggagcagcagctgagacgacgagaaagcaaatcagaggaaaaggtaagacaagaaactcgcaggagggttaccagtgaagatatgctcaaactgaagtcaccagagaaatgcaaatcaaagtgacatttatttttcttctgagaacccttagaaagtaggataatgccaagtgttggcagaaggtagggagcgagactccccgcctgccgcaggtgagaggggagaccgacacagacattctggaaagctggccagcattttttttcctcaaataaaatattttatacctgcggcgcaacagtttccctcctgagtaaacatgctggagcagttctcccccagaacaaggagaggctgtgtgtgcctgctcagcacagcatggcctgggggtggtggggtggtgggcatttggctctggttgctgtggttagaagcaggggactagatgtacacttcacaagatggagacacatggaaacggtgctgagtgacacagacagcaaacagaaggagggtttcagtccctgccttggtgtttaaattcaaattacacccctcccagacctgcgctaactgggcatactgtccatacgtacaatgatattaataagctactccagagcagctgtctgagtggaagggagtgggggttacaggatggagataggatgcaaaagcatggaaggagcagagtggtccttttaaacagaccctttcacagtaacaattttatgggcagaagg

SEQ ID NO: 33237 - DNA, 2419 bp, Mus musculus
tctggtttacaaagttccagaacagccaagactacataagtgagaccctatctcaaagcaaaagagtaattttttttccccagcacttgagagaccaatgcaagcagatctttgtgagttcaaggtcagccaggggttcatacacagtccttctctaaaaataatagattttttgatgtggtgctgaggaccaagcccagggcctcgggcatacccgacaagtgctacgctgctaggctgcatttctagtctttgttacttggagacatgagccttgctgtgtgggtcagactggccttgagcatgcattgctctgcctcagcctggaaccactgtgatttgaagttgtagttcccagggattctggaaatcaggcgagttgagtacatattttagctctgaggcagcagtaaggtccttgtctgtcctcaggcttttattgtcctacatacaaagctcccaaatcttggatgtgttttaaagacaccaggtttgtgtgttaggttagattgaagtcaccttgttcttcagacaggtgtgatctggactcatgctctgtgagactgatagacatgctctataggaactggcctctgaccatttactcctgcactgtgaaccactggagttgaatctgtttgggtattgcagagagcaccagccggctcggaaggactgccttcactgcgtgaatgcccaggactgggctgccctagagagaggaggttgctggcacagccggtgtgatctatacctgcagcaaagactctcatgtggctagttccttgtagtggccccagcaagtgtctgctagcacattctaagttagactttacattattagaacaggaaagcagacacctgggactctctggggagctgacctatttctgggtcagctcttaaagtccatttgtgggagccatctttttggtaagaaggaatgagctcattgggtcttggttcttatgggaaggggaggcttgatgagtgatacttgttttattctcttcaaattctgtattcttgcagaaagaacccagccagccagcggagtgcaagcagcagtgagaagcagtgaccctgtggggccgccttgtggatggctgtcaggaccgcaggccgcaggcaggggcctcagtccctgccaaagcagaattttgttgacagtgctgtgacatctaaccatttccaagtgcatgattcctctcccctttcccttcttactttgctaaacttgtacagtggagactgctgcagttcagaataggagattagttgtagcacctgcagctttggtgcctgaagatcacttggggtggaccgaggttgtgcctgggattgacagagcctgtgattgtgtgcacccggccctccctactggcaaggccccatgatttccagctgctgaactgcgtgggaagctgctccagctgctgtgccctagtcatcgcccaagcactgtagaggaagctgtgctcgccttagagcattttttttcttgcgttttggttttaggggtgggtgggttgtggcacacacctctgaggccagagccatcgggttcaccctcgtacttatttatttacttgtgcttggggagctttggacttcactgtcctcccacttacgagaccatgttgctgacttgatcaggaggatgtgacaccaagtggagggaggctcatggaggaagccctgctgcttcctgccaccaactgctgtgctgtgctgtgctgtgccatgcagactacatgttattgccgctggaagttggcaggctgtagccaggggacagaagttctccttcactagggatctctggcctgtggagtacagcttcagcttgtactgtgcacaccagggccacacctgggtttggtgaccagttggtggttggtgtgtgtggggggaggggtgtttctgagagtatggtggtgtctctggtagccaggacagccatgtccacagtgaccagccatgtagagtgtgctcagccttacccaataacacatttgtaactgaatacggtgttttcaatttgtacagaatagttaggatattctattaaagttgtgaaacacaaactgagattggtttttttgttgtttgattggttggggtttttctgatagcccacttgctccttctgactgcccacaaccctgctggactgagctcttgagtggctggaccaaagattccagtctgcagactttaacacttggttttgaggctgtgaaaacccattcttaggagcaagctgtttgactgtggaaccagcctagggctctggaagcagttagctactgtaagaaaggccttagcaaatgatcatagggggcttgagcaatagctcagttcacaaacccacatgatggcaaacaaccttctaggttaacttctaggggatctaaca

SEQ ID NO: 33238 - DNA, 1101 bp, Mus musculus
atccccttcaagggcttgttatcccagtagtagcataagtggacactgctgcctactgcctggcatgggtggggtgtggagctgtggtttccttgtgtaaacctgctgcctcactgttcttacctttccaatggcctcttctgccaccctaataaagattattctcctcggtagcttcattacctaaactgctatggcttatgttttggatttttacatcctcgagttttggttttttttgaagacaaaaaattttacattcctgtggtcaaaataccacttcctttaagtaacaggataaagttcaggatgcctatgttctgaggccgtggtagggaggcacctaatccttgcccacttgttttttacctgcaatgcctttatttttctgtgctgggggagacccccgttgcatcccagcccctagagctcccactccttcccttgtgtgcattgcttgccttcttctctcctatccctgctgtactcgcttgggacaccctgcctctgatgctctctaggtcagtaggttagtgaccatgaccactgtgttgactacctctagatctagccttggctgtcttttgacagctcttgcttgattggcatctgaattgagcttctctagagaaacaactgatagaatgaatccattataaatgggatttattagagtggcttatagtctgtgattcaactattctagaactgactgtctcccaatggaaagttcaaacatttgatccttacttggtccacaaagttgggtgtctcagctggttttgtgtatatgtcaccatcccaaagaaataggctctaacgccagtgaaggaatggacttgcctgacagtgagggcaagcaggtaaagagcagaaactttctttctccatgtcctttacataaactaccactaggagctgtggcctaggtttaaggtaggtctttccacttcaaataatcccatcaaaaaagtcccccacaggagtgcccaacagcttgggtttgagttaattccacatacagtgaagttgactgctgagaatagcacagcatctctgggcttgggttccttgttgacttacaaggcccctgaaacacag

SEQ ID NO: 33239 - DNA, 1222 bp, Mus musculus
ctggtatgcatgcatatgtgctggttcctgtggagtgcagaaggcatcagatagatctcctgaaacaaaagtttgcagtgtctgtgagctgcctgacatagatgctaggaactgaattcattgtctctgcaagagctgtctgtgctcttaagcattgagtgtctgctctagtgcagccatactttcctgtgtttgacagtgtggagtctgttagagtgcatccctacctggcttcttttgtaagaattagcaagtgttgtgcagagtaagctgtgtgttactttgtacaggttcaggtgatgctctttggtcacaccctagtcatcatttttttgtctctctaatacaggaattggaaggtgatgaagaaggagaagatgaggatgatgctgatgttaaccccaaggttagtaatttggggacgtcctgagcctaccagtattgcacggtgggacttttgaagctgttcccactttgaggcaatgatgctaagaatatacatgtcagaaaatccacagttgaggaaaggcaactcatatgcctggaacattaggcgtcagatccaaccaggtgttactagttctctgtagacttgaacatgcattgcttccagctcttccctagagggatgttgtgacaggaagcacccgtgtgcatcagcagagcacctggtatggattgtgtgcgatagtaaagaaaattagcttgtaatcagaatttttgcttaggagattgacaaaaaagcatcgtatgtacatatacatatgcatagtgattgttgcaggacaggaagactggcaaaagaaacgacaatctgcaccaccagtttcacctggaagcttggggttttctctgtggtctcaggagactcttcattagggggctttggcacccgatggcaggatgccctgagctgctctagtgcagccatactttcctgtgtttgacagtgtggagtctgttggaatgcatccctgcctggtgtccctgtgccttgcatctctgactggctagtgtctgtctgttgtccttgttttccctgggtggagtgtgtgctaaaagctgtcagtgcagcgacttggtggtgtgactgctgtgctgctgagaatgcatgcacacactgggaagtttccagagggaaaaatgggaaagctgccaccacccacacgaatgccactcccctctaaaggtcactcatgggtcatggagactatactacctg

SEQ ID NO: 33240 - DNA, 1196 bp, Mus musculus
ggaaagacttaacacaccttcatcagattcaggagccaggaccacttaccacggtgcctcccaccttcttgttacccacagtaacccccaggagggatagatgccatgacaaaaagtaggcttgagcggggcagtggtggcacacgcctttaatcccagtacttggggggcagaggcaggcagatttctgagtttgaggccagcctgggtcaacagagtgagttccaggacagccaggattacaggattacacagagaaaccctgtctcaaaaaaaaaaaaaaaggagaaagaaaaaggaaagagttggtttgagactgttaaataaatagatgggacttgaatttgaaaatgctggccaaagcaacctttaccaggcaaaaggactaatttctttactttccttttttttttttttttttaaatttcatgtgcattggtgttttgcctacatgaatgtctgtgtcagggtgccagatcctctggaactggggttatagacagttgtgagttgccatgtgggtgttgacaattgaacttgggtcttctggacaggtggcagtgctcttaaccactgaactatctcgccagccccccaaaagactcatttctaagaaacgaagacaatttgttcattcctgcttggtaaccttatttgctagccaaactaaatgctttttataaattgacatggggaggctgggctggtactgcactccctgctccagccccaggctacattgaggaaatacctccctgctacccttgtcagcagcagtgaaggcacatagcccagcctagtacatttcctccctccacagagacctccagtcaggtaaaattggaaccttgattgtaccacagtaaagaatttcaggacaagtcatagtgaagcaaagttagcaagcttattaagcagagataagaaatggtgcatgctttggatttaagtataggcatagagtaagagacagtcttagatgaaagatagttcatatttaagacatgagtgcatgctgctgagagaaagccaggctaacctgcctaccttaagatcagctgttgatgtgaacttgtggctaagtcagagtgctcaaagaatgtaatttacagtgatagttaaagattaagtttaaactgggtgatggtggtacatgcttttaatcccagttcttgggaggcagaagcctctgagtt

SEQ ID NO: 33241 - DNA, 1178 bp, Mus musculus
tgagatgcttctccttatttttgtgttttcatgcgtattgttcccatgactgacacttaggactttcttgaaaaggcgtcagaaacccagggtcatagtcttcatgactgtacagcggccatactcaggtatcagccacctcccctgccccagacagggagggactaggtctcttgtctaccttgtgtctcttttcctgctgaaacatttctctgtcccttaccttttattttaaaacagggtttctatggaatatccccgcaggccataaacttgggatccttctgccacagtgtcccacggaacagggatgccacttctttgcgggcagttccaacagtcatgtgcttttcaaggagtgtgcttagcaaaggctgaagttttcacgcttgtcaggagaaagtgctgagactctgtccccacaggttctccctcctgatgtcctaacccgtgtcagtgaatatgtgccagaaattgtgaacttcgtccagaagattgtggacaatggttatgggtgagcatgagaaacctctccttctgtgccaggccgcacagctccatggggagagagtctgggaacgggagccacaccttctcaccgcccggccccgcacctgacctaactcctcttcactctagctcccctgcaagaacttgcactacattacggatgaaacccttgcttcatacatacatagtatgccgttgtcacaagcatttaactgggaaaatgccactttgctaattgagtcaggaagcaggctggagaggcagatctgaccacaaactagcacccagcagccattctttggaaactctgttacaggcttcatgactgcccagaggcctgtgctcagctgtcctcagcctcctcttcctgccgacagggaaggaccaggtttttctgtctactgcgtgtttgttttcccactaaaccagccagtgtggtgggcattatgctagcagagcaatgagaatccttctgagtggcccagtggcctcccctaggtgttatcaggaagacctgcctgaatatctgtttggcagcttgacagtgatgaccgtgtcagttggggccatgatagtgcacttggatactgcagggcccctcgagacattggtaccattcagacacttgaagagtgtgtctcctgttgcttggctgtgattttagtgta

SEQ ID NO: 33242 - DNA, 1151 bp, Mus musculus
aatcaaaacctctgcattactgatactattgattctggttagctggaaccaagaaattagtggtgattaggaagatatcaccaacattacttaggtgaaatcttctggaaagtgttttccaagagcacaaacctcagcgttttagtgaggctgtgttccagagagacccaaggttgtacctcgtgctgcggcttgacttagtaacatgtaagagtcacccaggtggtacaggttttgaaggaatgaaggggtcatggaaagcagctgaggctcagcactgtgagaggctgtggaagttcactggtgaaagtacagcctcagtctcagttgatggcccaggactgaaggggtcatgcaaagaaattgaggcttggcacaatgaatagagcctatgagaggctattggtgaagcctagttgcagcagaagacaccagtgttttggagaagccaataccatgaggcgaccaccagtagagtataggcagcagtagagtgcaggcagctgaacagttggagtttgattttgcttttgattgtgactatgccctgatatttttccctcttgaaggaagaaggtattttagtggagcccacagttaagagacttctaattgtaaaaagactttggattttaaaagagattggacattttaaaaggattgaaattttaatatgtaagaattttcaaagactggaacttttaaagttatttagatcttggggatatataagaaagtaaggattgaggcttaatagtgatgtgtttgtgtgtcaagttgtgaaagactgtcttccaagaaactaacttccttgttttcttctgtaaagtaagtctgatgctttgagaaattacattcagatccaacaccctcttgtgttcgtgtttgtttgttactcgccaactccttgcccacctgagtacggggaccctgccttcttccccaggtggaaagactccgactgggtccagctggtggcagttcatgtcacaggcctgaacccacctggacacactcactttctgttagcacagtctcatgccactgctgccagcactcttactcccttacattctggtcctccacaccagctcgaaggcaagtgattctctgctaatacaaaatacatttttctctatgctctatttagt

SEQ ID NO: 33243 - DNA, 1180 bp, Mus musculus
tctcactgctcagtaaatttccacttacctaagggtgtggtcagtgccttgctctcactgctcagtaaattctccttgcctaggggtgtggtcagtgccttgctctcactgcttagtaaatttccccttggctaggggtgcggtcagtgctgtgccttgtgctcactactcagtaaatttccacttgcctagggatgtggtcagtgccttgctctaactgctcagtaaatttctttttgcctaggggtgtgatcagtgccttgttctcaatgctcagtaaatttccccttggttaggggtgtggtcagtgctgtgccttgtgctcactactaggtaaatttccacttgcctaggggtgtggtcagtgccttgctctcactgctcagtaaatttccacttgcctaggggtgtgatcagtgccttgctctcactgctcagtaaatttccacttgcctaggggtgtgatcagtgccttgctctcactgctcagtaaatttccacttgcctaggggtgtgatcagtgccctgctctcactgctcagtaaatttcctcctggctagtggtgtggtcgactatgtggtcaactatgtggtccctatgatggactgaccgaagaggagaagactagagcctggtttactgatggctctgcgcgttatgcaggcaccacccagaagtggacagctgcagcattacaacccctttctgggacaaccctgaaagacacaggtgaagggaaatcttcacagtgggcagaacttcgggcagtacacatggtattacagtttgtttgcaagaagaaatggccagatgtacgattattcactgactcatgggctgtagccaatggattggctggatggtcaggcacttggaaagatcacaattggaaaattggtgagaaagacatctggggaagaagtatgtggatagatctctccaaatgggcaaaggatgtgaagatatttgtgtcccatgtaaatgctcaccaaaaggtgacttcagccgaggaggagttcaataatcaagtggatacgatgaccccttctgtggacagtcagcctctctccccagccatccctgtcattgctcaatgggcacatgaacaaagtggccatggtggtcgggatggaggttatgcttgggctcagcaacatgggcttccgctcaccaagtccg

SEQ ID NO: 33244 - DNA, 1168 bp, Mus musculus
gaaacgtggagcttaggctatgagcacaggacatttgcctcgtaatccaagtgcccctgtgttttgtgtctctgctgagcacgagcacagtgtcctctgaatgcaaataccggtttgagtgcaaggctgctatgttctcccctgcatggacactttaaggtcacagtggcatttaggctgcctctttcaattgccagaacctgaaccttggtgtccacaaagctggatgagctatgtatggcgagatatactacttgattacatgtgtctttggagagcagggaatatggctcagtggttaagaagagcactggctacttttgcagaggacctgggttcagtacctagcactcacaaggcagctcacaactgttcagctccctcttctggcctctgagcgccctgtacccacatgatgtacaagcatgcagataaaacacataaaataaatctaaaacaaaattttaatgtgtcttctgtctgcttttaagcaaattcacaggcaatttcttctacaactatatgatgggaattgagttcaacccccgcatcgggaagtggtttgacttcaagctgttcttcaatggacgaccagggattgtagcctggaccctcattaacctgtccttcgctgccaagcagcaggagctttatggccatgtgaccaactccatgattttggtcaatgtcttgcaggtaacttggtgcgcttgcagccaggaagggcagggtgccacacctgctggactctgagagagttcccagcatgctgtcctgtacagagctggcccttccaaggtcacagtgaggacatgctgaaaatctgccactacatagatgccattgtgccagcccccaaagagacaccatgctgtcgggcctagtccaaggacgacgactcccttaggtgctgccctcagataggatctgagagtatatgggcttttgttcaccagctagagaagagagatggcaggcatgctgtgggctcaaggagtgacctgtggagtcttcatagtgggagtgggagaggttgagaccctgaggaaggtcctctgtcctgagcagccactaggaagctcatggccaggtgggacaaacatgggagttttccatgcttcagttaaaggcagttgtcactcaggaggttgtggcaggattgttatga

SEQ ID NO: 33245 - DNA, 1808 bp, Mus musculus
acccccaatgccttgggcatcctgctgcttggcctcgtgggttactatatcttccgaatgaccaaccatcagaaggacctgttccgcaggacagatgggcgctgcctcatctggggcaagaagcccaaggccattgagtgctcctacacatcagctgatgggctgaagcaccacagcaagctgttggtctcaggcttctggggtgtggcccgccacttcaactatactggtgacctgatgggcagccttgcctactgcctggcttgtggcggtggccacctcctcccctacttttacatcatctatatgactatcctgctcacccaccgctgcctccgtgatgaacaccgctgtgccaacaagtatggccgtgattgggagcgctacacagccgctgtgccctaccgcctgctgcctggaatcttctgagggcagccttgggaagcatagagaggtgtcattgagtgtgtggagttggatgcatgggggctggcatctggctctcccctgcaaactgcctcctcagtttgctcatctggagaatggagagcctggtgtcccacagtggctgctgacagctggagagctgaattcacacggataccccagcagaatggcttgttctctctgttcagcatcctgatagcagaggccctttcatgtctctctgcttggagcccaccatctattctgtctagataacttaggcttatcagatgtctccgatgattgggccatcctggtaaaccggagaccatgcaggatttaaagagtttggcaatgccatcacccccccgccgcacccccccccccccatcctggtgagctaggctccatttttgtctgtagcatgtgcagtgttaattgatcagccaagggttcagaggccattgaagaagggaggcttttttgtttaggttcttgattttttgtttctttgtttgtttttgtttttaccccaggaatggcagacagtggactggaatattcagggggcactgcccactgcacagtccctggctaacttgataaacagggttcccaggactccccaagtgcccacctagcagctcatccacctgccctcttctggaaggtgcttcttgtttacccctgagacttggctcggacaacccagaacgtatcaccagtcagtggccttagccacaccttccccaactggagacccagtgttggggaaggaacacattctcattagggacactgcccccccccccaaactcagggtattctgtaaaactagataggcttatcttagccttgcaggcagttctttgtattaaatctgctttgttaaatgagttatgttgtactgtctcctgaatgggcttgaccagtaccaggggtgggaattggtgtgggagtgagggctgtcgtacgttgttggatggaaccccaggaagtattagagccaatgcctattaggacactatcaaagcttcatgtcctactgagcattggggacaccctcctccataattcccttatcagtccagaactctgctgggccatttgcttgtcagaggtgaggcgttcattccatttgccagtgacaggaagccacacagtgaatggagaagccacatagctgggcctggacttctcttgtttctggaaaagtagaggtgcatgagagatgagtggtacccacagccagggcacaactggtctgcttccagttagagctggttgaacgtttaacaaagggtttctggcatctgtgctagtcagcacctttatttttccctcgggcaaagtccttttaaggaacctgggtgtggtggttg

SEQ ID NO: 33246 - DNA, 1294 bp, Mus musculus
aagctgactgtggtatgtagccacttcaggggttgcgcttctcactaggttggcggtacatgtggccttgtgcccacccccatccccattgtagtcaggttcccaggatggagacagtgctcctggggtggccactcagtgaggaggctctctggggtccagtgtttggaagaggaggaaaggggaccaaagggaagtgaggtcctagagcgttgacactgagggaagtcctatctgtcagtcctgaccacttaagccaggaccccatgcttcctttactctgtctcctcatctctgtacctcccctgacaccccagtcctggttggccctttctcctgccttgccctgaagtcttaccttctcccattgcattcaaggcctatagcacaaagtgcatctcagagatgtgctagtggcttatcctgggcttggcctgcaacatgggaggcttgggacgggggtcttggacctgctcatgacccctgagcagcctgcaatgaggtgtgtgtgcccagccacttggctgggcagggagatagatagcttcttcctgcaagcttccagaagcacgctgtgttctttttgccaaatatgttcagttatagtcagctgatagattgatgtggctgaaaacaggaccgagtgaactgatgctcccacctgggtgcctccatggcttccttgagcaactgtccctaagatgctttcaagtgtatgagacatgaggaggctgggccactctggttatgcacagtcaggcaaactgtccttgtagacgagtccccgactctgggatacatgaggatcaatgcccgttttctccccgtgtgctttcctgcagaatccttgcctttccgttgttaggttgggttttctatatgaattatcatctggaattctgtagcacacctcataggtatggaatttttttaaattaaatattcagaataaacttttttgatccatttactgtgtgatcttctgcagtgcttggtctccatgttttgctttgaaggtggcattgggccaagttcccaggggccctagcttaggtgccctttgtcaactggtgccgggaatgaagggcaggattgggatagctggacagatgtctcaatagctaagaccctgcattgttcttgaagagtaacggagttcagttcccatcacccatgttgggccacacataactacctgtaacctcagcttcgggggaccccatgcctctggtctctgatctggttcttgtaggcaccagcacacacaagggcatacccacatacaaacccatat

SEQ ID NO: 33247 - DNA, 1684 bp, Mus musculus
ccacccaggcagatcccaggggctctcccagcattaactccgccccccagtgggctatgtcctcccatatcagtcatcaagaaaatgccctatagtaggtcagtctgatgggggcattttctcagttgaggtttcctctctgagaggactctagcttgtatcaagttgccacaatgctaaccaacatagccagctccttctggtgaccttgggggtttgtagatgggactctaggtgacatttacagaaatcaaccctctatctgctgatctaagtgaagggaagctcagctgcgctgcctctgggactggccacatggtcctgtgtggatttagacccatattcctcccacatacagagccttggaggcaggcacagtgaacaaacaggacagcaatctcgctgactcacaagggcatctgtattcctgtttgtcctgctgtcgggtgaggtgcatgcctggaccctgacatggccctgcttttcctcccctccagcattcacaagcttcgagagaatgtcttccaagaacaccagacgctcaaggagaaggagctggaaacgggacccaaggcttcccacggctatggcgggaagttcggtgtggagcaggataggatggacagagtaagtggctgaccgggctgagctgctggcctgcatgggtgcatgatgtgggtggcagtcagacttttcctgagtcatagtgtagagtggggtttgctgagggtgaggggttgctctgaggggtcttctatagctgccctctggtaaagttcttctgtgtctctagtagctgttttacattgtcagaggccccagccagtggctagtatgtagggggggctctctgggagagatcagcaccatgaccggctttgtgagcacaacagagtctggaagcatccgtctcacagacgtcattgtcaccatggcctatggttgagatgggcgaagtcagctctgagggcccttagctcccatcacatctgtggagtccactgacgcttagcttatgtcctatttgcatttgtgggccactctgtggccaggtggggaggatgtccatcctgtctcagctgtgcctgagcccctgggagtggcatcaatggttctgactgacaagcagatgctgtgggcatttgctgcataaaccatcagtctggtagtgttttgcatcttcttgccccaagatgagggagtggagcctgctctggcgctcactctaggctggctggtttttccagagagaaagttgcagtatgtgagtgtgtctcctgcagagcaggcctttgcgctctgttgatgctgtaacagtgtagtcctgagtgagccgtatggggtggttctgatgagtagacagtgatgctgctgggtagacatggaagagaggctcagctgctgcctgtctgatgggtgactccctcacacatggattgtattcagctatgctaggcacagaaggccatgaccgtgtctcaaggagacaccactgtccattagaggagtggactcattagcctgcgggcaccctgactataggctgtgaagagacaccatgaccatggcaactcttatgcaggaaagcatttaattagggctagcttacagtttcagaggtttagtccattaatcgtcatgtcagggaacatgagcacacacagacagacatggtcctgaagat

SEQ ID NO: 33248 - DNA, 1179 bp, Mus musculus
agtggtttgccctggctgcactgcctgggccttgccagtaagtagcccaagctccagtaagtcctcaccacccagtagaccctcacagtcagaacttacagcccaccccccacccccctcccccagcgtccaccaggggtcaggcctctgctggctcacccagagtgagtcaccagttcaggccctgagtcaacactgcttctctgtttgactgagaaggttgtcaccagaagtttgaaggagggagaagcagcttttgtgggagcttcagatgtagaagagtgcagaggtggggttgaagaactgattgtggtactaggtctccagagcaccctgggccttgctagacagcttctccacccaactttagccctggccctagagctgacctttaattgagggcttatgacagttatgcctttaacaccttgtaaaatgccagggaatttaattggcccttcagactttgacctgttagtcgggaaggcacctggcataactccgcaccgtcctgagcatccttacctccttgtgcccctggtctttgtcctgggcatggtcgtgtctgcctaccagcttgtctcttaatggagtcctgggcaggctagcctactccgtctgtgcactggcctccataggcatggggtgggggttgccctttccataacaactcctgacccagccacctttgctccgctgcgctataggtatcaggttcagggcctcaagatggtggattcctccatcctgtgactaggtcctctctgactgagcttcgtgctggctgtgtggggctgagtggctttctctgtccccgtctgatttctatcagctttattgatatttcaccctacacgtgatcacccgattgaagggttcagtggttatcgatgtattcagagttgtacagccatcaccacaaacagttttggccttctcagagatctacatagaatgtgcatgcccatggtcccagtggctgggaatgctgaagcagaggaccttaagaccaaggagttctggccagcctaggaacaaacctggagtctgtctgtctgtatgtgtctctctttctactcctccctcccactccctttttggtggtggttgggatgcatttgagacggatctctatagctttgattaaccggaaactcactacgtacaccagcatgcccc

SEQ ID NO: 33249 - DNA, 1239 bp, Mus musculus
cggtgtagagctcgtctggcaacttttgctatgtggacccaagatattttattacagagtttttaaactagtgaagaaaaaaatcataaataccatagagaaaatattttagaattgactgtttcttatatttatgtaaacttatgcctcctcatttatatagttacttactctttcatgtatatccaggctataaatatccttttgagtcaactcatgttcttatacctaattttagtcttttaaaggaatgtactgtaatgcttgtgtataaatctgagcaaatatagggcttttgtaaattatgcatttactgtaattattcctgtttaattttttaatgatgaacccgacagaggaaaggattttgctacgtttataaagtcatcatgatacaagccatgtgcattctcctctacccagctctgtaacaatcattctgaaagaagcagactttatttccagatgttttctgtcatattttaatgactgaccttaaccatactttttctagacaaaatctcagcttccattagacttgagactgatggtcaggactctgtgaacagcccttaccccaaccacatccctagccctgctctggacatgggtggattgtctccagaggctgagcagggccctgagctggtaacagcactctacaggggcagggtggcctcacctgcagactgagcagctgatggagcctcgaagccatctccctccctccacactcatcaaggaccaatcatggggcaggtgctcatttcctggctggggcagagcaggtgaaagcaagagacttcagcggagcaggcagcctgcaactccaataaaggccttatttttcttgtataaactgtcttacatttatttgtaactgttgtaagagtggacctagttctccactcagctgtcttgctagcctcctgactgacttcagtgaactaagaagccacagggctcaggcacacatgtgcgtatttattgtgtagctgatgtgggagaggcttttatatttgctttctgcttttaattcatctggacagttggttgttctgtttttctgttaatcgtttgtgaccctcccgattatataacagtctgtgcagtcaacttctgaactgtttttatcacagtgttatttattgctgtttttcaataaagtccccagcattttccactgccagttaagagtgctgtgaacaggcgtcggctgccttatgctctgctgaaggt

SEQ ID NO: 33250 - DNA, 1154 bp, Mus musculus
ttgcatacttggaatcagcatcccctttacagcctcctatagcagagcatttagggttctaagatagcttttacctttggcagcctaccctgcctccctgcaccatactgagggagatgaaactcttctgtccctccatgcatagagaagcagggcctagatcactcccttgctactgagagctgttccttgatggacaaacataggacatgcaggatgctggtgtgtgagttgagggagtgagtgatgagcatgctgtggaccagaagcagttgggttttcttctgccattggtgcttagcataccttcacctgtgttaagtgagagcacaggaacattgtagctctcagtggagggaggcagtctgaccagtgttctgtgttagatgcagggtctcctgctatagcccagatttgtcttgaaggcacttttttcttgctgtagcctctagctgctgggctcacacacaggaccccccaccccagctgaaattcacttgttctgtttacacacacagagcttcctggtgaagtatggccttgtttgtattttaggctgatacaagaagagaaggagaatacagaacagcgggcagaggagatcgagagcagagtgggcagtggaagcttggacaatcttggtcgttttagatcaatgagctccattcccccctaccctgcttcctcgcttgctggctcctctcctccaggcagtggtcggtccacaccaagaagggtccctcacagtcctgcccgggaggtggacaggctgggtgtcatgactctggtaagtggggccttttttacttcagcctgctggggaagggttacacatggaaatcacatcttccttcaagaggttccagattataaatgctgaaggagtaaagactgaggcaggtgatctctgtgcgtttgtgtctaacctgatctgtgtagtgaattgggttagccggggtatatcatgagaacctgttttttgtttgtttgtttgtttgtttgtttgtttttaaagttaactagtatttagttattcagtaatgtaaatttgtaaattaacatatataataagttaattatataaattataatataaaaatcataatatacaaatatatattgtatagttaacataaaatacttcaatgaccaga

SEQ ID NO: 33251 - DNA, 1223 bp, Mus musculus
tcagtcaagtcacactgctcttttccctcctagatctgcaggtggcatttgacattgtgtgtgacaatgtggggagagactggaaaagactggcccgcgagctgaaggtgtctgaggccaagatggatgggattgaggagaagtacccccgaagtctgagtgagcgggtaagggagagtctgaaagtctggaagaatgctgagaagaagaacgcctcggtggccggactggttaaggcgctgcggacctgcaggctgaatctggtggctgacctggtggaagaagcccaggaatctgtgagcaagagtgagaatatgtccccagtactaagggattcaactgtgtcttcctcagaaacaccctgacaagcctacagctcctctcaggagtcactgtggacttgatcacaccatgatgtagcaccaagtgccttttgtgcccagtgccaaaaagaccttgctgatccagggcgggtcccctcccaccagctcctggagtatatctgtatctacggaacctctgctccctgggctttcggaacacatgaaggttccccgtcgtgttctccaccactgctcctcccccccacccccccaagaggtctctggtcttgcaagaaggaagttgaagctgatggcacatgtgctgactgcagtttgagagccttcttcttgttccttgggggaagacaccatctcagttaagatcacttggttgccttacagttggccaagaggacatctgtctcacatccttggaggccatcagacagcagctcctgaccccccaccctcaaacaagtgcaagacccctgtgaggactgtggtttaaagggtagcaccttgcctccatggtggtctgtaagcaagtgccctgggcctacctacatatagtggctcactctgaaatcctagcacttgagagttgagaactgcactttacagcagcctgagctacaaatgagatgttctccccaaacacacaaaagcaagtgcctttacctggagataacttgtgtcaccaagaatttctattatattaagaacccttctaacctcagaaatccctcccatcaggctgactgaggtgtgcttacagccctgggtgctagttgtgaatggagtgatgtgatttccttcacaccagcaggggccctgactgccacacttggagcccaataaaccattgtctcagctttctaacctttggctgggtgtgataat

SEQ ID NO: 33252 - DNA, 1150 bp, Mus musculus
acagacttagcatgccctgaggctccaactgagatattctgtggagggtgaagaaggcagtgatctgcgggcttccctgcaaggtgtcagactggctgtgtcctgagaaagggctgaggtgctacatgcaagcatgtgtttgtgggttcttatgtctgcaaatacccacaagcatgtgtgtagaagggtgttggtgtattcctgagaacatgtgtgtgtgaagcatgcacacaaactggccctgaacttttgacttccaggcctctgcctctctgcgcgcacacacacactcgcactcctgtatatgaagcgtatatgtgtttctctgggaactgtttttatcaggtgaagtacttcctttgttcttgctacccacctccagggctccaggatctccagacagccaaccctaagacaggcccagcttcctctgtatctctgtgatgagaaccttggcatagagctgccctcaccctcgggatagggcttatgttccccggaacgagccaggcacctcaacagctcctggggaggaataggggactgggaagtgtctgttggctaatatttaaaactgacccaacaggagtctgggccacttcggggatctgtcccttgcccttagtcagaggccagtggcttcacactgggcgtgggttgggagggaggcaggaacattcatgtcctgctcagttcctatctaccatttgaccctggttgacacaacacaaccttttctgaaaggttttgctagatgtgagtagcttacagaaggccatgcaggctcagggaaggcaccacgataagccattagtgtcctgatgaagaaatttggctgtaggctgggacacacacacgcacacaagccccatggggaggcacatagacattcagagcattccaccagtgagattccatgtggacctgggggctaagtcagggtgaagcttccacagctaagtggctggaggctgccctaaaagctcaggaggcaccgcaagcaagccttgaaaaaccttacccaccagcttgaccttagacttctggccttcaggctgtgacaatacattcctgctgtttaaagaaccatatggttggtgatgttttgtttgtttctggttcttttgtgttggtgttttttgtttgcggg

SEQ ID NO: 33253 - DNA, 1099 bp, Mus musculus
tccctagcaagcaaggccagcagcagctctacctgccactggaggatgcggttatcccaggctgccaggtgcatcagaatgcctcattaagggatttggagacatggtgtaatccccactaagggatagatagatgctcaagtgtctcctctaggtctcaggacctggctgcatttccgttggtgttctgagtaggaccaggaatgattggtgcaagcccaatgacagaggtttggcagaaggaagccacagctcccagaagctctggtccaaattactgattcctcggtgagggggtgcagcaggctcttcggctcctccatcagtggccaggtcacctgctggctccaggttcctcagataccacagaacagggacattcacacctaggagaacagtaccagggttctgcccagttcacccccatcaggccagaatggccacagttgggtgtgggggtgctggtgggggaagggacccttccagatccttagagtttgacatgctcctgggttgggaagttctggcctccacacttgaaaatctctggggaactgatgcccaatgtcttgccagctttctgtccttgccttgggttacctaggaggaaagtgcgggtctctgctgtccctgaatgtcctcaacctgagttctcttagaagcacccactccgtagtttagacttcccatcacctggaagacccttaaatttccaagcctctggggccagaccaagccttgcctccctccctccgatcgtgccctacctcccggctcccttagagttacaccctgatagccaagccacagtgtgacttgcctcccaccgtcagctcaagccagtccttggcgcagcagaaaggttctggcggttcaccaagtgtcccgcaaggaaggagcacaggagatgccctggggagcagagagccaaggggcgggatcaacaggttcgagtgcggggcggagccaagagtaaggggttggggtctctccaggtgacagtagccaccgccaggcccgcgcctcctcccccggcggtgattggcaggcggcctgcgccccggctcccaggcgaccgacgccccgcggggcaggcgag

SEQ ID NO: 33254 - DNA, 2836 bp, Mus musculus
gtaagaacgggcggaccaagaaggggaaccgagtgtcgcctaccatgaaggtaacccacttccttcctagactgtgaccctccggagccctgcctcagcctcggaagcacaccctacccctcaggaggagcactttctctcgatggagaattgtttgcaaaaaaactggtctaagatatttaaattatttaaatatgtatatatggacgcccaattatttataattttatgtattctcattttcggggggggggatatgaccaaaagaacaaacaaattgcagctcagacctctttggaatagcggaacagacttctttcttcactatcaaagatatgggtgtgatgctgtttcatgtgtgcctctaaaacttggtgacatcagtttccaagggtgcctggcctgtaactggaaaggcctgcctgggacctctgaggcagtgagaaggaccctgagcgttcccgatcgggagcattctgccgtcgccgctccctctgcttcctttggtatgaaccctgtcggatcggtttactccagggacagaagtcctcccgcctctgtttttagatctccaagactgatctttgaactctcttgcagtcaatcatcttcttggacctaccggataggagacccttagacaactttataaactcctgtttgccatttttggactggccaacagggcacgttgcttgtagccactggaactttgcttttctggagaggaactaggaatggacaagagggtgtgtgcgctcgccacaactcaaaactctggggatgaaattctgttttgtgatagaggatgatttgttgggatataacaatgtattttgcaagaatcaaactgagaaaaacaggcttccctgaatatgggaagctttgtgctggaactccataatttaagggtgagctgccctttcccaccccaggcagcctttatgcaggcagactgcaggagtccgaattccggtgctgccccaaggtgaaggaattctatccccatctacctcagagttcctgagaccctggtgactaagctggaggctctgctgggtgcatctgcctgcttctcttccacatgtagtatctggacccttgtcacgttccagctatctttacccaatgatttacttttagtaaggggtattcatggtgaaaatatgcacgaccagctgtcggagtgcactatatggtcaccaagtcaagtaacccttatatttttctttatatattttacgaatgtaacccctgtcactgagaccaaaatggaagagcagggtcggtggcatttaaaaaaaagggctgaggtgagggagaacaattaattttaatgaatgactttggagtttatacaaaatgaccttagctcgcttcagggaatgcttctccccaagatgttaagactctgctgggagacttctgagcaacctcccgaattaactttatgggaggctacagacagcaagactggaaaatctcattggcattttttttttttgtctttcacattcctttagaaaactctttgtttggatgctaatgggatacttaaaatactattctgtaccacagcccaagatggaagaagccacaccccaaagctgaggtgggagctcctcccaaacttcctttctgtctggtggctcacaggacaataagattttgtgttttttaaatccaggccctaggctccaagagtgttggggagaagacagttgaaatgtcttttcttcttgttattttctaaaagacggtctcatagcccaggctgtacctgaacttgctatgtcactaaagatgaccttgaatttctgatcctcttgccccatttcctagtgctaaggttacaggcattgcccaccacgcccactccttaggtgctgggaattgaaatcaagtgcctgccaggccactccacagagataggcctccctcttttttgtgggggaggaaatgtggggtcttactctgtagccaaggctggcctactgcttgagcccaagtgttgagactacaggtagaaggcacctgccctgttctgatgggattctctgcagctatgttgcttcaggcaggctgtggtcctacctgacacctattacctgtttcttcagccagctagctccctttcctgcgcccagggacaagactgtatctttggaattttgttaccagaatgggtttgatgtttctgctctgtatctgccactgttaccgagtcggtctgtagttactacaggtgtcgacccagagatagtatgtgctatgcacactggatgctccatccaaagagaagcattcaatcatgtatagacagccccatggactgatgggaatgattgggagagatattaaaatgacaaacgtgtctgcaagcacctgtgtctgctttgtcttttttctatttgcagctgagcagagtgggagcaaggaaactagttttagccagctgtgtgcacacacaaatgtggcttggaaaatagtcccagaggcaaaggtatatcacaaagttttaccgcatcctgtgtctcccctcagtggggttctgtggctgcccactcagtcactaacccgggtgtaagggtctgtgtccacacggtgaatacttaccccatgaagcacaatgaggcagaagctggccaggaggagcacagtcaacacatatgtttgacttcagccaactgctctcagtgaagatatgaaatcatataagtcatcaaagataccagatcacaggttgattattttataaagtttctgtccctgcttcatcctcttaaactcttaagattatgggtttgtactactacatctggttgaaatttggtct

SEQ ID NO: 33255 - DNA, 1539 bp, Mus musculus
aggtaatttgcacacctctggctctgtgcctttctattaggactttttggcagaaggtggagagcgggaggcttaagaggggatgtgagggaagaggtgaaggtgggaccacatgggacaggccacggctcctctcatggcgctgctaccgatgactcccaggatcccagacgttcagaaccagattctcattgctttgtatctttcacgttgttttcgctgctattggagggtcagttttgttttgttttgttttacaatgtcagactgccatgttcaagttttaatttcctcatagagtgtatttacagatgcccttttttgtacttttttttttaattgtgatctattttggcttaatgtgattaccgctgtattccaaaaaaaaaaaaaaaacaggttcctgttcacaatacctcatgtatcatctagccatgcacgagcctggcaggcaggtgggcggtctgcctccagggatcctgggaccctgatggcgatcgtcctgtcatgctgggcccttcatttgatctgggacatagcatcacagcagtcagggcacctggattgttctgttatcgatattgtttcttgtagcggcctgttgtgcatgccaccatgctgctggcccggggggatttgctctgagtctccggtgcatcatttaatctgttaggttctagtgttccgtcttgttttgtgttaattacagcattgtgctaatgtaaagactctgcctttgcgaagccagctgcagtgctgtaggcccccaagttccctagcaagctgccaaaccaaaacgggcaccaccagctcagctgaggcatcccagccaggcaggacccttgagggccgctgtatccatggtgatggggtgaggttttggccaaaaggccaaagactggtggtgggtccacggaatctgccctgtgacatgaaaggctttgaggggctctggctggtggccaggttggctttttgtatttctggttgacacaccatggcgcttcccagcacagacatgtgaccagcatggtccaggaaaaaaaaaaagacaaaaaatctagaaaataaaattggtaaaatctcagctcactgttgtctgtgttttctgggaacaggagtggggtgatgccacagccatgtggggtggcatctctggccctggcaccaacctgggattcccaaggggaagggtgtatgcaagtgacagccaagagcaaagtgggagcctctggcgtcagggaggccagcgacagccactgatcagaagcggctctgggtccatcactgccagctcaccctcctgcttatttgcagatggaagatcaacagaacccgcgttcactgccccttgtctggcgcaaatgggtgtttgctctgggtgaatcaccgtttcttaggtgctgccaagcgcccagagagccatgcttagtgttagggccaagacccaaggtggcctttcacatagttctgcagacctgagtggcctggcaagactcctgtgatgtcttcggggtggcagttactcatgactagtat

SEQ ID NO: 33256 - DNA, 1186 bp, Mus musculus
catctgagggccaccgggcaggcgggagccaccaagtagtggcacccgcaaagaggaaggagccagcccgggtgctcctgacgacgtcccccttggggacatgttgttaccagaagaggaagttttgttctctttgttggttgtttttccttaatctttctcctttctatctgatttaagcaaaagagaaaaaaatatctgaaagctgtcttaaagagagagagagagagatagaatctgcatcaccctgagagtagggagccagggggtgctacaaaaatagaattctgtaccccagtaatcaactagttttctattaatgtgcttgtctgttctaagagtaggattaacacaggggaagtcttgagaaggagttttgattcttttatatgtttttaaaaaaaagcttaagaaacattgctttaaaaaggaaggaaaaaaaatacagcaaaccattgttaaagtagaagagtttttaggttgagaaatgtactctgctttgctgaaaagccacagcttaggccctcagcctcactccctggcttgctcagtgcctacagccctgttacctgatacctgtgctttatcccaggggtgggcagacctcttaaccttatagatggtcagtgcgacctctagtggtctcatggcgtgtggcacaacccccctccccagggctcagcttaatgtgccctctccccccaacaacctgcaggttcacagcaccagccacacagcggtagggatgaaatagtgacataatatattctatttttgtaaccttcctattttgtagctctgtttagagagatgctggtttttgcctgaaggccctgcagcctgcccacatcaggttaaacccacagcttttgtgtgtggtttgttttgttgtgttttctttctctatgttccaaaaccattccatttcaaagcacttttggtcagctagctggaggcagtgttgctggtgtgtgttggggggaggggttctaatggaatggatggggatgtccacacacgcattcagatggctgtacaacaggttgtagggctggtagtatgaggtgcttgggaagttttgttgggtcaagaagagagaactctgttctcgcaccaccgggatctgtcctgcaaagttgaagggatcctttggtgccagctggtgtttggaagtaggaaccatgat

SEQ ID NO: 33257 - DNA, 1195 bp, Mus musculus
caccctgcaaaaggggggcccccggagtttgagttgctggagctcaccccccgatgtccactgagctcctgaccctcggcttggatcaagggtcgtccgatggttattttcaggtcgtttttaggcacctagttattttttaaatatttttaaatattttttgaaaagatgacgtctgggaaatgcagcgcggcggcctgggacgccaccattgtgtctcgcgtgcgctcgagcggcgcccagcccccggcgccccgccagccccgcggtggggttctctggcttgtggcttcctaatttcaacaggggaccggggtctccgtggccaccattgcttcgaccggccccgccagctgcccaaagactttccctttcagtttcagggtgggtgggcactgggaaccctcggagcaggagcgcatcccagggagttggccaccggaatccctctctgtgcaatctaggagaagggaatggggtcgtatcgagcgacgcccccctcccacgttgacggtcagggtccggatccccgcaggtctgtgaggagcagaagtgcgaagaggaggtcttcccgctggccatgaactacctggaccgcttcctgtccctggagcccttgaagaagagccgcctgcagctgctgggggccacctgcatgttcgtggcctctaagatgaaggagaccattcccttgactgccgagaagttgtgcatctacactgacaactctatccggcccgaggagctgctggtaaccacgtaacccaccaccgacaatccctctttatgctgggtggtgggagctgcaaatggcaggagatccagccatccatggacagatctcctgccccacgaaaggcacccgcaccgcaccgcacgacaccgaaatggcagtgagcagaatgccaacccattctacctctgtgcccgccctctttccgtactggactccccaccatgtctgtggtgaaaccactctgaaatgtgggcggtgtgcgccccctagcgacgtgcaggccacggcgctggcggtgggagattctttttgtccgcagtctgtccccttagtatttctacaggcacattttgttgtttacctgtatggggtcccgggttgacccaactctttagaccttctcgaatcagcctgccttccttttgaccgtgttcctcattctctgcagcaaatggaact

SEQ ID NO: 33258 - DNA, 1193 bp, Mus musculus
ccttcatccatgctacactgggagatagccagggccccaggcttctgcaccttggtgtgcaagtgtgttttgaaatagatgattgattgcctggggtgtggggatttctatggggtagagtcctgggggaacagtcaggtggctcatttgctcagagctcagagaacatagcgcagcagggggacctgggtttgagtccaacttgtacctcatactaggctttctctgtggctctggcttatttcccaaccctggtgtcatgggacattactgcactatatactatatatagcactatatactgtatagcactatatactttagcaacagggtctgaggaggccccacagatgtatatggtagctgtttgtcttgctggagtgatcttaacccactcatagtgggtcctggccccttgcccttcacaggtggtcaatggtgtattttgtgctatggtggctggtgtcctctgttatctggatcaacctgtttctggctcttcttctggaggtaccagccgtccctgtcctgtccagacctgggattgcctactgagttgttgagagttttggtgggtgagccctgctagccaagtctacaggctaaaggcagcctgattggggacctctgagctgcttgctctgctggtctgtggggctctcaggaccccaagctggcttaagggtgaagctgggcatcttgctgtttcaggggtgtggctctcacaggctctgcatccagatgtccaggttgggctgtcccccacagtgactgtactgtgactgcagactgggaaatgggggctctgaagctggtatcacatgggtacttacaccctttttccctcctgctccagaactttctccacagatgggaccctcaaggtcataagcagctccttgttgggaccaagcagatgtctgtggagctcatgttcaggtgtgggcttgggcgtgtctccagtccatgggactaatggagaggggtgtgggtggaggaaggctttctggcagggatcctcttccacccagtcatctggactgctgctgagctggcaagagatgctcacagcatgatggtgagcacttctgtttctaccagggccttgtatcatgtgctctgcttaggatccagcacatggaagggaccatctatcttccattgtcttgtagcttctggctggtaccatgggg

SEQ ID NO: 33259 - DNA, 4240 bp, Mus musculus
gaaacagacagaaaacagaacaaaacaaaacaaaaaccaaacctgacctacagagcctggctctagaattatatgctctgcagggttgggctttgagaaggtttcattaatctaagagaaggattttattttattttattttactttttttcctcattcacaaaatcagttcctcaaattgaccaatagctgctgctttcatattttattttgggaaagggtgtgtattcctaagtgtgtgctcatctgcacacctgtgtgcatttgtgtgtatgttgtgtccaggttagagatcacagggtggggtggggtggggtgggggtggggtgctgtgtaaaatagtctctggactgatgcttggtgaattggctcccgaagctcctgctgcttggagtgggtgacctcatattgtcctcttccttctcatgaactgagagtctgtgccctcgagagagtcttctcagtcacatcagaagtcttgctcaggtgtcttcttccccttccctttgatgatgttttccgaaaacagagggaggattatttggtctggattctttgaggatctttggaagaccaaacaaagcaaaggggacacacacacacacacacacacacacacacacacacacacacacactagaaggaagtaaggcaacaattttgagaatatatttgtaacatatttaaagcttatggaatctctggtatgagcctaataagttagtatttctttgggagcagtggtgggcacatctgcctgtgtggggacacaggacaatatgtgagtggcctctgggtttggtctttgaaacacatatttttctgggaattataccacattagctgctagccctttaggactcggggagttcttgtggagtctgtgggtaactggatattcgactgtttcagatagtaacattgactggatgtttcttgcttggatacactggtggttacctggagctgagatggccttccagaacacctgtgttcatctggtttttctctgcttgtgtacctcacttcttcaaggcctacactttgctcaatcattgtataaacatactaaactcagatcccgaagaccaatgacacagatggactttgagaacactaagcaatatgtaaggagatgtacccttccgatccccgctggtctcctccacctttggggcatctggctattctctacactaaactcccacagctgctcttggcgtccagggacctcagcttgggccagatatagtgcctgagtttatttctcaggtgcttatgtttgagtctctagagactaaagtctggaggagaaaacatcagagactttcttctcaccaccaagaactcgtgaaaggatgtgaactcacaacttctctttgcataaaaccacagctgctcaagtaaaagaaacaactatggtgaactcaaaatcctcccagaggttctttcctgcgtgcatttcccacaaatatttgatgcctttcttctcccttaggagatatgagataaagacacactggccaccctgattaagaacacaaggaaacataaatcctggttgtcaattgctgtggaatttatattataaaaattgcagcatgtaaaaatgttgccagggaactcaatgattggcataagcatcaagagttacagttacttttacccaaaacactttgtaaatagaaggtctgtgcatcaatggaagacaccgtaggtatggatattttttgtttatttttccttttcacagtaaatttgtagtgatgctatactagcagaaattttcacacctttctacttcaaaaggttttcttatagtaccggggaaagtatttattttaatatataagatcactcttgaaaatcacttttgtaaaaaaatgttatgaatgtaaattttttttttatcaaggagaaataaaaacaggtgagtgtgggtcattttttttttccttcttctcagtacagtctacctcagtgtcttattaggatgtggttcagtaacagatgttgaggcttcaagattctggctgaatcattctctgagttggggagctgtgtaccatttgatttttaaatgccagggactagggagaactttgaaggagagagtttagattaaaaagttagagccttcctgtgaacccaaagtcttcttgttggtgatattcttcagagtatattctccatacaaaaacccatctgttgattgcacactcctcacacacaagccacacttcaagtcatcatgatttagctctttggaggcccctgatctgaggtctttgaaaagtgggtgttccttttactgatgaggctgtgagccagtaccttcagaagtcacatgaaatcccccggacatgaatgcaaagggaatctgggttttctgaccatgatttctcaccctgtttagacccatgaggctgtttgtgggcacctcttacacaaatagctgatgcaagggtatttggagaaatcctgctatgaaacctatcagtttcctgaacatatcttaaacaataagataggaaccctatgctggggttgggttgacttcaagctgacactgtttggccttgtgcaatcttgagaactctggaaatcaaggcggggccagcatggctcctagtttcaagctttgacatattatttcactttagaacactgtccttaaaattttactcttttccatcttttctggaaaggtgcaccaacttgggtgaccctaccaaaaaggactccactaattccatgttgatatctactgttgctgggaaggaaacaagtagctattgggtcatgagactcattttggtttcagaagatgttagctttgtgagatctagaaaatcatggctatcctgggagttcgtagtgatggatgaaagagagagagaaaagaaaatagaaacaaaagcaagttacattgatatttcttgttgagttttgggagatgtctcatcattttaaaactactttcatgatcatgatgaaatgcagttatttcttccaggatagcagcagacatgttgtctggttcaatgatgtcaagcatacatcaggagatgttcatgtacttggagcctttctaaatgtttccctgtcatttgatgctagcttgaagggaagagccttgatggctttctggatttaggctgagcacagtttgggagagtggagattggcaggaagagctgaactgtattgtgtggcagctgggtgtggtgccaccaacacaagtaaaaactatccttactatcttatcaggacagacgttctaccatgcacagtgattattgggttaagggctgtaattttatttgaaacctaccataacactggctggtgggcagtatcactgtgagagtctggttcatactggtgatcttggtaaatgaatgatggttgttctagtaatggttctattttatgatagatggatgtattccagattctagctaatgaattcttgacaacataggctcttcaaaaattatggttttgtcggacatgcgaaaagaatagtgctgattttgtgtaaatggtgcacatagcatatagtcatttttagaaaaaccttccagtatgttcctcagaatatgaacttatacaaaagatgaagttgggcaatgggaataacagaatatcacttgtttaaacgacacaaaataatatgatggtcttttaagaggtaatgactgaaggcatatgcatcctcagatagtactcaagaaatggagatcaatgagtatttgagctaatttgataccaatcaggatacaaaaatcagtctctggtcaaatttttatctgtatgtgggccatttaaaaaacaaacaaaatgaaacaaaaacatgttaaaaatcagatcatggttctggaacccttgttattatttgagaagaaaggaaggtccctcagatgtgtgtgtgtctgttcacatgtgcaggaatggcttgtttggtctttatcctttgtatcaaagttgctgcttctttcccctttatgtgcctgggtggttatatcccatgtgtcaacagtgtgggatcaaatgtgccatagcactgcagaaaacgcagaaacacaaaacccatccaaagcacagtgacattttcctacaagagccaagtagcatcatgtccagaatatgcctttttttgtgtggggaggagagggactgaaattgttctgcatgtataatacaggctaattacttgtttatattaaaatttggaata

SEQ ID NO: 33260 - DNA, 1136 bp, Mus musculus
ctgctttgaaggataatccactgatccaatcagtactacccatttgtagccattcattggtatatgtgcaacctatctctggtcacaacttcacaggaaagcgactctccttcccaaccaggcattagttgccaatagctcctcagagagggatagccctccttctcctatgttggaatttttacttggcttgattttgtacaggtctgtttgtgagctcagtagccatgtcatatcaagaggagagtatttcctaccctttgactctcataggtttttcacagcagacacttgggggtggggttgatataatatcccatctactgctgagcactcccagtcacttactctcagcagcctgaactgcaatgagtctctgcatccattagtactcactgcaatgagaagcttctctgatcaaggctgagagcagcacagatctagggatagaaacacaaacacatagaaggctgtttgacaacatgactattcagaaaagcagcatcaccttgccctatggctttcctagctgaggatttgaccatgttcacagtacctggcaattcctaatgtgtccatgtctgtctgtctgtctacctatctatctatctatctatctatctatctatttatcatctattaatctaatttataatttatctatctatgtatccatctattaatctaatctatctatcatcctatctaatctataatctatatctattaatgtaatctatcatctatctaatctataatctatctatagtaataaattaatttaatctatcatctatcgtgtctgtcctctctctctactagtcatctatctatctatctatctatctatctatctatctatctatctatctatcatctatatctctacctattaccaggcctaatctgacctctagtggccaactgaaataaaatctgttgtcattgaaagtctagagttttttgaccttcattctaagctggatttctcatcttatcccaagttgatatttggggctagattactcaatggtgagaggaacattttgtgtatggtagcatgctgaactctgctcactccatagcagggacatcacagccttccaaagaagtgatggaggcatactcttgttaac

SEQ ID NO: 33261 - DNA, 1102 bp, Mus musculus
ggggtctggagacatgaattgtgatagagtgcttgcttagaacctccaatgaggagacatggctgtggcctaaggaatgacacccaagaatgacctctggcctaaatatgtgtgtgtgcatacaccatacacacacacacacacacacacacacttgaactaggatttgtttatctgttccaccttaccgagaaagcactgtggtgctgtgtgtgtgtgtatgtgtgtgtgtgtgtgtatggtgtatgtatattggagtatactttatgtcatgtgtatgtgtgtatgttgtgtgtgtggtgtgtatatgtgtatgttggagtgtgctttgtgtcatgtgtgtatgtgtgttctgtgggagacttgagcccacattctgcctctccctagggctgaagctcccttcacggacctggtccccaccctttgagtctgatgattctcagaagcacaatcagagtgagtatgacgactcggccagtgagtgctgctcatgccctaagactgactctcagatcctgaaggagctggaggagtcttcattcaggaagaccttcgaggattacctgcacaacgtggtttttgtccccaggtcagagctttgcacgggccagctctctttctgtctgttagcttggtgccatgacttcttagggaatgaactcaggagactgtgtaagtggggaggtggctggagcctgagctcaattgtgtgcttttggttggagggggaaaacagtcttgtttgttgttgggaagagggcccacttaggaaagtatttgccctttttaggacaaagggcacaaggacctgagtttggtgcccagaacccacataaaaagccaggtgtgtgcttatattcccattactggggaggcagacacagtattcctgggcctttctgttatccagactggtctaactagtaatgtctgggcgtataaggacaaggtggacagcatctgagaaaccatagccaactctgtcctctggctttacatgcatgtctacctgatcacacatgtgcacttacacacatatgttcacatgtaagtacacatgtgacccacaggtgtatttgtgtacacacacacacacaca

SEQ ID NO: 33262 - DNA, 1212 bp, Mus musculus
cacaatttactaaaacagaacaaaaaaacttacaacccaccatcaaattagagaaagtgaaaatgtgctgttcatttagttgatggattctggattctgtctttgattcgtttttggttagcaatatccttagcctgtgaccttgtagaagcaggccaagggggctgctggagaggtgtggctgaggtctgtccttgaatccacccctggcctggtatctggttttggctaagtcacagcagcaagtagtctgtctccttttgtagagaggggcagaggacagatgactcctgggaacagtcccaactctaagatcatgtgctatatgtatgcctgtgacatcattcctgccttggccaggatcaccagctaggtttatctccttgcatactttatatagtttgggagcaagtccagtcctaggctcagcactgacttgttggctctgaatttgagtataggaaaccaccagctagccaaagctatactttttgttttgttttgttttaaaaaccagcaacttaaaaaagtttgattgtgctgttgtttgtttttaaacaaagtttcacatgacccaggttggccttaaactcatgatgtaccccgaggatgaccctgatcgtcctgtctctgccgatggagtgttagggtgacactctccactatgccagggctactgcagccaactttcattctgtaggtggaaattccagattgcagaagctgaggatatagcttagtccgtagaaagcttcctagtattcaggaagccctgggctccattcccagcaccatatagacccagtgcagggggttcagtcctgctactgcagcatttggaaggtggaagcaggaaagttgggcatttaatgttatccctacctacatagcaagtttgagtcctttctaaggtatatgagaccctgtctgaaaacaaaaacaaaatcaccttacatccatgaataaccacaagggtattttaaaaaatggtgataagtgaatattacagaatttatttgcacttgaatgagtatagatgcatacacatttctggtctgactgagacacatttaagaaggtgaatgcatatcttcttaaatgttacacacggtcccacactcttctggaagcacacgaaggactttatttgaagttgatgacaggtgtcttgctctgtggatccttgttttctgaggtaggacttttttttta

SEQ ID NO: 33263 - DNA, 1211 bp, Mus musculus
aagtagacagatcttttgtggtctctgactagccagagtagcctttgaggtgaatttgaggcctgatcatttaccctgtctcaaaacacaaggcagcactcagatgtgtatgctgttagtcccagcactgaggagacaggaggcaggtagacttctgtgagtttgaggctagtcaggactagagtctgtttcatcaacagacagaaaaaaaaacaggtacatggaacctgatgctcttctctaggtccatgtacacacacacacacacacacacacacacacacacacacacacacatctgcacctaagcaccaaatagaaaagaagagagaactctccaaggttcccatcccactttagtactgagcttgacacttacacagtggtaacccacctctccctcttatttttctcaaaagcccttatcagaatgtgacagagtttgatgggcaggatgcttgtggctccaacagctggactgtggtggatattgacccgccccagaggtccaacgaccccaagtctcagaccccaagccaccctgggtggctgatgcggggcctcaaaccctggacccaatacgccatctttgtgaagaccttggttaccttctctgatgaacggcggacctatggagccaaaagtgatatcatctatgtgcaaacagatgccactagtaagtgtgtcctgggaacaggggtttgctgatgaattgacactattatctttggtaggcagcttctgtgacagggtttctcccgtggttggcatctagaggagctaagggctgagactcatattttcatagataatgaaactataacccatgaactacttcagagttcaagagttcccttttgggcttggaagatggcttggtgggtaagattatgtggtgttcccagtacccacactgaaagctaagtgtgcccatgttcatgttccagagtcctggttacttgcatctattcccagagcactggggctcagggacaggtgcagggtaacactaggatttgatagctgccagcctagctttagtttcaatgaaagattctgtttcaaaagagtaaggtagacaatgatagaatgggatagaataggatgcctgacctcctctgcttggctctgcacatgcacatgcatatgtaacacacacatgtacgcctccccacatataatacacacataccacatataacataccacac

SEQ ID NO: 33264 - DNA, 1203 bp, Mus musculus
tactgagctatatcccaggccctcactggaggattctggttacattactcctcacccatgccctcagtcctcaatggaagattctaggcaggggctctatcccttagtcacactaccaatcctttattcggggattctaggagcatgttatacactccatgaaaacaacttctttgttttccatattcccaaagatttttttgtgtctgtacatagaatgtattttgatcataatcacccccatgcattcctcatattccacatagacccaccccaccccaccccaccctacctcaccctacctccctctcaagttcatttcttcttttttaaaataaaattataacccacttagtgcactctgtggcacctgccatcctcgaactaagaacattggttttgagtaactagttgtgtgtgtccctgtaggaactattctttttatgccttggacaaccagaacctgaggcaactctgggactggagcaaacacaacctcaccatcactcagggcaagctcttcttccattacaacccgaaactctgcttgtctgaaattcacaagatggaagaagtctccggaactaagggccgtcaggagaggaacgacattgccctgaagaccaatggggaccaggcatcgtgtaagttgcttcattcttagatccccagcagctgcccccagggtcccctctggcagccactaccctagctgccaggaaggtgccattgttgtttgttgagctacagctttctgtgagaggagttttgaaatacaaaaggcaggtatagatgtgtgtatgtgtgcatgtatgtgcatgtgtgtatgtgtgtttatggatagacatccatgtgtctctggaagccagaaagcaacctcaagtataattccctggacaccatccactagttttcttttgctagattttttttttttctgcctaaagcccaacagttggctttataggctgtgtaagaacctcagggatccatctttcctatttttttcagtgctgaggatagaagtgctctattgctgtgaagagacatatgatcaattgttataaagaaaagcatttaattggggctggcttaatttccttctgaagcctaggctgtcatcatcatggtgggaaccacagaggcagagagacaggctgagagcttatattctgatccacaggcagaggcagagaaaagaga

SEQ ID NO: 33265 - DNA, 1205 bp, Mus musculus
tgtgccacattttcttcatctgtttttctgttggcagacatttcctcagctgtggtgaacagagcaacagtgagagtagatgtgcagtggagtgtctgtgatatgctgacctagagtgctctgggacatacacccctggttttttttttttttttttgtgtgtgtgtgagaagccaagaccaatttcaagggttagttgttcctcaggtgccctccatcttgtctcttgagacagggtctcttactggcctggagttcactaatagaagtagcccagtgagccctggggatccatctatctctaaatgccccctgccctcacagacatattatgttacacaagcttattacatgggtcctgggcatagatgctaggccctcatccctgtacaacactttgttgtctccccagttctaggttctagttccgttagccgttctagagtccctggctcacctactttgctttgcctttattatctgccttctagtgtgccctggtatggacatccggaacaacctgaccaggctacatgagctggagaactgctcagtcattgagggccatctgcagatcctcctgatgttcaagaccagacccgaagatttccgagacctcagtttccccaaactcatcatgatcacagattacctgcttctcttccgtgtctatggtctggaaagtctgaaagacctcttcccaaatctcacagtcatccgaggctcccgtctcttcttcaactatgccctggttatcttcgagatggtccacctgaaggagctggggctttataacctcatgaacatcacccggggctctgtccgcatcgagaagaataatgagctctgctacctggccactatcgactggtcccgtatcctggattctgtggaggacaactacattgtactgaacaaagatgacaacgaggaatgtggggatgtctgtccaggcaccgccaagggcaagaccaactgtcctgccactgtcatcaatgggcagtttgtggaacggtgctggacacacagtcattgtcagaaaggtatgctgaaggcagtgccttttaaagatttctccgtggttagtatgcccaggagaagtagactcctgtaaaagtttaggtgatggaggttgtagggtacaaaccctagaatctccataaaaaatacattcgtccccttatctgcgaggcatacctatttga

SEQ ID NO: 33266 - DNA, 1233 bp, Mus musculus
aaatagatgcatgggcagggaccttccaggtgtgatggtggtggagctgtgtcttccggaagccactggagtcctgtcattcaggacagtcggccatgaagcttgtagggcaggttccaggttatccctttttcttttcttctttgtcttttgctttttcctttttgttttgttttgttccaagtcaggtggaggcagagcccaggatcaccataaggaagggcgtggtgtgtgtgtgtgtgtgtgtgtgtgtgtgtgtgtgtgtgtgtgtgtgtgtttcctttccttctaccatgtagggtctgggaaatgacactcagactggaagaccttgggttagggttagagtgaagggttcccccctttcttgtgttcaaataacctttattttaaggcactatggatgataaagttaaaatgccacagaacgagggaagtacttttgacagttccatgactacgtacattatttcctttttattattaacttactaatttcttactatctatttatttatggttagcatacagactggtggctgtcacagtgacactttgtacacaagtgctgttgaactttgtgcatacttaccctcctgagaccctccctcatcgcaccgccatcctcatcctcccaaatagccttccttctgtggtactggttttgtgttttgataaaaggttatgtagaaagggtatgttgtgtagaccaaatttgccttgaacttgttatataacatagattggagtttctggtccttctgcctccgtcttacaagagctgagataagactgtactaccatgcccaggtcttcattgtttgtttgttgtttttatttgagacagagtctcacgttagccaggaactctctgggtaaactaggctagactgaaacctgttctgtttgtgcctcccaagcactgtgactacatataccactgtgcctactttttattagttttattacattttttaaaagatttatttatttatttattatatagaagtacactgtagctgtcttcagacacacgagatgagggcatcagatctcattacagatggttgtaagccaccatgtggttgctgggatttgaactcaggacctctggaagtcagtgctcttaaccatctctccagccctatgtatgtatgtatgtatgtatgtatgtatgtatgtatatatgtatatatgtatatatgtatgtatgtatatgttcatgtatacttg

SEQ ID NO: 33267 - DNA, 1373 bp, Mus musculus
tctaattcagtctggtgaccatgtggtagatggaaagaacacacaccaaaccaacgtttgtttgcttttcttttaaggctagagcacacacctctaatctcagcacttgggaggctactcgggagggttggggtggggatctgtctgccaaagtgtgcatatggagttcagaggatagcttgcaacatgagtcctgtggattgaacccaggtcattgggtttggcaacatgtgcctttacctactgagccatcttgctgttccgatgacaatgatgactttgacagtgacagtgaccataaaggcaggctacagtcttgagtcttagagtccatatggaaaagccctgtcacctcagccttctactcattctggaacatcaagtcagtccatggaagctggttgaccacttgcttagctccaagaatatcatattcttggggaccacaggaaacgtgcgcagggctactgagatcattccgagctgactggcctctagccaagcccataacaggatgggtgaaacttcttcatccaaactatttattagtgaactgtcatgaacctgaaaggaggctgccccaggccaagctcctgtgcgggcatctaaacctttgcttattactttatcatgtagagaatgatgagggagaaaacctccttatctaggctggaggccacacagactactggaggggcctgaactaccttgtgagaggctaagatctaaaaactctcagcagttgcctgaggcaagccagctgtaaagaaacccacgctccagtctaagtgaagtcttcccagccccaacattgttggcattggagctaaagagactgtggtgggctgccctggggaatgtcttccaggagtacccttgctccctcatggagataactagaggcaatacaggaactgagcatgttgctcaggggttggaagtgtggcttaaagatggaaccactacctagaatcccccactgcagagctaggagtgtggcttgggtggagaacctacctggaaactccagagagaaccctgtgggcatcatacatggcttagcgtgtacaaagcctgcctggcatgcatgagatcctgggtttaaaccctgtgtttgcctgcttttgacaaacgccatcctttggtgttatcagtgtctactggacccttcagaaagaaggaacccaaagactttgctttctgtcccatccccgaccccccttccctctacagaccctgcctcatcgacccaggtcatacccctgcatcatctgtatccttccccctcccgacccctatgtttcacagggtacagtgttctgctcacctgtcattccatcctcgggcttccttaaaggccttaccatttgaaa

SEQ ID NO: 33268 - DNA, 1222 bp, Mus musculus
agaggcccccacacgcctctgcaggcaccaacatttctcatacccatacccataattgtatatgtatatacataattaaatataataaaaatcccctttaaaagtttgtgtgggcagtatgccagacactgaatcaacataaagggatttggccacctacttctagccttgctacctgcttctctttaccccagatctgtgcatcaagggggcgtggggaggttgcccaggggtaccgtgtgttcagagtagaactctttggttgtttataaacagctgcactaaaggcagaaagtcccactaggtagagctttgtgggactgagaaagtagctttcttcttttccccttttatcctgttggtaccctcagcctgtgggatgtggctgttagggccagggtcagtgtcccacacttagctagtctactcaagagatcaaccagtcttgcttgctggcttagatgctccttatatcatgctaacactcaggattaacccggacaagagctgtggatgcccgggggacaagagagatctaaggacccgtgcttaaatccttggcacgtgtgaacagctagccatggctgtgtgcacactcctgtaacctcagcactttgctgggtggagacaggagaactgcttaggtttgggggccccagcatagctccaggtgcactggaagactctgcctcaaaggaataagcttgagagtgagagagcaggacacctgatgtcctcccctggcttctgcacacacacacacacacacacacacacacacacaccattcttgtatttcctcacatgcacacactagttaataaaacaatgactaaacagcaaaagataataaaacagtggtagaaaaactaagaagttaaagcaggagaaaataggagcttggggcatagcttagtagagcccttacctaacatgcagaggctctgagtccagtctgtatcagaagaatttaaaacccaccacagataataacccctgaggtggtagcagtggtccttacagtgcagacaggtatacctggatgcctgcctgcgtgcccttcaacacaaggatgtgatggtctgtatgctgtcactgagaggttggtggcatacagaagagctccttttgtcctctgtgaggtcggagtccttgtgatgacatcatttccagcattgtactgggtctgacttgcagagggggcaggaaggggcttggcagg

SEQ ID NO: 33269 - DNA, 1205 bp, Mus musculus
agatggatctctgtgaattttaggccaacctggtctacacagagttccaggacagccagggctacatagagaggccctgtctccaaaaacaaaaaaacaaaaaaaaagtttatgagtagtcagatataagttgtgtggccacatttgagagagagaatatgaatatggctcagtgtgaccatgggtatacacatactgatgtgctccaagaactgtcaatcaccagaagcaactatagatggaagcagtgctctgcagagtgcagaatagaccttcctagctgcagactggatgcagagctgggtgggcaacacccattcatctctgagcatttaacagccatgtttgatcctccccgggccaaagccaccagaaggctaggaggcctggtgtgggttaatagccaccagcaggcttagcagcagtaggatgtgtcttccgttacttccaggcccaacctgcaagccaccctcccagcttcaatggcgatgggctggaggggcactcggccccagccaaagcaccaggaacccaagggagcgcgatgctacatggcacaggacctgacaacgtagagcgacccgaggtggcccgctgggacagtgccccccctgagagccggccagccaagagcgatgtgcccatccagctactcagtgccaccaatcagattcagaggcagacagccgtgcaacagcagatccccaccaagctggccgcctccaccaagggtggcaaggagaagggcagcaagagcaggggttcccagcgttgggagagctcaggtgagctgcaccccacccccaccactcagagaagctgcacacccctcccagtggacctgtcccagcagcatatctggaatgcagacagggaggcagataggcaagcaccagtgtgcgcaagaagacagagaggttcacttttccagttgcatttctgttgtgataaaataccctgactcacagttccaggtttgagtccatcgtggtgaggagtcagagcagtgagagcttgaggcagcctctcatagccattcaggagcagagagaaatgaatgcatgtatgcttagtgtccggccagctttctctgaaccacggcccaaacctaagaaatggtggcgccccaggctgggacttccacaccagttaaggcaaataagacagatactcacagatcagcctgatgtagaaaatccttccct

SEQ ID NO: 33270 - DNA, 1131 bp, Mus musculus
gttcttagtctccagagcccatcgtcctaagaaaccactacaaagaccctgccctgtgatacttaggtagacagtaccttagatggtctgcagactgccaggccatccccacctctgtggaacagggaagtgtcagaggctgctggcatgagcaagagccctccagagccaagacctaagcactcatgagctcagggagcgactgtgggcgtagttaccaagaatccaaccgcgagctagtaagacaacagggtgctgaaagtggtggtctctgacgacttccgggtgccaggaatggagcagggtcccccttgtcctcatccctaggcctatggaccccagcacccgaatagctcttactcttgtccttctgtttctatcttgtgtccggagtgtgtctatatcttccagacctcattgtgccatgttgctaatcagtgttttgtggtttgttttgttggtttgggttttgttgttgttgttgttttgtttctgtttttgtactgagatgtatctgagcactttagaaaagctgacttttaagttcccactctgtgaagagaacattccagtacctaacaagagctgggtgggctcaccaccagacaccatgactttttggatttagaagttcaaatggtttccacttggccctgggaaggattcagtgtatcccccaccaggtggccaggtggttctcagctgtgtactgtaaacagtaggacagtgtcatcagttacctgtcaccagcagccatgggtcccttcctggcagatctcatttgtgaagatggtgagccagcagcattcaatctcccttgtcaatcgtgtccatgatcttcgcctacccctgattattttcacagcgatagcagagcatcctggcaacagggtattctggaaccacgctagaacttgtgaccagattctagcaataaaattatccagagcatctcaggctgaaacagaccttctttggggattgggaatgcagagcgtggagctgtgccctgccaaggtttttgttgataaggaacacaaatgtcgaaggtgagccagtgcagagtagatccgaggatgtggttcagtcagaagagcctcgctgagcatgcatgaggccccacatcctatt

SEQ ID NO: 33271 - DNA, 1172 bp, Mus musculus
tgcataaagtcacccctccccaccacatgctcccagaacaacttgatttaggcactacttcattgagactccactcctagggtattccagattatgtcaggttgacaattaaaattaaccatcacagtgtgttaatggccctggggcaggaagtatgtcacaatgtacaaactggttgtttctaaagtgacatttatcaagcaaggcttgagatgaaactagttttgagtggtgagggtttggcagctctatttgtggctatcatgtagatgtcacgaagtggatacatggctgacgttcaccctgtctggataacacacatgtattgcctgtccctataggaagaagagaagtccacactccggcaacgacgctttctgcctcaggagactcccagctcagtcgcagatgcctgaggatcttgacagggaagccctgttcctagactgggttatgggtgagcttgtgggggagctcacactattattcccactgctgctatacttcaacactccctgggcccttcccccttggctccaaggaccacacactggactgacttgccctgtccctaaggggagggcagaactgcactgataacctttgaccaactatgtgaccttcccccaaataaactcttacccctttcgaagcagcctggtgctgtctttgggttcctggggctcctcaccatactgtctgtgctcgcacgttgggcttagtctgaaggagcctacagcttgtcccactgaagtaacaatacccatgtgggtactctgtaccctgtctccagacaagttctgagcatgctttgccgcttcttacctggcttttgggtgatcccacaatgtcttgggtaccttttactctccctactaaatccccacagccatagactatagagacagctcagaaggggcacaatgtgctctgatttgcagaggatcagagttggactactagttcccaccccaagtagctcacaactgactgtaactccagctccaggggatctgatggcctcttctggcctcctactcttcctacactctttgtatactacctctcatatacacttacacaaaatgaaaaacctcctacagcctatgcacctcagccagtcctactgtgtgcaggagctatgtgtgacagtgtatactacaaactaagtc

SEQ ID NO: 33272 - DNA, 1175 bp, Mus musculus
gctctgttggccttgctggcgaggaggggcacggtgccttcactgcctgagcacccagtgcgcgaggctgacctgaaacaccagccaattctcatggtaggctctgctcctgacctatgaagccctgcctaccaggcttggctcctcccctttgcactttcctgcaaagtttctagcttgtgcttgaacctcccttcaggctctacccactaattctcgttacactccccaaatggttcctctagccatgccctcaagctcagcccattaggtgtagctcctccaaccagttttagcccctcccacaaagcttagctccccctatcaagcctacctccattttccaagcctagcttttccatcaagctaagggtgtcacactcagttctgcagatcatacctggctcctccctcaagttgctatacccttccactcctcaggttcctccagttctggccttggtttctctagatgggctactctattgtaaatcctggtgtcttagctcaaaacccagcccatgtgtgacctctttcataactgtagctctcaaggtcccacccagcaatccctgaccccacaccattccctggccccactcctcccacttctctgggattggaggcagaaagagtagctccctgcccagtcttctggtctcatcttccagcctttgccccaacagggagcccacctagctgtcatcgatgctctcatggttgccttctcatttgagtggacaaagacactacctggtcccttggctctgagcagcttggagcacaaactccttttctgggtagacacagtaagtagggtgggccaggccatgtggagtggagacaatgacgttagccaagtgaccaggcactgacttctctctgacccctagactgttcggcggctgcaggagaagacagaacaagaagcagcccagcgtgcatctcctgcagcccctctggatggggcctctcctgcccagccctcggtgaggctaggacaagggatggatggatggatggatggatggatggacaggtggatggatggacaggtggatggatggttatgaggcaggtgggaagggatgggctgcacctcctggccattgctgagattgagggtgggcctggaggtgactctcttttcctctttttctctgcactttttattg

SEQ ID NO: 33273 - DNA, 1172 bp, Mus musculus
aagccgcctgcctggcagtcgagaacgtgactgggagaatggaagcaatgcatcctccccagcatcagtgcctgagtacacaggtaagtgagaccgggtaatgttagaagctacgcgttctctacctgcctttccccaacccacgcccagtctctgctgactgactgccctccaggtccccggctatacaaggaacccagcgccaagtctaacaagtttatcatccacaatgccttgtcacactgctgcctggcaggcaaggtgaatgagccccagaagaacagaattctagaggtgagtcccacagctgtctgggtgggtaagactagcgggtagagcagtagtccagcctgaccagcttcttgccaccatccctcaggaaatcgagaaaagcaaggccaaccacttcctgattctctttcgggactcaagctgccagttccgggccctctacactctgtctggggagacagaggagctatcgaggctggcaggctatgggcctcggaccgtcactcctgccatggtcgaaggcatctataagtacaactcggatcgcaaacggttcacccagatccctgctaaaaccatgtctatgagtgtagacgccttcactatccagggacacctttggcaaagcaagaagcccaccacgcccaagaagggtggcggtacccccaaatagtgcccaccttgggcagtgcactcctgggtcctgtctggtcatgctgtggggggctgagctgggagcttcagtgactcagggctcagctcagtccccttgtctgtcctccactttcttgaataaaataactgaaaagagaagctgagacacggtgtctcctccctaagcctgaccaagtttacgtctcgtgttttcacaagccctaccttgtcgtctttgcccttttgctggccctgtggcagctcctgccaacatctgtggtgaccttcctgttgacactccctcctctagatgttctcagccacctctgatctgacctggcaagagattccagaccagctctcctctcctgggcctcctccacccccacattttcctcctccgtgtggttgcatttggtgtgcagccaacttctaacccgatccctgtttcctgttgccaacctgccttcatttctgagcccagttacagtctctgagctggggat

SEQ ID NO: 33274 - DNA, 1148 bp, Mus musculus
gatggggcctcagagggtgccctccagtagtctgccctccaggagtctgaacctagggagcggtggggctccctaagaggtagaggaataaagcctgaaagaggtagccagggccctccagggggcaaaatttgaggacagaggtagggacttacaggggcctctggtagggagaatttggggaaaggcagagactcagatagagaatgggaggagtggggtttgggaaggaggtgtctttgcaagggtgggccttagtgaaggtcttggagggtagggcagaggtgtgcttagagacaggacccgagtgagagttggagattatgaggagtgcttagcttgtgctcagttagatgaacttcaggatgagatagagtggggttatcttaacaaagtccctgatttgcccctgctctgttgcctccccacaccttcccacggcagccagctgcacagctaactcttgtgtcatgcaggacctggccatgggctctgatgcagagggtgagaagatcaaggacgccatgaagctgattgtcccggtgctgctggatgcctcggtgccaccctacgacaagatccgggttctgttgctctacatccttctgcggaatggtgggtgagggaatgaagggccagggatggtctagatcctacagccgttaaaactacaaggccctcatcgcctagcatgcctcttagtgtccttcctatcgctgtgataaaacaccctaacagaagcaactcagggagaagggggttatctgactcactgaggtcaagcttgaagcagctggtcatactcacagtcaatcagagagcagtgaattcatgtaaacttgtgcttgtctctgcttctccagtcttacacagctcaggatcctctccccagggaatggtaccactcgtagtgggcaggtcttctcacctcaactaatgaaactaggaaagtcctttagcttcttaactaagaaccgtcacttaatggtaaaagaaattagaagagtatttttttaaaagacttagttatttagccaggctgtggtggctcacacctttaactccaggcctcgggagacagagacaggataatctttgagtttgaggccagtctggtctataaaactagttccagggctacacagaga

SEQ ID NO: 33275 - DNA, 2315 bp, Mus musculus
attcctctccactgatcccattagccactaagccctccaccccacccgcccaggctctcagtggtaagccttggggcttagtggaaaatccctcattatcagcatacccctggcaccctatctgctctacatgggtgggggcacacaaaactgcaccccaggaactggggcagcgaggaattccttgcttgtgactctagctttctctaccccctgtgttcccctgtaagctctctcctgtcctccagaagcctctcatgctggcccctggccccccacactccaaagcctcataaccaaataataatctatcagaggctctgtctttatcagtttgtggaaatgtcctggtacctcctgcttggggacccaacaaccttgcaccttagcttcctggattcctgggtccccaagagacaaggaagcatagacagtggtaccatggtcatttcagttgctgagctccactggctggggttctttaacccttcctgtctggctccccaggatgtggtggaggaccggctagaccgaaagctgtggccctttgtgtctgaccctgcccctgtgcctagctcccaggcagctgtcaggtgagggccctggagaggcctgggttgggggttgggagctgccagcctggactgacctctacccatcaccccagcagcgctcgctttggccactggcacaaaaacaaagctggagtagaggcccgggctgggcctaggctcatcgtgtacattgtgggtggtgtcgccatgtcggaaatgagggctgcctatgaggtgaccagggccactgagggcaagtgggaggtgctcataggtaagtagccagaactggggtccttgggagtatgactgtggggattcctggggaccagggctggacatggggtcccttagagtctgcagttagatttgttgtcctcaaacgcctaagatgtggggacttgggcttctctggagcctgagcctagattctgagtccttaaaagcccagggctagagtctggactctttctcttgggggggggggggggtgtcctgtgctggactctgtagtctattgagatctaaggctgagctctgaggtccttatagggcctgcgactgagctctggtctttgaggggctggggctgaactcaaagaatccctaaagggctaggattagattatgaaagttctgggcttgggggtgggaatctggggactttgaaaggctggggctggagtcttcagtggagtaatcacctggggctggatacccctgttcctaagtttctgaacccctcaatcattgagaagacagggccctggtttgcagaagggcaggagtttgttctcaccagccaggacacgagtcaggagggagggactctacctcctcctttaaccttcccctcctgcccaggctcttctcacatccttactccaacccgcttcctcgatgacctcaagacactggatcagaagctggagggtgtggccctgccctgacacagccccttgcctctgccctctcctattccagagaaataaacgcttcccttctgtcttcccaccagggctcacctcattttcttcccagagggagctgtattgagccagacctccccctgcgttttcactgtcctgcccgaacctttccccggcccccagaagcatctgtagctttcattaacgctgagaacctgggctgtagggtcagtattggcttgaagtttaggaggcactggctctcttgctgggtcctccatccaaacccaggcctgattttggcagaggagatagagaggtgcagattaggggttgccagggctgcaaccccactgtcactagagttctttaggctgtaaggttagaaatataggaaaaattttaacctttatctttattttgtgtgttacacttgtatgtatgtttatgcatcataagtatcagtgcctgtagaggtcagaatagggtgtgggatcccctggaaccagagttataaatggttgtgtgaagccatgaaggttcttgagtctgctgtgagaacagctagtctcttacccactgatgcatctccagcaccagaaatagaaacggaaatagagtagacctgaatcctgactcttccccggaacctcccaggagctactgcaagtagaacttgaatccccaattccagcaatcagagctagcatttaaaatacagcaaacttggggctggtgagatggctcagcgggtaagagcactgactgctcttccaaaggtcctgagttcaaatcccagcaaccacatggtggctcacaaccatccgtaatg

SEQ ID NO: 33276 - DNA, 1449 bp, Mus musculus
atgttgggagccgcgcccacattcgccgttacaagatggcgctgacagctgtgttctaagtggtaaacaaataatctgcgcatgtgccgagggtggttctccactccatgtgctctgccttccccgtgacgtcaactcggctgatgggctgcagccaatcagggagtgacacgtcctaggcgaaggataattctccttaatagggacggggtttcgttttctctcgctcttgcttcttgcactcctgctcccaaagatgtaagcaataaagttttgccgcagaagattctggtctgtggtgttcttcctggccgggcgtgagaacgcgtctaataacaataagcagcatcattttccttgttcggggttgttctactttcgcctatgcaatcaatgctctcccaataaacgtgtgcagaaggatcctgttgcagcgtcgttcttcctggccagttgagcgcatgcaaaaattaaggttatattctaaattaatctaccctgattctcagtcaagtaatgatatgcagacctctaattaagaaaacagtgggtcccccaacttcttagcggaacaagtggcgctcagccacccaagattgagcaataacaggtctgtgatgcccttagatgtccggagctgcacatgcgctacactgactggctcagtgtgtgcctaccctacacaggcagacacgggtaactcgttaaaccccattcgtgatggggattggggattgcaattattccccatggacgaggaattcccagtaagtgcgggtcataagcttgaagtccctgacctttgtacacaccgcccttcgtgattggatggtttagtgaggccctcggatcggcccgccggggttggcccatggccctgggggagcgctgagaagacggtcgaacttgactaaataagaaagaaagaaagaaaggaaggaagaaagaaagaaagaaagaaagaaagaaagaaagaaagaaagaaagaaagaagaaagaaaacagtggggttgagcaccactttaaggagattataccaattgtaataggtctgtagttgcatgggccattgcttcactacttgttcaaaatagggggaatctgggccagaatcattggcagcttttctgattggtgcgaactctgccagaagagttgaaatcaagggcctagtcactgcatcagggccaaaactgacagggaaagtctcacgatatacctgaggggaatgaggctcccagggaagaggcagtccagcatgagggacaggcattgcaggagtgagcaccgcaagagtgatcactagaaggcaaagttcccctaaatcacaccaggggtaagctaggggtacctctgatggggtgggagcagaaggattagtgagtgagggacctgagacagcagggctagaggacaccttggaacctgacagcaagagggctgaagtag

SEQ ID NO: 33277 - DNA, 1249 bp, Mus musculus
tggtgatctcccagcattatccaattttaagaaattaagagtaaatattataagggatagagccatctttggcatcatagtctctatcccccctttttgtttttgttttttaaagaagttttaattctcctagttatctaatgaccggtttgagatagaggccttcatatacattctgtgtcctccccaggacatagcctgtgggagtcggttgccttgataccaggtgtaggtcatgaatgtttctgactaacaagaacagaacatttgtttctagggtggcttttcagcccagtcatatatactatttagatttacaaaataaacagctaggacttctctgtttagtctttcttgccagtggctaacttcagcttaggaatttttcccttgataggagccaggtaacaatgtatgggctctaatatgttgaataaaagtgggcggaggaagctaatcagcagggccacgtgctgagtgctcgtcactcttcggcccctgagaaggtctgagactggggcctcccgcggccctaaccgggctctccccaagcggggaggtgagttcccagagagcagggctctacgtgtgggcaggctgggcaggagaagtcccgagtcggggcagatgcctccctcgccggagcttggaacagactcatggccagcagagcgaattttaaccatttatattttttaacatgaaacacagaacaataatcattcaaacaacaaaacaaaaacaaacatgaattgacggatatatggacaatttgttttggtgcaccaaaaagagacaataggcagacagggaatagaactctgtgtctcaaagggacacagatatcctaaccagagctaagaatatctccataggagccagagaggaagtaggacgtctcccattttccttctgttcccaggagagctctgaaatagcttattttcattttttctcttttttgctaaaagatcccaaacaggggataactgcttttctaaaacttattttctctctctcatgttcagactctacttccttatctccttcttctgggaatactgccagataatggagaggaggcacagtggccctgagagctatctttaagcctttaatgaaggctgcctctttagtcaaagtcctcgagaggagggtaaattgacttaatttatattatcctttgtatctttatattttatattatcctttgtatctttatattttatattatcctttatatctttat

SEQ ID NO: 33278 - DNA, 1099 bp, Mus musculus
tgccacttatgttacagctgctagttcacgaggacgatgacatttcctccaacatcactgggttttgttatgattatctccatatcctgaaacaggttccagtgctctcggatcagcaaaaagctaatgtagaggcaatcatgttggccgttatgaaaaaaaattgacttatgatgaagaatataactttgaaaattagggtgaagatgaagccatgtttgtagaatacagaaaacagctgaagttactgttagacagacttgctcaggtgtccccggagctcgtgctggcttctgttcgcagggtcttcagtgccacgctacagaactggcagaccacgcgcttcatggaggttgaagtagccgtgcggttgctgtacatgctggcggaagctctcccggtgtcccaccgcgctcacttctcaggtgacgtgtcaaaagtgagtgctttgcaggacatgatgcggacgttggtgacatcaggagtcagctcctaccagcacacgactgtgaccctggagttctttgaaactgttgttcgctatgagaagtttttcacagttgaacctcagcacattccgtgtgtactcatggctttcttagatcacagaggtctgtggcattccagtgctaaagcccggggcagaaccacctacctattttctagatttgtcaaatctctcaataaacaaatgaatccttacattgaggagattttgaatagaatacaagatttattagccctttctccaccggagaacggataccagttcttgctgagtagcgacaatcagctcatttacgaaacagccagggcgctgattgttaacagtgaataccccgcagaaaataagcaggccttaatgaaggacctcctgacaccactgatggagaggttcaaggttctgttggaaaagctgatgatggcacaggatgaagagagacaagcatctcttgcagacagtctcaaccacgcagtgggattcgccagtcgaaccagcaaggccttcagcagcaagcagactgtgaaacagtgcggctgctcccaggtctacctggactgcttacagaccttcctgccagccctcagctgccccttg

SEQ ID NO: 33279 - DNA, 1708 bp, Mus musculus
tgatacaaataaccaagaacttgtgtgaattttaccactcagaacccatcatagctctgtgtagcataatcacccttcaacaggcaggaagtgagccctacccatgccagctgaccgagccagtctattgcacaacaggcaggaagtaagccctacccatgccagctgaccaagcaagtctattgcacaacaggcaggaagtgagccctacccacgccagctgaccaagccagtctattgcacaacaggcaggaagtgagccctacccacgccagctgaccaagccagtctattgcacaacaggcaggaagtgagccctacccatgccagctgaccaagccagtctattgcacaacaggcaggaagtgagccctacccatgccagctgaccaagccagtctattgcacaacaggcaggaagtgagccctacccatgccagctgaccaagcaagtctattgcacagccgaaccccagaacaaaagttcagcacatcactgacctatcactcctttggatacaggtttattgtagatttggaaacgttttcacttttctattaattgtgcaatgaatagtctattttctcattgccactactcccctgtttcccggacagcactgttgtagatgtgcagaacttcagacaatgcagcaataagaatgtgcaagagtctacgtctctgctcacttctgctccagtatgctcttctggtttcaatgccacgctgtgagttgaagtgggtagaactgctctgagaggaactggactagttacattgcctagcaaagtctccttagaagagacctagcctggtgccgtgggtctcctgcatagaaagtgtgacctggccagatgagcatcccaccctgagtgttccccagatgaccagactgatttcctgaagagagcacatgtatcgtcaggtggattatctgttcttctctattgtactgctaattctttctggtagttctagggttaacgttggaaccatctcagaataactatggatttgaaaacgtgtttacagtgtcttttaaactatcatttaggaacagttgagtcagatgtcaagatgtttcgggataactgctgctttcctgaccacccgttgtgagaccttaagaccccgtacctctccttagtatgcaaaaatctggaaagactgtctattttttaatataggtagataggattgccatttatttcctatttagatatacagtcattcatccatatgaaaatatgcaggtcactagtttattttgaatggactatttacttttggtgtaacaaggcataaataaaactttgaaagcaaaaaaaaaaaaaaaaatggggctcagagctaaacaaagaattctcacctgaagaataccaaatggctgagaagcacctgaaaaaatgttcaacatccttaatcatcagagaaatgcaaatcaaaacaaccctgagattccatctcacaccagtcagaatggctaagataaaaaattcaggtgacagcagatgctggcgaggatgtggagaaagaggaacactcctccattgttggtgggagtgcaggcttgtacaaccactctggaaatcagtctggcggttcctcagaaaactggacatagtactactggaggatcccgcaatacctctcctgggcatatatccagaagatgtcccaaccagtaagaaggacacatgctccact

SEQ ID NO: 33280 - DNA, 1158 bp, Mus musculus
cctgagttcaaggggtgcgtgggccagttacctggagggtgttgctctcctaacatggacaagggccgaaagtggggaggccccaggacttgttaataagcaggaagcttcctcctcctagtcagcttccctttgggacaagggaggccctgctgggtggggcccaggaactacaggtctgaggaaggaggggcaacttggactggatattagcaccccaggacaggttctctggacacagtgatattgagcagccagtcccttgccactggggacagatggccaggctggacttttctgcctggtgcaggcatcatggcccctgcagcagaaaccaaagcccccagcccatcctgtctgcaggacataccacctggggtgtgagcagtcagggggaaccagctcagacctgggaagtctctccccactctctagggctatagaagctgcaaagaagaaaccctttccctagagcacccatcttcctctggggagtactaatatcacacgtgttggctggctgtaaaagagagaaccccgctacttgggagttctcagcctcggtccatttattcctgtggacttattccacttattctggctagagtttcccagtccgttccctccccttatctcctcagagtattcccatggtctctgcccagtcagagttgagaatggtgccaaagtccatcaatgctccccaggctcctttacccttcaccccaccccaacccgcatcttggacccctgggggctgaccccttctcagtgctcctagagcctcaagtagaatggtgcccacagcattccctgggtgcttcctgggtggggcctccagctccgtttccattcctggtggcctgctcttcaagtgttaaaaaagcctgggggctggagcagggtacccctgaggaggccctcttgtgtgctcctcatgtgcccctccacactgcccaccaccattttgcacactgcctgttcacactccatgtctccaaggcagaaaagatggaaaataaagtgtatttacacagtcctaagggatgccgaatagagagccaaagggctggggaatcacagccagaagttgccaaacctccatccgtgtgttctagaagttcaaagatggatccagtggctaggtggtgtgagaaa

SEQ ID NO: 33281 - DNA, 1133 bp, Mus musculus
ggggaaaggcagcctcctgtaggtgaaaattctgttcactacctggccacctggcctgactgaccttcacagcttgatcatcttcctgaagaggcattcaggattccctccatccctaccccttctggacaaagtcttccacgtttccttcctgggagtttcttccaggaactggagatacccagaggtggggatgcatttcactgattctgcctgggaccagaggttgggcccctgctggattccagggccatccctccacggccctgtggatgagacagggttgggaatagggttctaggtgccataagagctgcctgtccctagagcagagtaagacctggtaaggctagtggctggcaggccccaaggagtcccctgcaggtgtctgtctctgtcagctccacaccttcctgccatcatcccatctctgttggtttctacccatctctgcagtttggtgccttgtgcctccccctcctcttcattatgatttgatttcttttctgttggacaaatcggttgtttctgttgtgatttattgtggtgtttttttttttctcttttcttcctttccccatccagttattgtgatcactctaagccctgctcctgccccgtcccagcgagcaggtaccagcctttttatcattgctgcttgcatatctgcacattgacctaaccgctgccccagctgcagaatgccatccctaccctatgctgtatgtgggtgtgtgggtgtatttgtgtgtgtgtataacttagggagagagagaaggaaagagagttctgtgtcttcattttcactctcccttaactacagaaatgtgagcctggctatactttctctgtgtccattagtcttctcatttcttctctggctcaatctggaatcctagaagatgaaatgagctcccttaatgagcaggagtctgctaagtgggcacacaatgatgtgtgtgtgtgtataaataaagtaggtagagataggtgcactgctcttatttaatctgtctcaactatgaagtgaatgagtgtcattatttgtgtactgtgtctcctttcagaaccaggaacctagcagtaagtaaaacagatcaagctcctatcctgtggggctgaggatgcaggat

SEQ ID NO: 33282 - DNA, 2587 bp, Mus musculus
cccccccccaacctggccaacccagctgcccatcaggggacctgggacctggacgactgccaaggactgaggacagaaagtagggggttcccatccagctctgactccctgcctaccagctgtggacaaaagggcatgctggttcctaatccctcccactctggggtcagccagcagtgtgagccccatcccaccccgacagacactgtgaacggaagacagcaggccatgagcagactcgctatttattcaatcataacctctgggctggggtaacccccaggggcagagagaaagccccttgtccccatccccccaaactcccagtgtctgtcccctccaccttctctcgcacacatgcttgctctacgtctttccttctgtcccctccctctctaccactgtccctttctggttcccctgtctccctcccagcctctgaagcctgggtgccgccactctaccctcagtggaaggaagccccaggttcatctaggcttccttaagtctttgtcctaggatggctttgtgggcattgtgactgcagccaaatggttgctgtctctgtgtctgtctgtctctctttgatctcagggggtccttttggagtttattgtattttattgtacttggtgggggtgtgttggggggggggtgtcctcatggggtcggtaccttcagaaaattttaccaaagtaatgtttagctgcttgtggtggccccctctcctccattgcctcaggcattgggggttggactgcttgctgctccttgtcatttctggcctaggagaggccaggctccatgggggaccctcacatgggactgggagctgctgacagtttggggttgagtagaagagctcaggtggcacagagggagaccaggggcctcagccacacgatggccttcagggaaggtgtatgagggatgcagtagagagtagcaggtagcagggagggactgttgggaacagtgacaggagggaatcctgccaaggggcaggaggggtcccgagaagtcagggattaggagtgaagggagtagatgtggaggtccgagcatgtgaatcagggacgagacggacaggcgtgaatgcaggggaggccagagtattgggatgcgacgcgacttactcccaacatgcccctgagcatgctttagctcacctagagctgaccagctccaacccaacctgtggcctggactgggccaggtgcctgtcccattgtcctgcagtttcgaggacagagtggggtatgtttcctttttgttggtgatgcatgcagttcaagtggacaagagaacaatataacaaaacaaaaaaatttacaaccacaaatcccagcaccaaagttgagaaaccttgctggaagtagctgatgcaaccatacgtaggcttaggtgacactgtggctcttaactgtcctgttgacgcctcttcatcctattctcacaatgccgcatgcttaaatcgtaatagaagtcatcttctatgcccgggtagggtagggcaccctctctccttatctcctgtgttggggaggcggaatgaagtagggagagagtagcaagcccggccccacccttaccattctgaggctggccgcagcatggctagcctttgtgtgtacttaggtcacatggctggtcccagggccagcacaggcccaagactgggcctgatggttttatttttatttaactttattttctgtgtgttgtctgtctgtctgtctgtctgtgttgtctttgtctactgccctctaatgttaagtgggagtctggaggagtctcccacttccccaccttctcccaagtccttccctctgtcaccagccatccctcaggcccaggcagagtgggtctcgggcaggtagggacctggagtggcctggtcccaccctctgacctcctcctcaggccaccagtgttgccctcttccctttttaaaacaaaatacccttgtttgtaaatccttagacgcttgagaataaaacccttcccttttcttccgagtctggtgtcctaagcctggtagagtgtacagagatatgggaagggcctgggaggagggcttttagtgtggttagggatgacattcatgggaaactagccgggccgggagctgggtgggaggtgtttggagtgaccgaaggcatcaggcagctttgtgaggggccccccttgtagaaatttcagtacatcaagaaagcccttatccatggctggccttgagcatgtgctcagatgtcagcccctccatcctccgcccccgctccctgcttcccagggtggcagcctcaccaaggccagggctacctacccacacctagagggctgggtacagcccagccaggtgctcgctgccggtctggagcactcgaacctggacaggccgccatggtgggcactgcgctcctgctcctggccctgctccctgggacctccagtaagcacggtacaccacgtggtacgtagaggctgccacggggtgggggcattgtgtcccacttgcccattgtcccttctcaactgcgttttgcacctggatgtgtgtggtggtgtggggagggggaggggtgcc

SEQ ID NO: 33283 - DNA, 2587 bp, Mus musculus; identical to SEQ ID NO: 33282

SEQ ID NO: 33284 - DNA, 1143 bp, Mus musculus
ggtaagcccattcccttggcaagtccaagggtgtttattaatagggtaccaggatgccctatacatcaataacccaggggtagagagccactgggtttagtcaggcagtggtattgtatataatctccaaatttgaaggagtagagaattgccaggcccctcctaacactacccaaaaagaaaagaaagaaatgtagatctggtacaaagtcagtaactccagccaggcactgacacttgagccatagtgtctatggccatctcttgtgtggatcaccttcagagcgtgcagaggcagagggtccattctaggtctagcagtggaagatgaaagacttcctcccgtcctgccctgacggctcttccccattaggtgctcaccattgctgctgcagaacccctcagcctcctgcactccaggccaggcaagcccacaaaggcccgtggaaaggcactggtgttcttgagcaaccaagatgggcagaaggatcctgcatctgaaggttctgggcctgtccccatgactgctgctgaccctactcgtgaggcttctgtctctgaccctaaggcctctggagccaaccctgagacctctggccttgcctcagaggtcactgtccctgaccctgatgccccaaccaagtccctggctggatcctccacagagagagaccttgctgtggactttgagaagatctacaaatacctttccttctcctccagaggtggccatggccctgagctctcagcagctggtaagagctactagggaggagagggctatactgtgtttgtgttgcgagggggttgtctgggggatgttaaaacctgtcctctcattcttctcctttccttctaccagagtcagctgtggtccttaacctgctcatggcacttccagaggaactgtcccacctgccttgcacggccctgctggaacatatgaccaaaacatatgctcaactgatggctccccagaccgctctccctggagagaagaggcccaggcctgggactgaagatggagggactggctccacagggccagaggagcctgaccaagctagtcctcaagcttctgagcccatagagccgaggctggcctggaaagcagttgggatctgcccactgaacccgttcctg

SEQ ID NO: 33285 - DNA, 1180 bp, Mus musculus
agctcattggaaaaaaatcactcctctaaagtcggggagggtggtaccatacctttagcacggcaaagtgtcagactataggacaagtacagagtgcaactttggggcgtttcatctccagggttgtgagcattgggtggaggtgtacagttctgaggcctgtacttgtgtgtttcctgcagctggccatgggcaagatgatggagcagggcccagtgctgatcgttacctttcaggcccaggtggtgatggtgatcaagaactccaaaggcgaggtgtatgatggtgacccggtgagtggtaatcaagggaatggaggtttgggagtgcttctcacatacagggccctgtgcattgcacgcctccccagcacagagccaggcagaagcaccacaagtacgaattgagagctttttgaagtcagagcaccgtttcatctgaccactgaccagagccagcagcccgggaaccccttccctgtccccctcagtagcccttctttctgtacacccaccaagcctgacccctcaccctgcccggtcttcacaggacaaggtgcagcgaatgctgtacgtgtgggcactctgcagagaccaggaggagctcaacccttatgctgcctggcgccttctggacatctcagcctccagcacagagcagatcctctgagggcagcaatggagtctaggcagctcgaggctagaccatcatgggacagacacacagagacactttgccacatctgatacagctgtgaacaagcttctgccccaagttcttcagggcagctgtgaaaccagctggacaagggaagagcttggggtgtctagcaggatggggactgtctcccagtgcgtccgtcacaggggttgctggcagtgtcagaaggccccagcccaggactcctgtcgggtgaggcctggcctgctgttctaagtagtccactggcattgccttccaagccactttaggtccttttgttttgttttgtttttgtttttaaatcagtgctcttacttcctgtacataagcctaagatctggacctaataaaacaccaaagcgcagaagagcagtttgaacggtttgaagtgtacctctctgctgggaaggctgggactgagggcctgtcagagacctaggtcagtgaaggattgtagccagagagagtgctgctttct

SEQ ID NO: 33286 - DNA, 1098 bp, Mus musculus
aaggctcatatgcccagatctgaccaaaaaaggagaggggtcctctgctttgagggtgcagagtgcacctccccgtgggaccaaaatgttgtgataaaatacgcatttctagtttcttagccagcattcttctgagtggaggtgggattctcctcagtcgtgtagcctttgtattccacacctgaaagagactgtgtctttaaaggacctggtgctcagagctagcaccttaatcactataccatccctaccacccaacacctgtttactccatagtaactctgagaggaactgggggaaatgtcaccagcttctggaggtcacttcaagttcgacattttctttctgtgtggtctccactgtctgggtagcactctagataaaagtcccagtgcattccttgatgagctttctttgtcagtgtctagaagaaagtagctttgaaaaggcattcctgaaagcagttttcattctatgaaaggactaggtcctggccctggacgcgttcatgacagctagtcaggctgggcagaaatacagaacccagacgtgtgtgtagctcagagattaaagcacttgcccagcatgagggcagccctgagctctgtccccagcattggaggaaaagtcacaacccaagagaaaggggttttttttgttttgttttttaaggagaaattcatcctgtttttattgagcaagttaaggccatttcttttgttgggaaatctgatggaaaaaaatacagagagtaggtaatgttcattcatcagaaatatggtttgaccaataccaaagaggctttgactgagttctcttgacctcctctggtagtgggttatttcttgagccacctccaggttcttccgcctacttctggttgggttgcctgtttctttcttgagtgattctctcccccaattgaaacttctaggtaatgtgccaagccatcctggctgtgcctctggtcacagaagtgtgactatatctccctcctccccatactctgatcagctaccatcttccttgactacctgagaaccaaacttcccttggagggtgggatgtgatgccactatattgaatgggttctgtctc

SEQ ID NO: 33287 - DNA, 1966 bp, Mus musculus
gggtgtagatcacatgagtgggatttctggtgtcaatgtccccggcaatgcttcctcgggctggtgcatcttcatctacaaccttgggcaagacgccgatgaggggatcctctggcagatgtttggcccctttggtgcagttaccaatgtgaaagtgattcgtgatttcaacaccaacaagtgcaaagggtttggttttgtgaccatgacaaactatgaagaagctgcaatggccatagcaagtctgaacggctaccgcctgggggacaaaattttacaggtttccttcaaaaccaacaagtcccacaaataactcgctcatgctttttttttctttccttcttttttttttccttttcttttttctttttttgtacggaatagataattaagagtgaagaagttgaaacttttttgttagtgtacaactcattttgcgccaattttcacaagtgtttgtcttagtctaaatgagaagtgcaaaggtttttatactctgggatgcaaccgacatgttcaaatgcttgaaatcccacaaatgttagaccaattttaagtttcttaagttatttcctttaaagtatatattaaagtgaaaccgaagtagactgcgctgactaaccagtcactctggacggtggtgggactgaagcatgcttttacttctaagactgtctaacacctgtttcatctgatgtctccacagactggatttaaaacaaaacaaaaaaaatttttttttaatttctttgttttagtttttaacctaaagatgttagacagatggggagtgtgttttttctcaactgcttcactattttaaacaatttctgctttaggtgacaggaaatttgccctccccagcagtcccactgctgccccctgcccactcagtcccagctctatagtgttgggagcagcagcagggcccatattctggggctcccacaaggggagatgggaagaggttccacatgttgggctgagccaggccctccagagacacaaaaggtgttttgtaagcccaggcaccaatgagaacggaccaaagagtttcagggcagctccagtatattccagagtcaaacctgagctccaggcatgcctgaagatgccccactcctctgacatcctgagcgtctgtccacacattgcatgcatggtgcccacacatcagatactgttgttcatgcaacttcccgagtttccaagaccatttaacctagcttgaatgcacaacgattgctctgtttttaatgacacagaaacatttgagcattgtattttctcgcatcccttcttgtgagcactagactttttccaatcttagtcagattttgctttgaaattttgcttttgtatggacactcagcagaaaagtacttcttgccagttatctattaacaaaatcctttgatttgtagttttaaggattaaccctcaaagttctcttcataactgccttgacgtttggggttctgttctgttaattttcttttgcttttttgtgttttttgtttgtttttacttttgcatttaagaccattaaatttgattttgttttgctcgagttttgttttgttttttgttttaccttttctttcttttttggctagggaagggcacagacagcccagcattcagggaggagtctgtcagaccttaaacacttgcctcaagtttaaaaaacatttctggagctatggtataagaaatacagctatggatcaatggttcttaactcaggagctggtaggaaaggtcaaagggaagggaagagcacatgaggcctgacccctacagccctcaggactgttctgatgtttattagtatgtggagagaatgagaacaggctagtgcagttactggcagctcttcactttgatgtaagcctggagtgtataacagcaggctagtatttagttcttgatatcatggtatgatagcattatttacacatatctg

SEQ ID NO: 33288 - DNA, 1128 bp, Mus musculus
gctatttacttggtcatatttatagctgagtgttagatgctgcttaaaggtcctaacccaaaaaagaactgctttcctcggttccattgtctccatattgaaaatgatgtcagttgccagactcggatagagcaaaaacaggatcactaacataggtggccaggaccaggatattactgccttgggggcaatggaaatccaaatttaggtgccgttttccttggtttttgtcaggatggtaagggcttgccttaggtgggtaatgatttcttcagatttcccatctttgttttaagcagcagatactgccatttccacataagctgcctttgagaaggttattttcacaatgtagccttgtagagttctcagcctggctctgcttccaaagctgacctgcctcagcctcctcttctgaagacaggctggggagccatgtggaaagaatctgtcattccagaagtctgaagatgttggaacactcccaactaagtaggcagacagttttatgagggaactgctcaggaacaagaccaggggatgctagagggaaagagcagggtttgtgctgcagtcatgtagaacgggaataaaggaaaccaggagaagaatgacagaggcctgagggaaatagtagtgagggagggaaagaaggttaatttaataagtaaggagttaggggaaggtggcagagataagtaaggaaaggaagacaggctcagatgggcagagaacaggtagtctggttccccgctgctcccagaaagacacctaagtcaggacaagtcttcctccatcagagatgttgaagagtatcttaagaaatgagaatggaaggctggagagctggctcagtgtttacgagcgctggccactcttccagaggaccagagcaaccacatggtggctcacaaccatcagtaatgggatctggtgccctcttctggtgtgtctgaagacagctacagtgtactcacatacataaaataaataactaaataaaaaagaagaagaaatgagaatggggaaggtggtaacctgagtcacagaactcggctctcggtttcaagaagtcctgtccacagtaacagttcctatgaataaagagtctcttgctaggctagagat

SEQ ID NO: 33289 - DNA, 1183 bp, Mus musculus
aggaatatgtcacagcaggcagccagagtaggaaattgcaaaatcatatctctctccacattcaggaagttcagagagcaaactggatgtagcacaaaaactctcaaagcccaccccagtggctttacttcttaaaagtttcacaagctacccaaagagtgctgtcagtaaggctcagaacaagatcagtgtgggatacactggctgtggtgaagtgtatggtggtgtctaccatatatactccagaacttattttttgagacagggtctttcactgaacctgaagcttattcagcgaggctgactcgccaaagagttccatggctccccatatcatgttcccaactccccgtgctatgtattatatgtatgtgctaactcatccaacttttattatgggtgctatggatatgaactcaaatctccatgtttgtgccagcaagctctttacgaactgaatcatctccccggtagttgatcttttagtgcagaaaagaaaatcccttaactgcaaaatgtagtcatttatctctgccttcacatacccagatgaatatctagaatttacctgatcttacttttctttgcagatttttaaataatacaatgtctaatggttatgaagaccacatggcggaagactgcagggatgacattgggagaacgaatttaattgtcaactacctccctcagaacatgacccaagaggaactacgaagtctgttcagcagcattggcgaggttgaatctgcaaagcttattcgggataaagtagcaggtaaagagcctgagaggtttcttgaaggagtcatggttggctatgctgtgactcattggcttccttgctggtaactccttagtacagaataggctgcaggctagaaaccatagctataaatgaagttttgttctttaacctcagactacttttcttcagccccagtataagactggacagagatggggtgggggttgggggatatcctagagagccgtttcagcagttaagagtacttgctactcttgcagaggagcagagtttggtcctcacacccacagcagacagcttactgcatatgtaactgcagcttagggaagctgatgctctggcccacgagcacgtgcacatagcaccaccactacacgcacacaaatccataattaacaataaaatacatcttga

SEQ ID NO: 33290 - DNA, 1138 bp, Mus musculus
ttttgttatctggtgaagcgggttaaaggatgtggtcagcatggtcagcctctgggaatctaaagttaaaatttcttggttttaagatttttcttagtgtgtatgcatgggtgttcagcctgcatgtatgttaaccctgtgcaccatatgcgtgtagtgcagatgggagtcagagagaaggtcggatcctccgggggactattgttaactgcgtttgggagccgactactgaacccatgtcttctgtaaaagcagccagtgatcttaattgctgagccatctttccagccccacttccttcgaaatttaaaatgcctactatgtgccaggcagtcgggcagtgaccagaaaaacaactgcctgtgccttttggaggctgctgttctggactagtgctatcagaaacgtatatgccaccctgtttgattgaaaacttctctattgtctctacctctgtccaccgttttttagcgtgtttgttttcttttagtcgggatcttcctaagtagtcctggcttggaacttataaatcacgctgaccattgcctcatagagatctgcctgcctctgtttcctgattgctggggtttagggtgatgtttcatatgatccaggttggccttaaactttctgtgtaacgaaggatgtcagtgaaatgatccttttgctttcatctcccaagttctaggattacaggcctgcaacacagccgctgcgtgtaggtaaccttttaaaagtagttctacaggatttgaaaaaaagttatattcaaaatttttatattatgtatgtatttgtttgtatgtatgtacgtgtttttaaaggatggtgtttgtgtatatgtgtataatatgtatatattataatatgcatgtgtttgtgtgaccatctatgtgagagtcaaagggttacttggaggcgtcagttcttccgtcataagagatatgggggttgaactcaggtttacactcagcaaccaatgtctgttcagctgagtcatctttatagcctgcgatgtcctttgtaaaaaaaaaaatatttattcacttaacatcccaattgctgcccccactcctggtccccttctccttctcctctgagagggtggagcccctcaccttggcatatcaagtctcta

SEQ ID NO: 33291 - DNA, 1157 bp, Mus musculus
ttatagtttattccagatgtagaaccaagaatagttatcatagcaaccattttctggcctccacaaattgtacatgcatacacagaaacatgcacatacataatttttaaaaataataattaaaataaaaacaatgggaagagccagtccactgtgggtggtaccaatcactaggcagaggtcctgaggaaattgaaccatgctcaagtagtcaagtatgcatgcattttttactttgtgtacttcattgtagatatggcaatcagctgtatgaagtttctgctttcacttcacaatgatcaactatagtacattttctgcttttattttaactgaatactacttcattttgttgttcaaacggttctgattttggccattagaatttctttctgttgattgttatggtccttgattattatcaccaaacatgtcaaggttcctggacacttctaactctagcattgcaagatcctgcaggattgtattatatacttcttacctcagtcctgaaataaaccatttctccaagaagtcttggatgtttgtgtaagagaatgatgatgtcaccaattaagatgaaggttaatgggatggtttagtgtgcggaggacttactgcccaagtctgatgacctgaattaggttcctgggagccacatggagttggaaggagagaattgacctcccaaacttgccttctgacatctacaggtatcccatgttatgtgtgactgcctgccctcgcagaccagatattatatgtgcacatatatatgcacaatatttttccccttttatacagaggctcactatataatcctggccggcctagaaattgttatatagaacaggttggactagaactatcaaaaatctacacgcctctgcctttctgtgtgctgggattaaatgtgtacattaccacgctcaatcacatttttttttttaagtttttctttctttctttctttctttctttctttctttctttctttctttctttctttattatatgtaagtacattgtagctgtcttcagacactccagaagagggagtcagatctcgttacagatggttgtgagccaccatgtggttgctgggatttgaactctggaccttcggaagagcagtcgggtgctcttacccactgagc

SEQ ID NO: 33292 - DNA, 1175 bp, Mus musculus
catacatacatacatacatatatgaaggaaaaaaagggggagggtacgcctattctggaagattattcttcataaggaattcaggtagtgagtaaagagaatggtgaagacactgaagaggtgatggtcacctgttctgaagaatcacagagaagaagctggagaagttacatcatgattctaaggacagggtaagactaagctttacattcatttgtttgttttttaggtgagcagtgggtggtggtatcacatgcttttaatcttagcagttaggagtcagaggcagacagatctctgagtctgaggctagcctggtctacagagctactttcaggataactaggactacgcaaggaaactgtcttaaaagggtgtatatgtgtgtagttgtctgaggccagaagagggtaaataagtactggagctggggttataagtggttgggaggcacctaatgtgggtgctgggcttgtgcaagaacatcacgccctcttaagctatctcatcaaacccaggtcctacgtttttgtaaatcatgtggttgccctagcaacaggaaacatgcccacatgtgttttctgtcaactcctttgaagcaagctgtggacatgtgtttattagttctctgttacggacagagcgcctgagatgagcaccttaggttagggaaggtttaccttggcttctgggcttcagtctgtggtcccttggctcccttgcttctggcctctgatgggagagcggaagatggtggtgggaaacatccagtggaacacagctgcccatctcatggcagctaggagtgggagaggctgaggacaggagagcaggtaccacatatccacccctagtgacctgcttcctccaacaaggtcctccctcctatcagccctgtcagtttgtaatggctcattcagatgtgaacctatcaatggataggttatcaatggataggaacttgaggagccactgatgaagtcagagtctccacagtccatcttgcccagtccatctctcaacattactgcatagggaaactttgaagatagggactttggggggactgtggagatggctcagtttgaaaagtgcatcctatacaagcatgacactgcttggattaccagtatccattaaataaaaaaataaaataaaataaaaagtgaaaaaaa

SEQ ID NO: 33293 - DNA, 1243 bp, Mus musculus
ctcttttcctgaaagttgatcatttgtgggtctctgggataactgccatctactacaaaaggaagcttctctgatgagggtataacctatgagctatacataaaaatggagtggagagtttattactatgtccttttattaggtattagactctagcttagaccttatgactcgtgtgtgtgtgtgtgtgtgtgtgtgtgtgtgtgtgtgttgtagttctcaggtacatgtgtgcacctacatgcatgtgccacatgtgtatagatgtcagaggataatttgtgattcgctcctactatgtggttcctggggattgaatttaggaggcaagcacctttacccactgagtcatctcacttgctctgtaggtgcctttgaagactgctgcctgggttaccagcacaggatcaaatggaatgttctccggcatgctaggaattatcaccagcaggaagtgagtggaagctgcaacctacgtgctgtgaggtgagcaggacctccctttgctgggagggcatcatgcttgccttagatcctcatgtcctaacttggcactcatcttcccaccttctgtagattctacttccgccagaaagtagtgtgtgggaatccagaggacatgaatgtgaagagggcgatgagaatcttgacagctaggaaaaggctagtccactggaagagcgcctcaggtgggtaaggcctcaggccaacatctcagggagaaaaacagcgattatatatttcctatgctttttactttttctcccttttagcattgtgcattgagtccttcagcattctgggtaagtgttctacaactaagatacatctctaggccttccattttgtctttggtgtgtgtgtgctacatgcaaatgagtttgcaacagttgtgtttatgacggttgttttattcagggtttctttttctttctcttctttttcttttttttttttttttttttttttttttttgcgagacagggtttctctgtgtagccctggctgtactggaactcactctgtagaccaggctggcctcaaactcagaaatccgcttgcctctgcctcccaagtgctgggattaaggggtgagccaccactgcctggccccagaattctttagtctaaggctaaggcctcctggggtccaactgctcccatctacattagcatgtctattgttgcaaactccctgggcccctgactcttaacatatttttgctccctcttccacaatgtt

SEQ ID NO: 33294 - DNA, 1168 bp, Mus musculus
aaacacttaaaagtttttgtttttttaaatcttcacacctatatgtatgggtgctctgcttgcatttgtgtctgtgcaccatgtatgtgcagtgccgggggagggcaccggatccactagaactagactgtcagaacaggaggtgccatgtgagtgcggggaattgaacttgggtcctctgcaacagcagtcactggtcttaatgactgaaccttctaaagcacttcactaaaaaaaaaacttgaaactcaatatattgtggtactaaacaaccttttccatttcattttatgttttacattctgttattttgtgtgtacttgtgtgtctgtgtgggtaaacatgtgtcacagagcacatgctgaggtcacagtacaacttgagggggctagtgctccctttccatcatgcgagtctcagcaattgcactcaggtcatcacatctagcagcacaccctttacttgttgagccatcttgcccttctgttttaatttttgttttgaagcaaagtttgatatagcatggactgtcctcaaactccaaaccaatggtgctcttcaacttctgacccatctgcctccacctcccaaatgtagggattgcagttatgcactacaactcctatgaagtgttgggtctgggaaccagagcctcatgcatgctgggtaatcactctaccaatcgagccatagcctggtcctttataggccaagctgctgacctagaacttgcatttttcctcctatgctttccaagggctatgactacagatgtgtgccacacccagctcctagcattgacacttaaaacaatttttacaagcgtatgtgtgcatgtgtacacacatgtgacactgcaactacaacttgcagtaagtagttggctctctcctccacctagaggaaggttggggacaagcgctcccacttaccgaggtcctgggtaaagtactcaacaagctgcctcattgagaattgaattgggagggggtgatcagggttcaagtgtggagggcagaaacatggcaacctctgagggggtggggcaaggcagagtcttagacttagggccttccttgagatctttgtgagatgtattctggaccttcagtctgtctggtcatcagcacttgctggttgccctggggggagccagggtcacttggaa

SEQ ID NO: 33295 - DNA, 1121 bp, Mus musculus
atgatgaggccctgcccttcttgcctgcttggattatgaatctcctcccctcctacctgcctgtgtgatgaagcttggcctttcatagcctgccttggtgctgagggcccagtgtttctagtattcttggtacctgagactctcacagcctttctgaggtgtaaggcctcattcctctttagtgtcccaggcagataagttgagtccttgtaacttcccataactcctttggctatgatgcctagtctctcctggtctcctgggacttgaatgtttacctcaactccctggtccatgaagccccaccttttggggcctccgtgggccatgagaccccattcttctctgactcttgggtgtgaggacactgaactcccaactctatttttgattcttctttggaagaaagaggggtcaaaagggaggaaaataagaccaggagctgccctagacctctgctcttgattacctccaggattggggagttcatgctttgctcacttattcaggtgtccaggttttgggcaacctggagtctccattcaagtccctttcaggtagaaccctccacatttcacagctaatcttcccttaccctgctgtagaccctgaatttgtccctgtactggtggtacctcctggagctgggcttctacctttcactgctgatcactttgccctttgatgtcaaacgcaaggtaagttatgagccaagagtccagctggagatgtggataccatgatggggatactttccaatttctgggccgggcctgaagtgggaagaattggcctcagcactgtaccctgggggtgctcttgattcctcacagaaggtctgggatccagaggccttatggatcttctgaaaaggcttgcttccaggcatgtggccatccagccacagaggcttgtcctggtggtgaccctctgtcttctgcaggacttcaaggagcaggtggtgcaccattttgtggccgtgggactgataggcttctcctacagcgtcaacttgctccgcattggcgctgtggtactgttgttgcatgactgctccgactacctgctggaggtgggttcacctctacacttgccctgccagccctgctattttcttgggc

SEQ ID NO: 33296 - DNA, 1616 bp, Mus musculus
atgtgtactggttctgcctcatcctgcgcatgctctacagtttcctgcataagggtcaggtatggaggcctgggacagggtcagcccccgggacccttccttggcccagagctcctcactgttctgagctctggccccatctgttttcatagatgacagaggacattcgtagcgatgtggaagaaccagactccagtgatgacgagccagtttctgaaggtccacagctgaagaatgggatggctcgagggtctagagtagctgttaccaatggcccgcggagccgggcagcagcatgcctgaccaatgggcacacccgggccacatagacaaccttggactgatgttgaggggttgccgccagcattgtgaatattcagatgctgggctggtgattctgggagacagggaggccctacctcaaggtaggaagaagactgatgatctgtttcccttctgttcctctccctttatccttttgagcagcttgacagaacctgggggagcagtggactctgcatctggcctgagccaaccccaggctgtagcttgggggctgtggggagctttggctccaaggaccaataaaacgtcaacagcgatgaattctctgcgccagagcttaagttcccttcacagcagttcctctccataacgtactctgttgacaggattcctcactgccacatcaagatttatgtcaactcttgcctgtatagcaccacagcatgaagatactccctgctcctcagtcagtgccttcactttgttctacttcatagtagctctccaggacgttggtggtagcagatacaggctgacctgtaggaaagaaattcttaagcttagatgaagcctctctgctgctgtccaagccagagggtagagcagaaacctgtgggtgtccttgtagtcccttgcttaaagcaacctgcagcccaccctggggtctttatattcccttgagacagtggagacctaagatttggtgtgcggtcactacctttaggagtggtataggaaaacatcctcctccaagatggaggctgagtgaccagtattacttaacgcagaaaccaaagccagaggatccatgtatggttagaccttgccatctttgggagtatgcaagaggaactgagtgtcatggaagaatgagaatcagagagtggggaaagaggtcatctcaggcaacatccaaaaataaagacttttggtacaaagagcagagcctggcatggtgactcatgactgtcatttaacactagggaggaagaagccaatagacaggaagaacatataagcctgggatacaaagcagggcccagtttcaaaacaaacaatgggggtgtgtgcatgtgtgtcaaggaacaggtactgcagaagagaaaactatacaaaaatccgagatagaaacagctgagaaaaggaaggaaaaatgctggggcaagaatgagggccaactctgcgtacagaacaaggtagtgagatgagatagatttttgccttctggagaaatatgagaaaaaggaagagaactgtggcttctgttgagagaacaacagtttaggagaaacagagggtgcattggtagagaatgcatagagacttgtgaa

SEQ ID NO: 33297 - DNA, 1099 bp, Mus musculus
ttttctgttgctgtaataaaacataatgcctagggcaacttataaaaaatgtttaatttgacttatggttccatggggctatgggatcaccatgaacgtggcagtgcaacaagtgtcacacatgacagctaaaagaggagacttatacctcacatcctcaatatgcagcaagaattagtcagacctagaaatagtgtgcagatctaaactctcaagccaactgcaagtgatgtatttctttcagcaaggcagcatttcttaattctttccaagaaaatatcaactgagcaatattgatttctctaacttcatgcctatgtgcttccgttctgttaccattcatgatgaagaaaaactgtaggtaaccttctaggttccttaacatccgagttaaaggagtgaatgcttacataagaaaaacatccatgagtaaaaattatttgtttataattttcattttaattatgtggtggggtgtgtgtgtgtgtgtgtgtgtgtgtattccctggggtcttgtagcaagaattatggggatttgtcaaaaacatgacctgatcctcggaatgaacttgtcttaactgcttggccatcactttaaccctgtaaatattttaaagactatataaatcattgtgatgctaggaaataagaaagaactcatacaagagaaataccatacttttcaagtaagggtgtctgtgaaagggtggtgggtggttgttcattttgtttttcatattttcacaaagtcctttgaggtgatatttgtcatcaagcctggcttggatgccagtaattagtcaaggctatatttgaactcttgactctcgtgtaccagcattctgggtacaagtccaagagtagtagatgtacccccccccccaaagtgtcctgttgtgtcaactcttttttaacaatgttaggattgaaatgcttaatagaagcgaatataagaaacagtaaagcctcatgtgtgttaccaaagtggcgttttcatctatgtgttaagagatgtagcatagtgagcaatcaactgtatgtctcacaatgtagttggatgtgctgtggctatgtatgttacttgatgttccatgcttca

SEQ ID NO: 33298 - DNA, 1187 bp, Mus musculus
gccaatcccaaatgttcagccttgaaaccatacacacacaaccaacagaaatggactcaaaaggttttcttgctatatttgtgcatacttattcatacataaagaagaaattggaaaggaagaatttaggaaaagacaagcaagtggtaaatgatgtaatacattttaatatttatgttaaatagaaagcatacagacagcatagcacttaagagaactggatgtagttacaaaggacagtttctagtctcagaaaccacctggtggttaaccttctgtaactctagtccggagggatctaatgccccctcctgcccactgctagtactgcaaacacacatgtagacaaaaacccatagacgtaaaataaaaatgaatcttaaactaaattctctacagtgatgctataaccctgatacagacagcagtcaggactatttaaaatgaactcctttcagtcctgcatagaagcgcctatgaccttcctctgcgtctgccttctcagaggcaaaggcatcctccttactcacacgttagaatacttcatatatcgttcatctaagatgtacaatcacagtactgtgagatcactttgccgtggtgttttctgtccttgtgttctctgtcctttgtatgtgtgagaattttggcagtgacacatcttttatatctctcttttaatcatatattgtgatctagaattcattttctctataaatctccatctttccaagtggctagacatgcagactttttttttttttcaaagatttatttattattatatgtaagtacactgtagctgtcttcagacacaccagaagagggagtcagttcttgttacggatggttgtgagccaccatgtggttgctgggatttgaactctggacctttggaagagcagtcgggtgctcttacccactgagccatctcgccagccccgacatgcagacttttgtctcaatctaaattgtccaaggtatagccttgggcctgaatctaatgagacttaaggatgacagtatatgcgaaattcaaaacctgttctaggctcccttttctttgagcattagccagagctgagctgagtgcatgctatcattaaaaaggtttttttttaattaatctcttatgtggagtaatttctccctgagaagggatattaattctagaatagctatttctc

SEQ ID NO: 33299 - DNA, 1161 bp, Mus musculus
agattattcggcgggaatcgggtcccctcccccttccttcataactagtgtcgcaacaataaaatttgagccttgatcagagtaactgtcttggctacattcttttctctcgccacctagcccctcttctcttccaggtttccaaaatgcctttccaggctagaacccaggtggtggtctgctggccggacacaacaattggcgaaccaacgtgggactgagaaacggcaaaggatttttggaagagacgctgctggttcggagctccataaaataaaggataagggaaattcataccggagaaggtatgggctaagctgagacagcgttaaacccgagcgctggttcacttaggttcagcagtgaggagctgggtatcaggcggtaggccgtagctctccgaagctacatgaggcgtgagaaaagaaagggtttattaaaaggaataggcggattgccccagttaataaaaaatgcatcataagggaggaaagtgtccccaaaagcagagagaaatttctctctgggccttatagcaggagtactctgttcccttttgtgtcttgtctaatgtccggtgcaccagtctgttctcgtgttcaattcatgtatgttcgtgtccagtctgtatgaatgaatgttctatgttttgtgttggataataaagatggtataaaaaactttatctgcaaagccgagagctgccacgtgtttcagccaggaatcagacacgtggcgagagggtccctgctggaaaaactgttcgttttaggaaataagggcgagtgcacagcctctaagtttcggagtaaaaaagctaataaatggttcatgattaatgtgtttgacaatggtaaagtgttttttatttttatggttgtagctacaaaaattattattctctgattggtctaaatgtaactgcttcatttggttcttttttattgataatgtgctctgagtgttttcacaatcagctcataagttgttggttaagattaataattgttacattgctacagatggttagtgttaaatttgataactcaagtttagagtccttccgacacatggcataaggcagcccaagaggctgggtctctaaagatatttctagtttaggtaataattaatgtggttcgtatcctaaatagtaaaatt

SEQ ID NO: 33300 - DNA, 1191 bp, Mus musculus
caaatgctggacaaaagtagtagattatccaggtgagaagaaaggaacacatttaggatgtgttacaaatagacatcagaagagtaaagagggaagttgcctatgatattgaagcatcaactttcgcaacaatttatgtgtaaaaataattaaagaatgagagatcataaagttgagacagagttgggaggctatgggatgcattggagggagaaagtgtgggataaaaatgatgcctttgtagtactcacatataaaaatttccaaaaatatcaataaataaatattaaaaataactattgaaatgaagagctagaaagttagattgtgctttttttctgcgttatctgggaacaagtccttatggctttgttcttgatttccatcgtaacttaaagggaaacttacacaatgtccggagcccttgatgtcgtgcagatgaaggaagaagaggtcctcaaattttttgttgtagcaacccacttaggtggcgccaactttgactttcatatggagcaatacatctactaaaggaaaagtgatggtatctacatcataaatctgaagaggacctgggagaagctgttgctcgcagatcgagctattgttgccattgagaaccctgttgacgtcagcatcatctactctaggaacactggccagtgagctgtgctgaagtttgctgctgccacaggagccactccaattgatggccgcttcacacctggaaccttcactaaccagatccaagcagccttcagggagccacagcttctagtggtgaccgatcccagggctgaccatcagcccctcaaagaggcctcttatgtcaacctgcccaccattgctctgtgtagcacagattctcccctgcgctacgtggacattgccatcccatgcaacaacaagggagctcactcagtgggtctgatgtggtggatgctggccagggaagtactccacatgtgaggtactatctcctgttgagcacccatgggaggtcatgcctgatctttacttttccggagatccagaggagattgagaagagggagcgggctgctgctgagaaggttgtgaccaaagaattccagggtgaattggccacaccagctcctaagttcactgctgcttagcctgaggtggcctgagggtgtacaggtaccctctgtgcccatccagcagttcccca

SEQ ID NO: 33301 - DNA, 2525 bp, Mus musculus
gtctcagtgtcattttgatatgcatgtccctgatgcctaaggaagttgaacatttctttaggtgtttctcaaacatttgtgattcctcagttgagagttatttgtttaactttgaacccagtttttaaattgggttatttggttttctatcagatgtagtgttggcaaagatctttttcccatatgtaggttgccaattttttcctattgacagttatttgccttatagaagcttttcagttttatgaggtcccaggcttgattagagttatgtcaaaatgttttggtgtaactctaaccaagaaaataaaagatctttatgacaagaacatcaagtctctggagaaagaaattcaaggccgcgcgccgccgctcctctttccttcctcttccgagcatgtcctgctccgtgtacctctcgggtccctcaccatggctgcgctcacccggaacccgcagttccagaagctgctggagtggcaccaacctcaagctgcgcgaactttttgaggcggatccggagcgcttcaacaacttcagcttgaacctcaacaccaaccatgggcatattctggtggactactccaagaaccttgtgaacaaggaggtgatgcaaatgctggtggagctggccaagtccagaggtgtggaggctgcacgggacaacatgttcagtggttccaagatcaactacaccgaggatcgggcggtgctgcatgtggcccttcggaaccggtccaacacacccatcaaggtggtcgggaaagatgtgatgccggaggtgaacagggttctggacaagatgaagtctttctgccagaccttgaccacccaggagaccatcaccaatgcagagacagcaaaggagtggtttctcgaagcagccaaggatccatctgcagttgcaaagcactttgtcgccctgtctacgaacacggccaaagtgaaagagtttggaattgaccctcaaaacatgttcgagttctgggattgggtaggtggccgctattcgctgtggtcagccactggaccttccattgctctgcatgtaggttttgaccacttcgagcagctgctgtccggggctcactggatggaccagcacttcctcaagacgcccctagagaagaatgcccccgtcctgctggctctactgggcatctggtacatcaactgctacggttgtgagacccacgccttgctgccctatgaccagtacatgtaccgctttgctgcctatttccagcagggtgacatggagtccaacggaaagtacatcaccaagtccggggcccgcgtggaccaccagacaggccccatcgtgtggggggaaccagggaccaatggtcaacacgcattctaccagctcatccaccaaggcaccaagatgataccctgtgactttctcatccctgtccagacccagcaccccatacggaaaggtctacatcacaagatcctcctggctaacttcttggcccagactgaggccctgatgatggggaagttgcctgaagaggccaggaaggagctccaggctgccggaaagagcccagaagacttggagaaactcttgccacacaaggtctttgaaggaaaccgcccgaccaactctattgtgtttaccaagctaacacccttcattctgggggccttgattgccatgtatgagcacaagatctttgttcagggcatcatgtgggacatcaacagctttgaccagtggggagtggagctggggaagcagctggccaagaaaattgagccggagctggagggcagctctgctgtgacctcccatgattcctccactaacggactgatcagcttcatcaagcaacagtgggacaccaaactagaataactccagccgcggccctactgactggtcctccttgtcccttctcaccatatgcactgcatggtcctgcccctccctgcccagagcgcaccaccggtagttggcctggactacaaggctgttgggagaagctggtctggaactgccatccacccactacgcaccctccctgttgaagcagatggaagggctttgacgtgtcatgttgttctgacctttatttcacaccccagctagaataaagacacctagaggaggcacgggggctcagcctcttcagtttaaaaaaaaaaaaaaaaagaaattcaagaagacctctgaagatagaaagctctcccatactcatggtcttacacatataaccagatatgttgattctaatagaagagaaattgcggaagggcctggaatgcattggcacaagggaaattttcctaaacagaataccaaatgctatggctctaagatcaacaattgacaaatgggacctcatgaaactgaagtttcactttttcatctcatatgtcagaattggtcatatttgtccaaaattaggaacctgaatagtttgtctttaaaccccattagtcaaaaggaaaggactaagataacaagcgcctgagatggtatataggtggtcaactcgtttctttttgagcccagg

SEQ ID NO: 33302 - DNA, 1255 bp, Mus musculus
ggcagcttccattgtcgatgccgctcctcctcatacttttcaaagtcaagaatctgcaagctctactcggggtttaatttctgaacctgcaaaagtgacccaatcctgtcagagtggggaaagctggagaaaaagtgtcatcgaagcaaaggagcctgagattccctcagtggcgccgccgtctgacagacagcaggacagagatatactagaacaaaacttccagttcaaggaacagagtacaaaattggactctgtgggacagtccctgctttggaccctgctacagaatgcctctcctgcgtgtcccacaccaagccctgctgtgtgtccccgtctaagctctcctgcgtgtccccctccaagccccgctgtgtgtccccctccaagccccgccgcgtgtcccactcccagccctgctgctcagaagtttgaacatcttactgccaagctccaggagatggatgagcagctggtagcagtgcagaccatggcagaaaatatagagcaagacttccctgcatctcaagtgctgaatctacactgggaaaaggctggactggggaatcatgttggattgtcttccggccctgacattgaaaagctactagcttcaaaggccatcagcatttctgaagaagtgtctttgcagactcaagaggacgtggaagagcaaaaggatgcagaggaaacttcagagactgaattttcagaagcagaaaatcattctagccagaaaacctatgcatgcccttctgtggggtctgctgcttgctcttctgtgggctggaacatcccttctcctggtactgttctcacttcttagatttatatgttcttgtgttgcattaaagtgttactgaactgcacctgggaggggcacaggtataaagggttgtgagttaattttataatattcacttcagggaagaaaaacattttaaacatgccattcaacataaaaaaaagtcacaaacacttcaaaccatctatagtaattagtattatttaattttataaacattgagatgttaattattagaatgttgacatttaatttataacagtcctattggttatttgctgtgccccaaccatgtactgtttcttgcacagttcctttgtaaggttggcggggagggaggaacgccagccattattctcactgcacagctgagactgaggtgtagacaagggcattccatcatgtagataataggtgtagtatttcttacagaacccatggaacctggat

SEQ ID NO: 33303 - DNA, 1513 bp, Mus musculus
tggtatatcaagacagaatcaagtttgtgatcaagacatgaagtctataaaatatattttttataactgaaatagagaaaataaataggattaattaaataattcttgttcctctactggtctctgtatgttagatagatttgtaggttattacctggtagtcgaaagatactgagagacaggactgatggatcttgttttttactttcaggctgaagaacagttgagaattgttgaagaacaaagaaagattcatgaggaaaggatgaaactagaacaagaacgacagcgtcagcaaaaagaagaacaaaaaattatcctgggcaaggggaagtccaggccaaaactgtccttctcactaaaaacccaggattgaatggcaaactctgaactttttgcaaagaaaaatgaaaaaacttcgtattgtagcttcatgttgaagtggtttttttgtttttgttttcttttttccttttttttttttttttttttaatttggaaaatctggaaagttagcttgttctaataggggctatgctctgcaatccctttattttccctcttttccttcattaagtcaagtccttatcagatcattgctgtcttgtagacgtggtgtattttgcacctgttgggattctgtactggctgggcctgctgaagagcaggtcacttggtgactggctggtctggtaaggtgttcactgaccactgacttcggagttatactctgtttactacgtcataatgctggttttgctgactttttgtttttttatgcatttataaaaaaagaaaaagttggtaattgcattgcaaaattcccagggtttgactggacctgcggtgttgttagagcagtgtccttgggatgctgtggttcttgaggttcctgacaacaggtaaggaaacagttggtcacctgctacagaaataacctgcagtgcagcattgtctctctcggacttttgtttctttcattgacaaaatcaaaccagcattccccattgtaaataaatgattttgctgaataaagtaaagtcttaaattcatatgtttaagcaatttttattaagttctgttaagtctggagggtggtttccttttagaagccttagagctgtactatatttcctctggttcatacttttcacagggtttctatgtacaccatatatacttgtgaattagtacttactggctatttttgcagacactactttatgctgataaaagaattataacatcaagtattatctttggaatatactaaacctgtgcctctgttgtagaaattatacttaataaacactagaaagtatgttttaaaagtacagaatattgttactttcagagagggtagaccatcagctagaacttggctttgtacattcaaaatgactaaaaatagtcttcaccctagcatgttgggcgggatgaaaaaactatttaaatttactagtcttgggggcttgggcttgctttgggtatttttgcacgtggaaacttacat

SEQ ID NO: 33304 - DNA, 1137 bp, Mus musculus
aggacagcatcaagtctcacccagcttgcattcatacaatatttataaatttctcacatttacagatatgtttatgaaacattccagaaactgaaatagttgagtaaattttaatagctttgaatctagctgctcttcagtcagtcagcatatcagtcgcacattgatagcatcgaaaattgtatgtgtgactttaaagggttttcatggaatgacactgctctttccacctcactcacaagatcctaatggttttgtaggttcaactcaggtagcattgagtctgggtgtctaacttgtcgaaggtttcacaagtgcatgcacacacgggaggaaaggcctttactacatacaccttgccacctagcactggcacccagataggtgatttatttgagatggatgaagcatgaaggttttacgtccgaggttaacatgggtgtcttcttagcctgatgaactgggagctcaccagttttcaggtagacaccttgttgcaggtattgctggcacgcctgtttgtcatttatgtgtggcttatgagaatcggaattgtagtcctcatcagtggtttcatccacagatccctctctccagtcccagatgcatcattctttctgcgatgtgatgactggtaaatctagggaagatagcgacttgaatgacttttcttggtagatttttagtggcacttaacagggcatggtaatttcggaagttcagctgtattcttttgtttgtttgtttgtttccaaagagatcactgggaatttgaaggcaaaggggtctctcggtactgtgtacagggcgagcagtctcagcattttaggtgcagagaaaatgtataccctttaactagtgtgctgacagtggaggtgaaaatacactcaaagccaaagagagtaaaggtgcttgtttgcaagcccgatggcctgagtttgatgttcagaaccttgtgatggaaagaaaaaactgtctcctgtaagttgtcttctgacttcatcagccatgtgtggtattcctctatgttctaaataaatacacaaatgtgatcttaaaaattagaaaagggggaaaaaagaacttgatcctcaaaggatccatggagtttgggatctctttggtacatggtttacc

SEQ ID NO: 33305 - DNA, 1359 bp, Mus musculus
tttgctttttgtttcatattaacatttttttttaacacggacacaatcctctacagtctttccaaatactaaaatcatttgagtatgtctgctgtgatctgaacactgcccaaaccatcaagcaatcttcatatagtttgcattataaaacttcattaaattctccaagaaaaaaaaaatgacagaattttatttcctgactgtgcatcccctggattcctgaatttgagtgcagattgtagatgaacaatataagctgcctttagtgattgtcaacatctgatgttaagtccatgccccatggaagcagtccttagtatggattacatttgtatttttcactaacagtaaatgtatttttcttatgaattgtttgccttaggaatgatgaattacattttttgttccttcttaccataaacatctgcatccctcagctcagcctcccttgtatgttgtttctttataaatggttgagctgctgatgcaggtattgccaagctaacagtacaaatcattttaaagaggaagctggcgcgtatggcagccgaggagcacactctgcaggacactggacaagacagtaaatactcaacttttaatgctgattaaaggagtataggtaaagaatacgtaggtatccataattggtgagacaaatattcactttatttatattttatatatatttttaatttggtaaatactatccagttttgtagttgtccttgttgatttgtgtgatattaaagtattagtaataattgcccggagactactagggagggtttagtcggttgctgttttggactgggaggggtgatttaaatctagtgttagaaaccaattttttagtggctgcacagtatatcattgtcagacagaaaggtggctgtagagctgccctgtaagtcagatcaacagagctgagaggaagattagtaaatatttgctgtagaggcaaacactttatttttctaacatcgcaacatgtcctcccctttaggaggaagagagagcaaagcgtgaggaactggagcggatattagaagaaaataaccggaaaatcgcagaagcacaagccaaactggtgagtgctgtgcatttgggaggccatcttccatatcgagtggatttgtgctgagtcattagatgaacttgaagaaccttgaggttgagttttggagagaattataacatttcagtgctttaaaacatttcctggaggagatatactactcagtcctaacactgacatttcttagacctggaaaccaaccatcagggaaaacaaagcaaaacacccaggttctttagatagctgacagatacgcgctccatcactggacagaaggaaga

SEQ ID NO: 33306 - DNA, 1159 bp, Mus musculus
tgcaccatgggctctagcagaggcagatgctgtttcagatctactgtccctaataaatctaatgatttagattcttttatgctaactagcttttctagatttaaaatgtgtggactcccccccaaagatttttatctccatttgaatttctgtattacttatcctggctgcagttttttatccattcatttatttatttattttagtgtggtgtgaaaacaagctatataattattaaggctataagaaatgagactcagtttagtagtaggtttaaagttagttttctaattcttaggttctttaaaatattaagttgtcttttctacttttatttgctagtcggcagcaggaaatagaagaaaaactcattgaggaagaaacagcacgaagagtggaagaattggtagcaaaaagggtagaagaagaattggagaaaaggaaggatgaaattgagcgagaagttctccgaagggttgaagaagccaaacgcatcatggaaaagcagttgctcgaagaactcgagcgacagagacaagctgagcttgcagcacaaaaagccagagaggtaacgctcggtcgtttggaaagtagagacagtccatggcaaaactttcagtgtcaggtgtgcctcctgctcagtccagaacgagatggaatgcgactatcttaattcctttctcatctaaacttacatggctgcgaaagataattttttagccagaagtgctgactggtacttaaaagttactttcttaaaacttattcaaggatatttttgatccgatggaactggcttacatatttgagaagtgtttgaaacttttgccatggctgcaggactacattcttttttgggagggtagggggaaccagggagtggtaaagggaaaaggctaaagatccacccgcggttgcattttcttctctgttatcactctgctacctagactgtgagaggctttgccttcagtcagattacagagagcagggtctgacattgagtgacagcacctgcttttgatacgtaggttttcttactgttcttttttccttctgttatccttcatcctctccctcaatcctttcaacacagtggactaatctagcattctgattataaggccctccattctcctaatgtgtttcaaggaatctt

SEQ ID NO: 33307 - DNA, 1209 bp, Mus musculus
cccttttcctaacacgacttataactatggcttcaagaagtgcttgtatggtatccatactgaagctatccatacttaaagtgtatttgaaaccttttagaaacatcaccactattgactttctagacaaaattttccagacttaaaaattaaagtttttagctaataaaagtattataccaataaaaaaaatcagaattgttaaagttagacttataaaaataagcatttttatttgcgggctcaaataccccctataagcatgacatattaagcataaagagtttttaaggttcatcaaatgttttttgataatgtgggggaagttgagagagaatcatctaaacaccaaacacttaagatattaattttattgaaaaaaatccttgcaacttttaagttagctgagacttaattttggtgaagactttaatgtttcatggagaaatgtttgagtgaatttacactccagcattgacagtgtttacagaacttgtctcctatcgatgatccattgcgtagctgtccatacagtgaacactttcattagagactgggtgctctggcttttagagatggcttttatgactatgttgaagtcacagtcatgtgtggattgtatctgttgagaattgtacttccatggcagtactgaaatggagggatgtgggaccttaagtgatgggtataaactatttaagtaattagacttgttgaagtgattgaagaaacatttgtgattattgtaacttaaataaaattattaaatattgtaacttaaataaaattattgaatatttaatgtaataccaactttatgttccttttgttttaaaacaattcatcataattctacttaccagaattaataatgtcattactctttgtgtgaggcagtgtcctggtggctgggaatttacagtgttgctcctctaacctcccaagtactgagactgtaggagtgagccatcgctcttgtcccagtacacctgcagacaggctttagtcacagtgcttcctgggtcctttgggtttcacattaccaagtgaactttaatgatttaagtgtgtacttctttgtacacaaatatagttttgtactttatacttgtatatactttgtacaagtatagttgaagttttataattttataatttaaatatatatgaattaaaagttttataattttcctacttaaaggtaatact

SEQ ID NO: 33308 - DNA, 1105 bp, Mus musculus
tatggtagttactgtttcagggctctgtttcactgttgtgtttagcacatcttcttgcgtctactatctctggttctcaggatctgtgtgcattcataacaacttgactttgttagcacaagctcttttgctgacccatgactgacctcatggaggagcatagaagtatgttatgtgctgcagtgaatttctcacagcactcgcaatcggatgtgtattcagtctgatatggaagattaaggtttttctggaagtaatacaatattagagtaacttaccttgggttggttttggtaggttaaaacttgttagtcctctctttataagtacagtttgcccaggacaagtatttgtctcttaaccatccatattccatgaatttgtgatcctgtttctttggccctggctgttactttttttttttttttgttggtatcgagtgaatgtagtttgtttgtttgtttgtttttaaagaaaggggtttgaaagaagggagggtaggagggactccaggaagtagcatgctacctcctgacttcttgtagaactaggacagcagccagagagccaagcctccatctcctcatgtgtgaagctgggaatggcatttaaaagctttgtttgttgttgttttgttttgtcaaatcactgagaatacacgaatgaaaacctggaagcaggtaagcatcatttcacagtggatgggtttggtgaacgtggttcggactacaggttgggaagatgtagaatggggctgacaggcagttgtaacgacccagagtgaggtagctcctagagtaccaagtgcttttcgtgatggacctgaccttgaagtagaggtgcttgctgagtcactggttctctctgtgtcttctaggatacctacgtggagctaccatggaaaaatcctggatgctgtggagcttcattgaaagatggctactggccttggcgtcctggtcttgggctctctgccgcatctctctgttacctttgatagtgacttttcatctgtatggaggcattgtcttacttttgttaatattcgtatcaattgcaggtatcttatataaattccaagatgtcttgctctactttccagaac

SEQ ID NO: 33309 - DNA, 3016 bp, Mus musculus
cttgatggatgccttgggtttcaatgtgtggagaatgatgtcttttctgggtgtgtgttcatactggtctgcacagtgactctgagctttgaaaggcctcagcactccattctgatgatcctgtaactttccaaattttcagactgggcttcttaagagtgcttgatattctcatcagaactccagcctagtgaaatacccttaactttagtttaacacgctggtttgatagatgtcatccaaaaggttcttgctggttaagtggtataatctaagttgtactcagatggagatagaaacaagaaaccttcaggtgtctgtctttcctttagtgattattgggacaatcacggttagcaagcaagtgctgctgcgttttcaccttaaacattaagatgaagtgcatggtggtggtttattcttgacttatgcaatgcggtatttttaatgtaaataacactggtcacatgccaatgtatatggtttcctgggttatatctatttttatgtaaactctattttatttcggtgaggaatgagtgtgaggcctgtgggcagattccatgttctgctgctactgagatccagctttttcctaataataaacaggacctttttccaatatagatgtgccgtgtttttgttaggagctgtctggatcgtggctagtgagataggaggttagcatcttactacagctttctttgtatagtgaactttttaacattagtgattttggttgcagatgaaattttagcctgtcagtttgtgaatcttcagctaaacaataacagccacagcaagggatagaactagctgatggttgagtgaggataactcagcacgtgtgcacacggccttatgcaatcctttcatctgaatgaagtcccagtacctagaaggtgcctgacctgacagaggcaagcatcatttattgaactgtttggaagtaaatttcagaatgaaagaaaaacaaaaaagcaaataaccaagtatggcttaatgttgcagttctgtgtaatgggctatataaagtcttaggggaatttgtcaggttttttgtttgtttgtttgtcccagcctattacacatgtagcagttaaggagctgtaggtgggaagttgtgagccctttaagcctggaagcatttagtaaccttccaggcaggaggtggaacctgccaggtcctttcccacagtcctcaccaggtagctgtgcttgagcccttcacactaagtcagctcctacccacgactgcagatggcttggctgtatgattgaccttccacagcagctagagcacagtgataatgaggcagtcgtctcgaccttaatttacaactttccaggaacatagggctagaagtacttttgccaagtagcattcttagccttcattttatgccaatgtttagaaaacaataatgtatagcaagtataatttctaaagaataatgcttttctataaattattaattgtaaagagtcttgttttttaaagagttggtaactcgccgtggagggtgtattttgtatgtgtaaattcaccacaattaaaggctgcttttcatcttgtcaatctttgctatgtagaatgactatcctgaatactaatctgccgaaagggcaatatgtagcaacagccagaatgtagacttgagctgccatggcatacttagttagtttttacatttacggagtactgtattggagtcctgttttcattaatcccttggcctggaggagtttaccaatgtgttgtgtcaaccactaaaatggaacagttgctccttccttgctgtttgctgctttctgttcagcttttgctgactgggacttgtggggtggaagaacagcattcagttgtactaacttgctctcctagagagagttcttcacttcagcagagacaactatgtttaaggatgtagaacatctctcattaccagctatgtgtttgatatgattaccttagatgagtagggatagaaaaccaactcaaacttttgagggccgtgatagaccccggtatcatttctgcaagctctcatttggtctctgaaacatgactactgcaggatcatttcttcacttcagactcttcattggtgggaatggccatggtctgtcaatctctaactcactgagaaatgagagaaatggataaacttagaagtcttaaattccatagtttaaagaataatagagtgagacttaagaaaaaagaattgtacagagaatactgcatactaaaagaagaatgtatttgttgcagactaaaggatactaatagactagaaaccacttgacagcagtttgtgaggtggatggacagaaaacttcagaacacaattttagatcaaagccctaacataagatgacccttgtcagcctcatgtaactatcttaaggttttgactgtgatgacacatccattaaacgttgctgtaaaatgggtcatgcaacatcttaagttggccggatacacttatggaaggactagagacacttaaatgttgagacagatcatggttctggtaacatcactggagtgatagcatgtgtgtccctgaagttaacacctactgaggcttgcccttctgttaggcttggcttggttgtgagtagacctgatagagatgattaaagctatcttagatagctttcacatgggtcacatatcagatagcttgcatatcagatatttacattataattcataacagcaaaattatatttatgaagtcgcaacaaataattttatgattggagagtcacaacagcatgagggaactgtattaaagggtcacaacattggcaaggttgagagccattgctctaggccatcattacatacttgagccctctgatactctctccctcaagcctttttcctattgtgttggacaattatatattttaaagagaactacaaagaaaaattagtcataagtaactcttttggaatgtttacttaaatttaggtattgtcatgtgactcaggtaaagttagaat

SEQ ID NO: 33310 - DNA, 1277 bp, Mus musculus
cttgccggcagaatcgccgtcacctcgctgctccgtcacagggctggaggccctgcctccctgacccccccacttcccagtgcctgtctccatagtcctgtagaggctacactaataactcttggaaatgtgagttgctggtttattttttaatcattgttttgtttttgtttgggatgtatatatatatatatatatatgtgtcactatagaataatgcattggtaaggtaagaatgggcttttagaggatgaccaaaaaaaattccatgtcttaaaaaatatatttaatggcaatgcagctgtcttcctgcttccgttgctgagcttgtagaagaaggctgtattgcaagacaaagttgaatgtaaattgatctccccacaccccgcgccaattctcaaggtttaccttgctgcagttgtgcatcttaagcagtttgggccacatagcactgtgtgtgctatcctttactgagctgttaaaggatctccggaaatcttctccagtgttgatgaggaacctgcgctgcatttgctgtgtagctgaatcccccagggacagtaggactgatctgctgactacagcacgtcgaggcagatgtgacacaccctccatgctgggagtggtcaccacaggacacagatggcatatgtccctgatgcagctgacatgaacaagaagagaaatcgagaatacactaaatccccctcctcctgtacatttcaagaagagcaggcatatgcaatatttacatccttaatttagtttacagaatggaaccaaaatgtgtaagtgttacgttcgccacacttcatgctgtacattgggtctttgtacattttgcttgacttaatcttaaatttaaactattttttgctatataaactttaacagttattaaacagtgttttctttgggtacatgtttcctggataccaagatgttaaatatatttctcgctattgtgtttcaacaagagacttgccctccctgttgtcttccactgtacatgctgtatataggggtcacgtgatgccgctgaagacaagaataaactggagtagattagtttgctgtatttagtctgtattgaccatggatgccctccttaatagccatatgcaataaaataaaatacattatttatgaaatgaatacagattggaggacatttttctgcacagataaccagcttaagcttaaaacaagtctcatcccggatgtctagcattaacaagcactggggacttttggtttggttggttggtttggttttg

SEQ ID NO: 33311 - DNA, 1874 bp, Mus musculus
gttacagtgtgcttgtataaagaaaaataaataaattaataaaaatacatatttcttaaaaaaaaaaaaagaaaagctaattagtcctatggctgagaggtgtgatcttggctgggctccggtgggctcgtgcatgtaggtaatgtctaaaacattcccatgttgtagaaccacagaccccagttgctgtttatcatcaatgtagacggatgtttatctggtcccttagggatcatagggctctggagctggggctacagaatttctgattctgtaagcacctgcatttctgatgctccatgactcgctgttgctgctgctgctgacggtgtaactctgttgtgttgcaggaagcccacgccatccaccttgaaggcaggggagctgcgaacacacgtcagccgctgccaagtgtgcatgagaagaacataactatgatgctcgcctctgccaccgtcacaacatggtgctactccccccccttgtcctcttctccctcccattgtatttgtaacagcaatgaaccctagaattatatcctgtgtacctcactgtccactatgaaaaccataaagtgccttatagggattcgcgtaactaacacaccccgcttcgttggcctctgtttgctgaaggagaaggacaggcagcggagagctttccataatggcacataccaaatggcgctcctgatccaataaaagatgaattgcattttgcaatccagtgcactgatgtctggggcgagaactccataagaaacccaaaggtgctaggggcgtgaggcgctctccacacagcccacagcccgcttcatcctgtcaccccagatgtgagtgctgtccaacccactgtccagtgtttccacatcaggtccctcgaggggctatgcagagaacagtcaagggaactggtttcttccactttctacatggaactccatcgtttcagccccaaacacaaacttatgccctgtgtggtactatgcagctgcttttgtggaagtcatggctttcctgtggaataaagatggtccaaaggttagatggaaaataaataaataagtaaataaatatatatatatattagtaatttatataggtgtcagcaattaggcaggtcaagttctagcgtagagcctgttgttaaataaagcgcacttggttttcgtctctggagaaactgtactatcctttcacagggttaccaacatcaggccactgaatgtgaaacaccagctttcctcaaactcactcctaaaccagaggaggtgtatagatagccaaagccaaacccattcctaaacatggtgtctgataatgagccctgtgcctggcgcttcttgcttctgctctgcgtggagtattttcagggtttgcaacactaaccacagactgaatgactgacttcccgtacgacagccaaggcctttgttagcctccttcatcctgcatcctggcaggcatttcacacctgagcacacacaggcaacttcccagctcctctcgagctgtgacacagcccctgcagggagtggacaggtcgcaggagggcagactcggaccactatgcttgaagtgacatttcactaaaagtacccaccctccaaaaaaaaaaaaaaaagtttttaagactactaaggccttctgtgtaatttctttaaatgtgtatttcttaagaattcaaatttgtaataaaactatttgtataaaaatgaagcttttatggatttgttgctagaaatgaaacgttgaaagagaagttaccacacgtaccactaataaacctgtaagctttgctgcataccttagatcatttttattttgtatgtgttcaaacaagagtcctagactgggggtaacttagggcgacta

SEQ ID NO: 33312 - DNA, 1216 bp, Mus musculus
cactcagccaagctttctgcaagcggggcccagaagatgacagtacccctctaacgtcataaagcttttaaccacagaattaaaactgccttctttacttttatatttttgagcacatgtgtattttgctggtggtgcctatggagaggtcggtgaacagctctgggatctggctctctctctctttggaatcatgtgggttccagggatcgaactcaggtcatcaggttcggtagcaagtcctttccctgatgagcccatctcaccagtcctaatgcagagttttcattctgggttaagcctcaaaaacgaagtggaaggactcggggagacgcacaggagcccgttgtgttcctgtggagatgccaaccgtgttgctatggaccttctcctgttttacatgacttgcagagcccaggatccatccacaagcagccttgggtatgcaggccgccaccgacatctgactcagcaccatctggccgcagttcatcttggggatctgcgagccttcgggctttttttgtacagacatttcctccagcgatctcaccccactgccctgtagttggagccccatgatgattctctacctaatctactgtctgatggattttaaaaaagcccagcattctcagatcttttaagaagcagttctctcagagctctttcttgagttaataaaacagcaggaggcccatggtgtaagagtaaacatatataaaaataccttagtgcctttgaaataggaatctatgcttttatcagaccgtgtgtgtatgtgtgtgtgtgtatgtgtgtgtgtgtatgtgtgtgtatgtgtgtatgtgtgtgtatgtgtgtgtgtatgtgtgtgtgtatgtgtgtgtatgtgtgtgtgtgtatgtgtgtgtatgtgtgtgtgtatgtgtgtgtgtgtgtatgtgtgtgtgtatgtgtgtgtatgtgtgtgtgtatgtgtgtatgtgtgtgtgtgtgtgtgtgtgtgtcttcagcacacattcacactgtggctcatctagtccaggttttgaagataatatttctagaaataaagtacaagttgaaatgtgggttttgtcaaagactctgggcactgaggcacgagcctggatgggtcatataaccataacccagctagacaattatcttggcagttgcctctcattcaccaacaattcactcaggagttattgggaacgtgtcgggaaggctt

SEQ ID NO: 33313 - DNA, 2083 bp, Mus musculus
actgaccaagctgggcacaggagcccacctgtgagcctagcccccgggaagtgaaggtagaaggcaggaggggaagagttcaaggtcaacctaagccacgtatagagtcatgtagagttggagactggcctgggcaacaggaaagactgttaaacccaggagtgctgttgcgtgcatttgatccaagctgctggagaccctaagagaggagcaattatttgagtctaggacttcaacaccaactagggcaacatagtgagtttctgccttgaaagtatgtaattagcacagttggccgtagtgcctgggtgtttcgggcatgtgacctctaacacacttcatctcctgctctctctgcagcacactgcagccggggatgaaggcggtggccagtcactggtgtcgccgggcagctgtctagaggacttccgtgcaacgccatttatcgagtgtaacgggggccgtggtacctgccactacttcgctaacaagtacagcttctggctgaccacgatcccagagcagaacttccagagcacaccatccgctgacacgctcaaggctggcctcatccgcacgcacatcagccgctgccaagtgtgcatgaagaatctgtgaggctcccgccctgcccacggcagctgtgtgggaaggccacgttggtgcttatccttctgtatttgtttcaactttgtttgagacaatgtctcacttttcatccctgcctagcctggaactatgtaaccccgggctggcctccaacttgtggcaaacctcctgcctcagcttcccagatgctgggattatgggcatgcgccaccacacccagcttggtgcttactcttaacttattacctcagatgctgatcccaaagttgatcttagtgttttcaaactaccaaagcaattctgcaccagcactcattccaaccgtctgtcagcaagtgggcactagctcctccgggatctaccagccttggctcacagccctgctaacacccaccttggagagccaacacctaggagcaacccacggacctctccccatgtaggacataaacatcatgctaccaggtgtccccaacaatagctgtctctgtgtccctgtgcttcccctggcaacaggctgctcaccttcctgcagtcttcctaaaatgaggcagagtctaggggacagcaaaggaatctatggccaatgatagctgagctcactgacccatttccacccaaggatgcatgcagtgtgcttctgtctagacctggtttcttggaggaggagatgatagcacttttttctatcaaatccataactgccacctcccaagtccctacgtgttggcccctgcctttttaagaccctgacggcagctggcacacagctcatggctctagccaaacccacagcaaaggagacatctctctagccctcaccagcatctgctggaaggtacacttagcaaatcattgacagtggcgtcctacaacctgtgtcaccctaaacacctccctccacaacctgttccctgcggcaagctgttctatggcttttctgtgtaacaccataaataaaagatattctaaggacttgactatgttttctgtcccccgaatcattgtgtgtgtgttgtgtgtggtatgtgtggtgtgtgtgtgtgtctgtgtatctgtgtgtgatctgtgtgtgtgtgtgtgtgtgtgtggtgggggggggtgtcttatgtgtgtgtggtgtatgtgtgtatggagtggggatgtgtctgtgtgtgtggtgtctgtgatgtgggaggggtgtctgtgtgtgttgtatatgtgtggtatgtgtgtgtggtgtatgtgtgtatggtggggggagggttgtctgtgtgtatggtgtgtgtgatgtgtgtggggggtgtctgtgtgtggtgtgtgtgtgtgtgtgcatgtgtgtgtgtggtatgtgcatgtatcattcctcaggtgccacccaccactctttattaggatctctcatggggctaaaattgccaagtaggctggctggccggcaagccccaaagattcacctatcttagcatcaagatacaagctgctcttttctgtg

SEQ ID NO: 33314 - DNA, 1128 bp, Mus musculus
ttacaatgttgcagaacagagctagattatctctcgactatttcagtccctttgaaagccactcctgtgtctgacctaacatccttgtgactttcaaaacttttcaagtgtattcttagcatgctgctagcttccaccaatcccaaagctaagagtgtcatcagatagcctatagtagacagcaatgttctccatttgctgtaccaccccccataccccgcctacctgggatccctaccatttgcctggatttatgacttcctttgtaactaataaaatctcttctagccattcccaaagcagaatatgtctttcaggcgccctgagtctgtgttcctgggacaccagcactcacatcttgctcaagaataagctgccttacccctttgtggtgagagctgtgtttttgcattcaagggctctgaactagtagtggtaggatccttcatggactcaataccaaggcgttattgcgaggcggggcctagctggagaatttagatctctaggtaactaaaaagatacagctagcggggcggtggtggcgcacgcctttaatcccagcacatgggaggcagaggcaggtggatttctgagttcaaggccagcctggtctacaaagtgagttccaggacagccagggctacgcagagaaaccctgtctcaaaacccactcacccccaccccccacccccacccccaaaaaaaaagatacacctgctctggtcccttaccctcctcaggtgagcagcttcgccatgttatgatctccccactcgatgttctcccgctcgatgttccacactgcacagaccacacccaaaggccgagagacccctggaccaaccacacctctgaggcttagcttcctccttcgtttccccaggcattctgttgcactgatgagaagctggcagtgtccagctttagcattgcacacccattctcattatgagtccctaatacagtattgctaactaaagtccggcttttgggacggctcactgtcatgttttacattcatgggtctggacaaccgtaacgagaggcctcgtgtgtcccctaacatctcatcactgacaaaatccagacagagccaactaaaggaaggacggagccatgttggat

SEQ ID NO: 33315 - DNA, 1181 bp, Mus musculus
ctactctgccacggcaccttatcccaggcccagtgaggatgttgggggtgttgcgtgccagtgtgcagctgtagaaaagtggcctctcagaagcctcagctggcttgaggttgctatttgggagctgaaggtagaaatggggtgaaaacggagagcccagggcccttactgtggcctacaacgagaaagcctttgattgtgctcttatcttacagctccagcccactcctggtggctgcctggggcgcctgcacactcacaagggagtgtaaccggcaggccttccagaagtacgggcgctctacaaccactaccgacatgatcacagaggtaggaactgccttcagcaggctcttcacgacctgaacctgtgcagactggagtgacagactgaatcctccatttgcctagccttgggctcagcagcacttggaacagaggatttacgacctaaccatgtattctcactaatgtagagttgatatgtcaactacgacactaatctggtctttcaaggttttcttggcttctcagaaatagctgaaaagaaaatgagaataaaattcccagcagcccaactggatctgggcttgctctgagacaggaaatttggagtttgtggttgttctctgcttctcgtgccttttcgttactagtcacccctcacacagagggctccatccttccaatactagacagtcacccctcacagggctccatccttctgttactagacagtcacccctcacagggctccacccttctgttactagacagtcacccctcacaagggctccacccttccgttactagaaagtcgcccctcacagggctccaatcttcatgtggctggggagtgcagggtttggtttttaactgaggctcacaggacattcttgggccccatagttttctgttgagtgaccgagtgctagcttagtgaagtagtttagaacagacagtggccatgcagagcagatctgttagaggcctgtggggagggcaggaaacctgggtgccactggcatttgagtgtggcagggagtgcccagattctgcaggtctactactcgtgtgctcactgctgcccactgtggccctcactctgcctgctgagcctccctcccgagagtggcctgccagctgcatgcctagttagtgggggtctgctctctggctcc

SEQ ID NO: 33316 - DNA, 1195 bp, Mus musculus
agattaaagccatttactacttaggcagccctcagttgctggtaacccctcagcaggggtggagcctcacctactcctcccccatccatgctgggatcagttacaagaatgctgcttctgggccagaacgtctgtgtcccctgctctgctcttacagacccaggtcccagcactaaaggcctgtgtgcccagatgtcctcctgtggcagccacctgaaggttcgggagctcaggttagccccatccgaggacatcggtacccttcctgattactgtgtcctgttcccttttctctaaggcttttttaaaaaagtttaattttatttcttaaccatttcttcttgctgtggctaaggtgagataggaactcattttttgtcctttggagtagatgcttgctgccctggtggagggtgggggctggtttatcatgtggtagaaatgaggctgttacttacccgctgtctgcaggggtggcctggactgccaccaggggtctttgggtcttccagatgtgctgatgtccttgtctgacctcttgcagatgaacgtgacgcccgcttctctcgccagtctttttgaggaagaatttaaacaagacatggcagccctgaaggtaagctgtggtttttacactttgtaaaggggcagtggtagctgtcccacatgatctaaagcagtcagttgctagtgcctgcatccgggccctgtggtggcaagactgaagaaaggagcagatctaggtctgcagagtgggccctgtgatgagcttagtgggaggagccccggggcagcaggatgagctgggttcttctccttagggcctgaaagagcttgtgtgaataagttagtctgtactcttgccaggacgccatggtttatcttacattcctatcagagtcgggcacattcctggcaccaaggtctagctgtctggctcctcgttcccctccagtgcctgtgtctgttgagagtcggtagggaaacaacgcaggaaaagccagttggctcactgggggcatcatggcaagcatgacttaggatggccgccgcccccgtcttgctaagtctgtgcgtggaccttgagcacggaaatcacccgtggtgcccacggtctctgcttcctcccaggttctgccgccaactgtgtatttgagagtcactgagaacatccctcagatcattgctttcatcg

SEQ ID NO: 33317 - DNA, 1575 bp, Mus musculus
tttatggtatcgctgccttcgtggaagtccgagggcagtcagatgagtattttagagaatgttagccgtgcctcctctcctcggatggcggagacagcctgcgtcttcatggtgtaccttgttcccagactgggtctgcagagccgcaatttagaaactacaaatacaggttcgaattaaccatgtcagcgagtgtcagactgattttgggggttggggagtgacttggaagtaagctaacagctgtataaagaagagatttcatttggctgttttgacaaaaatgttacggtttacaaaaaaaaaaaaaaattagccaggttgctgaagtacaacaagcgtgcttcttgctaccataatgtatatccacacgacaagttggtggtctaaagtctaaatattattattttttaaagaggtaaatgggtaaattttacatgacatattttatacatggcctattccctaactggccatttttaatgactgggtacatttttaataggtcagacacaagtggtccaggcagtgggtccgagtcttgcctttgctaccctaggtcatggtgtagccacctttaacttatatgaagtgtataaatgtacatcttgcccctgctgtatcataaccggaagtgcagcctggtgctgttatgaagccaaggtgtgcatcctgctgcgtgtgtgagctgtatagatgttgcgtcaagaaataaatgaaacttggccagtttgtttctttagcatttaattttaacatacaaataattttaaatttttgtcttaaaaatttatacaccagcagtttagacaaagccttaagcaaattgtatattattgatctcacgtaataaggaagtaggcattatgtccatgccagcaaatacatgtcaaaggtgtttagatcagaggttaggacgtgactgtgcttgtgaggtccagccccaccatctgtttttgtatggcctgtgagctaagaatggtctctatgtttctgagtggtttttaaaatcacatttcatgatacacgaaagtcctatgaaatgaagatttgcgtgtctataaataaagactcattggaacaccatccatgtttatttccttatgtgctgcctgtggctgcttgtgtaagacctagacatgctctttgcagagatcacctactgacagctgacgtcagcaacctgtcagcggcgtgtgtccttcactgcccgcttactggagcccagcagatcttcatgcctgggtgctgtgtgccttgcttgaaatctgagtatgttgaagtgttttacagagtatgtggggtccaggcctggtcactgtagagtcactgtggctcttgtgttatgtatagtatacattgtagctgtttgctgatgccttggagaacttttctttccttgggcatatattcagttttctggccaggtatagtgatggtacacacctttaatcccagcacttggaaggcagtggcagatggatctcttgaatttgaggccagcctggtctacagagtgagttccaggacagccagggctacacagagaaaccctgtcttggaaaaattttttaa

SEQ ID NO: 33318 - DNA, 1850 bp, Mus musculus
gactgttggttatttcctattgcaggttttcttgcagtcctctatatcagaggaacagaaagcacccgagtgtgtcctctaaaactcaattcatatctctccccccccccataggtcagttttttaaaaatattttattctattgaaaattaatgcaatatattttgatcatattcatctcctgaatccttcccctaatcccagatctactcccacaccaggtgacttcccaatttgtgttgccttcatacacctgggtttgtagttatccactggaatatggtcagcttccaagtagccacatcctttaaaagccagtgtccttatctttattgtgttaaaagattttaagcactttaaccaggacctgacactcatgctcctttctaacctcacaagtggttgtcacttccctttaagtgggtcagtgaatccatgtcaaactaccagcaaaccaagtgcctgatccacttgggaacatattatagtgaggcattgtgcacaagacaggtgttcgttctggtgcgggaagcaggtgcggccgcatgggccaagatgtttgctgcctgccaggctggactgttcctcgtgatccggacctgtccacctatctgtgaccaacctgagttcgtgcctgaagcgtgtgtgaattctgattggatgaggtggggtggagttaggtgaagtcattcggggtgagtataggagagttgctgtttagcccttgccctaagtagaagctagttgttgtagaagttgttgctgcccttgccgcaagaggtattagaagaagctgctggggaagagagctgtaaaggaaaaagcccgaagtaaaagaagttgctgcgtgaacccgccttggtgtccctgtcgttcttgtctctgtgggtcggagactgcggcaagtggtgacccatacacgttggtcggcaacggtaagtaaagatagaaggaaactttagtaaacagcggtaaggtaagtttaggtaagcggccagtttagaacctctttagttagactgtaagagtctgtggaacttttgatatttgaaaatgagagatcagagtgatgccatcttgtaaagggtgaaggaaaatgcagtttccaagtggagggcattcagattttagtagacaagtcaaatagataggatgggtgtatcaaggtcagacaggagaggcagagcagagcagaggcaaatgtccaaagtgatctaaattatagaccaggcagctttacattttaaaaatgggacttgcatagatagtacggacaggtgacctcagagacttgagaaaggactactatagactgagaccgtcactgtgcctggcagacatgtggccagtggaaatggctaaaggatgtaagtagacaagtcaccaatcccagcaaggaattataattaaatcaccagaagaaggtggttgaaaaggtaaacttattctgctagggagagcaacatcttggtggaaggttggtgtatctaagctcagtttctttttggagaggtttgaagtgattgtctctcttcatgaaggagaaaatcagataggttccccggaaaaagggacgaagcattaaggttctcaggtatagagaggaaggtaaggttcccaggagaaaaggggacgaagcattaaggatctcagaaacagagacaaagggaaggtcccctgaaaaaaggggatggagcactaaggttctcaggaatagagacaaagggaatttcagcaacatgggttcaactacgacgaaaatgaaagtaaaaatgttagccatctggaacttggtcagggcatgcttgagggacgctagtggaaagtacaatgctgaaatagaggaagga

SEQ ID NO: 33319 - DNA, 2696 bp, Mus musculus
taatttatctttggaaaaatagtggatacttttccccattgagaatattttgtttctttgctagtcttgaaatactccttttctaatagtggattgtttaaagagaaatgctgtaattttaggtgaaaaatatcctctgaacagattccagttgttaaataaattatgattactaataatttgggggaaagttgattagagagtccctgacaggacacaggcaaactataggacacaggaaactgctggacgtgggtcttcctccatgagccactagagctgagcttgtgtggaatatgtcatgtctctctgagcagccccaagcattgagatcaaatttaatactaccaagcaagagacgtgaattcccagagagcatcaacataacttttcagcataggtggtttctgaaaataacaggctctgagaccttggctctcatggtcactgttgatctggattcagtaggaacttctcagcactgcctttgacccaagactaagaagagcaactggtgtaggcagtcgctgctgaagctccattctgtgctgtgaccgtgcactgagtggcacttgtgggattgtgtgtagaaatgggtgttgctgagacaaaagcagttcgttcctctagtaattatgtttgtgcttcctgcactggaagtggacccgactggcaccattgggcctcctcaacagatccactccatttgtccttccctccttgcctagaaaagttctgtgaggaatattcccatgggttctgatgggccctcccaggagtgacttaaattgtcctctgagggtcaccttagtagttaagtatctactgcagtgtgtctgcttttgatgacagcttttgtttcagagctccctccaaggctactgaaatccgtatgtttatacttctaaatctgcctgagtgaccttgaaaagggaaccagtgtgtttaggagaaaaaagcaacaggatacaaaccaaagtcttttataattgtggcaagagttgaacatatgttagtgtctccttccccattggtctgcgttttggtgacaggtgtatttcttaatgcagatatgaaaaacagtagctccgtgttgaatacattgacaaatggaagtgtcgtcaatggacatttggacttcccctgcgcgaaccagctcaatgggatggagagcaggagtcacccgtgcttaacaggatctaatggcgttagcaatggacagccattgtccagtggccaggcctctgtctctgctaatgggactgaggagccagaaaagaccatgggcattaaccccgagatgtgtgggtctctccatctgaacgggagcccaagtagctgtgtggccagcaggccgtcctgggtgggggacataggggagagcttgcactacggacactaccatggatttggggacactgctgagagcatccctgagctaagcagtgtgctggagcacacgagctgtgttcgggtggaacagcgctacgacagtgctgtcctgggcgctatgcagctgcaccacggctcctgagcccagcgttacctcagttcctctgcagtgccagcttgaggaagctggacagcctgtgctgtaggtgcctcggctttctgagagagagtgagtccttggattccttcacgtagagtgctgctctgtgcatagacccttctcatggcgtggcaggcctcctgcgaggggtgctttggaggcttctcttgtttgacaccagccttttttttccccacatcacgagacattgccacctttttgtgaattgtatttgatcaggacagttgggcatcgctcacctttactgtttgctgtagcactcctgatgacacagctttcccctgtgcaaggacctttacagtgtgcagcaaccccgggaagggggctgactgctgcaggtgcgctcagtggtcggatgtgctagccccttccctccctgtgtagactgctgcctgtgtctccttagaaacagctctgcccaggatggattaggttgttgtttttactccacatttatacttgatctctagacttttttaccacaaacaatggtttcctttatatacagtggatgttgctgtttgtaggaactgtcgggtcagaatattttactatggtgacctatttttttgttactgttttttgaagttttctgcttaaagatatataccactatatatccagttaactgagagaattttgggtttctcttattaaagctgcattaaattcgtgattttatagaaattagcttttgtttaggcaactagtggctatacagcaaatacccaatgacttctgatttttgtaataactatcagtgcaagtgaactgtgaggtgacaaagccaatgttttaagagtgtactagcattttgttttcaagctgttctttacaaattgaataaagaaaatgcactgctgatctgtctctgaaactgctttgtaggtggggttagggtggggtccaggaggtgtatggtgggaaggaggtttggccttgggttatattttgctttccgagtttgtcttcatgccccatgtaatgggtttgctatcacactcagctctgtgtcccttgctttactgagactcacatgaagaatgtagccactctccagggtccgaaaagctgcctacatggttgacttgaagccgagcagtcgttccctgtgagccatgtc

SEQ ID NO: 33320 - DNA, 1099 bp, Mus musculus
gctgttgctcatactctgaagggagtgcagcaggtgaacagctagctcacggaaatgctgggaactaactgtgagggtggtggctgtggcttgtgacctactcaagacaagtttgggataactgccccacgctcttggttgctttggtgtctagcattcccttgaagactgtaaaatactgatcattttctgcagagtttatgtgttacagtgtccagaagactacaacataacccttactttaatgtttcaaagtcaaaggagctgagttttcttagacttaggatttctaaaatgctgtatttatttggcacatgccttttccccaatctttgggtgataacaaaaataccatggctaatttttatataaaagtgttttgttatggtgttcatttcttcactggaaataaaaggtcacctgtgtgtttcctaacccacaggtaatattgtcaagcccagaacttgctctgtcataggtggtgataactttggccaaatcattaatgcactgggtgctcacccatgaacagtttgctcagagcaaatgttcatttaaagcaatggtttctgaaatcagcagaggctgttttgcctaacagaggaaaagtggtaaaagccagagcctctcctttatggagacagcattgttcccttcctggtcaggcaggagaaagaagctcttcgctcttctcatgccagcaggcaggtcgtcctggatgtcagaaggccacgtgggccttctggtgttttccagtactgtctgactcaggaaacgtgttggcactccctagagattcttgccaattcctagtgtgaaatagcacgctgtgcacagaaaggctgtggagacagctaccctgccctgagatctgcacagacagaaataaggagtttcctccttaaatgcatctctgctctttttgaaaagctgtgagatgatcctgtcatctttttaatgtcccttgcttgagacccatcactgggcttgattgatcatctccccaagctcagcctggctgcctgtacccagtgctttgtactgagtggcttctgtccgcagctgagtgagtgggtgtagagtggacttgggtgagctg

SEQ ID NO: 33321 - DNA, 1188 bp, Mus musculus
aagggaaatgcagaaataatccttcccgtgtctgccctagcagaatgccatctgacacgactggctttccaaagaaccaaagtttccacttcagaggtcatggtatataattccagaattccaagccagaatagaacatgcctaattttgatctgtttatatatacccaacttttctatatgcttataaagtttgttttagtcaagtgaaaacagtagcttcaatttttgtctacatattttgtgtctgtgtatgtttaggtatgttatgtgcatgtaaatgcatgtactttaagagggaaagatgtcaggttcccctagagtgggtgaggtagtgctcgcttcccttccaaacccaagcagaataaacgtgggtcactgagacatccataggctgctttctcagatgtagcttagattgcttcttcagcaatgacagactacaagtacaaacaccagtgacaggagagtggggtggtacacatgtcaaatccaaacatggtgtcgttaggattgggagagatcaattttgcggtttgaaaagtagatgatagctatggtgactgtgtgcagcatgctgaacagctgttcataggcaggaggaagagagagcctgtatgaagatgtcagccaagatctgttttcctagcaactcagaaaatgagatgctaagctgtagactatggaagaatttcactcctgctcagcctgctggatcagtgccttcctatggtgataggctcctctgccctgtgctggtatagttccatccatgtcttactgcaccccccagacctgtttgagatcaacaatcattgatggttttaatactggaggaagagttaccttcctatgttttgtttttcttggctgatgtgagcttcattccatgataaggaaactgccctaggtttggggcatggagaatgaaaatcttgtccctgttctcctggggctttgtggctgcaggcagagaaaatgcccttcacatttgttggctgtttttattttggggacagagtttcactatgtgatccagctgccctcagactcatgatccttctgtctcgaccttctgagtgctgagaatatagataacaccccacatctgcatttctagtcagtagctaaagaggtatttaatctaattttcagagatgtgaacttgcacaaaaacaagaacctataa

SEQ ID NO: 33322 - DNA, 1142 bp, Mus musculus
cctgcaaatgtgatcccttatgattgacgtttcctgtgtatgaaccatgcccgtttcagtcacgcagaagatgctgaatctgtaaaaactacacgtgtcaatgttttacagctgcgtaattcgaattgacttggttttttcaagtaatcctagaaagggggagcattcccatagaaactgctgaaactgccacaggtgcttctccgaaaccttacggttgtggcattgaatgttcagtatggcttcccttctgcacacaagcatactgttgaggtatttgttgcggtgattggttttaatgctaatctaggaattcagatatagattctttagatttgcatgctttgcttaccctaatttatgatatctacctttttatttgtaaactaacaatagctaaattcagatcagaactttaacagaaatattatttatataaaaattgttgttaatttttaattgtcacatggcattagcacaaagaaagtgttacagtggtgatgtgacactatctagttctgaaaactagatatttcttgatctgtgattattactctaattaaagggaacactcattggaacggcttctctcttctggtattgtgacactgtaagtggaaaatcaaaggggtctttgtgacaatatgttctaaagttcctggggagtggttcttatgtaagttaaatttaatactctgtttaaagtgtttgagggcagtttggttcatttttgccactttggcaaaatatttaatgtgtagctcccatgtgctagtttcctgattctgaaacattcgcaggagggctcggtggcgtagagcttgcctagcgtgctctaagagatcgaacctaatctctcagtgctgtgaagatagttggctggagaacagttattttcctgtagcggggcagtgagagctgggactggtagccaggaggaacatggtttgccgcagactgggctcagcagcagggaagtctgagcctgctgacttccttctcaaagctgcttgcagagtctcaacaagactagcgtttttaatagactccctgttttcatatttttatatgggtattaggaccagagagagtggataagatctttctttaaaagttttagcgatttctcccaggtaatttat

SEQ ID NO: 33323 - DNA, 1244 bp, Mus musculus
ggtgaattggggcggctctcaacttcttacctgtgctagctgctgcctctgctctgagtagacaagggcggcaaacaccaacatgggagagccgcccacttcctctggtatcagaggaacaatagaaggttgggttttagtgtgatttttttttacagaaagacaaaaatttgctattcttttatcatgtttggtaactttaccttcttgaggaaagggatgcttctaagcccacctgatactaaagtagtatttttttccctctgggtagaatcaaggtacccacacatgcaggcatattgtgctttttctctgattcagtcttaatggggtggaaggcggggctgatagcaatcttcccctctttagaatatgacttcatcagaacttgtatgttttatgataggtgaagtgggcagcctttgaaatatttacggttaacccaagagtgggcgggcaagataaagcagggtctgtggttcattgtcaagaggcttcacctcggatgaagtgagctcagttgtctgacagaagtggctgtaggccacagatgcagctcctgtggagctgttaggcttttgtacttaggaagcaggtgtgtctgcttcacctgagaggcagggctagcaccgggacaaacatatcttgaacatacaaacacatatgaacataagtgtttaatgtgtttggtcagaagctcacttgtaacttttttcaggacaaagccaagatttactgttagccccttccttctgatgctgaaggttccttcgtcttgatgcgtctgtccttcagagcactgatcctgttagatgtctcagcactgtgactgaattggtctgatgctctagcgctccaaggagttctctgtaccctcacacgcagcctcttctcagatgctgctaccacagatcctctgctcttgctgctgcctttcctccatccgggtgggacagctgtgtggctctgcctacaggcagaagcagtcagtatgactgacggcgtcccagaggtgacagacaacttaaataagaagtagatttcactatttaactgttgcttttatattaaattagtgctttaaaaacaaaccagcaacttccaaataccaattttctctctgttaaatcatactgaaacatgctaagtattttaatgtatgcaaacataattgtgattcacttgcaatgctaaacatcttcaataatgttgaacttgaaatgaaaacttggcaccaaatttat

SEQ ID NO: 33324 - DNA, 1151 bp, Mus musculus
gcccggcaagtctcgtccctctaaccacactaacgtgcaggcccaccctcaacccctacaccttcagcgttggcatcagtagcggcctcctcaagcggtgatcgcctcccagcccctaacttcaccaccagacgcctaaggcggcgttcctgcgcagaccctgagaaggccccgccctgcagccaaggccacgccctatcccaggcgccagcctcagcaccacctgcgggaggccccaccctatccaggcgcgggcctcgccccaccacgggcgtcagcagcggtcggaggcagcggactgttaggccccaccctctcaaggcgcaggctccgccccgtggctcaggtcccgccctcagtgctcgctgcgctcggatgcggatgggacgcggcagcagctcgcctgtcctttgtgttcgagtggcggcagcttcgcaggccttcaccggcacattcctctggccgatcagtcgcgtgcttcctagcgacccatcatgtcagcgggagcgggcgcggccgtggaggcaggcttctccagcgaggagctgctgtcgctccgcttcccgctgcaccgcgcctgccgggacggggacctggtcgcgctctgttcgctgctgccacacacgccgcgcgctcacctggccgctgaggactccttctacggctggacgcccgtgcactgggctgcgcacttcggcaaggtgggcgcgggcactttaaggcgccattttccgcgtggtgtgctgttagggtcagagcgcaccccacggtgtctggagagcgcggtcggcagcggcagcgcaacccctgagagttccagggcgcatgtgcggtaccgcgcggtctgcgacccaggacggtggggggtggggggcgcggaagctgctcagacgccgcgggcgcctcgagggcttcaaggcgcatgtgcggcgggcggcgcgcgacccaggacctccgggggcgcggggagtgttgggaggcggggcggaaatggggtccgtctcgccggctcccccgaaggatccagggcgcatgtgcacacttgtggctcttccgagcggggcgggcagactgcagttgaggccgtttgcgcggaggccgccgggcttcgggaatcgtggcgaggaggaaactgggggcctcgcgcttct

SEQ ID NO: 33325 - DNA, 1101 bp, Mus musculus
ggaactatatcaggcacagaggtgggggtggggatgggaggagtggcgggggatagcggtgggcacgtcaggtgctgctatgtaggaaaagagttccttgccctgagaagcagctgaggggtaagatgacggtcaggtggacttcagcatcacagccacgtagtcatttaaaatgtgttcaactggtctgcttatgtctttgctgctactattcaggagtgcttcagcacctgagccagggtgctgggtttccagcctcctgaatggcagactaggaagtctcctcaccacccaggctgtgccagaccaggcagaggatgttgcctggccaccagctgaccagcccttggacctgatgttactgaagtgatgtcactttctgactttaactgaaagtactactaccacatttactatgaaagaacaccaagagaagctggtgtaattccagaacttgggataggacttcaaggctagcctctgctacatgagaccccacatttaaaagaaatatatacaaacatattactagaactgttcattacaaaggagaagatcatcttagccacctcaacaagagtcaaaatgactcttacctgcacagaagtcaccaagccagcgaatgctaatgtcacaatacagtctctacagtgaagacagggtagaacctttcactacccttcctggttattttaaacttgaaagcaatctctttaggggccctagggaggctccttaaatggaacaaaggcaacagaaaacaacacctctagtggcagttcccctggaggctttctactggggcagttaatctctctgttggccttgccctctctgttgggaaggctgggatggtgtgtgtgaaaactatatgctggagagagttcccagcctctctgctttagtttcctgtctcactaaggtaagacggtaattattctgtccagctgtaagggtcattgtcaaggtcaactgagactagctgctgattgacagtgagttctaagctaacataaccttttcctctccaagtggcttttggtcatggtgctttatcacagcaacagaccctaactaagacaaacccagtctccttagttt

SEQ ID NO: 33326 - DNA, 1100 bp, Mus musculus
ataggctgacttcattctcataggctgaagagcagcagttcctggacatggctggggcccttggcttccagcacagtgacatttaggactaaggaaggtggtctccatcaggcgagcagcagcaatgaggctgttgctgaagtagctacatgtgagttatagacactgaggtctgggctgagtgtgcacatatctgccacttctccatgcagtgactgaccagagtcctttggcttctggacttgagttgaatctataaatagcatacctgtgtactccttgtaaatactgggatctgagcacctacctgagatgggactgggctaaccctcctgctaggatttccttctcagcctttctggccacagggatctgaagttgtgtttgtgaagtgttggaagcagaaaggtgaagagatgccgtggcagctgtctgactcgtgtgtagcgcaggctccatggtgccatcgggaacaggcactcgggcacagtgaatttgtgtgtctctgttcttaactgcagtattccagtctcggctatggctgtgcccagggcatcatgggttctagggagggaaactgttacctgcctgtggtgcccgcctctgctgccctgccctgtcctgtctgggccttggtcacagtgtgcagaagtgggttagccctgtacatagatgtgttatttattccatactctctagccggtgctgccggccgggcagggtttggctgcaggctgttttcatccaggagctctgctctgcctctggccgcagtcagcgttgtccaggccactgaaagccctcctaaccctctgagcgagaataaagcaatacaaaccccaagtggagcagcacagcgagagccctcaagtgctgtgcctgcgccctactctgctgcctccccaggccaggcccaggcaggccctggaaggctggtggcctgggcaagcggccctgcttctgttaggccatgcttgcccctggtttggcaacagttaacagtgacctcaggagcttagctgtcccttctttcctccaaagaggttgttttcaagtcagagatactttcccttagaaaggtgttttgtctttaaacactg

SEQ ID NO: 33327 - DNA, 1215 bp, Mus musculus
ggtgagaaaagctgagctgttcctttccttttggtaagccctgttttccaagcactctgctgacccagaagacactgcagcaaaaggcagtgtgtttgctgtcacagcaggtctcaactcaggaacaacactccttgcaactccactgctggcacaggggcctggggttgctgggcagcccctccatcaacaggaagcaaagaccatgttcgccagtgtccttgccaccgccgaggttgccgtccgtgccccaggacaattcctttcagacctgccttaatgattcgcttggagtgttccatgagtattcatgttcccagcatccctaccctggacagggtggttaggctgtcagcacgccgccttgtctctctgaggatccagtgtcttccaggctctccagggagcgagaatctgcacccaagagcagttctttttaaaaccggccctggtgtacacacccacttctctctcctgcgtgtctgcgcggggagctttgataccaacagcacagggcgcctctcaccaactcctaagtcctctgtgttctgtaagggatgcgggggaatcaagccatttcctgtcgtgtagatgtgaagcactttccgttctgaaccatgctgcggtgtagcagcgtccgaaactccactgttctcctccagctgctgcccatgcgccctgtgcacttcatgccaacccccactttcctgggacacgacaggagaccgcaccggggtcgactgctcagtgtgtgtgtgctacacccttgcaattattaaactccttatttttcttatctcacaaaacgtgttgcttcatcttccttgagacggtctccatgtgcatgtcttggcttatcaggtttgaaatcctgatgtgttcaatgcagggaaatactgttgaaatctgggagcatttaaggatggtaagagtgggaaacagaagttctaggagtagtttctctcccgaatttcaccctcctcccactcccattaaattggaataacaactgctggtaagatgtgggccattttctggattaaaacaaaaggcagtgctctgaaggaatctgggatctctacaaaagaaaattactgctgctgttcaatcagctctgcctggtcaggagctggtcccgagtcccgttaggaagttcgtaccagatttcagagacacggcagtagcaggccttcctaggtttgagacagacagaca

SEQ ID NO: 33328 - DNA, 1197 bp, Mus musculus
gaccagctctgatgaaagtctccagtttctcagcttcagattggacttcaacgaacattacaaagccagagaacccaggctccgggtctctctgggcagtagggggcggcgcagttcccacacgtgaggctggcttgggttagtacatgcttactcaagcctggcccctcaagcagctgtgagctgcaggtgccccctgtctacacacaggccccagtgttcagcactgtgtctgctggaagaagtcttgttatccactggacttgcgtgtctgtaacgctgctgagttcaacaggccacttacctaccatgtagtctccgtagtcgaaagacactgtgatgtgctgggacatcttatttccaccgtgtaatttatatttcaacaacaacaaactgtttcttgccacaaaaaaactagaccataaattaagagtaatgtcactgctgttttttagcattctctgtgagacagtttttgttatcatgatgacactaaaattgaaacatgtctaagaaagtccacaggctgttttactctggcttcagtgtttgtaaccctcacctgcgtgaggtcatcactacccacgcgtcatctccacacactgtcctctctccctcccgaagtttacatttttatatttgctttactgtttcagataacatgtcaaacatttcaaagagtgggagccgtggagggaggtgtcctcagcctgcctggccgcaggccgctggctgaaccaggcaaggctgagactgtcttattttcaaagttctgataagtgttaggaagaaatcagcttggattgtgaaggtttcccttctccttgcctattttttcactgtaaatatttatatactactgaccagatgacggaggggactgggttttggttttttttgtaaaaatgtcttatccagtcacataattatgccttttttatgttgcataagtgaaaacttagagaattaaaaaccattatctttcagatgtttcatgtggtttctgaatagtctggagaaactgcttgctgggtttgtgggtgggaagtgagggaatttggtgggctgtgctggggtgtggtagcggtttataatttgtaaagcccatattcggattggagtattgatggagcacaagcgttactgcacgctggtccctcccaccagctgactgcacatgcatccagctctgtttaa

SEQ ID NO: 33329 - DNA, 1208 bp, Mus musculus
tttcatactttcaagaccagtagcacacagacagcgccaccattcagaggggcagccttgccaccgtggaccacagttctgtgagcttgtgtgtgctgaccctggggaaacacgtcctcaagtcccagtgtggacggccaggtcgctctctcagggtgctgatccctgcagctgctgtgttgactgcactttcttgtcaaagacttgaagcttgtccacactcctttctaatgaatagttcattatctttaaattcaacttcattcaaggtctcacagtggtggcaaatggaaccagattcttattaaatatcataggattgtctctggcccatttcctggcacagcccttgttctcggagacctcaggagccaggcctgggttgctggagagagtgggtaaataagctgatagcctaaactattagctaagggctaataagaggtgaacttgcacatgtaaagcaatgggaaagacccagcatggagtgtatggaggtagagtgctgtctgtaaaggagacagacagtctgtagctgctcagcatggctgcagaggatgtgctaaggggaagggagctgctgaaaggacagttggccccgctggaaccctcccatgctgcctggctacagctccaacttagagcagggccacggccactgtagggcacctgaggccagtgagattcagaaagagcagtctcagttctaagtgccagtgggcaactcataaagcgcgcaagcgagagccctagcacagtgcagttcccaagcccagagtctatgccaggagtgccaaggctccgatcagaagagctagtagatggaacttaccgtattcactcatgagaagagaactcagtaactcccattcaggctggctgaacaatggtgttactgaaaaatctattttgaggggagagggaatagttaagatacgatctcactgtgtgtagcccagtctggcctcaaccattctcatgcctcagatgggattatgggtgtgggctacatgtgtgtctggctgaaagtgaccttttagaatgagagtagatgcttctttccaaggcagattgtctggcgttctcactatagtcagcgtgccagctctcagaactgacaagttccttccatgcccattgtctgaatgagggcatgtgggggacgtgaggcctctgcactacagtgcgtgacgcacagtgctgccgtg

SEQ ID NO: 33330 - DNA, 1162 bp, Mus musculus
aagttccatgagtatgtatgaagcagtatgttgtttgctgtctcttgagattcagtatgcctcaagacatcttcatgggagggagatgctgtgttctcatttttcccagctgggatacttgctctgctgatatgagagtggagatagaacttgatacctgagtgtggatgacagtgagatgtgtgtgctggccacatgtcttcacagatagcaagattcttacagatcagcaaagacagatgtgtgactgacctgctaccatcactgtgccagtacaggctcttataatgaacattctgtgtgtgagagagagcatgtgtgaggggcacatgtgttcgggcaaatgagcacatctgtgcttatgcatgtcaacgccataggtcagggatgggtgtccttagtcacttccgtagggtttttttgtttttgcttttggttggtggtggtagaggttttgttggtgcggtggtgttgagtcagagtctttccctgaatgtggaactttctatttgattagattggctggccagtgagctgcaggggtctccccatctacgctttctctgtggggttgttattcagtgctgggatcctgaactctggtcctcacatgcacttggcaagtattttgtttgactaggccatctctccagccccttgttttatctgctgcagtggtgtcacctacttgtggacatttaaattatttgtcttcctgttacattcggtcagcagtaataactattaacaatttgtggaccacagggtgattctcagccacagcagggtaggtcttcttagtagtaggactgcatagcagtcctcagtctctggtacaggtcaggtgattgtcacctgtaaatatttcaacagaggaaatattggatattaagtaggaactttccaccaatgtgactttgttgctaagtaatatttttaaattttttgtttgtttgttttgtttttgttttttgtttgtttgtttgtttgtttgacaaggtctctctatgtagccctgactgtcctagaacttactatgtagaccaggctgttcttgaactcagagagctctgcctgcctctgcctctgcctctgaagtgatgagatcgtgtgtgtgtgtgtgtgtgtgtgtgtgtagaaaaatgtgcatgtgtgagtgcag

SEQ ID NO: 33331 - DNA, 1140 bp, Mus musculus
tatccccactgatatcactgatccaggcaaacctcagaatgggggtgatattcagcccctttaactgggggacttgatgggaaccacgtgtgttccaatgtgattttactgaggtcacagtgagcagagtgaacattttcctacagacgacggagtcctgacaactgtcaggatggtgactggacttatgagagagtagagtctgaggttgtgtcatctctgccccttgtcagagttgtcctgtttgctagttagttaccatgtgtgggatgctagcatgggactagggatgctgtccctgggcctgtctctgctgtgtgacatgtgaaaagaactcttcatcaccaagatgctctgtatgggcttcagcagcagacctgggaaacaggacctctccccaaatctaccttgattcagccccaggcatttccagcctttggcgcttctctgggtatccccttctctcactccagagtgacggtcactaagttctaagttcctttggtgcctgattgtcagcaaagctggctctggctcttcctgtgctggaagcagggagtgcccgtggttcagagagctcggccacttggcagcatgcagcttttcttcccttcctggggctctggtgtcctgagcattggcagtggcagctgcgaatgagctggagtcttgtcttactgggtcagactggacactgcccactagggtattgctgggttccctgtgctgttcgttgtggtgaggaaggaccggagcggcctctgaaggctgggctctctcatccaggtcaatgaacacattcctgatcgtgtacctctgcatcctggtgagcaaggccctgatcaacacggtgctgaagtacgtgtggcagagtgagcccttccgagatgagccatggtacaacgagaagaccgaatccgagcgccagaggaatttggtatggaggcatgtcccttgtgtaaggatgtggcccttaggccattgtcacaaaaagatgatgccagaaaactacagaggtgaacttgcttcaggcaggctggagccttgccagagcttaggacaggggccctcactggcacctggtgtaggcaggtgtgaactgcctgctgtcttgggtactagaatgtacaagtctggaaa

SEQ ID NO: 33332 - DNA, 2440 bp, Mus musculus
agttgtgtgctccaggtgggagagcgaagagtgtcctgtgctccctctccacccaggccttcctcacaaggcaaggtatgggtgctgtaggtccagcctggagatgcccacttgatggacagacagccccagtgccccagccgctgagagctctgttcttgggtacctgtgtgtgcctgcacctgtcccacccttcattctcagggagggcggggtggaatcacaggtcacccactcaggcacagcacactgcaatctggatggtgcgtggccggcgtcattgtcccaggcctggtgaccatacatccagttgggctctggaaaaggacattaagcctggcctcatcttaagcactgtggcttgaagctggccttgcccctgagtatccacccagctgccgttgtcacctctgctgtctcttgagaagaagatcctatccctttgtctgcagcctcgtgcgtagcccatggcgcttggctcatactgtatccggatgttcctgcccgcctgcccgagtgtttcctgtgtgaaccacacacacttaccctgtcagacacggagtggtgtgtgtctcctggacctgtggccgcgctgtgctcatgtttgctgtcccctcacaaagccatcttcctagatcatgtctgagtcaatttgctgagatcctgaccctacacgtcggagtgtccatgtcagcgtccccgtcctgttcccagctgcctgtggaagatgacgtttatgtatgcgaataagtcacactgttaaccaagtctctcaggagtgtagtgatagctgccacactctggaatgatgtcagttaaacatattggaaaacatttgtttcaggggtgcagggaaagggggaggtttggggagcccaggcaggtgttttacctcacccagaggtgagtcccaatacccacgctgtctggggctactgtggattcatccgctctagtctgctgctctggtgcctcctactggtgccacacagatcctatccagggcttcacttggaatggacaggccatcagaaggccactggactgtgactctccgctgctgccacactggcatttctgttttcagcaacactcccgacagcaccgtaatgggcctgactcagaagacggttttttagtatgatgcagcctttcagaaagaaccaggcagagcctgggggaaagccagccccaaccctgtggagttgcgtagtgggcctggagccatggtgagggtctctggcacttgagagcctatatcctgggaagcacaaattttataacatgattacacaagatttccctataaaccgtgtgcttgaactggggaccagccaacagtaggagcaacctggcagttgggggaggttgggtgaacataaacaccacaccaaagatggggagggggtggccttgagcttggaacagacaggggatgtccagctctgctgagggctgtctgtgcctccacacaccctcatgcccattcacccacctgtgtcgccatgtgtcagaggattggagccccaatccacactggcccttaattagtagtgtgtgcatttttacagctcctttttaagaacccagacaggcacaaatataatacctgtggggaggggcagattctctctgtgtttagttaacagattatttgtaatgtatttttttagggatcttaaaattacctttgcactaaagtattttcatagctgtttctatatcttactcatttgttgatgcaccttctgatttttaaatatgtttttaaagctttcactttttaagtttaagaattttggccacttaaatgctggtgagcgtttcggctgaatgtctcagtgtctggcagcgacctctctgattctcctctgtgcctctctctttcttgatgtttccagagactgaccagctgagatgtgctgagggcacaccatctcctctgcttgctttgtcacagtcctctgtcacgtcacggtttctattttgattttgttttttatttccatccttcagccttaaacacctaaacaacatccttcctgcagggcctcgattctgcagccctcgccgggtgtggggacactctcctgcacccccacccctacccagcagctgaagtttacttaggaacttcccagattgaatgcacactccaatgtcctttaaaattgtgcttaggaaattaccaaatgaagttgcctgagaatttgaagtagacaagggcacaggtgaaatgcagagacagagaccaaacacgcgtgcagaaggccgtccgactcacctcacagtggctgcgtttgctttccttaaaacaaggaacttcaactcaaattaagcatcttcttttcttaattcagttgcacaaatgaacatctgtggcttactacattggcccagattcatggctccaccacctacaaatagttcatctcctgta

SEQ ID NO: 33333 - DNA, 1340 bp, Mus musculus
attcttcaagaccatgtaccagcctgctttctgacagccctgtgcagagatgttgccctctggagcatcaggctccttacacacacacaggcacacacacaggcacacacactaggaagggcactgggctatgtgagtgcacgctgtgctggactgagctctcccctcccagggaagcatacctcccagtcaggactttcccttgctccctcagtccagcaggcaggacccaggccaaccaaagctgcatgccatccaggcgcctgccccctgccacatgccagctagggaaacctaatgttcctccatcccagcgatccattcctgagcacaagcagaccaaaggccccacgcaggggaatggcacacccaaagctggaacagggtaacttttcagtgttcctactgagcacatttcccaggatcagcggccgaatgtcccgagtgtggcgtcatggccacccaggtcgctgtgcatcacccaggtgtctggtgttctggaggaagccccagcctgggtctctgaacccccaagttcaaggcatatctgcactgactggtactggactcacccatccatttatttcatcttaatgtagtttattggcaatgccatagaacactagccccttgcattctgcatttcttttggaagttacccattcatgactacaaacaggaaagcgtcacttggtgaatgcaatctttttgttttaaaacctagaagacgggtgaatggaaaggggagaggttctgatactgtgtctgaacaaagctttaatgaagatacgtatgttggaagtattatgaaagtgtgattctaattttgcagaaaaaaatgtctatcaatttatatagctttattttttaccttatcaagagatagagaattttaatatgcatatattgtctgacttagaatcatgtgtgtcagcattaccacttaaaatgtccacctactatgtcatgtatgagtaagagagaatcaaagatgtatctaacatgaatggttatctgtaactgtcattgtcataagaactgggattgatttaagttatcaaatatagtaagtacattaaacatgtcattctccaacactaatgtcggactgagagcccagtaagctgctttgaaacttgtaaattaaaccggatcaaacgtctcccgaggtttattttgcgtgctgctgatctgcctttgatttctgctggcagtcccactacactggatttttccacaggagatctgttttcttcccaacctgtgtggtagtgcataagatgcacacacactttctgccaaaagaagccatgccaggcaatggtggcacacgcctttaa

SEQ ID NO: 33334 - DNA, 1140 bp, Mus musculus
aggaaggcctggtcagccagggggtgtgtcctcctgggcagccagggggcgtgtcctccaccaaaagcagttggaaatcattgagagtcttgcatctgcataggtttcgttttcacaagaaatgtaaagtataatttaaaatattagccttcttttctacaatataaaggagactctctgttttttaaaagaacatcattaaattaggatatttttattatttttaaagaaaatgtataactccatgctgtcagtcatcctcagcaactcaggcactggctgcctctccacgtcagggcaggccccacttcccctctcctagccccgtccactctgccctacagcaggaggggctgcagctgagcttggggtgggggacggggatctgcagcctccattcaagtcacggcagaactgccacaaactgttgttttccgcttttttgtgtgtttcagaaacaaattctgttctttggaaactctctgtgcctagtagggcagatatttttatatgtgtgtatatatgttcacgtgtgtacataggatcttggtgtaaaggatgtatttatggtctcacgctgctgaacatgtgtcactttacggtccctccctgtctcctcaccctgctgccatgggaggccaccgaggctcgttcaccactgtatgtccaggaaaaacaccctcctcccctgccctatggcttgcaaagccattactggctacaccttcagagaatggtaataaaataaaaaacgtgcaaagactcagtagcatttctggttatgtgttatgcgggaagaatcgtgggacataactgcccagcctgttttgaaaaagccaccttcctttgggaacttgtcctcataaggacactttaaaatgtcatgtttttgccgggcatggtggctcatgcttttaatcccaacactcaggaagcagaggcaggcagatcttcttgagtttgaggccagcctgttctacgcagagagctccaagccagcaagagctacacacagtgaggcctcatctaaaaaccaaccaacaacaaatgtcacacctcattcagcattgctcttacttcctactgctctgatataagtaagaagttaaactcagaagtctttattgtgtgaatgaagtt

SEQ ID NO: 33335 - DNA, 1512 bp, Mus musculus
tgactgagactcagaagtgtaagcctctatccttgtctgtttcagggtcacattaaaggctacatctcccatcagcatcagaaactggtcgtcagcaagcagaaccctttccctccgctgtccacagtgtgctgatgcccaggccttgccaacagcgtgctcctgctaccgctgcccgctggagctcacatctcctggtgcagtcgccagcacctgaggcactcactgtggtttccagtgtcctaactcatgccagccttgccaagacctggagttctttttcaagatggaccaacaccctgctgctggcctgtggtgctcctgagcgtccgggaaggagacagctgggcttcggtttgtttatggaggctacctttgtgacatcttgtagggtttcctccctccctcctctctctctctctctctctctctttctctctctctctctctctttcttaaaaaggtaacccaagtttatacaagtggcacgagttctttactgtctgttatgtaacacatctgttttcatatgcaaaatgtcagcattgtgagctcggaatgctgggttaacttgaggcttctttttaaaagtagaatttagggggaggagagacggttcaggcgagaacagctactgctctgccagaggatgtgtgtttgattcctggcacccatatggcagctcacagcctctaactccagttctaggggacccattgccttcgttggcctccacgggctcctgcacacgtgtacaaaagctcactcaggcaaacaggcatgcatacataaataaatacacctttttttaagaaaagcaagagttagtctaatgtaaattccaacagttgtaaaggctgtgcagtactaagacaggacctggctgttgggctctggttatggccccttctgagcctttcctctgcctcgcttccgtttcctatagccactgtcctgtcgggccctcaccctgcagcttcatccagcttagccccttccagagacccttcctctagacagttagcctgggtgggcttcagcagagggttctgggcacagtgcatcccgcagcactgggtacggccagctctccctcttccttcctcctcctcttcctttttttaaataaatagtttatttattttatgtgcatttgtgttttgtccgcatgtatgtctgtttgaggggggtcagatcctggagttacaaatagctgtggatgttgggaattgaacccaagtcctctggaagagcagctagtgttccttaccactgagccagctctccagcccctaatactccaacttcttaagagtgtctgtttcctctgtgtgttgtttattttgttcacttgtctatcatctctgtatttctctgcctgcccgcccacccgcacatctgtccatccatttgtctgtctgaggtagggtctctttatatagcctggctggcctggaactctatgtagaccatgcttccacatgatgctattcttgcctctgtgtccccaga

SEQ ID NO: 33336 - DNA, 1151 bp, Mus musculus
gccttgaggtgttctcacatattagaaataaatcaagtctcagagtgtttcatgtcagtaggtgtgacagccatagcacacccttaatcccagtactcaggaggcagaggcaggaggatctctgagtatgaggctagactggtctatatagcaagttccagacagccacagctgcatagtgagactctgtctcaagaagaacaaagagaaaaatgttcctttcaaatgactattttgtgaaggacagtataccatacacacaaactggatattacaaaaagaagatggggctggagagatagctcagtggttaagagcaccaactgctcatccgaaggtcctgagttcaaatcccagcaaccacgtggtggctcacaaccatccgtaatgagatccgataccctcttctggtgcgtctgaagacaactacagtgtacttagatataataataaataaatcttttttaaaaaaagaaaagaaacaggctgaaaagaaaaagaagaagtgcacagtcatataaatgtaagtgtggactgactcgggatgagctgctggggagaactgacgtagaagacatgaaggtgctttaaggaaaaggagttgaggaaagtttctctgttctctgtcctcggtagagaacatttttgtttacatctcacacttgaatgagattctgacatgtgtacgagatttgaaaggggtttaattatgactggtgagactatattctttcaatgggtagaaatatttgatttttttttctgtaggctgtttaaagttgcttttttcgctggatggtggtggtgctcacctttaatcccggcacttgggaagcagaggtaggcagatctctgagttcgaggctagcctggtctacagagtgagagagttccaggacagccaggaaggactacacggagaaatcctgtctcaaaaagcaaacaaaagttgccttttcttcatcaaaatcaagaaaaaataagtgaattctacaacagtcagtaaataaacagggatcagcatagcctggtctgtgtcactcaggactcacaggtcttccacccacacagctggagtccgctatgcctgagcaagggctctgttccctcctgtcactgcccaggttcacatcagaaaatggccacgtgat

SEQ ID NO: 33337 - DNA, 1198 bp, Mus musculus
ggatccatcccataattagcctccaaacgatgacaccattgcatacactagcaagcgcttgctgaaaggaccctgatataactgtctcttgtgagactaggccggggtctagcaaacacataagtggatgctcacagtcagctattggatggatcacaggacccccaatggaggagctagagaaagtatccaaggagctaaagggatctgcaaccctataggtgcaacaacattatgaactaaccagtaccccaaagctcttgactctagctgcatatgtgtcaaaagatggcctagtcggccatcactggaaagagaggcccattggacttgcaaactttatatgccccagtacaggggaacgccagggccaaaaagggggagtgggtgggtaggggagtggggggggagggtatgggggacttttgggatagcattggaaatgtagttgagaaaaatacgtaataaaaaatatttttttttttaaaaaagggaattagtctggcaagtactgtaggcagggctgggcagaggccatcttgggtttgctgccatgccatctgtgactcatgcccacaaggacatcagtctgacctggcctcaggccagtttaagggcacaaactctgttgtgtataaaaacccatgttgacttctttggatgcatatattcatgtctaaaacaaatcccagagccctcgtatcaagattttctcctgattgaggaaatctctgtttttccctcctgtggaaacttggtccttgcatctgtgcagaccttgttaattcagagtgcctagtaatgttgctggacacagcctctgtggtcgtggtgagagacctgcacagagcctgtgtgcctgcttcccacagcgggttgtcaggccatcctgagttctgctacatggcttcaatcaggatgaactaaagactgcaagattatacaagatgatggtgatgggatccctggaggacctgctggcatgtatcttccctcaggaggtagctgtgaagcatacggagcctctgccccattcagagcacaggaggagcctgagcctgggccggccagggacacgggcacccagcacggttttgctgcaaatggctttctgattacctgctttaatcacccgcctgccagttaatcccactctgggggttgacctatgcgttcccacattcagcaagcctttgtt

SEQ ID NO: 33338 - DNA, 2041 bp, Mus musculus
ggattgctgcaagtttgaatccaacctgggctacttagtgagttcatggacaatagctcagactctgagcaggagcagcacgagggccctgagggtaaggcaggtaaggcacctgatagcaaagcctgatagcccaagctcagtcactgagacccagaggaggaaggagggaaccaagtcctacggttggtctatgccatgtgcccacgctcttacacacaaaaggaagagtatgaatatataatagcagcaaagtaagaatgccccagcaaagcatgatcagattttccttctaaatatgtgagagcatgcaacatagagtctgtttgcatgctcatgtgaggagaagccaggggttgtgtgtgtgtgtgtgtgtgtgtacacgtctgttgtagcattgcatatttttgttacatgttccatacagaatgttgggtctgtgtttctaggttcagtgccctatcctaaaatgtctgatttctcttttctagcctggagatttgaaaaaaaggattgagtcacttatagacagagactatatggaacgagacaaagacagtccaaatcagtaccactacgtggcatgacgcaccagctgactgtcgtctcccagtgagacacacacacgaagcacctgagagtgaagctgctgtgccgtctccaggtccctgcagctgccccgactgtggacgcttggattcggagcagaggatgtggttcttggctcatccttcccagggcgcaagggctttgagatgacacccatcttccctccctgcttcttcccctacttctttattgtttctgttactctctaacttcgcattgagaagttccttcacaagctctcgttcctctggcagaaagccacgggcttggtttgttgtgtgtgtgattgtgggacacagtggaattaccctagctgctgtgttcttcccctcatgaagactcagagagaaagagagagccctgggctggggcactggggagaaactgtccaggctgccactcggatctctgcaccctgagcattggcctctcttctgtgtattttcagaaagttggaaactttggcttctgtaaatcaggtttctaaatgaggtccctgatgtgccaagaggacatcatgtctgtcatgagacacagctcacccagagggctgcttgtcgtttgttgaggggcttgggggtttcatgtttgtttccatgctggttgagtgtggaggtcctggttttggctttggggtgactgctgtttgactgttgaagttgcagtttgtgtgattaccataataaaatcgggcctggttttatagtcttgcacagagaccgtcttggatctctgccctggcactatatggagtttagttatgtttgtcaaaaggcaaaggaattgttggttcctggagacatactgtgtgtacaggtgggttgggcagcgagaacgaggctccatagtggtgttggcatggtgatgatgacagacacttttgcaacatttaaaagtactttatattttacaaagtagcatgtttcattttgattaaaagctaccaaaggaattttgatcatgtataagtgtttaaagcaatattttctggaatataccaagtttatataactcgattttatgctaaattattaaaggattctccctttttgaaacatgcatgtttaagatacaacatctttttgggcccccatattaaaaccctttctctttaagtatcatttctatatttgtacattttcatttatgagttctatgatgtggtctctgaaagaccaaatagatttctatttctacttcttatttttaagttcattgtgtctacaaattgttaatattgtaatttaatgtagacttactttgaataaaactagtttaattggcctttaaattactttactaatacattggctatgtagatgacactctcctcctgacggctcagcagcttttgacaggtagcaaatcagacaaaagaaaggaacccggtcaccctcacaggactgccccttctctttcctccactacaggc

SEQ ID NO: 33339 - DNA, 1193 bp, Mus musculus
tgcctcctgcacattggaattaaggtgtgcacacaatgagtgggaagcacgtttaaccctgactctgccaggtctctcacactggattcacttgtcagcctgtttctgttagtagtgagaatgcagtgagctgtctactggtttgtcaaactgaatactttttagaacactgtacccatatctaccacagccacagttagtatttcagaatagtcagaaagtctgagaagatggaacttctgactaccccgtttgaagtcatgcacattgtttgcatgcattgagttatagtccagtagctttgtacggatgctgcaccaagtaagagtctctgtgaatggctactttaagattgactggaagctcagtttctgtcattgcgtgcaggtaactctttggcagtgtctccttagcataccttctcatggctttgcattggaattgtatttgttctagatcgtgaacatttccctgccagcctctgcagaagtactgaaaaatggcagttcttgtggtaaagaaaatgtttctgaccccagcctcacaattacttttggaagaggatatttactgacactcaacttcacaaaaaatacaacacgttacagtgtccagcatatgtattttacatataacttgtcagatacagaacattttcccaatgccatcagcaaaggtaagacttctgtaaaaaatgcaaatctgaagggaagggtaaagaacttgcctttccgagagccacacgagtgtccactatgtcccctgcctttctgagtcattgctttctttttgtcttttctgtcccttttagatgcttgccagagcctgagtatgctttctctggtactcaggcttttccactggccactgtgtggctggctgcatgctggcatgtgcacatggcatggaattttctcttcctctctcagtcctgagatttacagctcacctgtcatgacatttttctttttaaactcccaataaaactgttgttaagcttcacaacaaacaaaagaatatgagatggtggtattcagtcactcttaacttaggtactgtgaacacattgtgttttgttttcttttgttgattgattgggatacagagatctacaccatggattccacaactgacatcaaggcagacatcaacaaagcataccggtgtgtcagtgatatccgggtctacatgaa

SEQ ID NO: 33340 - DNA, 1181 bp, Mus musculus
aaccaaacaccaagtcttaaaagtcaaatcagtggagccttctcatcctctttagagctctactttggtaacatattaacatttaaccagttagcaaaatatttaacccagttagcaaaattaacaccgtcatttcaatagttattcctttgtgcatagtaaatgttgcaagatgaacttcacatttgataaagcagattttaaaacagtttgccagaaagtgtgcctcccttccacacctatctaagcttggggatgtgagaacaggcccctgtgcatctctggtgcacctgcccaccaggctagatggtctgatagccggcgtgactcctcttcctgccaatgaggtaggcaatgaggacgatgaggaccagccctgccagggcaccgcccacagcaatggggatcaacatgttgttaccatcctgaacacactcttccactgcaagaaagacaagccaggggattcactccagggcaccccctcaaggtccaattgttcctccccagcccaaggggaaaggatgaggccaggctagagactttgggacatctatagactatagacatgagtgttttctatgcagctggggaatcccaggtatgctccgcccaggttagaatgaatggtgctgaccactggaccattggtcagctttcagaaagagccactgactgtcattttctgcaatctctttcctcagccaggacacccttacctcacatacccattcctgcagttccttccttacaaagggaagtctcaagctgggaagaaaccctgtctttgcagaggaaaagggtgtttgctccctgcccatatatccctgtccctcaggaagttctatgatgcctctgctgccgacccccccccccccccattactctggatgctgcctctgctacttaccagacccaaacctgtcactgtccaccttgaaagcctggacctgcacactgaagacattgagggagagcatcttgctgacaaagatgtgttcctcagtgttgcacttgtatgagtttcccacagtggcctgaagagctttcagtgaatggttggagatgctgaatgtgggcactgcaatgggagagagagtctgctcaagcacaggctacagtgggtgaggagcatgggaaccgatgggaggaggaagccagtctcacctagggcatcagga

SEQ ID NO: 33341 - DNA, 1820 bp, Mus musculus
taatgggggggggggggggtcggcagcagaggcatcatagaacttcctgagggacagggatatatgggcagggagcaaacacccttttcctctgcaaagacagggtttcttcccagcttgagacttccctttgtaaggaaggaactgcaggaatgggtatgtgaggtaagggtgtcctggctgaggaaagagattgcagaaaatgacagtcagtggctctttctgaaagctgaccaatggtccagtggtcagcaccattcattctaacctgggcggagcatacctgggattccccagctgcatagaaaacactcatgtctatagtctatagatgtcccaaagtctctagcctggcctcatcctttccccttgggctggggaggaacaattggaccttgagggggtgccctggagtgaatcccctggcttgtctttcttgcagtggaagagtgtgttcaggatggtaacaacatgttgatccccattgctgtgggcggtgccctggcagggctggtcctcatcgtcctcattgcctacctcattggcaggaagaggagtcacgccggctatcagaccatctagcctggtgggcaggtgcaccagagatgcacaggggcctgttctcacatccccaagcttagataggtgtggaagggaggcacactttctggcaaactgttttaaaatctgctttatcaaatgtgaagttcatcttgcaacatttactatgcacaaaggaataactattgaaatgacggtgttaattttgctaactgggttaaatattttgctaactggttaaatgttaatatgttaccaaagtagagctctaaagaggatgagaaggctccactgatttgacttttaagacttggtgtttggttcttcattcttttactcagatttaagccttacaaagggaatctctggtccagacccttgggcctggcaagggtggctgatggttaggctgcacacttaagaagcaaacgggagcagggaaggcttgccacacaggcacgcacagggtcaacctctggacacttggcttgggctacctggcctgggggggctgaactctggcatctggctgggtacacacccccccatatttctgtgctctgccacccgtgagctgccactttcctaaatagaaaatggcattatttttatttacttttttgtaaagtgatttccagtcttgtgttggcgttcagggtggccctgtctctgcactgtgtacaataatagattcacactgctgacgtgtcttgcagcgtaggtgggttgtacactgggcatcagctcacgtaatgcattgcctgtaacgatgctaataaaaagtctccttctttgtctgtctggacgtgtccttctgtgacccatcaagagagccctcatgtgcacaaggtatgggacaatgtcgggataacccggcttctagtcagcctatgaaaagactaaatgttgttttgttaaggaaatgttgcttgtcatggctctaaatgttaggagacttacataatttgttgttttgatgagtcttaggtgatgagaatatggccatgtgactagtctccagaagcactgcacctatgtcacaagaaccttatacacattaaacatgaggtgacttgaagaggccagtgctcactgtttccttgaagctctgatctgtccacctccttatgtccatagcagactgggacaagccaggctcctctgcagtatctcctctgcttgctggtgggatttgtaaagacttgggagcatccaccatcttcaagtgttccatctatcctgtaggccagctccctcct

SEQ ID NO: 33342 - DNA, 1167 bp, Mus musculus
aaattgtttttcttccagaaaatcttttcagaaccaggaagcctgtccatgacgaccatcaccaggcttcggaagagctgccgagcagcgctgcaggcacagagctgagtgcacaggcgcccacagctgcagttctcttcagagcacacacttcaccaattcctaccacaacgttcctgctgtaaatacttgaaatcacgacactcaatgtgaacttttaaaagaatgacttaaaattagtgttctccattttttcctacctttggagtcataaactgaattctctggcccagcttcatgatcttagttgggtcccaggacccataagtggaagcagagaacacttgttcaaatggtcattttgagacacacacacactcgcgcattcaaaaaaatcttattttgacactaggaatatgaggtacttgttgaggagagcaacaagtttcctagtgttagaagttaagtgtctgccacgtgtgaccttggcttctcaggcgaataagatccccagcgccctcccaggacattctcctagcctgtgcctatgcagacctgtgccctatgggggttaagcgggacacagtagcctacttctgagcatggtcacttgtgatgatccccggctttctcagaatggcccttataggtagggccctgtcctctggctgctcacccctaatgtccttacatacccagcacagcctataaggccatcactgatatcccctggtgaaggctattcatgaagctggagggcaggcctcattcactggcagtaagccctgagccccttaccttgcagcttcctttctggtttttcaaagctgtagccttagctgggaggcatgatgtactagctccgcccaggagtggatgggctcagagctgcacccacactactgtccagatgtcccccaaggtcgtttgtaccttaaaggtgtacctggagatggctttcctcaggactacctggtgtcacctgccaaggagaatgctggggccccagggagatggaattcagtcccactgagatctcatggtcagtctgagtgcagagattcaaggaacaaagctcccttcagctcagtcctccctttcagagggctgatgtgagctgctcctgcttccagtcagaccaggaaggtagagcctgcaaccctgcca

SEQ ID NO: 33343 - DNA, 1148 bp, Mus musculus
agacttggaagcatctgccttgttctgggccaggcagggttgctgtggttgagcctggtgtgcggctgtgaccaaaggaatagatagcctggggctcgggccatgcatggctctgacccagtctatgcacactggcctagtgtccaagggtggttctgcagtggtgtggcttccacaggagatgggaaggaacgtggaggtgtggcgggttaatgcagtctttcccctggagaccggctcagctccttggagttcagagcatgggtttaatatctctatttttggaagctgttctaagcttccaagcaaggccaaggtcacgaaatgctcctctgcaaatctctgctgtccctgctcagctcctgtccctcttctgagctgatgatagagctggggacactggctgtctcttcacacacctctcccagataaacaagatgtgcagagttaggaaggagagcgaggcgtgcaatcctagtgtgtaatccccgtgtttaggaggttaccgcaagagagtcgcagcctgtaggtcaacctgggatctcagagagctgccagggcccagaaacacccgaataagcaaacaacgaaacaagaacagcaaactgtgaaaggctcccaagaggcagactcaaagcaagtgtgcaagaggacagcgttttcggttttccctcttttcttttcttcccttccttccttgcttccttgtttgtttgtttttgagataggctgccttgtaaccccatggtggtagaatgatcccgtttcacccagatgtccagtgagtgtagcctgctcctcctgcagcagggtgcctgttttgcattcacttcttgatgtataattagtgtaccatggttttctgttttattacggactgggtgattttttttttgtagtgtaaatcaagcactgacatttataacaacacatcgcactaacaacttaaaaaatttagtcaggccagtaagatggcctggtgggtggagcctcgtctcgtcaccaattcataaccaggacccacccactttgttgagcagaggccatcaagttgccctccgctgtccgcatgtatggctccacagcccacatgctcctccttgcccactgaataaaaagttgtaattaaaaaaaaaaaaaaaaaacaa

SEQ ID NO: 33344 - DNA, 1160 bp, Mus musculus
gaggtgagaatcccagttgtggggttcctgaggatgccatgcaactgtgggaattgagtgggttataatcctggaggttgggacagcagatgggagatggagccctaaagcaccctggcttcactactctctattgtcggatgctcacgtgccttgctgtggtctgcagattgagtgcagtccctggaagatgtagaaactgaaagccaggccttatgattcacatagaaatacagaaggctgtgcatagctctgtctatagtgaaggagaggtacagaggggaggccagcagccatgagggatgaagtgagactacttaccagttgctctagtgttctcagtagatttgggccacatgacatcagcagcgtgtgtgatgacccacatagaacatgacccacatcttacctttcttctgcactccagcttcaccctatgatacccactgagcatgctgacagctcgctagttctgactccctggcctgctgttcccacttgatggtccatccttattaaggcaagctcccatctgacccatttccatattcccccacctcacctggctactgtgtgctcaccctccatatcctgccatctggggtcactgagtgtttgtttgtttgtttgtttgtttgagatgggctctctttatatagtcctggctgtcctggaactcaatatgtaaacagactggcctcaaactcaaagagatcctgcctgcctctgcctcttgagtgctaggattaaaggtatatgctaccacacccagcaaatatctaaattttggagtggcttttgcatattatttttttacgatttaccttgtttttcattatgtgcatgtgtctgtgtgggtgtctgcacatagtgctggtgcccttgagaccagagatgtcatatactcctgcagctggagttggttgtgagccacccagtgtaggtgctggtgaccaaaccaggtcttttgcaagagtagtacatgctcttaattgctgactcatctttccagccctagaataggctgttaaacccagatctctgccagtgtgttattgaacagaaacacctgcttcatgatcctcgaatcaggttactaagtccacgtgtgtttgcttcagttctttgtgctaaattcatcaagggaattcaagttcatt

SEQ ID NO: 33345 - DNA, 1134 bp, Mus musculus
ttccctgagcggttgttttctcttgatggcattctccgttcaagctctttctttcaagtgagtttttagttaaagggtgtgtgcgtgcacacacacatgtgatttcatgcgaacagataggacaactttatggagttgtctctctccttgtgtctttgtgtggattctgggggctgaagtcaggttgctagacctgctttcacctgcccaaccaaccaccttaccatctgggcttagtatttgtgtcagttggacctttctgtaagtgactcttgccctaaaagcatgctggtctttcttttctttctttttttcaggtttttctagacatggtttctctgtttagtcctggctgtcctggaactcactctgtagaccagggtgaccttgaactcagatctgcctgcctctgcctcccaagtgctgggagccctgaaggcctgtggcgcccagccctaaaggtgcttatcttgccttgatgggtgtgaagtttgagatttcccctcagttgtagatgctttgtctgtatcttccttgtgtgcagctttgagctcatgcttgcacctttatctgtatgctttgttttaccatctaagagtgcagtaagcagtagcggtgtcactgcctggatgctgcgctgtcttaatcaccagacaacttagcccgttccttttaaaattagcctcacttccattttaagggcatgggcagaatacggccagattatttcccagatggtaacacaagtggcctctagcccagttcccaataaaacctttgtcccctctggaacttcaggagccgagccttcagtccacgtttccattgacattctggtcttttccgatgcttgtcagaacagcttagaagttttgcttggaaccttccaggattcctttacgccacaggcctgcagatcatggatcacgtttcctgcagcagtacccgtgcctcagtttccctcatcagtcatgttttccatcaccatgacaagagcgagcgaccagcaaaggtttattttggccatcacgatggtgaaggtgtgctggaggcgactgtggtgtccacagccagagcagagatgagtgcggtgtcagccggctgccttctctgttcctttgtatttaacgtgag

SEQ ID NO: 33346 - DNA, 1146 bp, Mus musculus
gcctacctgtttgagacgttgatgttcttttagatgtacgggtgtctgagctgtgtggggtagtgccacagcagagcagcgtgcttctctgttgctctctcactgtggctgacaaggcagaaggaagcggtggtactgtgatggagacacgtctgattgttctgaattctcttttgactgtaggtgattggcacgcctcagagaccggcagcatccaacactattgtggtaggaagcccacacactcccaacacgcattttgtgtcacagaaccagacgtctgactcctcaccttggtctgctgggtgagcacccccaccccagtttggcagctgctgagaatgtcccctttgtcctctggccatgtgtcacatggtctgtagtgggggtccctgagcagagagagcgcagggctcccatctcacctctgactgggccacagagaacaccggtcactaatacgacacaaacgcttagaaagtgtcagaagatctgatctctaccaggtccaacaccagggctctatcccatgcatggtctgtccctccgaggcagtactgccactgagactgtagcagacgtggaagtgactgactctctttaaagatcaccagtgtgtcacattttaaaaactgttgtgaaaccctgtctcccttgcttcaatttaaaatcatctgtgccccaaactctgcagagaaacgtagtgactgttcccagtgtgacttagtgagggcgacacagttgctgtgcctcccgacctgaagcttgcaccatggttcccatttgacacatgtccatcaatctaagcatctgccttatgtcatggtagcttgccaaaattacccctggaaattcctaagtttacactaaaatgtgccgtgctctgatgccagcagacgcctttagaacagtggtgcctagtgtgtggtccggatcagacccatgctgatttctgcccttcggatgtctgtccatcttccctgacatttaaaggcacaggtgtgtgaactggcctcatacatgttcttttctgacctgagaaacattgatacttgccaatgtccttgatatattagggcggagtccctgctgcctatggtggggctgtgggaaaaatgggcctctgcagcctaggccttctctgaa

SEQ ID NO: 33347 - DNA, 1848 bp, Mus musculus
ttcttggtctggacagagcaggcttccccactgactggcctgtctttgcagtgatttgagcaatggtgcagatgggatgctggccacgagctccaatgggtctcagtacagcggctccagggtcgagacccctgtgtcctacgttggggaggatgatgacgacgatgatgactttaatgagaacgacgaggaggattgattactcaacccgtagacccctctccccttcgaatcagcttcaggaaaaacacgtatagaggaaagaaacttaaagtggggctttctgttctttttggcctactcccaagaagatacccgcgagttctggagttagatgtgcagctccaagtgaggaggagtgtgcgcagtttgagcctagctgcggatgtgttgtgaagccagcgtgctaatgcagagcctctatctaccttttaggattttatggtttctctcttttctctcttttttttccttttctttcttttttgagtttgaagcttattttgcccctcaacagttgttgctgggtttgccgaggaaactgtactgcgcccacaccagtgacaatgacaaagtgctgccctgcctccgatgtccagcacccaggtggtggacagccaggctttaggatgaagttttccatttgttaaatcatgcagtgtccaaagaaccaagccagtagcacagctctactgtttaacaagcgccatatgtcttattatgactccttccttaaattatattgactgtcgtaattccatcgtgtctggacaccttttctctattgcagcaacaaattgcgaagtagattttgtttgtttgttttctttttgtttggaagaagtttactgccacgctggtgcagctatggaaattgtttagaaagtttgcttatggtaaatttgcctgatttcttacaggctacgtttggaaactttttattatatagttgtttacatacttataagtctatcatttaaagacgtgtactgaaacaaatgttgtatttgtttcatgagcatcttcctgtaatctattataaagttgaaattaaacatagagaatgttttaacagttttttaactcaaaatttgtcaatcatttttaatagttctttttttataaaaagaaaaaggaatttaaggacaggcaatagtctcttaaaatttattcacaagaacccattaactgcacagttgcccttagctgcctgttctaaaatgatggtctttttattgaaacacaaataaacttttctgtaatattttatggaatataaagagactttaattgtttgacttgtttaactaagcactgttagtttttattaataaaacgcgcatgggcattttaaacaagctctgtgtttctgtaactcaggactgtattccacggttactccggattgccctaaggtaaaaggtggatgctggcccgggagcagagtccccgcatgtctaatagttcttgctctgttggccataactgggcaagacgtgggaaaggagggtgaagcaggcgtgggatcttgagtgccaagtacagaagccggctctttgactttttccctctctcctgaaagttgaggcacactttgtaggtttggctttcaggaaagctgtaacactgagcattctgggaaaatgagtgggtagaccagtagtctgtttgctccttgacatctgtgctggtagaatctgccagacacaattacttaggaactgtttgaggtaggtacctaacactggagctgcattgtggcttcagcatcactagatttccaggaacttaagggttggcatagtctttccctccatttttctctcccattttgggaatccagacact

SEQ ID NO: 33348 - DNA, 1099 bp, Mus musculus
gagatggtgtcagacctaactggcaaatacaacaatacagttctcaggtctgaggaacgggagaaaaagatctgagggatgtgccacaaacacccatatttgcagaggagaaagcgcagggggtgtggtaagacagcagctgaagactcgccatgcttgtgtaaaggccacctgactgcgcatccacaaaacaaattggagtcaacgagggtgtgcacattttcacgaggcttctgaaaggtactgttgaaagccaaagagggagacatcatgtgtgtgcacttagcatccagagttgtcatctgtggggccaggagacagtacgcccaaaccttcagaacaccagaaagggtgagaggggcccatccatgaagaaccctagtggggaagctattgaagaaagtcctttaaaactggtggggatggtcaagcctagctcctcacggtcgatggcttctgctaggatgggcgtgtgtggggagaacagagatttctaagaactagctgctgggagtttgaccatcctccagtgagtatatgggcagcacaaattggacttggtatgttttatggacgcacgtgctcaggatgcattgcatgaaattcccaaataataagaatactgtgttgcgggggaaccctgttaggcaggccagatgcctcagagtataatgtccttgtgtgagcttggtggcctgagttcaatccctgggacccatctagagaactgacagagttgtcctctgaccacgtgtgttctttccctttacaactacatgtataataagttttaaaggcttcaagaactgattttcaatttcatatactaggctaggccacagagttacgaccatgcttcaatttggactccctctcctaaaaaaaaattagccgggcgtggtggcgcacacctttaatcgaagcactcgggaggcagaggcaggcagatttctgagttcgaggccagcctggtctacaaagtgagttccaggacagccagggctataaagagaaaccctgtttcgaaaaaaaaacaaaaaacaaaaaaaattaaaggagagatgaaatcatccccaaatcaaagatgaggggatttgta

SEQ ID NO: 33349 - DNA, 1113 bp, Mus musculus
gtcccccttcacaaaggcacgcctggttcgttcatgccagggcgcaccttcttcagtgtgcactcttgtcccttgcctgctggtctctgtggctccgtacacatgtagcagtctggccctagccttagacgtacacgcaatcctgccgttcgttccacggaatccctgtctgaaacgtgagaagcagtattccctggcagccagcaggcaggcagcctttctcctgagcttatgttggtttgttcctggctaaagggtcatttttgtggctgggatggacaggatggtacagaaactcctttatcttagaggacatgggggtccttttcttagagtccctggagagggagggctgtgagcccagtcttctctgggtgaccatcacccctcagttcaaacacaggtctggatgttggataaggtttcaaactagaatccacaggcttgctgcctcgatgaaagtctgggaaagatttttaaaggctgtgcatttttcaagctgtctttcttaatgtttttaaaggactgtttttaaatagcattttgatataaggcagtgtggaataccagcatctatgtgcattaggggggtgacccagggaaatccaaagggaacagtatttgatttctcacaaagccaaagggtcctcggggacatagctctgagatggagcctgcaccggcagcaataaaggccaaacgtggtattccacatgcctgtgtctctgtgagcccaacaggccacacatgccaatgtctggaaccacttttgattggggtgggagggtcctgaaacagacaagacagactgtaccagcttagcccccacagtactgctggagccttatgccaaactgcatttccagaggctgagagaggggcactctatgggcagatgttgctgaaggacacaaccacacattctggtacccttttctcttcattcttgttgggaggtttaatctgtatctagaacccatagtagcagaggatggaaacaaaagtcagtttggacacagcaggccccttgtactgaacttctttttaacttggatttgtaacttaatgtttctgtttataagatactaacgatttgcaatgtattttaatggg

SEQ ID NO: 33350 - DNA, 1151 bp, Mus musculus
agcatcgcacactaaatggtcaaagcagagccatccccttggccgttactcgtagcccgaattccagatccagccctgattattattgtcattactaattctagataagttctctgtgtaagtcaggctggctttgaactcactgtgtagctgaggagactctgaacttatgatccccctgcctccacctcctggatgctgtggtcacgggcctcagtcatcacgatgtgttaatatggtgctaggaatcgagctttgtgcgtggggcaaacatgagaggtcatcaggcctcctctgcctgttgtgttccaggtgcttgacaatctgaactgtcagctgtaaagggtgttatatttccaacctgtcgcagagtgtaaactccccagaacgtcttgctgaggttggaagacaggttggaccaccacagtgaactgagcactgttgtaggacggtgggggacggggggttgcattgtccatatttttttgagagtataaaggaaactcttaagagcctaggttactgccctgtatatctagcttcctgccgcgtgacattaggacaagaagccttggggcctgcagggtcatgaacagtttagagatggaagaagctacctccactcacaggttcctgccttctcctgagaaaccagcctctgccgcagctcagtatggccttggggcaactttccagtctagaaactctcagctccgattctcaggggtgggcaaggggtacggtccttcccggactgggatgccaggctgtgtgctcccagctgcctggccgaggagtctgacgtcactcgttcccatctgactgcaggtgaccagaccctgcagctacagcaaaaagtcccactttgactttgaggaagaggacgtggacaaacttgaaatccggtgagtgtcttacagaaagtgatagcatccaagcagtgaaggtcagtcacttaaacgggttccaaactatggagattgccccggcacatcacagcaacagccgcctgggggtctcattccagtcctagtttttacaccccctgtacttgctacctgcaaaggtctaggattagttttagaaacagccatgggacaaggcgatcctcctcctccctctcctccttcccttcctcctcctctctcttc

SEQ ID NO: 33351 - DNA, 1164 bp, Mus musculus
tgtgtgtgtgtaggccagagcggatgtcaggatatttccagtcagttttccacagatcctctcgaactttgctgtttgagctgcactggctggccagtgagcctccagcatctacccagcagctccttagtgctaggattccaggccttggccatgtgcagcttttacatgggtgctgggcctggagtgtaggacctcacgattgcacagcaattgcattgcatccagctctaatttaaaaatcaataactgtttattaacagtagcgtgtgccacaatagattatgtaaaaatatgaaaatgcttcctaagttctgtcttctaaacgtgtatgtgacatccttgttactatggaagtctgtgatgaaaacataccgatgagaattattagaaccggatgttaataatgtttccaggggcccctgagcacctggtgtaaagtccccacgtcttaggcacagcacgcaccgcttcctcctttgctttgctagtgctcagttcatgtatgcatttttctgttgcagtataataagcccagtgaaacggtcattcccgagtcagtggacggcttgcaggagaatctggacgtggtagtgtctttagctgagagacactattacaactgtgattttaagatgtgctacaagcttacttctacgtaagtatacttgctggttttgtgtcagaatgtgcacttcggtctgtgctgtctaattcacagacacattctccaacagtcttttattaattggtggtgattgaagttacctttaccgattgtagagtattgagcaggttgctgtattaaaagagcaggttacaggcaccaagttatcgatatgtgtagctcactacggttacttgggaagaagctacatgtctgccttccatccactgatgtgggactgacagttcctggaacagaggggcttacacataaacgagcaatgacaaggcaaaagatagatctgtctccagccaccaagagcctgttggcctctaacacaccacagtccaggtttcagcttcctgaaggtcctcctctttccaaagtgtgactcaagtaaacccaagaggtgatagcttgaaataccaatttggcccatggttttgtaaaatttcccattgagtactgctagatctaaggcagtcctgtgaccaggt

SEQ ID NO: 33352 - DNA, 1099 bp, Mus musculus
tgtggccctgctagttcttgcctccaaactcctacttgaatttcttctctgatttccctcactgagggatgtgaccagagagctagaagaggaactaaatctcttcctcccacaagttgcttttggtcagtgttcagagtgtaatgagttgtggaaacatgaaagataccattgaaagaagagagacattatgaagtatcagagggataccagggatgttcttgtgatatttggattaagaatctacctttattgggacaaataatgatggttagctggggatgaagaatcagttgtgattaataagaccagcatcatcaaagtgcaattttctggatatacttcctaaaggtcagcacacagacactgcagtccagatgcagtcaaggctatctcaagcaggaaacctgacttggtaatgtgtaccccacatagtggaactgattgtgtaggcatgaacgctgcaagatttaagaggtcacagaaatgagctgagattgaaactggaaagagccaggagaggcagtagaaactccagcatgctggagatgctaggactgcaggaccatgtcaggtgaggagtggagcctacttaagcctaccagacaagctgtgagttgtggatggcagagccagcctgagacatggagctgcccaagtcccctggagcccggaagatcatgagtaagtcccagacattagattataaattatttacattactggattttgcttttgttttgatccacttttaactgtgctttggttctttcttccctcttggaataactacttgattctgagactatagttacaagactggatattgttagtgtcactgaactttaacaagtttttaaagatggaaactttgaaggttatactttatattgttgtattaacatcttgatgataaacaaggaaaggttactgtttaatggtgatgtatgtgtcaagttaagaggtcaccccagttggttagtttttgtgaacttgaaacaaactagtcacctggactagtttccatcagactgacccacagggcaggtttctgattaatgactgatgtggaagggttcaaccatctgtgggcagtgcc

SEQ ID NO: 33353 - DNA, 1177 bp, Mus musculus
ggttggatttccaacacccagatggcaacatatagccattgctaactccagtcgcaggggatccagcgccctctcctagcctttgtgtatattacacacgtgatgcacagacaggcatgcaggccgaatattcatacacataacagaacacacagcccttttcccaatgcctgccatcccttacgtgtcctgctcacctgcctagcatctcacatacagttagttggtttgttggtttccacatgaattcccttcccgatttcctcccccacgtccacagtggatctatattttcctcttgtagtggcagaaaagagatgtttaaaattgagtatatggggaataaagagaccagagtctggagctctgtaggaacagaacgtaagctcacgggattggagagatgtaagaagccctgtgctgagacctgacacctgactccgcccgggacacacacacacacacacacacacacacacactcctctcattgctctgaccacagtgctggtgagtgccagggagaagcaagggtctgaccgagagctctggctccgcagggaaggctgttgtaatatactgggcatgttttagaagtcaaatatggacagaaaggaggaggatggactgattagtgtgggggctcaggggcagaaagaactaaagaccaggcttaaggtgagcaagcgtgtgttaactgtggcttccaggagttccaactggaccagcctaggattagctctgagacttggcacttcatggcctcagcaaacatcatcaccttgttgagccttgtaaacttttatgacaggtaattaggaggggaggagggataagtcagtgctactaaactttatcttggggtcctttgttttcctagtctgatagccaaagtgtctctttaaaataaattcatttctgccagactgcttacatccatgagcacagcacctgccacgacgcgtgggcgccctgagcatgcccactctccctaaggctgagtcccgtttggtctctagccaggtgtcaaaggtcctcagtgccaacttgcagcaatatccaggattcttcccagcccgttcactatgaggtcttaaaggtctgtcgggcggcccatccccaccgtctcaccgtgtgctcacattggagggctgtggggctgctccctctggggaaac

SEQ ID NO: 33354 - DNA, 1104 bp, Mus musculus
tgtacgccaatgtgtactatcacatcacggccagacacgcagcctcggacaagtggagtgagcagccgaaagagcagccgagcaaagacaccgagtctgggaaaagcccttcccctcctgagcggcagaacccagcctttgacccagcagaggcgaggcccactccagccctccccatggaagcacagaaaacgagcccgagcttgtgtccagagtcacaggcttctggtcctccagttctggagcctcagggcgctggtcctcttatttcgcccgagccccaagccccttgtcttcctgctgaggcctcaaaagctgctcctgttccttgccctgagcgtgtagacccaccctgtgagcttcctgagctggagaagcctgagcgaggcccttctcctgagtcagtcaagtctgctcttgtcagctccaaacccccaaagcactcttcctttgcagacacaggggctgccccttcagctttgtctccagagtcaccagtactggccacttcccctgaaccttggggaccatccctcagtgcatctccagagtctcggaagccagcgaggactgcctcccctgagccaaggaagccatccccagcagagtctcctgaactttggaagccattccctgccatcgcttcagagcctcggagaccaaccccagcagtgtcgccaggttcctggaagccagggccgcctggttctcctaggccttggaaatccagtccttcagcaacatcaggaccgtggaagtcatctaaacctgttcaacctatgtctcctggaccttggaaaccaataccttctgtatcacctgggccttggaaacctgccccatctatgtccactgcatcctggaagtcttcagtctcatctggttcctggaaaacaccacccacatctccagagtcatggaagtctggcccacctgaactccggaagacagcccttcccttgtctcctgagcactggaaggcagtgcctcccgtgtctcctgagctccgcagaccaggcccaccactttccccagagatccgaagtccagcaggttctccagagctcaagaagccttcaagctcaccagacctttggaaggttt

SEQ ID NO: 33355 - DNA, 2193 bp, Mus musculus
accgaggagaaggaggccttcatctctgaggaggagatcgcaaagtacatgaagcgtgggaaagggaaatactactgcaaaatctgttgctgtcgggccatgaaaaagggcgctgtcttgcaccacttggttaataagcacaatgtccacagtccatataagtgcacaatttgtggaaaagcgtttcttttggagtctcttcttaaaaaccacgtagcagcccacgggcagagtttacttaaatgtccacgctgtaattttgaatcaaatttcccaagaggctttaagaaacacttaactcactgtcagagccggcataatgaagaggtgaataagaagctgatggaagccctggagtcgccattggaggagcagcagatttgatcttcagacagtggcccttgctctacagtgttgcttgccagactcttaggttgttgagtagcctagatggaccagtagccagtatgtgtgtagtggtgtatcctggtctgtaagtagtgttacaaaaaataagtacttggttattttttcatatgatccgttgtttatgtggatggctattttataagtcttaatacatttctgttatagattccagatggatataactcattttccttaagttttatttttgttataatacaaggagtgggggaaaataggcaggccatttaataaacaagtaagtttaaacctaatcagagtctttgtcctccaccatgtgtgtgtgtgtaactgatttcagaacatagaacttattagatgagggctcagtggtagagcctcgactagcatgttttgcatacttatcagttccagggttctatccccaatacctttaaaaaaaaaaagtggaatgtatgagaattgagcatgaaaagtaaatttgagaaaaattttgttaaatgtacttttgaaacatgtcttatatcttattttttcatgtaaaattagtttataagtctttaatactttcatgatgatcattaatgctgttacagagcggcacttctcgccctgggggtagaatgaccctttcacagaaagcagagatattacataatggtgatagcaaagttagttataaagcagcaatgaaaatgtgatggttggaggggccaccattacatgaggaactgtattgaagggtcacagcgttaggaaagtcgagaatgctgttgaagagagttggagtcttagagccgctggttttctgctgctaggacaactgagtgggtttgcaaagcagtgttggtattttctgcaggctgagaagaccacatgattaaggccaccgcttccctctagttgtttgcaatggcgtcttccttgtggggtcttgcccttcacgtccctgcctgatcacatcaacagatggtcttcacttgccaaacgtgttagtgtctgtacctcctaccctgggtcttatgtgctttctgtcgggtggggcttgagacccaagtaatgagcaggagctcaaagtcttccagattgacagtaaaaggttaataaacagcgctggtgcggcagccagcgatccacactggatgccgacttggttggttgggagctgaattgatgagggctcactgtatctcaccgtgggcagcacagtgaagccctgcctcaaaagcattcctgtctgaaagacatgtcgctttggtttcacatggttttgccattgtaaataccttgtatctctctgtggattattctaatagtttgttaaatgtgtatcaaccaaattaaaaaggctttcacgataacatcttcatgtgtacttaatttttataattgtattataatcagacttatgatgcctgaggaagatagtttaaaataagacttattttagttttgtaggtttcaatggcttgtaggcatgtggcaaggattggaagggtgtggcagagaaacactgctgccctcaaggtatccagaagaaagagaagaggaatggaaaacgcccagggccaagatatgtccctcacaggcacaccacgagtgacccaccttgcccaagtgtgccaccacttcccattggtgtattccgtttttactgtagaggctgaagcattgtccagagcagagccttcacaatgtactcccgaaagtgccctctggcacatggatgtgctgcactaatgtctgtccactcaagtcaagatgaattgcagggattttcagtgg

SEQ ID NO: 33356 - DNA, 1385 bp, Mus musculus
ccacaacatgtcaatttgctttaacaagaaaattctcctaaagtgtttgagctgagcggctgcagatggaagtactctgctgtctgtccctttgtattcctttatgggttgtttagagtggcttgtgtgcatttcctcaggaaaggacatgtgtgtgtgtgtgcgtgtgtgggcgcacgcgagtgtgcatgcatgcccaagaatatgtgtgtcttctattaaaatacttgcaggtttatttcctaggcatttttctgtgcagtccagtttgactctccctcttgcatctcttggaaactgtctgcagatgctgatgacatccaggggagcatttcccaagagatcaagccttgggtgtgctgtgcaccacagggagacatgatatacgaccccagttggcaccatccacctccactcataccacactactccaagatggtcttcgaaacaggacagtttgatgatgccgaagactagaagtgtcactttccacagtggagtgggggagtttttgtgtcctccagatcacaagttgtttcctgtgtttcaagtgagatactctgtccgttctcagcgactcctcagtgtgggctatagacaggcattaactggggcatgttgttgtggtggttgttgttaatggactctggagtgtgttggaatttttgtctgtgttagagttgtgttctttataaataaagttagggaaaaatcacctagtatgctctgtctgcgtctcttccctatagttatgacttctggtcagtgccttgctccttctctcaaagcccttgagttacatgttaaggatggaaatagtactctcagagagagaaggcgcatggctttgcttctgtgtatcctgcatgttttagcagggattgtaacccaggggtcactggtgactgtgtggcttgtttctgttgcctctgaaggaaaggctaaacatttactagtttacaaggaaggaaactaaatggcactttaagccagaaattatataatcctttttaaaataaagatttatttattttatgtatatgagtacactgttgctgttttcaaacacaccagaagagggtatcaaatcccattactgatggttgtgggccaccatgtggttgctgggaattgaactcaggacccctgggagagcagtcagtgctcttaaccgctgaaccatcatctctctagcctaggggacagtttaaaaatgcatttcttccccctgccctcatcttcctctgtccacagctctagctgcagctcagagtccctatcatatacttaaccatcatttgacaccaacgacttccattttggtcatctagaacagtgtcatttaatctcagaacacccggaatgcttcatttcactagtgattt

SEQ ID NO: 33357 - DNA, 1171 bp, Mus musculus
ttcctttcctctctctctctctctctctctctctctctctctctctctctctttctttctttctttctttctttttttttccccagagacaggattttgctatgtatctctgactggctttgtagaccaggctggccttgaactcagagatccacctgcctctgcctttggagtgctgggattaaaggtgagccccgtcacacctgacctaaatttatttttatttgacacaaaaattgtatgtacataggagatgcaatgtggtgctttatagatctgtgatgtgtaaagactacatcagggcagttggcagccatcacctcgtgtattcatcagctctctgaggttttcagagcgttgttgttagcggtgatatgccactgtgctaatgagcagtagacgtcatctctcctatcctgggcccattagccatgtattccctacccttttctgtccgtctttccccagattctggctaccactgtttcacactctacttctttgagaccagttttttccttccagcatgtaacttagaacatgcggtattttgttttactattcttgacttctttcatagaacaggataacccatggttccgttcatactgcagaagatgacagtatttcatttcttctgtggctgagtaatatataacatattttctctattaagtcacgtccaaaaaaaaaaaaaaaaaagtcacgtccatgggcactaggctgaccccaggtcttggctaccatgaatcctgctactctaagcacgtgacttcagttcccttggatggatgcatacagcattgcgggtcacatggccgttctgtttctgttgtctcaggagcctccccacagctcttctctttgcttattcacacccatctgccaacagtcctgagacttcccctgcaccagctcagcactgcatttgtcatttgcatctctcatgattagattagtgatgctggctgtctgcatatcctctggaggtgtgtcatccagctaatccacccttccctgagtcctgcacttccctagcatctgtacattaacctatcagaccaacagctggcagctgtcctcaccctccgtgttgggcgtctttctccctctctgtgctacagaagcttgtttgctttgtgttaaccatattgtacgtcataaacacgct

SEQ ID NO: 33358 - DNA, 1142 bp, Mus musculus
ccaagataggggcagacagacaggaagaagatcatgatcccgcgtggttttaaatagccacaggtagttataaatatcatatagggacagaataattgggataacttgtctgatctaggtgggcagcttgtatcatcaattggctctgaaattattgtgtgggcatcttgtgaattgataatttattgatacataaatctgacttgtaaattataagcttctacagtcttgtttctaccaggttgctgggtgttgtggcggctgactgcagggtggatggccatttcatgggcctgccatggcagcgatcctccaagagaactggggagctccggcccagagcgaccaggagttgagatcacccaacacagatataaggcttaccttgaacacctctccccaccccaccccccaaaaaaacccaacacacacacaaggctggggtcaccatcttcctaagacccacagatatttcacagtctatacgcagagctccaacacacactggccacgccctgggttctgcttgcagtcttgatgtgtgttgggaacctctgctggtttccccacgggcatttaagagtctccacagatctggcttggtttcacccttcccagttcatggctgggagccatcaagctggagggatcggcttatgcaattagaaattaatgtcttcgcatgatttttcagagttgcagagatgttcttagtcatagaaacagggtagaattttagcttttaaaacaaatggttgtactggctcttctggaacagtatttaacagttaatttccttacaaagccaaagtcagtattagagttttaggaaatgcttttattttttaaaaatgtagaaatgtagatatttcaactattttcaaagaaaccaaggcagttgtgttagtcagggctctctacaggaacagtatggatatgatggggagggggtggggaaacaaagtaatttgctaaatcagcttacattaaaatagtaaccgctgagtcacacctgggggctgagacccagtcagggcttagttggagcctcagcagtaggaggagctcccatggcagctgtctctcagtggggagcctgacaacccatggttgctcaatccacaaagctgggtgcctcagcg

SEQ ID NO: 33359 - DNA, 1154 bp, Mus musculus
cgtggttctctttgttttggttaataatgaaaagcctccagtcacactgtcctcgagtctccacagtgtaagcagtgtgcttcgtgtacctgcgtgtcccacgcaatgttctgtggcacagctgagtggcccgggtttactagatctacctgtcattcacagctacctgtctgtctaccacccagcttgccagccacccgtacccatccacctgtccacacatcagtctgtccacccataaaccaagctattaatcttctaacaatagaacaataagtttacttagtgagctttgagaggagggttcaaataaaaaattgttaacacctggaagttgtgaaattatggagattttgattcataatgcaaagcatgtaatttttactataacatgtgagtgtgaaaatctctatcctcaggtaaccggttgagtgcatgagctctgacttcgaaacgaggtaactgtaggatcggaaggaagagcaggctcatgctgtcgcccacagcaggaccccactggtgtgtctggctaaccacctgtggcccaggaatacaaacccagccttgagaatgtagggaaggagctcttgaacacaacacagcctctgtctgtgtctactgggcctgtgctgagtgctaagtgcctgtagctcactgcacccgtgtgcctgagatgcagtgttgcacgttgacacagggacttttaccctgtctcctctcaggaggtgaagatgcactgtaaaccagaaagattaattacaaatgatttttttcttctgttgtatcaaattaaaatatcttgtgttcgagattctttagtgtgtatatttattggtgtgctttcagaacatctcttcaaaggcttcctgcgaactcctgttcagaagcagtttgcgatgtcgctgtcgctgtgattctgcggctagcagagggggctgtacccagaactccgttctgtccttttctgggaggagcagagtcccccttaaagctaagaattaaagaaaacaaaaggaggggctggagagatggctcagtggttaagagcactgactgctcttccagaggtcctgagctcaattcccagcaaccacacagtggctcacaaccatctgtagtaggatctgatgccctcttctggtgcatcagtgtac

SEQ ID NO: 33360 - DNA, 2135 bp, Mus musculus
tctgcgtctgcggcgcgtgaagggcacagatgtcttttcccctttcccatactgacactcgggtttgctttgtccacaggctgggtggtcagactccctgttctggaaggccaaccagtggctaatgatccacatgtttcactgtcgaatgatcctcacctaccacatgtggtgggtgtgcttctgtcactgggacgccctcaccagcagcctgcacctgccccactgggcactgttccttttcgggctggccctgctcacggccgtcattaacccttactggacacacaagaagacccagcagctcctccatcccgtggattggaactttgcacaggaggaagccaagggcagcaggcaagaaaggaccaatggccaggtgcctcggaaaaagaggttgtagcggcgcccacccagggactgggtggaccatgatgccgactggggagtgtccagggttggacaaagctccacagtgactctttacgtatggatggggacatagataagtttatatctaggtgaatactaacttgttccttactatgaattctaaagtacccatgaagtattgctggggcctcgacgtgcctggaagaggtctttgccatcatgactttcctctgagtcttctggcgtggccccaaccacagcacatctgccaaggcagtgctagggaaggagcaatggcagccaggtgtgcaggctgctgaggaagccagtctggagccctgcgacgattcatcgggaaggacctcgtgtgggtgtgggtgtgccttatttggaagtcgtgttctttttcattgcaacaaattgaccctaagaaaatgtgatttgctgatcatatttatttactagcctggggaattttaagcccgtggcagtgcactgccctctagtggcaagaggcagaaggacagagttatggtaaggggttctccttggcttactagagtctgcccacccctcctggagtggtggtggtggtgtgaaatcttgtacttcaaaaacaaacaagcaaacaacaaaaaaccccaaggaacctaataacctttttgaaaaacaaaataatgagaatttttagtgatatatttcttatttgacagaataaggtgtctggagggggtcctgtactcatcctcgtgtcgctcatcctgagtcgctagggccccgagcaagcaccttgcctgacatgaccatgggaacatgttctcgccgcgctgtttgcaggttagacctccagacaccggctagcaatgctatcggcagacacaaaaactttcccagagaacagttaaagaacaagggggtttttgtttgtttgtttgtttgtttgtttgggtttttgttgatttgttttgtcaaaactacctgagaaatggtggttgctcttgaaaatcatgtgtgacttaggcttgcctcagcagccctttaactttatgaggatgtatgatgcctattttattataaagtagcccattaactttatgaggaggtatgatgcctatttatttcaatctaagaaagcccttactttgtgttcctaagataatcaactgaactgaaaaccctgtagctcctgtgtctgctttgttgaggcaccagcctggcatttttgttttttttttgtttttttttaagctgggcagaggcttaatatagtgacagctctttccaaaacccaaacatacttcctgtctgataacgtgacccgaagctcacctgagtgcctgagaacactctgcgtcctgaacatgttggcaagtcttcaatgggaccaggatggggttagagagtgtcttagtcgggcatttctattcctgcccaaaacatcatgaccaagaagcaagttggggaggaaagggtttattcagcttacacttttccacatggctgttcatcactaaaggaagtcaggactagaactcaagcaggtcaggaagcaggagctgatgcagaggccatgggttgatgtgacttactggcttgccctggctttctcagcctgctctcttaaagaagccaagactaccagcccaaggttggcaccacccacaatgggccctccccccttgatcactgattgagaaaatgccccacagctggatctcatggaggcgtttcctcaagggagg

SEQ ID NO: 33361 - DNA, 3135 bp, Mus musculus
acacacagaagcggctgggacagggagatcatctgactttcgctggcctctacaaggagtgtgacctcaggttacatcctccgtcttcacgtgtgtcagctgagtgccattccatagctcaggtgacctttggtcactccacacacatctcctttctgaccaggacttctccccggaaccttggagacaagtattcatgagaaggctctgcaatggagcaagcactagtccctgcctagagtagtggctctctcgccatgatttttttaatacagttgctcatgctgtggtgatccccaaccatgaagttattttcgttgctacttcataaccgtaattttgctattatcataattaaatatctgcgtgtcccaacctcttgtgaaagggtcgatcgaccaccaaagaggtcatgacccacaggttgagaacactggcctagagaggggccacccttcccagctatagtacctttgtggtctccagtgtcctgccagacagatctcggagaggggcatggtccagaggacacgaggagccgcagctcactaatgtgagcctaggctggcctgctctgtggcccacactggccaagattccactgcacgtgtgccccactagactcctacatcagctgttaggaattagaatggggtatcgcttggtagtagagaacttacttagcatgtaggaagccttcctggcttctgtcttcagccactggagaagagacgctctcctacttgaccggtatggaaaatcaaaaacgttctccctttctcgccacgtagatgttttacatgttcccatgttttcaacagtagaggatgtgatggtcaggggcagcagcccagcgtcttccccatctcttcccgatggcttgcccttttcccgatggcttgcccttgccccttcaatttagcaacgaggttccaacttctctcagcagcataccataggctcctcaaagtagcactggacttggtgcagcagagctagtgactggctgtgtgctgttgtcttctgtgaagcctatgggtcacaaggctctccttccacagacagctcctcagtaggccctgtggcttccacggcaacattgctagcaagaggccatacccctacctgagcccttaagtctctgttcacacagcctgtggtgaccctcctgatgggaactaagcattgcctcattcctgtgtgccgtaggggcgacacctgagcctgggtcctagagaaagagcagagactagccatttctagttttgtagggtggaggtccaaagtcaggtgctggcagcttcagtcaggaagaggcccagtacttcctacgtggaatgtttctttacctccaggagaaagctatgccatatatctaaggagcagaagggctgaaaagattcaggaagcccaagtgagtttcctggaggcctttataaggatcactgtctggacacatggtgacttaagtgttttctttggctggggctgtctctgattgtggaagctagtggctgggaggaggcccttgcctatccccaaccatggatgtaatgcgtccacataaccttagtggggcacattcaaatgctagtacaaaaaagagtgttgccacaccccgtgtcagtaagatctcattcgttccacaaagggctgatgcctcttgttccctgtagagagaatattgtatgtattgtatggatgcgtcacctgtcaattaaaaagcctatgtgtggcctacggcttaggcaaaaactagaaggtggaacatccagggggcagaaagaattctgggatagagccaggcaggaggtcgcctggtaagacatgaggagactgatgtgtggtacccaaacacaggtaaccagccacatggcaaaatgtagattaaaataaattttaagttatgattctagtcagagaagagcctagctatctggccaaggtattttgtaaatatattttgagcctgagtcttatttctgagagcatggggctgggggatgggagggagaaccggaggtgatttttacagttctctgaccatttccagtgatggctgcccagccactggcaagtgagtgggtgaaccacccaatggaaggtaacctctgtcttccaagtggggtcctggcagaagacatgctaacccagagctagacagtgtttgctgagggcatattcaacaaggtaagccagggtaggaggccaggaagccagctccatctcacacagccagaagggctttggggagagacaggtagccagtacaggaactatggcgctagtctttcctctcacggtgacagaccagtgagttggttacacagattgatacataggagacatttcttttgttaaaactatgaagtgtgttacaaactaaaaggctctgggttgttggtacagtgtgaatgttggcagggcatagcctaaaatggaatttgccccttgggatgttgagtctaactcaggctgaggaccaggctcaggccacgcctaagcttcccttctcttcaatgctggctgttttcggcccccagttccatccgagggcctggagctgcaggaagaagccagagccatctatgatctcagttcaacaggccccataagactcacctagcagaaaaccaacaaaagacacacgtgtcattaatacttgatacatttaagtcaattctgtgtctaaatttttgctgtgtcctaatgtttcaggatattaattcaatgtgcctttttttgaccccccctccatttcagtatactatgcacatttttatttctgttacaaatttttaattgcctagggttagagagagagctcagtggtaaatgtttgtattgtatacactagtcctcaggctccagccacagaaccacaaataaaaaataagttaaaaaaaaaaaagaaccccagcggccgctactggatgaccctgggcaatgtggtgcccaaggggggatttcctcttctctaaagacaaggggggatggtaatggatagaaggaattgtaagggtgaggttgggaggagggacggctagggcctgccatcttcatgtaaagtaaataaacgttggtaaaacccccaaatttatgtgccatatatatgtatatatacacatatacttt

SEQ ID NO: 33362 - DNA, 1190 bp, Mus musculus
tacacctgaggccccctggcgcacccgcaggcctccagccctttcgttgtgttgccctggatggtaccatctactgtgtgagccgcgccgggacctggcgtttcgtgccttctcaggacaccgaggctggcagcgatatgggacctggtggcagctttgagcccgagcccctgggatcccccctggatgtccggggcgtactctttccatttgtactcaacctgcctgagaagccggaccgcggggagcagggtgcagtctaggacaggatcggctgggcagctccactgtccagcatttgaggggacgggggtgctcaaaagagtgggctagcccccaaacccccagtgggggaggaagggcaaagatgtctcaggaatagaggaagcagaaaggccaggctgctggccatagtgcatcatgcaaacgctttgagagtaaaagaagcttcgctggctctgaagacattttcccaatgctgttttaagccccgctttgccgtgctggattctgctcttgcttcgcttgtttagtgaggggttcatagtttaaagtgtgggaagatacagataagcccatccctaagggaagaggtagaagaggccacagataaagtaggatgcaggtgcggactcaggtgtaatgaggagcctgtccagtcccctccttaccagtgaatgcaagactctcaaacctgaatggggtcctaaaagtaggctaggtatccttgcaacagcagagaaaaggccaaaccccgctaggaggtttaaaatgataacttatacgatctgcgtgagacccaaaacgttcacccagtggtttgcaagttttttgtaggctcaacttcaaaaagtaatttgtcaagtactgaaggcgaatcacttgaccagtcgaattgcctttgttaatggtaatgttagcaagcagcatgctgaaccggagaggacaggaagcaagggtggaaagacctcaggtcaggaggctctggtagctctgcgtgctcacctactttcctgtcttagaatgaactagggcatttttcccccctctccctagaacaaggaagttaaaatcatgttttgacagttgcatgctctgaactctctgcttggtgatgttttgaatgtatcttctgtgattccaatgatggagatgaatttacaaccatctcgaaggtggtgtgtgtgggg

SEQ ID NO: 33363 - DNA, 1419 bp, Mus musculus
aaagtcatcacaggtacacaccggtcaatggctagactacccaaggatctgagaaagaacaaggtgtgaaatgaatagttggcatgagagcctacagtgttctctcattgtacttatgaccctgactggtccctgccagcaatggttctctagttagccacagagctcaagttttccactgatatataagaacatgcaatagaaaagaccagaggtgtttacaatgcattttaacttttcccactgtcagcagcacctcactgcagtgggataagtccagaccaacccacaggaaatcccacaggggaagacagagtaaggctgcctctgagcccacgagcatcggggctaaaggtgacctcagtcatgtaagtgaccccacacttcaccagcagattctatccatacactctgactctagcatccagaagagatatgagtatggtttgtcatgtggcaataagtgagccatagaaacatttttaaatgtctactgaacatcagggcgaagccagaggaaactctggtggaggtccgtagcggtcctgacgtgcaaatcggtcgtccgacctgggtataggggcgaaagactaatcgaaccatctagtagctggttccctccgaagtttccctcaggatagctggcgctctcgctctttttttcccgacgtacgcagttttatccggtaaagcgaatgattagaggtcttggggccgaaacgatctcaacctattctcaaactttaaatgggtaagaagcccggctcgctggcgtggagccgggcgtggaatgcgagtgcctagtgggccacttttggtaagcagaactggcgctgcgggatgaaccgaactatgattacttttaaatgcagaatgataatttatcctacaatagctgtcagaatcatattaaaacccaacctctaggaggtgggggaagtttcctcaaagtgagagaaatggtaggtgttacttgagggactgagaacaatgactactgactgcgagacacaacagttgtgagtggatttgaacatgtaagggagaaaaatcagagggtttatttttctttttaaactaaaatgttctaagttatgactaatataagttgtgaagatcttcatgaagttgtaaaagtcattactctgaaagtgaaaaaatcatttaatgagagctgccttttccctgagttgtactttcctggtgtctagacacagagtgaatgctttgttgcatattcctcttggaatctaaagagcttctctgatttataagccaagctcaggaattgtgttatgtcccttaattcctgtctttatatatatatatgtatatatatatatatatatatatatatatatatatatatatatttaaattcacattttttaaaatgtatgaatgttctgtctggatgta

SEQ ID NO: 33364 - DNA, 1120 bp, Mus musculus
aaataaatactggtctctgaaactgttctactcagatgtttgtcattgtaatggaagagctattaaccatgaaataacacagtcagtgagctttctatggccatccagcaggacctgtgctctcatgacctagttgaccccacaaccctacacataaacaattatttagcttaactctaaacatgtctatgacaggacacatgtatattttatgtccatgaaggtagtacagctgtatgtgctcatggagacaaatgcatcacatacagtgtcctctccctataattgtcatcctgttcttttgagcaaggtatatcttaaaatgtgtggcttgtgttttctcaagtaggctggaaaccagcaagcctcacagattctccttcctctattattaatatgtgggtggatgagtacatatatgagtgtgtgtgtgtgggtgcttgagtgtatatgagtgagcatgtatgttcaagtgtgtgtatgtgcagtgtttgtgtagaagggacacacacatactacagcacatgtatagaggtcagagggcaggtttgaggaactggcttccactgtctgtcttactccagtggggtctcacttatgtctgttgcagtgtctgtaccgttccagcttccggctgattctcctctctttctccatctcactctcagagaacttggattgtatattgtgctgcaacatctgacaggtttatgtgggatctagaactgaaatcaggctgtcaggcacctagtgctttaaccctagagaaggtaagggtttcaatgctagaacttaaagatacagaagctttgagtcatacaaggtcctccagagacacaactgtaacaggggtctgctctgttatgagatttatatcaagaaggtgctgtgagctcttagttcctagaaaagctagctacacccatctttctgagtggcatttcccccacacgggcattttcagaggatcatccagttttcaaactggagtcaagcaacatgagaggaacacaggaccttccttaaacattgggttgtgagctttttaattcctaagccatcactccagcccatactggaccattctaagggacacatgcaagaataacagagaagcaaa

SEQ ID NO: 33365 - DNA, 1107 bp, Mus musculus
acttgcacattttaaaggcgattctttgttgatctctgcagatgaatcctttgccagtggctcccactcatctttcggtgattcctgtggagatcaagaaaggaaactgggaagatctgctaatgagatgaccacggtgacatgcccttcctcacctgtgttgagggcaagcagtttttatggctcagcatcacccaaccatctcaggcagccacgtcctcagaaagctccagacagtccttcaaaggagagcatcaactgtcagaaggatgctacaggtgcggtagctgattccgagagaaagcaagctgcaggtgtatctcagggggtgcctgatgagaagctctgtctgtctcctacgatgtccatcatagaagaacaccaagtacggttgggacccaagaattcttctgcaaagagaaaaagggcagcggacttgggttcatctccaaaaggaaaactgaagaagaggtacaagagaaagtctgctctggcaatacagttattcaagtccgaccagagcccgccgtccacaatcagactcattccgggaactcctgacgttgaggcttcttcctatgaggactatttttcccctgataatctcaaggagaggaattcggagagacttcctcctgaggctcagcaactagcaagcccttctctgttccactgcagaggtctctcaaagtgggagcgaagaaacatgctggaaatgtgtgattttacctgcattggtgaaaagcacagatccatcagcagcattagtgacttaatttcaaaaagtgcctctagtcttgagaaacctgtcaaggaggaagtgaatacagcttctacctgcttgcttttggtggagacctctgctaacgacagcccagggctttgcagtcagcctggccctcagctgagggatgacacaggcccagagggaagcagccaccctgacaccctgtctagttctgcccaccacatcacacccttgaaaggaaatagtacagaaaccagagacccaggtgatggaaaaggctcccccaaagaaggtagcacgcctcctgcatcagcctctcctgaagatgaagtacacatctgtaatctcagtttgggaga

SEQ ID NO: 33366 - DNA, 1136 bp, Mus musculus
ctcgcccatgcgcttggaacatgtgagattactgtcagcagccagatggggatgagctgacatccaaggaggtgctgtgactcagatgtgtgttctgcatcttaatttgggactgagcacaactgttagctgtgtttgaccttcaaaacacgggctaacttttaatttaatatcttaggtaagaagacagtatgccccaggtgtctgtctctccttacataccgtatctatcaaacggctatctcattacacacggcctgtcgagaagcctctccactcagaacacacacaggaaagcaacagatgcaaaactgccctcccagttttctgcacattgtctaaccacaggtagaaagctatgatctgcctgtctgtctcagtgatctatctgttcatctttcagtcctagggactggtttagggtcttgaccatgctaggcaagtgctactccagtgagttaacatctctagccaaagctaggattttgaaactagaggaactgagagacggtgatgcccccgagaagcagcagttccgtgtgacccagtcgtggctccatgacaacttgcttacctgtagttggactcttcaccagcgaggtagaagtgatcatacagcgaatgcgcctcgttgccttcccagtccttcagctggatcttaagcacgtagcggtgctgaccggtcagctgggagacaaactcattgcccagccagtactctcccagagggctcccgaagccctgcaaccgagagagtagagtcagtcagctgtttgttcttgtgtttggaatccatcaccttagtaccatcttaggtgagaggatggtactcctagccctgggctgtacaaatgcaaggtcttgcacacagaaaaagattttgttttttttttatttaattttgagagatagaagaggagtcgtaaatacatgccaccatgggcctgcgatgtcaccagcaccgtggatgttagctgtactctctgccttatttggggcaggcttccctttcaccactgtgttattctaagaccagctggcccacaggggtctggggagtcacttgtccttgtctccccttgtcataggattacagatgagagctaatgtgttcagccttatacgggttctgggga

SEQ ID NO: 33367 - DNA, 1099 bp, Mus musculus
ggctgtcattcatgctggaggagagaagctactctccaagtatcaacagcagaaaacagttggccatgaagtgaaggcatactgtgccaaactgaacatatttcttcttttgattttttttttgtgcatgcatatgtggagggggtgggggaaggggggtgtgagtgtgtgtatgcttaggccaaaggagacagctttgtgtatgcttaaataatcacatacatgtacacacacacaggcacacacaaagattacagacaggatatttcacatgttgacctaggtataaattatcggatgaattctcattttaaagataatatcaaactgtgagcttgacgttatcatgccctatgtattccctgcattttctgactcaaccagaagaacgttaaaggacaagatgtttgaaaatgaaacctttaatgtatttagctgtgatcgggagtatttgcttaacatgggtgagtttgtaccttttacctgggactacctgcgtaacgcctggagcatgaacttggggattcaagttcactggccttgaactgtggatgaaactgttctagctgcctgaggacagttaaaggattcagttaggtaaattgtaatttagcattccgaaacatgactctttccggatcaagcataaaaggcatgtgcccttggaagcccaagaaagaattcatacagttcccattagtctaaaaataaataacaaataaagaaatgtctgagtcatgcattgcatttgatggagtccagtggcagagagaacttaagctgtactgtggatggtggctctgcccggtgctcggtggagtgaggccgcagcgctctgaggaagtgatacgagccagctgggtggatttaattctgtcttgggttcctccagtgcactaagtgtgtcatgctttgagtagcaatgtggaagcctggctgtgccaggaccgagtggctagggagggacttgccactgtctttgaagctctcctgcaggcatctccacggagaggcaagttgcagctcagctccataggagctcctgggccagcttgtttaagttttccattcctcgttgggaaaagtaacatagagatac

SEQ ID NO: 33368 - DNA, 1213 bp, Mus musculus
agacgctgggtggaaccaaaacctctcagtcatgtgatctccaatacggaccttgatcagtgtggctctgctctgataaaagtatcacaactgccgtttgctgtctgtacttgcctgagggttcctagcacactcctgctcccgcttgctcagttgctggcaacacacgactgttctgtgagctcaccactgttaccacaaggaagcctgttctattcccaaaggtacagagtcaggttttagccagtgagctcagctgagagaagcaagaagtgactaggctggtactgagtggccgatcctgctcttaaacaaccattgggtaagcagagggagctactctgaaggacagtgtttgtaactaggtacatggcattctgaggcacacacctagagggcaggaagggattggtggttgtgggagactggcagggtggctggggcactggagatttgtagagcactggagacactttgtatgatatgctagaatggcaccaaaatgtcactacacagttgtctaatgccatggaatggactcaagcctgcaccatggctggtgtctgataaatacgacagtgctgatagactgcttttaacccttcctctccaatggggaatattgataatgaggaagtctgtgtaggcagcagctggggcatctctccatcctctaaactgtgaaactggaactgacacaccacacagagagacacagacagacagacagacacatacagatacagacacacatacatacatacacacacacacacacacgaacaaaagaccattgaaaaagtttttgatttttttttttttgcaacttcaggttataccagtaaagttgacctgctcctgccaacgttttcttttctttcttttgtttattatgcaattttcttttttaaaatttatttatttatttttattagatattttctttatatacatttcaaatgctatcccaaagttccctataccctccctctgccctgctcccctacccatccacacccgcttcttggccctggcattcccctgtactggggcatataaagtttgcaataccaaggggcctctcttccctgtgatggccgactaggccatcttctgctacatatgcagctagagatacgagctctgggggcactggttagttcatattgttgttccacctatagggttgcagacccattcagctccttgggtg

SEQ ID NO: 33369 - DNA, 1200 bp, Mus musculus
ctgaacttctcctggggcctgttactgcttcagtcagagccaacaagctgagagctggttccgggaaagacctgggcagagagagccctttggctttcctggtttgttcctctctagcagcatttgcctcagggaagtcttgacacctcagcctctgccaccatcaagccacttctgaatacagttccttccttaaagtgcataccatcaataatgtgaccacccaaagtctctttccggagaagcccctcttaggccccttcttgcacctgtctctctaaactgtaagcccctgggaaacaaaaagcaaactcttgggttttggactctgcactctcctactccggcaacacacatgatgtagagccatctcctaatcagtgtgcattgagttaggtagcctctttccagaatgatctcatccttttaaatcaacattatctcagtatttcagagccccctcaatgaagggaggatcccccacatgcaccataaacacaactatgaggaatggacataagagtgaccaacatgaggcccagtcaagaccctcagtgggacccttcccaagacaaagctttccaaaggtccacttgatgagccggggttgggaaagggtgtctgtagtgtagctcttggaagggacagcagcagagccccagtacagaacaagagtgtcagagctgagggcccaggaagagtgtggaccagctcctgcacccccaccctgtgcctccattcctccccctgactcttgccaggagaatggccgatagctgtaaggtgaatgtccctggagagcgcccttgacagtgtaaagcagagttctcccttgagtgaggaagcctctggaagaccatttcagcttcccatgcaagagaagaagatgaaacctcatctcttgctattcagctgaagacattggggcatgtaggtgaaacatggcttgtcagtgacctcaggacagcagtagtatcagccaccataatccatcatctgagaagcatgtgagagtgtgaccttactgtgggtgcccctctgctctgtagaactaagaggtaaccagcacttggagaatgtggtcagactccttagagacagccccagctgtggcttacccatcaaatgtgatttagcttgtgactttgcaaaatacagtgtgttgtacaaactctgcctggggagatgtgaacagaaaca

SEQ ID NO: 33370 - DNA, 2151 bp, Mus musculus
agtggatttcctgtgttgcaactagctatcttaactgtcaagctgatttttctttctctagattccatcacccaacacaagatctgtgactttaacaactaccaactgctacagtgagacatctacaatgaggctgctatcctcaacactcaagaagaacaactctggagaaaaggaaccagcagacaccttagggcttgaagtcacatgtcactttgtgtgctatggtttttatcttcagagggtatgtggtgtgtgtgtgtgtgtgtgtgtgtgtgtgtgtgtgtgtgtgtgtgtgtgtgtgtctaggtgtctagagattaaatccaaggcttgctaagtaagcactgtactgtggaactacatctccagcttttatccttaaaactctttatgtaacttattcatgactcattgtatttcagagaagtcttgaccagcaccagttgggtactttatacaatactaataatgatcatgatggaaaggtcacagaacctttgtccttgagatacttgttcccaattatagaatggaagttgatttaaattgctgtagtcctaaacaatcaaatagctccctaactcttctgacttagacgctgagatctttattagcatgttgtgtctagataggaaggacaatcatgcattattaagattgcaattatgtcccttgagatgcccctcagaacaactaaggaagacaggtatgaacgttttattcaccgaccttgcgaatgtctaccactctgcctctactgactcccctgaggttccctaaggaaagtcagcttctggggtagagttctgtcaaaggtgtccaacccatgacccatgtatcaaacttgtttaagggtacctagaatgtagctcatataaaattataaacatatttaaaagtattaagagatttgtgtgtacatatatttcccccaaccccagcggggttgtaactcaattgcacaattcttccgggtgaactctagatgaccacgttgtattacactgtgaaaaggctggacgtgccatcatcaggtcaatcactcttcagtgtgtcgacacgggagactggcctggggcttgcagacctcctcttgttggtgtccccagtgttgggctgtagtctagtgccaccacatgtcatgctgctccgtcacctaacagacactgagtcccagtgagcttaaaagcagtgctcagctcactgtagttttctgtgttacgactcatgtcagctgctgtttccatctcaggaagcctcaacaccacttccaaaaccttgtcatctccgagataagcaattaaagcgtacagtttgtgactctggcattggccttgttccctgtacaattaatgctctgatggttcattcatgtcatgtgtgtcagcacgtaatttctttttgttgccaaacactatcctatggcatggatgctctacagacttgctcctcgccccatgagcagagtgcaggtgtaaagcccagtgggaaagcagttgatgatgtcacgttgcgttgggtgatagttgatgatgtcatgttgttctgggtgatggttgatgatgtcatgtgttgctggatgatagttgatgatgtcacgttgtgctgggtgatgatagttgatgatgtcaggttgtgcttggtgatcagtagtccaggctccgtggaagaagaggatcagatgagggtgtgagagaccccactcatcaccctcctcatcttctgtaatctgagtaattctgtttcccctcacaaatccatagcttgaagccatcacttgaagccagaataatggtgtttaaaaagtggggtttgggagaaataaaagagatgcccagcaaagagaagcaataattttaattattagaaatcagtctggtgaaatgtcaagctgcacttataattatggaaaacactacaatggaaaaaatacttacaatatgatttaaaactaccaacttattatacaattctatagtcagccatgccaagtgtatatgcacagtacagtgacgtaagtgatttaagtaaaccacagttgatttttatggttcttgttaatgctacaatgcttgtctggtaatttcaaaatgcaaaattcaggcacctgcagtcaagaccaaagctcctgggctccaggggggtgaa

SEQ ID NO: 33371 - DNA, 1241 bp, Mus musculus
ctcgcacgccagcacaggccaaaacccaccacctcacttcttcccgggctcatccccagccagcattcgcagtcgagcatgcgtcgtgacgaggccaagggaccgagccaatcagaacacgtattacgcccataagtcggccaatcaggaggcgccttattacccgggagccttgcttcaccccgcctccccgctgacaagcacgggtcgcgcggagcaaagcgagcaccccgaggcgagtgcgcccggcaagccgaggcgtgccctttccaaggcggcgagcagaggccgtcactgtccccgccgggtcccgggcccccgcggcccatgctgggggcggagccagggcggagggcggcggcgcggccggccccgcgcagtgattggcgggcggccggcggtggctgaggtcctggtggccgcgcgggcaacgcaggcggagtcgcggctggcgagccgagaggatgctgctgtccctggtgctccacacgtactctatgcgctacctgctccccagcgtcctgttgctgggctcggcgcccacctacctgctggcctggacgctgtggcgggtgctctccgcgctgatgcccgcccgcctgtaccagcgcgtggacgaccggctttactgcgtctaccagaacatggtgctcttcttcttcgagaactacaccggggtccaggtgaggcgcggccgcgcagggctgcgtgcgagccctccccgcggccggggcggcgcttgcaacccgggcgaacactcgcagcccggcgagcacgtgccgcagctcacggcctcccgccgcggggggaagtttctggttctcacttcggggttccttctggaacgtcctgctgaggctgagtgtgttcccgggtccgccccacccccgccccgggccggctgttactgcccatctcagtgcctgccaaagtagggcactgagtccgaggtggtgatgctgggactggcttcatttgcacttccgaggtcttttagattagcaagacctctaggcgctgaccaaagtgacagctgtgaaggacgactcctgccttgggttcctcccgggtgaaagcgagggcctagggaggaaatgaatacattggttacaataggagcctcactgtcgatacagttctcttcagcttggactgggcttcaatgtgggctgatctcttgtcagattgctttcttcctgctactgtttctttctttctttccacccctccctccccccccc

SEQ ID NO: 33372 - DNA, 1651 bp, Mus musculus
tttgatttggggcaaacacatgtggcttttcaggtgctggggttgctggagacatggaagctaagtggagtttatgctgtttttttttttttaatgttttcatgaattaatctccacttgtaaagattattggatactttctgtaattcagaaggttgtattttaacactagtttgcagtatgtttcgctatattggttatcttccatttgactacttggcagctcagactcttaatactaaagtattttacattttgaagctatgtgatactggttttttgttgttgttgttgttagtttctgaaagtcaatgaaagacactgtaatgatgcgttaagatgttccaagaaaaaggtgagaattattcatggcaaaaaagatctgtctagtgtatatttttattatattgctctatttagctaattttctttatatttgcaaaataatgaacatttttaatatttattaaaatgcttgatttgcatacccccgattctacagagaataatgtgtaaagtgtcagaatagacttgaagctctgctgtgactcagtctcctttgtcagagcttctagtagcccagctactgagctgctttgttagtacctccagcacctgagccgttaagtacttataaatgcaagggacccgttatcttcatatcggaatagacatgaacagagctctaaggcgatgaaagtctgccagcatcctctctgtcctcgcacgtgccttctgcctggctccatttgctttggcactgcgttcgatctagagtgtaggtgctcactgcttatttcagccctggctctgtggttttgtgtcctccagtggtgctgttcactgttggggtgcaggtggtgctgccctgactcagaggggcagctccctggctcctgagggtgagccttcttggctactacagaagtattgtgcgtttgtttatggcaagaaccatcaggattggataaatgtgttatttctctttgatttccatggagccacactgttggtacatgtcccctgtgaacagagctacctttcaggagcacatcatactgtcgtgagtcacggcacggtgtgtcctgtgagaagaggctttctaacgtgtgatttgccgtgtttctatgttgtgatttaagcgtgattgcctactagtcattcaaggtaacatttctgcaaatttcatacagatttttgtcacaaaattactataccaatgatctagttgaaatagaccaattgaatcacaataaataattttttttaattgagggaaaatttgcttcttgttttttcaaagccagaaaacgagccatttcaaacatctttgaagagtcatgtgctgtcacttgttttctatgtgttagtgtctatattcatgtatggatacacatgaacatgtatattcatacacacacgccaatagaatataacagcctaaaaacaatccagcttgtgtatcatgttactgtgctgaattgtaatggtttttacttacaaagtgaggctaaaatcgatttcatgtctttgttaaatacgttttttcagcaatcctattagagcttattttgaccagatcaaaataagtacaagttcagagactttaaatatggctgaggtctagagcgatagctcagtagttaggaac

SEQ ID NO: 33373 - DNA, 1175 bp, Mus musculus
ctgctcctaccacctggtacagggtctctatggaggaaggctgagaatgaccaaaatggtcgtcataggagtgttcttgggtctccatcatactgagcctcagcctctgaactaaatgactcatatgctgtgtgtttctccttccacactcctagcatacatccaagtaaaagccaacttctgtgacccacccatcacatgctggttactgtctttccgtggccctgtaggcatggtagtgcaactcgatgcaggcgcctccgttaggatgcaggaaaatcagaatggaattttgtttgtagctttcctgggtgtgtaagattctagggatggaaccttggaccttccactcagttgacaagcatctcgccaccaagctgtatccctgccctgtttgtgctttctgttttgaggcaggtgctcagtgagttgctcgtgctgtgaggatggaattttatatcttctgcagagagaagagtgcttagcaggaaggtgtttgggggaagcctctataagccctcatagcacacacggaaaggcccacccgaagatttggcctgacactagctgtctgtactcctttacagacggacacatcagctctgactgcagcacaggcaacataggctctcagcagtcccagccagcatgatttattactgagggctacgggtcatctctgagctcttctgtagcctgtgtgtctatggcatgtccattcacagtgtccagcatattcaccaggccaggcctggactagagagactgaacgtaaagagattctgggctctaccaggaccaccttccatgggaaggaagccatgcttcattggtggaggtacagacagacccgtgttcagagcaggtctgtgactgctctccagccccgtgtcattcctcctgaccccgcagtcaccatgataaaatgtctaagggagggaagagttaatgcatggtcaccaaaggctcacaatagaaataggcttaccatgccctcaacggacctgcttttataaattctttttaaaaggttcaatacacattttctatcactgctatggagtcagcagacaagccacgatccaatacttgtggtttttacactgtgagattttaaccttcgctggttcgatatgctgcttcttttagccatgttctgcctgccaactaccaaa

SEQ ID NO: 33374 - DNA, 1109 bp, Mus musculus
gaaaatcaacacacccggtgcctctggccatggcagatcccgctgcctaactggtgcccggggtgcacagggtagtgttgggtaacatcctctggcttgctgttctttcctgaccttgctgggatttgtttgccaaagatgagtgactgcatattgctagggctcagtgagaatccaaggcatagaagctagtatgtgagctatgttcaatgcagacaggactgctggtccttgtccccacttctgattttccacaaaccagtgccctgcccagggcctgctcttgtccccagagtcactgagggtctgggggcactgtcctttgggctcttcctacggtctgtcatgctgccatctcctggtgccttcagcccccctcctcacacttagttcccatcttctactcgcctaatgaacacccctgaacacaggcactttctccagtgcgacaggaaactggaaacaacgtgggtggcttactggaatgctctggtaaagagattattgcagcagtcaacacttctgatcgacacaaatgaaactgacaacaatgtgattaagctgtttgtgcacagaggaagtgttgttgttgttgttcatggaaatgccccgacacggctctgaggagcatgactgacctctgcttcgggctcttgtttttgaggccgctttcttacctcctgcctgccctggctttggcatctttccacactgtgctggtggtgggattctgaaagattttgggagatctctaccatgcctctggtgctcactcgcatgcatgcacaaatctgcaagtgacgccaagcggtcaatggaagatgccctccaggaaaatggctgagagactcaaaagaagcgaagccatggtgtacagtttcaaaacattcctagctggtaggtgctgggccctctttaaaatcttgacccattgatagggtcagttctgaaatctcagaaccttgttgttggtcaacattatattgttccattcaaagtagccactgaacctgtcactcgcagcaggatgtggggtgtcccggaacataactctatgttatcccttttgtggtttttgttgtcttctgtttcagggtgtgcatcgctgg

SEQ ID NO: 33375 - DNA, 1453 bp, Mus musculus
tccatactcttactactggccactgactttctgcagggagtaccagggaccagcctgtggactgtggtgggagtcttgtctggatttctgattggtaagacctactgagccttcttagccacacttcctttccaacttgtatttgtattttatgtttattcttttcattttcaagtgtgtgcacatatgttatatacatatgtatggtatatatgcatggatgtgcatatattggtatgtgtagggatgctcatgtgtggtgtgtatgtggaggcctgcagctgatgtcagatgtcttccttagccactttccacttactgagtcaggggttcttactgaacccacagctcactaatccctgattgtcttgcgtataagaagaacaattgttttgttgttgttgttttgttttgttttgttttttcttatttaggaacctagtactggctgttgctaggcaactgttgggcggagcctagaggaaatgctaacaggaaggacagggaacaggttaggggcagtgggcaggggatgggacccatgctgtaggtaagtgccctaagactctgagcttagctttgtagacctgactagactgatgggggcctcaaggaaaggtaggagcagccacgtctgtccaaaatgctgcctatacattgagtggccgatttctaagcagcatgcttgcaagtgaatggccaaacagcgaggtgtccaggcaagagttactccgccacctacaaagtggcctctgtctagtcatcttcctgcggagaggggatccactgggatatgatgtgacagtcctcacagctgagagacctaaccacttcgttcacaggcggtatgacccagtccagtaaacaggataggaggaagtaaaactgccctgtcatcttagaaaggactgggctgtgtcatgctgctccgttgcccaacagcaggtggcgctggacacatctgtgactcctttggcctcctggcaatctccagcaggaaagggagagtatgtcaaaagacagaacaggaacaaccaaactgagtcagtccttaaactcgggcattatagaaaattatatttaatacatgtttaaagtcatatcatcgtatgttattgacagacatgatggtttgtttctataactccagtgcttaggaggcagaggcaagaagagcattgttgtgagttctaagccatcatggcctacatagtaagtttgtggcaagcctgggctaagaagaaaaaccctattaaaatatatatatccagaaacagatcatgggtagagtgcttgtttagcattcaagaagccccaggtttcatgcccaacactattataaatgaaccgtacaagcagtgcgatccaaacacttagctgagacaggaggattgactcaggtttgagaccagcctgggctatgaatcaaggcttcatctcaagaaaacaagta

SEQ ID NO: 33376 - DNA, 1195 bp, Mus musculus
cccagatctgttgctggttgggtttggcagagagttttatggagacagtagaaaagcaggtctctgtgtttccaagagagctcagcaggctggatacacagatgtggcccctctcttcagcacagtaacctggactcacctttgtaatgacagttccaagaaagaggaagtagaaatgtccagtcctcttaaacctagaacagccacagcatggcttctgctatgctctgttagtctaaccgttcttggcagccctgacccatgaacatagaggtccagagtctagttcccacgagtgtgcatccaatgcaaggggttgtagtgaatgctggccctttggatatactaccacagaaatgtcagctaaagctggaaccacagtcctcagaagactattgtagatcacaagcccttcccatagaaagttgatgctcatataggaaagggcgtggatctcactgccctggctgcacagagagaggtccaggttcaaaaactgtgcaaaactgtgaagtatatatgatgctgttcagaacctccataagcaccccatttgctttggttatggaacactgtctttgtttcacacaggaaggctctactgaaccccagccttctcagagccagcggctcagatatgaatgtgatgaccaagagtctgtctagcccttcagactcctgaatggggcctgtgtgtccttgccaaggacagcagtgtcctctggtcatcagtgaatacactctgcaagaaggaacagtgtactcttgttttaaaagaaccaagaacactgagaaatagctggcccatgtaccaagagcaaacatttaatacaattattggcagaagagaacattattttggggggagaaaaaaaaaagcttgtgtttttacagagaaattaactacattttattagtcattttaaaattcaacttgtgatccagaatgaggctattcattttaaaatataagactaaaacttgtaactggtccacacggacttctctttgggtctggagggttggggtttgtagatcaacagtgtgaaaagggtagagagttttataactgcttccttaagtgcttgctggaaacagaagagtacccatccatatgtagggtcttgtgggtgacacagaagccagtctgttttcttagctccaaactaggttaaaagccccctgtgaggctcag

SEQ ID NO: 33377 - DNA, 1219 bp, Mus musculus
aagacagcattttcaacaaatggtgctggcacaactgattgttatcatgtagcagaatgcgaattgatccattcctatctccttgtgccaaggtcaaatttaagtggatcaaggaactccacataaaaccagagacactgaaacttatagaggagaaagtggggaaaagcctcgaagatatgggcacaggggaaaaattcctgactagaacagcaatggcttgtgctgtaaggtcgagaattgacaaatggaacctcatgaaactgcaaagcttctgtaatgcaaaagacaccgtcaataagacaaaaaggccaccaacagatttggaaaggatctttacctatcctaaatcagataggggactaatatccaatatatataaagaactcaagaaggtggactccagaaaatcaaataaccccattaaaaaaatgggactcgttcctttcgctgctgcggccgcagccatgagtatgctcaggctacagaagaggcttgcctctagtgtcctccgctgcgggaaaaagaaggtctggttggatcccaatgagaccaatgaaatcgccaatgccaactcccgtcagcagatcaggaagctgatcaaggatgggctgatcatccgcaagcctgtgactgtccattcccgggctcgttgccagaaaaacaccctggcccgacggaagggcaggcatatgggcatagggaagaggaagggtactgccaatgctcggatgcctgagaaggtgacctggatgagaaggatgaggatcctgcgccggcttctcaggagataccgggaatccaagaagattgaccgccatatgtatcacagcctgtacctgaaggtcaaagggaatgtgttcaaaaacaagcgcatcctcatggagcacatccacaagctgaaggcagacaaggcccgcaagaagctcctggctgaccaggctgaggctcgcaggtctaagaccaaggaagcacgaaagcgccgggaggagcgcctccaggccaagaaggaagagatcatcaagactctgtccaaggaggaggagaccaagaaataaagcttccctcgtgtctgtacatagcggcctggctgtggcctcatgtggatcagtctttaaaataaaacaagcctttgtctgttaaaaaaaaaaaaaatgggactcagagctaaacaaagaattctcacctgaggaataccgaatggctgagaagcacctga

SEQ ID NO: 33378 - DNA, 1150 bp, Mus musculus
cgcggccacccgcagctgcggaagccccagaggggagcgacggcgaggatggcggccggcgtgacttcgtggaggcaccgctgcccaaggtgaacaggtggaagaggcacgcgccgccgccggccggggtgaacagacagccgccgccagaaccttctgctccagccaaggtgggaggggaagcaaggttggtgattttggagatgcaatcaactggcatacacttggagagatagcccacaaaagtgtgcagccacagtcccacaagcctcagcctgctcggaagttgccacccaagaaggacatgaaggaacaggagaaaggagatggaagtgatagtaaggagagccccaaaacaaagtcagatgaatcggggaggaaaagaatggggatgaggactgccagcgaggcagacagaagaagaaacggtgcaaacacaagtgggttctattgcaaataggcgtgaagcctgaagtacccagagaaattggcctcctgtcccactcgcccacaggaaccaagacatacacctgctatccgtggggagatgaaaggatctgaacctgccacctacatgcctgtatctgtggccccacccaccccagcctggcaaccagagaccaaagcggagcctgcctggcacgaccaggatgagacatcgagtgtgaagagtgatagggctggtagggcacgggcttccttccgtgactgtggacaggggaggggggtggtcgtggacggggccgtgaatggggtggcactcgaatccactttgactaccagtttgactaccaaattgatggtacagaggggccccgcacccacaggtatatgaacaacatcacttactactttgacaatgccagcagcaatgagatttacagtatgaaccaggagctgctcaaggattatatcaagctccagattgaatattacttcagcatggacaatttagagcaaaacttcttcctgagacggaaaatggatgctgatggcttccttcccatcacccttattgcttcctttcaccgtaaccctaaccactgacatttcactcatctttgggctctaaaggacagcaaggtggtagagatggttgaggagaaagtccgaaggagggaagaacctgaaaagtggccactgcctggcc

SEQ ID NO: 33379 - DNA, 1160 bp, Mus musculus
gaggaggtcagcaacctggagacccttcctaagggcctgtctgccagcctcccagatctggattctgagagctggattgaagtgaagaaaaggtctcggccctcaccagcatgccccaagaagccagagaagcccaggttctcccacccaactgctctgcctcagcagcttccctcccagcagctcatgtctaaggatcaggatgagcaagaagaactagactttctgtttgacgaggagatggagcagatggatgggtggaagaataccttcactgcctggtctgaagaggactctgactatgaaattgatgaccgggatgtcaataagatcctcatcgtcactcaaacaccaccttacatgcgtcgccaccctggaggggaccatacagtcaaccacacttcgcatgccaagatgagtgctgaactggccaaggtcattaatgatggactcttctactatgaacaagacctatggactgagaagtttgagcctgagtattcacagatgaagcaagaagtggagaacttcaagaaagtgaatatgattagtcgggaacagtttgacactctgacccctgaaccccctgtggatcctaaccaggaggttcctcctgggccacctcggttccaacaagttcctactgatgctctggccaacaagctattgtagatgctcccgagccatctaccattgcccgttctctaccaatcactgtcccagagtctccaaatgccaggacttcccacacaccccggacaccccagctcaaagactctagtcaaacaccatgattttaccccgtggtgaaagaaggacgaaccctagatgccaaagtgccttgaaaaagaaagacaaggcacaactcgaatccccccccccccttggaaagtcatgtgggctgggtgatggatcctcgggagcacaggcccaggactgcttctattagctccagtccttcagagggaacacctgcagtcgtcagctatggctgtacccctcagtcactgcccaagttccagcatccttcccatgagcttctcaaggaaaatggcttcacacaacatgttcaccacaagcggaggcgctgccttaatgagcagaagcactttggcactggccagtctcacgagataaacaccctcttctgcttttggtcc

SEQ ID NO: 33380 - DNA, 1105 bp, Mus musculus
gacagacagacagacagacagacagacagacacatagcgtacactcaaagacagacagacagacagacagacagacacacacacacaatataaaaaataataaacccaaaggaagtcagttaagtataccaattaaggaggcactatggttattcaaagttacccaagataacaatctaccaaatgaagatatcatggtagaggatcatgagacacatattagttcttgaggactccaaaagagatgggtcaaccatgctattccttgtcagatggaaaggtatgcatctttgataatattgaggcacatacaacatagtcaaagctgcctattccatttgcacaatgtacaattgttccatatgccagaaaagtaggcagacagacttattcatggatgtccactaatgcccttttttatatagagtggtatagaaattttatatttcagttttaatatttcacagtcatgggcttgaatgagatttggagaaaattacattgcaacagatcttctgaacattgttatacattgttcatttctacagaaagtcacactccctgtgccttgcctgtgaatacaatacaagattaggtagaaaatgggtacagtataatcacgaaaagaatgcagcactgcagcatataatagctgcagtagaggaaaggaagagtctaggggagtcccctaatgccagtgggctgagcactgcaggagagggttcctccgcccacgcatagtgtgtcttagacaggttgcttttcaaatgtgtcaaatgatggtgctacagctcattcctttactgaaaactgtctagtgctttccctaaatggaactcaacatcttgactattttcagcaatgccgtttacatgcctccgtcctactgttattctcccgtaacagaagtcccactgtacattttcagaatcttcagaatttgcagcctcacctgaggctttctgacattcattgttccttgttctgtgacacttattgcccacatattcatacacttgtcttgctcatttccttcactggagttcagatttcttccaacgaaagttttctgtctctaccttgtccaaaataaatcccgatttcc

SEQ ID NO: 33381 - DNA, 1105 bp, Mus musculus; identical to SEQ ID NO: 33380

SEQ ID NO: 33382 - DNA, 1735 bp, Mus musculus
actcacatacattgtcatagaaaaacatatcataccccactcgtatagagcataaaacatatcacactaactcgtatagagcataatcacatacataactacacactcatttgtgtagcttaaacgcttacacacacacacaccctacttccctttatcccttaccatacaatactacttagcctataacatcatagtgtatctagatatgttttgttttctcttttttttaaatgtcatgttgagaatgataactcttcctttacttagcttcagagctaaaagagtaatatatcatcatttgcattcatgagaaataaatactgtaaacataaatataaataggtgtggcaccattctttatttctgaaaaatataaatataaagggagttgactgtctaaaagcttccagagcattccatgctttacctagtacaaaggatgaagagtaagatgagagaaatatctctttgctcaagaaagattcttgaaagatttgtatttgtctctaaaataaatatgaagtgatgaaacctttttaagcagggggtaaatttactcttctgtggctgcttttctttgagcaattagttcaaggaatctttggcattagtttgtgggacaccctgaaaaggaagcctcaggtgttccagtatgtggactcttgcataggaccttgtcactgttttcctttctctcgtgttgtgggtgacctcatcatcttaccaggaccccaatgttgttttgtcatgctggaaggaacacattgctcctgcatgctggccatctgggatcctcttcccatccatccacttcacttctgtgtctaccaataaaaagttcgattttaaaccctttgagaaatttgctgggattcaatgaaatctgaagtcttacagctcccaaataaaaagtaaaataaaagtagatgtctttttctttcaggcgtgtaccagatgtctgtttcagaagcagctgtccctgggggaggaagtaggaagggtgaaggctgaagacccagacattggagaaaatggcttagtcacatacaatatcattgatggagccggcatagaactgtttgaaatcaaaacagactatgaaacactatgttgctgctgctgctgctgctgccgccgcctagagctcctcatttagccccctgagacaagcctgtggttagttgttgttagccttgctacacagacaggaaaccatagctaggaattagacactgcctgagttttgagagcttgctgttagcacaataccaattccgaaacaggccttcctcactctcagggaagcttcttacccgccaggctttcctgcccttaggccttgtgtcagtggaactcttccgggtcacagtaattctctgttaataaaagtttcccaccgtgtgggcactcaatgttagggcaggaaggggatgcctttggtttcatcagtgttggtgtgaaagacccacaacgtgaggactcccccacgttctgactcaagagaggcgacaccccaaaatcaaccacaagaaacggtcttgctgcaaattgcaagaggatttttttattcaagagcgctctcgggcccatggtcatacaccaagcaggggtagaggaccatggcgccccaagtagctggattagggggtatttaaaggaagaaaccacgacttaaggatgtgggaagggcattgttggaaaataccaaaaataccagttaagagtcacaagg

SEQ ID NO: 33383 - DNA, 1735 bp, Mus musculus; identical to SEQ ID NO: 33382

SEQ ID NO: 33384 - DNA, 1205 bp, Mus musculus
ttttctctttccttttgaactactgataccaaaggctaggagaggctgaccttcttaatggggacactggagggcagcaatgggtactttcaaaatgctcaatcccaagaggtttcccgagtcccctggcagtgctttgcttgtggctgatggccagcagcctcaggggaatgcagaaagctgtgtttgctgagctctgtcctctctttcctgtgctgggcagtggggtggggaggtcatggaagtggcaggttggctgttttacaaacaagttcaagttctcttgtctgttggtccccatagcagttgggctgtcagctgctcaaactgttttgttctctaaccacatttgaaaacgatgtgaggaagaataaacaaccgtgaatgtggagtcaaggagacctgagggtgaagcccagcttggctgcctgcctgctgtggaccttggacaaattgcatggcaattctgggtccctggtctcctcttctgacacaccatgacctggtgtaatgtgggacgcccgacttgtctgcaagtaagactccacaacaggatccttctgcaacacgtttattgggagagcatggactgagtaggcgaaagaccccgagccccagaaatggcgctgcttatataggcctacgagtgacgtgtccatacctgattggttatgctaccagtacctcattaatatgcatcgggccacgcagtgactcggcaaaaaacttttttttttctttttttttttccattttttattaggtatttagctcatttacatttccaatgctataccaaaagtcccccatacccacccacccccactcccctacctacccactccccctttttggccctggcgttcccctgtactggggcatataaagtttgcaagtccaatgggcctctctttccagtgatggccgactaggccatcttttgatacatatgcagctagagtcaagagctccggggtactggttagttcataatgttgttccacctatagggttgcagatccctttagctccttggcaaaaaaactcttatgcacatgcgtacattggttgtttatccataatcatgggtggtggccagtggtagccagcgccatcttataatggtgtttgcggcttcccacagtgtaaggagttgcatctgtatgaaatcatctccatttggttattcactggggagtcaggtt

SEQ ID NO: 33385 - DNA, 1205 bp, Mus musculus; identical to SEQ ID NO: 33384

SEQ ID NO: 33386 - DNA, 1149 bp, Mus musculus
gtaaaaatcacattagtaattctcagcaggattaacctaggattatagaaactaattaaatgagtcctctctctgtgaccctaaaaggacacttgacattaccttgcaaagttccatctgtctagggtggtaggctcatgcttagtaagtactaggaggcatgggtgagtttgctgtatccaattgcttttctttcatcatgacttcaaaaatatcccattctttctgataaatggcattaatttactgaaggaaaaaaaagagtgttttaatggatggatttattgaaacaacagtgagataattatgaagctttctaaaagtaaatgggtaagacatcctttgtaatatacacaggcatataaaagaggcatttaaatatgtcccatggtttatttagactgccctgagccatatggggtggtccagacagaacattaagaaaaagacctctgaaatagcccacccacactctggagaaaaccaggcttctggtaattggaagcagcttgactctgcattcctcattcctctggttgagctaaagtgatgcttgtggatctgggtggctaacaccatggattataaatctctgacagaagatctggtactgggttctggtgacttcaggcactcccttccctggttgtagtgatcagtttgcaagacttcatcaagcctttttttagggatgaagcccaacttcagacaagactttctctcactatctatcagaaaacagactgacagtagctctgtgagaaacctcaggtactagggagaatatacagagcagtatcttttatttcttccacctctgactctttaaagagcactcttagattgcttaagatatatttcccttcatgaatctgaggattttgtttccatagatatgacatgaatggaaaactatatttaatgcaggagacaacaatcctatgaaaattaattttcacttcctgatattttctttctctctccagagagtaggggggtttgaggctcacttgatctagttttaaatgttagccatcagctcctatatttgtttccccttttctaatgaaatgaaaaaacaaaacaaaacaaaacaagtccaaaaaaaaaaaaaaacacccttaatagttgagcatctttaccttgtca

SEQ ID NO: 33387 - DNA, 1131 bp, Mus musculus
gtatattctgtacccaagaaaaagtgaatccaaacttaagtcttgcaccaaatgcagaaatctgagctagagaattacgtttcaaccattcttgtaatacttccttgtcgcagaccctctgggtccctggtctgcgaggaacgggattacttaagcagatgggcaaaagagtcggatgaaatgacaatcagacacacgcaagagaggtgttgaatctgaatgtaatgttctggttgagcttcagacttatattacaatgaattatcagaggatacaaatcacaaaagacaagatacactgaaattcaccagttacagcagaaaggaatttgcagggactaattaaatgtttacattagggataacaagccctgcctaggatcagcctaatgccaggcaagaatttcacactttaaggttaaaagcatcagggggttgttaactcttgacaggccttaagagtaatgtgttatcacagagctctaaattcttaggtctagtaaaacttatcctgtctggtgagttcccccttatcagggtagtatatcaacttatacttgacatggaatgtagcctgtagtaaaagatttctatctcagtgagacttttagtctctttctgcagacagctgagttaatggcaagtgctttatttttttatggtagagcttaattagttactgaataggttaaactccttgctgctatcaggaatctaagaacactgggaaaaggctttagctatgttagaattcaatcttaaaagtcatttactataaggtaatgcttaatagagtgcacgtgaatctatacactagactaatgtggtagaaatttgaatattatgggttagggaaagaaatgccataactctgggaggaaaatttccatggaactcttatcctcgtgaaacagcttccaggcttttcgcctgacaaaccgatccaaactggagagttgactttcgccagacatctaggaggaaagtcctagaaattcatttctcatgagcagctttttggcatttctgcctcacaagctgactccaccagagtgccctgacacttcctctctccctcctctacgattttcacagacaaggcataattcctgtgatttgaattgaaagaggg

SEQ ID NO: 33388 - DNA, 1179 bp, Mus musculus
gagcataatcacatacataactacacactcatttgtgtagcttaaacgcttacacacacacacaccctacttccctttatcccttaccatacaatactacttagcctataacatcatagtgtatctagatatgttttgttttctcttttttttaaatgtcatgttgagaatgataactcttcctttacttagcttcagagctaaaagagtaatatatcatcatttgcattcatgagaaataaatactgtaaacataaatataaataggtgtggcaccattctttatttctgaaaaatataaacataaagggagttgactgtctaaaagcttccagagcattccatgctttacctagtacaaaggatgaagagtaagatgagagaaatatctctttgctcaagaaagattcttgaaagatttgtatttgtctctaaaataaatatgaagtgatgaaacctttttaagcagggggtaaatttactcttctgtggctgcttttctttgagcaattagttcaaggaatctttggcattagtttgtgggacaccctgaaaaggaagcctcaggtgttccagcatgtggactcttgcataggaccttgtcactgttttcctttctctcgtgttgtgggtgacctcatcatcttaccaggaccccaatgttgttttgtcatcctggaaggaacacattgctcctgcatgctggccatctgggatcctcttcccatccatccacttcacttctgcgtctaccaataaaaagttcgattttaaaccctttgagaaatttgctgggattcaatgaaatctgaagtcttacagctgccaaataaaaagtaaaataaaagtagatgtctttttctttcaggcgtgtaccagatgtctgtttcagaagcagctgtccctgggggaggaagtaggaagggtgaaggctgaagacccagacattggagaaaatggcttagtcacatacaatatcattgatggagccggcatagaactgtttgaaatcacaacagactatgaaacactatgttgctgctgctgctgctgctgctgctgctgctgctgctgctgctgctgctgccgccgctgcctagagctcctcatttagccccctgagacaagcctgtggttagttgttgttagccttgctacacagacacgaaaccatagcta

SEQ ID NO: 33389 - DNA, 1164 bp, Mus musculus
gggtgttgtttccctaatttctttctcaaacctggttatcctttgtgtagagaaaggccactgatttgtttgagttaattttatatccagctacttcaccgaagctgtttatcaggtttaggagtcctctggtggaatttttagggtcacttatatatactatcatgtcatctgcaaatagtgatatttttacttcttcctttccaatttgtgaccccttgatctccttttgttgtctaattgctctggctaggacttcaagtactatattaaataggtagggagaaagtgggcagccttgtttagtccctgattttagtgggattgcttccagcttctctccatttactttgatgttggctactggtttgctgtagattgcttttatcatgtttaggtatgggccttgaattcctgatctttccatgacttttatcatgaaggggtgttggattttgtcaaatgctttctcagcatctaacaagatgatcatgtgggttttgtctttgagtttgtttatatagtggattacgttgatgggtttccgtatattaaaccatccctgcatccctgggatgaaacctatttggtcaggacggatcatcgctctgatgtgttcttggattcggtttgcaaggattttattgagtatttttgcattgatatttataagggaaattgatctaaagttctcttcctttgttggatctttgtgtggtttaggtatcagagtaattgtggcttcatagaatgaattgggtagggtaccttctgttgctattttgtgcaatagtttgagaagagttgggattaggtcttctttgaaggtctgatagaactctgcactaaacccatctggtcctgggcttttttttttttttttttttttcggttggagactattaatgactgcttctatttctttaggggaaatgggagtgtttagatcgttaatctgatcctgatttaactttggtatggtatctgtctaggaagttatccatctcatccaggttttccagtttgttgagtatagccttttgtagtaggatctgatgatgttttggatttcctcaggttctgttgttatgtctccttattcatttctgattttgttaattaggatactgtccctgtgccctctagttattctggctaagggtt

SEQ ID NO: 33390 - DNA, 1205 bp, Mus musculus
tgtagtgtataaagcactgttccctgggaggtgtatgcataagggcacacccctgtcactcagtggggtccagtgaagtttgtcacaaatgcttagtgtgtgtgcctggggggagttttcccaccagaagagagtgaagttctcaatagagagctgtctgctgctgaggagacatctaaaggagggacacccacagcgccctcccccctccccagtgaaaatgttcctgttgtcagctatgactatgtgattggagtggcttcagagggcagggatggggccagcttaactgagcgagtggctgagccacccggaacagactagcagaaatgggttactctcatttgtgacattaaaagaaaaaaagccacaaaactcctttataggatgtcacttattggccatggcagtgttagtctttttttttttttttttttttgtaggtttctcacctcttttccccacaaaaatagcaccgtaactacctaccgtctacgactgaaaacaagaaaacagggtccgagggcctcggtgtcttcccaggaactcacagccaatgtgccgttcagagggttccgaaggcctttctgtaattccgctgctgccttacagtatcagtttgctcggtgagagtaaactggacgagggtccttttgttgctgcacgagcaaacgcgacaggagctggatgagttgcatcaggttaggatgcagtggtcacgaggttactacccatcacttgggatggctgctttgggttttgcaccttagcggtgcttgctgagctttatcttctaaaacccgggagtatagggatctattgcgctcttggtatccgcaacccttccactccctctccagcgacctcctcccactgacgtcatctactcggtctatagttctgttcttacagaataagtcttgttttggaataaggtaatcattttctaaagaatctaattgtattgatttttaaaccttctgagaatgtaagcatcatgttcacatgtagacatgaaaatatttatataattgtacaaataaataactttttagatgttcaaagagtcaggttttttttcttttttttaatggccagagaacaattccctcttcaaaactttccatgaagcacgaggataaagttgtatcttttcatccaggagttgcctgtggcttgcttattctgtctgtatggctcatgtt

SEQ ID NO: 33391 - DNA, 1211 bp, Mus musculus
ctcagggaccacatctgtgacatgggatttgaagctgccatcaagaacagaacagctcccttaaggctgggaccaattgatgtcaacaagttagaaagcactaacctaaagaaagagacggtctctcctgtccagatttccaatcattttgagaccctggggcaccaggggagctacctggccaccctcccactaagaatagacggcatgcactgtaaatcatgtgttttgaatattgaaggaaatataggccaactcccgggggttcaaaatattcacgtgtccttggagaacaaaaccgcccaaatacagtatgacccttcttgtgtcacccccatgttcctgcagacagccatcgaggcactaccacctgggcactttaaagtgtctcttcccgatggagtagaggagaatgagccccaaagtggctcctcccagagacaccaggagcagggcccgggcaggactgcggtgctcaccatcagcggcattacctgtgcctcatctgttcagcctatcgaagacatgctgtcccagaggaaaggtgtgcagcaaacatccatctctttggcagaagggactggagcagttctttacgacccctccatagtcagcttggacgaactccgaacggctgtagaagacatgggatttgaggtgtctgtgaattctggtatgtcattgttatatgtttgaaatatgtcggggtcatctcttgatgtctcatgacaggatttgcgtagttggatagctgggctctgcctcccgtgttgaacgtcatagcaaagcttggtaacctctgctcatgtgttagcaggatagagaaaatggaatttcctcttctatggccggcagcactcaaatggtagactcctctgatttgggtttcttttctagagagaattcagggtccgcattctaaaaacgagcattgtaggactactaaaccaaaggaccagttgttactttcctctgaagatttctctactacacaaaacagaatagcattttggtctgatgaggcacaatggcgcatgcccatatccagcacttaagaggctcagcgaccaccaaaacaaacaaacaactcaaacaaacacacagacagttgatgcaggaggatccatggtcaaggccagtctgggctttgtaacatgaccctgtctcaaggacattgtggcacattgcatgcccgtaatttcataccttac

SEQ ID NO: 33392 - DNA, 1140 bp, Mus musculus
aagaaatatcactttaagaaggcacagttcctggtcaccccccattacaagtccctttccttttaatgcccctttactagagactagatttcaacagacaagtttacaggtgacagtcaaaacacagcacagggtctcagaaagattaagaatacagtcgaaacacagcacagggtctcagaaagattaagaatagaaacccagagaagggatggagtcggtttaaattcaataaattaaaaaatggtagaaaacatttttagtataaaaataagtctgcttatgattataaggaaattataacatttggcttaattttaacctaaattaatgacatgtcatttcaggtatcctgaagcagtttatgttgtatatactggtgacattaatgtcagtggtcaacagatactagatggtgctttcagaaggtttaacatcaagttggctcacccagtgcagtttgttttcttaaggaaacgctaccttgtggaagattcccggtatcctcacttcacattgctaggccaaagtcttggatccattcttctcggctgggaagctctgatgcagcgcgttcctgatgtttacatcgactcaatgggatacgccttcacactccctctctttaagtatgtgggaggttgccgagtcggaagctatgttcactatcccacgatcagcactgacatgctgtctgtggtgaagaatcagaatcctggatttaataatgctgctttcattagcagaaatgctcttctcagcaaagcaaagctcatctattactatttatttgcttttgtttatggccttgttggatcttgcagtgacatagtcatggttaattcttcttggacattaaaccatatcctctcactgtggaaggttgggcattgcactaacattgtctatccaccttgtgatgtgcagacatttctggacatccctttacatgagaagaaggtgaccccagggcatttgctggtttccattggccagttcagacctgaaaagaatcatgctttgcagatcaaagcctttgctaaattgttaaatgagaaagcagctgagttaggccattctcttaaacttgtccttattggagggtgtcgcaacaaagatgatgagtttagagtaaaccaa

SEQ ID NO: 33393 - DNA, 3596 bp, Mus musculus
taatctcacgtagcttttttttttttttcttttttttttttttttttctttttgagacagggtttctctgtgtagccctggctgttctagaactcactctgtagaccaggctggccttgaactcatagagatccgcccgcctctgtctcccaagtgctgggactaaaggcgtgccaccacacccagcttcatgtagctcaatgtacagattttactaactgtttgctctcaaaatctgagcagtacagatctcaaagaaaaaaaattaccagtcaaatttccatatactcatacatcttttaatcttttcctttccttgtcttaatccctgagtgttcctgcctccacctcccagaatacaccagtgtgtgcagtgctggtgatgggacccagggcctcctgcagtctagacaagcactagcactctgccaactgagctacatcctaagccccaaaccctgctttccaaatcacttctgcttgcgagaacatgaagtaatatttcctggtttttaatctgttctatgacgctggagtaccatgtagagcctcagactgtgaggaagagcagggatgtgtacactgccaccacaaagtatactgagctgatctcaaagactgccttccaaagggaagggaggtgctgaaagaaacagcaggctatcagctggcactctcaaaatgcattcctaaatttttggattaaattctgtttgaggggtgggtttagagggtttagaggttgaacctagagccatgctcatggtacacgagtgttctaacccctgagctactttacctcaactccaggagtgccgaaataacagcgtgggtgacccttttaagtacacctattaattttcttaaaaggaagaagaaacttcaaacaggcatctctaatcctacacctaaagtatcagtcaggagatggggtggactcatttcttcatgggtgtgtacagatatgttaaagtcaaaacaggcagccatctttcccataactaggtttgtatggaaattggggtttgtatgggtttctcatctcttaacagccccatttaaggctaaagtcagcctcagttcattcaagagaatatcaagctaagttgcttttctgaaactgaccatgtatttataatgtatatacatatatatttctgtgtataaatatatatacataattttaatgaacttttctctttcttctggactgacatatgagccaaagaccgcctaacagaaaacccaaccccagacacaagattcctttttttattgcccagggttgtccaggagactccccaaagcatagagcctattgcttttgcccttggttacccctagcagtggaagataagtcccgaatgctgaagacacaatgtactttagaaagaggccaaagacccctgagctggaactgacctgaaagtgcacacagagagagagagagctgttgctgccccaggactagctttcatggtatgaaggtgccaggcgagcttccaaaggggaagggcaaccaatagtccgacccagctatcccacctataaaccacatggaaaaccagcatggcacgcacacttgacagtaaccaacagctcttaaattggacacacgacctgctcaactaggagaacctagctaactattccgcactagagaacagccactgtttactaaaccagcataattcctaacaacaatctataaacatttgtctagactcttaaactatacagttcttcaggtatagcctacaaactaatgtcaacttacacattttctctctttaaatgaatatgcatttcactgaggactctttcctagacccctggagatctcactgtgagtgaggcagatacagtcttaactcgtgatatagaggtctgttggctgtttaccaagtaacttagcactataaaaacaatttttaaaactttttttttacaatagtaaccactaatagtaaaggttttctgcactcccattattacagatagatgtgattacaagtctgtagtttcttagtagctgaaaatcagtataaatttcacctggtcttattctgcgtaactggcaggtgtgtgggagctgaggctgtgactctaagaagctgtaacgtgagcagatgggactctaaaggcattcaccattctgtacatacatagttccttctagttaaatgaattacccacactgtttgacattggtgttagagcatacaaaagaggcacactgtctcttccagctggttggttggtttgattgttggttgtttttgctttgtttggatctccctagcttcattatctattcccaattacattgttaattcactacagtggaaactcagcaaaccatcagctggggttagagataattcagtctacaaagatttcagagactggaggtggacgggaccttccacgttctctattttgttttcaactttacagaccaaaacaatttaaagaactgagttgacttcttcattgtcacaaaactggttaatgacagaatcaggattctggccttgtattctgactcttggcccactctgttaaggccagtctgcggtaaaatttgtctgtagcccacacagcctacacaaagtaataggactttaaagtaattctagaaattggaatgaacatagattgggagtgtggtaaaagaaacgattctcaatttcttaaaaaagcactttttcattaactttccaacgttattttaatgggttagaagcatatgactgatttacagcattcctgatcatgttttacagatgtttactttttactagatttcaggtaggtactgtgtgaaatggtgagactcgtttttatctgtttctgtgagacttctcagtggttgttaagtccactacaactgtgattttccccctcggtggtccaagcattcagttttgagtccacaacagcagaggttcaaattcctgtttacattgataacacaactgtgaagtatccgttacctagtctttgtataatatatttatatctcattgtgatgtagaactgttgatacaaaatcgtatctaaatgtgtcaggtggtttcgttcattcaattaaaatgtttttacatcatctttccctttcttccttaccttcccatctttctacctctcgagttcatggtttcttttccttgaatgattattgctacatatgtatgcaaataaatgtatgaatgcaacctgctggctccctttggtgttgcttgtatgtatttgcttttagggatggtgatggatgaccagttggagggttcatccctgaggagagctaattctctctcagcactcattcattccctgcagctcttcatctaagacagtggttctcaactactttagggtcacatatcaggtatttacattacaattcataacagcaaattatagttatgaaataattttatgattgggggtcaccagaacatgaggaactaaactttagaaccactgatggagggttggaccatatccaatttcttcaacatatcaactcacagtgtggttattgtttaggtcttatttgggcatattgttgatactttgtgagtttagattcc

SEQ ID NO: 33394 - DNA, 1234 bp, Mus musculus
gtatctttgtaccacatgaatggcatgcccacagaagccagaagagagtgtggaattttcccgagactggagtgaacagtttgagctgctatgtgggggctgagattcaagcctgggtccttccccccaggcattttcaatgttaagacatcttatggttaatagctagaggacttggaattaagaaatcagactctggtactcaagtgtccacataatacagattgtaacaacaaatacacttctagggacttggggtacctctcccttcctaaagacagtctgtctggcacatgggtccctcatagaagtacgttatgagaaactgcaaaagtgtaagacaaatttgaacatgctttggaataactttgtgggtttttttcagtatgaaaaagatgcaacatgataaaaattccacacttaaagagctaaagttcctgacaccagtgagacgctcacggcgcattcaagacaagacttcacgactgccagccatgttaaaagaccacgacccttctgtgtcttccctggagcagttgtctgagttgggaggggatgcctttgtctgccgccctaatgcagcactgtgccctctgttctttgagaccgacgtagcggaagaggaataggagtcccgagtcctgagcagttatggttgtgttactcctgtggccctgcatgtgtacaactttatcgtaggtctgaagttgtccgcatgcctaagtatggtacaggtaaactccactagcttgtttgttgtgtttttaaaatataatgttggctgcttcactttactaattacttacagttaaagaaacaaaatcagaaaatgtagtctatataaatttatatttttacgttgactttgttcctaatacgtttataataaatatatatgtataatgttccaatgacatttcattgattgacttatttgatgatggaattgactttaggaccctactgtggggctatagttagctgcctatggcatttatttcaacaaatatgttctggggtctcaggatgtgcccccagaagagtgcttgcctaatgtgcaaggctctgaattcagtccttagcaccacaagaaaaactgctttgtaaaatgtcatttaaccacagtaaccaaatttaaacttagtttttgaagtatattgctaagtttgtattacttttagttgtgataaaatatacctgacagaaacaaatgagagttatttttacctagttt

SEQ ID NO: 33395 - DNA, 1190 bp, Mus musculus
ggctgtgtctgaagacatgtcctgacttgtcaagcctggtcctgctatatcctgaggattcaacaagcccgctccaacggcgtcatccatccagttgggagagctttgttcgattttgaaatttctcgccggctgccaagtctctggattctgggacggccccgcccctcgcctgggccccgcccctccgcgctcattggtccgttcaatccacgccggcgccgaggcgcgctcattaagcgatggcagagtccaggaaacgcttccttggcagggctgcgaggaatcccttgccggtgacccgggacctgcagctgcccccgaccaggcgagaccagccggccttccgaggtgagcgatggcacggggcctcggccgctaactctctctgagagcccaggccgctgccgagggtagcgcgtggctcggctcctgccggggccagcggtttatcttcggggtctgagggcgggggcggggctgcccggacccccgactgcgcctgcgcgcgcgctcgctagctcccgggttctcctatctctgtgcttggaacgtggaggtgaggctgggactgtttgcatgatgtcctggacgttttggaaaaatggagttgaatggtctgcagcaagaatgtggaaaacttatgtaagttggtcagaatttggcgactggtatcagatctctctacacagttgtttctggaaccctatattgaaatgtgttccctgcaattttcactcgattaggacatttgatgctatttatttatttatttatttatttgggaggatgaacctcagagctttgtatacgctaggcaagtattctatcattgagcacaagctagagtcctgagaggagggaacctaaactgagaagatgtttccacaagatcaggcaggctgtaggccagcctgtagggcatcttcttaattagagattgatgggagagggagggccccgcccattgtgggcggtgccacccctgggctagtggtcttgagtgctatttaaaaacaaaaacaaacaaaccaggcagagcaagccttgtagctacacttcttcatggcaccaagttcctgccctaactgcttttgatgatgagctaactgtactatggagatattagtaaatgaacccattcttccccaagttgcctttggtgagagtgttttcatcacagtaatagt

SEQ ID NO: 33396 - DNA, 2588 bp, Mus musculus
tttgctgcatgtgctgactgtgtgtccctctgtgtactaaggtaatcgtgctcccttgctttgctttcttgtttgttcattttgggtttgctttgttttgttttccactgcgaattgccactaggtttcagaaagggggtccttaacatccgaagagtttgccaagcttgtgggaatgtctgtccttctggctaaagaaaggtaaggaagcccttgcccctcgccgtggtgtgtgatgtagcccctcgccatggtgtgtgatatgtttctgagtgagcagatcactgtgggctttttctttttgttctcaggctgctccttgcagagaagatgggccacctttgccgagacgactccgtggaaggcttgcggttttatccaaatttatttatgacacagaactaagaattttgtacctgaaatgctttatgtcaataagcttgcattttgccaaggtctcacgacactgagctaagagataaacccaaataaaccaagaatgtgttagaacttctcagtataatataaaactcttcatctctcccaaaatatggtctcagaaacttacttagggtatatacaggaaaatacagaaaaatgaatatgaatatgcatgtaaagtcatgctatactgtgtagaactcctgggatataacttgaaacatggtggatattaatttgatcctgagttcaggtccttggaggaagaagatgtgaagttgcatgtttggatagatcaggtaatcattttgccatgactaaacctcatcaaattgtaaatgttttcctccacatctaatgtgcccatccttggaggcacacatgaaggaagcaacagctacactgtagtttaagaatcaacagcactgaaatcaaactgcagaaagccgtaccaggctcttccttgggggcgttggaagcagacttaggcatgcctctaccagatcaaataaaatacccttggaaaaggagagggctaggtccagcttacgtggagagcactcgattgtgatgcagaggccttgggcttcagacctaccacccacacaccggggaaggagggagcaaggacctgttatgcatttacacctcaggtcctgtttagtttctaagtgatagtttcatgagtggcattctttaaagcctgcagcagtatcattttgtttaagaaatgtggattttgaaatggaattaaagagctgtatagacacaccccgagttgtaatcacaggtcgggcagtcggaaaggtctggttctggaagggcatgaagggcgtaggaccttaggaactcttctgcatggaagctaagggtgtgaaataggaaacagaaaggctaacagatctcctttctcgtctcccaagaagtctcagcctcaaccagacgcatattcctatcataggccagcatgtttctttcttctacaccctacatgttaacggtcgtgtagagaaagcacctgacgataagtattgctgacaatagaacctggctagtaccacctccagattgctggagctttcagtaggttgcctgacttcatatgtatagcatggtgacgttacctcaaactcagggagcccataggccagaaggtgcttttcggaggctgagctgaggtggaagggtggtgatagcgtggccttggagccacagggagggatgcgcaggcacactatctgggagtttgaggacactgtctggatgaggtggaggctactgcagatgccctgtggagaagtgccagtgtcctcagctgcaagccagggagccctaccctgacactttcctggacagtgatggcctttgcctctgtcctccagtatctcgagcccgctgtggccaaggccttttgtgtgggttttccagtctgtcactggttgtggtgaccttaggtcttccctaatcacctcattgtttatctcagggttacttgagggttaattcagtgttggctacccaaatcttctaaggattgggtagaccagtgtcagtttattagtgtgtctcggctctctgtgggatacacgtagtctatcacatggccctgctgcacacacacacacacacacacacacacacacacacacgcaagcacgcacattcctcttgtcaaactaaggatcttaaaatccacaggtcactgataatctgttttagcacttggattggttgtaaggtttttgggttgtagagtccaatggatctagcttgtggcttcaccaccacaaacatactgcatctgtttattcagtgtgacagcagattaacaaaaaaagagtctgatgaagtggcataaacatactttggaaaagtcacatggatttaagaaagaaagaaagaaagaaagaacattgtttgggtttgttgctgttgttggtttgcccttctggcgcttcttttcttgcccagtgtgccgctgggtcctttggtactggctgtgcttaaatacaaaccaatcaagccccgggcggacaaatgccctgctcttggtgctcatcactgtaatttttttcctgactttgctctcaggagcgtgagtatgtaaatatctgataatgaatagtttagtcactgtcaagaaaatt

SEQ ID NO: 33397 - DNA, 1131 bp, Mus musculus
gttccactctgggagaaaagtgcctttctgaaggtagaatggcctgtctttcacattgatttaaataggacagccaaggcagcagaaggcacctttcaagtgggtgtttttaccacccaaccgctctgcctgtttcccgtggacaagccagacatgctggtggatgttattttcactgaccgtcttccggaggcaagagcaagtttgggacagccgctggagatcagagccagcaaaaggacaaaactcactcaaggtcagtgggtcgagtttggctgtgcaccggtaggggtggaagcctacgttacagtcatgctgaggctgttgggtcaagactcagtcattgcttctacgggacctattgacctggctcaaaaattcggatacaaattgatgatggcaccggaagtcacgtgtgagtctgtgctggaggtgatggtactgccacctccttgtgtcttcgtccaaggagtcctggctgtttacaaagaagcccccaaacgcccggaggagaggactttccaggtggctgaaaacagactgcccctgggagagaggagaacggtgttcaactgcactttatttgatgtagggaagaacaaatactgttttaactttggaattgtgaagaaaggccatttttctgcaaaggaatgcatgctaattcagagaaatataggttggtattgagatttcctagcctttaaaagatcaaatcagtgccttcatgtaatcaaaagtgataggactaggtgagtcacggtgttcatgattcattcatcctttaggcgataccaactagtgttattgtctttttctgaaaaagtaagagcatattcatatttcagtttgtgtgggagattggtttgggaatccagagataccaacattgcatagtattcatataaaacagacataccccttcctgcaaaccccaagttatttctaggttacttgtaaaccattaccatgtaattctgtgtaagtagttgttataccacaccatttccagaacaataacaagaagagagtctggacatgttcagtacaaatgtgatatttttcctgactgctttctatccatagctagttgagtctatggatataaattgtgggctaggttggaggccg

SEQ ID NO: 33398 - DNA, 1561 bp, Mus musculus
ggtatttttattaaattagggtagtatgtatgtagcaaccaaaaaactggaccccacatttttcttctttggctgtggggtcttctcgccatagagatcaggcacattgtctgtactgctccaagaccagggggatggtagtgggcgctgttcccactctgcctgtaaggctgaaggaggtaggttgaccttaccacagtgtcaggagtacaagggtcaggaaagcaaagtatttccaaaagcggggtggggagggacacccgtcagcattcctggagaaaattcggcattcatgagaaaactgtctttctactccagtgctctcagtgaccaatggctactgagtgctgcttcatctgaactgatctgaattgaggcaaatgtagggttggcttcctgcaggaagactgttcaaagccaagctctttcccttctaggtgcctgggtctagtgcacattagtcttgttggcagcgtgtctcctcagtctggctattgtgatctttcccatagaaagagtcaggaacgaggggaagggaaagatagaggcctaaggtgaaattttaaaaaactcaatctgttggtttgatttgtggtttcatgtttgggtgcaattgttcttgagacaaaagtagaactttgaaatactttatttaaagaaacgagtgctctgtcattattaaataaacctaatgtaagtctatgaagagtttcacttaaatacatttatataaagagccaatgttaaagagttatggataataattcttcaaggtggtggttgtattggaacaagtgttctttctgtcagctagattcctggtataaaataatttgactgcagggaagttgacagaaagcattacttctgtatgctacaaccctttaaaattgtgctctgcctccacccatgtggtggtttgaatgaaaatgtggccatagtctcatatttggatgtttaatcactagggaatggacctgtttgataggattagaaggattggaggcgaggcctattggaggaagtgccatactgtggatggcctttgcctagtctctcaaccccagagttttcatgcctgagtgctccctgctggataatggagtaaccctctgaaactgtaagcaagctcctgattaaatgctttcatttctaagacttgctctggtcgtagtgtctgtacatagcaaaagaatggtgactaagacagcctgtattcatttatttattgtacatgtttggtgaatgtgtgagtgtgtgtgagcgcgcattcacccatgcatgagtgtgtggcagccagaggttgcctgttttcttctaccaattctttaccttatattttcaagtaatttatagaatttgagattattatataattattgttttcccctttcccccttctaaacatttactcccaccttgctctctcattcaaattcatggcctcttttctctttgttgtaacacatacatatacatacatacacacatgcacacatacacatataaatacatataacacacatatacttgcatacacacacacacacactcacaccat

SEQ ID NO: 33399 - DNA, 1218 bp, Mus musculus
aaagtactagttggactttgtgagtttaaaaaaacacacacacatttggaaaggaaaatgtgcagtgacgaaagagtctgggagaagacgggtggaagaacaaaagctataatcagaatacactgtatgcatgcatatggatggatggatggaagtctcaaagtaacaaagaaaaatatatttaaaagtagcaatgtgtagtaagaaagaaaatttaaaattgtgatagcttattcaattatttcttagattttaaagttcagaatgatcctgatagttaaataataattataaatataagatctatataaatagtgttgaaattggaaggtcttagaatataattatcttcctgtggagaaaagcagatgtttaattttaactaatttcttaccaagtatcactatttaatgtgacttaatgacattagctcataattattttatgcttcatctttctccttattattttctcatagcaagaaagtatgagtatcaacagccacaaagccaggccgacagtgtgcagctctcattggaataaaacttcagactgagcaacagaagtgaatgtgacgaagtacgagaaacacgttcctcgcccctctataagctcagcccagttgtgcccctcccccaagcctgcttgtgttgcttcttctgggacttcctgcataagtgcaaaaatgcttagaaagaaaatgcttagtgactggagatggggacttatccttttgaagatcaatgatgactccaggatacagtgaaaaatacaagcacatctttggaagcaagaatcctagagttaatgtctcttcagaatatttctacagcattaaaacatgatatcctagctgttggggtagtttgctcttaggacgtggtctataatgatatttaacaattgtagcagactaatttgtgttgcttccacgattgttcctggctctttgagtcaactttacttcaagacttgtatgacacacaaggaccttctaggctcttcagtgtcatgaaggttatcccatctgctgcctgtgggtactttctgtatcgggtttgtctccctttaattgcatccccaaaagttgttattttgtttcggatcccacatttcccttgcctccatatggttcctgggggccatcctgttagacaaggagacatctctgtcttgctccctgttgctgtggatggttacagcagtgtcttctgctgc

SEQ ID NO: 33400 - DNA, 1110 bp, Mus musculus
gttagacttaatttcaaactcttcgctaaatggttttagtgtaagaagttctgatgcactgagtcatttagtgaaccaaggacatgtaaaacttaagtcattagaacgtccatctaggatttttatttcaagaaattatagttacaatattgttattatagtgaaaacttaaaatttcctattgacattacttttgacttttagctaaactatcattttgtatgagaatctgcactatgttaagagcttggggttttaacctggttgatttttaacttcttttttttaaggaaccttaacttgaaagcagcgtgattggcttccatatcatctttgaatataaattgatattcctagtttcagcgtgtcctcatagagaccaacagaccaggtttattctttcaggaagtttttcaacaccggaagttgtgtgttatctgcacatggactggattgcccactgactcatacaaacatcggaaaaaaggactgaagaaaggcgggtttcaggaaccaactccagcccacttacggcttttgagcagcttgaaagaagataattctagaaatgagtgacgagatcctagtcatttctacatttgtctgtagacattcatcgtctttattaacctgtctgcttggggaatggtatttgagctattgtccatcactgtagcagctagtaatctacttgtggtcagagtttttacctgtgggtacagaaatcacatcagtagtagatggaagagaaaccactcatcaagacagtgatgtcccacacacccgcagaaattgactttcattaaacaatcactaaaagagtgtggtacccaccaacaagtgtcagttgtttctttataatccacactggatcatcgggagttctgtttttctttttctactcaaggcattctcgaacaaattttagcacaggagatctgataatcatatttgggggtgttaaaaacaagaattgagctggtcgtggtggggcacacctttaatcccaacattcaggaggcagagacaggtggatctctgagttcgaggccagcctggtctacagagtgagttccaggacagccgggactacacagagaaaccctgtcg

SEQ ID NO: 33401 - DNA, 1140 bp, Mus musculus
ggtttctctgtgcagtcctggctgtcctggaactcactctgtagaccaggctggccttgaactcagaaatccgcctgcctctgcttcccaagtgctgggattacaggtgtgcgccaccaccgccctctttgtgtctttatatatatcaattagatgtgtagatgtatctgtgcgtatgcgcatgtgagtgcagtactctcagaggccagaagagggcagcagatccccatggagctggagtcatgggctgttaggaagcaaacttctgaaagagcagtatatgctccttaggatctccagccccttttctgttctctctctcttcacctggcggtgccttcctcatagtctgccactagccaactagcttcatctcttgtccatcttgtcagtattttggtccagactccagtgttttggcacttggtctattttttggctacaaacgaatgctgtttctgtgatggtgttctctctgctgcaggcccttgcttcctttgtccttaggagacaggtattactagatgcatttgataccaggcgtcgcctagaacccagctcctttctttgcgttttctgagtatttcagaaaactagttattgacttttcctgggaacattgaggtttctgtgttttccgagtccaagaattaagattggtgctctagacaactgacactattcagaatcagtcaaggtagctgtatggcactgtgactaactagccaagaggtggtggcatgtattactcctttgtcttaaagattttgtcataagcacaccacgtcagaaccagagacaaacatgccccgtcttttccaccatgccagaattaatttccatctcgggcagcagtttcccagatgatcccattttccttggtaatctggctgaggtgaacacgggttccttttttcttatctttttttaaggttgactcatttatgagtaaataaaaataaatttatgtgctctgtgcatagaatcccttacactcttgtacagataagaagatgagtcaaaatccctgaaattcctagtacaggcaggtgtaagcccccagtgcaggtacggggagccaaacccaggtcccctgcgggattagtgttcctaaccctgagccacctctcccatcttagt

SEQ ID NO: 33402 - DNA, 1118 bp, Mus musculus
agaagcaatgctgtgtggaaaaccatcacaatggatacggcattttttaagtccttggacagtagtcttgcagaaacatgttcaggaaaggcaaaaccacaagcagagtaactgtctacttgagtaaggccaaagtcagcctgccaccaggtcactggcaggtcatccccaggaatgatgccatatatggggctcagtgtcattctctgctgttggcagatctggcactcaccaacaactgtagccgagtggcagtccatgttgtccagcccatgtctaatcccctctgccatcatggcccattgggcaatgacaggaatggctggcaaaagagacagacctgtccacagaacagttcatcctgtctacttagttattggactctcctctgctggtcactttgatgagcattttcatgggacacaggtatcttcacatcctttgcccatttgcagaaacctgccaacactccttccccagaagtccttctcaccaatcatacttatttctcgtccctgatcatccagccagtccattggcttcagcccatgaaccagtgaacaactgtattatctccccttgagaatgaaatgcatgtctgtgtgtactgcctgaaattctgcccactgtgtttttttcagggttgcccctgaaacaggttgcagtgctgcaactctccacttctgggtggtgtctgtagaacatgcggaaccattggtgaagcgagccccagtcttctcttccaatcataatgtgtacaccaagaggctataggcacaggcttagcagcagatggcattgtaacaggagtagaaaccataggcatttgagcaacttcttcatgtaacttgattctgccttcaggacctgctctggcctaattatgtatatcccactttcatttgataatggatagctactgtgtacatagtacttgatttggtggatcagagaacacttagctcgtgaagggcagcccaggtcacatgataacttggtggcctgttatcaaacatttagtttccactgaggcccaagagcaggccaagagctgtctgttaaagggagaataattgtctgcagatgatggtagagccttgctgcaaaatcccaaaggt

SEQ ID NO: 33403 - DNA, 1161 bp, Mus musculus
tgaaaatgaagttttggtgtgtgtatgagtactgctcagttcttaggaggaatgaagtttgaaatttgtagtaaaatggacaggcttagacttataacatggaggccaaactcttttagtcgtaggtttccaaaaggccttgggtgttagctgtcccttgccgtattctctccttacccttcccccacccctccctatgtttctactttcccccttatattctagtttccttttcttggtaagacctccacccccaagtgcctttactaggtacctaacctctgtagctatttggattgtagtacaactaaaagcttaaaagctaacatccacatatgagagaaaaagtacatatttgtcttagggggggtctcacctcactcaggattgattgtttctaattccatcagtttgcttgcaaacttaataatctcattgttaacagctgaataatgttccattgtgtagatgcaccacatttttgttatgcattcatcttttgatggacatctaggctgttgccagtttctggctgttatgatgacagtaagaaagtatctctggaggaggatggtcctttgggtatatccctgacttagtcggggttctgttgctatgaaaagactctgtgaccaaggcaactctttaaaaaggaagtatttaatgggctgggttactgtttgagaggcttagtccattgtcatcatggtggcccggaagataggtgttagagcagcaacaggcagaggcagaggcagagaggcagagagacagagagacagagagacagagagacagagagacagagagacagagagacagagagaggggagggggaggagggagagggagggagagtgtgagcctagactagggcttttaaaacttcaaagccgggctggtgagatggctcagtgggtaagagcacccgactgctcttccgaaggtccgaagttcaaatcccagcaaccacatggtggctcacaaccatccgtaacgagatctgacgccctcttctggagtgtctgaagacagctacagtgtacttacatataataaataaataaataaataaatctttaaaaaaaaacaaaaaaaaaaaaacttcaaagccaaccctacatgacacttcctccaacaaagccacacctacttcaacaa

SEQ ID NO: 33404 - DNA, 1243 bp, Mus musculus
catttttggacctgcttaggacacttcacctaatacggcaccctgtcgctctgtggttattaaacaatctggaggccagctttctgtttatttttggatggtttggaggggaaaggctgagtataatgttctttgaattgcttcgtggtcagatctgtcaaatgccagagatgatcccgtaagcaggcttgctttagcagttcactggtgggagaattagctgttacaaatattcatagtgattgatttcttttgtttttcttcttcttgtagaaagaaagatcacagctttcccagcctgggagaaaaactatggaatgcggtgtaccactgactgaccgtaaccaaacgaactgtaccgacagtagtttgaaagccagcagttagcagtttcttcagacttcaacactgtccagcgctttccagagcagactcactgtttacaagaactcttggcctcccgaagttagcaacctcagattttgtttatttaaagaatttctgtgaaagaaaaggaccccagagcccattttccaaaatggccatggacgggtatctgtggatggtcattttgggtttcattattgctttcatcctggcgttttcagtcggtgccaacgatgttgccaattccttcggaaccgcggtgggctctggcgtggtgaccctgagacaggcatgcattctggcttccatatttgaaaccactggctctgtgctgctgggggcgaaggtgggggagaccattcggaaaggcatcattgacgtgaatctctacaacgagaccgtggaaacgctaatggctggggaagtgagcgccatggttggtgagtagcctccctccattggcaccagtgggacgtgtatgcacttgtgtgtacacgcatagcacgtgtgcgcactctctcccttgctcccatggctattcccacaagtgccgtctttacctgttttgaagctggctttgttttttgtgtctaccataccattttcattgactgtactttgtgtatttttttttttttacaagcaaacttctagtctctcaaatttttagccattttaaagtatacttggcacacaggttacccctcgtagaatattgaaatgttgttttagggatatgttaaatttattaaagaatatgcatattctttaatatatcatggtttaaattttttaacctataaccaaccttgcaattttataatttaatctataatttcattataatccattaaaa

SEQ ID NO: 33405 - DNA, 1155 bp, Mus musculus
gatcagtcacttaagtagcaactatgcagtagtacagctttgatgtgtttctagcctacattattcctttaaaaatgttctatagatctgcatttctagaggctagacagatggctcagcgggtaggagctcttgctgttcttgcagatgatgcaagttcagttcccagcatccacatggaactccagtctcagggttctaacgccctcttctggcctacgtgggcactgcatccctgtgaagaaggcactatatcggtttggaagaagtcatggccaaacactgtgcttggggcctcagacatgggcctcccaaacagctttctgtctctgtgtgtgatgtcagctcaggtgaccctagcactctcatgctggccgcacacgtgggcttgctgaacctgcacctgtgtagaaggtgcctgggccggagcagcggctcactgcagcagaacgaacgccacactgcttccccataactgggactcgcatcatgagggttgtgttgctaccagatgctcacctgctgacctccactttactcattgttacacaggaggaccctgttccaaacggtctccaggcactgcctctgttttatgctgctaccatagcaataaatgtcttttccatcatgtacacaggagcgccaggtaagaacccgccatggaatcctaagtgcacaggaaggtattgtaactgaacagcattgactagctgtggagcaagtcctggtattggctaatagtaaaaggcattgttcacagtcattatggtatagtagaataattataataataataataaatgtttttccttgttttaaataccaagaagatacataaattgcaaaaaacaacaggctttcgagttaaattccactcagccattacccactatgttgtcccagcagccagctgacagccttggagtcttagagcttgttctcgagccatgggggtggtcaggaggaatgtccggttgtccaggatgggagaggcgggtcagaagtggtctaccgctgcaagccgcagactcccagggtctggtgatgattgctcctgctttcccatcctggcttaggtgtgggatggggagaaagagatgtgtgtacctgtagtccctgcacttgggcgactgaggccaaaatgttgcttga

SEQ ID NO: 33406 - DNA, 1881 bp, Mus musculus
cttaaacaactaaaagtcggtgtttgtgaaagtctcctctcctctgcgtcgtcctttaaagtagaccttactcctactgccatgtctctgctcctccaggtgggctccgtggtagctgtgggctggatccgctcgcggaaggctgtggactggcgcctcttccggaacatttttgttgcctggttcgtgactgtgcccgtggctggactcttcagtgctgctatcatggctctcctcatgtacatatgtggtctcttttcttccagtcggtagacggctggagggatgttctgacgtggctaagatactcacacctcccacccttgctttccctgacacatgcacacccttccacacgccttccagatggcttcgtgccggccctgcttacccaggccacagctcatcttccagaattaacctacctactgtacatagtagcatacatcgagctgatgctgtgatggcatgatgtggtgcggttacttacagtagatgtgtattgtgtacctagaataggtagcatttatctccagcaaactaagaacgaaagcagaggcattgcctagaccgcaagactctgttaattgtatataatgatttcagtggtggcaagtgtagagtataaaatccttttttaaatacactgtaatataagtgagatacagtatacttaatgcaaacctgggcgagtgcccaggcccttgagtgactgcacaaccctgggacaggtgttcacaagtgctctctctgaagaatgcgctcctgagctgggtctgagttactgtcatgtgtcacaatggcttcaacggtaaactcaaactacttttaaccgtctgcttcctgtacacctttttgattggagaaacttggaaagtaccaaagaaataggggataacgtgccagtgttgcatcttcccattgcttgtcccctccccacgggccacgacagtgaacctggtgacaccagcagcagccaggtggctgccacaccaggtactggtaagcttgttcagcggcctttccctgtcaccagcgtggatggcgtacggcagtgggggtgtagagttgtacactacatacatatcaagtcccactcggtgtccctccccgccgtgccctgcaacctgaaaagcagaatccttgttgccagcatcagagccagtgagcgcttgatgggctcggatgctgcaagttcacggttagtgggaggcactggcgaggacactgggcttggggatcttagaggccttttctctgtaggacatccgaggttctcctgtggagccgctgttctcttctgacggtgggagagagtcaggatgactaaaatgttaagggcccgaaaccatggaaatgctgctaatatttttatattgacatacattttcacggtacttcattgtaatttttttcattaatcaagcatattaaatttataataaaaaaaagtgcccctcaaaaacttacttctgacgtctttttctttcagagttctcacaaaaataaaaactatacaattcatccgcttgtagtttcccctacatcttactacaattccgtgtttgtgcagaaccagtacacaaaactagaaagggaaagagtgagccacacctctgtcagcaggcaggaacatagtcatccgtccaccatgatgaccatggtaaggagactacactcctgtgtggagctcacctgcttggctcttcgtttctgctgactcccactgaggacctggtctgttctcaagctgggacactcagtgaaacctttcaaattcctcactgtgccagcaatgtcgcctaacagctggatgggtaatggatgagaaccaccatccaggtgtgcgggtttcagggccactgccaagtctgaaaccct

SEQ ID NO: 33407 - DNA, 1169 bp, Mus musculus
tatggactctgtgtttatgtgtctactctcctcgtacttcctctttattatttttctttttttaagttctggtttgtttgactatttgtattctaaagagagaaataaagaaggcatggagtcaggtggttgggggaatctgggaggagctgggggtggggaaacatgaccgggatatagtgtatgaaaaattattttcaataaaaagagttagcggtagaaacatcaacaaatatttccaaaaaggccatttgtacataaccaaggcacagtaccctcagattctacgttgctctagtactagtgtactagtgtagtttactcaaatctcctcagttgcttggttgtgttcaatagcccttttgttttatccacagtccaactgagactcacaaaaacactttagcattacatctttttgttcttaaacccttttcttcatctttcatgacattgaagattgagcagttgcttcgcagaacgtcccttaatttggatttgctttctcgcccatagacaaattacatgctttgttaagaatactgactcgtgggctggagagatggctcagccgttaaaggctaggttcacaaccaagaatataagaatatcgacttgtgtccctttctgtgaatgacagggcacctgaagttagctttagtcacttggtgaaggcgattttctggctgtgaaggtcctttcctcttcagtaaataatccgcggagtgagtgagtcctgggaaccatcgggatctccttaaccgtttgctggggaatcggttgtcactaaggtggctctaaagcagtggtgtgttccttgcacaattcctgcgacattgatttctcttctaagaagagctctctctccatcctctctctctcttgaattaacttgcatgctctagaagcccgcagtcgcctaacctctagggcctgggttttctctcatcgttccaactgagaagactcacattttaaaattacagttgacctgggacgaagttcccataaagacctgcaagtcatccaccatagagagggtggcagggtctgggagcgacactctggctggcagctcgcgtccgcagagcccgccctgggtctctgctggcgccctgcccgcccgcgccccttcaggggacagtagctacggctttggcacattctcg

SEQ ID NO: 33408 - DNA, 1197 bp, Mus musculus
tgtatgttttcagggctgaccatttggctgttggacagctgattggtatgctcttccctgaggaaggccacctctctgattcctaattttcttcatttgcctatagttctttgtgtaggctagaggccttgtggacttttctctgtctagttggcatatacattggtgctatccttgttcagttttgtaaatgtattcattgggactagagtccacaactctgcattttgattggctatggctttatgtagtgatctccggttgttgcaaagatgaggggtgaagattatacttaacctgtggtataaggacaaatgttaatagactgttgttagggatttagtaaattagtagttacagtttcttctccagtaaccatgacttcactagcactgagtagttaggtttctagtaccagacatgggatggatccctcttgatgagcagatgtcaagtccaaaggagctgttggttaccatcaaggcatgtgtgctactgctgccccctgaagcttatgtcgtggcagtccttgatggggttcctcggcatcagagaaagaagactgttgggtgcccccctcctttggaagcttacacatttccttctgataccatgaaagccagtcctcagggaaggggcattcagggcaggtccagctcggggtcctctgggttctgtttctgaagtccatggtctctttaggagtaggcacttaccttctgcctctgggaagcaacaagggaaacagcagtgtgctgtgtgttttgggagtcaaaagagagagggtctcttttctggaattgaggttttcattgggtggtctgataggttattagaggggatactatcagtccatgtgagatgtgtgtttatacacagaattgtatgtattataaggtggtttttgtgtgtgtgtgtgtgtgtgtgtgtgtgtgtgtgtgtgtgtgtgtgtatagttaatagtatgattctctgtggcttctgcagatatccttagccaccttattttacccaccttgctcttcctcctgtgtacacttttctccctcatccctaaagagcacagctcctttccattttccctgtcagatcacttgtatcctgctatccctctgctcctcacatcttgtgcatttacctccttgctctccataaggagttccctgtattttacactctctctctctctctctctct

SEQ ID NO: 33409 - DNA, 1200 bp, Mus musculus
acgtcttgaatgtcttgtcctattctttcagctggagtgtatggcctagcagcagtgagttggatttgttatagctttgtttcttagcacctaactcagtatccttataaactacaatggccaaatggtgtgtggaggtagttctaaagatgagactcgtgtgacatgattcactgattttttatcagtctgctaagactgccatcaccaagcaccatgggttaggcagctcaggtgccctcttaaaaaggcatcagtcctgatggattagggttctatcctttgacctcatctaacattaattgctttcttttttttttttttaaagatttacttatttatttattatatgtaagtacactgtagctgtcttcagacactccagaagagggagtcagatctcatgatcggatggttgtgagccaccatgtggttgctggaatttgaactcctgaccttcggaagagcagtcgggtgctcttacccactgagccatctcaccagcccccctttaactgctttcttaaagatcttatttccaaatgcagagatcctgggaatgaggtcttcaacatatacattttgaagagaaggcaccatcttgttgactgcctgctgcctgcgaatgccctgctctggttacctttgcattgctgtgtcagaatgcccgacacaagcatctggaaggacaggcttggctgggctcacagtgcagcatggaaggcagtgcatcaccaacaggaaggagcctggggcagctggttacactggcaatgagtaacatagccaggaagcaccaggcaatgaatgctgttgcccagctcacctttcctttgtattcagttcagaccctagactatagggatggtgctgctctcattcattcatatgtatgtgtgtgtgtgtgtgtatatatattcattcactcattcattcctgggtctgcccatgcccaggtgaacctctgtgtatgcaccttcatcgacatgcccaggtatgctttctgtggtgattctgagtccagtaaagttgatgataaaaactaagccaagttattaagatactgacagtatggcagtttgagtttttcaatggctgcagaagcagctacacagggctgtctcagctctgcttagacaatcccactgcccggttgcttctaaagatttggacaaaggaccacacaaagctgggactcag

SEQ ID NO: 33410 - DNA, 1105 bp, Mus musculus
aattccttatgagtaaaagaagtatttttacatttctaagcataaagtctaaagagaaaaaagtctggaaacaagcagcttacataagagcaaattagtttctgagtatatgaaaagagcttcacttgtagaataacaggaatgcatgctaaacagtaggaacatgcaagtttttagagtttaaacactatagattgaaaattgtgcacactcagagtgaaatacaagggagtgtttatactttcttagtggcattggatatgacaccatgacttttagaaaactttgcctatacatttcagccaatcaaactgaaactgtcattacactacttaccagtttactttcaggagtttctcccctccccccatgatgctcatccaaaataagaaaactataaccaggatgtctcggttaaggtttctcttgttgggataaagtattatgcaaaaacaagttgggggaagaaaaggtttatttagcttacaattatacatcacagtccatcattgaagcaggtcagggcaggaactcaagcagaagccatggaggagtagaggagtactgcctgctggcttgctcagcctgctttccctgcagcacctaggaatcagctgctcagggtggtactacacgcttcaatcgttaatcaagacaatgtggttcatacttgcctataaaccagtcttaggaaagcattttctcaattagactcgctcccaagatatgtctagttttgtgtcaaattgagaaaaaaccaaccattgagtatttaacaatagggaaatggtcatggagatgaccattcatcaattcagtagcctataatcagttagaaaaataagaatatgaagtttactagaattaaacagtgaaaaacaaaatggagactacatggtctatagctgtgacttccatctagttgtggaagggtagaccatgacagtagctattactagagatgatatttgtaggtcactttctctcctgcttttcctcagtatccatgttttgatgatgaacttactacctcgtaagagaggtaatttcttagaaacaaaaaggggtgtgtgagagattgaactagcccttctatcacaagaga

SEQ ID NO: 33411 - DNA, 1166 bp, Mus musculus
acagccagaggcgcgtgtctgatgattccagatccgttgaggttgttactcagtgctaagcatcacacccagcactgcactctctccttcatgcagcgtatagcacagtaagcagatgtgaggacggattctgaaggctggtggagactccccaagtaaagggataccccacaataatttagtaagcttatatcttgcatgaaggacataaaccgctagatattgtatgtttaagtcattagcatattaagtggaaatgaacagaaattctggtttaatgatctttctctatgagattgatttatttagaatgcatgtgcctggctttgtattaaccatacaggtaaatgtatgtgcctggcttggtattgaacatagactcaggagctttcagtctcattagcgatgagaatggcaaacaatcctaaccacaaaatacacatgggtactagagagaagggaagaatgcagtgggagattgtaacagggcttccttgtctgtctgcattgcgtggctgtgttcagaagatacatagaaaggaagatgttttcaaagtactgatctacaagactgaagagagagtcggtaagactgtaagaagagtgacacggggacttgcctaggaactgtcagggtgagaggaataaaattgaggagctaagttcactctgtctaggggatgactaaggatcatacaggtgaaactgcagacccagaccacaggttgggaagccctcaaatgaaatagcaaggttatactctgattgaggttggttttccttaggtcggatgtttgcctcagttggtaagagtgcttgcctagaatgcacaaagcccttgggtttggtcccacataagatcagatggtgacggcacacacctataactccagaacacaggaggtgtgggccaaggatcagagaactttaagatgaccttgtggaaattcagtagttgataaggcaagatgccagtgaatgagtgtgtgtgtagttgcttcctcaggtagagcctgttgactttaagcctgagcgagtggaaaatccttcctctaaaggctacacaggggaattggggtggggtggggtgggggtggagtacaaactcgcatgagcgcatgcgccagagcactgcacgggcgccacaggtaaaggtgtgtgtgggc

SEQ ID NO: 33412 - DNA, 2482 bp, Mus musculus
ccaggccctgtcctccagacccaaccttcatttcccacttcattccaacaggaggcacttaggggaactgggatggggacgtggagaacaacccaagctccttaaacttaatgttgttgttgttattattcataaagtgaagcaggtaatgtttctccttgtaaaattccctcccctcctccctgtgtgtgcgcgcacacacacacacacacacacacacaccccctctggaaacttttccccaagagtgtttctaggtagacttcattgaaattgtttttccttaatcaagtataatataattcttttttttttaaaatattcccactcagcactcagagacacaaaaatactgtaagtctcacttaacagcagaatctcagaggaaagctgtttgcaatcctactccagcctttggaggactcagagggtcagctaacaatcagaaaggggaggtgtacctcttggtctgtaccacctggtggaccagccataacatgcacactccactcgcctctgtagtatgtacttggaaatgtggactaagggtcttgtgcttgcacctttgactctggtaaccctcagagcaagcccctgtgatttgcctgtcatatcttatccagtctccacgaacgactgtagtgtcagtgacttagaaaacccctggtgcagacggagtcccaagggagatgatggtgtgactcttgtagctgcagaagtgatgcatacctctcgttttcattttgtcttgagatcctgaattcacccccaagaaccagtgtgcactagcccctctcctgtgaggatgagcaaggagagacccaccaccagcatagtagggcacagctggcagtagggcttcaggaggctcacatgttgtctcactagtttgcccgttctcttcctactcgctccagggataggtaaaaaactatatatataattataattatatatatatattatatattccatcattagaagatggaaactattataccagttggtatgtgcagtcaaatatccaaaaggaggacataatgcttaaaaaattacctgtaagcataaattctctcctttatttgtacattttatatagataaatttttaaagtactaattaggcattacatttttttcaaatgcacaggtttgttgggcttttttatagaccttaattggctttctcaattaagtgtgttagctagaaaagcagaattccacactgtcccgctatcaactctgagcatgcgcaaggctgcgtaggacccagtttctctgtatatactgttccggttcccagtcatctctgtagaatgtgcaccgtgctgccctctcccacatcttcagctatgtcattgcttcctggatgggatggggcagggatgggagggagggaagggaggtctatttgggaggagggtgggtcaaggcagaaggagacgctgttgaaatgagggccgtgaattcactttctgttggtttgcagttgtgtttgggtttctttgttttgttttgtttttaaattcaatcaggcagctcccttttctgcaagcctctttgtgactgtagaactattgtagaaaaaaaaatatgttcttttctatattataaaagaaaattatccaacacggtaatattggtacctgtcattttttcacttctgttttaaaaaaatgtatttttagcaagataacttgggtaatcttctaaaaaagaaatttaaaaactcacttgttagtgactttgatgccttttaaaatgagagctttttcatttcattccatctttaaaattttttatctttgttgtagaatattaaaaactattttaagaaagataaaaattctctttaaagagatgtctagagtgtgtgaatagagccccagatgcctctaaaagccgcatgtacaaaccgagtctactcccgtctgtttatatttgctttcctgttttgtaacctctttgtactctgttcctggtgacttgtaagccgaggggaggggcacctagacgccttggtgtttctccatgtcatacgctcctggccaggcagcccccctccctctccttgtatgtaatatcttttccccctttctagcaagtactttcaaaagaactctgtacattttaacataaaaaaaataaattatgttgagccattttggatgtctgtcttgcctgtggaatttttctcccaaatgtttcagactttccaggattcttgatccacgcggagactgcagattcacccttttcatactcaccatagtgtccatttatgccagtgattaaataccaacacatactggggtggtggtcgtctcactgtgtaggcctagctggcctagaacttgctacagaccggggtggcctagaacagatcctcctgccttgagagttccaggtgttggatttttcatttcccccttttctaaagaaaatatagtaacttgaattttctagagaaatctatttgaaaa

SEQ ID NO: 33413 - DNA, 1504 bp, Mus musculus
attgtagagtgaaatcgggcaaagagaataaagacgtgaacaagcagtcatggctgtgcccagtgaaacttctttccaagagcagatgtgaggcaggatgttgagctctggctccatggtctgagtgtcccacccccacccctcagcatctgcagtgttacagaggagggaacaggagcctgcctgtgtgtcttgccagattccctgggggttgagccacacagtgcatgtgtcatgtggcagagctgaccagtgagcttccctgctgctatgttagcttctgtcttttcagggacggtggattgaagagagaaaaggtgaaggacacattcaaggaggagcagcagaagctatatagcaagatgatagtcggaaaccatgaggaccgcagccggtcctgagcctccgtcttgtgctggctgaagccgccacctctaaatcctgaagtgtgagccagctgcagttgttgctgccacagcctctaccgtcatccccgccacccactgctgcatccttccggactctggccctcaggctgttctggactccaggactggagctgcgtcagagctccgtgggctgcctgctgtcctctaaccagaatgcttctggctggggctccctgggacaaaatgcctcttgttcttatagtaagcctctaagaggaatgccattaaagcagttctagctggtgaaaaggtgggccctgttcttgccctgagaggatgttaggtgtttctgtagaaacagccatatgctggtaaagtcggaaaagacactgcagaggccggtgcctaaacagcctccagcttagcgcttgagatgtggcagaaaggactgtctgcaggagtgctcacgtcctccagcgagtggagtcctaagtccctgtgttcctgcttatgaagatcaccagaggagataggaagagccagtgggctcctgggcagttagctagccccaggctgagcctgaatcccccacatgacttgtttaatatgtctcagtttccctgtctgttccatggaattgcggagagagatggtggtgtgcctacctcacagggttgttgtggggattccagtgctagtgcgtgtgaaggaaatgtgtgctgctctcccagggacagcttcagagagcgtggcaggacaaggtcagagctacagctgctgcccaggattttaaaattgtttgtgagtaaataaaactggatggtaaatgaatttagggactttgccttcattcctgagaaatgtatttcttgccggttaacaacctttgtactggaaaatgactggatggctgggtctctgccccactctgaagtgagaagaggctcaggacagggtaggctcatgttgggtgtttttacatctctgttattcctagcatagacacagatttctcctagataagagccatgggaaccaagctgaggttgatgagattgggggaaagggtcctgtcagaggcattctgggttcaagcgtggtggagaacagcgagt

SEQ ID NO: 33414 - DNA, 1609 bp, Mus musculus
aagttagggcattgacatttcatattgtacccttacctttcaaaatgttcatcatcagaaagttggcatgcacggccagcttcactcattgtggaatactggaatgtccgttttcccccacgctgtatctgcttgcctgctgcctttttaccttgatgatagagaagcaacctgtgggctcccagctgtcccttgtcacacatatggaaggaagcacattaatgcttctcttgctttgtgtgactaatggtgtttctgtttccacccccagctctggcagcatgtaaacagccttttgccaagaacccaggtcaccgctgagaaggctgccttaagggagaagaatatcggaggacaccaatgccaggcgtgtttggaacagtgctcagtacaggcagcatgagacgttctgtgccagcctctgtgtgctactggcaaaggctggggctctctgggtaggagggtcctgggtcagccagcatcaggagccccctcaagggagcatgggaccagctatgaactctttacagtgaactcagttttagcttatgaaggaattttaagtaaacgttacttaatttctacatactgacgtttggcagccttgggtgtgaagtgccagcagctacccttgtctactggagtttcaggattcttctggcaccaaggcgaactcttcttggtacttctgacaatacagatctttaggacaaatttacccgctgaatgctttggggcaggaggaaagtaaaaccttggaagcagccacatagctgaacagaaagctgccccttgccgctcgcttgcccggacactcaggactcaggtgctgttccagcctactcaccacagattgtcatctgtgcccgggagacctggcatttctggggtgctcctgtgacccttctgcagttctgcgccagagctctattcaggcagttggatgacatgaactttgagatggagtttgtcacccgtgagggactggctgcctttccaaggcttgtgctatctgaagggaccatctgaaggacgtgtttgtgtgtggaaaagagggcaccagcctgacgtgcgtcctccaccatgttcctgttgctaccttttgatagcttgattgtcaacctcctgggtatctccctgaccgtcctcttcaccctgctgcttgttttcatcatcgtccctgccatctttggagtgtcctttggtatccgaaagctctacatgaaaacactgctaaagatctttgcggtaagttgtacttctgtgatatgtttcctcactgggaagagaaggacattagcagaaagaatggttcttttaccttctgtgtcacagagtggggcttagacactggacattgccacatgcagaacaggtagtaggacataaggctgcttatgggctcatttttcctctctcactgtaatctgaggtagagtcttacattcatgcaaaaagaatgcacagagcccgggcagtggtggcacacgcctttaatcccagcacttgggaggcagaggcaggaggatttgagttcaaggccagcctgttctacaaagtgagttccaggacagccagggctacacagagaaaccctgtctcaaggaaa

SEQ ID NO: 33415 - DNA, 1230 bp, Mus musculus
gtcttgggttctataagagcaggctgagcaagccagagcaagcaagccagtaaagaacatccctccatggcctctgcatcagctcctgctccctgacctgcttgagttccagtcccaacttttttttagtgataaacagcaatgtggaagtgtaagccgaataaaccctttcctccccaactgcttcttggtcacgatgtttgtgcaggaatagaaaccctgactaagacagtcagttgcgccatttctttgaggaagactggttgaaatttatcatctctaaataagggggaatttaaaatacaaaggcatggctgtcaagagatttttccactttgtttcacaatacttctttctttagggttaaaaacgtaccactaaaatgatgactggcgttttcatcaaacagtggtgccatgcctgggtttcatccccgaaccaccttttcttctctttcctcaaggaaatacaatgaggcttacctgaacacttggactataagcataaaaacatgagactgtgctaataggaaaggattctgacccacaacttaagacggctgaaaggacgtttcttgggttgggaacttggatatgagaggaagtttgaagcctctcgggggtaaaacttggtgtccaagtgatcccagtccaaatgatgttttaatcgttccttgttttctctggacctataattgtcttcaaacataatttttaacaatctcactgcttctcagaaatcttggctgggtatcagttgcttccagaagaggaaggagttcgtgctttcagcaggtgtcctctgtcatatgaaacagaaggttagagacatagctggctaagaggaatttacaagggacgtagctgagctcttaaaacactccaagagaggaagtgggcgtcctcttgcaatggccaagggaagctacttatcttgaggaccatccgtggaaggttatatttgaattaggtaggcatttcactattcggttgagtagcagtaagctttacataacaagttgtgtaaaatgccttggcattgggctggagagatggctcagcagttaagagcatcaactgctcttccagaggtcctgagttcaattcccagcaaccacatggtggctcacaaccatctgtaatgggatctgatgcctcttctggtgtgtctgaagagagcaacggtatactcatatacataaaataaataaatctttttttaaaaaatgct

SEQ ID NO: 33416 - DNA, 1190 bp, Mus musculus
gcccaggcgcatgccctaggcatggtaaggctgtggcatttgttggatgagcagttcctgtacatcaggagcctccagagcattgatgctagtggctttagtcaagtcgaacatgccagctgcttttggttacgcttttgttttcctggcagttcccaaaccagacctagattcatacgtgtttctgcgagtgaaagaacgacaagaaaacatactagtagaaccagaagccgatgagcagaggtgagtagcgtgtggcccttccccatggagaatcagctaaacgccatacatacaactgttcatcctttttcagagactacgtgattgacttggaggtgggctcacagcacttgatccgatacaaaaccatcgcacctcttgttgcttctggagcagttcagctaatataaaacaaagcaagcctgaggacatggagtggtcacagacaatattagaaacgccatcttttgtgtctaatagtgaagtcatgttccatacagttcgtcagcaatgtgtggaccacttggacgtagaaaggcgccgatgcagaattcccttcgttgtcacagccttctcctaaattcctgtttaaccagcaccaacagatgggcccgtgctctgaatactcagcaaataaatcaaccgtcaggtgtgtgccttttatttttctactacttactgagctcaggaggggtctcgaagaggcttccctgccctgcccacgacggccagatggactgggcataacttgatgattacagaactcctttagctttcctggtggaagatcataagcagttgtggtctgcttctatacagcgttaatatgtggcctaatgatttggaacctcaaatactaagcttaaaaacaaatgtctcaaatgtcttttttttttttttttttttttttttcctttcttttgagacaggtttctctgtgtagccctggctgttctggaactcactttgtagaccaggctgaccttgaactcagaaatctgcctgcctctgcctcctgagtgctgggattaaaggcgtgtaccacacccagctaaccaatgtctttcattcataaccgaagaaagtcacaactaacaaagccgctcttaaatgtcacgcgtgtggtaggagagtctggggacagttcttagctaggtgtctaatgaagtagattgacccccagcaag

SEQ ID NO: 33417 - DNA, 2119 bp, Mus musculus
aaaactatgtgcccttttctaatattgtgcatccatattagacacatatgtgttctctctaagattgtctatgataaagatgaagtaggggctggagagatgaccggctgcccctccagaggggacttggcgtgtccccatggctggagccctctcctggcctccacgggcattgcatgcaggtgttacacagatagaggcaggggaaacactggtacgtgtacagtaaaggttaaagaaagaggtgaatacacttgccgtcacagtaagtcagtggtgacagaagtagctgcatttgtcagcattgcgtgcggcacgttctgagtgactaatcatcacagacctactaaagtcagtatcagcacagctcatttgtaacacgtcttagagggttggggtaggtcgggtttgttttggtttttggcctctctaaagtgtgctgttcccttcttacaggtcctgcctccagctgggaccttcgtctatccactggccgatggcagagtgtccctacctcctctccagagcgttattctcttgtctctgctgccagagccacggtgccacacctggagtgaccgctcgtcactcagcatccactttgtctcccagttgtgtaggactctgtgatcttttgatttgtttccaagaaaataaaggaagcaattctctttataaattcaaagccatttaaaacacaggcagttggccagcccaagacagagtcgttttcttaccagataccagtgtcactggttctccttgtcccttgggtcagtttcctaggtggctttatgatcccacaagtcatgtcttagctcagtccctcccccagattagtagcaggctttgagggtgtgtgtgcctgtggtccggctgacccgccgcccgagtccccaagctaccagccttgacgtgcttcagatcttcagattggtttctgctgttcaatttcagaggctccttgagagaataatatatgttacttgttttagtgttgcagttattattaaggcagtatttatgcaattccggttgtttctttgaaagcagttctgttaatgtgcattacctcgagatgttggggagatgttgtgtgtgttgcttgttcattccacagataagtaagcacaatgagcagaccctcagccatcagctccacctgccccagctctgcccggtgtggaagaagcaagtgtcctaagcacctaactctagttttgttacaagtataacttaggagaaaaaattggtagaaataatacagtatgttgctaatttgtaacctactttaaactctgatttatagcctcacatacagtattcagggcacagaaatcttttgattgactcaagtaagttttggcttccgtgtaacttcaagttaaagttaatttttttcagctcttctttatctctatactctcttagtatcggaatttcttatgttcttttaggaatttgagagcactgtgtttgggagaagttaggaaacataaggaatgaatgaagcagttgaacttggagatactgtaggtgctaatactggatctaatctttcagatttaatttgttttctgggccttgtagttactcagtaaaccccttagatctgtgtaataatttaattgtataacgctcatttgttcctttaaagcctattctagtctgtctgccttttaaacttgttgcaataatgtcgccaagatataaacacattagtaaaacttttcttaaataaaccctctcttgtcttagtctatgtgatttgataaagggaatgctatggcatcttatttggatgacaatattggaataactgataaagcatatctaagcatttttaatttttttatttagcctgtgcgtgcatgtgcgtgctctgtgtgagtgtgcacatgccatgcatgcacatggaggtcagaatcatatctttccttccaccatgaggacaccagggatcaaacacaaatcaagtttggtggcaggagactttacctggtagcatcttacccacccttacttaatatgaatagatagttttcattagaaaagagttatcagaattactactgtatcttggatcatctgatgacttttaaaaaataaggtagatatt

SEQ ID NO: 33418 - DNA, 3402 bp, Mus musculus
acagcgaaccctctcccttccctccatagccacatccagctaaggccacggccctttagattaggaaggcttttttttttttaagggctgcagcagggccagcaggcacggtgcaaaaggagaggcagaatcctttcactgagcctcgggcacaaaaaacagaaaatgttggccggtttggaaaaacaaaacaaaacggattgtaaagaactgcagacggacagctgctcagctcaacgttgttcgggacatcattaccaattgcttgtggagtctaagcctctacaggtagaagagtctgatcattgccaagccaggctgctttcagtttattattaatccccctctttctgccttagatagaccatcgccaccttcaaaacacacacacacacacacacacacacacacacacacacacacacacacacacacacttctgaaagtagccagggtatcccagtatagaacgggatagctaagggtttgggtgggaggccactgcctactctaccttcagcttttgaactggccacctttgataggaaactgtaggtctcagatggacacttctaccagtccatcgggatacaaggatgccaggcaagggtctgcttttgtatgaaggaggtacgtgggcatgaagagacatgaggcatttcaggctgagaagccaacagctactagttttcaacaatagagtggaagaaatgagcaaaggtagaaatgtcaagcaggtcacaagtcagggtgattgggggaatcctgtgccaacagcctcactttgtaattccatctgtcacatttcaaaagaacagcagcataagacagggataaaagcccacataccctccaaggcttgagtaaaagtccacactcagcatttcaaagactaacgtcgttgactgcccaaggctgccctcttaatacaccgcctatgcatgtgctgtggaaggcaactctgtgcatgtgctgtggaggagatgggcctcatggctgtgcctggctgcccaggaatcagtatagctgtggaaggagacagtatccatagactctgcttttctgcaaggaaagcccttttccttatacatgattgcctataattcagacaaatttaaaatcgctgcctgcctgagccctccacctttacttttgcattcctccggtcatattcttttgaggctaaagtgccctatccgaggagatggtttcaaaggctaactaatctgcagctttcccaagtgcccagaggtatttctcaaagttggtatgcttaataagtgatgtaaatattccagttctcttaggcagccttactcctgttgtccctgtagttctgaaaaaaaaaaaaagttaatttcttccaccaaagtctgataattccccaccgcatccatggggctacagtgactgtccctttggcatactcaatccagaggtaggaatgattttgaagaatcatctagtggccttggattgacccagaaacaggaaaactctggttacttctgaaagactccagcctgaaaactcaccatgccaacttagttactgacctgagtggggtagtgacctaattaacttcatgtttagtagtcctattatcttaacccttttaagaatacttccaaccttaatcacaatgttatgaggaaccttaggtgatttgcctatcattgtggatgatttaaaaatatgtatgtgcattagtaattagaaatagtctaacctcattgtccataactgaaatgcaaagtctcctgagtgtgtagatctgggccttgagccactactagttcagtgcttggtgaggggtctgctcattttgggaaagtgtatcatgtggcagggccctctccgagtggcgggagactgcctacatgatttttttttttccctggggatgttagcagtttcacagcataaaagggaggacatgttctggggggctccagattgggaaccctcaggaagtaacttcctcaggaaggattcataaccaattgatcgatcaattgatcatgtgaactgcagcagctgtctgtccccttacttcagagtccccagcttcagagttttgttgcggacctgtgaggatttcagacacacacacacacacacacagaccagttttgtctatactacatcagcagttccagacaaaaagggaggctatctaggggcccgaaagctgcatgatcagcagcctttgtccttttcaacaaaaggtgtaacaaaccaatgtgcagactcattagctttgtccctggcttccaatggaggtggtccatgtgcgctctgaccagcgttgccaatgaaaaggtcagatttggaaagctttaaaatagtcattccggagagtcagggaaagctaaacccaccaaacttttgggaactatcaatagctatcttagaaaatagacttgagaggcaagaattgtaagaatatgtttgctttttaaaacattctgtatcctcagagctcatggttggtgggttagcactaggtcctccctggggctgagtctaagcccagttccaggcttcctaagaatgtgtaaattacagaaatcacatttcccaaagctagaacctgttttatcttgttagcctccctgtaaccagatgctctgttggaccttcatagccggacgtggttcaagatgtgctccagaagcagacccggggtcacatctccaggatggcatgttggctgctctgacctggcgctgtgggtcctaagcgcagagacggaattcctgttggccctggttcccccctcctcgcaccccctgaggactccactttatagcctaagccttttatacaaaagctttgaatactgtgaagatgttttacattccttctcattcctgttgtttcttaactacatttgaccagatgttttgatgttatcacgtatgttaatagtgattcccaggtgtgttttgttttcatgctttccctgccaatgtattcacttcactaaaatcactcgatcaataacagcgtgagttgtgattgacccaacccctgtcatccactccccactccccgatgccctcccactcggcatgctcccttgagttgcttcagtggtgttttctggtcctagctgggtgggatggggtggaagagacctgagaaggagcacgggcattccctgccctccttccccactaaccatctccgtataagcctggtgtctgtctgtctgtctgtgtgggtttcagttctgccaaacatttctgctccatgtttcagatgcccccacccgacaggtccattttagagttcacgttcaaattaccagcgagaacttaagaaatggcttatgtttggtgctgtggtcccatttgggactttgaagaataaaatatgacatggcagggactgccaaga

SEQ ID NO: 33419 - DNA, 1295 bp, Mus musculus
tgtattagtgtaagctttgtcactatgcgctaaacgtaatcctgactttttgaccccagttaccattaatagtttctggttgaccatttgaacatgtattaacttaggaagactaattgccaataacgtctgcattttcatcttgcatggattaacagccatttatatggacttatgtctcttaatgcacaaagaagcagatatctcgaaggagcttacacaagaaccacaattactagatcatgatatacttggaaagtgtgaaatatggtgtgtactcagttattggcttccattttttatgatctttcaactataacaattatgatagaaatcgatttaacacaatcagttatgggcttccattttcaaatatcttttcaactgtaatgactatgacaggaactgattcaactctcaattttctttatgcatcatggtaaagcattgcagcagtgttgttttgtttgaagtgcacactctatggtacgaggtgtttagtatacccaagcagataggtgtcgatcgaacaggagcagggagaatacttccaacagttgaggtgttaccaaaccacttgagaattcatgagcactttaactctaaactctgaatttcaaagcttgatgtgaagtcctctagaatgtttacatttactaaggtgtgctgggtcctgtctcttttgactaatattttcgtaaacattaggctggagaaaggaaggaagcagtggtttccttagataactacagaattatactggtctctgggattactctctcagctgtattaaaatgaatttgtactttgaaaggaatgatattgacactaaaattttaaacatttaaattttttcataatctttcataaagaagtttaataataggtatattaactgaatttcattagttttttaaaataatattgtttgtgtatatatacatattaaaataaaaacatttacaacaaataaaatacttgaaattcttgttttgtcgtcctctttataaatacataactatttgggttcttcttaatttcagtgttagggcttttggcaaatgtgactgcacttaaggaaaacacattaaaagatagactgttcatttttttttttttttcaggatactcaagtactttagcagttgggtgtgtactaacactggtgaaccagccctagtgagaaatatggcggtgttgaaggccacaagccctcagaaatactaaggagaaagtagtttactgacaggactcttgacttaagaagcatgtgactagggcgctgccattccagc

SEQ ID NO: 33420 - DNA, 1149 bp, Mus musculus
gtttccagcccagtgtgatgaaggttaaaagcatttcctttacagtaatatgagagaaatgatgttttggctcccacaggaagcatgaattagagaaagatccatgcagggtgtgaataggagataagaaagaaaccagagataagacaggagttctgaaaaaaaaataggaatgaggattcctgtgtagttagtgtgtgttacttttgaatgactctcagtctttgtgcgtggcttttgtgcatggtttgatgcagaggcggatcccctcggtctttgagagaagctggtgtcagagtagtgtgtcctatactgagtttccctcagggtgctttaattttgaaaccttaaaaatacccaaaactacagctgattgtgacatttgttttacaaaactataaaacaagaacaacaaaaaaatcttttaaaatggaaaccagtgaacatcataccttaaaagaaaaacaggcgaacaaacaaaacaacaacaacaacaacatcaaaaaacccaaacaaaaaccaaaaccagggtctcactctggagccctggctgtcctagaactctctgtgtagaccaggctggccttgaactgacagaactctacctgcctctgcctcccagttctgggactagaggtgtgcactatgccgggcctaccctctgttcttgtatccagcttttatcatccctgtagccatcccggtaaaaggctgcctagagtccctagaagacagaacacttgggaggccaggctgtatgcagtcacgtgacctgctttagccagacagctcttgaactatctgactgcccattagaaccttacattttgtccttttgaagtgttccatttttttccccctctgagttcactagcaatgaaaatattttcattttcttgcctgtggcttagcccctctctcctgtgacagagatcctgtcagcatatttgttcttgtctctggtgaattacttaaacttctttgaaataatgagtcacatcaggaagttggagaaaagtgtgctcccctccccctttaagctcgggcattagctcaggcagccttcaaactgccttttggctgaggctggtattgaacttgtgctcttactgtatatccccccccccccccccccgctaggattacagg

SEQ ID NO: 33421 - DNA, 1756 bp, Mus musculus
aggacctcttgtgagtcatgagggctaattaaactgctataaccacttgtaggaatcatgtcgtcctcttgatgctccatgaccccaaatgacatagaactgagtgacagagccaccagtctattttccgtgtcatgtcccgaggatatgcggttatcagggtcaaatgttatgattgcagagaccagaacagagacttcccttgaaactgaggtgtgtgtgtgtgtgtgtgtgtgtgtgtgtgaaagagagagaaagagagagagagagagagagagagagagagagagagagagagagaaaaccactcatgttaggacaatctctctctcagaggcttacattaatataaagcagctactgagaagagatggatggttgtttattgcaataagcatctttgatccatgttttccagacaggagaatgactctttcttggcacagtgaatcttgaattcctgtctcacagctcttttatagccagtcgacttttgtgtaatgctaagtgcttgtatactgtgcagcctgctggcccacttgctctttgctttattgcactgcctgttaaatgaagtcatgcacacaccaggtggaactctagcgtctgataagagcctatacactcactagtgaagagacttaaatgtgatttttccccccagtacttacatttttcatggaatagaaactgggaataaagaaattgaatcagaggatgaattgttggctaggaatttcctaggttctagaagagtttagaagattagatttccacccaaaatttagggtatggcttttccactgggcaagatactatttccagtgcctttggggtcatttctatcagccttcaatgaactgtgctaccagaaaattatggccatttcctacagggagagaggtcatggctcattcctatctgtgtaacttttatctgctaggtaaattaaccctgtttttaattagaaatttgtagctctaagagactaggaggcattttttatttaagctagttagcactctgtgtccatagttaatgcaaaagcaaaaacaggcataaagctctccgggtgagaggaagcatgctctttcaaatgtgactgtgaccctgaatctggtgccacactgaagacttctgggctccgtgtgtgggagctgtcccccgactttgtctggccttgtgatcctgatgaaaagaaaaccaaacaaaaatcagtgggcttctttctctttctgttcatgatcttgtgtgtctcccatcccctaaaaaaaaaaaaaaaaaaaaaacttttgtgtgttttggtttttcagggttcggggattatttatttaggagcgaataaggttacaacctacttcaaaagtcagtgccctttgtctctggtttcagcttaaaatcttcccctagaaaattctttggctgctcaacagaattgctcaatgtgaagatgaggaacgaatgaaaaataaatcaggaactcctgaagggcctcgaacatgccctggctcaaggaaatgaggtcatcttttggcgtttaaattgcaaaatctgtctgtccctctcttagaaactgttggcttggttattagtgctgcatcaacgggtccttacagaaagttgagaggtttcggtacacactctgagatcatgttaaacacaatgcggtgtatattatgcaaacaaaggaaaagtacagtttcagtgatcctaaccagcccatacatgagacttgcaagttagaacattgttaata

SEQ ID NO: 33422 - DNA, 1130 bp, Mus musculus
ggaagataattactatcttgtaccttccccagttggatggtggacttgcaatacaggactcacttcctgtgtatcaactaaggtttttaattcatctcatgatttttgtgtcatgatccagctgttaccccgagtatattatcaccctgcatccagtttagaagaaagttatgctggccggcggtcaaaaagagaaccaattactttaaccctggctgcattcatgggaataggtatggcagtaggagtggagatggagtgtcagctttaatagaaggaagacagggaattcagtctttgagggatgctgtcaatgaagacctagcggcaatagagaagtccattgacgctttagaaaaatctttgacctccctgtctgaggtagttttgcagaacaagagaggtcttgatttgttgttcctaaaggaaggaggactgtgtgctgcccttaaagaagagtgctgcttctatgcagatcatacaggaatagttagagactctatgcagaaactgagagaaagattagagcgaaggaaacgggaatgggatgctcaacggggtggtttgagtcatggtttgaatcacgaccatcttggataacttctttgatttcctctgtagccggaccaatccttatgatatgcttacctttagttttcggcccttgtataataaatagaggaatgacttttatctagagtagaattgatacagtaaaactcatggttcttcaaaggcaatatcaacctatagttcaggtagatgaagagttaggggacaccaatctctaaaattctatgattagaattagtctaaacagaagaagaggggaataaaagaaaataaaacttgagacctgtgattcatgtaatgtatgtcaaatagcccaaagagttgttgtgagctttgaaacctggggctgagaacatagcagaacagaccaggacatgcccaggcaggcccattgcttccctagctcccacccctctgacctaagttaaatgttaacaggctgctgatgtttaaatggaccaattatgtgaaaccgcaccaattcctcccccagtccctctccttttctataaaaacctctagcttccaagcctcgtggtcgattctactgtctcctg

SEQ ID NO: 33423 - DNA, 1729 bp, Mus musculus
caagatataaaacacaggagaaaggctcacagtggcttgtgggatattagacgatctcattgagaaccgtttcttcagttctgctttgccaaagtacaggcaattcttaacctgtccgtcagcattacagactgacccagcttacggtgggtcggaaagcagtgctcgctctgtttggagaccgggaattcccctacacttcatattctctgaagctctaatgtggattcaggcatcttgagaaacagaccaaattaggaagtcctgaagcacagggctgggaggcccagagtggatgggatgaaatccctgatttcagggttatagcttaacgctaaacttcctttccagccagtggccctgttccccctgcagacatgcctgtgtacaaaagcttgctcaatcgctcgctcactgggcagccctgggctgagcatggcaggccaaagacttccctttcagcaaagatggcgcaggctagaaagggcactctgcggctcacagtctctttaggatctgtggcctaagttcagggcatgctgaattgaaagtggcgtggcccttctgaagcccccttcccaattccccggggctccatttcagatgatctctctgctcagctgttcctgctgtgtctctgtaggactgtggccctctaagctccctctcaggttttgtttgtttgttttttttttaaagtcttcttgggaagagagaatatagatgttgaaagagtaaatgatttaggcaaggaatttaaagatgtatctattatagagaattttaaaggtaacagattactatttacttactaatgaacagatagggtctgggagtcccagaacaccaagccaaaggttgaagaaatcacctttcaaaaagttttaataatgaatttatttcctgatgtccaggaaaggtttgactggcctccaggttacgatttttttttaagcaatttaacagggctggggatgtagctcagttggtgacacacttgctcagcatgcacacgtccctggatgtcatcctccacccccccaccccccagttctgggggaaaaaaaaagaaaaatttactactaagtccttcctgtgtggagagaaaagggaactgcatatagagccagtgcctctccataggccttctgctagaacagagtaaggcaagcacttggcactgcatagactgcacttctcgtagtttccatctgaatgcagcccccctgtccgtgcctctccgcatgcagttagatttggacaaataagattcctgaggaatgactctcttaattgcgccgcggttccagctttatgtaaacacacacacaccccagttatagttctagtttggagatgctgctgccatgttggcctcaggtaggctgtgtgatgttttcaccactcagaggccgccaagtgtggggctgaggtctggcctgaaccttccctgtatggtgtcttcaataccaactgtcaggatgcctctcttaggcccctgccttctcgtagtttctgagaaggcccagcaaaaatgcttcccaccctcagttaatagtaactgattctactatttgtaatctttcaaatggacacatagaaatctgaactctgaaaccacatccagaccagatacagggcagtgtgacggtcacacccgcagccttggctttgacccttgcagtccttgggacaggattcaggcaccctgttaagtctccaaggcatc

SEQ ID NO: 33424 - DNA, 3245 bp, Mus musculus
aacactcaccctgggtgaaggatgagcagctgctccgaggtcctctcactgaccccacactgtcacggaggttctgtgacaccagttgtgtttccctctgatcagcagttttcagggtgtgacctgctgtgctgcctgtgtgcattcatccagtgatgccctgagttacagcttgtgtctggtagccctgactcagactctggaatcccagtccctgaagctgctggcagattaagtgaaacccgcacacttgtgttctagcaagtgaccctcacacaaccagagaacctgggacctaaggtttacgggcaaggttcaagagaattggtggctcttgcaccctcagctaagttttagcatagtactgtgtgaacacaggcacactttgatgggtgggtggcatttggctttcttttctataaagactgtgatacagagaagtggagagccagtaggatgctccggagggtctagccactggcttcttctctcagaacacaaagcaaatcaccatcttctgtctttcagaatcaagagattgaggagctgacaaaaatctgtgacgagttgatcgcaaagctgggaaagaccgactgagagccgtcccgtgagctgtgcagatccgagtctggctgcttctgtcgtgaccacattatcttgccttatccagaaataatgccccccacccccctttgcagagagaagtaattgtttcaaagcacatgcctgctgctgccatcgtccccgcttcgccgctgcgctgccgctgctgctgctgctgctgctgctgcggcctggctggtggagagggagtcacaagacagctctgccctgcgacctggctgccagctcccgttagagctgctgctgggtctggcttgtgcttctacagcctgagttcatctagctgtcgtcgtcgtctttgcttttcccaagtttgtgacatttctaattttgtggcaactgtgtgggtttatcttcccagctcctgtttgatgtttttatgacctagttaatgttttaagttttcagtatcagcagttttactgaagggggcagtctgagtcatcgtcactaacacttggggctccgaactcccttttagttacagacggactcatgcatgtgttctctacattctgccgcttttcccctgaggcatatccagataagaccctctggggaggagcgtagttacagaaagaaatgtaggctcttattttgaaacagagccctaggtctaaaagccagcttcagactcggtaggggctgggaacctagctctactggggagtgcttccggtacacagagccctgggttcggcccccagaactacaaacactggatattggagtgcatgcctgtgatctcaactctccagaggtggaggcaggatgaccataagtccaaggtcaccctcaactacatagcctcttggaggccagcctggactatgtgagttcttgcttcaaacaaggagtgagtggaagcatggggtatcccagctagtgggaggcaggacaggaagatcacttgagcccagagtttaaggacagcagtgcactaggcaaacagtccttttcttagaaatcaaacacccaaaccaaaccttgagtcagggtggaaaggctgaggatacgagggccaggggtcatagctttcatggctaaggaagatttgccgtgctgtctgctgccccggtgtttggataccccaggacctcagcatggtcccttatgctcataccaaaagcagcagcgtggcctccctcagagctggccttggatgcatgcgtccaccccggggccgatgagtctctaaagcaaagtcaacttctgttatttatttgaaccgcacaccagtgggatgtgggaaaggtttagttgatcttgttaaaagatgacagaagcccacattaccagccagagagtgaagagcctaggttttccctgtttaaaggcacggcacccttttagagacttaaaaataacagcaacagcaactgctttcatactggagatgggcttttaaacagaacgggccggccgtaaagagtcctctggctcgttctccaaaccagcccctgggaatattctaaacaaagactgcttgaatgctgggaaggggagcagggggggaggtccacaagacaaagcaaaattctatgaactcagactggacttaccctgagggcgttaatccccaaatagacatttccctctttgatgctagtgacttctttccatctatctaacaggcaaagtcaagtccactcaagttttgatgccttttttttttttttttttttttttttgccttaatcttataccctgtgtcttcatggtaaatgtgcactatttagcacacaggcatatccctccttgtaaaaccattgcatgagccgacttcagcaatgaattgtgcctcatggagaacctccatagatcttaaaaacagtgttcctttagcagtgtgttgccatgtgctgtaacttttagccccagggaagtgagtaatgtcttttcaagctagaaatcacatttttgtcaatatgcatttattataaccggtgcttaggttaggctatattctgaggcctactgtcttttaacattttgtacaaaaaagaagaaaaaaaaccccaacaacccacaagcagacagaagttatctgtggttggagaaatggcttgacaatcatttgggctctgaattttgtcacagtggcttaatgcaaagcccatagcagtagacatagtgtcatgttcaagtgtcttcaagggtcataaccaatgtcagcttagccgtcttccgcaagggaagttaattttgcattttaagaagcaacgcaggaattcttgctagtgttacggcggcatcagtgtgcgctcattttatattgacttattttcagtatggaaagcttaagagggtctccatcggaaatctcttgttccctgattttttttttcttttaatagtactgagattgtacccagggtcttgaacatgctaagcaagtgctttatcatggaactgtatcttcccctgtcatctttctaagcatgcatatttttaaagtgtcctgtgctgtgctgtatgttaggcataggagaggagcagtggctgtccctccctgcacactggcagacgggccttgaataacaggccctgctaaatgaagctgccgtacaggggacatgaactagccctctaagcagtgtttgccagtggcctcttagtca

SEQ ID NO: 33425 - DNA, 1184 bp, Mus musculus
ctgtggctccctttgtgccttatgtatatatgtgtttctctctctctctcctcacccttttttcttctatgtgtgtgcgtttctgtgtataagtacttgtgcctgtctgcggacttgtgagatgttaggaatgatgtttctgactgaagtttttgatagtgacaaaaagaaggggccagatattctctctcagaccagtatctgcacgttgtgcgtgcatgtgtgcgttttcgggatgctctgggggctgcttttctttccttgctgtcccgtctgtacccactgattctctttacctaaaaccaaacagccccctacctgccaggcctcatttctccatgctgcccaccgcccgcatgcttggctgggccagtggctgccagcgtctggtgaagggtcgtaaccaagccgtcgtctcctcaggtctgccggagagcctcccctccagagcctcgctgttttcctctaacaggtctcgctggctggtggtgtggtttttttgccttgttgcaaaggagatgctggggagcgtttcttcttctggttttggtcccctcctctgtcccctccgtttctccgcctctcggaggtctcatgtcccgggcttgtccattttgcttccgtcgtctcttctagactgctggagttaataccaccgacaaggaaatggaggtgcttcatctacggaatgtctcctttgaggatgcgggggagtatacgtgcttggcgggtaactctatcggactctcccatcactctgcatggttgaccgttctggaaggtatacagtgcactggtcctttccgggtcctgccttttgccatgggagcagcgcatccgttacagggctggggagaggcagaaagggacggctcccgtctgctgcgtacccttttctgctctggctttgagggccatgcagggggagttcctgggttttcaggaagtgacgcgtcagcctccccttgcacatgtacatctggctttctccctggtcaatgtaatgcatgcgtgagccctgggtttaccttgcagcagggctttctagcacaggctccttccatccttgggtacagcatcttccctcatccatttggtacagaggctttgaatgatggggtcttctttagccagtcccacggaaagccatgggcctctcctccatgaatacatgccaataggag

SEQ ID NO: 33426 - DNA, 1118 bp, Mus musculus
ctaggcagtgaaagtacatgagatgtctttagaaatagcttcgctatttcctgctcttggctgagtggtgtaccaggagaaacagggttgagctgtcctataaaagcttgctctggggggctggagagatggctcagcaggttaagagcactgactgctcttcccaagaggtcctgagttcaattcccagcaaccacatggtggctcacaaccgatgccctcccctggtgcatctgaagacagctatagtgtacttatatacataaaaaaaaatattaaaaaaaaaaaatcttccgggtgatggtaccacacacctttgatcccagcactcaggaggcagaagcaggcatgtctgtctaccctgcattcaggagcagaggcagaggtaggcagatcagatctcttaagttcaaggccagtctgatctacagagcaagttccgggacagccagggctacccagagtaaccctgtcttaataaatggagtttggggatgttgatctttaccagccctgactgtcatcgcacgtttgtcctgtcctaactgtcactcactgtttatcccccactcaagactggtcttaggcaaaccacttggcgagggctgcttcgggcaggtggtgttggctgaggccatcgggctggataaggacaaacccaaccgtgtgaccaaagtggccgtgaagatgttgaagtgtgagtggaactcctgtgtcctgtagagtcgtctctttcctttctaagcaaagtggggtctgggcctagtcgaaaacatcctatgatgcagtcacggctcacactgtcactaccggagccgaggaggatgtagcaatatacgtgtttaaatctcaccttgcttcttaatgttgtcctgggcccaggtggtcctcttagtcccacaaacgggctgatttttcttgcagtgtctccagctaccctcagtactacatggtagtagtggctcctgggagggaagtgggaggaaagaagggagtcctggagaaaagggggctcctccgggatccgcttcccccaccccacctcacctcaccccgctctctggtttgcatgggaagccgacgcaacggagaaggacctgtcggatctgatctcggag

SEQ ID NO: 33427 - DNA, 1154 bp, Mus musculus
cttcttaattccaatactaatttgctttgctgaccaaatacctgcctggtaccagaagacagggaggcagagactgggagccgtgatgtgcccttgggctgagccctagacttggggctctgtacatagctatgaagaaaaacacaaagtgtataaatcttgagtatatatttacatgtctttttaaaaagggtcgttactagagatttacccatgggggagacgcccagggtagcatccgttgctatatattaaaaacaaacgaacagaaagaaaaaaaaaaggaaaatgttttttaaaaggtcatatatttttttgctacttttgctgttttatttttttaaattatgttttaaacctattttcagtttaggtttccctcaataaaaaattgctgctgcttcatttttatcctgggcgtgtgaaaagagagcaggtgtccagcgcagaggagggagacagggggtaaagggccatgagctggtcttccccctgccccccatgacctctgtctcctggattgtgccccagacctcccagccaagccttctatctcccgatgcattgggaacagcaggagaagactgaggtcctgagggcagagagccaagctcgcacacttgattgtttcctcggaggagagagtgagaggatgaggttagccagagggtagaactggacagaaacccaaaccctagaccctgtacattcagatgtcttgtctatcttccccaacctactcctcatattcctctcctgtaaatatcctccccttccctgttggtctctgttacccagttgggtctgtccctgagcttggcttcctatagtttttccttcacaaactccacccatccctcaggaaacagaaaacgatctctttggttggggtcaacttggcaactcaattctgccacctgctggttgctttggtaccttggtctcttattcaaacccacaccactcaagccttagagggtttgtttttgttttttgtttgtttgtttggttggttggttggtcttttttttctgggtctgctgaatacaaacctgttcagtatgatttcatctgtaggggttagggctgcttctttaaatgcagttttggcagctgtggtttgggtcattgtcataagagttcttatcgttgtt

SEQ ID NO: 33428 - DNA, 1193 bp, Mus musculus
tttcctcctgtcctgacggggttgcggtggcgacttctcaaaccgctgtcttgtgatggtgcttcaagcattttcacagagaacaggtttgggagatgggaagccagcggggtgagaccctgacattcattttgaagtttctgttataagcacaatgagttcacatttccatgagttttccttggaactatcattgagttccctttttaaaaactttgatttttagtttaagctgctggtatatattgtttttatttttcaaacaaatcaaattaatttaatttatattcttatatttaagaatcaggtaatcataaatggtctggtttttctgttggtatcacagatcttttgaaatgttatttttttttccagtagaatggcactcatctggaatcaaactgtcagataaacaatattgaagtataaagtgtgtggggaggggctacattttgattgaatgtgttcaactggtgtaatcgatgtagtaataatatacatgtgaaattaccttttcaaagaattctgagaagtgattctatcaattataaactcgcagatttttttttttgatttttataaaatgaatgaatacccatttttaggtaagcactttgccgctgagctgtccccactctttccttcccctttctttacttttggagacaggctctcactatgtagccctggctgacatggaacgaaatctatagaccaggctggccaggcattcacagagatccacctgcctcagcctccccattgctgggattaaaggtgtctgacaccataaccagctttagaatatttattttttatagcccactcatctagtattaaaatttcagaattagttacagcaagtctaatattttaaagcaatttaccatggaggagtatgtccttttttatttaaaatcttcataatttaaaacttccaaatttaaaagctaactttgtgggtgctctatagtatcacaagcatataaaaattttttgagaatatttagctaaaatttcagtaatatttgttatttatcatataatttccatatataggaaattaaagaaaaaattcaagtctgacaaatctatagtatttgttaccaaaatgaaattgtgactttgccacctggttctcaaattcagtctgtgaccagtcagtttaaaataaacaaacagaatgagtaaaa

SEQ ID NO: 33429 - DNA, 1183 bp, Mus musculus
acgtttccaggagctgaaagcccagcgtgaaagcaaggaggctttggagatggagaggacctccaggaaaccccctccctacaagcacatcaaggtgagtgcgtctccccgctgcttaaagccccttgacttacagggatgctccgatggtcaccctctccttgttaagccaccacctgggaaccgtggcttacatggaattctgttgtttctgccagagtatcctgcaattagacaaggatatagacctttagccttccttttccagacattgtcccttgatttcaggtattaaatttcatcagcctgtggcaagcgggggtggggtggggtggatgagacttgacatcaagcttcagcctttttgtgtagcaaatagacatagttattgttcctcgtctattctggagaaatcacgataaagagctttccgtattgtgtctcagtgctttgatgttcagttcatgttgctcacagatcctcatcttctcccgcccctctcttgctctgtcgtctcccaggccaacaaagtcatagggaaggtgcaggtccaggtggctgacctgtcggagatcccccgctgtaactgcaagcctggtgatgagaacccgtgtggcctggagtcgcagtgtctgaacaggatgtcacagtatgagtgtcacccgcaggtgtgtcctgctggggaccgctgtcagaaccagtgctttacaaagaggctgtaccccgatgcagaggtcatcaagaccgagcggcgaggatggggcctcagaaccaaaagaagcatcaaaaaggtaatgtggtggccacatggctgccctcgtcagtcgtggcaggactgtaagaagcatagctacttaaagttggacttctcacttctcacagggtttgcacttgctgagcgagaagaaagtgggaaaggataacagaacagcctggcactgtcattgatgagccttgctcagaaggggcattgtgctttttgatttctttctttttttaaaaattattaagtggaatgattcaaacatattttcttgttgttgcttttcatggtggataaacatgtcagagaagcaacataataaagttgattactcaccagggcagaaactagcaaacccagaactttgctgcaacatcaagtcatagccataagtgtgaccgaatcaccaaatcactaagg

SEQ ID NO: 33430 - DNA, 1636 bp, Mus musculus
tttcctttttgacctcgtgctttttagtatctgataacttttatagagtaagccccagggttcatcatgtatttataaataccctaccctgacctatctctctcctgcttctctgctatggctcgcttgtttttatatctataaaaggactttgcacttttcagatcttttcctactagatgactaacaggcttgctctcagaagcctgcctgctccaagccaagtgcaagggcgactgcctgtgccatcatcgcagcctgggtcttagaactgagggttaggaagcagaacgttggctgactggtgtaagtatacgtacaccgtcggtcgtttcatgtcctgtgtcagtgacattgcaaggcactgtgcttactcggagcctgaagctgcttggtggtagcttttcaatatggtttaggtatacagcatttgtggttgattttattcagcccagaaataaaggactcaaagcagcatgggatactagtggtatttcctaacctcaggaggaagatgagagttctggttatcagtggaaagctttagaaattgggctggaaagagctagagatgatagcacgagaccatcacaagcactgtgccttgtaggtgtcgctgggccgccagggtagctgcctgtgtctggccaagcaggatgggaccagtgctcgtcactgccagtgtgctgcagtaacctctgatttcagtctccagtcagggtggggatcagagtggagtaggttttatcttcacttttgctttgcaagccctacctactcttattttaattctcaaaaattacctttcctaagctgtagaatagacttgagttttctgtgcgttatataaataacatatatatatatataaatataaaatgttttatatatataagtggtgtgtgtgtgtgtgtgtgtgtgtgtgtgtgtgtgtgtgtgtgtacacatacatactgagttaggaagtatttgaaactaaagagataataagggcctgcagcccactgcttctgtcagtgtctcccactgcagtgtttgcggaagtgtgtgtaactaatatggatctgagatactgagggtctgtctgctcatgtgaaatactcggctggactggtaggcagcttttatgcagtggcttcttttttgagtactttcttactgtttcgggtcaaagccagactacagtttgaagtcctcccattatctgttcagaacatagacccggctctccaagacctgccgctaatcttgtcaaaacaacactcctcttgcagcacttccccacggagctaaaatgctgccaaccacatgccatgccctaatgggagagggagacaaattgcctcagtctccctgagcgtgagcagcgtatggtctttatgtttctcaaggcactgcttcatttctagacttgaattgcttttcacgtggctgttgcatctgaccatcccggactctgccaggctgctaagggcagcgtggaagtgatcggatggcaaggtcctcaggaaggaccgcccacacttggtctttgcttatttgtaacagaatggttggttacggaaaggtctggtccctccttggatggacgaagggatccgtgtaggcagctttgcagtggattgttgtatggact

SEQ ID NO: 33431 - DNA, 2721 bp, Mus musculus
tcaatgcagtgaagtgtttacacgttataaggaacattggaacctcaagaaaaactcacttcgaggacactggttaaaattcacaggaagtgtccagtagcccactcagaaaaggattggtgtacatcttaccttgtgctggggatcccaagttaccacacccagcctccagacaggaacctggaaagtctgtattagacagtggcattctctggtggctggttcccctgggtgaccttttccccccctctcccatagatggacactgagggagactgtcctgaaaacccacacgcttgctgctgcagcttccttctcagctaccttgtgtcctgcatgctgcctgccttactccatgggatcttcccaagagaaccctctttggagactactggaaagcggaggggcactcactgttctgtatggacgctcagcaggttttgtggctagggcgtttacatatcccaatgctttaacagcagcacttccttgtttcttacatgggaatgaatatctgtttagggggcttggggggggttactccttatccttaccaacactacgggtgggagtataagatgtagaggtacttaggggtcccgtccctctgtgtgttctctgtgctggagggctgagcatcactgcatttgggagagctgctggcttttgagccagcttttctttcctggattatatgaagatcagacagaagcttactaatagcacagtttgctctgaacactgttacgtgagtggattgtagaaccactggtgctggtcctggtcctggtccttacaactgcttcagcttctgcaaccctgaaggttgtattaactgtgtgcctgctcttttacaccgtattccaagccagcggtgaagttgaggacattactaggtaatacttattttgaaggtcaacctgaaattacatggcccttccctgctgttcatgttgtaaatgcagtcttttagtagcaccgatttaagtcacctgctccttccacttgagtaaaggaagtatgtgacataaatgtcacatttttttttttttttttttttgacacagggtttctctgtgtagccctggttgtcctggaactcactctgtagaccaggctggcctcagaaatccgcctgcctctgcctctgcctcccgagtgctgggatcaaaggcgtgcgccaccacgcccggctgcgtcactgctttctgaggtaccatcaaattgtttattacagttggcagtcatggatttgagcatgcaagctaggctaccttctgaaggaaaaccctgtctacagggtctgaggagctgaatctggataactcaaggcacattgatcgtgaggaagggtgactgtacactaagtgttcccttccttagcatgtgccgtcatctttgtcctcctcacgattgccctttagctcctctgatttccacaggtctctatagagtggcaggagaggtgagctgtgttttggtttttttccttgttttgtaaacctatcatggtatccagaggcactgcacataacatgccctgaaaccctcagatggcagtgccctctacagacaggcaaagggagggaagcactgtgccctggacgttagagaggcaagcatggtacgtcaggcccagcctgccttcctgctcatgggtaatactggatgagcaagctactaaggagttccaggtatatggaatactttattttttctacaatatgtcttgagtaagaatacctgagaattaagtagtatattcattaaatactaaaaagtaagttttgtcaattgctgtcttgaggtttgtttactcttgttagcagagtcattactacttaagagtaaaccaaagtacaaccaagagtgcgttcttgtgaccaaagatgggcagcttggccctggagagctagataaacccctgcactgagaaaggcttcttcccgcagtccggtacttacacgtgaccacgctgagtgttatacaaggcagtgtggtggcaagggacctgggtgtggacctgcactgcgtcgtctgttatcatgcacaatctcctgaccaaggctgtttctaaactccagggtgacagcattctgtctgtgattctgtctgtgattctggcagcacagttggtgggagactgtctgcaagggacgatgagtagctctgataaccttgctgatattttgcacttttgaaatgtttgttttatatgtgattatatttaagacgttagtaaatgccgaaataaaactattgaccatttgcctacattcatgtggccttatctatcatcaagaaaatcaatatagtaggcattttctcttacatgttactaaattcaaaacaaaaagttttaggcaactaactgatggtaagctcttttcccttgatggatgtttacattctcatggacactatagctcagaattgaaacagagcctgtccttcagcatctgcaatattagctaatacaactgataccagcagttagttacatacaccagatgggaagccagtcttaatctagacctgaacggttcttatgaagtacaaaccctcaggcacactcttgtgtttcactgccagactttctgagaaaacgaagtacactgagaacacgtttaagactatgtcagagctgggcaatgctggagcgtgcttttagtcctagcactctggaggcagaggcaggtgggtcgcttgagttcactcaca

SEQ ID NO: 33432 - DNA, 2462 bp, Mus musculus
tagatctgtgggacagatctgagctcggtttatgctgatagaaggaaaagaaggagattcacactcagggaatgagtcagccgtagctgaagtggaaaattctttttttttttttaatttaaatttggtctatatttcgtagggcaaattgcatagaattgcctgtttcataagaaagatgttatttaatattagtaatagtcaatttagagccaagtttaagaaaggggcctttcttggttatccgtgtatgttgttattcagagacaggtaaataatttaccttttaagcctaaagtgagatctagcattcagtatccgcttttgcaacagaggcagtttcttagtagaatatcaaggtgatacttttttctagactagcaggcctttatattagtgatactaagcctgtagccttcccttctgctcacaggaatcaaacaaatgctaacctaggatgagaaaaagtgtagtaaaaagattgtctacgggctagagatgtgtgtggctctgcctaacatacatgaagtcctgggctaaatccccagtagtggataaaccagccatagtggtacatacccatctcagcatttgggaggtagacacaggaagactacaagtctaaggtcatcctcagctacctaataaattcaaggccagtctgagccaaataagatcctgccccaaaaaataaacaggataagtgactcaagaagtgatcattgtatcctaggagtctgtagtttttaaaaaatatcatttggctgagtttggtggtgtacacttttaattcagtcagaggaggcaggtagatctcttgagttcaaggccaacctggtcagccaaggctatataaggagacactatcaaatccatttcatctcatttaatctcttatctatctaatcaatcatctgtctatggggtgtgtgtattcttgtgtgcacacgtgtatgtgtgttttatatctataatttttatttttgagacagaatttcatgccgggttggccttaaacttggcatatagcctaggacaacctagaagttctggtcctcctgcctcactttgtattacacaggtaggtgtgtgcctggtttatgcggtgtcaggcaagcactgtactgaggcatagcttatgtagaatatataaaagagaatatagaaatgtctttaaaaggttttcgaagctggatttgtggcacacgcctgtcactccagcattatgaggcagaggcagggtacgtggatctctgaatttgaggctatcttggtctacacagttccaggctagccaggagtgagctctaagtaaccctccaagcgttttctataaaagttttgacaattatgctctaagaggagaaaccttaaagcttagctgtgttgtcagtgagacagtgagagattcggaaggaaacgtcttacttcacttacgctgcccacgatgccaattaatgcacatccttcattggtgtgtgtgtacatgttacgcacaaatgaacatatatgtgtatataccttaagttattttttgaactactaacatgattttaaacttacagaagagttgtaaaaatagcattcccgtgtatcctccatctgccttccccttgttttgacatcttctctaacagaaacatttgttaaaattaaagagttaatagtgctattaatattagctgaagtagcaagctaaaagtagacacttcatttatctttttagtagcatcctctcaactgttccagatccagttttgcatttggttgtctgtctcagtagtcttttgctctgtgatgttacatcctacggatggctggtgttgtcatgtgatcctggcgtggttcacaactgagcgctcagctaacttggtgtctgctaggatcctctgctgtaagctttaccctgctttcctttgtaattactaagtatttgctagagacactttgagactatgcaaatgtcctgtttctgcttagagtttgcctcttactatctcctggcagatcttgcttgtggcatttactactgtggtgtttaaacggtgatttttttattctcatttcttctatatttaataattggaattcttctggaaggaactgtggtttctggatttatatttttaattatatcaagatattcaggataggtataaactcagaatttaaagatagaaattatgttaattggttccagtggccagtatcaaagaaaaaaaaaagcaacatttgtgacctgtctttgaaaatgtaatgaataagaaggaaactagtatttatgattcgtaaaatttgtttgacttttgacttgaatttgatttaaaactgaagcaattttcttttgaaattcacaactagactttttaaaggtgtctaaatttatattactttgggggtcatttttgtcaaaatcttgaataaagttacctacacctggcatgataaacagctgttttctc

SEQ ID NO: 33433 - DNA, 1126 bp, Mus musculus
atatacttgacagcttcgagcctgtgacttttttctagatgagtgatttccttgggaagctggaatacagaccaaagagtcacgtgatgttttatcaaatcttgacctttgtattctattaaggagttcttttttcgggactgaaaacctcaagggcttatggggaatatatcacttggctctttcttcttgttcctgaccacacatgcagttctttaggcacttgtattttctttctcttgttttgtttttaaatcggggcctattaatgtaggccaaggctttctacctagtagtcttcctgcctcgccttccctagtgctgggactacaggtgtgcacacacaattcggattcctccttttctcacataggctctcactgtgtagactactagctgcaaacttaattcttcctggtacatcctgctggcttacaagaaaacatgatcctgtgtgtttactattttaaaaagctaaagggaaactagggagatagttaggtggacaaagtgccctccatgcaaacgtgatctgagtttggattcccagaaccacataaaggctgtgttcccatgtgtctgtgttccctagcctggaatttaaaacagtgaataagagaccctgtgtcatacaagctcaacagcaagtgaaagacaaggacccactatctagattgtcctctgacctccacaagcatgcagtctccatgatacacatactcacatcattcacacacacacacacagagcaaataatagaaaacattataaagtaagagttgaagtttagggcttagctttaatcttatttggagcattaagcaggattctgggtatgaggaatgtcgtagtctaggtaggtgatttaaaaccacaggaaaaaggatcagcaatgtatcttggaggtagtacacttgtctgacacacacaaggtcctgggtttaattcgcagcactgcttaaaacaataaccaaactataataacccacagtagtaagcagtatagtgaagagtttctctgttatctgttattgctatcaggaaagcagggtggttgcttaattcaatatggactgggtcatttctggaactcaccataatacttacaatattgtagtcaccatct

SEQ ID NO: 33434 - DNA, 1145 bp, Mus musculus
cataagcttgtctgttcttggtcttcgtgggaagtcgttcaaacctgcctgttttgcaggacctggagaaggagagtgacacgccccttcagcaagtgtctattgaagagatcctagaggaacagagggtgcaacagcagaccagactggaggcagagaagctgaaggtccagacccttaaagatcggggcctttccattcctcgcgcagacactctggacgagtactgagtccttgctcagagactgctctagagagcaggtgctgtcacctggtcacctcacacattgaccagagtatcacgctgaaaagtgatctcattctttcatggatgccaacatgaagaaatcatgggattttggtttttttaaacaaaatcattgtatattagttttgcttttcttcttcagtctcagcacatagtcctggctgacctagagctcactgtgtaaaccagggtgacctttagcttgtgggactgcaggtggcctccacctccaccagcccagctttactgtctaaagaaacagtggcgtgacctccctcacacaagtcactgtggagccaagaactatgtctttatattgcttatctcagagtttacatttcttttttaaaaatatttcatttacttgtaaataaaaaatgattctcagaactgtcacaaaatggagtttctggtggagagtcaaaattccctactgcaacataaggctgtatacatcctaatgtatacactaggatgcctactgtggatatagctggctcctcaggaggacatttcatactctgctgcttcctagttcccattttcatgtttgtacttggcagaagttttaagcttgagaagggagttttcaaggaactggttacaacagaatcctcaggtttagaaaacttgagccctgatttacccacagtttttccaaactataagaatatgctttgctctcaatcttacattaacttatccagattttcaactccttttgatcatcttttgcttagattatcatctatacaagaacaacaaccctccctacacacacacacacacaaaagccctcaaatggtgcttagtaacaattgattcatgatgacagcacgttttgttggcttgattgttggagagtaataattgcgta

SEQ ID NO: 33435 - DNA, 1155 bp, Mus musculus
gaatgtgttaaggatgaacaattctaacaaccgaaagcttttcattctaagcatgaaaaaaaaaaaaagtaatgtctgtgtgagtgtgcatgggccccagcagacacgtggaggtcagaggacaacttcaggagtgtgccttcgacccccacccgggtcttgggtcctggattgttagggtaggcagcaagcactttcatccgcagtgccattttgctggcccacttttctgtcccttatcgtgtgggtaacccccatcatttgcaaagaactgagcttatttatgaatagaacaatgtggaacatgtacttatttattgaagtcttaagccttcactgatatttattgctcacctcggtgctttaaggtgagcgagggcagctgtagagtgtttctgatagaaccatcccgggaatcagttaagagagcagccacttgggtgctgaaagacccatgtgtgccggcctcgagacaacaggctgccagtggagaagcgccttcagcaaacactgtggctttgattggattagtgtttgctcctatacacaccgtcactctatctctgccgtctgggatgtttgacccatttgtttaatcttatattttaataaaagcagttgtcactggcattctgatacctatagatgggtagtagttcttttttaatctttcaaacgaaccttattaacacattcaagtttacaactgtacacacattttttttttcttgtttcacttcaattgttcttttgagacaggatcttctcactcattctgtagcccaagatggcctggaacttatatcaacccttctgcctctgcctctcaagtgctgggattaatggtggggcctgcaggcatctgggcatttttttcagacactgctaagtactgtcaagcaccttgataacttctaatgcaggaaagccaggtacacaaacacgtaggtagacaggagacctgggcatggttatgtgccaacacccactcatacttcttccaagaccatcacttcactttcttcagagtccttcgaacaccgatgagctcattctacaagctggcttgttctttcttggactagtccttgcattagtggttatctagcagctggtaggctgtgaccccagctttaaataatgcagacaccccaa

SEQ ID NO: 33436 - DNA, 1618 bp, Mus musculus
gggaaagattagctcatggagatttctatgtattcgctcattaccttctattgaacaaaaggaagatgaggttccaagcagaaatcagtgaaaagtgtgtctgtgcctgatgcttgatagacaccaggatgtttgcctcctttgtcccggttagaccctgagatgctgtcacagagatgctgttcttcttttgaaacagtgtctgctatgtagtcaggtgacctcaatctcaggatcctcctgcctcagcctctccagggcatacgctacaattcctacttttccttttaatatcccctgccaagtcaactttgttctttttcaattttttttctgtgtctgcttgtattgaacttgtcccaggtttccattaactttggaccatccttcaaataccctccaaaggatctcacgtaccaccctgtgagtactgtaaggacgcctgcattcatccttcatctttctgtttcttgctcaggcttctgtaatcacccattctgtttttattgctcctgcagatgagtgacatgggctggggcgctgtggtagaacacacactggctgatgttttgtatcacgtggagacagaagtggacggaagacgtagtccaccctgggaaccctaaccagtccttgcttctggtgacactgtaaaataatcctgggggttttgtttttgtttttataaagtgtcaaatgttttccaagagatgctgcagtacactttgatcaaggtaaaagggtgggtgggactgcagcagtgcctgctcttcagcatccctgccccacacaactacttactctgagtgccataaatcagccgctccctgtaaggctgctgctgtgcccagacctgccagggaggacctgttactttcctgtgtctgtgtgttccaaagagcgagtaatcatgctcagacagcttgcttgaggatgttggatcccctggtttctggggaggcaagcttgtttgagtggctgaaatcaatggcattccattccagagcagtctaaaggcagtctttttggtgtggagtttggggatcatctgggaagctagtgggttctataaactataattgtgaaaggaatatgcctacagggtttaaaagatagatctttcctccaataaaacttgttttcaagcttgtatggtacttggcttcactggaagtgaagttcctgttgaccctgttagcagtgtgagcagtgtgacggggacaacactggcagggtgggacaggcgcttttattgctgtcctccccgggtcaccaggcgctttcactgccctgtgtacagtggactctcagggagagcaagactgtagcaggcctccagtccgtgtcttggaacttggtgctgatatgtgcggcttgtcctcttgcctgcctttctagtagccagccaggggttaggatcaaagaatgatgaggagcctgccttacgaggatgccttaatgacctccgattttaaatacataagtctgtggcaaatgcaaaatcctacactgacctaaagacttcccttttttgtgtagccttttttgtttgtttgctttgttttgttttaacttaagtactagtgatataaagtgactaaccaggagctaggtagga

SEQ ID NO: 33437 - DNA, 1199 bp, Mus musculus
ctcatacagccagacactgagtcttcaacactgcctgttacttaagcagggcatggtggcacggacatagcattccagctctctgaaccagtctatagtcaggaaatgggatctcccggctgccaggccccagctcctccttggtgctccggttggatcctgtacacagcctccttaaggagcagccttctggttttgactgtgtcgtagtgatagacagcagcattcacagaaacttgtggaagggactcttaaccacgcggctataaacacttgactttatgattgttgccttttgtgttttctttgttataatccgttttttgttttttttaatttgtctcactatatcactctggctgtccaggacctcccagagatcagcttgcctctgcctccagaatgttgagatcaaagctgtgccccctatgccagctcttttggcggccctttgtgtatgcagtacaagggactctggtctctaagtccctcaaataacaaccattgacctttgactctctccccctccagctccccagttaaagatctctgatgaccggctgaccgtggttggagagaagggctactccatggtccgggcctctcatggggtacgcaaaggggcctggtactttgaaatcactgtggatgagatgcccccagacactgctgccaggctgggctggtcccagcccttaggtaagctgggagagctgtgtgggcctcagcaggggtaatgggcttgaggtttaccagcgcatggtcttaaaaattaaattcctgaagttgaagccagtttggtattcttaagaatactgtgagagagagtttgtaagtagcttgcaaaattgaccaaaaatatgtacaaagaaaagtagaactttttttctttaacaaagcagttaaacttgcggtcctctgattttcacatctcctttcattgggacaggtaacctccaagctcccttaggctatgataagtttagctattcttggcggagcaagaaaggcaccaagttccaccagtccattggcaagcactattcgtctggctacggacaaggggacgtcctagggttctatatcaaccttcccgaagacacagagacagccaagtcactgccggacacctacaaagataaggtaagattggccacccgcaggcactgtagctgcagtcagtgcccctagatgttgct

SEQ ID NO: 33438 - DNA, 1144 bp, Mus musculus
gctcctcggctcctcggctcccatcagcaccagtgtgagccaagagcgtttccccctctagcgccccggaagacctcgctgatccctcttgcaatgcttggtcctgaaagcactgaggacggcagcctcccgtcgttagcccagtgcactaggaatccctgggccgcgaacacatttgtcttgcttgacaacctccctcctaatactcaggattgttctctcgtgggcatcccgttcaggacatgaaaaagatataccctccgtatttggaccattgtgtttttctgtttaggaaaggccattttgatgtttgtcttttcattatagggatgcaaacttggttgatgtaagtggtctggagacagaatcttctaatggaaaagatactttggtaagtatttcctctgaggcctttggaaggcgaactagatttggttttaaaatgtttaatctatttttttttttttaaaaagtagtcaggccatttgattctcttattgccctgtggctccaggaaggtaccggagacacttcagaagtgatggatacccaggcgggctctgtggatgaggagaatgggcggcagttgggagaagtggagttgcagtgtgggatatgtacaaaatggttcaccgctgacacctttggaatagacacgtcgtgagtacatttcatggccttctagacagcatgatcctggagagatggcttagcattttagatcactagttaccctttcaggggtttgggcttgattcccagtattcacatggcagctcaaggaaccccagttctggggtggaaggggaaattatgtaatcatatttctttttttttaattaatttatttattttatgtatatgagtacactgtagctatacaaatggttgtgagccatcatgtggtttctggaaattgaactcaggacctctgcccgctctagccctgcttgctccaactctgctcacaacagcccaaagatttattatatgtgtacactgtagctgtcttcagacacaccagaagagggtgtcagatttttgttaggagtggttgtgagccaccatgtggttgggatttgaactcaggacctttggaagagcagtcagtgctcttaactgctgagccatctcaccagccctg

SEQ ID NO: 33439 - DNA, 1099 bp, Mus musculus
gatctcctcttcggggttctcactgacacccatctcctagcattaatcgcttctgcctcgtgagatgattattttctctgttatcgtgatgtcaatggcaagaattacatattctgtattttttgtggtaccaaatgcactgccttgtacttagcaagtgctaaataaacatttattaaagcaaaatgatgtgattttttaaaattgactttagtttttaatgatatgtctatggaggcaggatcatgcataggaatgtggtgcctgaagaggcaagaagcagcttagggttcccctggagctagggttatgggcagttgtgtgacacccaatgtgggtgctgggaaccaaataccagcctctaatctgagccatctctccaacccatcttcatttttgaatagtatgacttcgaagtaagtttgacattccccattgagagtcccttgagaatgctgatggagttgttaaagggaacaggcggctttagggactcctggtactgcccagttcttcagtgcaccgataaggagagccacggctgtgctgtctccccatctataatgggagccttcattaaaggctgacttcagagttaccgagtagctcagaactgggtgctgtgtcaaagttaggatgccctgagccaaaagaagcactgtgtcctgatagagtagaactctcaggaaactcaccccgctaagcagttcctggggaggcaggcatgctactaccattgcagccagcagacatggcccctgggatgccagctatgacacatagtactgtatagaggcagagtctctgtgcatcttagagtttattagccaacaaaacaaaacccaaaaaccctggtccttaaggatcattggctagcaatgccttcaaaatcagaaatggtgagaccttgtattaatccagtccaggtttttccctagaaggtgacagcctgagtgagtggacaggtaccttctgagagagggaagacaagttgtgtcaccccggtgactaacagaactgggaagtgagtgtggatagcatgactgttggtggctacagcagttacagatgacattagaccttttcaggagcaaagttt

SEQ ID NO: 33440 - DNA, 1233 bp, Mus musculus
cctacgaatttacaactgtacttcacagccaagctacgcctcatgcatgtggggcagtggggaataatgcaagtgcatgtttcatgctatttattggattcatttcaagaattctatgaatagtctggaacaccctcattctgatctctctaagggatgaactccatcctggtgtatgttggccacgaggtgttggagaactacttccccttccagtggaagctggcggatgagcagtcacacaaagagcatctcattcagaacatagtcgccacggctctctgggtgctcatcgcctacgtgctctataaaaagaagctgttttggaaaatctgacagcacccgctgaaatacatagctagaggagtccagggggtctgggagaagagcggcggcagcctccctcacagaggggattgcttccagatgctgcgtccaaaccgatttgcttagacatcagaaagttgcctgtgtctttctgactcacatatctatgcatctgaaatgccatgctctccgctttctccattttgtatgaaattgctatatttggaacatgtgtggaaatcttgtttaacttctcagagatttactctggacattttgcctctgtgaaagaggccaaggttggtagactgtgcttgattcagagagaacccattccaagcttggacagcacctggggtttggtccctggcatcacaaacaagcaaacaacaaaaagaaccaagtcttatttcctgaaaactgactttccacgtgtatgcgcatgccgaccgtaccgccgtggtttcatggtcacagactataaagctttttgaatggactgtgtcatgttgtctgattttatttatttttttttttatagtatgaactttattgtctctagaaagccaaagtgattttccttgtccactttcacggctttgatggccccaccaaatgcatcatttaaagctactcgcttctttcctcacttggaagaaagctgaaatatagatttgttattgcaaaccactctcgttacagctctgtctgtccatctaccttattattgtctgtctgtctgtctgtgctggcatgtctctggatgatacctaggcatctctaggtacccagagatggagccctgggaagaagaacgttcctccggagctgtctcctgggtaaggtgtggggccatcccctggcctgtcagagctttggttccctcatctgtggaaggaaaggaac

SEQ ID NO: 33441 - DNA, 1148 bp, Mus musculus
cctgccctcctatatcaattagcaatcaaaacagtccccggcagacatgctgacagaccagtgtgatctaagcagtttgtcgagattgaggttcccttttctcaggtgactttaggttgtatctgggggctggtgagatggctcagcggttaagaaccctgtctgctcttctgaaggtcctgagttcaaatcccagcaaccacatggtggctcacaaccatccataatgagatctgatgccctcttctagtgtatctgacaacagctacagtgtacttagatataataaataaatcttaaaaaaaaaaaagaaagaaaaaaaggttgtgactaggataaggggtaactttcctggactccccaaaacctctgggagaaagcccctgatctgagtgagacctgctgagccccctaccagccccattatttcatttctcatcctactgtggcactcttgtgctttaacaagtttctgtgtgtgctttctccttcacccggaacatcctgcctgctctaatgctctgtctccaccagggcacaggggtcaatttgcattcctccttatatccccagagtctagaacgtgtacttagcaaataactctgtgtgctagatggttaactcgatgaagatagaaacaagaattcaccttaggtgactctcttggtcatattgttttcttccccaggcaggaaaaatactggtgtattacaaggatcagacgaaagccatcctgacccgatttgccgcctggtgctgtatccttgtaagtagccagccttctttactctgattgctattctttttttttttttttttttggtttttggtttttcgagacagagtttctctgtatagccctggctgtcctggaactcactttgtagaccaggctggcctcgaactcagaaatctgcctgcctctgcctcccaagtgctgggttttttttttttaaagatttatttatttattatatgtaagtatactgtaactgtccccagatactccagaagagggcattagatttcattacggatgattgtgagccaccatgtggttgctgggatttgaacttgggaccttcgaaagagcagtctgtgctcttaaccactgagccatctcgccagccccacccccacccccgatt

SEQ ID NO: 33442 - DNA, 1146 bp, Mus musculus
actgactgagctccctcccccccccctccagtcatgacagttcctttctgcgagtcagcactaaggtttagagcactgaagacagttgcttttcacacttcgttgtccttcgaggctctctttccattgagaggagggtcaagttgtctcagcatcactctgagtagaaagtagaactgtgtcccagtgagaacactaagttcaggggctggggctgctgggggcctgtttgtgaggctgtttgaaccctgcttcgtggatagccactgctctgtggttctgtcgtttaagtatgtttttttactcccctagtggctaccttggccctggcggtataggggacttggggaagtatcctcattgtactggaggagcagctggctacatcgaccgcctgctcctgggagacaatcacctgtaccagcacccatcctccaccgtgcgtgagcctttccgttactgagaactgggaagcagggaagtaggaagctagctttgtattctttaaggaaaaggtggtgtgaaatcactctattagggaaactggctgcattcatgcctcagatgttcacttcccgttggcaggtaaaggcatttctgattgcggagtgaagtgtaccatataaaacaagcagagttttatttagcccttcaggtttccaggcccagactccgagacagggactccagtgcaggattcgcggggtatcctcactggatccgtgtgaggagtgcagctggggcgtggggggtgttgaactgcaccatgcttaatctctgtgtctctgaggaggcattcagtactgatctgtactgggtgagggctgggtcccttatgctgcttgttggaggaggaggtgatttagggaagcagaccaagcccccacactgtcgtttcttttgttttatgttgtgggatccagctcagggcccagggagctgtacgctcatagtgtgtacctggctttactcaaggaccctgcaggaagtatgtgacagaagccttttggcagcatttctagtagccggctgggtatgactgtttcaggccttggaaaggttgagggtctgggtggtgcactgtatactcccaaagttctggtctcgtttttatattaaaaaaaaatacaaatgttttattgtaac

SEQ ID NO: 33443 - DNA, 1241 bp, Mus musculus
catggatggatgttgaccctggctgttcagccacgtaggcctcctctacgtctgcctgcatgtttgagtgttctgctctcctggcagcccggatggaagctgccaagcgagaaagcctggcttcaggatgctccctggtgaagatgcagaggattctggatctgcatagtttcaagggagtgatcaaacggtgaccttgaagacatgctgcctgccttggtaactttttatagactagtaggaaacagaaatcttttgggggagggggggacaacccactagttcctcagagacaatttcttctcattcagaaagccctgttggaagctggggatgttttaactccgtggcagggcacttgcctagttgtgtgcaaagccttggatctgacccatggcatgtgcacacacacaaatgctcaaagaaaatcccagacgccagaagtgtgcccctttcttgtcaataaggtcattgtcagtaccggagatgattttttttatgaagcgtttatgctgactcgtgtcactgagccaagtgtgcatggtcgttagctactttgtgggttcttctttcttctaccctacttcttccctttccaccccctaacactagataggagagaggagagagaaaggaaagtgggcactgttatattgttggacgacttcttgctgattaaggggtgtcgagttccttggagcaatgatctttgctgccaagatatctcatttcttcttgtttcttcttcgcccacgaccacttcacaaacaccgaccaacagcaaacaacaacccaccccgcttctcgggggccctagcacttatgtacttctgaaaagtccccagaaattccaatcatcacacactcagagaaactgtctgctgctggcaaaactacacccctgctagagcatgaggcaaatcatagtcagctgctgtggacagtctgaagcagcctggcatcccacacctgagattaaaacaaaaacattcttacctgtgttttgtttttgttttaagaaaccaaagtgcaccaagatagcatgctcttgagattgtggctgtctagagatttttggaacagcaagttgaaggaactttcttacctgccttgaatggtgctttgaacttcctgctgacctggagtttctgtgtgaatatttctatccagtgtccccctgtaccggaaagtacaaagtctgctctgggcttgcatgcctgaacactttaaaacactgtgga

SEQ ID NO: 33444 - DNA, 2033 bp, Mus musculus
cctaagtagttgaaggcctggagaaccacctcaagaagtagggatgtctgtctcttgctcttcttcttacctttaagaagagttcttttctgcttcaatagtaatgtcatatagcttgagttataaatgattggtttgcaactttgttaggtggatcccgtctatatcaggttgctctcacactctgattctgacggtgacttgaacttcttatctctccctccactttccagatgctgggatcacagatgtgcactgctaggcattgaacccatggccttgtgcacgccaggcaagcactctgccaactgagccacatccccagtccaacttcattgtattttaagttatttttactgaactttaacctccatcaataaggcccacacagtttaaaataagttcttctttcttttcccgcctctcttgttcataaccagtcttccctagctcgtgcctcaggctttctttctcctgatctttctccgatcgtgtgtgcgctctcagaatggagtcttgttttgttttgttttaggattctgcaggaccgtggtctttctagataccctaatctattaaatcagttgcttgatttacaaccaagccacagttctccgtacctgattgcctttcttgtggatgtctatgaagacatgctagaaaaccagtgtgacaacaaggaggacattcttaataaagcactagaggtgagttcctctccttgtctctcccactgccactgctcttgcatcatacctcatggagtttctcagggctctttctagtttgggggcgtactgtcagttgtaactgctgtgcggtatctctcatttgtgcaggacccatgttaaattgacatatgcccttgagagtgaattaaacattaatacatttttatttttcattttcagttatgtgagatcctagctaaagaaaaggacactataagaaaggaatattggaggtatattggacggtcccttcagagtaaacactgcagagaaagtgacataccggcgagtgtatagcagcgagggcatccggaagaagtggacgatgctttctaaggcctcttatgcaggagcgtagagtggttagagcggtcatctcttgcctgtgcgctaaagctgtccaggtgctgcttttaacaagaactaagtatgactcctgtgtgctgacgctgttcagacgagctctaagaatccattttctaaagcaaagtcattggaggggagggtgaggaaagtttcccataaaggaactactgcttttgtagtcttcccaacatttagtccagtcctgtagaatccgctcctcctgaaagatgtgtatgcaaggctgtgcgctgggagtgacgattgatttgcagtaacctgaatctcggtgcattatgcggcaactgcgcctgttggttagagctgctgtgcgcactcacaggatcttgctatcactgtaaccaactaatgccaaaagaaaggttttataataaagtcacattatctataaacaattccatagtgtttgatgtttaacagtatataagggacaaacaagaagcccagtgcttgggaggctgagacaggaggattgctgcaagtttgagccagtctggactacatagagaggtttgggccagttcagaatatagagggtagccttctttgaaaaaaaaaaaaaaaagtcaaaaacttaaaaagaaaatattactatacattttgtgattatgggagggaaatgtgaatttattaaaaatggaaattggtcctgtttttcttgtcagcaacaaaatggactcaagataatttaaactgaatttaatcagcatagatagctcacagtcattgcctcatcttctgaagtctatcccacatccacgctatgccatagcaacaagttgctgctgcctgtaccagagctgggaaactgcggcgtgaggagttggaacgcacggttccctatgccagctctaggttgccaccttctatggaagcacacttgcgatgtactggccgaccagaggctctgaaatgtag

SEQ ID NO: 33445 - DNA, 1191 bp, Mus musculus
cgtgctgagccatgcactcagggacgcgcataggattccatctgaccacagcacatctcaggagtccttgagatacagacagggtacgatcacaaacctggctgtggccttatgaacactgatacagatgtgggctgaccatagtgcaatgattctcagcctgtgggttgtgaccctttgggagtcgaacaacgcttttacaggggtcacctaaaacaatcagaaatgtcaggcattggccttgtgctttattacagtagctaaattagtttttaagtagcaacaaaaataactttatggttaagggccaccacaacatgaggaactctaaaagagtcccagtgttaggaaggttgagaaccactgctgtagaccccttccttaacacctgtccctgccgtggcagctgctgggcagagcactcagcggggtttccttgggaatcgcctgagtgcctggcttggattctaatagaacacgagccgtgcaaaccctggaccctcactagctgagctctattcattctccctgtgaaactatgctgtaaaccattcctctctgaaaagtcggaaatcacagagtaccaggagacaattgtattattgtgttataagaagtcagcttcgtaaaacttacctagaaacctgagaaaagaaaatgttaggattcagtgacgtggaaagttttaacagtaaatttagaagtccttctttgtaggattttctcactgatagcatcttgccttctccatattatgtgagatgaatctttaaaatctccatccctgtgctgttggtgcttcctgagcatctgaggcgcctgtcctccctgggtggcgcccctgctcccgaacacttcacacagcgtgcagcactcagagcacgcagcgtgcagctcacggagcagaggtctcaccggcctagtcccattgttaacactgtgctctcccacccagcgagtgtgtttgtcccctggccatgtgggcatggaacccagagtctcacacatagtaggcaaatgctccatcatcggctgactaccaagcctcatggtttatttttttaattttcagtctgtgtaaggaaaattgtaaaaatgcaacacagtataaaaaagtatttttctaacacagaaactgtcttgtgacagaattgtaacttgtcctagttacatattttttagggcagaagt

SEQ ID NO: 33446 - DNA, 1217 bp, Mus musculus
gaaaggagttctgcacagatccaaatttaattccaaagacaccccccggattaataaaatgctgctattttattataggattatataaacgcctagcactgaaaaacatgtaaagtgtgaaagaatgtaaagacccttttaaggttaaagtggaagcctgaggggggaaagaggtggctggctgtgcaccgtttgcaattcttcacactcctaagatggtccaaaagaagggggccgctggggactggagatgtaactcagtggtagagcacatgcctagcatgtgcaagtcttccggttccatcctaagcgttgaaaaagaaacaaaagcaaggaaacagaaaagttacccaacaaaggaaacaacaactaataacactgcttgccaattagcacctaaaggcctctgaaaacctgcattcgggaagggggccctggaaacacagcagcgaggacagtaggtattcaggccaggcctccgggccgggccctctaccccacgcctctatggtaggacccgaggaaccggaagtgggcctcgccgggggcggggcgggccgcggagggggcggggcctccaccaccacctctgctgcggacggaggcgagatggcggccaccgagggggtcggggaatctgcggcaggcggcgagccgggacagccggagcagccgccgcccccgcctccgccgccgccagcacagcagccgcaggaagaagagatggcggctgaggccggggaagcggcggcgtcccctatggacgacgggtttctgagcctggactcgcccacctatgtcttgtacaggtaacgccctcctgcgggccgcggcgccagaggcccggggctgagtgcgagcgacgacgacgcagctcggcggacgggggcgccctccgagtccgcgccgcgcagccccgggtggccgcaggctgcggcggcgctcttctgaagctagggtgcggtgacacttccgtggtcccgcagtgctgccctgctgagagccgtgcatcatccgaaaggcgcccttttgacagctcgctatgggataatgtcacttaagcggccagatctgctctttacaaacactgtcgggcctttgcgtgccttctgctgcctggagagaactttcctgcctttccttcatcttggccactgtgcacatcccttctgtcttcctttccatgtcccctagttccttgtcaaaaagtacttact

SEQ ID NO: 33447 - DNA, 1650 bp, Mus musculus
ttctgccctataagctgtacattcatgattggctgtcttctacttcaaaagtacagtcagggccaagtcgttaggttactcggcccccagctcgtacctgcttcagtggtgaatcagccaaccttttctgaatgaagcagacatttgctgttacagaatatgattaactatgaaagtattagaaatgtgaactgagtttccttcactatactaaagtacttcatttaatttaaaggattatgctgaacgttttcaaatcaaactaagggacgtcttttaaaagtgtctgactctgttagttttgttttgttttttgcttttctggagttttgcagtattggagatccaacctaaggccttgcatactagaatactttagtgatcatattttttttttatttggaggcatctctctttttagcctcggctggcccagaacttcctcagctcctcctgcctccgcctcctgagtaccagggttagaggtgtagaggtgtgctctaccactctcggctaagactgagcttagtgaagcctttcctgcccaggcgtgatcgcactttctctttctcgtctgcgttgatgatcaggcagcagaatcagaacattattgtcaatttccaaacaagtcacggggtcgttactgtaactcagtacagaagagcaaatggtaggagttcattcttttgttttctcgggagcctaattgaatatgtattctacaaagactcattagtcacggataatttcagtatgttctaagtgacatcttattataaatgtagaaaatggctgtacacagatgccaatcagagacctggcacttaactttcataacaatttacttgttttcttttttcccatagatttagttatttgcaattaagatgtactaaaatatcattgtcattcctaattttggcatttatggattctataattcataataatttgtactgtgaagaataacttccaggtttgttgcagttctctcattgttaggttgccagccgtttataacgtccctcctttgttctgtaagagattccccctctggctgacaattcagtcgagagttctgaggatatattcctcatcatcgtaatctagaaacgatgtccactttgggctctgcattcctcgcctcaactcagatttaacaaaactgtgttcaagtatttccctcctgcttacaaaagtttgcccgtcttgagtctggtgagtttccccactgttttgctgaggaaaatgacttgttagagacttcagttaaaaatgtaagtaaagtcacaaaaacgaacttgtgagaaaccatcagaaggtagggttttttgcttgtttgtttgtttgttttaatcctacatttccttttggtttattttgattttatgactgccaacttgttatatatgagtgtttatatatgcatataatatatgtatatgaaaaagtgaagatttggtcaaactatattttcccattcaagtacaaaaaatgttttcaaggctgcaaaaagtgtacagttgttaaacaagttgtaaataaagacttgtataaaaatccagtatagagctcgttttttctgctcttttctatgactgacatttaaacgttgtctgatttttacacttgattttgcacttgctgctg

SEQ ID NO: 33448 - DNA, 1135 bp, Mus musculus
caccaacttaccaacagatatctatatcatactttttatagtttgcaaactgttgttttaatattattcccccctaataatatgttatacctccataaaatatctgtaaatgaagacaaaagtggactttaaaaagtaagcctttacgtgtttgattcagtccactgctacaggctcacaagcaggtgtttatgtctgaaattggaggtacccattatctgaaaattcctctcccataaggtaggaattattcaaacccaaattatatctatttcaaatgtgaaagaattaaatgccgtgagaagaacaagcgagtgagtaaaagacaatccccaggcatgcagagggcactgcccatacccgcagatgtctggtcagactcactgcgagagctctgagctgacggcaaactggaaagagcccatgttcttcctgtgcttgcaagcctcctcggggaccactgtgagtccttgtgtagtctgtttcattaggatggcatcttactgttatctcccaccctctcctgcataggttgtttatccctctctacaaaggctctagcacgttactgggactggatagtgctccatttctgctgtacgtgctgtttcctgttggcacctcagtctcaggattcagagtctggaaacacgcttataactgggaagtctattttataacaatgctgtgaagccagcttttggggtttgtgctaggaattgaagctagggcctcgtgcactccagggcaagtgctctactcactaaacacttttctgttgaatgagatttttcttaccctttaaggtgctgtctcctaaaataaaaacctcgagactgtccctacttgttgctcacacacacacacactattgcaaatcccaaagagagaaggaaacaagatattccagtaattaagcaatcagatcggctaaaaacggaggaaaggtgatttcaaaaggaaatcggtagaggtgccaggtattgcagaaatagttgctatactgagatttgttttcggtttttaccttggcttttttcttaactttaacttgcaaaggtttcatcttgtactggtagtgagttttttagacccagaatttttccatttgcaacatgaaagtagcagtcatgtt

SEQ ID NO: 33449 - DNA, 1098 bp, Mus musculus
tgttgttttgattgttgtaaattcacaaaattaagtcttaatttttccaaaggaagatttgtacttaatttctggaatgaaaaggatttcataaattttaagccataataagtggaattaattttcctaataaattatgcttcgctattcattgtagtaaaaattatttatgcatggtgatagttatttttgtagaatattccatgttttcaccaatcgctatttttcttctaatatttcagggaatgactctacataaaaaggcggctgaagacagactagctagcacaggttcagggcagtcatttctggctaggcaaagacaagcaaccagcacaagaagatcctacccaggccatgtccagccagccacagcaaggtagaaaggtcttgccactaggaatttttaaaaagcatacttctgttacatataacaacatttcaggaaattcagccagcttgttttctttctctcctgtgttaatatttagtgtttctcatgaggattcctctctctcctatctttggttactttgtcctttactttgtggtcttttcagttccttttaatgtgccaaaaatttgtaaatgtacaattaaaagtgttgtataatagtgtaatactttttctttgtatgaaaatgtcttcttccccatttgtgtgggctttgtaaagaatcgggttttctgccaataattgatacacaatttatattctttatcgtgcctactgtgttaccatactttataagaatgtctttgtttaaagggaattaatctttttatggtgtattaatctgtgttttcgattgttttccaaatgcacttcagataacttaaatatttactgtactatacaaagtggtgtcaaatgcactttttgcaaagacgactacattggcagaggtgctagtcagacctgtggcacctggcaggatcactcagaggggagaaattaaacgtattctaaggtttgaagttcttatatgaaatttcattctttcctgctgtattgtttgctggcagaagtgaaattggtgaagatatttgggtggaaattacagagaagaagaacttggcaggattttttttccttcc

SEQ ID NO: 33450 - DNA, 1345 bp, Mus musculus
tgtggcagctttacacttgtactttctgcattcaagaagctgaggtagaagattgctgcaagttcagggtctgcctagactatgtaatgagttcccagaagcttgagctaaagagtgagatcctacccaaaccaaaagcagggcagtggggaaaggtgcttgctcccaagcctgacaacctgggtctcacatcatggaagtacagaacggattctgtgagctgtcctctgaccttcacatgagtgtacacacacacacacacacacaccccacaatcacacaccacaaacacaaagtaaataaaatgcaatggaaaggaaaatagagtagcttgtaaagggaaatgattttgtcccaggaacataagtaaccttgggaacaagtagtaatgggtacgattttgaggaaacaggctgttcatttctattggcatgggtcagggcctttaggaaggtactaaggacagtatttagattttacaaataatgagttaacccttgcagcaaaatgaagatatttgattagttgtctattgtcctgaaaatgtaaaactattatcttgtagatggcattatttggctcagattcatcgtgccttgggcagaatgaggaaatgtgtattagacgcctaactactgaggttcatactgatttggttgtctttgatggctgtgacatggggatgtgaggtctgtagttctgtttgaatggactgagtactgtaactgagccgctaactggagagcagctggatggggtgtgaggtgatgcccaggccctgccttctcattgctagtaccattgacttcttagcctcagtgtgtgtgtttagggacagaaagctaaaatctgtcacattccaaaaaaaaaaagaaacaatcagattagctgccaagtaatgagattctgaacgaaacgtcaatttctttcctaatctaggcttaaaatgaaggtgttgtctgccattaaaaacaacataaaacccagtccttatatagagaacacgatcaatgcaatctctcataatttttcttttatccttagaaaatgttgtaaggaaggaagagcagcatcagcttcctgttgcagaggtgaaaccttcatcctatggatgaaagacttttgttttcctaacataatggaactagtgatatttaggtaggcatgaaagctagtctgaggagaagcgggaggagtggaattctctggagtcaggttttcataacacagttttccttccctggaacagtttcggtgcttctaagctaaagctccaggaagaacactcgtcacagcctttatcaatctcgagggtatacttgcaaatgaagttaagagtggcatg

SEQ ID NO: 33451 - DNA, 4313 bp, Mus musculus
gtcccctccctaagctctcttcacttccatcacagctcaagctgactccagaatacctgcagctgatgaagtacaaggccattgcttccaacagcaagatttacttcggcaaagacatccccaacatgtttatggattccgcaggggggctgggcaagcagtttgaggggctgagcgacgacaagctgggctttggcctagaagatgagcccctcgaggcacccacaaaggagaactgaggaaacactgtctgcaagctctgctcgggcagcttagagagagctgtattctttaagatgagacagagcaaagcgctcctcctttccacactaccttccttgactcttcttactgtggttaaaaaggaagaaatggacacaaacttacccccttctgggaagggagagcagatggagagttgttttttgggtttatttttaattcaggtaagtaagttgtatgacttctgagaaggtgtatgcaccgtagatttgacctctgacctgcagacaccaacattgtcactttgaagctggtttaagtggagctactgtcagtatgaagagggagagtgtgtgctgcctcctcgtgcttgaattccttcagggaaaagtgtactccacagttctctcccttgcctctagtgtaggcagtgtctgcgtgtggggctcgtgacagaaggccgtctgctgcggaacatgagctgcagagagcgttggccggctgggctttttgactgagtggattacttgagagttaagctgtcttgagccctttttaggaagaacttggtgctaggttttgcaaggttttctacacactgtactctgctctagtgtttgttggctacatctcaccgcagcagggcttggtcacaccacacactccttttccgtactttgacctgatctgtgatttcatttcttcttgaataatctattcatgagttgcactcagcgttaagatgggaacaaacaagtgctgttagctgatgacgtagctccttataccccttagcactgtggtgctgtgtggctaattatgcgtatgcttttgagaccaaacatctttatcattatggagattcttcattgaagagcccttaacactgtggagaagggcccagccagatgacacccaagtagtagtgcctgtggcctgtgctggggctttgtctgacactgatgaagagagcaggcagccacttgagagtcggctccagtgagtcaccctaggaaactgagaatgcgaagaatagatatgagagaaagggatttcttatcctgaaattgcactgggggtggggctctaccatggcctgtgagtgcacacagaatgcctctgtggagggcagctctgcaggtaatctgcagacatggcagtaccctgtgcaaccatgactggctctagcttaggacttggccttgttagctggtcccctacctcatcctccccccacacaaagcacctactgttctctcttaggtgactactataaatggtattttctggcatcaattcccacctcagttttggttttgtaagtcgggccagtttgctcctaagtggcaccagacttgtcaggtatttgggaagcattcagccgacccaaaaagaggcagggttcactgtgcttacttcagatgttcccttctctgtcctgactcctcaggccactgaccctggccacactgtacaaactacaaaatgttcctgaaaaggacattttaatgtgctcaaaagctcttgcaaaagtgggtttttttccccaagaccaactcatcttcttctcatttgttgctgctaaccacttgttgagagcaacgtgctatacccagcatcctctcttgtacgtgcacctgagaaaacactacttcagtggagtcggtgcaggagggagggtaccccgccatccagcgccctcctagcccgagaggctctgtaactagcattctgagagctcatccctccattacaaagagccacagtaaagtcctgctgcagctgctccttccctgcccctttaatgtcacttctttaacagaacagaaatgtccccatgtcatagcataaattcagtagctattggtatctgtcccagcagtaaaatcatggaactcagatgtctttttagcatgggatgcctagcccatctgtctttatgaccttgttttttgtaatactataaaatctgacttaggcatttgaattctaaacatgtaaaatgtgataagcctgcagttttgtaggcagtgaattcatagctgctatttttaagtagaacttctatcaaaatacgttaaccgtttgtaaaattcagtttttgtaggactttcccaaggcccagccaccttggtagaatgcttctcactcactaaatgttgcagaagcaatttatattccatataggtttttaatcacttttcaatatatggttagaatgtttgtaaggaagcctaagtttaataatttttatataactaaaaataggtgtggaggactcagtgtgggtactgaggaggaatgaagtgctctgaaaagggaggtgtataaacggcctgtggggccgtgtgtcttgtgaaagtgagatagccgtgcttactgacctgggctgtcgtcagctggccgtcggtaaactacctggacaatagcccctctgtctgggaactttacctacttccttgtcctcagtgggcttctagccactgtttgtttccttataaaagctgtaatgggcaatcatgtgtttgtacttccattcctttttatctctacttctgtgtaaactggtgattgaatagttaaagcaattttttcagtgtgccccaagggcattaatgagcctttataactgagaaatgattcttgttatagtaattattccataaatgataccactagataaattaccttgggttaatagctccaggatttgtttcagacaacaaaaaaaggtctcaatgtgaatatacttacattttggatttaatttcagtcttgctaaataaaatgtttttgtctttttttgattaaggtaaaatttaccagtagattggaggacaggtgatagaaatcaaacttccttcttaggctttccctaaaaatatatccaggtaatatagattcttaccagcatgctggtacatgcctttagctccagcacccgaggagaaggatctgtttgagcccagcctggtctgcatagtgagactatggcaaaaacaaacagaattaacacattgctgcatttctccagaagataaaggcattcccagttgaccctaacctcatgtaatatcagtttaagtaggtaactcccagactggctgtggcaagctgcctcgcctagtgtcactagataaatgttaatgtcagtgaactttacaaaaactatataccatccaaatgttttacaacacctacttttatagaagaatttgcacttgatctgaaatttgcatttaactggatattttcttttaaataacaagtttgggatatcttggtttgggttttggtttagtgtatgtagtatagggtattttgctgatgtatgtctgtattccacatgcatacctggtgcctatggaggccagctgagggcattggatttcccggacggggcagttttgagttgttccttgtttgctggaatcaagcagggtcctcctcaagagcagccagtgctcttaacctctgagccatctccctctcccccaccctgccacaacatagttttcttggtttttttttgggggggggttggttggttggttttgggggtttttttgggggggggggtgtcgagacagggtttctgtgtatagccctggctgtcctggaactcactctgtagaccaggctggttttgaactcagaaatcctcctgcctctgcctcccgagtgctgggattaaaggcgtgcgcttcccaccatgtttttcattgttgttttcttatgtttttcttacactgtgcttcctttctttttgaaaatggttctttcacaatttgcactttgaccataacccccacacacacattagcatcttaatcccttaccctcccatcaaacttttcttcccatcaagcccccttcttacttaaaaaaaaaaattcactaaaactgagtttacttaatgaattatgttatttttctttactatttatctattcactttatattccaatatcagccccttctctcttcccaggccccccacacacacacacacacagctcctccctccattcttccttcccccttcctatgaaaagggggcagccttccctagatatcacccctctggcaca

SEQ ID NO: 33452 - DNA, 1177 bp, Mus musculus
tccagccccagatcacagcacatgtttgcactggggtccctgttagttttgttgctgtactaaagacaatgaacaaaagcaacttaacttgggaagaaagggcttattcggcttatacttccacagcagtgaaagaagccacggcaggaatctggaggcaggaactgaagcagataccatggaaaaatgtcgcttactggtgtgttccccagggctactgtcttatacaccaagagtgcctactccgggactgcacaactcacagtgagctgtgccttcctatatcacacattaatcaaatggcacagacttttctataggccagtctttgtttgtttgtttgtttgtttgtttgtttgtttttcaacacagggtttctctgtgtagccctggctgtcctggaactcactctgtagaccaggctggcctcgaactcagagatccgcctgcctctgcctcccgagtgctgggattaaaggcgtgcaccaccactgcccggccagtctaggtaatttaacttctcgttatacatcatcctgtgctttttacattgccgttttggtttgtcattgtttttctgagacccagtctgactaacccgggctggcctagaacttgtggtaatcctcctgtctcaccctcctgaattctggaatcgcaggcacgaccaccagcacacccagcaacatgccagaaagttttgtttggttttcacacataaacttgtctgactcagttctagctgctttcctatcctcatacatatccttccgctgctttgttgtggaacacagtttacattttattagaacaatttgatctttttagggttttgggtttttggttggtgggtttgtcgtgccaggatttctctaaggtccctggaactctccgtaaaccaggctgaccttgaactctgagatctacctctgcctcccagtgctgggattaaaggtgtgccaccactttaggtcttgtcctaactatcagtttgtataaccaggccagagctgagattagaatgaattatttaagctaccaaggcatagccttcctgtacactctagtgtctctatcccaacaaggttgtgggttcagtcttcaccatggaggaggaaaaaagcaaggcaggagggatgggaggcaggggagtagttagctgactgcctggaagatt

SEQ ID NO: 33453 - DNA, 1203 bp, Mus musculus
agattgaagtaggatctacaaatgtccggatagggagcactatttttggagagcgggactactcaaagaagcctgccctagacaagacagcagacgcgaaggcctcagtaccactggtgcaaggacactgaggccaagccgctcagggtcaaccatgcaccagcctagttcatttggtgtccgcatgtccccagtcacactcttccgtggcctttgtagagcgctgaagattatacatgttgacgggaatcacccgtgcttagcttcggctataggaagctcgggtcaagcagtgacttaggctgtgagacttcagaaccgacaccaatttagccaggacctgagttcggttgagcactgctcaggaatacccagcccctcacaaatgcgtgtccccaagtgacttttgggttgctggtgtctataattgagaaaatcagaggggttccattttccatctaatagaacaccctgctgtccccgctactctggagtgaggtgattctgctcccagtttccatcctggccttagatgtctccaatcacagctcctctgtggcactgactgaaattccagggtaacttgtaaactgctcttgggcctttcttgctgtaaaagagggacttggagcttattcctcgaggaccacggtgatggaaagtggatgacaggatttcttcaccatcataatccctttctggtttttagtaaagacttggagatgaaagcctccagtcctggcgcatggtttcagcaagcctcacttgcttttcctcctctggggatcagctatccccaggacacactgtattcacaagccagaatggtgcagctcctgactgttcacagtgccgtaagagctccaaaaatgaggaaacagctgggcctagtagcacctgcccgtaaccccaacatttgtgggatgcagccaggaagatcaggagttcaaggataaacaaagactaagtcagactcttctttatctaaaaacaacaataaaccagaaagcacagttctgcagtgatcacaacggcttgcgtgtgggctgcttagcttatttcctgatagcttttccgcttgtttcctccagccctcacatccttcatttaacaaataacttcagaacccgttgctgctgaatgtaatttccagacttaaaccactatgattcttgttctgtttcaatcaaagctagcgcggtc

SEQ ID NO: 33454 - DNA, 1463 bp, Mus musculus
tggcaaattcaaaaccagccagggctacatagccagttttatgccacctggcttgtacattgagaccctgtctcaaaaaaagagtaaatgaagtgttagctggcttgtttggcagttattggaaaagtgcctgcttcctgttgtatgaaattcttttgattgcctctaggtggcgacattggttggcctgaggaacaggccaacttgtgaaaagcacacatatttggcacacacatatttggtcagcagtttgccctagtagggcctattcagtcttactctctttatgaatagaagcggagggcatggaagacatgttccccccggtgacacatggacttgcaggctcaggtggttttgtcaatgctacgtcttgattaagggatctgaggacaactctggaagctttggggaaaccgcaatggttaagccgtgaaaggtctccctggcttgtgcctggggagtaagagcacagtagaggagaagccaggagagaactttagtccagatgaaggaaagaagcccgactatatccacaacgggacggctctcttgagaacattcagccaggctatgagactattgtttcatgtgagacagctgcttgggttactcccaggttttaatagcagcagtgacagcatcagggcaagtttaaagtcagacccacccagccagtaactgcctctccccaacagcccatgccctggtgtgtgtgtgtgtgcatgccctgtattaaagttctctaaggaacgacagacagataaaatgaacacacacacacacacacacacgggatttattagagtggcttacaggctgaagtccagacagtccaacagtagacagataggtaagggatccagtaattgctcattccttaagactggacatctcttcagcgcaggtgctggaatcccagggagaccctaaagagctgccagttttcattccacattggaatcccaaaaggaagtaggcttacttccagcagaggaatggctcagaatagatgatctgccccaagagagtcgggcaagcagacagagagcacaagcttccttcttccaagtccttttatgtgggtcaccgccaggaggtgcggcccagagttcgggtgggtcttctgaccgcaaaacatccagacttaaatgggtcttcccacttcagaatttcaaccaaggaaagtccctcgcaggtgtgcccagctgcttgggttttagttggttccaaacgttgtcgaggtgacaaccaagataagccatcgagtatcccaaatccagcatcaggtttgagaggctcaggaggccttgtattcttttctctttcaaataaagcatttaagccttttatattatgcgtgtgggtgtttttctcaaatctgtgtttgtgcatcccatgtgtgtctagtgatcatggaggtcagaagagggtcaaattgctggagttatggatggttgtga

SEQ ID NO: 33455 - DNA, 1283 bp, Mus musculus
gagcgccccagccacacgtcagcggtaaggaacagttgtgaagagctacaggatggcatctgcttctttgctgctacctcctgatttggggagttttgttgctgctattttgagacagatctcactggctttaagcttttcacacatacacacacccccacccccacccccgcctcagtttttcaaatttccaaatactggaattacaggtatgtgccaccattcctggtagatcaatgtatttttttttttataaaatgtacacacacacacatatatatatatacacatatatgcacaccttaatatatatatatatatacatatatacacacatcttaaaacacacacatatgtatatatacatacacatatagatgcacaccttaatatacacacacacacacacacacacacacacacacacacacggccgctttttcactagtagagggaattccattgctggtcacctcattctggaattaaaatgtttcatgatttttttttttcttcctggtagtaataaaaaatctcactaaatcttaacacctctgctcagcgagtcataggccaatgccgtggatagggttgccgtggatagggtggggtagcggtggttctcaatgaagaatctgtgtgttcttatcacccggaaggtgaggaacgctggttatactgcagcactttaatctgaagggcaagactgtaacttgatttacctaacaagctgttgatgatccacacgtatttttatttaatctctcttacagtactagggaccactgtaaatttcttgagatgatttgtatttttttttttttttagtgtcatgaaattcattaatatgcctataaagaaactgtatccacttgatctctgaaaatgtacatgtatatttctgttctgcatcctggggttttggtttgattttttgttttgttttttttgtttttaacttgatataagtgcatttttactgtgataacctaagtgcactggagcactgctcagaagaggcagcctggggagctgccttgtgtatgaagagtctggaggtctctactgctactcagacctttggtatgtaaccgagtcagctctagcgaggaccgtctaggtgaagtgaattcctgtgctctgaaatgccacttggggactctggagaatgaaggacagtttacttcgggggctttgctggtttctgcagtgctgggaaacactgcctttctgacgttgctgtacctcacaaggtaatagaggccctgcctacttataataac

SEQ ID NO: 33456 - DNA, 1166 bp, Mus musculus
tcatggaggagacccccaacatcctccgagtgccggcgcagatgggcaagaaggccggaaagatgtaaactgcgggaaggaggcgtggtctgaaggaggcgtggtctccctagtaactagcacaccggttccgaaggcctgctgtgtgcatcatctctcaagagttaattctcctagctgaaaaccagattaatgattacaacgaatcttttactatacatctcccagcgttttgtttttcaatgccactgtgcctttgactacattgtaaatatcagatttgatccgatgtgttttaacgccagggttgttgccctttgatgctgagatcttccggtatggatcctccgtgaaggcaggctcagggtgagatgagaaagggactttgggatgtgtgctgtttcacccgctctcttggcctttgagcacctcggttgaggcacaagctcaatttttaattcgggtaaacccgaggactcaagggttgttttggtgagggttggtttgggaggcgttgttctgttttcagggtggggtgttatgtagccccgggctggggctgctcttgaactcactgtgtactgagattggccttagatttctgacctttctgccccccactgccaagtgctaggattacagccgtgtttgatgccttctggtcggagcacggttgtttacataaaacctctgagcatgcttcttagatttttgaatatgccttttacaattggcagtaccctctggccttaaaaatatgttctccatggattgggggatatagctcagtgggtaaggtgcttgcactacaaacctgatggtctccgtttggattcttagcatctatgctaaagccaggaagagtggcatgtgcctgggtgggggctgggctgggggagggcagagccaggcagatctcaggggctcactggaaactccaggttcagtgagggacagtcttaaacaataaaatgaaaagctaccatagacctctgcccttcatgtggtcacacacacacacacacactgctctttagatctatagggccatttcctggagacatgaaagaactaaagagtcacttttcaggctggagtgatagtctagtggttaagagcactcactggctgaacagtggaccaggtccagaggacttgggttcaat

SEQ ID NO: 33457 - DNA, 1229 bp, Mus musculus
cctgagaaagatgctctacctgttgcctcccagtggggcagctccttgaacccctttgaggacgtgcagatctcagacccgggagccaccacggagtccaggtcggaaccgaaaccaccagttcctgcggccagggttccccagaccaaggctgtgaagccgaggtgagtcttcgtctttacatatggggcctttctccaccactgcctggtattcagcaaagcccccgctaggacaaacccggccggtctcaggatgtgcgtgcaaaggtttgctagcctcacgtcatttgaaccaggcccctctgctggcctggcctgctcagcacaaagggcagggcttttcccagcctaaagctacagcatgcctgagtgaaggttgtcctcagggagctaggcagactccggtgagaggagaccaccgtctgtggccgcttccgagcgtgtgagcggagcgtgcgtgcttgtggtgggtacaggcagggcctgtgttttaaaggttttcagtgctgtcctgtggagatggctgcctttcctcctggtgcttggggtcagtttgctggtgtgagagacctgggtcggctctttagaccgttctctgtctcctctgtgcctgatcgttagagcctgcctaagccggaaggagcgtctgcttttctgagtgactctcaccttgaccttgaccttgctctggaatgggggtggcgagacaagctttttggggattctgcaatggatgcactttctctccagaatccatacttgttgccttccattatttcgatgcttttcgttctgtcatagtcaactcttgggactgagtgtatctcagaaagaaactgtaggctgtcggctgctctagctgaatctttccatttctgttagaacagacccgtgtgtgacggctgtgcttggcgctaaacagtgtctctttctgtggggagactacgcctcagtcgtggaggattcacatagcaggcacggggccctggcttcgactccccagcacgaatgatcaatttgtatgtcaagaagtgctgtttccttcaccttgatcattaaaaacctgtccctccctaatgactactttaatatgtgtcttgaaatgcatctgccactgacctgcagattttattttgtcctttttgcagactggaagtttctccagaggctcagcccaaagccaggcttccctcccccgactctgctctctttgccccctttccctct

SEQ ID NO: 33458 - DNA, 1159 bp, Mus musculus
tctttccctaacttctatgctgttccccgttgagctttggagtggatgatacaaatggtccatttaaatccgaatattaaaacggtcacctggtcctaatacattgaccaatcccgtctctgcagtccctgctgcctgccctcccttcacacccaccttaaatgtatattaaaaactgtttcttgataaactcggcgtttgctccctaaaaaaaaaaaaaaaaaatgaaaacaaaatggaagaaaaaaaaaagagaacacttgcatcagagtgtgacttgagctcttgattgacgctgctgtgtgccgtagggtgtttgcttctgttggggcagccctgtctagctcactggctgacagctttgtcctgctttctagagactgacttgttatttcaggtgaattgctcgggagctatagccagcaatgagttgggaggaagtgcctgggaatcccatgtgtttgtttactcttccctgttgcttgctctccctgggcacttttcctccagggccatggaatgttcctgtacgtcctgaacattgctaccctggagactgggagtcctgaggttctgttgctctgacaactcactgccccatagcctcgtgcatcagcgctgccaaggttctggaagaaagaggcctgaaattattggcaccgcacgtgctcaactatgaccagtctttctgtgttcagggatgtacccacagcccagaagctagaaggcagcttactaaagatctacaggcaagatggctatcccagcaagttgttcctggcctacaaaggtaggaggcagtcatttcagggtttaagattttctacgtttcaactggctgtacgtgggcagtgtccctagtggagggttgaagaatagctcacgtctctgctgctggaaaggctttcgtttattaagggaactgcccagagcagagaagatcagtgaacaacccgagtcacctcatacctgtcggggacttttgagaggaatcaagttttcttccttctcacccaatcctttttttttttttttttttttttttttttttttttaatctgcttcttcatcccctctagttcctcccagttctctccggtgttcttttgttttgtttacagtcccatgtaaattagactagccttgaactcacaaaata

SEQ ID NO: 33459 - DNA, 1242 bp, Mus musculus
tggaaactgttatagaggaagtagcagaggaagtctggaaactgctgctgacccactgtccttgcctcaggccagggggcagggcagcttctgagggttggacttgcctggacttgcccagttcttggaaacacagacttaggtctaatctcctaactgaaaatttgaagcctgccatggaatcagcccagccttctcatgaagagttgccttgctcatggtgtctcttcacagcaatggaaactctaagacatccccagtcaccaaccagccaacccagcctaagaaagtaaacgcatgtgaggggaaagtagggctgtctagaatcccccttctttgaaggccctagttctgtagtccaccaagctattctggaactcatcggcttcccgtcctagccaccttagtccagggcctagatgtgtgcaccaccatggcctgtgttaggatgacattccaagccttttattaaaccttagtcttcttgccaggacattagaagtgttaggcgcctcctggtggctatatgagatacaacaggagtggaatgttgaactgtctagttaatagcttgcacagctgaaagactccatataaatagcaatccaactagatgtaatggcctgtaatctcagcaccccaaagggatcacgttccagcccagcgtttgttgcagcaataaatcatctgaaaaatggaggagaaataatttagttcaattctttgattaaaaatacgtcaagtacctgaattctgttttagcacaggggatgtcgctgtgttgctcgatgctttcctagcttgcatgaaaccccaggtttgattcactgcaccacaaaaactgtaaatggtgatgcatgcctgtaagcactgaggaggtagaggcaggaagatcaggagttcaaagtcatcttctgatacataatgacataatgagttggagaccagcctaggatacataaaacccttcctcaaaacatatatatatgtgtgtgtgtgtgtatgtatatgtgtatatatctctgtgtgtatatatagttatatatatgcatattatattataatttattatgtattatatacttcatagcacatgtatatagtatatactgtatactattatataataaatataatatatagtggggtatagtatgtaatatactagcataatgtatatatactattatataatataatctatataattatatattatatagtatacagattacattctat

SEQ ID NO: 33460 - DNA, 1202 bp, Mus musculus
ttccagtgcttgatccccatcttcttgactggttgccccaagaaatattgtttccgtttttgcaggacttctggggattttttttttcctccagaaagacaagcaacggctatggatgcaacatttttataatgcctttgatttctactcagagtgagtcccctggaacctcaactctccaacgctccagaaccgatgactagaccacgaggtgtaagggaaatcttaccaaatgggtttcaccgtcctctctctctttccgagagaagttgtctaagacccaccttgaacttcactactacctcagcagctgggacggcaggccacctgtgcttgacggccctgggaggagccctatggccttggaggcctgccagtccctgcctatgtttgtgctgtatgcttagggaaaagagagcacccctccctccctttcttcctactgctttcctaaccctgatgatcgacatgttcctccacaaatcactctgtctccaggctctgtgtctctggttagtttgagagcaggaatccaggaaaaaaaaaaagtttgaggtttcatccctgtctcctcactatggctctctaagcaccatcttggaccatctctcacaataggcacaaaacagctctaatctacctcacagttaggacttcaaggtttgggggggaaattccagggttcataggaagaagtcaaactattggaatgggtcctttttccacttaaaatcaaattaataaatattattgaatgtggtttgtcccctgctcgccttttctctgggtttgttttcttttcgtggcctgcttgctggcttccttgctccgagctgcgttttgacaggggcagtaaattaggagtaatccttgcctctttcttcctaatcctcatcagacacaaccagaaagtctgtctgtgtaagtgaggcagtcgagtctttgcctcgccttcctccccaccttttctgaaacttttgagatctggttgcaagaaggagcgtggtcctgcattacatatctgtcttcatgggtggaggatggggcctgctgtgtccaggctcaagaatgtctaataccacaaactagagtggcttaataaggtctcattgacatcagcaaacactttgcttcagttttgtgtgcctgtgtatctaaaggttcagggcactggtttgagaagggacaatatgtcttgtgtt

SEQ ID NO: 33461 - DNA, 1189 bp, Mus musculus
aatctcaaaagcccagactccaccgtcctagccaacgcaaaagctttctggccctgtgagagaccctgtctcaaggtaataaactggaaaatagtagagggagacacctgatgcacccacacgttcacatgcagacacatgactccctcgactctagtttcttatgaagaaatctccagcaagtggatgagaactctttaccatggggaaggtgacaaacattagctttggataactgagtgtggcgatagacctgtggtcctcacccttcctcaggctgcgaccctttaatacagtgcctcatgttgcagtgaccccaatcataacattattttagttgctactccataattgtaattttactattattctgactcgtgatgtaaatatctgatatgcaggatatctatctgatatgtgaacacggtggggactgcaagccacgggttgagaaccactgtgctagacagcctcaaatgcatcctttctctctctgtctctctctgtctctgtctctctctctctctttctgtgctggacctcaagcatgttaagtatgcactctaccaccgagatacacccctccctctccaaaactccatcctctcattttaatgtgtctatcacttcagaatttgaagggacttttctagaaattttctaggagaaaggtgtgtggactgggcagtgcaggaggaagatggaaaccagaagccctcagcatcccaagctacacgatgccatgtcaaactagagtgactcctgaaacaagcgggtgtctccagtaactgaaaagaagaagaactgaaacagcagacagggacagagggtgagcgaaattgaggaaagggaaggggacggatctcatcagctgggagagaaaaggatgccagccacctctggttggtggcttcacaaaaagagtcttagagttgggaatagtggcgcacagatctgtaatcccagcactggggaggttgaggcagaaggatctggaggtccagaccaatctgggcaacatatagaaagactatctcaaacaataagataccttagggagagcatccaagcagaagaggggctatcttggatggtttgggttgttcggttttgttttggtttgtttctggatggttgccttccttgttgggtaaaggatagggtgcgggggtttctcttctttgcaggg

SEQ ID NO: 33462 - DNA, 1181 bp, Mus musculus
ttggcgcgggtgggggccggcctccgggaaccaggcattcccagcttgccctggagccccagtatagacgctgatgaaacctacccgcctgtttgcatgatgaaatcctcgtggctcactacttccctcccaatcctcgcgccgctcccacccacttttgcgcttctcccctccccggtctcctcccccaactactcctcttacaactcaaaaacaagaggaatcctggcgcggtgatgaaccttgggctactgctggcgcagccgggccacatgcctattttctcgggcagctgtccctgcaccagggagcacagccagatcccagaaccaaggcaccgatgaagggatcttggagctcagtcagtgtccactgggttctgtgatcttcaggacacagcaccaaggcctcgctgcttgagcacgtgtctgttgtgcatcgtcatgctgagttcctacactcagcaagaagtagcaagcagggcagggggagaaagccggctccctcttattagaaacggcccaaaggaaaagttttctgcaggcttctggcctcccgttactggagttcttcaaccccgctggccactttttagttcacgctgttgcccctttgtcttttcgcagaactttgtgttgagcacaaagtttcacagagagttgagtccttttaggcgaggtgtgaatcagggtgtattttttatttttattttttataggcaccgatacagacctaaaggctctgggaaacgtttattttctctcttgcccgtccctttctggatgaacaggttagctgggtagcaatagccagtactgtttgtaatgcactctgatccacttctcactgtggtctgcgaagtgtccgttggcagaccaggtagttcccgttgtctttgaagaggaaggggtttccttagagtgtagcatttgcttcttaactgaaagaaagcagtgtcaggtccccaaagccagctggcccttgtcagatttttgttgctgttgttgttgtttgtgtgtcacacagtccatagctcgaggaaagacttgcttgtttctgccaaagccagttaatttaaggagtgggatcttttcccaaaggccattcattccaggtcgcctctgctaaagggcagaagcttgacccatttgctccagaatgtttctcatcacttagcaccc

SEQ ID NO: 33463 - DNA, 1197 bp, Mus musculus
agaaaggctcagcctaagtcctttttggattggatagaacgtttcctgtttcggcgaagacccggcaggaagaaagtctcctctgcagagagggacccactgtctttctgttgtgtagatggtcgacctaccggagttctgtaggatgggatgatgcggtgacagggtgaccaccttttctgtgtgccgtgcttgtccctgtgtaattgacaaggagaactgagggatgagaggttgagggactatagcatagggtgttcagagctccgagaaaacaaagatgcatcttagtgggcaacaaacacctccatgggggagggggctccccacgtggtgttgggggttaggcagtggagcagggatgtggtcaggttggccaggtccctcggtcagcctaatccccctttggtctagattctataaaggaccctgctgcatcggttgtggccactccttcacaggaagtgggaaacacaacaggcttggggttccaggaagtcttaccggctcccttattacaccttccccaccaggaaccaggattatctatgaccggaaatttctgatggagtgtcggaactcacctgtggccaaaacacccccaaaggacctgccagccattcctggggtcactagccctaccagcgatgagcctcccatgcaagccagccagagccaactgcccagcagcccggaagataagcgggcaggcggtgagtcctgtccaggtcctgaactggaaggaggattgtctgttctcaggaattccacatttcagggagagggtgatggtggctgtccaccttttgaggagcagctgtagagagacaagagggtggggggcgggtgggaagtgggactctctttggtggagggtctacaagctccaaggaactcaaagatctcatgcatcaggtaattaggaggagatctaaaatgacagtggctttctccagcaccttccatcggcccctctccctgtatcatcgctcacaaagtaccactcttagaacccagcagctatccctgagttcttgatgcaaggagacaatttatcagatatcatgcggtgtacttccttcccctctaggaaattacatgtctgcaagataaaaacaataaacctgggtacctcctggcacgtttactggtcattaaatggattgtggatggagacaggcagacaatggctcctat

SEQ ID NO: 33464 - DNA, 1540 bp, Mus musculus
tgcagagagcgatgtgacaagcggttgccaagctacacgtgtgggtccctgcagtgtcttcaagggtggagggattccccagtctttgcacagaactctcacctttaccttcccacctcaaaccaaagatgatagaggatggagttgtgaccgctaactgaaggctgtcatttacccttgctggcacactgacgacagctcctagattctgatggtattttagctctcaaccctcaagagtggcttggttgccccatagagttaggtggtggtagtggtgttggtgtgggtgtacttttaaatttccttaactggacacaggacacaaagctccaccccttggaccacgtattaaaaatcggattcatgggaaattgagcagtgtcactgccctcctgaggaagctgattcctaagcccagtcaacttctcttgtttctcttcctcagcatgctctttccagttgacctgtgagaataacaaaagatgacacctctctctggactcctaagactggagcggttccatttgccacttgtttattggctgtctgtctcctctctccacaggtgaagagtcacaatttgagatggacatttaagggaccagccgtaggacgcaatgatgcttctatgtcccccaaggcccttgggaggagagctgcacagcattcaggcctcataccaggcagacactgggtgtgggtcggccacccagtcctgctcctcactcagggtgccagctctgccttgaattttgtgaacaccagcacatacctccttgtgcctctgtctataccgagctgctactgcaggggaatgactctcactcacaccctccctgcatggagctccagcgagtggactcagaggagtctatcagaatgatctggcaatcctagccccagcctccggagcacacccatctttccttaggctgggttacctgggaaagccacacttttacttctttccctgacaggaaataaaagccacatttaccctaggcccgcccacagctgggccctgtctgaactgttttccactcgaaatgacgacatgattactattctctgtccagtgtttatggtgtgatttccctgtacaatattttttaaaaagatttattttatgtatatgagtaatctatctatctgtctgcctgtctgtctgtctatcatctttctatcatctatttatctatctatctatctatctatctatctgtctttctatcatctgtctgtctgtctatctatctatctatctatctatctatctatctatctatctatctatcatctgtctctatctatctatctatctatctatctatctatctatctatctatctatctatctatctatctatctatctatcaatcatctgtcttgtctgtctgtctgtctatctatctatctatctatctatctatctatctatctatctatctatctatctatcatctgtcttgtctgtctgtctgtctgtctatctatctatctatctatctatctatctatctatctatctatctatct

SEQ ID NO: 33465 - DNA, 1206 bp, Mus musculus
agtgcgtcttgaactgctcattccacagtgggcctcactgcgggtgccaggtggaagctcacttacctctcttcccggccactgaggactcattaccaacacactacaaatggcatcttgggtctttgtgtaggtctttgtgttggaaaatccttcatcattgaaccatccccccgggatagggttaattgtgtggaacttcctatttcttaaggtaggggactcagagatgagcaccagagagagagagcataatttgcatttttctgaaaacttctaggcttcttggaaagtcttaacagaggcatgactgttactaattcagccataatcactaatacttattaaattatctattattgtggtttgaataggtttggcacccccacagattcatctgttcaaatgcttggcccatagggaatggcactattaggagtgtggccttgttggaatagatgtggccttgttggaggaagtgtatctctgtgtgtgggtgggctttgaaatcctatgctcaagttccacccagctcccagcttcctcctagctgccttcaggaagatagtcttttcttggctgcctttggatcaagatgtagaactcttgattcctccagcactatgtctgcctgcatatgctgctgtgcttcctgtcatgatgataatggactgaaccactaaaccgtaagccagtcccaattaaacattttcctttgtaagagttgctttggtcgtggggtgtgttcatagcaatggaaaccctaagacatctatcatgctttatctaccaaccatccatctatccccccaggctctaggctcttatatacattgatttaattaatcttcacaacacatggtatgtgcgaccattatctccatcttacagacagcagaactgagatgttgcgtggagaagctttccaagaagaacaggagcaaactgtttgaactaagatttgaacctaagccaggtagttccagaaaattcatatgtagctgttgaactacttactttttagcagctgacatactgtgaggcttctacagtaacctcgaggaagctttgctaagaatggaaacgtggcttttgttttcaccctcaggtgaattaacttgtttagagtttgtcaccctctaccaccctgcctcattgctcagttataaagcaggaacatgtccctttagagagaatacaaaagtt

SEQ ID NO: 33466 - DNA, 1070 bp, Mus musculus
cgggtagaagaggctcagtgtgcctgtgccttacatgtgagggctgggattcaatcccagcacagaggaaaactttcagtagtcttcactgtttccccgtcctaacaaagtgctttctgcccctcataaacacatctcccgcaactctcactgctccctaaagccacctccaacctcactagttgactgctgctgctggtcacacactacagcccttgtaatacagctttggtgtgttgtacatacacagagagatgtgtgcacactttctgagtcactcattcttgggacctaccatagacacatacttgatatttacatacaacggatttcaaatacatgtgttcatatggagcaacccagaggatgaacatttaatataaacccccaagtggcatgtagcttacatgcatgcagacaaaacctgggttgctctggctgctcagggaggtggatgtctgcctgacattcagatccttcagtcaggcggcagctctcaggcgccctaactttccaaggggaaacagctctaaactgttcctgcttatataatagcacccgtactcagaccagagcccagacagtcaggagcaaatcttcccatacctgaatgaggtggtgctcaggcatgtacaggtgattgaagagggcgtggtacaggacctgggctctgttatactgcagcaagtccgcagctggctgcaaacacacaagttagacagttacaagtttcccaaaggggcgaaatctccattgttgttaattagatacgagtacacagagactcagtaaagccactctcgacttctgcaaggattttaaaagttccatatttaagaagagtctccttcagtaacattttctacattttgctataaactcttgagttctgattattttttttacttgaaagttactggctaatttctataggtgattttgcttttttatcttttcacatttttcataattaagcatgatctttttacttctatgattacccttttatttatattaccagcacaatattatttctactagattcagagagaaaaaatatatttggagaa

SEQ ID NO: 33467 - DNA, 1650 bp, Mus musculus
gtgcagactgactcactttatggaacgaggtaaacctagatgttaagactcaatcttcagtaccattattcctaacccagtgactgtttccttctaggatgtggggaaaagagagtttgtagaagatgaggaggtggaggagagtgacctgagtgactttgaggtgagctctgtgggataaagaatggcttgtggccacagcaaggaaggggggataggggagtgggtctgaacacaggagcaaaggaacaaacgcatggtttgttttgaaccagctgcgcaatgaggggcgtaggagaaggcttgcactttccctggtctgactctctgtttctacatattaggatatggataaactgaatactgacagtgaggaagaccaggatgatgaatcctccaatgatgaagaggctcataaggctaagcacaaaggcaaagcacccttgaaaggacctttacggaaaaaacgggcctatgtggaaatagagtatgaacaggagacagagcccatggccaaagtcaaagccacatgagttcccttcacactggcagctgtgctcttgtgtgttctgtttcctaaagtatttatattgttaatatttatgtcacttcagtggagccgaaatctggagtgagtatgaagagccttgagttgagaggcgtatttttataacacatgctgtaacagcttgagcccaaggaatctaacagatgaattcctggagctggaatggcactggctgtaaatatttctaaattacttagaaatgtcaggatttcaatttttttctcactcaacttttcttatgtggacaaatagaagagataaaaatttcaacttataatattttaatacaaaaatagatttttacccccataactacatccatgtgatctgggataaggagagcggcctttcctgctggttagtcaccttcagtgtcatcgccaggagaatctgcagagccctgctgcaccttcctgatgcagctcaccactgtgctgtcttcacaggatactgcaattttagccagaagaccctgaaacatgagagcaaacgggcattgatttctgtaaaacctgtttccccacagcctttattcttttgtcacatactcaaaagatgagagactgcatggccctaggggagggtgcctccatcagaacaggtgttaactgagaactgtcccatgcttgtaagtagtgggctggctcggaagaacctccttcattctagccaaaacaactccaggtggacctttggctggaaaacagaccaacacaagggctgccgtgcgatggccaaataaactgaaaaacagcaagccatgctctagctctacatattttggggtatggatttcttttcatgttcctttaaactggagacttctaattgtggtaaaaatgagaaattagtctttttgattttcatataaatacacatagacaccacaaactatggtcttgagaattctgtggaatataaaaccaaaggaagaatttcctactagttaagtatatggaaaatgggagctcgctcagtgggatggacatgaggagccgagttcaacccatggttaaaactggagtcatcagtgagaagcgtgcactgctaatctcagcgggagggagggagggagggaggac

SEQ ID NO: 33468 - DNA, 1136 bp, Mus musculus
catacaatacatcccaaccacactttctcctcccttcactcctcctaactcccccccccccgatgatcctactccccctccatttcctcttcagaaaagagcagccctccaagagacagcagctcaacaggacaaaataagatgtggtaagacaaggcaacagccctaatattgaggctggtcattaaacatagattagaatatactaaatccattttgtgctgtttatcagtgcatttgtgaggggccatgcactggtgccaggaacactgtcagctggacattctcagtggtgaatagctcctttgcaaggcttggagcctggtgataatctgtccccacccctccagggattgtgactgacttggtcatgtgcaggtctagtaccggtaaccccggctgtggtgaattcatctgggtgacagcagtgccatatctagaaggcagcgtctcacaaaaatggttgagatagatctcacatttatgcctgagcacccggccttttatctcagtacttttgatcatttatatctccctagtgattgttacccactgcaaaaagaagtttctctggctaaggttctgctctaggtataaacaaaatttatttcattttttttttataaattacattttctggaattttatacatgagtacattgtattgacatcatttccactcatctttctctgccctaccccaacttcttccccttcctcactttcaaattcatgacttacatgtttataattaatgttgcacatatgtatatataacctatgaagtccatttagtgttgcttctatgttcatgtgtttagggttgaccactcgatattggatcacctgtcaggaatcttgtacctaaagaaaactggttctttttctcttagcagctaccattatagatggttatgagcctccatgtggttgctgggatttgaggactcaggatctctagaagagcaggtggcgctcttaaccacggagccatatctctagcctctgttttctttttaaaattgaaatggtttttcatataatacattctgattttccctccccaccccttccaaatccttctcacctccccacccacgtagttcatgaccttccttgctctaaaacacataaaa

SEQ ID NO: 33469 - DNA, 1211 bp, Mus musculus
tatcctcagaaacggtttgtggccggaggaggagcaaacagtcgagttagcgcactgcagggctccaagggaaaggactgtgaagtgcctgctcctgtgggtatctcagtaactgatgaaaacggccaagtgctaggagaactcaataaagaagaagacagagttctggttgctaaaggtggccttggtggcaaattacatacaaatttcttacctttgaaaggtcagaagcgcatagttcaccttgacctaaaagtcatagctgatgtaggcctagtaggattcccaaatgctggaaaatcctccttactaagtcgggtttcccatgcaacacctgtgattgcagattatgcgtttacaacactaaggcctgaactcggaaagattatgtacaatgatttcaaacagatttcagtagctgatctcccaggtttgatagaaggagcgcatatgaacaaaggcatgggccacaagttcctcaagcatttagagagaaccagacaactgctttttgttgttgatatttctggatttcagctttcttctgtaactccatataggactgcctttgaaactataatacttctcacaaaagagttggagttgtacaaagaagaactacagacaaaacccgcactcttagcaattaataagatggacttgccggatgcccaagttaaacttcaggaactgatgaagcagctcctgagccctgaagattttctgcatttatttgaaacaaagatgattccagagaaggctctagagttccagcatatcgttcccatctcaacagtcactggggaaggcattgcagagttgaagagctgtataagaaaagcactggatgaacaggatggcaaagaaagtgatgcgcatcggagcaaacagttgctcaatttgcagagttccagttgagcatcttagactgagccacatcaaagtgtgcggctactgtctccagaaaaggcagcattcaaacctagtacagcgtattgacggaatacggtttccttctaaggatcagaaaatcatgtttaaaacgtggatgagcctgaaaagcatgatgttcaaagaagccaggcacgacagcaagacaaatatcaatgatctcacatgcggaatcttagaaagacaaatctgaactgatagaaatcctgaaaaatgtgtgtaattatgtgtagtataaataggagctagaagattaagag

SEQ ID NO: 33470 - DNA, 1162 bp, Mus musculus
caaacttgtgtttcccttcaacagctatttcttttatctgccatgttccaggcagtgtgttcatacctatgagaagagtgacgctatcataattggctgtattgtacatttagcaattgatcttttaaatatgtttttttttacattttgtcagtgcactaaatgtatttcactcatgcaaacagagaaatacaacagtactattttagacagtaattttgtcttcatcattccaaagctttcttgctgtccaggaatgaaattagcaatctgtcccatctcacgcctagagtgctcaagtggcactgagctcctaagcagcaggcatgggtgataactgtgcatccccgtgaagacatcatctaattctaccatggtttctgtagctggatggcatggcatgggggcatttgtagtctgtctgacttgagccttagctcactcattgtctagtccccaatcgctttccacataaaagaatttacaaacagctcccagcgctctttactgtagtgactgtcactgatgagtccagtagaataggcctgattctcttcaggtcatttgagacaccctagttctcacataggaacattgcagtgcacgccactcaggcatacattgaattatctgtggtaaaagaaactggtgtatcctgaacattttcctgtgactgttcattaattattattttctaattgagttaaagactgaaactttacattttaagttatgtagaacttgaaatcattttccaagttctttcacatgctcaacctcattttgtcctgatttaagttagtgctagcccctcttagagatacaacactgaggccctggcgggtgccatgatttgccataatcatcagagcctacctaataatggaatagcaaggcattaatgagcccactgatgagcaaagccttcattctgacagacaaattttaagtggcagccttgaaaattaaaattggtcagtttaaacgtttttatagttaaaggacttgtaagactgcattctgggcagatgtggtgggacgtgccaataaccccagcatttctgagttggaggcaggggaacacaagttcatggccagcctagactacatgaaattctattaaaaaaaaaaaaaaaggaagaaggaaagaaaggaaaggaaa

SEQ ID NO: 33471 - DNA, 1126 bp, Mus musculus
taagcatccattagatatctgactcagaaagtaacctctttaaaaccgatgaacacggcaaagaataatggtgaggcaatcataaatgaggacccacactggcatccctaggcttttaacatggaatgctatgtgcatatttcactgtaccaagcagcataagataaaatcccatctccctcccacctgcttgggctgagtctgtctcttttccgagctggctgtagtagtccctttagagtatcagtcctgggttccattccagagtatgttagtcctgtgggagagtttgaaagggaacattttgtgaagagaataaagctgctactttctgatgcttctgaaggaagatttagatgtctgtcacagttctgcttttcaatttatgattaaaacaccatttccgtggtgtcagtttcagtgaccatggagacaaggaacatcgccattacccaaagagtccctgtattcccataaattacaacatccccacaccttctctcccaattcccagaagcagcgtggttctgtttgccacgtggccgtgtgctctaggattttatctcactgaacatgtatctattttcattttggcttctttggtctgtctgtccgttaaatcgtccatgatgttgagctgcgcagcaggttttctttttatggctgataaaacagtcttcttaaaacagatctgaactgtgcatccaaggtgatgaacaacttcacagcaaacctggtgagaaaatgctgtccagcattgagacggtacccgtgactcttagacacatctcccattgtaactggggctgtgtggatcaggcagggctgtttgggacacttgagtttttccacagtaaacagaggactcgggtgagaagccatcagccaccacagtggccttcaaactggttcttcctctcacagtaatgctgtgatttcacaaagtgagcgttcacaataattccaggtgagggaatactcattgtaaagcctggtttatctaaacaccctggaaagatggacctggtgcagcatacctagcacttgagaggcagaggaaggagaaccacgggttcaaggctgtcctgggcctaactttgtcttttaaagaaaaacggtagatcta

SEQ ID NO: 33472 - DNA, 1155 bp, Mus musculus
tttagctccttgggtaatttctctagctcctccattaggggccgtgtgacccatccaatagctgactgtgatcatccacttctgtgtttgctaggccccggcatagtctcacaagagagagctatatctgggtcctttcagcgaaatcttgctagtgtatgcaatggtgtcagcatttggaagctgattatgggatggatccctgcatatggcaatcactagatggtccatcctttcgtcacagctccaaattttgtctctgtaactccttctatgggtgttttgttctgaaagtataacaacgtaaaaacagaattctaggcctttaggcccaggcttgggaaagtggcctttgtaaaggtatgctaatcataaaagagatagcgacattcctctacccacctgcttcctgggttcaaagagtgctcattcaaagaaagtcaccctggccattaccagaacctgcaatgcaaatgtgctattgttaggggctcttagaagctgtcttgagagttaacaattaccaggtattccttgtgactcttgtaactttacacttccttgtgactcttaactggtatctttggcatcttccaacaacgccctccccacttccttgagtttctggtttcttcctttaaatacccccttacccagctactcggggcgccacggtcctctacccctgcgtggtgtatgaccatgggcccgagagctctcttgaataaaaatcctcttgcaatttgcagcaagacccgtttcttgtgggtgattttggggtgtcacctctcctgagtcagaatgagggggagccctcacattgtgggtctttcagttcccatttctaagaaagggtaaagtgtccacactttggtctttgttcttcttgaatttcatgcgtttggcaagttgtatcttatatcttgggtatcctaagtttctgggctattatccacttatcagtgagtacatattgtgcgagttcctttgtgattgggttacttcactcaggatgataccctccaggtccatccatttgcctaggaatttcataaattcatttttttaaatagctgagtagtattccattgtgtaaatgtaccacattttctgtatccattcctctgttgaggggcatctgggttctttccagct

SEQ ID NO: 33473 - DNA, 1112 bp, Mus musculus
cactgtgcagacaccacagtgcggctcagactagagcgtgtggaaggccctcccatccccaggaccgcagccggggaagagaagaaccctgagcacgggaactgctgtggaggttattgctggtgattggactctgctttgcattgtagttcacagatctttcagctaatgataccatttggaaaaagaaaaagctgtcatgactaacctttgcaaccgctacttaactgttcattaatttagcaattataaaaacaaaaccattttcttctcaattgaaaaacagatattctgcctccacggtggcctgtctccatccatagatacactggaccacataagagccctggatcgcttgcaagaagttccacatgaggtgattttcgaagttacttcatttattttgattttaagggagaaaaaagtgtaatcacatatgggaagggtaactcaattaagtatcctaactcacagtgcacacatattctttctccttatccagggcccaatgtgtgatctcttatggtcagatccggatgaccgtggcggctggggcatttctccacgtggtgctggctacacatttggacaagacatttctgaaacatttaaccatgccaacggtctcacactggtgtctcgtgctcaccagcttgtaatggaagtatgtacttttcctgctctcgtggtgtacgcatgcacccgtcataaggcttcataataccttcagtaggggctggagagatggctcagcagttaagagcacattgctcttccagaaggcgctcagtagagacttgagctcagtgagatgatgactccatgctgcttagaggagcacactgaggagtgtgcttgctgtgtgtgtccttgctacatttcaccaaggaggtttgaaagctgtttgtccactgctggttctattccgtgaccactcagttgaggtagcaattgctggatttctcctgttgtgttagtgttgtcactacgaaaggaataaacgagaacggagtccctctaaccagcaagtagtggctttaagaaggtagaacaaacttcaccagcctagagcaggcgaggagtggggtaggggcaggatgcaaagcacatac

SEQ ID NO: 33474 - DNA, 1691 bp, Mus musculus
catcctgactcctgtgagtgtttgcgtattactatggttagttgcatcctttcaggactgttggagaaggaaaacacaaatagcatttatttatcccaagaccacagtgttgataaaaaaaaataggaaaaagtcagtgtactaacattaatattaaaacacacacacaacagacaaatagctattttgacagaaaaggcacttggtaaaattcagtgttctcttctgctgggcacaaacagacgtgtacattttcaccatagctgtgaagtgctaactgtgtggttgctagtgacgaatgagttcagggtcatcccagccacgtgggatgcagcgttgctgaaagctacaggaaggaggctcagtctgttccgtcttactggctggcttacttgctgaccattttctttgtcatttttagtcttcagtttgacccagcacctcgtcgtggagagcctcatgtgacccggcgcaccccagactacttcctgtaaattcctccccaggacctgtctttgtatgtggaagtatacctggctttttaaaatatatatatatacatatatatttaaaaacaacagttatttgtgtttctgtaacaaattgtgatatgtcttgacattaaaacacatcatggaccaaaacgtgccatactaatgatgagcggttagcacaatgtgaactctagcacactgttgtagatgagtcagcccacagcctgcctgctgggcggtagtgaccatttttcttgactggttaagcaaaaagggtcactgactgcttcgtctcctttgcgcttacttggaaatttagttaacaagtttaactggcatggattatagagttggagttttattttttaagaattcacaagctgacttccacttcaattcataatcctttattttattgaaatgtatgactaactgaagaagagattcttgggagtatgttgtcataacattaaagagatttcctttaaagtttcctaaactaaattactgttggatgttgagctgcatatttctgtatatttgtcatgacagtgcttgcatcctatttggtgtactgaacaaataaaatttccgatttagagaaaaacattttttaactgtgatgtacattaaatggaagcatcgccattttgaaactttatacaaatacttagaactgtggctggttgttttttagactttgaatctccttgatactcctggctctccttccgagggatagaattgccagtatggggctccttgctaggccacagatatctgctgagtaataacagtaggcagctgtactgacatattcgcctggtggggtgttcaccccaggccttatattcaattccaagttatgtgcacaggtactgcagaagtaatgtttgtttatagtttacactcaaaagcagaacaaagtcaaaatactgataactgttagaccactgaaaaggcgattgttgcatatctaagcatttcattaggtggttcatattaatttattcataattttaagtgcaaaatgtagattgctttaataactatattctaaatctaacagaagggactttaaaagctgagctaggttgtctcctttaacctaaaaacaggaattggcctgtttatttagtagcagtggtaatgatagtattccaaggtcataaacaccagctctagggtttacttaat

SEQ ID NO: 33475 - DNA, 1203 bp, Mus musculus
cttacttgactggatgatgaaagttgggtaccacaaatccctatatagactttccaattcctttcccagaagggccctggaagtggagggaggctcgtcactggaggacataggaataactgtggacactgtacttaacgtggaagagaaagagcagagcagccagtagagaggctggaagcacctgctgcccttccacagggcggtgttcattcaagccccatgcacctggagctcctctcgtccacaggtgtaccccgcccacaccccgcccacaccccatggatgaggaccgctttgcactgatggtctgtggcctgtcattataatgtgaaaggaggtaaaaagagtaagacagacctggatgcaagcctcagccgggcatggtgggacacgcctcaactcccacaatttttgagttaattagaccatcttcaaaccaaaccaaaccctagctcatataagaactggttcctgcttgcgtctaccttaccataaagtatttcacaattcagtcagaatctaaggaggatgaagggacattctattgtatttctaaaaacttaaagaactcccagagccaactgatcctgtatagttttgacttagatctggggatggaggtctggtccatgaaccttggggaacatagtgaaaccacagtaaacaaggccattgttgttaagtgcatttggaatgtgaactgtcgtttgtctacaaattgatgcccttagagcatctctcaacctgtggggtcctgtggggctcaaataacctgttcataggggtgcacctaagaccatctgcatgagatttacattgatgattcataacagcagcaaaattgcttataaagtagcaataaaataattttatggttggggggtcaccacaatatgaggcaatgtattaaagggttgcagtattacagaggttgaaaacttaagtctgtcttaaggtatctttttttttttttcgttttccgaaacgaaactggggggcagaagctcagctggtaatcctaggtcttgggaagggggcaggaggatcaggagggttcaaggctacctgggctacatgaaaccctctctaaaaattaaagattaagaaagataacttccgctgggcatggatgcacacgcctttaatcccagcactcgggaggcagaggcaggcggatttctgagttcgaagtcagcctgg

SEQ ID NO: 33476 - DNA, 1128 bp, Mus musculus
tctctccagcaatttttccctttataaggtcttagaatatagatagccctggctggccttgaactcacaaaaatctacctacttctgtctcttgagagctgagattaaaggcctgtaccaccatgtccagctcctattgaaatttttttagtggggctgactaaattttaagaaaaagatggacccaagagatggctcacagttaagagcactggctgcttttctggaggacgcaggttcaattcccggcacctgcacagtgactgacaatggtggttcttgtcccgggttcctctgctctctccgacctctgcaggcactgcacatgtgtgatacacatgtgtgatgcacatgcatgcatgcaacaacacacacacacacacacataaaaaataagtaaatcttaagaaagaaaggacaggaaagttgttggaggttaggagatgatcgagaaatgagcattttgcaaaacttagtctcactgtatgtggagcatgcactgaccctgtggggataatgttatggctggtagggttctacagcaaaacaaactttggtgctctgtccccaggtggtgcagatctttctctgaacggttggttacctgtgttcacagcacttggccctttttctcccagggcaaactcactgccccctaagaagggttagaacagggtgcttgtgggtttggcattaagtgaaattcagttaattaagccaggtgcctgcaggaacaggcctggaagggagattgggagggaggaaagaattcagccccagacaggctgaaaaatgttgactcattcctttgtgtgaacaaacttacgtggctcctttagctttccacagtccacctttccgtgccaggacataggtcacagctggctgacgcttgctggctgcactcacggtgacccctggtacggggttccactgagagcaagtcaagcattactgttcatttccgcagtagagcatcactgtagttttctgttttgctttttgttttgttttttgttttgtaaacttcccaccaaagatttattgttttgtgtatgaatacaccgtcattaccttcagacacaccagaagagggcatcggatcccattaagatggttgtgagccac

SEQ ID NO: 33477 - DNA, 1152 bp, Mus musculus
agtttctggggcagaaaaattgttaatggacttaaggacagcctgggatatagattgagattctgtctcaaagcagaacagaaaacacaaagatctggtttttctatgtacctggtggcttaggtctgaactcccagctactctgtaggagtatcatgagttagttcaaggcacgtctgaactatggagtaagtttaaggccagcctatgccattagtgagatcccatcccaaaataagtaaaaaagagtgtgtgtgtgtgtgtgtgtgtgtgtgtgtgtgtgtgtgtgtgtgtgtgtgtgtctagctcagtggttggatgcttgcctagcgtgaatagagtcctaggttcagtctccagtacgggggtagggggagtccagtgtccccttgctttgctttaatctgccttctcccctctcctcccacacatacttagcacttttttttttaataggttaaggaagtaaaaaagacatcatcaggcctggagctccaagtggtgacttccgtgcctggtaggaagcccaccacgaccatgattccagatgttgactgcctgctctgggccattggacgggacccaaattctaagggcctgaatctgaataaagtggtacgtttgtgggtttattgattcataattaataatgattgataactggcccgccggcctcctgatggcgctgtggcgatcgcatccccatccctgtgctttgttgtgaagctcttgctttggatgcccctcctttctagagtgctcacgccaggctgggtatctggtcagattggagaggtctggtccagatggtgcagccgtttccggactgacttccttctagaagacttctaaacgttggggttagtggatatgcgctaccacaacttcccgcccacttccccgtcctcttctccatctcccttctttttggcagtgagaaagaattgaattcggagcatcccatatgctaaccaggttctctgccatgaagtgtggtcttagccctccgtttcttctttctttttttagagacatgttctcactaagttacctaggctagccttgaactcagtctatagcccaggctggcttggcaggtttcctgcttcactcccgagtggcctgggttacagatttgcatcaccagtgcct

SEQ ID NO: 33478 - DNA, 1959 bp, Mus musculus
atttggttactgaatgggcttagttcttagagaaggaaggtatggtggtgttgctcctgatctcagcaccgaggaggcttaggcaggaagatcaggagtttgagaccggcctaggcttctacagcaagagaagtgcatgggataggaagaaaaaagcaggagtaagaagtgcctgggggctggagagatggctcagtggttaagagcagggactgctcttccggaggtcctgagttcaaatcccatcaaccacatggtggctcacaaccatctataatgggatccgatgccctcttctggtgtgtctgaagatagctacagtgtagtcatatacataaagtaaataaatgaaaggaagaaaggaaagaaggcaggccaagtgtgcactggaaggagccaccgaagtggggctgcagaggacctgcctcctaggcgtacttacacttactttggatatggagacctgacgtccctaatctctgttttctcgcaggtggttggcattcacatgcaggggattggctgtgatgagatgctgcagggcttcgctgtagcggtgaaaatgggggccaccaaggccgacttcgacaacacagttgccattcatcctacctcttcagaggagctggtcaccctgcgctgagagcctggggacccaggtggctagcggtgcgaccagcaggcctccgggaggaaccgatcgagtttacgcccagcttctacagatctctgtattttaatcaggaatttctggtggtgtaaatttccagctatacacacgcacagaagaacttatgtatctaatcagaaggttgttttgttaatccggggttggttttcatttgataatatttataattaatattttgatttttttgttgttgtttaattaacagccttgtgtttgttgtgtttttcttgctttggccccattccaagtttaaatgtacatgacatacactcaagttagtgtacctgatggatgaatattgctggctaatttcttttattttttatttttttcctttttttatgcagcccaaggtggcctcaaacaactcagaatcctccagctatagcctcatgggtgctggaattctaggcctgcatggcctctcctggcctagcttgctagttttatatgatgggaagtctgcagaatatacgtggtatttttgttctgtattggaaagctgccccaatgttacctctctattcttgttttattctttgctctgtgttaaatgatttaaaatggtttgtgttattttcatggaacaaagtgcattaaagttagacttgaggctggttaggtaaaggagaaatgacagtacatgcaagacggaaggctgaggcactcgggagccctttcttcttctgagtattcctggttcattcagtcatttctgtatctctgcgtttgtttttttttttttgttttgttttttatgaaaactgttccaaatttttgaaattcactgcattgtcttataaaatttattacgaactatgctgctgtcagtgtattttctaagactttccacactgggagaacagacaccagcatctgttagcgaagaagtctctttaaaacaggtgccagaggggctggagggatgggactgttcagggcttctcattcttgtgaaggattcagtttggttcctggctcccccttctggcctttgtaggcactacacatatggtgtacaaatacacacatggtgtacaaacacatgcaggcaaaacactaacacataaagttttaaaaaaaaaagagtgctagagggctggagagatagctcagtggttaagaacactgactgctcttcctaaggtcctgagttcaaatcccagcaaccacatggtggctcacaaccatctgtagtgagatctgatgccctcttccggagtgtctgaagacagctacagtgtacttacatataacaaataaatctt

SEQ ID NO: 33479 - DNA, 1174 bp, Mus musculus
ctatttacaatgacctgtggtttggcagaagtgactgggcactgtcccttttaagagctggttcttgtattgctaattcgtctcacagttgataagctgtgctccctgaaggagctgatctacttcatttgttacatgatgtgcagatagaagccagattccaggttataccttgtaggcaaatctcatgaatgtcacagtgtggcaacaaaggatgaaagccatctatccactgatgatctctggagacttctaaatgtcattgatggctgcaatggggagaccctagttggcagctggttccccgaagtgctcgctcatgaggtagccctggaagtccttgtgcacactgctgcagccctgctcatgccacttaatgtgcagctgctgcacagaacagtgacactctatgttgtgggaactaacttgccaagggctgtagacatggcatgtgggtttgagtgatctgaatatatattaaaggttcgtgtttgtcttgtagcattatggatccaagcctattgagagatcgagagctgttcaaaaaacgagctctttccactcctgtggtagaaaaacgtgctgtgccttctgagtcaccctcctcctcctcatccaagaagaagaaggcaaaagtcgaacatggaggatcctcaggctctaaacaaaattcaggtgaggagaactgttttgggacgtctgttactatttttcgggaagctagtaatggcacgttcagtttctcttttgagatatggactctatgcagttcctggctggcctggaacttcctatgtagacaagatggtcccacagagttggctgccctgcctcctagagctttaatagacctgtgctgtcacaccaagcaagcttaatattcttaatgagtttcttggttaaatataaaagatgaatttaaatccatagtatgttttcagaacccatacgacagcttgcaactacctttaactctggtctccatgggcacacatgctggcaaaacatccatacaataaaattaaagggcgaaaaagtgtatataccactcttactgggggaaaagttttaaaaaacaaaagcaaaaacctacactttactgagggttgggttctagaacacgctatttacattttaaaattatagggcaaatcttttttagtaaatatagtgc

SEQ ID NO: 33480 - DNA, 1163 bp, Mus musculus
gaccagatactatttgtaagtcgtcctgataagaagaaaatactattcttcaatgataaaagctgtcagttttctgtggatgaaggtgagccattttgtgcagatcttacagttggaaacatatttcagttttgaggtgataaagcttgcagtacttacagttgtaatttaatattgtgatggtgatttttagcatcgccatctcttagcctatagctaaaagacacatatctattatatcatatcttagaatgcatttgaaatgctgacttgaaaggttttaagtaatttgtacatgaaattacaatgtagcagtttgtgctttaactttttttttttttaatgaatgtttgctggcatgtattttttttttgcaccacttgcatgcctgatgcccacagaggccagaagagtgtattagagcctttgaaactagagttacagatcattgtgacccacctgggtacttggaatcaaacccaggtcctctggaatagcagccagtgctcttaaccaatgagccaactctctagccctagttcctgttttcttatgctgatatctcacttgtacaaagtagaatttagttttaaatcctgtggctgtttccttagtttttatttttaaaaagttttactactggccctgggcatggtgacccagcgctcaggaggcagaggctggtcactctcagtgaatttaaagccagcctggtctataaacctactcaaagtcagggctacacagcaagacggtttcactgtatgtggggctgtatgggaaagcatttcatagtgtgtatattgtggtaagtgtatttccctcatgactttctttatgttctcatcttccatggatttctttattgtcatcataagctgctaaagacttgatgcatgatatgaaaatataaatatttgttggtgactgatattctcttaggaatctttcaattaccaaagtttgtaagaaagaaattcatgtttttcctttgtggcaattatatagttgtgggctatgctatggtcttcagaatttgtgaggggtgtgtgtgtgtgtgtgtgtgtgtgtgtagttgaatccaatacctcagctttgctgggcaggcactcccactgagttctgtgtccaagcctctagcgtattcttctcatctctgtttc

SEQ ID NO: 33481 - DNA, 1112 bp, Mus musculus
tccaagagtgagggagggattccctctgatggagacagcacagaaattcatcgcctctcattttactgacttaatgcccaggagagttgtgttttgcttttgtgcctgcctgctcttttccaatggaggtttataaagccttgtggtatcagaaggcacagctctagatggaggctgggtgtactgtgaatggggtgtttgaggtcggacctccaagcaagaaccaggaaaggctcagaaccctgtgctttgagcttgttgagtaaatcttaaccttctgtcccctagggtcacttgtgtttaactgtctttaccttgtcctgcaggcctctattcagagaaggaaaaagcctgcttcacagaaaaagcgacggtttaagactcacaatgaacacttggctggagtgctgaaggattactcggacattaccccgggcaaatagggaacacttttattcctaaacacagttacagacacgcagtcgagatctttcttgatgcttgggatctcaagactgtctgccttcctgcctgctcctcaggcctgagagaggagctgctcagtttacagaacaggagcgggttaccagactcattcttttcatccagcaggctagtgggaaggaatgggtgttcctgtttaactttctgggtttgtttgttttattttattagaaagacacttatatgacactcaggtgtctgctatttatcttgatttctaaatggttctggattccatgttttctctattcgtttagaagaagttggaggatggtgctgaatgcagttttgtttattccaagaaaaaatatttataataaaatcatttgtaggaagatgtttaagaagttaggaaattcagtttgtctcttacttcttgaaaatggcagggagcagctgcagcccctgacttgtctggggggatgtttaggatatgacagaggttagagtcagtactgttggcgtaaggatttcatctttggaacacagggtatgcctctggttaataagctaagcaataaaattacacgaaatataaatgttaatgctttgttttaaaaagctaagccagcatttactaagttggattcatgatttgctaccaccct

SEQ ID NO: 33482 - DNA, 2374 bp, Mus musculus
gtctttattttagtgtgtggagatgggaaggagaggacgtctcgcaggaatctgttctctaccacatgagtccccaggattgaactcaggtcactgacagctaatgtttacccactgagccatctgtctagctgggcctcttgcttttttttcctttagatagggtctctctctagccctggctggcatggaactccagctgatcctcctgcctcaggtctccagtgctggactgcacccagcttgaagtcttcatccactactcacaagtctgagactaccagtcttattggggcacagtgacagtgctgtatgggattttcaaagatgctctcccaacacattttctttctgtttcaggcttgaaaacaccctgccccgttttgaccccttcaagacttcacaacagcctctatcacacatctgttttcctcaaagaaaaaaatatatataataaaatgtgttttgctcttttacactgtataattttaagaaatgtgttatttgtgaatgcatggtctgacatttctgtacagtttgaagacatagaacaaagacagcaacagtaaagccaagatcgttagtatttttataaagacattttaagaatggacagatggattcttacactaggttatatcacgacttttcgcttgagttttgaatgcttttaatggtgtttatcttatttttcttctgaaataagatgcatgtttgaagcatatctctagcatcaaaattttccacaattgtgttgtaaatgtgtggactccctctgcctggcccagtgtcaggccctgttattagtaacgcggtgtagaaatgagcttctgcagtactagctctgtaatcctggctcccagggatctctctgcaagacaatcagtgcccccaagagcatttgccattgtagtatattcaccactgggcaaagactacttaggtaatgtctctgaaacccatggccactccagctgagactataccaactgtgcccagggacatagtgacattctatacttagcatttatgatagcaccctcagagtgtgtaacctaatatatatcacccaccttccataaactgtctccatttccccagtggaaccttatatttaaggggagggaccttagtttggaggtaaccattgcctcaagaggagcaggccctgcccactcagcctgcagtggacatcacatctctctcaagtgattcagcaaagcattggcctacctgagtagctagctggtctggcagccatgtcagatagaccgcccatcatgttctctggacgtgctcatcttgagactacctactacattgcacagggcagggaatgaaacagtggccctctgcaatgaatacccttgcttcaagacttcaaggcccaaagttagtcttgtgttatgtgcaacacatttccagaggctgtgacagcacagcctctcctgctcctcaaaaaagagctatgtattattatgttgacctcagaattcccagctgctgttactagacataatcacaatctttgtatctttgtttttgatctgcttgtgttgtgttgaaaagggtcatattttaatgatttttgtcagtggtttgggagggttatttcattatttttcatgagaagtaatgtcaagtttttaaaggtttaaaaaaagaaacaccaaggcctggaatatgggccttttcactgtaaactagaggacgggggcaggcagcactgggaacttagacatccaagctggtgttcagggactgctcatggccccagcccccgtgccacttgactgtgagactcctacttgctttatcatcaattatgcttttataaattgtgtaaaggtacttttgtattgtcattttttaaaaaaaataataaaagtttattccagccattacatgatttgtctgacaacttacatcaagcaggcatgtcctaggatgcacagatttccaaagattctgccagtgatgggagtcaaggtaattacgacacacccagctgccaccaagggacccacggacctcagtaaaaggtaccagccaccctaacctacaaagttttgagacaggcagactccatgacaggcttcagattggcagttcaggagaccaggcaagtcagttcccgaaaaaagcaccaggcctcctcaggcacccagtcagaaagtgccctgccacctggcctgaggcaaaggcaatggatcagcaacagtttctagcccagacacctcagaaatggttctggaacgtccctagcgatagagccaacagattaagatagaggtcacctccttcccaccccaccccccgacagacacacactcaccccgaattcccctaatatactttaaatcaggcctgcaag

SEQ ID NO: 33483 - DNA, 1157 bp, Mus musculus
agctacccaggccttggtgcagggatagagtgatgttgagagttgactatggagcagtaagtaggcccagtgcacaaaggctgtcgtagactgttgtccccactccaccaggcacagcccatagcagcaggttcctgccaatcctgtcctttttcttggggtctctgtaagcagcatcacactaagtcacagttgctgtctcgcttgctgcgttcctaaggtggctctctaagccaggagaattgcagatccgttctgttcttggaacccttgcagcacagtttgatggattgtgctcagggttaggaggaggtaggacttgtggcatgtgtggaccagttgtctatggggagcaaggcaggggtgtggagaccactgcttctgcagaagcccctttggcaggtcagtgatgtgaggaagtcaaactaggaggctaaggctcaccaaggaactactgttgctgtcaccataaaggtgatgccaccttctgcccgagtcccactcccagggagagtgtggttctttgatgtctattagatttgaaaataataaatggaactctgactatcccaggcccatgcctatggattaaaggcaccccccatctagagatggagtctcctcacttgagcatcacagggcactaaatgggagaatgccaagaagcagagagaattccctaaagaggtttagttgtttatccctgctagataaatgcttccaactcagaatgctgctgccagaggacagggaaaaggaagtggtcactctgtacaaggctaaagcattcctacggttctctacaggaagtagctgttgatgtgccaagattccatatttgcaacaactgggagagacagaaaagcatagagtaatagcacagtacactgatgcatgtcagtttctgctctggaaagctgtgcacaacttgctttgtctttccaaactccacaggtgattgtatttggcccttaaagcatgtaggcattattgttacaacgtaaacatttctctgtacagagatatgtatatctcttctgtgttgcgtctaacctgtcagtaaaatggaagttggggattataaaatgaatgacagaataaaatgggcttacagagtatcccaggcagcactacagagcttgggtgccagaaccaag

SEQ ID NO: 33484 - DNA, 1144 bp, Mus musculus
ccactgaacaactgcagtgtgctaaggcagaacgggaatgaacataataggtcaaataggggcaagtgtagtggggaacatggagtctcttgctggggtgtgacagcttacagtgctccgtgtaggaagctggtctacctagagggccagatctttcccagcagatccctctggactagaaacatgatgactcaaatccttttgcctctcccatggctaaataaaagtagatggagccaggcaatggtggtacatggcctttaatctcagcacttgggaggcagaggcagacagatctctgagtttgaggccagcttggtttacagagcgagttccaggacagccagagatctacagagaaaccctgtcttgaaaaacaaataaacaaaagtagataggcttgggcagtggccaatggcctcagggaagcctacgaagaagcaactacaggctttagagcccttctttttggactccttctgtcacctcaacaggaagagaggggtctcgctcttactgctctgagcctaggtctgttgtggttacacgcatgttacaaggctgcaaacctcttccctgccagatactacatgcaccttccagccattcccagatcccccaaacctgctaagctaaagcccagcacatctgctccccgccatgacccccaggctcatccctacacccaggctcagatagccatgtgcacaaaagctgtagcctgctcatgatctctaaggatggccgtgtgtgtgaagactgtatactgagagcaggatacctggccagcctctgtcccaccctccggttcctgcacatcttctgaattttggagggttgctgtgctcagcaagatgtgggaaatgcacacattcaggggcgctgcttgcctggtggttggtcatcactgtccgtgtggctggctcttgcccactaccacctgtgagcccccgtgtgcacagcttgttggtcaagccccatgttctggtgaacgcaagagggttagtcctcctgattagcataatacggaagtcaatagggagccagccaccagtgcgacttcagcagcagtgggcacccacacaactcagtgcagtttggaaacctcaggaggtttcctgggcctgctgttgccagcaaggct

SEQ ID NO: 33485 - DNA, 1163 bp, Mus musculus
gcaccaggccactaggacatcccagagaccagcatggtgcttttgattccacacagaaccaggacccttttgtggccttctgtcacataagctgcagaagaggaggccctgtgggccctggcgccgccttccacgcgctccttctgtttcctggctcaggtcatgtctgccaccttagaaggattgagtagagctgtgatccgagcccaggaactctgctcctggctaaggaagccctctctctgtccttgtgaccttgtcactgtcacagcgctgggatgtcgcctgtgatcccaaccttcaggacctaaaagtaggaaggtcactcactagtcaagatcacgagtctcccaaacaggaaagcaaccgtaattttgttgtttggttttggagacagggtctcactctgtggtccaggccattctcatttatgatccttttgttgttgtagaggcctcctgaatgtgggggtcacaggcaggccaccacccaaagctcacaaaagggattttttttattaattattactttttgtgtgtctgtgattgtgtgtttgggcgcctgtactgtgctgcacaccgagaggtcagagggcagctttgtgagctccagggcttgaacttgggttttctggccttccccccccctcccccccaagctctctgtttgctgaaccacttagctagccccatctgtagacaggattctttttttaatgacagctgctacccgaactgttaaacctggtatcgtaggcacgtgtcctccatcctcctgcccctgcgtttctttctgtataagcagaagaacgaacatctgtcacgtaacgttaatttgaggggaagagtaccactgtgtgtggcattcgggactcactaaagagcctctccgcaccttgcctttgccagagcggggcctctagttactagaggctcccagttaccacggtgaatgggaggaatgtgtagaacgggaacattggagcagcacctggtgagtgggtcctttgggctgcacctgttggggccaggggtgacagaaagagcagaaggagtgggcgcatcgccccgagctttgccgtgagggcagagaggcaccagatggtccatggtaggttctagttgcctcttgaggctcaggctcccaggtacccactatgtgac

SEQ ID NO: 33486 - DNA, 1253 bp, Mus musculus
aggcaggcaggaagccctcagtcagtgcctgtgccacaggccaaaatatcctccctggggaagctacacagcagtgtgaggaatgaggaaaaacgtgctgaaggtggcagggagtggccggcagtggccgtggtccaggaaacaagctgaagtcaacgaccagacgtgccttttgcttttctgtgctctgcccagtatccctgcctcagtattcagtagccgtcatagccgacagatagcgggcaagtggggggctaaattgtgactgtctgtcacttagtcctttatatttttgatctttgttgacagcaaagagcaactaaaagccccttttgtgtgtgtcccatacctcatgtgcgggtgctgtgccccctctcaaaaggagcaaccaacagttgaggccactaggggcaggcatgcatcatagaatgatagaaggttacacatagtctatagaatctgtggctttgggtagtccgcaaccaggccattcaccactgccctggagaatcaggacctggcagtgtccagaaagaacggggatcgctggctctggtcctgatgtaacagatggactcaggagtgactggggaatatggagggtgaaggttctaacaaggatctcgtgggagagttaggaagtctacgccactgagaaaggatggagagacagtgcaagattcgctggatcttggccgtgtgcctcactggctcgcatcacctagatggcccccttctcttgagacttacccagcccggcatcctcttgactcagccatcagcctagactgggtggaactctgacctgcggtggtgagaggcctgtgtcttggaatcccacttcttctctggagtcacttaagagaacattcttgtcgaatgtattggtccaggctgggacttggagtgacccagtagaggctttatagacagcaggcccagcccattgtacaatgaggaaacgggtctgagaagatggaaggttgtccccaaagcgcagcgcttccacaggtgacccgagcaagtgtcacctgttctccttgctggctaacacagcaaggcgctggctcaccagagacttgctcttactggaatttcggagaggcctcgctctaatgactccttggaactttcccctctaagtagatgagaaatctgtcagaagagactctgaggcaaagatggcttccgagatgctaactggagggagcagagtgggcggccccttactagccgagtggtgttttgttctg

SEQ ID NO: 33487 - DNA, 1222 bp, Mus musculus
atgtgttgaattgtttaaaatgttctgttttagattaatagtggccatgataataggcatgatttgtgtgtgcacatgtatacgtacatacacatatatgtgcatgccatggcatgagtatggggatcagaagacaacttgaggagaatttgttctgccatgcagggtccaggggttgatctttggacatcaagctgccttattagctgagccacctcacagtctgaaaaccctgaagatagcagcgtcgcccctaaatggtatcttcacagcgtgtacactctgatcggccccaccagtgagcctcataccggggctcgctctctgccagactagcaggagtattcaaaggtcaaagagagtctgccatgttctcttgcttctgaacttttcctcagactcatcactgtctggccatgatctagttcctttatgactagcggcttgtccttcagacgtccccttacccaccactccctctgtagaccctgtgggactctccacatgtgggttaactgccctgcgacatgacatgggcttgctgctacagaactgttccttttgctgcgtctgtcatattttattccttgtagcagcggtggtggtgatagaacagggtcttgtgtagtgcaggctatcccagactcacacccctcatctccccttcatgtgcatggattacaaatgatacgtccttctaggccttgcttttccatcctttattctagcctctgggttccctttgtggtaagagtagagtagactttgtatagtgtctgacacatagttggtgtgtaataaatacgtgttattaattaattgtagcctcatctctgttactgtttgaccaagacctgtgtgctctgaacttgtgctcataggcgcttccttgagaactctagatttctgaggaccgattttcccccaaagagagcagaatgttgagaaaagtgctttcttgtaccaaggtatgtttgtaggtgagcttactacagaggaagagaggatcacctcctaaggaaaggcaggcagagcctctctggaaggtggcaacagctcactgcctgaacaaaggaactctaggtgcagggtgtggcttcaactgtagtgactttgaaggcctggaaaccttaaagtggccttaagctcccatgatgccttggggaagcctgtgagtttaggacgctgctgacctaggcaaggggacgaaggtaagaagagc

SEQ ID NO: 33488 - DNA, 1192 bp, Mus musculus
tgaacaagaatgcatcctaggtccacatggtcacttctcctgacaactgtgaacaggagtccttgttgggatctaggcgggactgtggattcaggcagtgaatccatccggctgtccatccatcattcatcttatgttccttatcaatttgattggctgttgttttgagacagtgtctgtgtacatccatgataagcgtggaactcctttgtagactagtttgaccttgaacttgcctctctctgagcctcctacctctccttcttgagtgccagaattatagatctgtaccacaccaacttcatcttaaaaccttgtccgttgaccttttccccattccttcattgggcataagatgtctggcttccctaaaattctggtggtttacaggcagctctgccccacttggattagtgtttgcgcttttatggtgagttttgggtttttcctccactcatttaaattttttttctttcttttgctgtttgagacaggttctcattgtctagccctggctatcctggaactcactgtatagaccagtctggcctcagatgcatagacctctgccttcctttgcctcccgggtgctgagatcaaaggtgtacaccatcagggctggcttgaatttctttttttccccctgcctttcagggtcacggactcacattctcagggtgcttttgtgtgtaatagccattctttctaatgtctgagggcagggcaagggcgacattttttgatggaggaagactcacagcattgcctcagtgaagttaagttttagtgtgcacatcacgcaaaaaggagagggtttatgtggctctgaaggatggtttcaggtgcccatgaaccggggtcgctgatgtagtcctgactaatgcaactcctgtaactacagaggaagacacctctatagcttccccttgaagaactttagaaaggacgtgttttaattaagaatttaaattaagaactgcctctgaaccctgggaatgcaagtgggttgtatatggcttgctttttctcttctcatttttcgggtgttctcagtaataaacagcgtggtgaaactcctgcaattctagtagtttcctctggtaaaattgaaatgaaacaccacctgcagggatcaattttaaaaaacaaacaaaaaccttagggccagggatgcatgcagctcactcatgtg

SEQ ID NO: 33489 - DNA, 1153 bp, Mus musculus
aaagggaaggcctgccagcagctgtgtggaggtggcaggggtcctcagaaaaaggagaggacacagggtgtctaagccacttgcttagggttttggctggtttccaaaggaaatcaaaagttggaaagggaaaattgaattattttttaagtgagacctcagagaagctgtgaggcttagcattgagagtcttggagccaccacggccaggggaggggcttctggaatgtgtgggcatgtatctccttaaacagataatcagactcagcatccctcaataaaaagataatcagtcaggtgcctaaatttcccaccaggtggtttcctgtcacgtgatttacaggccgcccgtttgaatcaactcctgagggaaagaaaactctagtatgcttttgtcactcacccagagtcagagatgggacttcatcatgatgtcttgagaactggggcttcctgtattgttcaggaataatgaaaggaaaggaacttagtagggcagcattctgattgttttccctgaggtatttctgcctgtttgccttctaaaacggtatctctggtctcgattacaggtcctcttgcttggcttccaggacctggcatacagggtgtgcatcagcctgtgctctctttgccttccttgctgtgataagtcacatagacatgacataactctgagagggaagggtttgtgctatcacagaaggggttcacattaggaactcagaaactacctgggaaccctgcctgcggctgctcactgccttgctagataggaagctctcgctcatttgctttattattttaaatgtatttctttttatgtctaaagatagggactctagctctggttcatctgcctccatatgtaaacttggctagacttaaaatacagagattctcctggttctgcctccctaccactgaaacaaaggtgtgtgctccagtgctcggacaggttgatttatttatgtatgttagtcttgtttgcttttgtgtgtgtgtgtgtgcgctcgtgtgcctgcgaacagtactcacagaagctagcagaggatatcgtgattggagtaacagtttagagtcgccgtggagatgctggaactgaaccctgctcctaagctaactttcttacatccagttgccctccacagtg

SEQ ID NO: 33490 - DNA, 1202 bp, Mus musculus
aggtgtgtgctgttctgggtggatctgactcattcttacctctcccacttaacaccaggtaggtggtcagcagcccacaagcacctcccagctccagttgtcctcaattggttgggaagcaagcagtctataaaattgtgtgaacttcctgtttctatagatgaccctccctctactgagcaccacacggctcatcctgggcatcctcagtcctccactgagcaccacagaaccccgcctgtcctcctccagcttttgttaggttttttttttgttttttcgagacagggtttctctgcgtagccctggctgtcctggaactcactgtgtagaccaggctggcctcgaactcagaaatttgcctgcctctgcctcccgagtgctaggattaaaggagtgcactaccatgccctgcctcctccagctttttaatgcaatttcactgggacacaatggtgtttgttaagtggtagaaattttctaattccttttcagaaataatggtgatacgaggaagatttccaggtatggattttttttttttgcaagtctctttcatttcctgcatttgtcaagtcttgcttttttctttgtgtttgcgatgggtcacactctctgtaactgccagctgttgtctctgaatgaatcctatccaggtaaccgatggtctggagtggtttgtcttagccccgtcatcattcagtgtgtgaggctcagctgaatgaaaaggttcttttcccagacctcgagggagagctttgtgtaaaagcctggccagaatctgttttcaatctgttttatgattcctgcagaagtgaaagctgataacactccagaaaactataaatccgttccacctttcagcccccgccagcccttggagcatctttcacgtgtgtgcttacctgttgtgctggaagtggcacgcccttcagagcccccccccccctgaaaacagcttttatttcaaacttttgcttttaatttctaaagtaaaagcaaggcctttcaacttaatttccttctgttgaaagccctgtccccggggtactgcctcgctctgtgaccaaagtgccctttgaaaacagaagacctactttctctatacgctctttgaaatacagcagtccgaggagtataaatcaaagccataagaggtaccgcttcatacccaaggggtggccagcacgaagattggcagc

SEQ ID NO: 33491 - DNA, 1165 bp, Mus musculus
cccacagtgacacaccattccaacaaagtcacacctccaaatagtgccactccccaagccaagcatattcaaaccctgacagcctgttacaagtaccttcaactccctggtgatttaaaatatatcgttggctatgttagaatggtttatgccgttgtacataaaaatgttagtactccatatcctatagaaaactcctatagaaaaccccatatcccaatctgaatgggaggttgggaaagtcaggacattgttttagacagaagccaggagcctcctgggagggaagcacagactgacctgtacccctgacccacactctctgacccagttatgctttctccgtgaccaccagtggacctgtctcaggcggcctttggttaattctggttacatagctttatttacatcctcagactctttgattttccctttccctccctcacaatatataggtgataatttatagctcgaagcatgaacagatcaaattaaaattttaaagattcattttatgcacatgtgtgcgaatgaatgcgtagcccatgtagaggtctggcagggccatcgtctcttaactgctctctgcacccttcactgctgagccctccgccagcccctggaagtaactgttttaggtccttgcattcagcatggtggaaacccagatgaccgatggctatggtggccttcgaagagctctggtatttatgcctaaagccttctttcctgcggaatggtttaaaaatagcttctttggaattccaagttccactgaggtcagaatgtttgcgaacactgacttataattaatcactactccattcattgtccttccttgggtctttttgagatggggcagagagcttcgagcagtgttgtccttagtagtcccaggcctgagctatcggaaggccaacagtcatattgcagtctccatttcccctctgtaacccccccccccccccccccccgtctggcctgcctcctgtagggtttctagtttagaaccttcccttattcagctgctggggagatttctgacttgtagttatcatatgtatgcactgtaactgcgcctcagctctcttctgtcacggcaagtgatcttgcagctcttctgtggtgagggagagccttgatccaaactcctcaggggctgatg

SEQ ID NO: 33492 - DNA, 1135 bp, Mus musculus
ccaaacaaaacaaaacaaaacaaaacaaaaaaacagggtatgtcagtgtagccctggctgttctggaacttgctctcaaactcagagacccacctgcctctgccccctctgagtcctggggctaaagctgtgcactaccaccacccagcttgtttgagtgttttgtggtaaacactggcaatgtaggtgtccgtctgtcttcctgtctgtctgtctgtcatgtactgtcatgcctagtgggcatacaggtctcccttgtctgttctctgtttttgtttgtttgtttgttttgtacacatctggtgtggaatttttagagctccagctgcttgttgccaaactgtcccctgtgatggtttcacggctttgcccttggccctctctgcgcacttgtgttagattttctgtttctctgtatcctgtcagtgcctgtgactgttgttttaaattctcccaggccctgaggtttacacataccacgaggcttcgttgattaatgttttactgtgtaggtgttcatttggagatgagaagacagtttgtagtaacaggttttatccttccccagttaggacccgggacttattaggcttggtggccagtgccctttaccatctatagacggccctggtgtttggcgggttgcattattagcatgtttgaattgttcttggatcctgtttatctggcattagtaccacccctacagtggcaggtctgattgatggagccgtatttaccctagagcagcgtgttttatattttagtaagtaaccgaagggaagaccaactcttgaatgatttgtatgaatgagtaaaacggagctatggatacgcagtgtaattatgttgtgatttttgttgttgaaatttgatttatacattataataagatttttttataaaaagctttaattttgtgataaattattttagcctattatttggtggtcgatctgttgtttgagacagggttctccacactgccttggctgtcttggagctctctatgtgggccaggctggccttgaagttagatattcttgcttctgttttctgagtgctgggattaaagacaccacactctgctaaaacacattttaaaagcgctgaatagtgctatatactgcccccc

SEQ ID NO: 33493 - DNA, 1321 bp, Mus musculus
gttgttcccgccctgttagccacatggctggaaacccgttctgtccttgaacatggcagaagaatgcctagcactctgccctttgcatacagattggcacagttagtttttcccatggaagatggatgagaaagctgactgggaccacatcacttgttgggtttgtttgtgcttttggaaggtaaatatagtgataatctgaagctagcccgatttagtcaaaattccagtttgtggaaatttctagcagaagcacacaagccctcgagcagggtggaatgctatttctgggtgtctcttagctgagcccctcaatgcatactaggattctcattttagtacataagaatgatggtagctagtgcctcagagcaaccagtgtcagtggatcctggccaaggttctatgaggaggcatctttatatatgccattaactgagtgtcttccctttccttgtcttaagcgactcccacgtaggttgtagcttagactttgttctgagttatagcagagcagagagggctgaaagaatcaagtcaatatgtttctccaacttgcccttgtgaccctcattgttaattaagcttgtgtagcagcgtgtgtacttatagaatgtgttcactggtccacgtgatcccagacagtttttttttttaaagatttatttatttaatgtatctgagtgcactgtagctgtcttcagacacaacagaagagtgcgttagatcccattacagatggttgtaagccaccatgtggttgcttggatttgaactcaggacctcttggaagagcagtcagtgctcttaaccgctgagccatctctccagcctgattgacagtattctttttttcttttttttctttttttttaaagatttatttatttaaagtacactgtagctgtcctcagacactccagaagagggagtcagatcttgttacggatggttgtgagccaccatgtggttgctgggatttgaactcctgaccttcggaagagcagtcgggtgctcttacccactgagccatctcaccagcccgacagtattcttgttgttttgttttctttcttttttttttccgagacagggtttctctgtgtcgccttggctctcttggaactcactctgtagataggctggcagtagaattcagaaatatgcctgcctctgcctctgcctccccaagtgctgggattaaaggcgtgcactaccactgcccagcatgttggtttttttcctttgttttgtttgtttcctgccttgcatattctcagaagaatgtactcattgatctgcgcaatctctaattgacagt

SEQ ID NO: 33494 - DNA, 2656 bp, Mus musculus
ttctgtttttctgaagtgacaccataactctgacaaccctgaaaacatttatttgggggcttgcttacaggttcagagcttcagtccattatcattatgacgggaagcatggtgctagaagtacctgagagttctacatcctgattcgcaggcagccatcagagagagcctgggccccgcatgggattttgaaacctcaatgccacacctcctaatccttttaaacagtgcccctgcctaagcatttaaatatatgaacctgtggaaatcatttgtgttcaaaccaccacacaaaatgcttttatttttcagcttgtttgttttgttttgttttgttttcttgtagtataaccatactaggaaatggataaggagacccagcaatcccccaccaaactccacctttggagtactgcaatgatttagattcagggcacagcctgggagtacacaccgctcagaagtcctgatgaagttggggctcacctgcctttcactgccaccattgtcttggttcctggtttctgttacaagttgtcaacgttctgcagtttgtttctggggaatagtctccattagctgagagccttttctttcccagaatgagacttatgagggaaattgcacttccttgggtcctttgtttcaatagtctgatagctaagggacgaggtgcaagtatctgtctctctttcgaatttcttggctgctggactgtagctcacttgcttgtctgggatgcgggaagccctgcattgatctccagcatgccatcaaacttcagtgtggtgacataatttcagtatgacatcatcctagcttttagggacagagacaagaggattagaagttcaaagtgactttgaggatagcctggactgtataggacaccctgtctctaatcccacctacccaaaacttaatggctatagcttaatggtggaacacttgcttgcaagtgaaagctctggctccattccttagtaccatgaagaaagaaagaaagaaagaaagaaagaaagaaagaaagaaagaaagaaagaaagaaagaaagaaagaaagaaaaaaaagaatacttttattcctgccaggatggttatagaagaaatatgagcgagtgcccaatgccaatagcgagggactcattagtttaattcgccctcttgagctttcttcctaaatcaaaaccagacaaattattaagtaacacttggcttttctccttcagtcttactgaaatgctcaggatagctggtgtaagccatagtgtatccgtgatggcatgcatctgtgtctgtctgctgcatagaggccgaaacagaacatagcctgatcaccattgtgccctaaacacctgagccaagaacagagcaaaaccttgccttatgtcatcttgctcaccttttagataaaagtttgcacctaaagctttctcagaaggctctgcgctgttacgctgtgttgccgtgtaggcacttgtaaggacatttgttcaccatacttgttatcatcttgtaccagcattttcctattgagaatttccctccttttgtatgttgaaacaaagcatccctaagggagtgaaggcagctgagttcagttcctgccggctgctgatgctggtggcccttgagtttcagtgaagtatggccgtgccgtgcctcaggcagttagcagcaaggagtgacgcgttgattatggcagctcaggtgaaccaggttttcctaagaggcaggtggttgcagggccccaagcgctgcagtccatgcgcttccggcactcgtccagatgcaccatagtagaacttatgaaaagttgttgttggctgtgtgtggtggaccacacctctaatcctagcactcaggtgacagaggctggagcgtcttcgagttctgagacagccaagactatgtcaaggggaccatgtgtttgaaacaaacaaacaaaaagtcaagttgtgagtcgtgggagacccgaaactgactcggaggtcccaaggaaccttctgaatatttaccctgtataatggcgacacaggattttagggtttgaaacaaacaaacaaaaaaaatgcgtatatccttgtataccatctacgggtgacgtagaactccaggatgtcctaaacagtgtagaatttgtcctgtgttgagttagacctctggtcagaagtactgtcttctccagagcaatatgtaaaccgttatttactgagtacctgcttcgcccagcgaagcacagcatgttataggatattgtaatgttaccataactttatggggctcagaaacggagggtgtgtccagcagggacaagggcctcactcatttgtcagccccacgattttttctttttataatttttcattatatgttgatataaacaaaatattctcaataccaccaagctttagacaaagactaccagttgtgtgtaggctgcacgctctcttctgttccacccatgcagtcatcctgtaaatgtagaaccatgccggccctttaaagctaatttctttgttcttgtgaaggcaggtgtggcctgcacagctctaggtcgcctctccctccctcttcctgctttgtgtaaggatgccacagatcccacacagtaggctttgacggtgacattgtcagtaagcatataggtgaagttc

SEQ ID NO: 33495 - DNA, 1155 bp, Mus musculus
agtcccttgcaaaataggaagagacagtgcttcgagttatgaccatcttagatgaccattcaaggctttggatgtaaatgtttacagtagctagttggcaactcaagttttcctctgggaaagacagaaggatcaatcagtcccagcactgtcctgagaaacctcaacgctgaaggcaggaccttggagcatccctcgaagccctcttttaattacagcccagggccgctggccctgctcagcaagcctgtcgctacactgataatcggtttgctcactgtgtcatctgccagtgcattctaccagccattgatatttctagaaaaaagtactgacttctctcctgaggagccagaaaagcctgaaagagagagctagagaaagacaggaatgacccccagcatctgaggacgtccagaagcatgggacagtatttcatgtgcccatcagatgccactatggaaatcggtcatttcatgaagcagtgggaaatccgtcaaatgctgtctctcctgttgagcccttcctgggagttttcatatgcttatctctttggtttggttttgtgtgggaggactggggactaaaccaaaggctttgtgtaacactgtcaaacactctgcactaagctacacacgataccctgtgtgtctggtgtctgtaatgtgcttttccaagtaacatttgtgagacatgcgaccatctgaggcttaacaactcattgtacttgtggaggatgcaattgtaatgctctttcttcttctaaacccggtctttgcttttcagggctatgaaggttctctcataaagctcacatctaaacaggtaaggatttagaacttctaaaaacagtccccatttgctaatcaatcccaataaatgttcttttgtttcaattaggattttctacctatgtgttatcagaattaaaggtgaagttgattgggaattagtataggaaaattatatatctctgaaatagccaaatgcacatatatatatatatgtatacatggatgttttcccgacttgtgtgtactctctcttcaataattgtccacagaagccagaagagggcatacatccccaggaattggagttacatgttggtgttgggaatcaacacctctcagtgatcccagtcgctgagccatc

SEQ ID NO: 33496 - DNA, 1178 bp, Mus musculus
agaaaaacccagaaacgattacgttgtgaccctgttgtcttgcttctggatatacaaatcttctcaagaaaatggaagcaagatcaagaattgaagatgtttatgtggaggtcagaagtctgttcttttatcatgcgggtctcaaggtttacactcaggtggtggaacttggtagcaagcacccttatctactgaagccatattacaagtcctctattttattaaggtttaatacaagttgattagttttcatttgtcacacactatggactaagtgttgagatgacagttatagtattctaaagcggtgtgcatatgtatatatggttgaccttgggcacggcagcagaaaactgaaataatgtggattataagtcattccgcagcactaggcttacaggtgctgttaccctgccgggcttttatgggaatgcttagggaccaaactcagggttacagatcagatatattgccaattgagccatcgcccagtcctctggaggtacagtccccttcctgtagtttaggctacattacatttgccgtatggcagtagatgcttgaactcctggatcctggtcctctgtctccacctccctcgtgctgggattataggttgagctacccagtgagttaccagattgagcgtggtagagtatcatgctcacaagagagcacttcttcacaccgctgtggacagaaagcagagacagaggacagcatactgaggttctgatttgcttgaaaggcattgtctctcgtgaccaacttcctctgagcttgttgatggcatgttggaattcctattgcgatgccctgctgtcttcaacagatagttgtcctcttaggcccctcagttgccatggccattttgtacacaatgggaaagaggaaaggaacattttgctttaaaaagcatagcctaaaagttagataatcacttgtgtgtgtccacagcataggccaggacaaagcaatgtagtttcggtcgtcattagcgtgggagtttggaatattatgtgcctagctgaaattcctttgtacatgaaattagaagaataaatattgccgggaatgggcagttgagactgaagtgtataatgtttttgaattgtggttactcatgaagggggaaaactgactattatgtagccattggtactataagccaccaaaat

SEQ ID NO: 33497 - DNA, 1184 bp, Mus musculus
tgggctgatcagcactggacaggcaagtctgcagtaatccatcttcctgcaagtctcacaaagacaatgggggaagtgtttgatacttttgtgaatcttctacagtgtttggttggagtgtatttctcattaacatttcctcaaagcacaggtttgaaatgtatgtatgtgaatgatatcgtgtgtattggttttcttaaacttgaaaacacatctttttaggtatttacagtagtcttcagacatgggatgggctagctaggtgttagccacacactgggatgggccagtggctgtaacaacaaccaaccgtcattgcattaaggatggaggttgagggaagttgtcccaagagtgaggtgtgtaggattagctgctatacttcattgcacacaaacctgggctttgtttaggcacgagaagctgtccccggcacttcctcttaaagagccacacagggtttcagagaaactcaacattatttttctgagcaaatttaaataatctgaggatggattttttagaaaacctatttggacacagtctctttgctccctttttcttcctttcttctttccttccttgtggggtgtgtgtgtctgtgtgtctgtgtagacccagctgtcctggaactcagctacacagaccaggggctgggcttgaactcagcgtcttgcctgcctctgcctcctgagtactgggattaaaggcgatgtcactactgcccagggtcgtcccccccccaattatttaaattagaacacaaaaagccacaggggaaaacatttaacaaatattccttcttgaacaaacttggagggggggggtcgtagttccccaggaaagctcttctctggcaaggccctaggctcagtcttcctggggtgcacacccctagagtttcatcttcagtggtgattaaggttgtgttttcagtaggtatttgtttagatctgccgtttgcgctccagaagtgagcaaagcacggggttctatccattgagcagatgccttctagttacaggacgttacggagtcctgttcctctcagccatccaagcaggaggaccgggatccggctccaggggatccggctccagggcgtcgagcagtaaagtgtatcctacagaatccatgctggggtcgcccctgccttgaagcgtcccagcttctccagctggttc

SEQ ID NO: 33498 - DNA, 1196 bp, Mus musculus
ggtagggcacgttgtaagcgaggacgcagcaaaaccgtcaaaccagaccactccggggtagaaagaaaagtttattgcaaataaacctgcaaactggcaagactggagggaggggcaacggaagaggaatatggtggaaaagctagcagattttatatggcggtcacagggccagcatctttgagctgttcagattgacccagaactagatgcctttgcccagggtacttgacctttggggtggatgaagggcagagtttcctggtgaacaaaaactcacctttagggtcgtttgcctggtaacagtttttcagtttattgggcctaaagcagcgtgaccatcactgccattttggagtgctccattggacctaacagaagtgtgtctgttgacatttgatcctcgtcctgcatccacccagctgattgtgagtcttaaaaagaagacagattttcagaggaggaagaattgaagtggttacaacttggggctatgcagtgagcctctaatttctgcagagaagtcagcgtttgttcttgttttgttttggcgcgcttgaccactgggctctccgtccataatgttttaaccattaactgtcctcccaactgtttgttcctgaaaatcctggcttgtagtcaaaaactggattagctgggaagaagagccccaacaggacaggactggctgtggccatttcttgattaatggttgacctgggagggcctggaccactggggaccttccagcaggtagtcctggctggtattagaaattgaggctgaaaaagcaggggttgggggtggggtggggtagggatgggggatgggaggcaagtcaataatcagcctgcctccagggttctacctgaatttcagccccccaccgaccagccttcctttctgactaaagctatgctctaaccctttgctcctcaggttgttttaggtctggtgttctattacagccggagaaatctggctaacaaaggttgcctgtgccttttgtaataccatgggtcactgttggacagagctgagtcatctgttgactttgatgtgaaaaaaagagcactttctgcatagactggggaaggctgggaggagcactctctgcatagacaggggaaggctgggaggagcactttctgcatagactggggaaggctgggaggagcactctctgcatagacagg

SEQ ID NO: 33499 - DNA, 1169 bp, Mus musculus
gagagtaagagcactgaaggtcttgagttcaaatcccagaaaccacatggtggcttaacaactacctataatgagatctgacgacctcttctggtgtgtctgaagacagctacagcgtacttacagataataaataaatacatctttaagatttatttttttactatatgtaaggagtcagatcttgttaaggatggttgttaactgccatgtggttgctgggatttgaactcaggaccttcagaagagcagtcagtactcttaaccgctgagccatctctccagcctgactcacaaagtcttaacaacttttcagtctttgtaatcacagtgccttcaatgtacaatgagaggaatgtaccctgtttgcaagtcaaatgagtcttattttacccacaaaggggtcacatttagcttcagccatcagcttgacactaacacagagccctttgggaggagggaaccttaactagggattgtctctttcgggttggcctgggggtgtatccgtaggtagggtattttcttgatgactaatgagggcagtgccagtcctgggcaggtgtcctggattgcatcagaatgctgactgagcacatttggggaggaaaaccagaaaacagtgctccctatggtctgtgcttccctttgggtcccaggttcctgccctgagttcctgttctggttttcctagatgccagactgtacgctaagtaaatcttttcctttcaaattggttttagttgtggtgggtttgtttgtttgtttatttgtttgtttaagatttatttattttatgtatatgagtataccgtagctgtacagacagttgtaagccaacatgaggttgctgggatttgaactcaggacctctgctcacaccagccctgcttgctctgactcctgctcactccggcccaaagatttatttattgttatatgtaagtacactgtagctgtcttcagacaccagaagagggcgtcagatctcattagagatggttgttacccaccatgtggttgctgggatttgaactcaggaccttcggaagagcattcagtgctcttaactgatgagccatctctccaacccagtcgtggtgttttatcaccacaacagaaagcaaattaggacagaaattagtatcagacagtgggccttgctatga

SEQ ID NO: 33500 - DNA, 1188 bp, Mus musculus
cctaactcctgagccatctcttcagattacccccaccctcttaatccagtcaagatgacaaccgaaaagaaccaggttcctcaccaggtcacaacaaatggagaatacgtgtgttgaaagatgtcccatcccatctaccccgtcaacagaaaatgacaaatgaaagcaatgtacagtaataccacaggcctggcagagcagacaacagtagatgctggccacaataccgattaaggcgttctcgtttattgttagatggaatgaaaaaatggcgtaagtacctcggaagacggtgtatcagtctctttcactattaactgaccccttaccgtataatctagcaattgcagttgtagttgtttggaatgagaatgtcactatgggctcctgtatttgaacatttggcccctagttagcactgttcagagaagttctggggaggtgtggtcttgctggaggaagtacaacactgagggcgtgtccggggcggggccagagttgggggaggagccgggggcggggcaggatttcagagttttcacctcaaccgtttcactctctgcttagtgttggtgcttgaacctgctcctgccctacgcctgctgccttccctccttgtcgttaaggactttccctctgaatccataacccaacagaacctagaagctctttcttccttaatttgcttttggtcatggtgttagtcacagcaccagagatgtaccgattacagtacgctttggtagtcacccaaatgagaggcaaacttctgtttattcagaaacttgcacatggataattcaaagcagctctgctcctaactcaaaaaacctggaagtgaccctggtgtccttcaagttgacaagttgtgaatggggcagtcatgttgagtttttactaacaatagggtattaataagtaattaataagaaataaatcgttgggcctatgactatagcattttggaagtggaggcattaggataatgaggagtgtgaagccaacctatttagtgaaatcttatttcaaagaagttaaacatgcctgtggtggtggcctacaacttaatcccagcactagggaggcagaggcaggtgaatctctgtgagtttaaggccagcctggtctacagaatgagttccaggatagccaggcctacaccattaaatcttgttttgaaaaacaaaa

SEQ ID NO: 33501 - DNA, 1921 bp, Mus musculus
ctgtgtagttctgactgtgtagttcttgctctgaaaaccatgctagcctcgaactcagagatccaactgcctttgcctccgcatgctgagatgctgggattaaaggagtgtgatacccggcctgggataattagtggttttgccctggaataatgcacggttctgaaagattctaagagtgtttgtggagcgtgatttgctatgagatctgtgggcaggttggaggcgagagaacaagtgtgagacaataaatatggcgtggcttcacatacatgtttatttaaatgtctttcaggttctacatcactctttcttccctcatgctcttgacgcagagagtcacatccctctcactggacatttgtgaagggaaggtggaggccccgaggcggggcatcaggagcaagagttctttctctgagcacctgtgggatgctctacctcatttcagctacttgctctttttccctgctctcctgggaggctccctgtgttccttccggaggtttcaggcttgcgttcaaagatcaagctctttgtatccgagtatctcttttcgggctctgacctggaggggtctgcagattctcgggctggagtgcctcaaggtggcgctgaggagcgcggtgagtgctggagctggactggatgactgccagcggctggagtgcatctacctcatgtggtccacagcctggctctttaaactcacctattactcccattggatcctggacgactctctcctccacgcggcgggctttggcgctgaggctggccaggggcctggagaggagggatacgtccccgacgtggacatttggaccctggaaactacccacaggatctccctgttcgccaggcagtggaaccgaagcacagctctgtggctcaggaggctcgtcttccggaagagccggcgctggcccctgctgcagacatttgccttctctgcctggtggcacgggctccacccaggtcaggtgttcggcttcctgtgctggtctgtaatggtgaaagccgattatctgattcacacttttgccaacgtatgtatcagatcctggcccctgcggctgctttatagagccctcacttgggctcatacccaactcatcattgcctacatcatgctggcggtggagggccggagcctttcctctctctgccaactgtgctgttcttacaacagtctcttccctgtgatgtacggtcttttgctttttctgttagcggagagaaaagacaaacgtaactgaaatctttccctgcccttcatctcacctagccattaaatactgcttaggaaatgccagaagatgccttgatgaataatgtatttaaaactattcatagtgaaagtttttaagtattggatggataaacctgatggctggccacagagatgtgtttctcttctgtggtggtttgaatagtaatggctcccatatgtttatatatttaaatgcttagagggtgacactacttgaaaggactaggaggtgtggcttcatcggaggaagtgtgtcactaggctttgaagtttcaaaagcccagtcctagtttagcgtctttccctgtagcttgccgatctggatatagaactcttagctcctccagcaccatgtctgcctgcatgccgccatgcttcctgccatgatgataatggactaaacccctggaattataagtcagccccaattaaatgatttcctttataaaagtttctgtggccgtggtgtctcattacagcaggggaacagtaattaagacttgtgcattaacaagctattctattgttactgaggtacaaattggagaagcacagggacttctctagatgtggaagtgaggttgaaatgagcctggatataaaaacatcaggtgtgagtagagggcgtgattcagtgagtgtctgccc

SEQ ID NO: 33502 - DNA, 1171 bp, Mus musculus
ccttacccaagagctgattttgaaaatgttctcattgatccagcagtattttttgtgaggacacttgtatgtctctccagtgtgcttatataaaaagaagtgttctgcctttagctgaaaaaatgagtaaccatgacaactgtcttttgttgttgttttttttcctacagtttatttctcaaaaaaacaaaacaaaacaaaaaaaaaacctggaacatgcaccaagtttgttcagcttttactaaagatgtctacagccgcggtttttattttgtttctgtttgccctgacccatgttttattactatggtggtgaggtgggaagcgttatgaaatgtccaaatgcggccatgccatttgtgggttagaccagcagtggcttgttgagtaatgatgacagagactcgccggcggtgtgcgcatggtcagaaccctctctgggatcaagaatggagcaggaggttttgtctctggtcctccctgccctctgctccttcacaagcgaagtgctgagcgcttggccatagactcctttctaacagctgcatattctttctgggtactaactaatcttagcagcagcattgcgtgtctgacatgacactggcttgccaatcccatctctggtttctaggctagctacttaagagtattttcatgagtatgcgccaacacattgtcgtcctaccgtggagagagagaaaacttttgatgacaaaacaataaagattttaaatatccattttagcttgtgggtgttttcataataaaagttaagccgctgaagtgcactaagaaggggacactgagctatgtggtgacaaacgccctcgcctcagaacatgagaagccgaggcaagaggatcaagagtctaagcctacttggggctgcatgagaccctgtctaaagaatcaaatctaggaagatgctagaaagcaagcacactagcaagtcaagtctgcaggaggaaagagaaaccatggcaacagtacagctctgaggctctgatcctgagtggtgatgcacaggcctgaaccaggccgcatttacagtgagttccaagagtctcggaaatgtcagctgaccagtgcctcatcttgcgaagttcaggttactgttgctagcctgtgctgtagaccccaggatttgtggagacaactattggtgaga

SEQ ID NO: 33503 - DNA, 1532 bp, Mus musculus
tggcttagactttgcatattcgtggttcttatttgcatagtggcatatggcttgcttgttagctagctcacatgggagcacctccttgccttcctgagagcaattgtggacttgctgactgagggtctgccttgttgggtctcacactgtcgtgttccacgtcgtgctgcgtggtagccttccctcatagcttgctttcttctgtgctgacaagaagcacatacaacttctgaaacattatgaacaattttcatatattttgaaaagctaatgcagactttgtttttctcatcctaggatatggtggcaccagaagacggtaaaataggaaattgaaggcaaacactggatgcaaagtttctgatttgtcatcaccatctctttaacacctggctaatgggaataaccaaaagttgtgtggtgtttggtccttgtgtagcttttcgtgtcccgttgtttgtggccaagagttgatatgtgacaaaatgctatggtttgtatgataatgtaacatgcagttcaaagcgatggccactgtggaatgctgacattgtgcttgtgtctcaagcctttcataccagagggggcattaggaatggagcaccctcctgctgagactgagcacagaccgcttgagctaggtggctttggaccatgagtcattccctcgtagaaacaacgatcctctattggatattaaaacacttggtgtttgctgttcttcaaacatttaagcccagtgccgactactaattatgctgatttgtgggttgcaatcgcttgatcagtagagcttggacccttctgtggtggtcagcgcctggggattctgacctttcacaggaagggtagaaagcaaacgacatgcacagaaggcttggaaccgctagacgtcagttttcaggtggtagcattcagacgcaaaagcatggagttctctgtggagtcttaaactgtcagatgttgttgtgacattttgttttagccttacattaatatgacaataaattaaaaagacaggaagtattcttgttctttgtactgctgaagcgtgtttcgtgtgtggtttcctcatctcacacaggcacccacttctggggctcaagggatgcatggcgcactggttaagagcttgtactgctccatgggtgacctgggtttggttcctggcacccatatcaggcagctcacactggcctagacgctggttctaggggacatggttgtcgctggtctccaagggagcttgcactcatatgcacatacacacacacacacacacacacacacacacacacttaattgaaaaatgacaaaacaggctaagagtagcagtgcatacctttaagaggcagaaggaaacctctgagttggaagccagccaaggttatacagtgagagaccccgtctctaacaaaacagaaacttaggggactagagaatcggtaagagtttgcttctcagtaactgggttgggcagcttctgactccggctctaggagatccgacctgtgagggtaccaactacccaa

SEQ ID NO: 33504 - DNA, 1136 bp, Mus musculus
tataccctcccccatctctactcccctactcacccactcccacttcttgaccctggcgttcccctgtactggggcatataaagttgcaagtccaatgggcctctcttcccaatgatggccgactaggccatcttctgctacatacgcagctagagacacaagctcctggggtactggttagttcatattgttgttccacctatagggttgcagacccctttagctccttgggtacattctctagctcctccattggaggccctgtgttccatccaatagctgactgtgagcatccacttctgtgtttgccaggcactggcacagccttacaagcgacagctatatcagggtcctttcagcaaaatcttgctggtgtatgcaatagtgtctgcatttggtggctgattatgggatggatccccaggtggggcagtctctggatggtccatcctttcgtctcagctccaaactttgtctctgtaactccttccgggttctaagaagggtcgaagtctccacactttgatcttcgttcttcttgagtttcatgtgttttgcaaatcgccagtaggatttgctgaaggaggcagaggcagggggatcatgagttcgaggccaacctgggctacacattttttcttctccattctaaggtatgacaaacacatggctttctaccacaggcagagagagatagctttgatgccatcttagctaagggcagtcacatggctggctgtagcttcaataccatcttgattgaaagcagtctcaccatctttgttatgggaagtccccactttacacaaaatctttaggagaacagcctggcttaaagtctccaaagacacttttcaactaagataaaattttcatgtggtttctatcctaccttgataaataataatttaatttaatactactgtaaagatttacaacagcagaaaagttaaagaccactgccttaaagaaatgttcagccttgtttttgctactaagttataatgttataatctttgtttgctagatacaatctagagcaaataattaaaaacagacacagactgtctaattcagatatgcttaatagatactagcactcaatcttgtcagaaatctgctaaatgtaacattaa

SEQ ID NO: 33505 - DNA, 2435 bp, Mus musculus
acgcggcccccagtaacctgccgtacctgcacagccccatcaccacctcccccagctgttaggactcgtctctggaccccaaatccagagtcggcccccagccagttgccagccacctgtgaacagcaaatagggactgaccagtgggggatcaggtgaccaggctccgtctccatttctccttggccaaccacagggccagctaggatggcaataacgactttgaatacacattaaaaacaaacacaactaaacactctaacataagcaataacggcggtttccgctgccagagaagacttggtttctgtgtcagtttttactttgcaggtagaaatttacctcattattattattattaaaaaagcaatcaagcttgaaagttatgaaaccccacagatcctggcaaatgtgcgcaaccaatttttattgagtggagagggaaaggaaagaggagaaaaaatgagtttgccaggaaagtgcctggttctgtgtgtgtctgttctcctgttgttgaactcacaggaattttgttctagatccttctaggccacagtattatacttagtcgtcaactggataatcacttactgtttaatgcatattgagaacctcagcatgtgtgtgcaggagtctagtgactctgggagatatttctgttgaggtcacacagtcgagcagagaaacacacaggtgtgtgagcagtgagaggagcgtcgggtaggtggtcaccatggttaccatcagacgcagggtgacatgcaaggaaaaaggtttatggttggtcacttttgcagctggcccctgggcccactgacccagccacgtgagatttttctctccagcggtctgtttggctggggatagagtggtttcttcccacttggcctaggatctggctattggtctgtggtaaacgccatctttaccaaggtgctcctggaaaactgggtgccgttcagattttcctgccgtgaatcatttggtaaggccagatcagaaccagatcactgaagatgaactaaaaatgaatctccctctcgcggatacattgggtgtttcagatttagcagtttacttgaagtatacataccaagaaattcttgttacaaaatctggtgaatactctgaaacgccctccctcttttgaataaaaagatacgcatatgcctgacttgggcctcctaaaagtctggaaaggtgagagaaaagagggtgtggggccggatgccagctcctgttttactgatatagggtgacttaggagccatgctgggttccaactgggccaacaccattttaaaggagcctttccaagtggaggaatggctttggaggaataagtgtgttttctagggggaatgtgaggggtaggggagggaacctgttttatctgtagtattgggggacaagttttgtgatggtgtgtcagattagaggtcactgcagacttggcagaaattagcatggtccccgtgccctcctcccccacaccttgagcagacatgtaaccaagcctccatgtcacgtggtgacatccagaacccccagacaagcctgggttcatggcttttccttccatgaaatgtgaacctgtgttggtagaacttggattgagtggcctgtgccaaattctgcctttaggtgagaagtgaggggtgccctgctcgcttcccctactgtccgaaggcttggctgaaggcatagcgggtccgagcttccccgatggcggactgcctttgcttagttggatggtcccatatttttacccccactgccttcctggcagctgtttcatgtttggtgaagaattagattaaatgagctctgtagctagtcgagtcctgggctctgagaatgttgagggcatctggagagcagatagcttgtagactacattcactttctagatgagtgtttgccaaatgtgtcctagttcccagactggatcccaacgacacaggcattgggagctccaaatgtccctcccctgcttcctaattcaaacctcctatgacagtgtcaaggggctatttataaagtcattttctttgtacttgataacagcatgagatccaaaacgcttagaaagtaggacattggtttgattggaaaaaaaggggggggggcggggggtacaccttaaagctctccagaagtttctgcaatagcgttagttgaagatcctgccattcctcatggttagttagtttcaaaagacagtatcccatccgtgagctgatttctggtgatgggaagttttggaatgtcagaaggctgttgagtatctgcccgagagtgagggacactcagttctccctggggatcttggctccatcatccatatagtgtttgtgagactgagggctgaagcacaggcgagcaggtagctagcagcagctctccgctccattcgcccctgagaccttgtgccc

SEQ ID NO: 33506 - DNA, 3276 bp, Mus musculus
aagctatgtgacacacttaatcatttcaattggaaggctgaaaacagttcttttgactttttttttaatgcaagcatattaaaactgtgactgtctttgtttctctggttcttgaaatacacatttctctctttatttattaaatttttgttagcttgagcccagtgctaggactaggcatccagtctagtgtgaatgaatattatagttatatcttgaatgagttcctcaaaatgaagtcaagaattagcctcagttttcacttttgttgaagtttcaatggcctgagctgggtgcttgtggatttggctgcgtgtttaatagcaactcgactaccatacagagcttcagaatgggatgttggctcgagagctcttccccttccctctcttttcctttctgttaacaaagggttgaagaaatgggcatctgtatagttttagtagctataatatttggcccaactgaaattagtttaacatgctaaacacggctgtgattttaatttagtaacgagctactgtggtatagtaaaacaaactgaaccgtgaacctccatcccacagctggattaacctggcccttaccttgaggagtctaccttggttccctcaaccaccagggctgtggctcatgttctgagctgagtagagacaatgtgtaaggaagcctgctgtagtgctagtggtctcgtggtgacccacctatgacaaaatgcacatgaacgagctgtttaaaaagaacaagtcctggaaaaaaaattaaaaataaatggtccatagagctaatagatattttcagaacttgaaaaccaaaggtatcaggagtgtattcaagttggcaaaaaggtggttgcttaggatttccttgtacagcagcatagactgtagaagagccctctggactagacaagcctggcattcggctgacagctgtttaccttcttgtatgtgcattatgtagaactcctggcaggtgtggaaccaactcctgcttcccaacagagctgcagagagaaggcaggtggctccaagctcttcttcaaggcctttcccagagaccccacagtgccactttactggtttggccagcttggatacttaactcaggcataaactataattactctgggcacgtctgcctgtacctttgcttctccccagattgcaaagctagtcttggaagtgctcctgtgcttgccccattcacctttttccttttcttcatcacgagtcttatataggaatccaggtgtcccttattttcctatcagaatggatcagggtttagtcctcatgtagtttctgctcagaagtctgccagtttgctaacagatggcagcatggaacccagtgtttctatgcaaaaacacaatggcagtacagtctgggttctaaccctgctttccctccctcacagagctctgagcagcctaagtagagtaacagcactaacatcgcctcctgaaggcagcaggctcctctgagctccacacttctgactgcactcatttctcttggctgttggaatagtgaagggcatttggaatgtatagagaaatacttgaatatggcaagcaaataagcatacattaacatcttattatcctagatattattacaaacagatattaacatttgtctagtgcagaaaacagcattagaatgtagtaaatgtcccaattttcttctactgcaatatattcccagttgcatgaagggtgcttaggcattgttccctctccccttttaaacagtcgtcatctgaattcctgtaaatggccttgtaaatcaatgtccgtatttgtaagcatatctggctgtctgtcccttcacccatgcacccagacctcacatgtgtgccagccttcatcctgtgtttctgttgggcagatcatcttgcacagagttacagactatagaatcactcagcaaatattcagaaatgatgtaagaattttcatggatcagaaagttgaaggctggcctctgatgttaaggcagtgacacagaaatgagggtgattgtgacagtaatattcaaacaaccgctgactacatccagtgcatgaaaaagatcacttaaaaaataccgccctaaaaaactgaagctgtttcagccaactcaagcaatctgcagttaatagacaactatggttttcctgtttgaaaaagccttatctatggcagaaactttttaaccttttctaatctagcagtgaaatatgaatccacttcttaatatttgaaatgtgtcagtgagtgggcgtgtctgttcatttcatacctggtaagtgtgttttatggggtatattttataagtaatattgtcacatttagtggagttgatgtagccagtcagttccaatttctctcatgcaaagttcttcagcctcctggtcacctggtttggagtaacactggtgggattgccgaacttgtgtgggggattcatagtatgtaatactgtgtagcatttgagtggtgtggaagttgtttttaaatcattttaaagtatatactatgacagatgaaacttaaaacttgtcggaagctgaagattttatttctgtgagattcagtgtggtcaggttgtgtggccaattttatacttctaccagaattctgcaaaattgaggtgacgctcaccccataaagacactcaccctatagaggtagttgtcacacacacacacacacacacacacacactgttcacttcctagctcctttcccctccacctttctttcagagtttgttctcatttttcagaattcttctgctatccttctcaagtggccctgaatgccctttgttagctcaatttggtgatgagttatccctgaacctctcccagtgtgcaggaagaaaaactagaaaacgccacagtaaaaggaaggaaggaactgaggtttttaaagcttgtagcatagaccgagaaggtgaccatgcggtatagtaaatgtattcactacacagaacactgagactcgtcatgtgtgtgtaatgcctgcttctgctccctcccagtgttttaaactcatcttatctttgtggtagtaatatttgtccttaataacctacaaaactaaaaaggtactttgattgacaaggtccctcaagaacttacacagccagctttgaggaaatctagactgttctgacaacagcatctggagttgtaattgttgtaattttcttcctgtactgtctcagtctgtgtaaataaccagtgtagtggccctttgatttgttgttggtgttctttttgtttccg

SEQ ID NO: 33507 - DNA, 1167 bp, Mus musculus
ctcatctactttggtacctaggatttgcctatcaagtcctgctatattatttctaaaattaactttgttctaaacccattttagatttatacatatgcagaactctataattgctatcataataaatcagcatgtttaacttttacactttgacatttcctgtatgtagttcttagtagcactctgctatgtacactagatattttgcttgactagaaaatgactaaagagtcttcctgagttttctctgttgctggactctctcatggagacatggtagagtgtgttgcagaacagcctcacctataggtgcagtaggacacatgcaccattagactggagaccagtgaccagaaagtcagcgagtgcaggcgtcagagagttagggctcagcacattgactctgatgtgaagcagcccaaagccaactcggcaaatacttggattattgttttgtgaaaaggaaatgtaaacaggagcaaggattccagcacccagccactccactaacaagtgcagtagaatactttctttaaagagaaagaattttaaaatggacttcatgttcgagacaatcttttttcctttttagttttggtattttatctgatttaatcttagtgttttatctgctaagaattattaatatgatcaaacagtttgccttctacagaagagttcttaaacctgtctataaaagtcaacccttccgaacaaagcactgtagaaaaataaagtatttcttttaaaatctaaagccttttatggcatcacttgatccttcccacttggactgtgaactcagtgtctctgatcatagtgtaatgtaatgtaatcttaaacctgaaagagactttgaggaaaaccaggtctcactcttggaaggcctcaggctggtaagatggctcagtggttaaaggtgcttttgccaagcaagcctgacaacctgcggtcagcccccagggccatggtgcctggctccatctgcacgccatggcacgtgtgataataaatacaaacagcaaaaatctgaggtattctccaaagtccacatggggcccaagcctgtggtcctgatagtctgccacactctcttgtactgctataagtcccttctgaaagccacatttaatgtgagcatattgaatctcttttctttaaaagatc

SEQ ID NO: 33508 - DNA, 1181 bp, Mus musculus
cccataaattcttaaaatgcgtttaaaaaacagaacttaacagaatttttttaaaaagcaattcacagccagatggctgtgtttgaaatttcagtgttttaattttctctttttgttcagtggacttgtacctcttcataatgcatgctcatacggacactatgaggtcacagaactgctgctaaaggtaagagaaatccaagtgttgaatagtaacattcaacttaaactgcttcctttctttttcccttttcccttttccctttcccctttccccttttcctttttccgttctcttttcgagacagggtttctctgtatagccctggctgtcccagaactcactctgtaaaccaggctggcctcgaactcagaaatccacctgcctctgcctcccaagtgctgggattaagagcgtgcgccaccaccgccgggctttaaactgctttctaaaagctgaatttaaaacaattccaaaagttatggctgaaattttcagtgaactccattttcagagtttgctttccctcctggacagacacacttactcatgtcagccattttctctaatccagcatggagcttgtgtcaacgctatggatctgtggcagttcacaccgctgcatgaagctgcttcaaagaaccgggtagaagtctgttctctgttacttagtcacggtgccgatccaaccttggtcaattgccatggcaaaagtgctgtcgacatggctccaactcctgagctccgggaaagactgacatgtaagcatttgtattctgagcccagtgtggctagctgttagggaaaacatttcgggctgcttcattacccaggctgtttcctaactagaccatggccttcattcttaatgtgtgctaatttatcatactcatgtctaatcatgcttgcttcatgtgttccacaagagcctttaccacatacgtgtgccatacatacatacatttgtacaaatgtcacatacatcatacatactacttacatatatacatgcatacacacacatactttttaagtgcaattctaattcatttgtcaagactactggtgttttgttttgttttctggttttgtttctgtgtggtttggtttcttttcctatgttgtcgttcgtttcgtgacagctaagggcaaggcccatcaacaaccatttactgagtat

SEQ ID NO: 33509 - DNA, 1163 bp, Mus musculus
cttgcacactaatggattcaaatgtactataagtatgccaaggtgctcttgacataggcaagcattattcttctcctttcagacctaaacaatttcatgtagcatcagcttcaagttgaggcatttgggggaaaaattatcaaagactaaaacaagaaaacaagataacaacattgctgacacagaggcaagcagagtgtgtttagttcactctaacatccctctcccttcctcggccagtttgtgtatgacagctgcctttgacctactcatgggcgtgtccctgttttgtaattgcagccaacttagaacagacctcttcctctttagactctttcctcagatcctcagccagtgcccaagtgctcaagctgctgtctctcacaccctctacttggatatgggactgcttactcacaggcaccgcgcgcgcgcactctcactgcagtagtcagcctggtttgttcaacttctgatacagcctcagtgctatttgctggtgggacactaagaggtgtttctcaggatgcacattcttcctttagtgttgaatattttgttgattttgtttgtggggtttggtagataggtacaaaacaccagtttttcttcaattcagcatgctagcactggagtgagtattagattggtgcaggtacaaggatggagagacctgtcggtgctgtcctcttaaggcgtgttttcatgtactaacaaaagcaagtctgctctattcatcagcctcctcccttagtaccagattatagcaaaagacatgtgagttctggacagtttattttacatggcgtgtggacttctacttacctcaaaagaaagctacattcttggaatatattcacaagaactgtagtgcctggtgtgtgcccaacacaataggtgtggctttaagataccccgccccctaccccccagaatgcttttctttctttctttttctgctagtttcttaaaagagagaaacagataaacttggttttgtaactcaattgtaatgattgtagcacacgcactatccctctcttcccttctggttgggacggtaggttgtgtgcccgtcccaaaggaactgagttctgttagttccatcatctgccctcggatagacctgtctccagacctgatggcttctcactttagtctcc

SEQ ID NO: 33510 - DNA, 1184 bp, Mus musculus
atgaactcaagcatacttaaatcctgaaatattcttgtgacgcatagctggacaaaataggaaacctgtcctttttcttttttcttttttttcttttcttttttttttttttttttgtctgaggctggtagctttgaggctggtgtataaagttaatttaaaaatgcactcacctagttgatagactgctaccctgatttactatgtctctgattgtaaatagctaatacaattgacaaatcataagggtagagccaaatcacatgactactacctaggaaagcattggggcaaaagctagggcacaggttctcatttatatcctcgactctccagtttccacaatcaccatgttttaatgatgtgcagagaggaatagtctacaaaattctccctgttcttcaccaccttaccaatacatgatacttggaagggtaatagctatagtacataatcaacaataataatgcctattattaatgactagttccaccattattaaaatataaaatttaacttctatactttggttcctctgcccttccccctgccccccacccggccaccccccccacctctgcccttttttgataaagaagtcatgtgaacagccttcaatctgtttctttcattgctactttttagctatcataaaaggagaaaatagagataatttttgtaaaattcaactttaaatgcttgtaaaaataaatgaactgtttgcaacagtaatggggtttgcttgaatttttatgccattcttttatggtgtataacaacccaagtgtactttagaagtcagtttattttctctttaaagcttgttcatttcttcctgtcctcagaatataatccccagaaaatgaaaataagtatttattgaacacatgccacgtgaatacagaagctgtttggggtcaggtctgctttgttccattcctggcttggagtgacttttctgtcagccaggtgctttgttctccggtggtagaattctgaccatatagctgtgcggatattaaagaatcatttgtagcaatcgattttttaattctgtgttagtagtagcctggctatgatgttcctactaaagaacagttaaagattttgcttaaaggacccagatagagctgtctcttgtgagactatgttggggcctagcaaacacagaagtggatgctcac

SEQ ID NO: 33511 - DNA, 1196 bp, Mus musculus
ctctcaagactcttccaagtgtctagtctctcccagatgtgtgaccttttgttaaccttcaaggctcatgacctctctggcccccccccctggaaagaatgttccaattcggagtcagctgccttcaagatatccatacttcgtaatactactcagctatacaaagaaacaacctcccagtacatgggacaagccacagcaatctaaaatggattgtactccgcgggataaggagttgaactcatgaggttacattgtatatttccatttctaaatagtagtctccaaatgacaaagttataaagcaggaccacaaactagtgattgccaggggatgccataaagagaagagagcattgaggggagagtaaggggacccctttgtgaatcaagacttactctgtatcttgctgtgtccagtttagatgaatctacagatggggtaaagagcatagtattgcatacatatacatgaatatatataaaaatgtgaaactccctaagcttctagtatatttaacaatattggtccaatgtcagtttctgatggatgttggatgctacacaagtgtctcatgagaggactcaggagaaggatatcttttactacctgcactcttttgcaaccctctgtgaagctgtaattatttcaatatagagatttaaagattatttaaagattattgagcttatccaagaaagggattaatcataggagcttgtgttcttagagaagtaaataagattgatgttctaaagaaaacgcaagtcaaggaaactggccctaaccagccaccatcaatcctgatcctgccatcccaggccagccgtaccaggcttttccttcccccgttcccaggttctccccagtcttgtttctatttacagctgggtaaacacccccatggagttggtttggtcaagcgtttcctagaaaggtctcgtcttggtttatttctgtccctttgctttggcttaaagtgtcctatcatgtttctgctccacgtgtggcaggtgccttgactcagccacagaatctaatgggatacgacacagatggcacactaggacagtgacagccaagagtcggaaggaagagattcaccactgagattggtccttactcatagaaagcattacaacccaagtagcagctctggatagatctagaaggacacgagggcaaggtggggggg

SEQ ID NO: 33512 - DNA, 1756 bp, Mus musculus
tttatttatggtgtgtattataaaaagataggggagaaaaacctcacgtttttctatgttattttaaatgtttgtcaactctgaggtatcagatgaagttttcttaaccatattggagtgcaatgcgctttcatacgctagcgtgagactcctggagttcttacccttgggtgaacccccaaaccctgtgatttttctctagggcaaattagaattataggggagatttttttaaatgcgagtttgtagaattaggggtgttgttttgttttggaagtttgataaaagatgcctgtttcatttccttactgaagtgatgtttccctgagacaagacagaaaggagcagagtctcatggtttcggaggtgggggccactggacgtagccctgtgccctctggctttataagttagcatcaggcagacatcaaatgtttttaatcctagcatgtgtggtttattttttatcttaactttttcacttttgaagattcaaatgttttgactttttaaatgttattttctatgatttcttattcctaaaactggtactagtctgtaatctgtgctttgtatattgtgcctctcccagatgggtggcgatctgggattgcatgctgattatctgtgaggaaatcatctttgtgccatgaggctgaagctggggccaggagtttgtgttttatctaagcaggccatgtatctcctagatgggtgtactttaaatgttccggatttgttgaccagagcagctaggttgaaattggatagaaagcaaaactgctctctatgggtcatgcattgtgtgttaagaaggaaggcagccaagggcactgtttcttacatagatgcagactaaagatcataaaatggctgggggcgggggcgaggtacggaatggaatctgttcagtggtatggatgatcttcagacattccgagtcaaaatataaaatatggtaattccatgttatatgtccctcctaaagcagacataccctcacccccttttgcccagatttgccccagctttcttgctcacgagcactgcttgaaagccccccagccagcacacctggggtgcacacccactgctcagctccaggggcatgttgtgcctttgcctgctcaccaggacccttcccttgaagcagtccgtgggctgtgcttgacttccttatcaaggctgtcactcagagacagaagagtcttccttctgctttctgcctccaatacagccctccttcttttgacccagtctgtcccatgactctgagatagcctcgggagctgcatttagaaactctatgcattgttcagagttcaccactgtagacaaatttacgcagctcagaagacgacaggccccttgcttgaagatcccacggcaagtttgacctggaggtctgtcttcatgcagttcttggctaggatgatggatggatcctaatccccagacattgtgatccaggaagggaaggcaaccccattctttgttccatatttatttccccaaattccctggggtgctttggcaaaatgggtacaataaataagctagaccataagacatgtttcttgtaagaagccgtttgagtgttgtaagaatattttctctagaaagctaggaaggcataatggaagtctgtagttctgcagaaactaaagcaacttgagtcaatggtgggagttattttatccctgagatgtaagcttggtggctcctgattctgggaaatctgcactcagccgcatct

SEQ ID NO: 33513 - DNA, 2572 bp, Mus musculus
tagctcatgagctaaaaaaaaaccaagatctgagatggtggaggcaacttcagctgtcccctgcgtcactctctggccagcagctgtccccccctgcgtcactcactctggtccactcagcaaagtgcttgctgagcagcaaattcaggtgtttcttcttggaacattttcggcatatctgtgtatagcctatattcaagccaggaagttgtttctaaaggtgtctactttgacagccctgaacacacatgacccccagaacacacgtgatagactaagagaatcaactcagctcaaggatgataaagtactgggaccagtttcatattataactggaaaccttgtaataggtcatagaatttagttaaaaatctagttactggaggctagcaagatggctcagtggttaaaagtacttgcttctcttgtagaagatccaagttcaattcccagaacccacatggtggctcacaaccatctgtaagtttcaaagaatccaacaggcaaaacattcataaacataaaataactaaatttagaatactgggctggagagatgcctcagaagttaagagtgctggctgctctttgagaggccctgaagttcaattcccagcacccacatagtggctcccaaccccctacaatgagactgctgtcctcttctggcatgcaggcagaatgttgtatatataatatatacatcctttttaaaagtctaattactggtgagactaatggaaagttagaaaaggcagcctggtagcacagatgtgtaatttcagtcctcaagagttaaggcataggtgaatctgaagccactctgagccatataatgagctcctgattccaaaatgtgtcagtagaaaatacaagtgaacttgtgagagctataacttacaaatcaatgggaaaatctgaagatttgctccttgccttccctcaccattgtgaatgtatattcgccctgcttttgagctcatggtaaacatttgtattcagtactgtgaggtgaaatgttttgttccatagtaaaaagtacctggcttgtcttggtgagtgaccagtatatattggaaagtaattcctgcttctaaagtcaagatgtgctctggagatgatgatgtcatactgtctggaggctaacagtgggagcttttggaattaaacccctctaatgctttcctggacccatctcattggcattgcctgttgttttgttttttcaactttccttaatgattgtgatcatattatgtccatcaccactataatcaagtagattgatcatgtttcctaactcggacataggaggaacgacagcgatgcgcttgggaccatgagaatttgctacccaggcttgcggtttcattccccagtgagctctgtcttgaagcaaagggacaggaaatggtcattgtgagggacagaagccagcaggctctctggactgacttactcttcattttctcacataagccatggtgacacaggcaggttcatgccctagaaaaataattgcttgtcacctgattgcatagttgctactgaatagggaaactaccattgggaagttagagaatagcaggacatactaatgccttcctctttgttttgtttttaaatcaggctgtttaaattttttcctaatcaagtgcttaacattttttttttaaagaacttaacactgcaagcttttaaaatgcttttggctctactaagtatttcgccatcttcactcactctgagtctctgtcaaaccatttgatttggctttctgctgatataacctgtctgtaagttatagagtgagtcataattcttgaaaggaaactactgcagcctgcctgcctacgttgtgtgtaaagatactggttcttgttactgctgggatggcttacactggtgctagtgtttgctgatacttacttaaagctttattttctcagtcgccatggtcatctccttgttttccttttacttgcttggacattgagactgatttttccccctgtattattttcaaatccacacaaactggtatatattctcagctacattttgtctgattttgtattaaatactgacattgactctggaaatttttctttctctccacttctccctctgactgggtcaagcaaaagcaggaagaagaggttttcttttttttcagcatgtgtttctgcgtgtatgtgtgcctgggagagtttatgtgcaccatgtacccttagattcctgtggacgcctcagaactggagttgcaggtggccatgagcacctaatgtgggtgctgggatcctgagtcaatgcctctgcaagagccgtcgcactcaactctggggccatctctccagcctcaaggccctttcttgtagcctttagagacctgcttgtcctgctgtagggataggttttctcagctgggttaacaggaaagaccatgggagtcatgctaaactggtcctattgctgacgagtcatttattaaatggtgatttgattacttgaaaggtgaaagaacttttagttcatcgtcccagatattaaagcactattgcgaaggataag

SEQ ID NO: 33514 - DNA, 1152 bp, Mus musculus
gcccatggagacagagtcccctcccaccttttcatcacacctccctgcttgctagtcactggacatggtggtagaatgatagctgttctgtctccacccatgaccactgaggctgaggggtgcgttcctagaggccagacgaggtgacgaatctctgaaaacccgaatcttggaacaacttgagataatctgagttcagttctaaatcttgcagctgttctcctgctatgcacccccccgccccccccccctgtctccctgaccccgggaacagcgtgcatgattttgcagagccctctgtgaacctctccatctgattggtagccttcctgaaaggagcatcctctttcagggctccatccctcattggctgtttattcatgcagagccacttggaggaagtctgcagccaaggtcctagtagaaccattgttttgaaacctctaggaggttaaacacttaaaaacaaactctacaaattgctctccagtgtcctcctggttagggccaaacagcacgtgttgcagtagagacacattctctgaagactgtaaaggactgtgtttacatccgcctcctccgtgtgttgacaggaaacatgtcaaactgactgttccccacaagaaaagtgtgtcagctcttcttactctgtcacctgtattctaaaatattgactcctagaatgtcacagcacaggcagttgccacgaatctttaagaggaaggaatacaagcaggcgactgcacttcttgaggcgttacaaataagattcgtgttgaatctgttcagttgacttccctgccccccggagcccgttatgtggaggcaatttctcagaaatcagaatctagtagggattgtctctctctctctctctatgttttgaatacttgaacatgacaagtccagtttaaaatgtctttttccttttaggacacagttgcaggatgggtaagaatctggttgatctcttctgtcataggtctcatgtgtatgtgtgcaagtgtaaaccagagggttagcattccccttcctttgtagaccactgaattattgggcaatagtttattttgttgttattggctttttgtttttgtttttgtttttttttaaattggcaccaaacagttctgaaactgtcaagtcagcaaa

SEQ ID NO: 33515 - DNA, 1213 bp, Mus musculus
cacctgaaggaacacgggatcatccaccgggacctgtgtctggagaacctgctgctggcgcactgtaaccctcagagctcccccgggccctctgccactcctaccgtgcccaccaccacatccaggtgcccttctgccgcgcccgcagccaccactgcctgccagggagggcctggtgagaagcagctgcccaggctcatcatcagcaacttcctgaaggccaagcaaaagccaggaggcaccaccaacctgcaacagaagaagagccaggcccggctggctcccgagatcgtgtctgcctcccagtaccgcaagtttgatgagttccagacgggcatcctcatctatgagctgctccaccagcccaacccattcgaggtgcgagcccagctccgggagcgcgactaccggcgggaggacttacccccgctgcccacactgtccctctactctcccggcctgcagcaactcgcccatctactgcttgaggctgatcccatcaagcgcatccgcataggtgaagctaagcgggtgctgcagtgcttgctgtgggggccacggcgggagctggtggagcagccgtgcacgtcagaggaggtactgtgtaacactctgcacaactggatcgacatgaagcgagcactgatgatgatgaagtttgctgagaaggcggtggaccgaaggcggggtgtggaactggaggactggctttgctgccagtacttggcctcggcagagccaggggccctcttgcagtccctgaagctcctacaacttctctgagccattccatcgccaccgccttccacgcctgccccatgcccttgccttgcctgcatccggattaccctgggaaatggtacaaatgactgttgtccttggatgtaatattttatatatatacatatataatatgaaagactggggatgtcatttcacacacgccagcctcctctcagagtccacattcctccaccaccgccacccctgtgattatgtacaggtctagcttcacacaaggttctgagggcagttccatcccgacagaaccaagttcggactcctgcctcactagcccattttggagtctcctcgcccttttgtcaaactgttatttaaaaaaacaacttccaataaagaaaaaagtcttatattaatttgtttttattgcgtcgcaagcaacgccctttaacctccaagtgcttgagtgcac

SEQ ID NO: 33516 - DNA, 1562 bp, Mus musculus
tcttttctttaaacctcctgaatctcgtggatctgcaaatgaataccttcaactaggtcccagaccactaagaacttgcacagaaaacacgcactgaatgtgtgttaaacctcgacattgtgatgaagttgcactatgtaccatattctgaatgaactaagaactccgtggatgtgtgacgtgtgtgtgtgtgtgtgtgtgtgtgtgtgtgtgtatatgtgtgtgtggtgtgtgtatgtgtgtgtgtgtgtgtgtgtgtgtgtgtgtgtgtgtggtgtggtgtgtgtggagtgtatgtgtgtgtgtgtgtgttgtgtgtgtgtgtgtgtgtgtgtgtatgtgtgggggggtgtggggggtgtgtgtatatgtgtgtgtgtgtgtgcttttttctctggctttaaattttaaaagacaaaaaaaaaaaaaagccatagggagcggacttgctgaaggccctctgctgcccatgtttacagcggtagtcataggagttttcgcaggttgactttgcctcagatttattcccccatgcttctctttgcacaagtatgtaaactacggtctagagtatcattttttctgttggaaatcctgctcttgctgaactgtcttggccgttgactttgacacagttaattatttatgtaaatacatgcatcccagtagccggcaggcagggatgctgaatctcgagccagtctccaggaacaactgcaaacctgacacatggtactgtgcatccattcataaaacacttaaaactgtgaaaatatggtttacattaaaaatgtacataaaggtagacggagaactcgattcagccagttagcttgtacattttagggggcttttcacattaactgcccgtctatgtcatttagagtttgacacgataacttgtatttaaggaattatgtagtgtataaatcggtcgaggatctgggggaggtggagaagcttactgtaggactcagcttgtaaggttcgttttgttttgactctggtcttggtgcaaatgttagttatgccttattcataccagttagagcaccgtgctgtgacatgggtatatccgtgctgcccggcccttttataattatttgttgcagatttgtgactgtctctattaactttcttttatgtaagtaatttgtacaagtttcttaagatttttgcttttgcttatttaattttgaataaaagctaaattcataatactccccccccctttaaatcgtaaagcaatgtcagaaaaatgtcaatacagggaccgagctatagatagtgtagaacatgtgtttatttgtctgtttgtgacatgagacttaaattgtagatttttgggaggcagtggggtgggggtggggcgtgaagtctgagacaggctctctctacatagctctggctgtcctggagctcactatgtagaccatactggccttgaactcacagatatcctactgcctctgcctcctgagtgctgggattaaaggtgtcctataccatgacactcagcaagttgtggttttaaaacattttataaacaacgaatgtggtat

SEQ ID NO: 33517 - DNA, 3187 bp, Mus musculus
ctgagcatgatcctcatatgccttcgttgtttctaatttaaataactcaccagcttttctttctgtgtgacaggggccacatgccggagtggtactcaaaatcttttggacatttgtgtgcagccgaagtggtaaagatccgagactccttcagtaatcagaacactgaaagcaaggacacgagatctaggtgatgaccgacgcgaatgaagcacccgtgactgcaacccgggcggttgttgctagagccttgccagtccttggaagaagagttcatctgggtctgattgactgtagagatttgacacgttcataaagctgcttcctgtctgtcttaggtctatatcatagaccttgactggaatatataacacttgggggcaggggtgggtggggggtacctgtattgttcagattgcttctgagaagcaagaactttttcggcgcgtaatggaagataacgaagaggtgtcgttcttttgtgacgtcagcgtatgtgtacctattcctttgtttgcggtgtactgagggaccgatgtatccactggaatagttggtactctcggacaggttttctcactgagatgagcagagaagggtttgcacaggggagtgtgaatgtgtgtgttgctggctgagtggcacggatgaagggatgcgatgcagtgtctggcacactgagatgttccgcaaaggatgctgatctaccaggtttagctcaacctggaatagctgactacccagggagccacccagatggggaatccagcttccttcttcacccgccccctccagggttattaagcattttttttttcttttctgcaaacctttgctttcccataaactgtagcttccccgtgactaggaatttagccataagactagttcaaggctaaccaccaagcttccctttgactggctccaaaggcttttatttaagtgagatggaaaagctgaatgctgacacaccccacccataagcaaagtatcaacgctttctgatttccagtactgggtgttgaacccagagccttttatatgctgggcaagtgctctacagttttcactctttattctgagacagggtctccccatgttgcccaggctggtcttgaacaactgcctcactctatagcccaagttatctaggtctgatagttgggataaagggctcagctcagtttacctgttacaattcatagtatattgttgtttgtgacatgaactccaagatacacaaaggagcccagggaactatgtccccagtaggtttaacccaaccaaacaccagaggctgttaattgtgggtggtgctgtcagtgttcctgacggctatgtgtgtattttaatggggtttgtcctcatccacaaataattatttttttgttattttcctgtgtttcttctctctctctctctctctctctctctctctctctctctctctctccctctctctctctctctcattatgcccttgaactgtattttagtggtaatgtgggatagtaatctcagtgaaaagcaaacagcgcagggtcttggaagggtggtctttatacaggttttactgtaatggtaaggatcgactcgagacagtattagtaaatatattttgtatggatcaaaacagtgagcaccgtatgaatgagagctgaagaaggacttttattttgttataacattgttaccttgtcagtattatttcaaaggttctttgaagaatagggggggtggggaggggtcagagtagagttttaaagtctgagtatttcaaattatcagtgttgctttgtgaagatatgtgtgtgtgtatattcaactttgatggcttccggatctgtaagattgtatgctgtatataccgttctattgagaaacatgtacacatgtctgtctactgtgctttcagacatagataaagcatgataaagattattatttaagatatacttgtatttatacctcagatattctttcgggttttgtacctcaaggttcccctccccacattgtaaatacactttaagtgaatacagttttagagaacaaaagaaaaaaaaagaataaataaaggaagaggtttataatttgccctatatctgtacagagtatattcggtaagtgcactattaaatgtctaagggaagagtctggcctgctctctgacttgcaccttcctcgcccttagaagcagggattgcaaagcttagggcccccgtgccaagcaaagaccaaagatgcatcagcttaaagagaagtcagacgacaatgacgaatcattccaaggccaagctgcaactgagccactcacccaccaacaggaaggcctggtgaaggttcaggaagtctggagagtctccccagaccaaggtcagaaaggatgcccagaggttccaagaacagagcaacagcaacggaacgatgcttagaagcaaaggaaaggtcactgatgagtccgcaagaggtctctttcccacttttgactttcctgttgaagagattacctacgtctggccagaggagagaattcagagcacggaactttccaagaactggtgttaacatcttgtactgtggccacgatttgtccccgtgatgattcttgggtctagattgtgagttcttcaagggcaggctcatctcctgcacatctttctacttctctacagcagctgtcagtgttttgtacttgtagacacctaataaattgatcatttgctaaagaacactgattgaatttgcttctcttattttttaagagacaaaaaggtagcttagcatgacccttaagccctcacttcagttcatcgtttccatccttgctttggtttgggttttattgtcaatattttggttgagatgggaatcttcctatattagccgaggctaacctctgactcactatttagctcgggctgcccttgaacttatgacacttctgggtcagtctcttgactcctagaattataagcctgtactactatgcctagatgctgcccacttggaaattgcagtgactagaaattggtaaacataggagatgttaagttttaaactaaaaaagacagcatggcgacttctctgtatgttgattctaaatcaaagagttctttgtcgagcctggtgtgatggcacatgcccttaatacccatgccagggaggcagaggcaggaaggtctgt

SEQ ID NO: 33518 - DNA, 1246 bp, Mus musculus
acattgtccagtaatttggagcagggcgttttacactcatataatgtattgtggcagctactgacccagtaaaaggtctttaatgtggctactacagctacagaacggaagaggtcactttattttcatttaaatagtccctgtattgacagggatcaaattcgtggtggggggaggggttgaaaagaagggggggtaagcaaattcagacaagtgaatgctttatcccctccaccccatcttccttaaacagggctgtgcccaagttcatgaaaaggatcaaggttccagactacaaggaccggagtgtgtttggggtcccactgactgtgaacgtgcagcgctcaggacagcccctgccccagagcatccagcaggccatgcgctacctccgtaaccactgtctggaccaggtgagtacagctgcctgtggatcccactcgtgggagcggagctttgggctgcatggttttttttctagtttcgtggggaagggtcctgcttccacacccatccctgctgttctccttccaaaaggtcgggctcttcaggaagtcaggtgtcaaatcccggatccaggctctacgccagatgaatgaaagcgctgaagataatgtcaactatgaaggccagtctgcttatgatgtggcagacatgttaaagcaatattttcgagatcttcctgagcccctcatgacgaacaaactctccgaaaccttcctgcagatctaccagtgtaagcgttcttggttcttcttaaggcaactgatgtcgggttccatgggaccaactgaagcacacagcctctttgtatgccatccttttgtagagaaaaacctgcatgctgatcttctcgaaagttacagtgtgtgtgtgtgtgtgtgtgtgtgtgtgtgtgtgtgtgtgtgtgtctgtgtgtgtgtctgtgtgtgtgtgtgtgtgtgtgtgtaataggtttactgtatccttactaaatagcttgagaagtacttttatgacccactgtatgttgttggcagagggattgtgtgtagcacacataaagtactgagttttctctccagcatcacataaaccaggtgtcacggtgcagacctgcaaccttagcactttggaaatggaggtgggaggatcagttcaaggtcacccttggctgcatactgaatttgagggctacctgggtctcatgagacattgtcttcaaaagaaagagaaaatcagtgttgctattgagtcaggaagtaca

SEQ ID NO: 33519 - DNA, 1099 bp, Mus musculus
ctccggacactttgtaggcaatgatgactctttttccagcctgccgtctcccaaggaactgtccagcttcagttttagcatgaaaggccaccacgagaagaacaccaagtcgaagacgcggagcctgctcaaacgcatggagagcctgaagctcaagggctcccaccacagcaagcacaaggcgccttccaagctggggttgatcatcagtgctcccattctgcaggagggtatggatgaggcaaagctgaagcagctgaactgtgtggagatctcagccctcaatggcaaccacatcaacgtgcccatggtacggaaaaggagcgtgtctaactccacccagaccagcagcagcagcagccaatcagagaccagcagcgcggtcagcacacccagcccggtcaccaggacccggagcctcagcacctgtaacaagcgggtgggcatgtatctagagggcttcgacccattcagtcagtccaccttgaacaacgtgacggagcagaactataaaaaccgtgagagctacccagaggacacggtgttctacattcccgaagatcacaagcccggcaccttccctaaggccctctcccatggcagtttctgtccctcgggaaacagttctgtgaactggaggaccggaagcttccatggccctggccatctcagcctacggagagaaaacagccatgacagtcctaaggagctgaagagacgcaattcttccagctctctgagcagccgcctgagcatctatgataacgtaccgggttctatcctgtactccagctcgggagaactggccgacctggagaatgaggacatcttccctgagctggatgacattctctaccacgtgaaggggatgcagcggatagtcaaccagtggtccgagaagttttccgacgagggagactcggactcagccctggactctgtctctccttgcccgtcatctccaaaacagatacacctggatgtggaccatgaccgaaggacacccagtgacctggacagcacaggcaactccctcaatgagcccgaagagcccactgatatcccggaaagaagagactcaggggtgggggcttccctg

SEQ ID NO: 33520 - DNA, 1160 bp, Mus musculus
gactaatgcgaaatcaaaacttctgaagttgtttcctgaaagagtgatttaattgagaagctgaaggagaatacccgcaggggctagtcatggtgaaagagataggtgctgtcaaatacctggagtgctcagctctcacacagtgaggactcaagacagtgtttgacaaagctatctgagcagttctctgtccccctcctgtcaagaagaggaagagaaaatgcctgttgttgtaaatgtcggagcccctcgttctcggtcctgccctgggacctttgtacactttgctcaaaaatcagcggagccttcgcatttgatgctacgtttttgttacagattaatttttctataaaaaccattttgaaccaatgaaccagtcaataattttaaggttctgttttaaatgtaagaattccaacttacagtctattaaaattcagccctaaaatgacaaagccttcttaaagccttatttttaaaatcccctattcttgctcagattaagaattgccaaaataccttctgaactaagttgcgttgtgctgagaacacctaagcactaaactctcttgagagacttctgttgctaagaagactgcagcttctggagtcaggggtgcagacccttccatagttcccagacagtgtgacacagcacagcctccttaatgacacgttgccatgtaacgcacctgtaacttatcagcccatgttcattacgtaactttatactgtacgtcacagtgatgagtgtgacagctcagctctttgatttcatagtgagttttctaaaagaccagccgactagcttttgcagactttgaacagaactctggttcgtgtgttgcctctcatgaagtattctgttcctagttgtgggtgtgctgggtggagtgtgaaacacgacacgatcaaaggagacagacagacagtattttgactaatatgaagtagagattactttacactacattgtacatggagtaattcaactgaataaaagtgtcatgggggaaaaatactactaatacgaggtgtctcatataaacaaataaagaacagaattcagaaattcatatcagaaaccaagtagatattagaggtccttaaactttagaatattatttcctttatttggatttattgaatttgtgcctatg

SEQ ID NO: 33521 - DNA, 1125 bp, Mus musculus
ttcaaaatcagaccctaatagcagtttcaattagctgaatataattgtggtatttttgttacatttatgtgagctaatttagaatgaaacaaatagcttgttgtgtttttcttttgctcagtatgtaatattttcctttctttttcagctttttaattaaatgaagccaaatgggatttgcgtaaagtgagtgtttactgtgaagagaagcagttcctgacattatattatttggaattcttgaggttcattctttgttgattgtgatatactagcttattcttgtataatttttttaaactgtggattttcctaaaacatttaatttatagaaatggatgtgtaacattccataatccgcaatggactatcaaagtgtttttaaatattctcaatgtatgccacaggagtgaaataaatgacattgtaactatgaattcatgttttagaattgtgtgtgctcccatgtaaggaaaccacttgttagtaaagaaatccatggattatatgtaaaagaattgctagtactgtacaaggatagagcatatgcatgaaatatgtcgtgtggacaataattcttacttcagtttcacttataaaggatgaacactgttacaaaagtgttttgttattcttcttcacaactagatcataaatacataggacaaagaggtggataagtgttaatgccagttcagatccttaacctaaagaacgaagctagaaggaaccttagacttcaccatacctccaatggagtcaggcaatagaaccatgtgtcattattcaatgtttttgtgaagctctttacaaattctgactcatgaaatccaatctactacggtcactttccttttgtttaatggaccgggcagggacctggatccctatgaattgttagttttcccagaatgactcagatgaagcttcttgataaccaaatacagaaggaatgtaactattgttattgtttgttgttaacgaacgtaactgtgtatagcatacccatgtacatcccagtattcctcacatcttttcaatagacaggcaatgcaagaacttttctgtgagttatagagatagtagaaaccagctgaaaaccaaaatataagttgtacttataat

SEQ ID NO: 33522 - DNA, 1155 bp, Mus musculus
ggtagtaagtgttacttgttccatgacatgtagaaaatctacacagtgagaagcaagcacctgtaatgctgcatactttttctagctccatggtatttgtatcctaaacactgtcaatatttgtagtacaatgtagaagagttcattttgttccaagtatttaaatatccacatatgtagattttaaaactcacaagtcatcagaggaatgaaatcattatttgaaactaaatttatattataaaattatagttatatggaatttatcttaaaattaactcaagaacaatcatataaaattatgacatagagggatcttttagaatcattactgggtgtgcctcagcatgagcctgcagatagaagagaagaatcagtgccttggaaatttagccaagtgatttggtgggataggcttgtaccttacacattttatagaggcattggatggcagaagtgactgagaggatcccaagagtttctggagcctgtgaaaggtagaaactcaactgtgatttctttctcaacccgacagcattcccttccttgaagtcttcatttttacttcagcctcaggcagctatgcttaagcatgaacatggacaacaaactggaagaatcgtttcttaaatggggtggcatagacgaaacacagtcttccagggcaatggttgtaatgggtagagtgtctggccagtccactgtgtctggagaactgcaggagtcagcatttcaagattgccgtttgcctcaccaggagatcctcgctgcagatgaagtgttacaggagagtgaaatgggacaaagggataagatatcccatgatgaactcatggtcctcgaggagacagtgaaaaatgatgaagagcagatggacacccacaagtggctttctcaaggactgcagtagtcacttaatgtccccataagtataaagcaggaaattacttttactggtgtatctgagcaactgatgagagacaaaaacaaaaaacaaaaacaaaacaacaaacaaacaaacaaacaaacaaaaagccagagagccaatagacttatagaaaaagaagaagtggaaacatctctctcctgcacaaatcctcacaataaatgaggatggatcacttgttttgaaaacccctaaatctctcctttgtg

SEQ ID NO: 33523 - DNA, 1175 bp, Mus musculus
atatatatatatatagagagagagagagagaacataacaaaagtaatgtgacacttgaaaattcattgccttatgctgtgtttgcaattggataattctttatatcttttttttttaaatatgcattgatatgagcaagtcagatcccctgaaactggagttacagacaattgtgtgctgccatgtgggtgctgggaattgaagcctggtcctctggaagagcagccagtgctcctaactgatgagccatctctccagccccagcacaatagtatttctttaaaatctttattatgtctaacattgtagagaatttttgagtcattccctcatatgttgaacaccgccttactttagatagtcttataagagattaacattctacctattattttgtgtatcgaaaataatatagtaattcagaagaccagcactgctgttagccttgctcaagaattggacatttttgtcatctgcatttacatagctcctgaagtataaagatgggctaattcttccccactttttctcatgttaaaggagtggttttaaaacatttggacagctgcacatttcttggaaatgctttatacctgacttaataaaaagcagtgagattcttgtgtatggtttttatccaacccattttaatatgtgcttttcagtaaaatgtataaagaaaatgcacctcacagacccgggtgcttaagaaagggaagaggctttcgttgtgtcttgtgaacttgggtattctctttggctctgccacagcttgtttgtgatattcaggctttcaaactctccaagatggtagtgaaagagtctctcgtatgaaagggtttggcttaggttaactggatggatggcttataagaataaggttgaggaggaaaaacaacactcaatttttgactgatgtttttgaggtacattgaatatgtaaaagttgaatttgtctcgtttcagctcattgaaagataattcattaaaaattaatgtatcaaataaattgtttgactatcatttcataaaatttctcagaaatttatagccattttcctccatagcaaaaccaaactttgaacaatttggcaaaagtggacatactaccttttcatgctttctttccccctcagtgctgggcattggatccagggctctgtatatgctgagcc

SEQ ID NO: 33524 - DNA, 1113 bp, Mus musculus
ggctgttctgaacagggcccttcatcctcagcgccctctgcgcagggcctctcagggccttttcctggagtccctgcgcaccccctgctgtcatggctgcatcttcatggctgaacaagatcaactcaatgacagttaatgcggacaattagatttttgtattgtcattgtaaacatgttgatggcctgatgctgaatcatgtgaaggaataaatatgcagagcaaatgtgtttttatgggcccttatgggtttaataagagaattatcataatcagaactttcccagtcatttttattaaagcatgtagcagtgctacccaatagaaataagtgtgcctgagtcctaagtttttccaaagacacctgaagtgcttgcttatgaaatatattgtagttcttaatgtttcctcttaccaaatgtgttagacttattctaatgtctgtcaatactaacttttcacaaatttattttcccaaaatagggcatcacatttgatgagttcaggtcattcttccagtttctgaacaacttagaagactttgcaatagctctcaacatgtataactttgcaagccgctctataggacaaggtaagaggtcgtctttccaaaggtcaaaaggtcagcatcagagcagccccgccttgttcccagaggctctggtaacaagctagtgagagatgtttgactgtacctcggcttgcctgaaagcctgcttttatcgtttctgtgggaaaccgagtctaaggaatttcttgctgggtttatatttggcctttcatgttatgaggaaaaactaataatatttattgtaaaaggtgtaagaagaaacctcatgactactagggaccatgagggaaccaatgtgtcctcgtagaagctgcagctggccattcaccagttccagaaattctcatgatctttcccaatcagaaatacatgagccattagcttacactaaccagtttttgaaattgattatatattttttaaatttacaaaaaaacacgtgtcatataacttcaaacattgttgttcttgggactgcctcagtctttgtttgtgggttggctaagaagccaaatccttccaggttctctcccttaccacc

SEQ ID NO: 33525 - DNA, 2232 bp, Mus musculus
taaaagggaaccattttctgccaaaacccgagattaagtttatgggcccatgttcattcgaataattgggttgtacaacttatctcataatcccattattcatttgatattctgttttagaaaatttaggttaatcttaagatttaataaatttcaaatcatgttattatgcaaaactgtatttgagagcaggtaagaaatcatccttgattttttttttctgatgtgagattagcttccgatgagagagctgcattgactatgaactcattacggaggccatgtagcctatagctggaggtcatttatccccttgtgccaggtttcaattcccattctagactttgtctcccattggaagattcaaatacaaatactgaagctcgagttcaaagcaattggataaaaacttttgtttgacttaatatgatgtcttgacaaggaacttacatcagaaatgtactttcatgtcttctcatttgaaatcagagggaacacatgctaattctcttgaagattgcctggcaacactcttttgctggtttggatgttaaccaatctgttttttttttttaactacttgctcagtgttattgtgaaaagactgagtttctaagcatttctgatagatcaatggattattcctccatgtgcacctgtgtatcatctctgtcttttcatcaaaactacaattgtcaatagatatttttcctcaaatgcctatccagattaaattatgcaaatcatttaaaaatgaggaagtttagtttaccatgaactaaacatcgtgctgtttagaaatgtagtttagggtaaattacgataatgtgtttgttgatgccaaaatgtttggcctcagtaagtatactcacagaagttcttgtgccttgtatgcactatttacaaaaaggaaaaaaaaatctcatttttcaaaaaatctgggaagtaagttttataaattaatcttagaatgttaagctgtgccattggttcctttggtactaattttgaaaatttcaagtagattagctttttttaaaaaaaaaatggctaaataattgatgtaagcaagaattcactacaaactgaaagacctggagagaatagaataatgaaagatccttgcaatcactcattcttgctaaagcgtttttgagttttgtttgtttgtttgtttttttcgagacagggtttctctgtgtagtcctggctgtcctggaactcactctgtagaccatgctggcctcgaacttttgagagtgtttagggagagcagacatccgcacaattcattgtgggatccaggcgggtgcggttctgtggatgagggcaatgattgcttcctcgtctctcacgcttgagcgttggatctgacaatctacttcacaagactcagaagatgaaggatgctctcccctttgtctttaagcatgttttgatcatttgtcattaccggaagtgccagactggagctcatagctcctgctagaagtcttttgggcagcagcatgtggtgtatttgaagatctatgcagcagattttctgatagcacattgctcccttatctgttttccagggcaggagtctattaggcatgtccttttatcaaagtggtagctggtggggctgggggaggatttacggtttaccctggtaggatgctgttatttctgctctctttaggtcgtttatttacttattttaaatacctaagtccatacaccttagagacaaaatggaaaaaagattaagaaataaaattttttcagtatgttgtaatggttacttccgtctccatccagttatttaacctttgaagtttgttggtcattttgttctaactcgtggaatgaatgattgggatgagtgcatatctcatcagaagtacactgccaccttgcctgagtggacgagcatcatcaaataaatatgtctgcattctgtacagcatcttaactatttcccttgaaacgatgtgatagcgtcagtaagatttgtgcagacacacatgcatgacgaatgtcctgacttatgtttaaaatggtcatttccattttcctcgttttaagaactctttccatataggcaaccggatttagaaatccttcatttaggaatactgaacaaaggtttcatttatttacattacgtctactgccatatcgtagaagagaactggcttgttcaatggtagcgcttgcatctgaacacagtgatgctgcctgccagca

SEQ ID NO: 33526 - DNA, 1943 bp, Mus musculus
gaacggcacagggaatgcatatgaagaggaagccagcaagcagtcatgacaggaaatagtcttcttatttttattttatacgagttacacacatgcttgtatataggttttatcatcccttaaataataggcaatacccccccccttttgtagaccttctctgctttcagtaataagtatggcctttcttagctatgatcttaataaattaaagtacattcaggttaaatctggccttaatttaatacacttcttatcaagcttgtgtgacaaagctacattactgaataatttgataaactttgcctacttgagcttggttttgtttttcccttttcctaaattaactagcattgagtgtaatttatttccctcttccatgcctctccttctattctgcagtacttataggtatttaagattgtggaccatcaagtttgcactttagagagtgatttcaatcctctattttatcagaaattgtgatttttcttgctcttagctagaaaaataaccatctaccacctttttacagtatttgcttgtttttgacattcagagtacagcacgtgcattgtgcaaattgttcaacaggaataacagaaaaagacaaggaactactgaagagcctagtaactactgtttctgtgtgtagtgtttagccttccaagcacatctcatgtctgttggtttctaattggcatgcataggctgctatgtgactgaagaatttcaaaccagctttacacccttcaggaagaagccctgtgattggctatctcctctctgccagaaggctggccattaagatgttggagctccagttttatgacagcaccgcctcccttgatcggcttccttttactccatcacttttacccttactgttttattttataaacatatttatgatgttcttgatttgttaactacacaaatcaatttcattaaagtccaaagataacaagtcttaaggtacattttatatcaataaaaatacaaaataaatgtgatttcataaatgctacaaaaataaataatggagagatttggtgcaaaacaacaaaatgcaaaaaatatatataaatacacacatatatagctaataaaattacctgaggagtgtaatgcttgtttatttttttgtgtatatctttgcaatctattttatatatattgacaagagactgtgaaatatttagccatgcagaatatgtgaccagaccagagcatgtgttggaagattttggtgaacattaactctaccctgaagtgatggactacaagttgtaatgtgtgttatctacacttcaatcgatattagcaagtctccaactgttagcaacatagttcgtttcccttgtacattctgtaaacatgatatgaaaatgctgtacctgggcggtcctttttaaactaaacattatttgcaaaacagagggtattatttgtttttaaagcttttgtaaataaaggcttcaaaaatgttttcctatatggttgtgactgatggctttggttttggggctcttatttagaagtgttgaatacttgagccattttctttgggtaacaggacttcactaggtggtgtgtgtgttctcaaaagattggtttagtttttattagtgttcaaagttgcagtaaggccagctgatccataaatcagttctccagcccagagcctgggccataaagcctggcactctgacccctttgtatcaactgtattcctttccttgccctttgttaattacctgactgaaagaaattagaagtctctgggtgtagaagctcacatccgtaatcctgctgttgtgagtgactgtcctgagtcaatttccactgtcttggtgtgttcagctgcactcccttgcaaaaggatttttccatgctggtctttatctgattacatcccgtttaggcaggatggagaaggccaa

SEQ ID NO: 33527 - DNA, 1181 bp, Mus musculus
aaagtattatctttcttttttcctttttaaaagtttacctgctataaaagttatgaaaacatcaaaactacaggaggagaactaaacagcgtgaacagcctccatacttagccatgcacatggttccctctgtctccggggcctgtctgttcccctctgctgggtaactgcaagtgactcaggcttgctctctgcagcctgcttgctgaggtttcctttttgttttcctagcacctacagggtgcgcagccctcccacatcaatcactaagtaagacagtgccttaggcttacctgcggcctactctacaaaggctgtttttctctgtggaggtttccttctctcccatgactccagcttatgtcacataaaactacccatcacacaagtcaagccagaaaattgtggacatttgtcattgtggagaaaaaccacatgactaacatttattaacaattggctttttcttttgtgtctttagtgtgtcacagctcacagatatgaatgaacaggaggaggtattactagaacagtttctgatgttgcctcaactaaaacaaattattactgacaaggaagacttagtaaaaaatatcgaggaattagcaagtatgtctccctttgctttgattcataattcctgagaaaaatgtgatctgtgctgagaaataagcagagatttatcttccaggaaaaaatctccttttggaacatagcttggaaggcaaaaggcaaaccgttttagataaggtgagttcctgatcatttccaaggcatttttactcttcagaaatcaaaataaacagcaattttatgttttcttttagtatgaattacttctacaaatgaaatctacctttgaaaagaagatgcaaaggcaacatgaactcagtgaggtagggctgatgagttctttctgtccctcaggagctgctcagccacaggagctggccccgccctgtgcatctgactttataaagctgactgacagctggaaacagagttcttgttctttcagggtttgtctatttccaaatcctataaggaatgaaaccccagcaaagcaggaaagtagtgtaactgctataataaaacctagtaacaaaaagatactttacattaagtataatttaaaagattagactgctacttaggaaaaataatctttaaaaataaaatag

SEQ ID NO: 33528 - DNA, 1712 bp, Mus musculus
tgcttgcctttagcaagttgacaaactagttcagacatgtttattacttgtagtgaatatctgaatatgccagtgtgaatttgcattctttatttgcaggagacagagtacatggttgtaattttatggccatattttttctttgtaaaaattggctatagatctgaataccaaacacatactcggattttactttagtataaaggaaagcttaggaattactagactacctaggtagaatttgtcaaggatatttaaaggtaagctgtaacaagtcgggaaagtcaaagttgggtgaaaacttcagattaaatgaacagagtatagaacaaaggttgtttgaccacagtttatatatttaaattgcaggacagctaagattctgttgtaggagaaagaagtaaattgaagttgtgctttctgttcttttaaggcagggtttctagcccagactgcgctctaactttgatgtaactgaggatgacctggctgtcgggtcttccacctcttgagtactaggagcctaagcatgtatcaccaaccccagtcctgtggagcttggggactgagctcagggcttcatgcctggaaggaaggcactcttatctattggccgacctgcatcctcttaaggaatgaaaacttgggctggggaggtggctaagtgctaacttgtgtgtcatgcaagcatgagggacccgattcaaattcttaggacctatataaaaacctggtacatggtagaacaggcctgaaattccatcactcctatacaggagaggaatgagagacttgtcccaggaagctttgcaggccaatttatatagtaggcagaatggcagccagtgaggcccttgttacaaacaaggtcggggcacggcctgacacctgttgttcagtgttcctctcacttcagcactgaaggttgctgggaggttttgttttgtttaaattgccaaatgacttgttcaaacatgatcaaaattactaatcaattgagctgtaactattaaaggttgggaagtaatgtcctgaataagttatatattttgaagtattctctgaacactgcactaaataataaaacacctcacaactgaagcttcatttagagtgaacatgtagtactagaggtttctagttgaatcgaccatgacttatccagggactctgaaaggcaggctgcagtgagcatgtgtagcttcagtattgacttgtaaaaaaaataaaaatgactccatgaacatacctaaattatgtcttgtaaagggatggagggaacaaaaagcgtgtggctctgatgctaataaaggtgtcacattaaaaagtaaaaaatttaaatacatacatactgcttgtttttccaaatatgtagtacagatgatgttttatctttgttgttgacctattgtctaaagagcaggtactatacaaatggcgaaacagccaggcgtcatgacacacaccttcaatgccagcacttaggtggcaaaagcaggcaggtccctgagtttgaggtcagccagggctacagagtcagatgttgtcttaaaaaaagaaagaaagaaagaaaataagtgatttatgttataaagctgtaaaagccattcccactatattccatatgtttattagctattctataggaaatgagtaaatattccttaggcttacttgggaaactttccaacagaaaatgctcaatttaacat

SEQ ID NO: 33529 - DNA, 1864 bp, Mus musculus
ctgcctaagttcccctttggagttccaaagtaaaagacacagaaacactttcaaattaaggggaaagtgcaattcgtagtaaaaatgttgagaaatggcaagttctatccagaaccataaaattacagctgtgaaaatggggaaaaaaaagctctttatcaataaccagttgttttatcaaatcatactgaagactgatcatcattcctgaggctcatgctagactatgaaaattatatcactacaaggagagagagtatcttcacccaaggttgtccagacagtctttcctggcatagcatgtgtctgcttaaaagccctcctggtttctcccatacctgataatgttgggactttgatttcacttccagttgcaggttgcattcaggaactttgacatttccttctgcctttaccaatatttaaaagaaataaatatggagagtacccttttctgttataaatgtaatcattttatttttcccctgtggagcatcttctgcttctcaaaaaaatgtctgtctttctttaccatgaatgtagaacctattaagctgaagctggattcattttctccatctcgaatctgagtccagacattagctcttagtagccttttactactctttcagagattacacataacaaaactgtgagccagccaacctgattgcaaactacaacactctaaatgcagtaggtagtgatacatcaacaagggaaaaggtcaagaacgagggaatttgcttatcatgtagttatcgcatgctttctgtgataagacaccacaaccaaggcaactagaataaaggatttattaggacttacagtttcagagggttagaatctacaaccatcatggtggaaggcatggtatcagccaagcaggtatggcattggagcagcagctgacagctcacatttcaagacataaccaagaggcagtgagagctaactagaaaaggcatgggctttttgaaaatttaaaggcagctcccaggaacaaaccccctcccacaaggccacatctcctaatccctcctaaacagttccaccaaccaggaacagagcattcaaatagatgagcctttgggagccattcttcaaacccccaacccatctgctaaacacagggaataaaggttacagcacttttcattttacaaattctatagaaagctaatgttttctgtaacattagcaatatctcatgaccatggactactggatggcaattctgaagtttctgttaaaatgcatttaaaacaggatttgaattgagcttttgatctgaaaactcttaatggagaaatgttgctgtgtttgaacatactgaaatgttcttattatatgattttacagtgtaagtacattctaataaagagatacatttaatcttagttttttataacagtactttaaagtgtgaaaatttttatcagataatgtattcaatttttttggaaatagaaatacagtaatatgaaaggataagagacttaaaacatagtgtgagttatacacacacatcacataatgtcatacaatataataatgctcacatttgaagacagaatgaatttaatatactaaaggcctgtaatataaaaatattattaatacaaaaataaagcaagtgtaattcctttagatgttaaattgagcattttctgttggaaagtttcccaagtaagcctaaggaatatttactcatttcctatagaatagctaataaacatatggaatatagtgggaatggcttttacagctttataacataaatcacttattttctttctttctttctttttttaagacaacatctgactctgtagccctggctgacctcaaactcagggacctg

SEQ ID NO: 33530 - DNA, 1145 bp, Mus musculus
cactttaaagtactgttataaaaaactaagattaaatgtatctctttattagaatgtacttacactgtaaaatcatataataagaacatttcagtatgttcaaacacagcaacatttctccattaagagttttcagatcaaaagctcaattcaaatcctgttttaaatgcattttaacagaaacttcagaattgccatccagtagtccatggtcatgagatattgctaatgttacagaaaacattagctttctatagaatttgtaaaatgaaaagtgctgtaacctttattccctgtgtttagcagatgggttgggggtttgaagaatggctcccaaaggctcatctatttgaatgctctgttcctggttggtggaactgtttaggagggattaggagatgtggccttgtgggagggggtttgttcctgggagctgcctttaaattttcaaaaagcccatgccttttctagttagctctcactgcctcttggttatgtcttgaaatgtgagctgtcagctgctgctccaatgccatacctgcttggctgataccatgccttccaccatgatggttgtagattctaaccctctgaaactgtaagtcctaataaatcctttattctagttgccttggttgtggtgtcttatcacagaaagcatgcgataactacatgataagcaaattccctcgttcttgaccttttcccttgttgatgtatcactacctactgcatttagagtgttgtagtttgcaatcaggttggctggctcacagttttgttatgtgtaatctctgaaagagtagtaaaaggctactaagagctaatgtctggactcagattcgagatggagaaaatgaatccagcttcagcttaataggttctacattcatggtaaagaaagacagacatttttttgagaagcagaagatgctccacaggggaaaaataaaatgattacatttataacagaaaagggtactctccatatttatttcttttaaatattggtaaaggcagaaggaaatgtcaaagttcctgaatgcaacctgcaactggaagtgaaatcaaagtcccaacattatcaggtatgggagaaaccaggagggcttttaagcagacacatgctatgccaggaaagactg

SEQ ID NO: 33531 - DNA, 1122 bp, Mus musculus
ttaatggctgtgggtctagcttagtactataaggcgttggggtaacttctcagccctggggtagataaatatgcatttaaattattagaagaagccaattcctgtatctaagacaacaccaacaacaaaaaagtagtcccagctctatgttcatcctcctttgaaacagttttcttgtctcttaggtcaaagttctaacaatctaggtgcattcatcctagtttcttaagcatctagagcctttcattttgtccttgttataaatagtgcattgccggtaggagaaaagtaggctagcccagctctgtcattgagaagactctttatcgtaagaagagtgcaccgttgttagtcactggggaaacttcacattggcacactttgcaatttgtattcagcagtttcataagacagttttccagatcattacttttcttctgtacagaaagttgttcctaggaatatttataacacaggcctctgcctttggtgtctaaattaccctgtgtttggtgtttcaaccattgtcctctggacaagcaagctgactgatgtcaggagggcagctttgtttcactcggatcatggcggagctgcatcaccctctggtcatgtgtagtcgtaagcagggatagctttctggatgcctctcaggggtcctgaccagtgtttggttacctgtaaacagtctgagtaaattgtaaaccactggtggaggctcagctgatgaagtgatgcatgcagtaagacccgccttccagggctttctacttaaaacagggagggtccttggcatcagagtctgggaggtggggctaatggcgtgcccccatgactcttactttcttcaaacttgctaaagcattgtttgggatattaccagaggagattatggaatggaaagaagaattatttgtgttctgctaccagtgtgtaggaagttctgtctgtgagtacccccaggatatttcattaaaaacagaaatttaggagtgagctcataccctctgtagatccatttcttgaggtcaatatacatcaacttaaactctaacttacaggttgtaagtcaccaagaagaaaggtatgtttctggtccacagagcaatttttgtaacttaa

SEQ ID NO: 33532 - DNA, 1169 bp, Mus musculus
atattaaaaaaaaaaaagacaataagcaccaaataagcactaaaattgtttccctagtctttccactaatagtgccttgtaagtttcaggaaagtgattattctgctttcagcagtgaaaaacattattactaaaaaggaaagtaggttgcttaaaaagttttaaattcatggtatggatcctacttaaacatttccacacattcctaataccttacacagaaagcttacccaggtagcaagctcttcagcttgggttaaaagtaaacctatcttgatttccataaaatccaataccattttcccatgttggtgtggagtgcaggctaaccacaggcgcctcttcctggggatgctcccacagtgtctctgacagttctgtgttgctgtggcctctccccgcaggcctccatctgcaggagcagccagcccctttccggcttcagcgctcggtgcctggaggatgagcagatgctccaagccatcaggaaagccaatcctggaagtgacttcatttatgtcgtggacacaaggcctaaagtaagtgtcaccattttcatacgtgtctctgcagccctgagtcctgaggccggaaggaaccaaagcttgactggtagcaaccctttgccttatctgtagagggttgttcctggtctgatcagaccatggggccaccaaagggctgctctctgctgcatctcagctcctgaaggggctgagtgtgctgagtacatttctgtttccggtttttaccattgtgccggtcacacagtaaatggcttactgtttaggtttgcaagtagtttggctgtggattaaatgtcagcggtgctattcaaaacaggttacaagggaataaaaatatgacagaggaaaaatagcttagttggtcaagtcagtttaaaatgaaagccattaagagtaagagcttcgtggcatagtcagttgtagatgtttatagacatagtcttcacatcatacataatgggccctgactttctagtaagctttcattgcacaacatagatcaaatctctgatccaggggtgaaggactggaagaaggtctgcccttgaaagatgtgacagattaacttctgttgcctgtcagtttctgcctctgtctgaatcaggtgcaaacccctttctccaaccctgactgccctcctcc

SEQ ID NO: 33533 - DNA, 1208 bp, Mus musculus
ctctgtactgtgatctgcctgttaaaaacaacagacagttggaaagtgaaacattttcctttgcagactgcctgaccaccaacagcttagagaacaaggggttattgaacttgaacatcccacgtggaattaaggaacatggtggcacttcccagtggagccatctctaactcttactgattgccaaagtttattttactgacttcccatgaccttatttaaatttagctattaaacgcatccagcatttgactgcccaaatgttcccctacctggagctgtgtaaatttaaatgcagaatagtctttcaaaataataattgtggatatcaaagcttggtactgaaaactaagttacagattttttatagtggagttttaggtggaaccctccagctcttgtaagcagagtgtgggggttgagcgaggcctacttttgaggactgtttcttgtctgtgtggctcagagacctgtctgccctttgtcagttttgcttcttattcgtgcttacggtactcctcgtgttaactttctgtcccagattctgcacagtcagatctccaccattgaaaagcaggcgacaacagctacgggctgccctctgcttattcgctgcaagaacttccagatcgtacaacttgtcattccacaggagagagactgccacgacgtgtacatctctctgatacgccttgcacggccaggtaggcaaagagactcggcatctgacgtgtgacttctggagagaggcacaagtcacgtggcagggttcctgttatgcttaggaatagcagtgttttaggacttggttgtcattcttgcccaactaatcacctgacccattaaccttgttcgttttgcgggctcctctgagctgtttaccacacaggcctcttttgataacctttgtattcttaaatttcctagatagtggttataatgtgtttgtctttccgtctgaaatcactttaaaaaaattatacaactttgttaattgagtcacttagtatgaggcctaagatagaacgcacaggttgtttagtgtggaaaacatttgtatccaaaactttagtgtgttcctccccacccagagtgtcctactttcttaggttgtttgtctgtcggtctgtttgtttgtttgtttgagacaggatcttactatgctgctttgagtggcccaatgtcacaggttcctcagggctggaatt

SEQ ID NO: 33534 - DNA, 1198 bp, Mus musculus
aatcctacagttgagggtggttgatctgcagtttcagtttattgcttctgcaattcaataagccatggactatctataggaagtgtgtgcctagcatagttcgtggtgctgcaggatcaaacacaagataactagtactttccttgagcttaggttctaagcagcactcttaagtatagcctgcattaaggcagcccatggtaagtataaagtaagtgttaattatcagaggtatcatagcaacttaaagggcagagagtggtcgctgcactgggtagatgggcaaggagctgttaatgggtggacctggctatgaggatgtgcagagcttgctaccacgctgtggcgggcaggggtgcagtgtctcctttcagaactcaggagaggcctcctatttacactcatttcatagaagggggacagtgggtctcttagggctctactgtgtgaggaggaagaatgtggtagaccgtgcagtctgtctttcagggcttcggcacctaggagtacagcatgaggatgcgtagacgggatgctatgaagcctagcttttccctgaatggatgatctctctactcctcccttcccaggccctggacttggccagagttggtgggaggagctacggcttgcctctctctgtgcccaggctgctgcttctccctggaccacaagttctatttggcacaatttggccttggaaaaatattttcccatactttccaaagagctttgcaagtaaaaagggtttatttcatcttttattagctaattaatacttttggtagaaatacaccaaattcagaaggcttttagaaatttagaattttttttatatatagaaatccatcattatcacaaaacagtctttagctttctgtattgattcagaaatggtggtctgtagagagaatctcttacaagcagtacctgtcaataaaaaagccatcagccaatgaaccatggcaggaaataggaagtgcaaggtctttttcttctaaaactacttaattttttttctttaaatcactttattctttttaatccatttgtccttaacagattgctccaaacacttagtttttgaattatatcacacccagcatcaggttttaatttaatttctttttaacattttaaacctctttctcttatttatgcttgcagaaaatggtatttttggttgaggttattttaa

SEQ ID NO: 33535 - DNA, 1204 bp, Mus musculus
acattaacatatgtctgtgtgtgtgtgtgtttgtgcagggattggctatcagtgtgtaagtaagttgagtttatgatgagctttggataagatgttgttacatagattttttttaaaaacccaattgatgtggagagagcttaatgttttatactaatagataatttagattttaagctattttaagatatacaattttatatgtatatgttttctatagatagattctttaagacatatttatcatatttctaatatgaagtcactaaactctagtgacaggcgctttggaatctgaatggagtagaacctgaggccttgagactttcgttttgtttctgtcgcactgtttctgacccacagggaatgctagcactacctgctctttgccaaccttgtccttgtacacatgagttcagcacacttggtacaaaacgtcctagtctctgccttagggtcacctaaatattgtgtgtagatttgactagcgagcaaacacccagaatctcagatgcttacacatcctattcattatgacaagcaaaggcaacttggatttcttccttcgctgctttctttcttcttatcctaagaactgtgctgttgggatttgcagtgagattgtcttgtaacagctctttaagggtgcttttgggaattcaagtttagaaactcctgagaaaaacttactagaacctttgaggtggtctcaaatatcttaattttgttttccttagtgattaaaaaaaatgtcaataaaactaaataaccgaaagattataaacatatatatcaacattaatatggaaaatcaacattgaaactattgttgatgttaactttagtattaactgtaattgatttaaaaacaaccccagcttctgaagagtaaacaaatcatctccctaaagaataaaaggttatctagttttaatttttatcaagtatttctaagtcctgcctgtttgcaggtagttgttttaaaatgttttcttccagtgcctttaatcccagcactcgagagacagaagcaggccgatctctgagttcgaagccagcctggtctacagagtgagttccaggacagcctgggctacacagagaaaccctatcttgaaaaaacaaaaacaaaaacatgttttctcataaagcactgtgagtcagcagaattgtcactaaattgctttgtaagcttgaacattta

SEQ ID NO: 33536 - DNA, 1168 bp, Mus musculus
attttctcaggctatgagcaaatgtagttccctaatttttctaaatacaaatctgtataaagagtaagggggcagtaccaatggatgtttctggtttatttttttcccttgaacccaagctagcttcatagcgctaatcctccgtctaccctcctgttgttctaacctccgccttgccttctcctccatgtagagccacggaagcaaagcgccctccttcctacccacagagtgtgcttttccagggccagtttatcttggaggtgctgaacctgtttcccaaataagctaagctctggttctgacactacacaattttagaaaccccgggggggaaaccagtaaaggcattttagcatgtactaatccacatgagcacagagttaagccaacagttctgtgttgagtagatccaagagcgggaatgctgacttgggcccctctgagcattcttccagccactggaatggaacagagtggccaaagagtgagaggtatggcttctgcagctccttcacactgcattcaaaattcagatcttcgcttaccatctccctaggctccaaggctctgtgaaagttagaaggatagctgtggctccccaccacccaacccacaaacttccctgtgcatgccggcattgcgatgtcagtatttactaattcatggtcaatgctgctcagataacccctatagcgaggacagattcaggatactagaggtgagtcatcctagacttctgcactacagagctaactgatagtcatgatgcatgctttttattaggggttgtgtttgaagtctcttatctccaatagtttatgatgtatgtaacctaccatgtttgctcccgataaataggaatgattgcagcttcactgccacctcctggaatagctctgctcctggtcccaagttgttctcaatgatgttagccaaagtcaggtttgtcatttatgccctagttatggtaaagctcaagtgttgacctgccatccctcataccacgtagatgtctgggaagtcaaatcttacagcaattaaaatgcctagagagcatttaagggtttttttgttttgttttttaaaccaaacattttatgtacaatacaaaattgttgacacatcgtttaaaaaaaatgtgggtgtgtgaacaactgtagtttat

SEQ ID NO: 33537 - DNA, 1097 bp, Mus musculus
tttgaaaacctccaagccacaccatccaagaccctaaacacaacctttacagtgatctctgatgtgctgatgcaaactgacagtccagacgttggagttcagggtcagaattctttaggaaatgtcaccaaagagtacacagatgggacaaggcgaggactcattggagaaaaagagatacaagctgtgacactggtttcggatggcatggaggtccccaacggatctgcatcacaggagttctattgtgtatctgaagatgacccaaacagtgagacacattcacacggcccgtatgctcaacaggaaatgggccaaaatttaagaggaacactgcccaactgtcatgtcgatggtgaatgcccagtactggtgccagcttttgagaagagtaaaaccagagtcctgggctctgagtgtaaagtcactgtgactgaagacccacacatcgattcccacgacaatgactcagacatccaaagtagtactgaagagctgaccctgagaagtgtttcagggcagaggggttcaccttatgaaatgggttggggcgagaacggcggagccatttgcacagataaagcaggttgcatgtcaacaccagttgagcaaccccccaatctgagcttcagacttgaacctgctgaagtgaagaagtacaataatgtggagaatggaccaagagatgctaaacgtgcaccaaacttgaaaggggaaccaacaaatatgccaaaacctaatttgggaaaatcagctaccaaaacaaataccactgtaggcagtaaagtcaggaagacagaaattataagttatcctacaccaaacttcaaaaacattaaagccaaagttatatccagatcagtgttgcaacccaaagacacttccataatgaaggacacacccagccctcaggtaacagggggctcttcaccatcaccagggccttctaaacacttgacaatgatgaacaaagcaccaagatctgactttaaagccagcaaaaaagcagaaatcccaattaacaagacacacaagcaacagtttaataaactcattaccagccaggctgcgcaagttacaactcattctaaaaatgc

SEQ ID NO: 33538 - DNA, 1190 bp, Mus musculus
gactgaaataggagaatcatgagttcaagaataacctggattgtatggtgaattcaaggcagtcagaaccaacaagaccttatttcaaaaaagaaactattgaaaatatttaaattgatttgcatattgagatttgtgatttggagcttaatatttattatcagtaataggaaggtaataggctttttaaagatcaagctgaaatattaggatagatgtaataatgaaaaacaaacaaacaaacaaaacagatttcacagaaataaatctctaaggtagagtatttgtgtgtgaaaatgtcttggaattttaatatccacatcaaagttctgtttttgttttttgaacatactaaattatttttctggtttgaattggtcagattaacttttgcttttacttttttaaaggagtggggtggccaacagaagaaggccaatagatcatcagaaaagaataagaaaaagtttggtgtagcaagtgataagagggtaactaacgctatttctccggagtcatcgccaggagttggaaggcgaagaacaaagattccacatacgtttccacacagcagatatatgactcagatgtctgttccagagcaggcagaactagagaaacttaaacagcggataaacttcagtgatttagatcaggttcgtgaattgctttcaaaataagatataaggtgggaaatacttgaaatggattaagtagtgtatcttaagaataaaagattgggaagagtaaaagtttctctatctgtgggaagaattttaaattctgaagatgagaagcaaagttgagaagcaaagttacatttttacatttgccaaagctacttctctctgggttattttctaatagctagcttaaattatgaaagtagatttagctaagtagataagtttagcatatttattggataagtgtgaatgtgattagttatataaagtttagaatataactaacttataataaagttcactaaaatgaaatttagatctaatggcaaatagaaatgataataatctcttcactggtatttttaccagtattttattgtcacatctctgtcttgcagaggtagaggttttcaaacatatagaataataggttcaagtctaatatgacagtgatcatgtaaatgattatgtaaatgtactatatacacatatgccaggcactga

SEQ ID NO: 33539 - DNA, 1166 bp, Mus musculus
tctctgtgtctctgtcttctctcctgccctcacttactttgcttttgttgtgtatgtggaaagttatcttctggaatgggtagaaagttttgctacctgatagtttgtagagaaaatctttgagaacattaactcagtataatttgtaattccctattattttgtctgcagtatgtatagctccatttgccttcctatactttgaaaccttctgctttctaagagttttattctcttccttttaactcctcatagtttttcactgtaaaattactcaatttttagtatgggacataccagttttctaagtctattaaaactgtatctagacttgtgtatttaattgaaactagtatctgctgtactttgccattggcaaatgaaacagggccatggatttcaactgtcaggtattagtattgttggtcttatttttcaggccagagatcctcagcaggagcctatggaagagacagaaaatttgaagaaacaacatgatttattaaaaagaatgttacaacagcaggagcagctgcgagctctgcagggccgacaggctgctcttctagctttgcagcataaagcagagcaagctatagctgtgatggatgactctggtatgtgatagtcacagaataattgctttagaagaaaggctcattattacaaaatgaattgctattactgtattatcagatctcggttgttgactagtgtagcaacctgcaagccaggtttactctgttctgtgcttttctctggttatacagaagaggttgcaggaacaactcctggctatcataccgtacagacagagtatctttgagaggtaaaacagacaggcctgtatatagtactgttttgtaacctcagggtgatagggatcttgtttttttttgtttccactttgcaggaattactgctgttttgttttgtttttgttttaaatctcactcagctaagattgttgtttatttgtcttgcaaagaaggtttaaaaaataataagcaagccaggcctggtatcataacacctgtaatcccagcacactgaagtctgaggcaaggaggctcaaagaattcttagggtacagggagatggctcagttggtaaagtgcttgttccccaagcatgaggaccttagtttggatcctcaacaagcacat

SEQ ID NO: 33540 - DNA, 1143 bp, Mus musculus
actttgtaaaataattatatgcatgtaaattttgagtgtagaatctggagaagaatgggtgaacattgcctctcactgggaaaggtagtgatgcttgttttgcccaccaagaaaataaggtgagccattcattttagacagttatctagcaaaggttagtaaagttttctaatgatccctgtcagaccttatgtaaagacgctctccggtaatcgaagaacataggtataagattgttagtggaaggatggtattaataacaaaataggaaacaaaataaatgtcaacgtacagtaaaatgcaacttaatttatttgttttaaatattttccttcttcttttttttttaaacttaagcctccagctgttccagacaacagaagacaggcagaaagtctttcattaactagagagatttctcagagcagaaatccctcagtttctgaacatttacctgatgagaaagtacagctttttagcaaaatgagagtactacaggaaaagaaacagaaaatggacaaattacttggagaacttcataaccttcgagatcagcatctgaacaactcatcatgtgagtaaatctgatacagcaatattatgtaaagggcatataagtacacatgctggcacatggtagttacttagtatgtatttgataggttaataactagtttgaaaaaataatctttgaaaaagaaaatcttgaatctgaaaagccttttaataagccagtatgtgataagaatcaaatagatgttaaatttattcataaaagaaaaaatgaagttggagggataatttagaactagtctctcgttaaattatcaaccctagttctctccccacagtaataggagctcttaagtgctggaacttggaatcagcttgggtaaccccagctggccattattactataacattcccatttttgtctgaatgaaaaaattaaaatggataggaacaccatttttagaatccccattcttgacctggaaagatggttcagcagccaaaagcacttactgctcttgcagagaatccaggtttggttctcagatctgacattaagcagctccgaactgcctatcattccagttccaggggatctgatggtctctgggttttatgggcacctacat

SEQ ID NO: 33541 - DNA, 1102 bp, Mus musculus
aggaagaaataaatggctgtagttttgaagtagttagaggtagaaaattacagtcttaacaattacctgctaggattggccttttgtgttctatacatcagacatagtgactcactctctttaatctcagataaatttatcctgtgtttttttttattgtttttctagcatatacaattgtaattcttatcagtttctgtcttgttttaaccttgtattttaatctagtagctgtaatgcaaaagttctagacagtctggaaggaggaagtaaaaatacttttccttgtgtattttgatgtgtttagttgttgaggtatgttaacatgtggcctatgtatgtatataagctttcaaaatttaaatctgcagattttaagatgctaactaattttattttctttgtgagaatccagactgtaaatatatgctggttcataccatgcttagtctgctgattgcttatttttcttctctcttttatagttgtgccttcaacttctctccaaagaagtggggataagagaagttcaactgtagctctctctgctcctgtgggctttgcatcagctgtcaatggagaggccaatagtcttatctcatctgttccctgtcctgccacctctctagtttctcagaatgagagtgaaaatgaaggtcatctaaatccagctgaaaaactacagtaaaatactttttgcaatcattcttcacatctattaaatagctaaataatgaggataatattttaaacttgaaaatttataagaaactgaagtttaataagatacacattcttaagatatatggtagaaggagatgtaatatctgtgaatcttatcagttggctaaaagaaataggcattgatcaggtagtttctgaaacctgctgttaatcatttttcagggaaagggttacaaatagcaagaactataggtaaaatattttaatattcaaacaagccctacgctctagagccatacccctgaaactatattatacaagactgtgtcagtgtgagcaaaacacttagaaaacacaggggtgatatatgacattcagttcatgctgttggagttttcttttgctttttgtttttgtg

SEQ ID NO: 33542 - DNA, 1197 bp, Mus musculus
acaagtttcttcttcccaatgtattcatctgctgtgtacatgtgtgtggagttggggcagggaggtgctcagtgaagagttcagcattagcttcatatcctagctttgaccatggaagctatctgttagggtcataatcattcttggcccatgaagaaaagaaggaaatactgaaggcaataatttaggaaacttgctggttgttacttactggaagaaagtttttgaagtatcagagttagcgtgttttccctacctgtgtattttagggagggtttgagtttgcagatgctttcacttgtaaacttctaagtttatggaaaagcaaataataaagcaggagtctgttattatttcagcttaaatgatttagttaatgctattcttagattgcagctacattactaaaggctatggtagattttaaatttttatttatttttgttggtttaaataacttggctttaatttctttcagaaatccacaggtagcttctacctggaatgaagtgaatactaacagtaatacacagtgtggttctaacaatagagatgggagaccagttaattctaactgtgaaattaataacagatctgctgccaacatcagagctctaaacatgcctccattaggtatgattccctatattcacagaaaaatttccatattactgttatgaagtagattatcttttatttatactctcaatgttttaaaatcacgtacttgaacgatactcattttcaacagactgtcgatacaatagagaaggagagcagaggttgcatgtagcacatggagaagatgaggaagaagaagtagaagaggaaggagtcagtggggcttcattatctagtcgtaggagcagtctggtcgatgaagcaccagaagatgaagaatttgaacagaagattagtagactcatggctgcaaaagagaaacttaaacagctccaagatcttgttgctatggtgcaggtcagtttgttgaaatagtacagttatgtaaggtgaaagttttgtgtatggttgataattatgttgctataacttcttttcttttcatttgattacattgaaccttgttatattgagggccctgcagataggctaagcatgtcaccgcagagttacattccccagccctatatgtgaatcctagcagctcccattaaagggtcagtcgtttacatgctg

SEQ ID NO: 33543 - DNA, 1154 bp, Mus musculus
ccatacctttcattacattttttattatattggtatactataccttgtttatatattggattttggctttttctacattttctctatgagaagaagagctatgaagaaaagaaagtacataaacatgtagaaacctatacatgtaaaatgtgcataaacatcttttgaggtttatgtgcctattatttttgctcatatatgtgaactgtgttgggaaaagcatgcacgctaaagaaatcgatagaagggctatctttctgaatttccacctttttgaacttaggtcacatgactattacagtttggaatgcatgaaatagcttcagaaacaagtagtaataacaagttaggctgtccagaatattcttatatttgtaagaactcatcttgctaattgttattatctcttagttttccattccttttagacctgtgagtggaaacccttttggggggttgaatgaccctttcacagggcttgcatatcagatatttacattgctattcataactagcaaaatgacagttgggaagtagtaatggaataatggttggggtccccacaacatgagaaagtgtgttaaagggttgtagcattaggcaggctgagatccactgtgacctaagataacaaaataggacattgaaaaactaaaggatgagaaataactttcaggcagctttgttttacattatttctcattctttaggttttctagtcctattttgtgaaaatatttcatatacagcttcttcatttcttgttataacacagttcttgccagtcctgttcatatgaacattgaaaatttcagatgtaatcttcagaaaaagcatggaatataaataaatattttcaagaaaatgcaggagctcattttcatcccctactaattattacattagtttaacaacagaagcaaatgtactgacagcaagataaacattgtttctctacttaatcaggacaggcttttgatgggcccgccctccctccctccctccctctctccctccctccctccctttctgtttttaaatacaagccaactcctaacccttcagaaagaaagtctgatcctgtatctcctactgactaggaagtcactgtctgtaatcccagcgggtctttaactaatagagattctcttgct

SEQ ID NO: 33544 - DNA, 1085 bp, Mus musculus
tcagaaacagtgggagcccagagtatatgaaatgtcttcagagactcatctaactctcttacatagtcagcacatttaaaaaaaagacactaaataaacatttgctttgatctgtataaaatgtaaattagtttgacactgcatttttgatgggtgtgctaatttctgcccatggcagtttaaaacattagaatctgaatcctggacagattcaaaccttgacacactgtgggatttttcttttgctttttgtcctgttttttctttcttatgatcttgacccccccctcccccacccttcattgtgacatttggtgtgttaactttaaaatgtagttttaaataaagtttgaacttatctgtaaagtatgcttttgggaaatgttgttgaattctatgcagcaaattgctgtttttgtaacaacactattcagaaacagcagtggtcaaaaatttgagaaattcttatttcctctaattcttatttattctaaagctctgccttagaccagtctttcaaataatgttagtgttgctgctgttaggtctgatgttcttgtagttcctgctcttgtgtgcgaataaagcagatgaatctcagtggtcttagaacatgttaataactcagactgtatacacagttcagacattgttagtaactagaatttaacaggattatctattagattaatatttttcagaatttaaaatgttgcctcattctaaaaattaaaaaaaaagctttatatgtatttctgtacagacaagtagcattctaattaattaaaaaaaaaaaacaaactctttcaagttaggataaatagaactaaatttatgtaacagaacactaagatttttaatgcctatggacaaaacatgccttttgagatgataatttaaaaccaaagcctaatagttgtttttgtgtgttttgagagagaagcaagttcaagtgttaagaacgtctctgtgagtttttcatcactaagtaaaccaactcttaaaaagtgctttgccttctgagtctgtctacacttaccacttcctataatattgcagagccagttaaccatgaataatctgtc

SEQ ID NO: 33545 - DNA, 1273 bp, Mus musculus
caaattctttcgggggggcacaaatgctaatatgtacaagaaaatcttagacttgaaaatatctttaaaatgaaaataactttttttttcagctgactgtattcacaaccttgatggatgttaccaaaggtcaatttgaaagtcaccttcgagattgcccagacccttgtataggctggtgagcacacgttggccagccttgaggacgtactgagacccgaagatgtgttgtgcagagagcgtgcctggtctccttccataggctaaggctcaaggcctcttgtctttagtcaggactgtcctcatcatgttacattgtttacaggctgttttgttgtttgtttgttctgatgatcatcatcacttcgactcacaggtaaattctttaagggacaccacatagaaattgccagttcatttcactttgccactgcggaaagggtaactgtgacctccatggaacccatcaaagttctctgatggtgtttgagtcagcgccctgtgtgattaatgtaaaagttacattttcttttttaatctacatacttatgtttttctgtacaccagtagttttccttttcctggttctctcttagaaccaacctgccattcacctttgctggtggtgacagcagtgcaatgtcgctatgcttggctggagtacctcagatagacatttgatacttattttaatgggcaatcaatagacctctgactctagaaacagtgttttggaggattataaaataactattatacaaacactatttttttaaaaaagaataagtgttctctttttcctagttattctgcctgccagtaaccccaggaagagtctagcttcaaaaacccacaaactcattatttttaattcttttatgtataatcaatgtaatgttttttccttctaatcatatttttttagattttcatacaatatagtattaatatttttcagaaatcaatgtatttatgaaaactgcaaacagaacttgttcatctttctaaccttcacagttgacagtgaagcattctgtacagtgtggcagactgtatccatttagttttggacagtctgcggtgtcgtgatgcgcaataaacagtcactgtcagatatgtcagcagtcatgcatgctgactgggtgtgtgcctgtgttggtttgagggtggggggttattatcaagagatacaagctgaacataatacctagattaaacaacaagggttatgcaagcaggttactaaacatatgacttaaatggtcacaatctg

SEQ ID NO: 33546 - DNA, 1177 bp, Mus musculus
ctcatcaacaactcaaaatagttttaaacctagaggctggagtgatggctcagtggttaagagaactggttcgtgtagaggtcccagctttggttcccaccacccatatggcagttcacagtcacctgcaactccagttccttgggccttaggccttcttccatggctgctacacacacacatgtgcacatacacacatgcaggcacacacacatacacatgataatacttttaaaatctcgaatgaaattcaactcaaggataaactagttttatacttccaattgaagaatcatagtagaaaattattgaaagggttggttttcataattaagccattgcttacatatgagcagaaagcctgggaggtatagtaattctcaacagcacgttttattccagctgctgtcctgagtgtgggccgaggtccagagcagatcaagtgcacattcagaaccagggctgtaggggagttgcaactcatgagagcaccccagaaatgcttcagatttcgttcatattcatgtgatttacaactaatttttggtcactgcacattcagaaaacttttaactgttgctctgtgtgtgtgtgtgtccccgtctgtccacattcagctaaataactcgattaaaggactgctgatacctgtttccctttagtttctacacctaaaacacagcactcaatcaaataaaactgcttactttgaaaatgtttctatatagttatgaagaagccaagaacacactgaccaagaccaagataatggcgccagtatattttatcctgggaggcaagaagtctggagagggttgtgtgatcacacgggaaagaaaagagtctttggatgtctatgagtaagtatccttgataaaggaaataagaaaaaacaagaacccaggccaatgtgaagcctaagagggaatctctctctttatatctagacttgatcctaagcatggcagatggtatgtggtacaaaccaattatgacaggtggaaaaacaccttgtttattgatgaccgcagaacaccggccaagaagtgtctaaatcacaccacacagaaggtatgcggcatcgtcatacatagaaaaaggctacccattaaggactgtcttattctgctgctttcatttgaccttgagaaatctgcaaacctatttctctctcttg

SEQ ID NO: 33547 - DNA, 1162 bp, Mus musculus
ccccttgagagtatatatagctcaatgatgggacaccatcataaactatgttggaagccccagatttgatcttagcatgagaaagaaaaacttagaccttaaattaactcaagttacaagtaaatcaagaaactcatagatttctctaaataaagataaaatgacatgttcaggctaactgtgtattctgtggagtccattggtatctgtgacccttgacactcaattatgctgaatgtttcttgtagctaggcaatcactaagtcatttccttccctgaccccgagtcctacaggaagactgcatttcacaatacctgttaaatataggtggtaccgatgaacatcaaaggactggccccaaacctcccaaggtgtcctcatcatctttcagattctgctgcaagggcaggtcatagagaggccggaaggctctggagcagattcagagaactgatggcttcaggaattaatactcttagctgcaagtctgggctctacccactgctttcttctttggttgtaaccaccaagacaatcatgagacattgccatctcctccaggacagaactggaaaaccctagttgaaagccctactcctagagactggatgagcaaagcaggcgcccctccctatgacctgctgggccaggcttatgttctcacctctccattaaagttatcaaatgcgttaaagggacagattcacccagaataaacattggtaggaactaaaaggaggtgagtgagttctcacgtgcccagtacctaaaccctcctctactccgaatgtcagtagggaggcagcagggcggtttgtaatgccatggtttaaaatctgtggtgcaggttttgatgccttgaaattactgcattctaaggatgcagcagtcatgtccctatgaaatgttactttcctggttcaaaggataatatttaggaataatacttacttcatatggtggctgtgaggactatggcatatcactctgtaaatgtcctgctgaacctttgtcaataagccgtagttgttaaattggctgggacatttacctcccactgatgtgaggtcaccttatgccgatggtgaaaacaggatatcggagcagcgagatagctcagtgccaagccagatgacccgaggtccatcaccagaaccttc

SEQ ID NO: 33548 - DNA, 1161 bp, Mus musculus
atatatatcaggtatacatgggtaaagaaaatggggtcatgtgggcaggctcctagtccattccttctccagtcccctccccgagatctgccacctgcagttgtttctgctcttacctgatggatgattacatgctcaggaatcgtcaccagtatctcctggcacacgagttgtttacagctgaccttctttgattgtggtggaatcaatcaaagactacaggtatcattgtagtgatacatggggcacttaaaattaatgttatctctctatgtattgatattggtgatgtagtatactatatgtatctgaattaattaggttcaggtgttgcctatctcgtgcgcaaggatggataaagagcttactttaaacacccttcccactgttactgtcttcctaattgctctgtggagatagccctcatgaaatacagctcaccattaaaagtacacaactgggaggactgagataatggctcagtggttaaacacttgccacgaaactgtgaggaccagagttcaggactcagaaatccatgtaaatgctaagtgggtgaggtaaccatcatgtagaagtcctggtctcgggctggagagatggctcagaggttaagagcactgactgctcttccgaaggtcttaagttcaaatcccagcaaccacatggtggctcacaaccattaaagagatcggacgccctcttctggtgtgtctgaagacagctacagtgtacttagatataataattaataaatctttaaaaaaaaaggaattctcagtctctgaaagtggagacagggctggggaagtccttggtgggtaggaacactcactgtaacaatatcaggactagaactcagatgcccagaacccatgtgaaaagataggtgtggccgtgtgcacacagaatcccaccactcaggtagagataggaggattactggggccaaaacacagctttccaggtttgcagaagaccttttctcaaaggagtgtgatagaacaggacattcatacggtgtcctcgtctggtcttcacagtggatgtctgtgtgtgcctgtgtgtgtgtacatgtgtatattacacacacacaaacaataaaacagattcagcatagtcacagaactgtacagtcaacactgctatctagcttagaac

SEQ ID NO: 33549 - DNA, 1136 bp, Mus musculus
cctgcttgagttccagtcctgacttccttggtgatgaacagcagtatggaagtgtaagccgaataaaccctttcctccccaacttgcttcttggtcattatgtttctgcaagaatagaaaccctgactaagacaaacatgtaccccacttgccaactgttgtgacatacagaaaacacataactgacaactgcagaatacattttttaaccatacgtagaaatgcaccaagaaaatactgccatattgtaaatgagactgcacaacaaaacctttcgaaggtctaaaaataaacaacttcatgatcctttatttgtttggggtggctctcagattcagccttcgtgcctgcagcactagactgctttaagctgttttttaagtgagatggtgggttgggggtcccaccaccaccaaaacaagacaaaactgactgacttagtgatgggcagcttcagtgagtcctgcttatagtctgctgctttttgacagcttagcccatggagtgatcctgcaaccaagaactatgtaagcatgtgtctggcctttgaatggaggctacttgaattcccaagaagaaaacactttttcttcttgggctaactttttaggcagtgaagaattctaaaactgatgtattgttttctctactttggcagagactgaaaattagacattgctactagaaagcatgtggggatgaggtctacagtcagaggagcttactgttttgtaattctgcatgtgttaagagtgatcttgactgtgataagcaaacaagttcatgcagagctggtaaactctgagtaactggggctgtatcagtgtcgaggactgtacaggacacatgcaagggtacagttaggggaaggcagtgcagggtaaaccagctatctctgcattcagacttttaaaaggttagctataggaaaagcaacagagcttttgagtaaccctaaaataaaaagaataaactttgatttttattttgtaggaatctggtggactgtatccaactttggggagatttcaggaactattgccattgaaatggataaaggagcctatatccatgcactggacaatggactgtttacactgggagctccacacagagaaggtttgtatgggggacaa

SEQ ID NO: 33550 - DNA, 1133 bp, Mus musculus
ctacatgtctctcaggttatcagcacaggataaagaacagcttctgggttactatctacaaacgtagtaaatgttagtgttgcctattttgaacttctctgtttacagggtttggcagtactctgtgatatcagacatacaagggtacaaaaacatcatcttcctggcaacattagcactcaggaatagcagcaatagggttgtaacttataaaatacatttatatctttgaaatttgccaaggtatttcatgaaaaaaatgttataggttttacagcttttataacaatcagtgccggaacaacacattagaacagttgtacatgatatcatgtttatgtagcaaaatacatcgaaatgtactagtattgaaacatacatgtaaaaatagttgtggaaattgtcttacttttcttatgtctcatttgtttaaagcataaattttctttttaaaaaaattctaaggataaatgaatactgtaattgaagatatattttaaatcattgtcattttttttaaagctattacaaattgtatccttcctgattatatagaactttgtgggtggtataaaataaattttatacttctaaaaaaaactaatcagagggattctactagagctctaagtattttcaatgtgaagaaactcaacatcaccttcctgtgtggatcccaaccacccaactttcttccatttgcttgctgaaaggagcctgatacagctgtctcttgagaggttctgccagaacattacaaatacagatgcagatgcctgcagccaaccattggactgagtgcggggtctccaatggaggaggttagagaaaggactgaaggagctgaaggggtttgcaattccataggaagaacagcaatttcaaccaactagatacccccccccccccgatagtccctaactaagccaccaaccaaggagtactcatggctccagctgcatatgtagcaggagatggccttgtcaggcatcaatgggaggggaggcccttggtcctatgaaagcttgataaatgccccagtgtaagtgaattgagggcagggaggcaggaatgggtggatgagtgggtgatagaaacactctcatagaagcaggaggaggggggatgggata

SEQ ID NO: 33551 - DNA, 1150 bp, Mus musculus
aaggtcatcagtgtgtcaacttctgcatgttttcttaggtcacttaatcctttcttaaacttgttttaggtctcaacattcctaatgctgctatcctttaatataattcctcatgttgtggtgattccctctccctcatcaaaaaaaattgtttctccttcagaactgtagttttgctgttgttatgaatcataatataaatatgtaatacgcaggatatctgtgatatgtgacccttctgaaagagtcctttgaccaccaaagaggttagagatccacaggttgaaaaccactgttttaggcagagcagagttgaccatcaggaaggtgggtgtttagtagtgtgtggttactcagatttttttgtctttggtttttttttaaagacagggtttctctgtgtagctctgactgtcccggaactctctctgtagatcatgctggcccagaattcagagatccacttgtctctgccttttgagttgaattaaaggcatactctaccacagcctggcttgactcataattgcaaccctagttgctatgaacatgactgttccctggataccattactaggctctgtctcaaaagaccccaaggtgaaaacaaaatgaatgtttatttggaaatagaagatttgaaacaaaacaaacatgaagccattagctaagagttgtttctatacctaaaatctatacacaagtaaattgaaatttgattcaaaagcattccttacaaattattgagttaaagggggggcggggggggggaggagaggtgtcaggaaacaccaaactaaaccaatcatggacaactgcatcagggggctccagccaatcacaataaaccaaactagtctttagttgtataagcaggcacccaaagaaagccaaaagaggtaaatgcctgtcagtattcaatcaagtacttttctgttttctttgtcatcttcaacaccagaaagccctcttcagatgatgctaaagctcaggtttctgatcatttgcaactgactgctggctgccagtgccacagtcctttaatgtgcaaataaactgtcaaatttaccttatcttattctattttttttttctgtgagatagggtctcactctgcagttcaggatggcctgaaactcatttcaattcc

SEQ ID NO: 33552 - DNA, 1381 bp, Mus musculus
cattgcacactttgaattcttgttttatttgttttgtgagacagagtcttgctctatggtcctggctatctgggaactgatcatggagatgaacaatctgacctcaaatttacatctaatcctcctacctctgcttttgccttctgagttctagttttacatgcatgtgccaccaggctggcttatatctcgaatttagtgcaacattttgtgatgtatttctagtatgtaatttgatgccaagtttgtttttaaaaccaacatttgtctaataacgcacacattcatgtttcataattttttccttttaaattttatttcatttttctactttcctactattaactttaattttgttttcattgttttcctcttagatttcagcttatttctaattagtgctgattactatgtgtcacgctttttgacttctttcgtttcgttcagtaggaatgacagttcttagattagaaaatctgattttgttgactgttgggtacatatgcacctttcaaaactttttactcttcacccatcatatcaagataatttatgcattataggactgtttttgttgctaacatgtgtgtttgtgtgtgtgtatgtgtgtgtgtgcgtgcttgtgaatgtttctgcacatgtgatagcaggaggagacaaagacttgtaagcaggtcgttgtgtctgaatacatgaagatgcaccagttcctcaaggaagaggaacagctccagctccagctcctggagagggaggagaaggcgaacatgaagaagctgagggaaaatgagatccagctgacccagcaaatccgccgcctcggcaaaatgattgggcggattgagtctacctgtcagaacttgacgttagaatcttttgaggtgagacaaaattcacgaggacactgggggaaaatttttttttttataaaattttttttattacgtattttcctcaattacatttccaatgctatcccaaaagtcctccataccctcaccccactcccctaccttcccactcccactttttggccctggcgttcccctgtactggggcatataaagtttgcctgtccaatgggcctctctttccagtgatggccgactaggccatcttttgatacacatgcagctagagtcaagagctccggggtactggttagttcataatgtagttgcacctacagggttgcagatcccattagctccttggatactttttctagctcctccattgggggccctgtgatccatccattagctgactgtgagcacacagtggcttttagtatttcaagctataggaactacatttttctataatcatctgaaaaattaaattctgcctaaatgtcatttccttaaggtatctatctggg

SEQ ID NO: 33553 - DNA, 1145 bp, Mus musculus
gatactagcatttagcatgtggcatgcatagaaaaacattcaataaaaggttggggctggtgatgagtcagtgcccaggagttccacattaagtcacaattggctttgtgctggagagctggagcgtatgtatcatttggtgtaatcaggtacagaggagaacaagagcttcttgtaataacaacacagcacctgatcatcacccagctgtgactgaagaggacttctgtaatcccagaccagaagtgtagccttgtcctgatgtccaaccatgagaaaatgtccacaacagatttgatggagaacctcagggaagagctgacctgtttcatctgcttggattatttcagcagtccagtgaccaccgagtgtgggcacagcttttgtctgatgtgcctcctcaagagttgggaggagcacaacacacctttatcttgtcctgaatgctggaggactttgggagccccacattttcaagccaacgagcggctggggagactggctaatattggcagacagctgagatcgcaggtgctgcagagcgaggatgagcagagcatctgtgggagaatgccagggcctagttgggtgttctctgacgatgagcagagtgtcattaatgtctcacctccaagtcaagggacgaacaaggcgtgtttctcaagtgaggctgaggagcagcacaaagtaagttgggatgcacagtggcaatctcagaacccagaactgctcctagccactaactctcatccaggtctctgtcggtaacagccatgggcacgtatcttcatgtagcatggttcttgctttcactctctctttgagagcctcagtcattttccaatggctagttttcctgatctttctaccactggataccctgcttatttgccaaggggtttgtttctattgcaggaaaaactccaagatatcataaatattttacggaaaaagaagaaggaagttcaggccatcctgaaccatgagaaggaacgagtgatgttgtgtaaggtcagtgtctgtctagtgtttcatcttgtgtgtgagatacctggtgacatgtcagggggaaaggactttttttttttaattacatatatatatatatatatgagtgcattgttactgcctttagacccaccaga

SEQ ID NO: 33554 - DNA, 1135 bp, Mus musculus
ttgtgtacttaccaacagtggctttgttactttcctttctccaaaccctattaggttggaaaaagtgatgcttgagcagagtcgttaaatatttcttagaatctatgcttgggggcttggggagctggtgagatggctcagtggttaagagcactgactgatcttccaaaggccctgagttcaaatcctagcaaccacatagtggctcaccaccacccgtaatgagatctgacaccctcttctgctgtgtctgaagacagctacaacgtacttagatataataataaataaatcttaaaattaaagaaaccatactgggttttgtttctgggtaggcccactatgcgcattctgctgtaagctctcaattgtgactgtccagccactatactagttcctttaataggctagcctcttcctatatagcaggaacttattacactttctgacttttagtaccacttgggtcttcccatttgagcaggatggtttaattacacttccagccttgagacctttttccttgggaaaaaccccaagtggagttagttattgctcatttttctgagtctaccgtgacattattggtctggagatatgggtcaaccagtaaaagataaagctgtttgctgctaagtctgtggacttgaatttgatcatggagacaaagatgaaggaaaaaactacttccaaaagtcatcctctctgcacatgtatcatggcatgtgtgtgtgtctttgagcacacgtgtacatacacatacagtaaataaataacaatctttaaaaaggagtacattttgttgctgatggggtttttttggttctttttctcttagtctgcttgttttgatttttttttttgagagagagagagagagagagagcatgaagtttggtgggtaaggaggtagggaggacttgggaggtggtggggaaagggaagaatatgatcaatgtatttcatgaaaacaatatagataaaagaatgtattaatgaataaataaaaggtgatgttctattgtgagagtcttctgccatacatcctctgcctcagtttccctgagtgcaaagattagcacatgcctagcctcaacctgactttcaacaccagacatttgtcccctcttgagac

SEQ ID NO: 33555 - DNA, 1493 bp, Mus musculus
ctggtcaggggctgactcagttaggggatgttggaagtttgaagactgggtctctacttcttcctgttcagagtcattgccactattcaggccaaagctgttatcccttacgacagacagatggggaggtagggctgacaaagatggaggttgatatttagctgtcatctgccaagagactaaaggcattagcattactgagagaagaacaatggagggttatcctccagagacagcttgtctcctgcacgcatcagctctgtgtcatctataccataaagtcctccactcactggctctgctgccagagagtcaaagggctggagggaatcttcactggcaattggagagttgtccaggtgatcaggaagatgtgaaggatcatctagatagctcactgtgtgatcagggaccaggatagagacctcttagtctctacagaggagacaggtacacacctttacttctggatgctcttccccagctccagactgcctaccaagcccatgccatttcctgtcagctccttttctgttgccttatcaggatggatgtcactgcttacatcctgggaaggtgcaaaggtctggatactcgaccccaatattggagaagtctgtggggaggtgaaaaatcttgggggtccattgggaatcatctcaaaatcctggtcaggaaaagaatcacacacttcctgtgatttgaagttaaatcccatgggactctgggtaccactggcccagaactcttggcttgaagattagtgatgtgacttggggatgaaggtttgtcccccaaggataccattgagtgggtattgtcccccagggaactgagaaagatggggtgagtccttgaggatgttgccagggttggtggatgggtaccgtgagtagttctgaagacagtcgtaggctacgatagggtgatggaggttatgaggggcaggaggagttgagagcagagttcacaataggtgaagtggtagtgtgagatacagtagataagccattaacagtctcatccctacccagactttgcccttgcccttgctgggggaagttcatgggagactttttagtgtgttagtatagaggccctttcccctagaaaggagaggatttcagtcccgaggcacctggtgcaggaggagagccagtaaagcaaaaatggtcttttgcctccagtttgccaggaagatgctcgaatctctcttggctgcacctgactccagtactcaaggctaacgagaggctgaggtgagcccatctgactctacttagactgtattttaaacaaaaatagcagcaactataaaatataacctggacttttccattttacatgatgattttcagggataactatttgtactgtggttttcaattgccttctttctcagcatctatctacctacctatctatctttctatctatctatctgtagtgtgtgtatgtgtgtgtgtgtgtgtgtgtgtgtgtgtgtgtgtgtg

SEQ ID NO: 33556 - DNA, 1845 bp, Mus musculus
gccaagaagaagaagaagaagaagaagaagaagaaaagaagaagaagaagaagaggaagaggaagaggaagaggaagaggaagaagaagaagaagaagaagaagaagaagaagaagaagaagaagaagaagaagaagaagaagaagaagaagaagaagaagaagagctgatgcttactgagtttttctatctggcactcccgctctggaatgatagatgttgcaacatcaacctctccatctctttgacccctgtggccattgacagctgttgtatttacctcctcttcctcctcttctctgtcactagtttcctccatgatcggagaactgcacctctgtcccaggtcgtcttctgccccttccatcataacctcaggccacctggtttgcttggccagaacagtttttggtccctggagtcggccttcaacaatccatttgtttttcctgtagctagacatactctacagagtcgtgtcaatctcattgatgataatggcggaactgttgagctcaggcacaaggaaggctggaagagcagccttctgttgagatgactgggcctgaaaaggttgggtccgcagactgtcatagaaggatggctctgctctctatgccacgaggaagcagcgcagtatctcagacacattgcctctggtcaatgagctctctgacacctttcccccccaagatctttagggactgacaggaggagggcagaccaggatcgtggagtgcagccttcaggagctataccagcaggtcttgcactttgtccaagctgtcaccttgacataaaagtccctcctgcaggactctcagactaggaacatctttggtaaggtcaaagcctagcactttgccaaaactatgcaggaactccacaaatggtcaaacaatctgagaaagccctgctggacagcgtcaaaccagcaatgggtgtgaagtcaggcagaggctggtggtcagtcagccagacacatatccccagtgggcttcttcatctcctccaagataacccactgcctctgccgccccaccagccgcctctgtgtggcaaggtcttgtctgctctacaggatggcctggctctgggctcttcctttccctctttaccttttccttcagcttctcctgctttgtcttcatctttgctttctcagccttgaatttcttctcctcgtccttcagctttaagtttttcgtgtcttgcttcctcttgcttctggcctgtaaaccataagggaagtcatttcttttcaaactctgcaagcacctctgcttgggctgcccttgggcaggagtcgactctctccccgctgtgccttctgcctcgtctttttgcttttagtcatctttgtgttattctcttcactcagtgtttcttgagtttccagtttctttggaagtctattgtctgttttattcagccactcgggcattttgatcttaggaggccaagcatggtcccgcttcactttgggaacctccttgttcttagccttctcattgtttcgaggtcagcttcatttgctagtaattgcttgaattctgaaagaaatcccctctgctgataactggacccactgcaagctctctggtgtatctctttcttcaaatctccagcaggcatgcagagactgaagctgaagtgctcatggcagacactgtgtaccacattttggctcaggtatttgataacttttggaaattgcttcattttcttcccacaggggccacaataccaagtctccccctgccaccaatggctgtccttttttttttttctttcttggtttgctttctttctttttttcttttatcgaatattttctttatttac

SEQ ID NO: 33557 - DNA, 1180 bp, Mus musculus
tcccaggcaataagatgcagtgtcttcatgtcaaacttggcaagtgagctagtgagctgtctctgatacggttgtatagcaacatagttcctgaatagtaagtagcatacctcgttgtagcaagtgttgtttgccaaatgcttgagcaaattctgagtctcagccagagaaaactattctgactacttgaaggcaccttacagattcctgtttctaacccatgcttctctcccacaactgcccccctcccaataatacagtccagaggttaatttctaagttcccatagggacagaatcatcgtatgtgtcattgtggggttaaggatgtggctcagttagtacagtgcatgcctatcattaaagaatctccgcaccagaacaaaataatctgtcagtatgggtttttctcatgtccatatatccttagtttcgaggctgcctctaaacaggctgtgtagacaagaataaacttaaattcttgattcttctgttcccacctcccaagttggaggatgaaaggtattcatccactcacttcttccctgtcccacttggctctgttacctctacactccaaatcaattgacacagtgagataagactggttccccacacagggatctatccatcgtgaagaaaaagattgcttagctttaccaagaaagcgcttgtcctttctaatcatccttagactgtaaaccaccccagggaagttaacaatcctggaatagtgtctactattagacagagttagtctcagtttagtcagtcttttttttttttttctgatttatttatttatttatttatttatttatttatttatttatttatttatttatttatttatttatttattgtgacagggtttccttgtgtagccctagctgttagtcttagtttagtaagtctttttttttctgtttgtttgtttgtttgtttgattgattgattgattgattgatttattgtgacagggcttctttatgtagccctagctgttctggactcactgtctaaaccacactggccttgctctcaaagatttgcctgcctttgcctcataagtgctgggactacaccacatgcagcaagtttagagaattcttaacagaaaatagttcctcttctccattcctccttttggataccattagcacatatgtcctttcgttgtc

SEQ ID NO: 33558 - DNA, 1185 bp, Mus musculus
ctgactttcagggtttggtccacgtactccaacaatggctgcctatgaatggaaggtctaagaatccggtagttgttcagtcctggaggctgaacattccacctggtcttgagtgtatgctggaattctaaagaagtaggcactaatgccagtaaaggaatggacttgttagcaaggtcagagcagacaaagggcaaaagctgccttcctccaggcccttatgtaggcttccagcagaaggtatggatcagttaatttgagatgtagtcaagttgacaaccaagaacagccatgacagttgcctttgaagtcagtgggtgctcatttatacttgccacatttattttgcttatactttgtttgtttgcttatttgttttgaggcaggtttcctgtggtcttgaatttgaaggaggtctcatatatcccaggctggccttgagtttgcaatgctgctgaggctggtctggaactcctgatccttctgattggatcttccaagtgctgcagttaatgcctagggccagctggttactgcagcaggcctcaggaccccgaagcacacacgtggaaagacaactgaccgcattgtcagaagggattgtcaaaactcctggatttggagaaaacaaagtttcccgaaactgcttaactaactggtattatatcagcaacagtcagtttgagtagatggtttttcttgaaaaaaaaaataaggtttttctcattttgttgaacaaaatctgggtgctagtctcagagaattgaatgtagctggggtgatttatgaaggtcagggttactgaaaatggaaaattcagtattgttctttaaactgtcctcattgcatgaaaaaaaataagcaaaggtggtcaggagacaaacgacaacaaaatcagagttaggtactgtcttctctccaatcacaacaaggtaaatctaacatgatattagcctgcgtattattctgaagtagcgtgaacaaaggcttttctttaacatccttaattccttgtctgaatttcacactgctcagcttaggggggagggggctctctctgcccaagtgaccatgaaactctcactcgagtgagaaaggatttttttttttgtattcttgttaaaatggtaaggtgagtgttagaaagggggacacggcaataatgattttatcagtgctagttag

SEQ ID NO: 33559 - DNA, 1154 bp, Mus musculus
ttttgagtcagggtttctctgtgcatccctgactgtcttcaaccctcgctgtagatcaggctgacctcaaactctaagagatatgcctggctctgcctctctgctgcctccttaatgctaggactaaaggcacacacaatctggcctgaatttcttggttttgttttttattaaaaactaatatttgacctgtccttttgatttgctttaaccttttgctgactgatagaagtcttcccctccaaaacaaaaacaaacaaacaaacaaaaacccaagaaaaagacaaacaaatgacaacaaaaatactgtttttaaggatggctggagagatggctcagcggttaagagcactgactactcttctggaggtcctgaattcaaatcccagcaaccacatggtggctcacaaccatctgtaatgaaatcgaatgccctcttctggtgtgtctgaaaacagctacagtgtacttacatatagtaaataaataaatcttaaaaaaaaaaaaagatggatatgggggcacacttaatccaagtactggggagacaggctggaagatctctgagttctaagccagcttggtctacatagcaagttcaaggacctagggaaaccctctctcacaaaaaaagatataaagatggtatatatatatatgatggggtcagaaatccgtctgccttgggtgcttttcaaaacaccaataaaaacataaaatcttccactttaagatttgtgtagctgaatgtggcagtaagcacattttaatcctagcactcaggatgcagagttgcatagtgagatcctatctaaaaacaaaataagatatctaagtataatattttttaaaagaaatctatgtatattttttagttgttcgaaacagggttgccctcaaactcatagatatctgcctacctctgcttccagggcgctgggataccaagtatgtaccatgtcactttgcaatatttattttgctctttgcaggtatgtggcttagggagggggtagccatgatgcaggtatgtggcttaggggaagggtagccatgatgcaggaatgtggcttagggggagagggtagccatgatgcaggaatgtggcttgggggagggtagccatgatgcagatatatgtacctaagtgtagg

SEQ ID NO: 33560 - DNA, 1201 bp, Mus musculus
cctgaactcatgatcttcctgcatcttttctccacatctcaaattcgggcgttacagttttgtgctggaccacctggcctcaggtttctattgaaaggcattctgctccacggagaagcggggcgttacctgattatgtcctctcctaagacattcagcaattcaggtttcctggccaaggttcaatcagtaaataaaagggcatagtgatgtctttaatcccagcacttgggaggcagaggcaggtggatttctgagttcgaggccagcctggtctactgagtgagttccaggacagccagggctacacagagaaaccctgtctcgaaaaaccaaaaaccaaaaaccaaaacaaaacaaaaacctatcagttgttaagagtactatctactcttccagaggacctgggttcaattcctagcacccacaacatagctgacaagtgtctgactccaactccagggtatttgacaccctcacagacatacatgtaggcaaaacaccagttcacataaaaaaaaggtacagagttcatgaggagatgcatctgcagagacttagtcacctggggagagagaacatggaaaaactgaaggcgagtgaagtccggcttggtgagcacctgcgcagcctccagacgatgatcacggacctcgagaagaactgtggggaatctgccgttgcactgctccaggtaagcctgaggaaagccattcctcaacagcatttgaggactgcagagtgaagagactcattaagggtcccttcctgaatgccgggtccagtgatcttcaagccagtgtgaaagctaagcagccattgtcgccctgctaaaagcactatgaatactgtcgatggtctgtaaatcagtacagacgtaggggaagcattgagcttcctcaatgcccactttgggcatatgtctgaagaaaactaatgtgccaaagaaacttttacagtagtaggaacaggtaaagatatgtgattcatataactcatatataagatgttgcttattcgtgaaaaagacaaagttataattataattaaattttatgtaatatatattaaataatatgtaattatatatggcatataatatattataatttagatgaaatttgggatccttatgttaattgttggcataataagccaagcatagaaagaaaagtagaagatttgaattcctacgtagaac

SEQ ID NO: 33561 - DNA, 1131 bp, Mus musculus
ccctccctagtcttatccgaagacctgagaagtgtgggattccgagagacaccaaagactgggcctggcactacaaggagattggatttcagcgcttctgtgttgggtgcagagagcttcaccacggggaggcattattgggaggtggctgtgggacaggcaacccaatggcaggtgggcatatgtgactgtacagagagaaaggacaacattcccggggcttctggagataaagtcttgctcatggggtccatgatggggaccgattgtaccctctgggtctttccccctttaagaaaggtctgtctgagaaaccaaatgtacaaagttggagtcttcctagactgtgaatgtgggcaagtatccttctacaatgtgacagagcagtccctcatttacagtttctctgaccttaccttccgaggagcgattaaaccaatattttctctttgtattccaaatggagacatgagttcagactctctcactgtctgtcttcctcagactcatccctgaaatgctgctgatagctcttcatcttcctgtgtgtggaacccaagatcaaaagagacacaaaaataagatccagactttgtgaacaccacttatgtaattaatctaatataatccaataaagccattagacttaatgtggctctctgcatgtgttcagtagaaggagctctgtttaagttcagtgatgatgggactcaggggatcaaggcacttacagacaatgcagatagcctgagttcaattcctggacctcacaggagagagaaagaacagacttctgaaagttttcctctgacattcacatgcataatgtggcaagtggctattgttccactaaaacaataaagtacaatagaaaacaaggcaataatgaagggttgtaacattgaatataatacacacacacattcacatatatacatgagatgtatcatatatttgctcaatatatatttgtgtgtgtgtgtgtgtgtgtgtgtgtgtgtgtcatacctatacatcacatacatggtcagtatacataatacgtgtgtgtatatatatgtgatgtatatgatcggaaagttagaatatatgaatacattcttgtttcgaaagacctagaatttgggctgc

SEQ ID NO: 33562 - DNA, 1109 bp, Mus musculus
tgtgtgcttagggctgagccgcaccacaagtagaaactgtttttttagtataatccaattttgggatttacaatgtgatcagaacaggtgctgagaataaatctctggtcctctggaagtagaacacccttaatcacttggaccctctctctagccattgaattcatttattatttctcttctgtccttcttttctttcttaagtctattatttatgtgtgctcactggtatgcctaggctgtgacactctaatgtggaagtcagaaaacaattgtgggagtcagtttctccctccacgatgtcagtcctagaagaaatcaaactgtcaggattactggcaagctcttttatccattaaaccatcttgttggtccctcaaatgaaatttctatttttttaaattatgttatttatgcaggtaaagttttgcgtgcatgtatgtctgtgtaccatttgtgtctttggtgactatggaagccagaagaggggctcagatcccctgaaattgtagttacagatggttgtgaaccaccatgtgggtggcagaagtcagaccttagtcctctggaagagcaaccaatatgctcttttaactgctgagacatccctccagccctacaaacccacccaaactaaagttacttcttctcctccttttcctccttctcttcttcttttggtttttcaagatggaatttctctgtataggcctggcattcctggaactcattctgtagaccaaggctagcctcaaactcagagatccacctgtctctgcctcccaaatcccggggataacagcctcaccaccgcctggatgaaatttaatttctaaacctaggagctagagaaggcagattgagcagagtactctgcaggtctgagggccatcagccgtagcatttacagcagtgctcatctggaactctagcactggaattgaggacacaggcaaatcctgagaactggttaacctgccagtctgactgagagagcaaggggccctagttcaaatagcttagagcaccgtagcagaagactgaagccaacttctgccctatgcacccctacacacacccctattaagagacctgaaatgctcagggct

SEQ ID NO: 33563 - DNA, 1192 bp, Mus musculus
tgccccgggcattaataaactattcttagcactcctaagatcatagttgcatgccataaaaagatagtacatgctccctccaactcaaaatgatggtcataaaatacacatacaaatcaaagaagcagtaaaactgggaagaattttgataatcatcaccattaaacgccaaaatgctgcacactatgtgtaattacatcctattttctaagaaaattggtgcctgtccaaactgctgatcactaagcatgggaacatttgtgtgtgtagaaatgctttgggtcttgtcaaaactgcattctagaactttccatccttgatttggtaaagacggcagcaaaaatctttgccattcctcctattaaagcctaaggtttcaggtcacagcccatgcctgctctccctaattcttctgaaaggtgaggtagaaggaccaaaaattcatggctaagctgggcaactcagaccttttctcaaaattttataaaggagttagagatacttgtcagtaccaaagcccttgtttgtgggtgccacacaaggccaaactggaagctgcagccgtggtcctggggatggagggagcagagaccactggaaggacttggataggaaggatggcaaaaaagatcaagactccagatctgcacctgagccaaagaaacctgaggagattccggcctccgagttcagctctgcaagcaagcacgctgctctgtctctggatggcgaggatgaggaggagggtgacgactgcactgagtaggctctgggctcaaaaaagagtaaggtcttggtctaaggatggctcagtagtagagagattgcttaacatcctcatggctctgggtactacccttagcactttatacccctaaattaaatataggtagataacttttcacataagagtttagctaaagggatctgcaaccctataagtgggacgacaatatgaactacccagtagcccccagagctcgtgtctctagctgcatatgtggcagaagatggcctagtcggccatcagtggaaagaggcccattggttgtgcaaactttatctgcctcagtacaggggaacgccagggccaagaagtgggagtgggtgggagggtgtgggggacttttgggatagcattggaaatgtaaatgaaatttaaaaaaaaagagtttagcctttggatatatat

SEQ ID NO: 33564 - DNA, 1160 bp, Mus musculus
acctatcagaagcatgcaagtattttctgcaagtttgccgagtacattttaattttgttgatagttttttttagctgtgtacaagttcttaagtttcatgaaattccactaattttgctttgtttttgtgtgttgtggtcgtggtggtagtttttggtttggcttggttgggttttgttttttttgagacagggtttcaatgtataaccctggctctcttggaactcactctataaagcagactggccttaaactcagagccaccacgtgctacctccaaagtgcctctgtgacgcagttgttgctgtttttaacctacgagcaagggatgtcttttcatttcacatacttttcagttccagtaatagttataattttctgtgtatggttctttccttgcttaaatttcttccaaagtattttcatgtaaccataagaaaaatatcagttttttcttagattagtgccagggtagagaaatgtaactgaacaagctaaaaatcagtgttaatgtagatcctttctctaacacttaacagataaactgggtaccgctctgcagaggactcgggtctttgtccaacacccacaccaggtagcttccagctaactgcctataactcatttccaggtgacccaacactccttgaccccagtgagcaagcacctgtgcaagtgtggtggtacacatgatgtatatacataaccattttttaaaagaatgacttcacatagcatgtgaaacatctacactgttccactcagcagagacttttgacattggatcctggctgccctggatctcactgtgaaccaccatgcccagcttgtccggctcctatatgattctcctaccgggtgtatgtatgtgcagacatccgtgtgcactcgtgtagtaattaccccatgcaatggctctgactgaataaactgcatgattacatcctgcattggacacagaacagtgcaagttacattaaaaacccattatatttgcaactccaagcaagaactataattaaaaggcaattggatgaaattagctttaagagtacaagagcttaagcaagctttggtaaatgaatgttaatggttagcatgtgggttttattagggtttttgttccttttctctgtgacccaagagttgaatttcttaga

SEQ ID NO: 33565 - DNA, 1099 bp, Mus musculus
taaaaatgccacagttcagctttagttagatgctacttttttgaagattcaccatatccctggaagttaaagcacatattttaggaaaagaaaaagggatgaatgacgactatcaattaatcttgatttctttataaatgccaaagtttaaaagcaacctgtctttgaaaaatcagagcctatagtttgacttcaatgtgaagtttttgctaatatggactattacagaatgttaactagtatatatttggtaggacaattctatcatttttataggaatgtggatcctgaaactctagattaatatcagtaaagtagtgcacaaaagccattcataaatttcaattttcttctaaatctaacacctgcatacagaacttaaggcaagtttaatcaaggtgatggatcatgtgcctagctggtgtttgcttctgccagccttgtgtctgactccatcctttatggattctagtttcagagtaaagattaaagaccaaccagaagatgcagagattagggagcaggctcttcagactggagcctcagagcactcagaagggtaaggttggctctccttgtaaaggtgggtctgctctgagctcctttcacgagaaaaagtctctagaagttacaagatgttcctatctggattttgaggcctagaaaatgggattttatgtgtctagcgtggcccttctgtctcttctccccgaagatgtaggtggaatagcaaaggtagaggacatggaaaagaggctaggtattgaggggtcacacttggaatactttctagtgttttagtttttattttatgtgcattggttttgtctgcatgtgagggtattggatcccctggaactggtgtttagagctgccatgtgggtaccagggtcctctggaggagtagccactgagctatgtcttcattttttttttttaagtatatgacattttgccttcatgtatgtctgagcaccatgtgagtccaatgcctctagatggcagaatggaacattggttccctgggaactggacatagaaaagattatgtgggtgctggcaattgaacccaggtcttctagaagagcaggcaatgctg

SEQ ID NO: 33566 - DNA, 1873 bp, Mus musculus
catccccctgcctagagacagaccatttactgaagtcactttctcaccatgggctctcgtattggagtatattttaattttgggttattatctaaggcaggtgtttgcggatcagtgccccctggaagtgagtcataggcattgttcaagaaggaagcagctaagacaacatgaatgaacaaaaaatgaatgaacaaatgaagaaaacggcaaagacaagtggccagaaagggccgggcggaagagccctcgacagactgaccctaaagcaagacgaggcaaggccagtccagaataccagagtggaagctccccgtgtaacatacaccatccgggatgaaagtgagattagccccgagactgaggaagatggcttccctgacggatacctagagtgcatcatacgaggtgagttttccgaacccattctggaagaggatttcctttttaaatccttcgaaagcttggaggaagtggagcaaaacctttctcgccaggttctggaagcgagttcccttctcgagtcttctttggagtacatgacaaaggggacgaagcaagagaagagagaggtcacgcaagagacgcctccgctgagggttggggcgagctcattacttgcaggcggccctgcagagaagccagagggcggtgtgtactgtggtgtcttatcgatgctggagtgtcctcaagccgggtgcaagaagaagctgagggataaaaccgccctgaggaagcacatgcttgtccacgggccccggcggcacgtgtgtgcagagtgtggcaaagccttcacggagagctcgaaactaaagcgacattttctggtgcacaccggagagaagccgtatcagtgcacgttcgaaggctgtgggaagcgcttctccctggatttcaacttgcgcacccatatccgcatccacaccggggagaggcgctttgtgtgtccttttgatggctgcgagaagagctttattcagtcaaataaccagaagattcacatcctaacccacgcaaaggccgggaagaaatgctgaaggtggagacagattgtcctcaggctgggtagtcttaatgacagaggcactggggatacacgcattatgtacagattgttatttgtagggatagattctatggctaaaataattttgcaactcttcattatacagttttaaggcctcttttggtattccatggtatagttccaacaggaaagtcaatggtgaaagcagtttcaaaagcataacccttactatatgtgctattgaaggggatggggacttttgcatacgtcggaaaatcagttatttttaactatgcagttcctaattgcctagcttttacctttagaaatatgcttcatggtaaatttgataatcctaaagaatggccaactttggcagtagtcaacaaatgaatacatatttctaaattttatgttttgatttttgtttttctcattgtaccaaactatattaatcatagttaaatgtgaatagttacaaaaaagttgatccatctgaagattttagatgtttcaaaataaaaggaaataaaacactagaaatgagttcaatttctggggaaaaaaaagtgcattaagaagacaatagccagtcatagtgagtggttcatagcactcaggaggccgaggcaggcagatctttgaaattgaagccagcctggtcagccctgcctctgggctcagctaaagctctatagaggtaccctgtctcaaaaaaagagagacagacacagagcacttcagaaagggtggggtgtggtggtatacatctttgatcccagcatccagaaagtataggcagacagatctcagtgagtctgagaccaacctcgttcatacacaaca

SEQ ID NO: 33567 - DNA, 1151 bp, Mus musculus
cataggagaactaggagaaaaagaaatgtaaagaaataagctgcagttatattgtagatgaatgtattgagagaggctgcttttgtatagcagcctagacttgatcatggcctaagattttgctggttaaatactcttagatatggccttgataaatcaggtcagtttaaagaataggtaggtgtgtgtgtgtgtgtgtgtgtgtgtgtgtgtgtaatttcttttctccccaggggattcagcctaagccctgggcatcctagataggcatgtcactgtcccacgctaagctatatcccaagcctgtgtgtgtatgttgaaaatttaaactcttgccctagcaactgaaatgtgctttgttttctctttgatatatttatctttttgccagatttccatgttatgtctctgagatgcttttttaaaaatgtggccatttcaaagtactttcaagctgttaattctcaccccacagctttcccatgtgcctttatttaaagagcatttaatttctgttcccacagttaagacatgagaacaatgaagagatcttttatccagcgtggaatttgaacattaagcaaaggcagctagaaacacaatgataacatgtttatgttgcaggtttaaatagtttctagttttggttttgttgttgggttttttttttttttgtgggttttgttctgttttgttttttaaatgaagggaaaatagagagcaagtttaccctgtgtctatattttgcctggaattcataagccattgggattccgtaggtttcatttttttattttttggaccccagagaaactttagaataatgggcaaggaaactacagtccaggatcgcattttgcctctcccttccccgtctggttgtctcagcatcctcggccctcttcctcactggagttgcattgcacttcagaaagagatgggtttagacagagatgggagcctgtcaatcatatcttgctctgtacaaaaaaattaataatgatgataaaagagctactgttcctgcctcagtaaaagaagcaggatccagtttagagtgagttaagaaatgaagtagctgactgtgagcctccacttctgtgtttgctaggccccagcatagcctcacaagagacagctatatctgggtc

SEQ ID NO: 33568 - DNA, 1057 bp, Mus musculus
ggaggcagaggcaggcggatttctgagttccagagcagcctggtctacagagtgagttccaggacagctagggctacacagagaaaccctgtctcgaaaaacaaaacaaaaaacaacaaagaaaagttattgggccatgcttgggtagcgcacgtctgtagttccagaatttggaggagttcaagccagttttgaccacatagagtaacaggctaacaagtcacttgaccttttatttgctattctcatgaggttgtatattgggtagaagacagcatattgctcaaacatctgataacctaatgaagaaaagtaaatgctatttctatggctttgattggttaggaaataccattctacctacatagcatttgcaagcaactcttttttttttttttttttttttttttttaaccaagtgtctaaagttctgtataaatgcctggtaagttattgttatttgagatttctgaatcaggtctcaaccaaaactataactaatgcatattcatgacctcatttcactagagaaatggactaagagctgggacacgtggcaaaagaagatagtcttcttctctcaatagagtgagtgtgcagtgcagccagcaggtaagagtaaacggtttcataggcaataaataccaagaattgtgctcttctgtgtaacgcaggctggggaatatttagcatgggatcctaagtatggagggaaactctgaggaagtgatgtccaagcacagatctgaagtatatatgtttgtgcgtactaacagtgacagaaaactgtcggtggtgtattagtgatagagaagaacatgcaaggactagtagggtgccttactctatctaggaggggttgcaaatgctgggagcgtgcctgctgtctatgctcgggttataagtggggaataaccactccaggacccccacaagctagctacaaagtaacattttcttttcttttctttttttttttaatatatgtcccaagacatatgatttatttattatcgtatctaagcacactgtagctgtcttcagacacacaagaaga

SEQ ID NO: 33569 - DNA, 1812 bp, Mus musculus
actgtggctctgggtacgagtggcagtttcttcttgggatttcagaaaggaaaccaaggaggaaataggtagagcgcatcgcatcgctgtgggcattaggtaagtcctgtttcatgaaatggctgggatttgtcttttttctcgttatgaggaaagggaggagggaagggtttgaaaaccagcaatttagagttttgactcttccaaattggtgaagatcttggcaaataaatgctggctttcagactgcatcgatcaccagctaccttggtccattggccatcacgttttcaaacatattaaggagcacagtagatgcacattgaggaaagtgggaattcaggttggaatctccttgaaattctgtttcaaattttgttccaagtgttcgtgtgcttttatcttatctcaattccctagatctattttatatgaaaatgtttaaattagcgaggtaacagggcacctaccttttctctccacttacctctataaaattcaatagattattctagaaaaagaaaatcgaagagcatttttttggctttgttttgtttttgtttttgtttgtttgtttgtttgtttgtttttcgagaaagggtatctttgtatacccctggctgtcctggaactcactctgtagaccaggctggctttgaactcagaaatccgcctgcctctgcttcccaagtgctgggattaaaggtgtgcgccaccaccgcccggctagaacagcttttttttaaattactgattttctttacttaattttccagtttcctcactccattttccaatcaagcatccagccggaaagaacttcctcttgcttcctacagtctgcattccaaccttcagattgcttggttctcaaattgcctgaggagttccctgttcactgttgtcctttagtagtagatccagaatagtggtttaacttaacaccctataatggtttcctttggtgttgaactgcaacgcaaatggctttccgtagaattcccaggctcctttgcacttggaccctggccgccatactaccgaccaacttttctaagaattacgacttaacaccgagtggtggcgccggcggcctcacttggcctgtaatctcagcactccgggaggcagaggcaggaggatccctttgagttggaggacagccaagtccagaaagcaacttccaggacggccaggctgcctagagaaaggatccctgtctcgaaaaaccaaagcggggaaagatcgactgcttctgtggtgactatggcttcctcctgtagtaaatatgacggccttctgtagtaacttcggcttctttccctacttaaaacttttatcctaggttccctacagccatgattcagtttcttttttacagtgtctgcatactgcttgctaaagccggggatttgggggatctaatctcacctctccggggacggtatttttggggcgagcacttttgtctgcggagacaggtcctggatggttcttagagtgatggtgtccctctgtacgtcatcgcatactcggaagtttttcgtgagcccttttctctgtctgaaaccattttgttaattcacagtttactagctatgtgccccacatgataaaagcttgactctgtgtgtgataactgggttttttttgggtttttggtttttttcactattgagtgaacaattgtcatgtgattgaagtatttctattcctgtttgagaaatgaaacattagttttatcccaagccattagattttatctttatctgggttgaccagtaagcattttggattattttgactaattag

SEQ ID NO: 33570 - DNA, 2067 bp, Mus musculus
ccagtctaccaaactcttctccaacatctcagacagagaaacctttgagggggaatccataacaaatgagatagctttctatgccagaacccctccttttattttgcattttttattactttttcattttaaatttctgaaaccatctactttaaaactaaattcatacatggcatctcctcccaagaatgacagcttgatgacagaaattgctgtttatacaattagctggggatgcatttttccaaaagaaaaaaaatacctattcaataaatatagagatttatatgatgcattttttccctgaggctttcagacaagatgtaaaaagaaacagtgaggtaatgagactaaggagaggctgcaatgatggtatgattatctcaccaaggtgtgcctagctctggcaagcttagccccccccccaggttattactcttccaggactcagtgtcagtttggtaaggaaggaaggactcacccctgacagtttgcgatcactttagaagccttcttgctcccactgtctgaaagccttttactccctaatcctaagaatttacacagagagctgacaacatccttttctgtgttaagcaaggctttcttctgcggcaaaaactcatcttaagaaaatatttctatttcagagttaaaacagcatttggatcttggtggtggcacagcctttaacatccacacttgggaggcagaggcacgtgaatatccatgagctgcgaggccatcctggtctactgagtgagttccaggacagctggggcacagcctttggttcaagttattatttctgtgttaattcatgcgctcttctcagaattctttttgtcaatcaaataaagatcagagttttttcaaggctggtcaagaagactgtacacatgctgtgttcacagactgccacatgcccatccccatccccaggatctctttgaatttttctctttcccttattcagccaaacctaaatatttaatgtgtgagattctgttttgatgcaagtggctccgtgccaactctgggttagtaccccgcctgaggacatgaaccaactcttatagactatggagagagatgtctgcaaggatgtcagtctcacttgtaataatcaataggctttttgttttttgttctggtctttaaaccagcatctgctagatcctcataataaaaatggaatgggcttctccaactgtatttttttcacctcttcagatttgtgcttgaagatcaatattgttgctcacttgattgtatctcatcatcactagtcagttttccccataggctccttttaatttgctgaaattagctgcaatcagagcttcttatgcttgcctgtaaagtccacattcaaagtaaaaatgtgttcctctctcaaaatagtttaatgcttttggatacagcctactcactaccaaaccctgcacatatgcacacacagacacacaaaggaaaaacccaacaactctggtctcccttcccatcagagcacaacactgttcacagttgttagtaaaggaagaagagtgatgctcaagatggtctatcagggttgttgtttggtcagtgcatgtgagctagatttaaacagggatagattctcattgtaaagtgagttaatattaggattaaagggatatgaatgtgatgctctgggtagttgggtgtagccatggtaataactcatattttggagaactctcttgtttttggagagtgtgtttaaaaaagtaaagaaaaccagaacaaaatagtatactccacaagtataaaagggccatatgcttattgtcatgatttgctttctgttgttggggtttccttccaaaagaaacttggggagggaagggtttatttttgcagtccatcatagagggaacccaaagagaagttcaagcagaaattgggagcaagaatagtagcagaggccatggagaaacatacctctatggcttgcttttttaaaaatgtatgccaggaacacctgcttaagagtggtacctctcacaaggcttgggattctccaacattaattatttagcaaga

SEQ ID NO: 33571 - DNA, 1205 bp, Mus musculus
ttaaaaatttaaaacatcacatctccagaagttggaggacgacaaagtccgagtcgtccagtaagcttgcagagactgatcgcggttctgccctgcaaaaacccgggcgggcgacacagactcgttgcgaggagtttcagctgcagaagaggaagagcatcacctgcagtccgaggcgtgggaaacgctgccggacccggtatttccgaagcccgggaggcgagcgccacggggggccctggctggctgattccgtggtgagtgcgaagaagccagcactcggcggagccccaagactccgcggggaggaaagggacggacatttcttcctgggacggctgcggccacggagatcactgcaacggggaagctggaggcagcctgggcgtccttagctgcaactggctgggaggccgaatgaagtcggagaacccggtcagctccggggagtcgggggcgaggcggggctctgacgtcacctcccctccccccagccgctcctagagggaggagtagggaaaagaagcagagagatccgccgcagttgccagccgtaactcctcaactcggcagctggctgcctggacatgtcctgacaaacttggcttcccctcggcgctctccccagacctcgtgcgctctctctccacctcttttggtgctcaaactttccccgggtcgagagccacagagaaggcgcccacctgagtcccgccagcactggaggaggatcgcgctctgcttggggatatgctgaagatccaagggaggcaaagttggtacttcgagcccggatcctaacaaatatccaaacggcgtgggaattacccaactgccggggactagaagggagagcaccgaggaccgggctactgtggtgagttctttgttcattgcatgcctggtagaattgaagttttaattgtaaatgaaataacgtgggggtgtttcacagtaagcgagtggggaaatcatgtgtatcctacaaggtctgcgctcaaggaactggactgcccgcggccttcacggggcgcgggaatgaaaggcaagcatgcgcagcttttggaattcacaaaatacacacagagcgctgttcaaaagaacttgagaagtgaagccgtttgtgcattattttcagtgtaacttgttatagaaatggtgccctgggagggcgcgttggggactgagtgatctgcagtggcgca

SEQ ID NO: 33572 - DNA, 3135 bp, Mus musculus
gtttggagacagtgatggcagccaaagacttgaacccacccctcctatccagtttacacacttccagtacaatgtcactgtgcacgagaactcggcagcgaagacctatgttggccaccccagaaagatgggcatctacatcttagacccctcgtgggagataaggtacaaaatcgtctcaggagacagcgaaaacctgttcaaagcggaagagtatgttctcggagacttctgctttctaaggataagaaccaaaggagggaataccgccatcctgaacagagaagtgagagaccattacacgctgatcgtcaaggcagtggagaaagccaccgatgctgaggcccgagcgaaggttcgggtacaagtgctggatacaaacgacttaaggcccttattctcccccacctcctacagcgtctctttgccggaaaacacagccataaggaccagcatcgcaagagtcagtgccacggatgcggacattgggaccaatggcgaattttactacagttttaaagacagaactgacgtgtttgctatccacccgaccagcggcgtcgttgttttgactggcaggcttgatttcctagagacccagctctatgagctggagattctggctgcggaccgggggatgaagctgtacggtagcagtggggtcagcagcctggccaagctgacagttcacgtggagcaggccaacgagtgcgcgcccatcataaccgcggtgacgttgtcgccctctgagctggacaaggacccaacctacgccatcatcaccgtggaggactgtgatcagggtgccaacggggagatagcgtctttgagcatcgtggctggcgacctccttcagcagtttaaaacagtgaggtctttcccagggagtaaagcattcaaagtgaaagccgtcggggccgtcgactgggacagccatccttacggctacaacctgacattgcaggctaaagacaaagggactcctccccagttttcccccgtgaaagttgttcacatcatttctccacagttcagagctggccctgtcaagtttgaaatggatgtttacagagccgagatcagtgagtttgcccctccacatacacccgtggtcctggtcaaagccattcctagttattcccatttgaggtatgtttttaaaagcgctcctggaaaacctaaattcggtttgaatcacaacacgggtctcatttccattttagaacccattagaaggcagcacacatcccattttgaactcgaggtgacaacaagtgacaaaagagcctccgcccgagtggtggtcaaagttttaggtacaaacagcaacccccctgagtttacacagacctcgtacaaagcatccatcgatgagaacgcgcctatcggtgccgcagtcacgagggtgagtgcgatggaccccgacgagggggagaatggctacgtgacttacagtattgcaaacttaaatcacgtgccgtttgtcattgaccacttcacgggaaccgtgagtacctctgagaatctggactatgaactgatgcctcgcgtgtacacgctgaggatccgtgcgtctgactggggcttgccataccgccgggaagtcgaagtcctcgccacgattactctcaataacctgaatgacaacacacccctgtttgagaggataaactgtgaggggaccattccccgagacctaggtgtgggggagcagataaccaccgtgtctgccattgacgccgacgagctgcagctggtccggtaccagattgaagccggaaatgagttggatttgtttggcttaaaccccagctccggtgtgctgtccttaaagcactccctcacggatggcttgggcgcaaaggtttcctttcacagtttgagaatcacagcgacagacggagaaaattttgccacgccgttatacatcaacctaacggtggctgccagtcgcaagccggtcaacttgcagtgcgaggagaccggtgttgccaaaatgttggcagagaaactcctgcaggcgaataagttacacagtcagggggacgtggaggatattttctttgattcttactccgtcaatacccatactccacagttcggggttactcttccaactggaattgaggtaaaggagaacctcccggtgggtgccaatatactcttcatgaatgctactgaccttgactctggcttcaatggaaagctcgtctatgctatttctggagggaatgatgatagttgctttaccatcgacatggaaacgggagtgctgaaagtcctgtctccacttgaccgtgaagtaatggacaaatacaccctgaatattaccgtgtacgacctcggtataccccagagggctgcctggcgccttctggacgtcacggttctggatgccaatgacaatgcgcccgagtttttacaggagagctattttgtggaagtgagtgaagacaaggaggtgaacagtgaaatcatccaggtcgaagccactgataaagatctgggccccagcgggcatgtgacctacgctattctcacagatacggagaagttttccatcgacagcatgaccggtgtggtgaaaattatccagcctttggatcgtgaagtgcaacctgtgcattacctaaagatcgaggccagggaccaagccacagaggaaccccggttgttctccaccgtgctcctgaaggtgtcactagatgacgttaatgacaacccacctaggttcatcccacccaattactcagtgaaagttcgagaagatctaccagaaggaaccatcatcatgtggttagaagcctatgatcccgatgtgggtcagtcaagtcaggtgagatacagcctcctggatcacggagaaggccactttgatgtggataaactcagcggcgcagttagaattgtccagcagctggactttgagaagaagcaactgtataatctcaccgtgagggccaaagacaaagggaagcccgtgtccctgtcttccacttgctatgtggaagtggaggtcgttgacgtgaatgagaacctacacactccggtgttctccagctttgtggagaagggtgtagtgaaagaagacgtccctactggctcatcagtcatgaccgtgtcagctcacgacga

SEQ ID NO: 33573 - DNA, 1101 bp, Mus musculus
tctcaacgtaaatttccaagcctataaggagctgttagaagttaaagttgagtcacaaaatataatttgagccttaatttgcattctcttcgtgacttaaattatgagcactgccttttggctctgtctttttttttttttttttttgtgaaaatagtttgctttttaaaaaggatcacatagaaactggtatttttcacctataaatgtaagggatggggttgttcccgctgccaaatggggagaaggagacaggatggatagcatcctgaaataggtccagagcagtgtgcagtggccacggactttttccagtggtaatttagtgggaggggaggtgagggaggcaccgggattctagggactgagattggttaccatatgaaagactcttacacacgtctataattatagttaaaggtgagagtggagctagaatgtttctaagtcattattctggggttcttgttttacagagggatagtctccctgggcggtggtatgtgtatatggtttctgagatcctttaaatgatgtactagctagactttgaactgttgtattgaaacaatgtatgttgggcggtaaatctgtctgacctagttattttgtagatttctagccaggagattgggtattaagtgttaaatttcttcaggaaaaccatgtctaatggagtagaaatgctaagattaaggggttagtggtaaaggaaaagcgttggctgtacaagcatgaggagttgaatcctgtcctcaggagacagacacggttggagctctgtccctgggcagcctagccagccacgttgggttcaggaagagaccttgtttaagaatataagatgaagggcctgcaagatggcttggaagtaagggctctctgcacaaggccttgacaaccagagttcagtccctgaaactcagggttcctcgtctccctacaaggaagatgtgggggtgggggaggtagagggagggagggagagagagagagagagagatagatagattgaggaacacactcagtggcctctacacatctgcatatacatgtgattcaagtggaaccacatagatattaacataaatacacacagag

SEQ ID NO: 33574 - DNA, 4118 bp, Mus musculus
tgtgtctctacaacacatttttcacttgagcagagagaggattttggcgttagtcacaaaacaatatatttttttctgttctttgcttttcatatttgacagccaaaattctgaacggtttaaatgggttaaaaaaaaatgaaataaattgaatgtctcattcaactgttgatatccccttcgtttctatttaaattcagggtgtaagttttaaatatctgtttctctgctatttctgttgtccttggctcttttctaataggtttctttctctgactcttttttttcttgcccttccaggaaacattggaaattcttttacaattgaccccatcttgggctctataaaaactgccagagaattggaccgaagtcaccaagtagattatgatttaatggtaaaagctacagacaaaggcgatccacctatgagcgagatgacctccgtgcgtatcgctgtcactgttgctgacaatgcctctcccaagttcacatccaaagagtactctgcggagattagtgaagccatcaggattggaagttttgttgggatggtctctgcacacagccagtcatcagtgatgtatgaaataagagacggaaacatgggcgacgcatttaacattaacccgcattccggaagcatcatcactcagagagccttggattttgaaacactgcccatgtattcattgacagtgcaagggaccaacatggccggtttgtccaccaacacaacggtggtggtgcacgtgcgggatgagaacgacaacccgcccgttttcacgcaggcagaatattcaggattcatcagcgagtcagcctccgtcaacagtgtggtgctgacagacaggaacgttccgctggtgattcgagcgacggatgctgacagggaatccaatgctctgctcgtctatcaaatcgttgagccgtccgtgcacaactattttgctattgaccccaccaccggcgccatccgtacagtgctgagtctggactatgaagaaacacatgcttttcacttcaccgtccaagtgcacgacatggggactcctcgtctgttcgccgagtacgcagcgaatgtgactgtgcacgtgatcgacatcaacgactgcccccctgtcttctctaagtcactgtacgaagtgtctcttctcctgccgacatacagaggcgtgaacgtcatcacggtgaacgccacagacgctgactccaaggcattctcccaggtcatgtactccatcactgaaggcaacattggggagaagttctcaatggaccacaagactggcaccatcgcaatacagaacacgactcagctacgaagccgctatgagctgaccgtccgcgcctccgacggcaggttcacaagcatggcctccgtgaaaatcaacgtaaaggagagcagagagagtcccctcaagtttacccaagacgcctactccgcagttgtgaaagagaactccacggaagccagaacgttagctgtcatcactgcgatagggaacccactcaatgagcctttgttttaccgcatcctcaacccagaccgcagatttaaaatcagccacacgtcgggcgtgttgtccaccaccgggataccgtttgaccgtgagcaacaggagacgtttgacgtggtggtagaggtgactaaggaacacgagccgtcagcggtggcccacgtcgtggtgaaagtcaccgtcgaagaccagaatgataatgctccagtgtttgttaaccttccctactacgctgtggtgaaggtggatgctgaggtgggccacgtcattcgctatgttactgccattgacagagacagtggcagaaatggtgacatacactactaccttaaggagcatcatgaccacttccagattggaccttctggcgacatttctctgaagaagcagtttgagcatgacactttaaataaagaataccttgtcacagtggtcgccaaggacggagggagtccagctttctctgcagaagttctggttcccatcactgtcatgaacaaagccatgcccgtgtttgaaaaggctttctatagcgctgagatcccagagaacatccagatgcacagcccagtggtccatatccaagccaacagcccagaagggctgaaagtgttctacagtatcacggacggagacccttttagtcagtttactattaacttcaacactggggtggtaaacgtcatagcaccactggattttgagtcccacccagcctataagctaagcgtgcgggcaactgactccctgacgggcgctcacgctgaagtgtttgttgacatcatagtggaagacatcaatgataaccctcctgtgtttgtgcagccatcttactccacaaccctgtctgaagcatctgtaattggaacacctgtccttcaagttcgagccacagattccgactcggaaccaaacagaggaatttcctaccagctgattggaaatcacagcaaaagtcacgatcattttcacatagatagtaacacggggctcatttcactagtgagagctttggattacgaacagtcccagcagcacaggatcttcgtaagggctgttgatggagggatgcccgccctgagcagtgacgtggtcgtcactgtggctgtcaccgacctcaatgataacccacctctgtttgaacaacaggtttatgaagccagaatcagcgagcacgccgcacacgggcatttcgtgatgtgtgtgagagcctgcgatgcagacagctcagacctagacaagttagagtactctattctgtctggcaatgatcataaaagcttcatcatcgacagggaaacgggaattatcacgctctccaacctccgccgccacaccctgaagccgttctacagcctcaacgtttcggtgtctgatggggttttccggagctcggctcgggttaacgtaactgtgatgggagggaatttgcacagtcctgtttttcaccagaacgaatacgaagtggagctagctgaaaacgctcccttgcacaccctggtggtccaagtgaaggcatctgacagagattctggcatttacagccacgtaacttaccacattgtaaatgactttgccaaagacaggttttatgtgaatgacagagggcagattttcactttggagaaacttgaccgagagacaccggcggagaaagtgatctcgatccgcttgatggctaaggatgctggggggaaggttgctttctgcaccgtcaatgtcatcctcacagacgacaatgacaacgcacctcagtttcgctcaaccaagtacgaggtgaacatcgggtccagcgctgccaaagggacgtcggtcgtcaaggtctttgcgagtgacgctgatgagggatcgaatgctgacgtcacctacgccattgaggcggattctgaaagtgtcaaggagaacttggaaatcaacaagctgactggcctgattactacaaaggaaagtttaataggtttagagaatgagttcttcactttcttcgttagagccgtggatagcgggtctccgcccagagagtctgtcgttcctgtctatattaaaatacttccaccagaagtgcagcttcctaggttctcagagcccttttatacctataccatctcagaagacacgcccattggaacagaaattgacctcatccgggtagaacatggcggggctgttctttacatccttgtcaaaggcaatactcctgagagtaatcgagatgagttctttgtgatcgacaggcagaatgggagactgaaactggagaagagccttgaccatgagaccactaagtggtatcagttttccatcctggccagatgcactcttgatgactacgaggtggtggcttctatagatgtcagtatccaggtgaaagatgctaatgataacagcccagttttggagtccagtccctatgaggcatttattgttgaaaacctgccagggggaagcagggtcatccagatcagagcatctgacctagactcaggagccaacggccaagtcatgtacagcctagaccaatcccaagacgcagacatcatcgaatcttttgccattaacatggaaacaggctggattacaactctcaaggagcttgac

SEQ ID NO: 33575 - DNA, 1454 bp, Mus musculus
tgtcttggtggcacttgggctactccttcccaagcaggagtgtgactcagtgtccatatgagtaagggacaaaacagttgtccttttcctcactgggcttcatgacaagaaatgaatgcctagcagttgatatatgggcagaccagaagtgtactgcgtcatgcatttttattaggagattgcagtaacgccagaggcgacttctgtctttgcaggtggctgacagcggaaagcctcagctgtcatccatgacacacattgacatcagggtgatcgaggaaagcatccaccctcctgccatcttgccgctggagattttcatcaccgcctttggagaggaatactcaggtggggtcataggaaagatccacgccaccgaccaggacgtgtatgacaccttgatgtacagtctggatccccacatggatggcctgttctctgtctccagcacggggggcaagctgattgcacacagaaagctggacataggccagtaccttctcaatgtcagcgtgacagatgggaaattcaccacggtggccgacatcaccgtgcacatccaacaagtgacccaggagatgctgaaccacaccgtcgccattcgcttcgcgaatctcaccccggaggagtttgttggtgactactggcgcaacttccagcgagccctacgcaacatcctgggcgtccggaagaatgacatacagatcgtcagcctgcagccctccgaaccccattcgcatctggacgtcttactctttgtcgagaggtcaggcggcacccacgtttcaacaaagcaacttctgcataagattaattcttccgtgacggacgttgaggaaatcattggcgtgaggatcctggaagtgttccagaagctctgtgcggggctggattgcccgtggaagttctgtgatgagaaggtgtctgtggatgaaaacgtcatgtccactcacagcacggccagactgagtttcgtgactccccgacaccacagaacagcagtgtgtctctgcaaaggtaatagcgcctatgtatgtggagaagagcgtgaaagactgtggtggggggcttagcagttaagaacccactgggctactcttccatgagccttaggtttgatttccggcacccacatagtggctcatgaccatctgtaacttcagatccagggatgccctcttgtgacttcaagggtgtcaggtacccaggtagtacatagacatacatgcaggtaaaacacacatacatattaaactttaaaatggtaggaggaggaggaggagatgatgatgatggtgatggtgatgatgatgatgatgatggtgtcaggtatccaggtagtacatagacatacatgcaggtaaaacacacatacacattaaactttaaaatgttaggaggaggaggaggaggaggaggaggagatgatgatgatggtgatggtgatgatgatg

SEQ ID NO: 33576 - DNA, 1767 bp, Mus musculus
cctgcacccgatgaactgccaccattgcctccagagttcagcgaccagttcgagtccatacacccacccagggacatgcctgcagcaggtagcttgggatcttcctcccggagtcggcagaggttcaacctgaatcagtacctgcccaatttctaccccgccgatatgtccgaacctcagaaacaaggcgctggcgagaacagtccatgtagagaaccctacaccccctaccccccagggtatcaaagaaacttcgaagcgcccaccatagaaaacatgcccatgtccgtgtacgcctcgacggcttcctgctccgacgtgtcagcgtgctgtgaagtggagtctgaggtcatgatgagcgactacgagagcggggacgacggccacttcgaagaggtgacgatccctccgctagattcccagcagcatacggaagtgtgacgctcaaactcctccccaaagtgcctggactttcatgaacctagagatgctatcggtgacatccgccgttgtgttgttcttttgcagccgtctgggccgcttctcggtgagccgcggtaggcgtggctgcacggagtcacaagcctcttgacatgttagccatttccagcgtcctaactgactgtaatcgaccgggttttcatcccctgtcccatcccctgagcatcttttcgtatttagatttgtctctgttaaaatgatgaaacggaaatcggtcctgtcgtcttgttagcatgattcatgtatttatatagatccgattattttaatttttgctttctttgtgtaaattttatgtacagatttgattttttgtttttttttgtttgtttgtttgttttcccccctctcctagtttttacctaggttttcaggacgcctcgtgtttttgttttctgctggatctgtgtggtggtgttagcgtcgtttgcctagcatctgattttctgatgtaaccagggtttcacgctgttcttttcctctgaagtatgacatttcattgacacatttcggtccagtgtagctgtacatatggggtgtggacgacctgttactggacatgtcttattaaatgggttgctgtattaggattataaacatttttcattattggaaagtgtgaaggggaccttctgcatacctgtttagaaccaaaaccaccacgacacggtttttatagtgtctgtatatttgtgatgcaatggtcttgtaaaggtttttactgaaaactatcattagccagcctttcttactgacaataaattattaataaaatactttagctttaatgcctggttttcttctgcatttatattgctgtttatgatctacctggtaaattgaaataagggagatcaatatgatataaagtctctttacagttggaaagccaggccaggccaggccaggccatacttatatattagccactaggtggcagtatatggccaataaatgttctaatggccatctgggtgttcagtaagctctatactctaccagcttccctagcgctgggattgtagttgcctgccaacatgcccatttgtaaaacacatgaattataattgtgtgtgtgtttgcacacacacacatgtaaagtcatgcagtttttttttctttttttggttttcaagacaggttttctctgtagcctggctgtcctgcaactcactttgtagaccaggctgacctggaactcagaaatccgcctgcctccgcctcccgagtgctgggattaaaggcgtgcgccaccacccctggcac

SEQ ID NO: 33577 - DNA, 1343 bp, Mus musculus
gcagtgctcggcagacagttgctgtctgttggcgtctgagttcacagctctgcacgactgcatgctttctgttatttcaccaaaagaacctgttttctgttcatttttctgattagaattaacatcagctaggtgtgggggtgcatgccaagcggcccatgtgggctacctgacatgttgtctcaaaaaataaagaaaaaaaaagcaaacccaaataataagtaccaatatataacgtggcaggcgattggctgtttctcctagcatgggataaatcaggtttgtgtagtctggtttctctcggtagccacctgtctactgaggatgatctccgaactctcagtagatggttctctcagacagacagacattttgagcacatccttacagcctcttgtttgcctttctctctgggcaggtgctgatggagctgctgctgacagagctctgccctgagctgagggctcacctggatcagttcaaagctggccaagtctgagagcgcacagagcagccgccagagaaatgtctgtgtaaaaatagacattaaatattttcctcttttgcacagagggcctgacaagaaccatatgatttttatttccgagcctccctctagctgtacgtgaagtgagcagagtcagagggaggaggacagatgctgtggtaggcaatagaaatcagactttaaaagctcaacatgttgattgaaatacaaatgttaatatgtgataagaacataggaaatattttaaatatttatgaaaacagttttgttgttaaatgacaaactcagaatattgtacagttaatctcctcactgaggattctgaacattcctgtgtctcacatgtattgaagaccactgttgtgcaatgcttgatgtaaagttattgtgaaacttttattgtttttatttttaccaaagatttcccatagtttgaagcatttgaagcaataaaatataaaaatgaatcacagtgctcaaaggtattatatggcttgagctaccaaaggagcttgggccctgtgtacctcagatttgctgagagccttttcagagaaagcgttgaacactgagaacttcggcaagaagggtaacatttgctacctgagttttagtacatggaaggccagtctggtgaggccctggggagataggatgtgagctgagcctcgaagcattaggctcaaagcagaagggggaagttgcttcctggagttgaaacttctgttagatccctaagtctttgcactctgaagtgttaggtgaggtccagggtctgtactatcccagtgatagtgggaccatagactgaatatcactgagtcaatattcttgg

SEQ ID NO: 33578 - DNA, 1237 bp, Mus musculus
tcagctgcttggtttttggggagctcttcatcctgccctgtgaaagctgccatgtctgtatgtcagtctccatagaccactgtcagccactgagagtctggcctcattgcactcaagtgtgccagcctggtgcctggcatataggaaggtttgaattgaaatatgtagatcaggaagtgagactagctcaagtgtatgggaaatgcttgaaggagaactttaaaaatatctcaattactttaaaatgtgcatatttttaagagcagtgaattaaaaaacattttggttaaaagtcaatatgcaaaaaaaaaaatctcatcatctctgggaaactgtattacaattccctgattatttaaagagtgttccccagccccaccccacccccaaccccagttagcttatttcaagctttgaatctggctgtagagtcaggctgtcccctgaggttggacactgatagaataagggtagggtggaagtgggagtttggggtctgtacgtgaaccgactacactttcctgggttcgtgacctgctgtctgcgatgttgcctgtccctcaggaggagatagaagaggacagcgacctgtccgattacggggatgatgtggacgggaagaaggattccttggctgaaccgtgtttcatgctgatcggggagattttcgaacttcgaggaagtaagtctctttgatggcagtgggatttattgatcattgctctgcttccagcatgtattaaatgtatctgtactcatgtgttcatgcatccaagatgcactttaaagatgcttcaggtgttacacttcatccttggtgctgaaggtacagccttaggacagagagaacttctatattcctgagacttgggttcctgctgtactcagcattgtgctcctctgtgttaaaacagagacaatgctttgaactcttttcgtgtggctcagtatagtttcattgtctcatcaccagaacttactcaaaaaatgatttgcatagcctgtgattaaagatgcagttttgatgccagggtagtgttttggatatatatcatatattataaatgtataagatgtataatatatgaaggctgagtgtagaatagtttcagtaactaaagttatagagtaaataaactttagaaatggaggctagttaaactgcttaagaaattagtcaaatattaaactctttcagatgaaagattttttagccttgttgtaatttagattcttc

SEQ ID NO: 33579 - DNA, 1184 bp, Mus musculus
aacctgggctctttgcaagggtagcctgtactgttaagcactgagccagctgtccagctcctgctccaactgttgatttttcttcactgccttaagatgccctccccctccagaattcttagttgcttcacataggaagattagtctgatgacatgtatcatcatctctgcagctgctggagaggtggctcagtgcttaagagcatttgctgctcttgcacaggacttgggtttggtttcaagcacctacagggtggatcccagccatctgtgtaactagtgtcagaggatcttatactctcttctggctccatgggcaccacacatgcacatggtgcacagacagacttgcagtcaaacacccacacttataaaataaaaataaagctttaaaaatgttttttttaaaggttgcttctacagaccatgctttaactgtgtgtctgaaaactgaccactgtttcactgtctcaggtgccacatcctacttgctcatcctactcggacattcaagttgtttccactcggggccattgtaaatgccaaaactctggtgccttctaaattttgtaagacctaaaatgtctttgcagttttttgagcgtgaccctttttttctcttgggtgggccagtttgtttgagcagcctttgtgtgggcaggcttaggagaaactgaggcctacctgacagaaacaggtgccccattgctctcagcagtggcttctgtgaaagggaagtgccatcatagcctttgcatagaagttttgcttaattattatttggtgtttttaaagcactttgatggtttgctttcttttttaaacttgtttttattaatgtttcacttatatgtatcatggagattctatgtagtatttcatcttattgtacagttggcactaactaaatccagcccttcccctcctggtaatattctctgtgccacactgaggttgacctttttttgtgtttttctctttggagctcagcttctgttatctgttagacagcattgttaagcagcttcttaagaatcagaagtcctttgttttatataagatgcttttcgggaaattgaacatcacatcctctaccaaaataagagctgctggcggctgtaacaatagattctggagtgcagtttacgagtttggcagcagctgataacaacagtaacaaacaa

SEQ ID NO: 33580 - DNA, 1194 bp, Mus musculus
atatggcttcttcatttctttggatttgaaaacattattattattttttctttctttttttctttcagattttttattagatttttattagattttttattagattttctttatttacacttcaaatgttatatcccctttcctagtttcccctccaaaaatcccctatcatttcccccgtccccctgctccccaacccacccattcctgcttcctggcccctgtactggggcatagaaccttcacaggaccaaggacctctcctcctattgatggccaactaggccatcctctgctacatatgcagctagagacacgagtcccaccatgtattttctttgactggtggtttagtcccagggagctctggggttacaggttagttcatactgttgttcctcctatggggttgcagctccttcatctctttaggtactttctctagctccttcactggggaccctgtgctccatctaatggatggctgtgagcatccactttttgtattagtcaggcactggcagagcctctcaggagacagctatattgggctcctctgtcagcaagctcttgttggcatctgcaatagtgtctgggtttggtggttgtttatgggatggtccccaggtagggccgtttctggatggtcaatccttaagtctctactccaaactttgtctctgtaactccttccacgggtagaatacattattgttgaggccaaggcagatatgattgttttgaaagaggcagagttttgagaaaagtgagaaaattgtgggatcatagaagatggtcagacactcagactctgtgacccttgtgtggctaacaaggcgggtgcaggattgtatttgcttttgtaagataggctaccattgcagtagcctcacaggaaatacacccatcacccctgaactttgtgcaacctttccttcctttctttccatttttcacccttcttttttctcacctactgtctgtctgtttgtgcttagtttgtctgtggcttaagtagcccaggctaacttcaaactagcattgtagccaaggatagccatctaataaccctccttttgcatccacacactaggattatagtcatgtgtctctatgtctggtagtttttctttttaacttaaactaaactggagtacattggagaacacttaaaaatctttgtaccctggttag

SEQ ID NO: 33581 - DNA, 2888 bp, Mus musculus
gtgacaatctgtgttgaagccaagacactcactatatagctcttaatctatgtgattttcagttatcataagcgctaaacacggagcttgccttgtaaacgtgcacctgtgcttctgtctgctctacgttgtctgtaactcgagtcctcacgtgcttatgtgagtgttagactccttatgaaaacgctttgacgtctgcttccatggagaagctgacttagatttgatgaggaggtgaggagcttgtactgtgcaatccctgattcaccaaagacacttctgaagagtctgactctccacccacaccatctcacactgtgagtaacagggttcacttcagaagctgctctctatgccgtctggtaaaatactcttaaggattctgaggcaagaggtaggcttgaacagcctcatgtcttgtgagttgtgactggtttgtatccagatcacttgcataataaacaaaagcaagtatttgttggatcagtgagcaacactctgagcttgaagaaccagaagcgcatgcctagagtatgttagagcagtgttggaaatgacactgttagtcactgtgtgtgctgctgttgtgtatttattgtagtaatagaaggcttagagcaaggaagaaatgctctagagaaaccaaatagaaacaagaaagaaagtaatcacacattgcctaaagctattgccttgatgctagagaattcccttgctttggtttggctgaatcctagaagcaccattcttaccattctcacatttgaaggtctgttaatcctcatggaattgctagtgacacataggtgtgaaacagttgactatgaaaagtagaatagtttcctgtcaacctagaggctgttcttttatagagcaaagtgtgtgacatttcatagtcataaccttttcattgctggtcttgtcagcatgtctttagtagatatatgtaagtttcatattcaatgacacgttttgcttaaaatatgagttttccctagccacagagagatccgtctggtgccagtgctccagcactgtggcatgtgtaccacacctgctccatcttccttagcagggaggcggactgcacttagcaaacaaacaccagggcatacattgctggtctccctttaatagacggtgtttcagatagagcagcgaagggagaaaatgctgaggccaaaacaatgctgagcacatatagcacacacacagaccgcacacgcacgaacacacacacacatacacacaaacacacacaaaaatgggtcggaacacacatgactaccggtttcccactgcttttggagggctgcaacattcttcagcagtttgtctctttgttctagtgaacaagattttatccatgctttatatgcctcttagctgtacaaacaaagggtttattttgtcttagtttttaacactgcacttttaatgtttttgtaacaacttaaatttaaaatgcagcattttggcattttcccagtagtgaattaatcacttgaaagcagatttttgtggcggaaataaatgtgtatatataaaaccttttatgttcacagcggcattagcctaggaatacattttatttggtttctccaagtttcatagctaaagctagaatttgattttaaatgctaacttatgtcttagtttgtactgtttggaagaagcttatctaagtattactgataacaaaggattcaacttcaagtaaaggacaagcatcttttaaaatccacttagcatgttatgtttaggtgcgtatctggcgactgtagagatgggtagggattacaaacttagcactcactgatggaaggtaggatttaggaggcatttgcagtggagcagtcatgagtacgttcatctcttcagcctcacctccacaaatctgtagggttagcactgttgcatggctggctggcccttagcacacgtgctcggaagatctgcatctgcagctagacagcgggcaggtctgctgactcgtagacagatctgaggacagttttcatctcgattgaatgttacctccttctctagtaagtttttgtgaaagatttcagactattaaaatgacttcttaaggagtagctactaccttaccccctcctctcagtctccatccaaacccactctcacggctactccactaacgctgtgctttgcttgtaaagtaacaccatgcagttgtgcgcaacccaagtatcaaaagcagctacgcggctctgaaaggtgattgtgataggttctgcttctcatctgcagatacaatgcagcaactccaaagtattaagattacagtaaagctgaagacgcacctttgccctggttagcaacgcaaaacctgtgtcgtcgtaaatgccaaagtcttagtgtgtaaatgtctgtacaccgtcacagcgaatgagctcactgctaatggccgagttgcttattttcatgaataaagattagcaagaaacttttaaaccatctttttaaaaaatgtcctagtttgttatattttaggcatgaagaactagcttggcctactgaagaaataaaagatttaagaagaaccaagttttgattctgttttgttcatatttttagaattagaataaaacattctatgtaccctacaaaactattagttagaatgaagttagcagttagctgtagttttgaaaatgtggtacttctctgggaaagtgtgtttaagatggtgctcctggtcagctttctttgaatcacgtgacttgattcatcttgtgaaactgtcaccatgctatagtacagtggacattgctttcgagcttggatgagtgctggttttgctgggctgttttatctttagagagggtttgatgatgctattgggctggaggtagtaactgacc

SEQ ID NO: 33582 - DNA, 1448 bp, Mus musculus
gggggacattcgagtaaagcagggacattgtcatctgctcaccatgttaagagcccttgagggagggatctttattgccattccccataagcctgcagggaatttcgctcaaatgtccttataatgtcgagaaattggactgctttttagcttagtcaagtaactaacatttattggtatgttcttggtaactgatttcctgatacattaaaaaacaattggaattctcccttgtcacttgaaagtgaaagatgggcgaggaaccctgggcatagcagtgcacatttataatcccagcatttgggaggcaacacaggatgattttttagttccaggctagcctgggctatataggatgaccctatcctttcaaaacaaaaataagaaaaactgaggaaatacaaatcctttttccccctctgtcttcccttctctctgcctgtcctctgccaccccttcctccctcccaccccaaactaggtccagcatgccagcaaacagatcagtgcagagaagcagtacaaaggcatcattgattgtgtcgtgagaatccccaaggagcagggctttctctctttctggaggggtaacctggccaacgtgatccggtacttccccactcaagccctgaacttcgccttcaaagacaagtacaagcagatcttcctgggaggcgtggatcgccataagcagttctggcgctactttgctggtaacctggcctctggtggggcagctggggccacctccctctgcttcgtctacccgctggactttgctaggaccaggctggctgccgacgtgggcaagggatcttcccagcgagaattcaatgggctgggcgactgtctcaccaagatcttcaagtcggacggcctgaagggtctctaccagggtttcagtgtctctgtccagggcatcatcatctacagagctgcctacttcggagtctatgacactgccaagggtgagaggggggctttggggtggaaggtgtggggagggggttatggagagaggattctgtgtgatctacccttccatgatgacctttgtgtgttagttgcctttcctacctctgagctaacctgagttctgaggaggtaatgtgatgtggtttggataagttagtaggtaaaggagcctctgtctcccgtactggtaaatactgtggctttgagctactcaggaggcaaagcctccctctaacccaacacagctgctagtctctcagctgaactagaagcaagctctgtgtcaatagagctgtagcttctttggattaagggaaagcggcagccaactttgcctggttgcatgtaagggggcctcgggggaggagctggttcttgtggaagggcagggtatggcgttgggtccgtagccttgtcttccgttgacctgcttttgaagcacctgatagccatttgcttcttggctctgctcac

SEQ ID NO: 33583 - DNA, 1215 bp, Mus musculus
ctcacatggtggcacacacttgtaatcctactacttgggaggtagaaatgagaggatcaggagtgtaaggcctgtctcagccatgtagctagttcaaggctagcctgggctgcaagagaccctggtctcaaagcaaaaatcaaaaccaagtttaaaaaaaatatggattgaagtaaatggaaattagatttcttgttagcttttgattttcagtgactgactgtatctgaccttcagggaagatagctcctcaactgggctcaggcagccctggaaaggaataacgttctgggagacaacctatagtattaccagataatcccacaggcctgcggtgcagggaaagtaatgagccacttgtctgcattgtaggcctttctcatagcagttgtggtacccgacgttgagagcctaccgtcctgggcacagaagagaggcttacaagggtccttcgaagaactgtgcaggaacaaggtgagcctcagaagggccgcagccaccttccggctctccactcggtcctcagaacctgtagatgggagagaaaataatctgatttttttcctattaggatatcaataaagctatcctggacgacttgttgaaacttgggaaggaagccggtctgaagccatttgaacaggtatggctttgatcatgtgcacgaattcagtataggacagagtctgacttgaagattttttaagatatttgcttatgtattttatgcatttgcatgggtgcgtgcatgacagaagagggcatcagatcccattatagatggttatgagccaccgtgtgattgctggaaattgaactcagaactcaggaagaccagccagtgttcttaacccctgagctatctctacagccctgacttgaagatttttaacgagtagattttagaggttgaagagtggacctaaagaaatactaggaatagtttgatgtaaagggatttcttttaaagatttatttgtgtgtgtgtgtgtgtgtgtgtgtgtgtgtgtgtgtacatatgtgtacaagaatacaggtgccaaagggaacctcgtgttctggaggagcaggaagtgctcctgaccgctgaccatctctccagggcccgggttcttactcaataagccacttctctcttccctggggttaccacaccgtcctgaagtctgtcccaataggacccacatccactgcttgagaaaacatggtgaagtg

SEQ ID NO: 33584 - DNA, 2110 bp, Mus musculus
tttagacttcttagacaacgtctgtgtgtctgaccttgtgtgtcccttccacgttaacagccatgtttattcgcaggtcaaaggcattgctgtgcacccggaattattttctattgacaacggccttctgactccaacactgaaggcgaagaggccagagctacggaactatttcaggtcgcagatagatgaactgtacgccaccatcaagatctaacgtgaggaaggatacttagaagaaatggcgcatctccacaatcctcctcgtaccaatggccttcgagttggtaactttgcctgcagcgagtgtgggaaaggaaatgccctgccgccggacttgtccacggggtcttaccatagggatagtcgagggcacggaacactgccttacttacagtcacctgtgttgcagcccatgatcccggggacacacaatttccaaaacgagccttaaacattgtaaaggggaacccataaaagtgctaagttatttaagacttcttcaaccaataaggtggatgctacaagttctgtctcctgtttttctaactgaggggttaggacttattctttctgatatgtctgctgcttgctgcgcgttttgcagctgtctgctgctctgaagagcaccgtacactggaggaaagctgtccctttaagaacaactgtccaggctgaagaaagtcacagtggaccagaggttttccttttgaacccctcctcccccttgcccctttccctcaccacctcacatacagtacactcacatgacctttctggtttgtaagggttccacacggtccctgtttgcgcctgctggaacatgaggttttcagtaaactaaagagcagaccctcttcagaacatgtgggtgtccagtctcagaaagaaaaaaaaaatggcggctcactcaaacgttctcagactcctctccaaatctggtctcctgcctccctccccctcgtcccaggggttataagaaatcctgccttagactctgcaatgaagatggtatttcaaagaacgccctggagcggccatgctcaactgtgacatctccaccgctctccacctgctccctcgtggaagcagcccatgttggtaatggccactgggctccctcgtggaagcagcccatgttggtaacggccactgggctccctcgtggttttcctggcaaatgataatgcggtgattaccttgctttttttcccctcccagttaaactcaggcaaagcatgtcttcaaaactatgtagggagctgatatacatgggtacttattaaaatggacagtaacaagtaaatatccttattatacaactacctgatttatgtgaaatgcatttgacaagccaaaaatctgggatgaagaaatctgaggggaataaaatcataccctgggattcacttcccaaggtatatatattttttaagttaatttgggaaattaacagcatttcactttactgcaagtctttgccacatccgacctatccaagctgttgtttatacatttgaagccactgttgttggctgtgtgacagtgcgtgtgttattgaagcacaactgggtttgcactaaagaatcatcattgtaataacactatttggtagcctaacttcatactcgtattcttaattgcacaggaagtcgctaatttgtcacaacggggttttgaatgtttgctttcagtgttggctatttctatgttttataaaccaaaacagaatttccaaaaacaatgaaggaaaccaaaataaatatttctgcatttggagtgagtggagaatgtctttcaagtgccttgtgatgtttgggacagccaaagtgtgcgccctgaggaacagcagcctcctggggactctgcatggcttctttcctgttcctgatctctctgcagcccagtctttctatgacccttcagacactgtacattaccacttcaccagctcatctagtcacagcctcccaggcctctatgaagagcatcatggtagagactgtgtcttagagatgataaaggctctcttctctctcccttatcacagagctgatttgcttgaaatcgctgtttgtagtaattctctttcttgtttacagcagccttg

SEQ ID NO: 33585 - DNA, 1107 bp, Mus musculus
atcctgggaaggtgtcttgaccacatctccagcctctttatgagctgctcccaccccctgaacagttttatgtacaattttatcaaggtgtttttatttttcatagaggagtagagagtcaagtcattgagtcataaaatataaatctcccaatttcccaagtattgtaaacccctactgtatgctattttgtttaaaaaatggtactgaaaacagaaatagcaatgtcatggggacctgtgtaataaagtttaatgtggctgtaaagaggccccattgcagcacatgacaggtgcacccctgtcccaggaagcaagggggtgacacaggcagggccggcagactgccctggcgcaggaagaggcggttgtggctctagctgtgtttacactctggtggggctgcttttgttcagggtttcagagcctgggcctcgagccaggttacagatatcgagtgtataaactgacaatgtgcttgatattctagatggttctgaaagtatgcatatctggtgtctggaaggaaagagacagagtgacataacggagttggatgttattctgtctgtatttgagaaaaccttcctggagtataagtaagtcccttgatgttggcactggtgggcctggtcagctgtgctcggagtggcactgggtgggtccatccctgttcccgatgttgtcacgcgtcagatgattctgtgcgttcattagagtccctttgcgtacattaattatgctagtgcgagttgttggctcatctattctcgacttcctcgtagactttgatctagaagtgtgtttctccagtgctgttggtttttctcagtcaggtggtgtatggcaagtatggcccactccagtccctgttagctcccatgagagcagcgatggggaagagcccacggctgcatagcctgcgtcactcatggcagagagcagccgccacatcagggcttcactcttgtgctaggtacacacaccccttcagttgtctggtccagcctcgggtggggaaagttgaaaaaacagcccagtcagtcaggtttggcctatcttccaccagcacaaatctggctttgttctctccttttttttttttttt

SEQ ID NO: 33586 - DNA, 2040 bp, Mus musculus
caggttttggcccatctcctctcctctcagaacataactgctaataccacaccatgaggaactgctcgacaaagctctcacagatctctgtaccccaggtaagaccaattggctcaaagaactggcacctacctgactaaacatagcaagtcacgcctcaaacttggactagacaagtgtgttggtggagtgctgtgttaactcaatctcatctattttaaaacaaatttctaaagcaagtttccttttacttcaagaacgaatggaatgagaacaactggcctgttaaagtctataacaaaatcatctcaaagatctcaaaggtatcacgtaggaagtgaagttacctatggggccagttatgccttaaagcttgccaatctaaaggtctacacataaaattaaaatacaaagccaacctaaattacaacacagaacccaactcatgacttaacaaccaaaccaaacttcctgttgcaaactatctgaagaaaattaaattcctcctaagtaagttaccacacggttgacagcttgctgataaatgtgcttccacggtattttcctgtgatgagaactgagcagaaaagctgtttggcggtgggactgtttgctgccacacacataccatgttttcagagaagtcaacccaacacctgtaggatagcctacttgcaagacacccaagcacttgctctagatctaagagaagtgggaagagttcacttggagctgcaggtttcgttaggaagaggtgtgatatatcaagatgctacccacaggagaagtagggtccgtgctacaacagtagcagtgctataggcactgaaggtaagctgcctcgcctgtgaggccagtgtattctaaagtagattcgacagcttggtttctgggcctggggtagatcaggatctgcctagcatgtgcgaggagaaacaagatcttggcttaaccaaggattatgttcagactggctcaatgctacccttaactttcacagatctaataatcggatccctaaaataaacttgaggcacattttgaacatgtatattttagtagctctaatatatgaacagatcttcagtttaggaaaacttaaatcaatggcagaccataaaattgaatttagcggtgaagtagacaaaccttctcatagatacacgaagacatggtgtataactgtgtatcacattctacacacaattctattcataaaactcgatgtacaattctattagtacttttctaattctattaggtatacaaatttataattttttagctaacatttctatgttatattatggcaacagcaaggtctcagagtattaaacttcaaagtattaaaataatagctaactacattttcccaactgtcttactgtttctcagcccctcaggaccctcctgccatttcaatgaaacagcttctaaagtatgaacatgggctggacaaaggtggttggcctttacagcacgtctgagtgggctgaggactgatggaaactgataaagcagagcgcagttgttcaactcagacttgtgcacagtacacaccgcctagaagatctgaggagtaaccgagtcttccttcccttcagcaggaagctagaaggtgatgctgttgtctcactgacttacaataatgctgtccgttacctttctgcaaactgctgccactctacaagcaaatgcctggatcccttctgatgtgcagtaaccaggactcacctttcccgttccctttggtcctttctcttgaacgtttgaataatcttgacacagctgttttaaattagataagaaatgcttggacttcttaagtgatgactttctctccttaaggtcatcatattttgtttgtagttgtttcagttgtggttctaatctagataacaaaatttttttttaatctcaaaaacaaattttacaaaatacaaattaatagaaatatatgtggtgtttgtggactgaaaatattaaggtgcccacattataaaaaacaaaaacgcaaaccaaaaataacaaaacatttct

SEQ ID NO: 33587 - DNA, 1168 bp, Mus musculus
cggtttctagactgtagtggaaggagcacttgttcggcctgtaacaggtcaggtaccccatcatggcagtttgaaagactgtgctgatggttttacagtgaaaatgaaaataaaaaattaactctaaataacacatgacaaaaagtattaaaaattatcagaaaaattgatccagaaattcataaaataacctaaaaagaacataacctcattaataaatgcaaattgacggtggattgccacttgtctgcaggctggcgcctgcgctggcaaacctagtggcaggcgctcatcaacatctgtaccatctcaattctaggatttggtgaaacaatctgataatagctagtaatgaaaatgttactgatacgtcatggaaaaaactacttccatacattatgactttgaaagcaaaatgagcacattcaagtataataatggaagacttacgctaaaaccttcgcatcagtttgcccaaatatgtgtgacaatttttacctttagaaaaaaaaaatctcttattatatgtgtatgtactacaggcacacaggagctggtgaaagtcagaagagagcattagatcccctgggactggaatgggagccaccatgcgggtgccggggactggactcgattgttgtacaagtgccctaagtgccctgaagtttccatccagacaacccagttctgctttttatgtattttctactttttatttttatcactaaatgtgaatcatttggattaaatgttggcttagcaatctagtaatatccaaaactaaaattgtgtattccctctgactctgttgtacagacaggacagcaccttggtttactgtttatagcaaactgtaagaaaggtctttttacctaggactaaatttactccctagtggctcatgttatctgaggcactgaggtgggaagatcactaattaacatattcccaagtgaccacggagtgcctcacagtgtgctaaaggctatctagaggcaggagacagttcgtgattcatttatgctgtgtcccaaaacccaagaccaagagctatactcacatctttcagaagaaatagcagacttacttcagtgggtaatggggaacctgaatcaaaaacataaataaaaatatttttaggtggatatccgattttcactttgtggta

SEQ ID NO: 33588 - DNA, 1163 bp, Mus musculus
cagctgagcttgatgcccaggcttgagggcgggagttcagatcccgggaagccacataaacactgggtgcggctgtaacctcagtgtgggaagggagacacagggatgtcctaggaacttaacagccagccagcctaaagggctatagaggaagacactcaatgttagcctgcacatacatgcatggaagagggctcctgcacacacaaacacagtaaatacaatatacaggcacacatttttggaaaggcccaagtggtggcacacatggaatcccagtgctggatgtatggacaggtagacctttgggactcagcaaccagccagctctctagtttagtggcctctaggcccctgacaaaccctctgaaaaatctttgttctctgaccgccacacgtgtgcacctgcctacacgcgatacatcaatacatacactatacagatggacctctgagcaggaaaacaacaaaacaagacagggacagacagttctctaggaagatccagaagtgaaaagtaatatccactaaagtgatgtaggttcaaagtatgtaaggcagagtggactgcactgtagggaggacggatctacccacagaggtgagcagagagtaaggggagtgcgcagctacaaccaggatgtctgtacccgtttcctacccaaggggactggcgtggaaggaggcggggacggtggtaagattttaagagtctgaggtcaggaaagactgctcaaagtatggtcttctgggggccatcagactcgtgaactcagcagttgtggttgctggcacaaatttgtacaaggccaagctagtcagtgttcaatgatggagtgggaagaggtgcacgagcccccttccctagatgagaggtatggacaggctgcagcttctggaggagagaagagccagttagttgtctttaaggatatagctcttggtaggtcaactgcagtccagcagatgaaccaaaactcaatggaaacgtaggaaggtggagattgacctggtaggattggggcaggaattggcatggcttgtggttgattagaacatgccatgtgaggattaacatgggtaggaactcacagagcctgaggtagaatgtacgtagcctgcaaggacggcactagatgcaatcctggagctgaaaggagctg

SEQ ID NO: 33589 - DNA, 1759 bp, Mus musculus
ggtactatcatcctagatgaaattacaaagttgcccttttataattagcaagatttggcgatactatgaattttgaagtcattttgaagcagtacagcttttccactgatgattttatactccccactcatgttaagaatgttgttctagttttcgttaaacgtagaaacaataatgtcaaatgataatgtcttagaacttgaatccatgagcagagtcaaaggctggaacccttgttttggacctgatttatggaagtgaagagttggaccaccatagcatgcattatagctactggttttgtgacagttgtccacaacacgtatttgttattttaaaaaaaaaaatcatgttttattactggaacaaaaataacttgagtatttatgtgagaggaaaaccgtgtgcgaacttggttgactcattgaaggcaaggtgctaaaatccatcagcatttgtttcttacttatccttatacaaatcagctcggtcttacagaccagcaaaatatctcaagagctgttatgtaacagcctcaaatggttgattattagaatgaagtacaggaattctataggaatatactataataccagttgtcaaacagagcttaagaaaaggagagatgaaatctactgtagttggagagaatgtggtttgagccagagcagagacttggcagagccatgggcacatcttcagaaaaggcctgccagctggactccccacccctcaccccaccccccttgtgagttctggtttgtgtggatgatgtccaagttaccacgtgggaaagtgaaccagatcacaaacttctgcaaaaaggctttcccagagggctgagagtctgaagaaagttcactggactccatgtccagagtctgtagcatgctgacttttctgttgacgtttacaaagaaaggaaaaataatggtgatatttatactgtgctagaaacgaaagggccagggcacacaggacttggaaagcatccagcaatagccctgcagcccatgtggagaagctgcgggctgcagtccatcctcagggagactgtgctctgctcctggcctccttatgggggtgctgagtcactgctggctctcgcagcatttctcctaagcttccttgttgcacaaagaaaggaaggaactcacattgtaacggatagattcttgtttagactggctttgttgttaacgctttctaagtgaatgcagcatgtgatggtattttaaagtgtgttcccatgtgacaattttataaaagtttgttaccttgcaattttatttcaaaacataaattcagatttaaaattatcagtgtatttgagggtttgttgttgttgttgttgttgttgtcgtcgtcaatacttttgctgttgtaataactaagtgaaagttaaaataattttaacccacagtctaatttgagagagtcagaggatgcaacaaggccttaatctaatatgttaaggtgttggcaagtggaagaacctctgatatgataggatttaaacccaaagaaataggtagaatatactcaaagaatacaggaaggggtggggactcagctcctccaaagtttacataataaccacagcttctctaaagtgaaggtcaaaagtggatcaaggaactcctgtacacaaggaggagcgtgtcacgaatgtttttgtctagctgctttctaacaggggatagggtggtggagaaatgactcagcagttaagagcgtcggctgttcttcagaagaactg

SEQ ID NO: 33590 - DNA, 1630 bp, Mus musculus
ccttggcccgtgtttaaggcttggggaaattagaaacaagaaaaatgaatgcaaaagccatgggaggcattgtttttctttgggctagttaaacatggcggaaagggattgctattgtccgagctttgccaagaaatacaaaaagaatcagctgtcacctcatccttctggaagaaggttttatagtattaatgatacaagtgatattttcccatggagttttccttaggatacatttcatgaattatacacaggagacattttattattagatctcatgtgtttgcaaaaggtactggcttctccctgattgatgcccgtccccttggcttgcgtcagcaatgcagaggggctccgtggtgacggcttctatgatccatatgcctgtgtcgttattattgttgttcacaggcttaatggttgcaaaatttagaattcggcaaagctccaggggaaacgagcggtcttgtgattgtatacaggcagtcagaggcctttaacggctcattgctggcttcacttgtgaacacacacacccgtccgactaggaaaagggtatttccgagtgaggtaccaatggctctggaaaggcagaaatggaaggttagagccaggctggtccttgtgcacctgcctacctccctgtccaaaggctgaccttggtaccccccattcccctactcttgccccaaaagaggtaccacatctgagacctgagctcccctccaatcccagtcctctccagctccgggaccttcatcctatagaacattctagacagccctgacttcctttcctctgagagttaccctctctgcctccttgtctcctcctcccacctagatacctattccaccaccactgtttccacattggaagagcagaatactgtgtagtattgtgcacgcatgccagttaggagtagagctgccctagagtcacttcatgtaagtgtcaacaggtacaaatgtaaagtccttagagcagtgacacctgtactctctggaagagaattcaatttgaccctccaagttccaagggatcatggctctgcaggtgtctttctctgcgtggctgactgtgacgattacattagggtcaatgagctaagaagtacatgtgggattcactatgttaggaaggagttttgcagccaagactgccttgaataaaaaatgtttttgcactgaaaaaaaaaaaactttaaatgacttggtctctggttgctgtaaaggtcatccaagatggatgttctgtttatattgtatagtatttcataagaaataactgcagttcatgaaacgtcttccctactgttactgatttctaacagcacatttgtaacatggtttttatcgtgtccgtgtaccatattgtaaatgatgattccttgtcatccttagtacaataagttaaaaggaaaaaaaaaaggacagggatttttgtaagtctatatttgaaagtccctccatatggtaatattgtgttcatgttgtatatgtagtgttgtgtgaaatatccattttggattgtgttactttttaagatattaaataacatttggttatatgtgtaagtggattttttttcttttttgatactcgagagataaattatttagaggaggcca

SEQ ID NO: 33591 - DNA, 4775 bp, Mus musculus
gagctgcagttgatatctcacatgagtctcagagcccgggctggatgaacacaggcagataatcacggaaatgcacattgatatgacatcacgaaccaacagaggaagtccattagccccatcacttggtcttccttcaggggctcaacatataattgtttatattcaaagccaaaccaaaaccaaccctttttactcttttagcactcgggagagcctggcttccaacacatcaagcattgttgaaagcaaccgccgtcagaatcctgctttgagtccagcccatggcggagctggtccaaccttcaacttccgcgccagtacggatcccccgaccagcgaagctgagaaattacagaaaccttccaactgcttgcaagcttctgttactagtgtatgattgtccttctgcctcagatcttctgtctcatccgatacagcaacgtttacgacgattgggcctgatgtttacatctctgcaaagacaaacatctcaagcacaggttgggggttacttgagctgtgctgctaagtaggctagggcaaaaaaaaaaaatcttcattttggagtattgcttttcacatgtatggctctgtagcaaccgaatagcagtaggggagatgtgcacacttctgctcccgcgtcactaactgtatctgagcacacataggaaagtctacacactgtaagtggaacatgtgtttttcaatgtcatacagttgccaatttccattctgaaatgccacagagttgtgttgctcccagccggcctatagggaatggggccacggaactaatccttgatagccccacctccctcaaaaaaaaaaaaaaaaagctgccacaaaatgtaaatgtaggggtgtccattgtgaaaaaaaatcaatgccaaactgggcagaagggaccccagccctttgtgtgtgagtcctttaaaataccagtcatttttcactgtgagttttcacaacactcttgcgggaggagcccatgagagtgggtcagaggtcccaatggatggacgtagttagagtgtttgttttcgctcttttccagctcacttgatgcttgtcttgagtattttttttttaaccttccctaatcacagtccggaatataggcctttgaagtggacaaaggaagggaaatgcagtctcacagaggggggcaggggcacagcactgagtgctggaggagggtgcgtggatgacccggagggatgaatcagatactggagcaggatacctgcctccttgagacacttaggatgagcgagcttactatactagatgcagtgattagtttgttgggaaacaaaatgttctttatgatacaaatgaagaatgtggcctgagggtgttattctttctaatggaagggacataaatctattttatgtagttttaaatagaatgcctaaattaggctgtgggagatgatttttagtggttgtaagaaagagcaaatttagggagcgttgaacttcaggccttttattcctgggaagatatctatagagacaaacatttaaagtaatttttgattagaaatatacatgggcccttataatggacagtagaatgtcctcattctgctggtgtggtatattcttaatttgtactcccctaaaatgtatcagaatgacaattatgcattcatgaactatgccagagtaatgtttacagatactttgtaatgacttcaggaggcacgttcgggggggattgtgtggcagttccctcatcttttacagtggtttctccacactctggtttatgacgccatgctcagtatcaaaaggcttggcaggagggggcccactaaccattgctcttcagtcctacaggaaaggcgcttctgccaaagtccctgttttctgagaagcactgcatacatctgtaggtactggaaatccatctgcaccagggttagatctaatcccaggaaaatgaccagagataaagttatattcagtttagtgtcagatgagttttggagccatataccataatgaattcataaaaatcaatataaaatattttcactcaagattctggtaacgagcatatgtttgtgagctacttctttttctgtgtcagacttagtcacgagcaatgtgtttaaggggacacagttatatgaagtaggtggaaacacatatactcatatttggtctgctatttggaagttgtgttgggtcaaactgggctccttaagtttggtatacatttctttttttgtgcttattgtaatgaagcttaagcaagattctcaatataccgcttcattgttgaaatgctttaaggcaattggctttgaatctcatactttacttcctcccaggcatgcctcagttgtccagaaacacactgtttatcttatcgcttaagtcatgtccagaaagagcaaccatgtatcttatatactatgtagtctgtttgcttaaggagccatataccatatgattcctagatctggtctaaattaatcccccatgcccccgaaaaaaaccaacctgctctgaaacttttggcatactcaagtcataaataataggaccattaaaacaatacattagtctctgaccctctgaacgtagccattggaagaaccgagtgccctgtgaacaggagaggacgtaactacgtttaagtgaagctttaaaatacgaatttttgatagttcacaagaaacaggtttacagaaggcgttattcaaacaaaatgtgtacactatttgcctaatcattatggagtacatgatttaaaaataaataaacaaaagaacctcccttagaccagcagccattagcatagcaagatgggctttaaagatgatataccacacaaacagacatgccgtggagaaacactcctgtcagaatctaacctggattcttgaatagaggaagcattggtggtgggaagcacatggcagataggatatgcgcatgtgtctaagatggtctcatcaagatggtgagactcttgactctcacggcctcgggctgaggccctctctgggctttgccaagattattctccactggaaccacagctttgtgttccatgacgacatgtctagtttttagagtttatcaacagaaaagtttacaaaactgagtctggttgaatctctgtgaggcattcaactttaaagggtcaacacatctgtcggcattttgcacacttatatattattatgatacaacatattactttatggtaatttttattttttacatataactacctccatgaatctgatgaaatggcagcggtgtgttaaagtgtgttcttaagacaaaaaaagcaatgtttcaaacgcttttcagcagtaggccatggtgttgcatgtgtgtcggtgacttacccattggactcatgacttttttgttgccatggttttctttcacaacatcctttggcttccaactgtaagcctgttgttccccttcctttctcccttctcccccatgaaagcacatctgatttgttacaaatgaatgaacattttaaaattactgtcttccccgcttctctacttctgttattagagagagagagaaaaaagttctctttggcaaagagccacttggtaaacatttaggaagttattaattcctatagcaattgaattggattgctagtgccccccccctccagtaagaaaagacatgagaactttgaagcactttgggcctctctgcttttatcatatgctaccctatggagcccaaacttccttcttattaaaagaactgtgccgtgcattctgggatgtctgttaagcaatttatctaccgtttgatatatcttacacatctcaggagaccttaatgagtgcaaaaataggatgtgtgcacacccaatagggaaaaccaataggaaagaagaaatgagagcagccaggtagaaataagaaatgcctgtgttttatatgttggagaattcacattcaggaaacacaagtggaaagggaatgtggaggagcagtgatttaaacaccagctgttcctaaatgtctctttctgaaaacgttacaatgtacaatgaaattctattgtggctgccaccaagacaggaagggggtggggggtggggggtgtacctagaggaacacccttcctcttttaggttaagatagctttgtccagtcctacctaggattaatcccttgtcaccacaaagtgtacttgaaggcaaagcttgtgatgtcagtgatgggcacagttctcaccaggccatttgggagaggtagcattctgagcttgtgctaacaaccagtgactggtaaagttccgcagctcaactgggcagctcaaaatgcttctgaagcgttagctgcacaatggcagagcaggtcctgtgggtcacacgcatgcttgacaggagcagacaaacggagtgactcaagatcccccagaaacacagtggcagctctctctctctctctctcctctctctctctctcaatgacctattttctatctgtttgataggccatggtgagacatcactaaaatgctatttttatgatgtgtgctaataaagaaaacaaatgcagcttgacaccttgtccatttcattcaaagaggtatgggtgtttggaatctcaacacctcagcacccctttactggtattgagttaggaagtgcgagatgaacaagtccacaccaataccactgtcgtcaaaggccagtccagacatccacctttgtttacagtttctcgttgggttcctgtcatttctgtgataaccccatcttcagga

SEQ ID NO: 33592 - DNA, 1173 bp, Mus musculus
cgtcccctttagggaagaataaggaggaccatgacactttgaccttggtggagggggtaaaaaagctgtctccatctgagaggcagaccccccattcttccagggaacctgttgggcacaaggaggagtcaccgaaagggccaggagggggccctgcagcctctggtggtgtggcagaggggttagccaatggccgccttgtccaacatcatagcgcagaacccagcagcctggacaaaaggaaagaaatattcagcaaagacacactgttcaaacctctacacagcaccctgtctgtaaacagctatcacaaatctagcttgtccctcctcaagtctcacccaaagtcacccgttgacacactgccaggccgttgtgagaaactggaaccttcccttgggacatccgcggcccaagccatgcctccatcccaacgtcagcaggagcctggagggaaccaggaggcttcttttgactattacaacgtctctgatgacgacgactccgaggagggggccaacaaaaacgcggaggaggagaaaaacagagatgatgtgggcaccatgcagtggctcctggagagggagaaggaaagagacttgcagaggaagtttgagaaaaacctcaccctcctcaccccaaaagaaactgatagcagcagcaaccagagagccacccactcagcccggctggacagcatggatagcagcagcatcacggtggacagtggattcaactccccacggtagggagagctggcctcctgtatacacatacacccgccagggcccggggctttatgccagagagctggcttcacagtctgggactgtgaacgagggctgtgagttgtgtgacctgtgttgttaacagcctgttttctaacttctttttcaggaattgaaaccaaaaaaatgtttctgcagctgtagagatcactaatctggactggtgggttggttccttccctaaagattgcatcagagtctgatctgagaccaacacatcccaatggttttcttctatttgtattgacaaccaggagaagggatttttttaagtccttcaaaaaaaaaaaaaaaagtaatgttctgagtatgatgaatatagtcagtgcgaggaaagtggtagagagcagtttggtgccaggataatggctgccccctttactgt

SEQ ID NO: 33593 - DNA, 1167 bp, Mus musculus
ttgaaaacatggaaataataatggtacctgctcatcgggtattgggtgaattatgtgaattcatatgcatgaagcccttagaaaccaagtctgattccttaaaggtatggatctgctattgtttattattgtttcttaaagagccattgctgacctgtgttgctcgtaactaagaatcccatccagttagagttaggcagtagcgtcagtagttgtcacttcactttaaactctaagaattgttctaaagaaagaattacatggaaactatacaacaaatacaattttggtttttactttgcaacaatgttgctcttatttttggaaccgttccaggcttttgttccgtgtctggtgatagcccctcctgcttctcatgtgacttcttggtgctttggatttttctagagcagtggctctcaacctgtgggtcaagacccctctgggggttgaacaaccctgtcacgggggttgcatatcagacatcctgcatatcagatatgtacatttcatagcagtagcaaattacaattatgaagtgacaaaaaaataatctttatggttgggagtcacctcaacaaatggaacttgattaaagggccacgtcatttggaaagtcgagaaccactgtcctagaggaagcctgattgtttttgaagtgctagtttgtgttcccatagtatccttgtacatctatgtgagcattatatattgggtcatcgttttcctgtgtgacccctctattttaggtttagaaccttagaagctaatagtttacatgtataagtaggaagacacacagtctctttcagattcctggcagtcacagtatggacttgggagtccaaatctctctttaacctgaggcacagttagcaaccaggagtggtgtgaagaccttgctgtgtaattgtaggtatttgtcaccccgctgcagtctctgagcctaacgggcaaacagggaagatggagccgtgtctatggtccctaggctgtactggtggagcctctgtttgtggaaaaagcaagcaagcaagcaaacacacaaaaaaccaatccaatatagatcttttggcaacgttgtaaaccaaactcatcttcttgactccaccaactgcctaaaagaaaacatcctttcagattagatgctcatatctgtgactgtaa

SEQ ID NO: 33594 - DNA, 1200 bp, Mus musculus
ttggagagactttttagaaatccctccagaaaatatgaaaattaagggaaataatttaaaaaaatatttgggaaatgaggaaaaccccaggacattttaaaagaaatacacgctgatagctatcctgggtttagtgcagctatctagcacacagtaggagcttcaagtagagatataggcctttataagttttagcgaggcagccccatttctaacatgtagtagtaagtagtcaccagtgtcgaatgtgatttatagcagtgggcttgacctttggccttgttcttttctgctcccttcaggagaaaaaaatgtaggcttccaaggtcagagcagacacatagagtgctgatcaggtcctgcaaggagacagctgcatagaaaactgaacctttcggtcatgaagacgatgccttctttcagtgtctcttttcagttatcaaacctaaagtaatcctgagagtccccagcctcctagcaaccagggagttctcggggccgcagaagagttcactgttcctcttccatattcattaccccacagtgccttctgggcaggagtgggggaatcttgccttttgttcaaaccaagttgaatataaaaaacgtgcacagcatcccaagaggagagaaggttggggcaaatggcggtgggaccattctgcctcatttttctatcactggatagaaatggtggcattaattagagagcggagtcaaactccccaagagaaaggaactctgtaatatccagagaacactggcagccgcgatcctgggccactgcgaaatgattggagggctttaagcggttcgtgggcaaagtctttagagcctgccctgttcttgtgtgtgagcatcctttgaaacatcattcataggatgccaagcctccgagggtagctggtgcttcatattccctgtataatgctgccgggattttggtgggggagtctcccatcgatcaagatggcaagttaacttttctagtcttcagcctctactgagcatgcccgtaaaagacttggcacgtgcatgagaaagcaggatggtgaccacaaattttaggtcaattcttgcgtttttttttaaagtaatgcctttaaggaagaaagtcaatatgtttcattctatggctctaaggaatttgaaaagaaagacaaaataaaagcctaaaacgacatccgcaaacatgaagat

SEQ ID NO: 33595 - DNA, 1203 bp, Mus musculus
ttgctctgcggaaccggcctttgcggttgttttcatacctggtggaaatgatttcacctggggttggaagtggttacataggttagttatcatctaagctccctgacttgaactctatttccgttatttgttgaattttgattctcattagaaacaatgacttaaatactgcagatgtctccacttaatacttgtgtcttttttttttttttatcagttaagcaaaactggctctaaagatgatgagtagcaagcacctgccgcccaagcaagagcagcctttgaaaagcggcctggttcagcatctctccttacttttttctctgttactgagtggctttttacaggacatgttcttttgtgagtgtcttgaaaaacacacaagtggaaagtcaatgacgaggtttggctgtagtaaattattttcacaaacttgccttaataaaaggtcaaagtgtaacttgttcagagtactttctgaagctcctgagcatcatggccggtggatggctccacagagggaagtcagtggtaacttaaccatctgggccaagcgatgtgatcatttttaaaggccaacaaagccgtgtttgaactctcagttcagaagagcccagtgctgagtctctggcattcctcgaacgacccgtaatgatgagcgtcacctccttttacttagataacaaagcgtaagttgcttcagagtatctgagtactggagttgggctttatatgattctctgtgtagttcctcttcattttcagcaggaaactgcttctccttaataaattgataactgtttatgcttttctctcggactggatgccggtgtgtgatcatgaatgctttcagttatgtgaataataaaagaatataagaagaaaagtgaggggccggagaagtggctcagtcagtaaaggtttgctgtgcaagcctgaggtcctgagttcagatccccaacagccacataaaaagcggggcatgacctgagacgcagagctggggaggcagagacaggaggattccccagcttgctgccctgacagtctggctgagtcactgagcacctggttcaggtagagagcaatagaggaagatgtagaacataaatctctggcctcaacaggcaagcacatgtgcatacacccgtttgcacacacatacaaataccaggtacacttgcatgcatgaccgtacaccga

SEQ ID NO: 33596 - DNA, 1206 bp, Mus musculus
accacatgtcatgctaactactattcgtgtgtatgtgtgtgcgtgtgtatgtgtgtgtgttccttaaatctgaggtagctcaagagatattcagggggttaagagcagcctttgatggtcttccagaggctctgggtttattcccagtaccaacatggctgctcacagctgtctgtaattccagttccagggcatctgatgccaacactcacacagccttaaatgcatatatatatatatatatatatatatatatatgcaaacaaaacccttttttttgagttttgttttcctctctccctctctcgagtgactttggtgtgccacatgaagcgattcccacggtcagctttgactggcctgccatgatctttccctgctggcacttgcctttagaggagtcccctcttccaaagatgctttctccgtctccagagttggaatacccgtgttcgtcacatggctctgtcctcctgctctgccaagtcttccttctgtcccaaggactgaggtgtactaggctaagccttcagaacagtctaggatcctaggaaatgacacactttctgatggctctgatgactgccagaggcctagcagcagcctagctctcacatctaggttcacacggtcagctgccttcccgccttggtccttccttatggcaacgggacatttcacacctaacacaggtttttataccctccttagtcagacccctgcgcttttcctgtcttctcctttatggagaatgacaattccaccttttgtttctcaggctaaaatttatgacgtcatcttcgactcttcccttttagggtcccaaaccatcttgctctgtgagctcatcaaaatatatccagcagcctgccattctctcctcccctcatcaaggccaccaccagccacctctgggacgactgtcaaaagagcctgctgaccaatcttttctacgttcacttaattttgtatgattattgcctccaaactggctaaacagattcagccaaatcagtctttcctctttttaatttcctgcagtggcttcttatgtaaaacctacaggtcttgtgatggcctaaacaggactctcttagttaggcctcaagcctcaacttcgagtactctcctttccccactcgattccagccacactggccaacctgtgccccaccctgtgcatttccagggttctccagccaccgg

SEQ ID NO: 33597 - DNA, 1194 bp, Mus musculus
ttcaaggttgaacaatttaaaggtgtgtcttaatattttctatgtgacccactgctgggatgtttagccacagacccgtcagtgggaaaagggcatagattagtctttaaataatgccttttctgtcaaacagttattttaaatagttcttttctgggggctagagtttatttttaccccccaatgagtaattatacattattttaaataatagtatatttaccttaacctcctggtattggtgctgtttgatgttttcatgtttattgaactaatttcattataataatacgattaataatgtatttgtaaattgaattttccaagattttgatattttaaggttaagcatcttggtggagctgtgaccatgtgtgggagcagtttttggttatggagagcagcagacggactagtcctttaacctctcatgcagcttctgtcttagttgtcatcttttcttcctaatctgataatcttggttcttgttgattaacatgtgaaaaatcctatctgcttgtttggaaaaaaaaaaaaagaaagatgtttttttcctcttcaagctctctgtgtgacttaggccctgtcatttcaccttacctgaatgttgggtgatggatcaacctagaaaatgagttggcttaaccatctgcaagggccttttgaaatttcagtgttgtgccgtggtgaacgattttaacaatgaaatggcttgcttttctctttcattaatgtcctccatcctgaggtatgatgacagttttaagggcgagcttagaggcgggtaaatgaacattgttttatttccattccagggtattgtgcttggtgactatcatctttcttcttagtaagaaatattaggtagtatggtatttatttttactataactttgttgtgttgtaaagaaacccatttccctcttgaatgtagctcttttactgatgccatttataatgtagtcagtagcatcaaagctctccaaagctttgaggtctgactatggagaacttaattcatactgtgtgacagagatccccaaacttacctcataatggaattaccttagtttgaaagcattggtacgtgggccccaacccagcaattgagatacagaattcatttggaatatgacttaagcattagacttttttaaaaggtccccattctaatatatagaaaagttttgaaac

SEQ ID NO: 33598 - DNA, 1760 bp, Mus musculus
actgaaagaactggcagatctgcctcaaaataagagctctcaagaaagtattgtctgtgaattgaggtgtaagtcggtatatttgggcactggctgtggaaaaagcaaagaaaacgcaaaagccgtcgcatcgagagaagcactgaagttatttctcaagaagaaggtggtggtgaagatctgtaagaggaagtaccgaggcagcgagatcgaggatctagtactcctggatgaagaagcaagacccgtaaacttacctccagcactgaaacatcctcaagaattactgtaacttctccaagtaggcactgaatccagtatctggtgtttgaagagaaaaactggcttttatataagacactggctttcacagattttatattgcttttttccagttttgcagaaaatttaaattctcgttctcttcactaaagtagagctgtaaataatttatgacagtgcatattaaagggtgtacattgacagcataccagcgtgctgttttatttgctgaagaaaatactatcttctatttttaatgatatattaggtacgatgtgtagttctgtagaatcttaaaatttttgtactactactaccaatttggtagaaatgtattaagttgtctaccatgccttttttttttttttttcctaacttgattgaatcacataaaagaagggggaccacagtatttgaatgtgtgaaactatacaacctaaggtttaaaaatgttgctcatgatgctgaacagctcttaaagaacaagaagagttgtctcaaactattttcatgaaaagctgtaaacttttttttagatataaagcagtataaagtacttattgttattttattctaaagttgtttaaaattcaccatgattttgacggctgcagattcttaagcaggttaatttatgttttgaggtaaatttcaatttacactttattaagacataatgttggtttctataggaagcatattttgtgactactatgaacagactgatttgtttagatattaaatgctttaagctattttaccttttcaagaagttgtgtttttttttctcctaccctggtcataactaaggctcctcactactattcaaactacaaccaagtagttttcatagtataaaacatattcttataaatagggaagtttatatctagaaccgggtggtttttgtatttgtagatttcagaagaatatggagaagactagagagctatggtcagttctttaatgactgtgtattcatgtggattgcatctgttagtaatatagtagaatcttgtttctgtgtcttaggtaattctattaatctgacatggtttattttaaaagtcttgtctaaggtatatgacttttggccttctggctttctaggaactgcacactggacaataatggagataatatatgtagaaaaagacctttcatatttactagttatattggtattggaaggttgaacataagcacaatttaagtgtgtaaaaattagtttgtagtttaggaataataaagacacttaatgtactgagtttaaactgaaataatcagggatgtttgtattttgccagataacatttttaaattatttgtttttttttttgttttttttttttttttgagaatagctcattggataccagagcaaaatctatattctgtaaatggtctgactgcccttatatagtgtggaaaacactaacataagtgagttgtaaaaaacactgtcaagtttcttctgt

SEQ ID NO: 33599 - DNA, 2586 bp, Mus musculus
tgtgaccctgcctgtggcttagcaccgcctctcagctgctcacttgccaagggaggggcaaagactgaatatttactttttttgttgttttcatttttgtttcattttgggggcggggcttgtgtttcctgtaatataactcaactcttgaagagcttccgtttcataccagtttcatcaggtttatttgtaaagtactttgaatgtaactcttacatgctttgagaagaaaaaaaaaatcacataacaaaactggggtaatctggtccaaatctggtccacaagtgttgtacagtatgcatgtgttaccgctgggcttcgctgcaggctggactcaggtaacatgtgcccggtgtctgcccgctgagccgactgcagcaggcagctgtctagctgcccgggagactggtgccacagcatacctttgaactagagagccacactctccatccaagtgagcatctctgagcccacctggaacacctgcccggttccttccatcacccacgtctgaccaccttttctctgcaaaaccctttctttctgccctcttaaacttgtctggagaaaacaagagtgtgaaagccgagggcagaaatagagaagcagaggtgtactcctgctgtagaaagctgcggtcgggggcagaaagaaaactgtggggaggggaggcagctttcaaaacccctgagaagactgcagatgcttgcctggccactgcttctatcacagtctgcatctgcagggcaaggtggccccggcctctgatgacgctgcaggcagtgcagagggggcacgcctctatccattagaggagagctgaggtcggggcgcatcataatgagatcaaacttgccaaacagaagagagtttgttaccaggtttctacactcactaggaagtattttgtagctgtcatcttcctagagattctgtccgggagattctgtcagggatgcataaaaggtagttgaatgcagaagcaaagggtgtggactggatcattttatatctatcttctggatgaacaagcaagcttgacctagaaattggtcaaagagccgtgttcttcaagctgggttttaacttaccagaccccgggcacttccttaaaaaaaaaaaaaaaaagactcggtttagcctagccagcataaacatgttaaaataaatactttttcaggtaatttaaaccacactcacgtactctgtcatactggaagaagccgtgttttggtgagccatcttatatagcaagctaaattatttttatttttttaatgcaaaataattttataggaattaatagaagaaaggcgaaggggaaaatctgttttaaaaaagttacattctgctggaatccccattagtaaggatttttattttcttgaatctatgtatattttagaaagttcatttttatcagaatcaaagttcgtactcagccagaattttaattatcaagtgactgcacctaaaatgtaatcatttccccctaaacattccacaacgtgtaccccgcttctcacaaggtgtaactggataggacactacttggaactacaagaagcctggtggtgggctgagcacagacctcccacgctgcccagcgccctgtaggtaactggaggaaggccatgctgtccacccttcctggccaggatccagttgagcagcagaggttgactaaatgaaggtgccgtcttcagcatcatagtttgaccagtgaaaatgttcatagaattttgtgtagttgtaccgtacgattttatcttcttcatttatttatttacggtcttatttatgttctgtttaatatatagtttggttctggccatcttaaatgttgggcttacaagaggctatattgaagtatttacagctatatgatcttcatcagatttatcgctaactttttgtaatacaaaaagtgtcagactacgagtattaaagaataaagtgtgtctcaggctggtagctcagagctgtgactgagggacttcggttttattttataaaacatgctcatttctaacatgagagaaactattctggtagaatcctttctccactctgaaagtcagcagtcatgttgtgcttatacaggccgctttctgtaggtctgtctgtcacatttgtattgacccaaatgatttttaaaaaaagttttttttttactaacttgatcacaaaaccatatggatgaataaaaaatttaatattattaaaaatatttttaaacttagaatttattctgcatagggtaaaaagagtttaatctttagctctcaagtttggattatcagtatattacatttttgtctatcagactcaagtgttacaggtacaaggaggatattaacttgccaaataacaaagtttagctgagtctctgtagcatacaaattacatacatttaaaatctttttgctatgtatttatattgtattaaatatgagaagctcaggactcaaacatttaatcaggttacattctggaaatgtttctgttttcatttgtcctgtttgtaatggtgtgtaaatacatcgcccatattaactcctgttgctgcacttgccccgtgtctgt

SEQ ID NO: 33600 - DNA, 1099 bp, Mus musculus
taaggggagggtggatacagagaaagttcctgtgtgagggtcttgaggtctacatgcgtgttattgcttagtaggttggttgtacaccaatgaaggtctttaattggctatgttacataggaactcggggccaggaaggtagaaagagttgacagtgtatttgccaaaacgttacccattcactttcttggaaagaacgctagttttcaggtttatgtttcgttcattgtttaggttttgttattgctattttggtttggtttttttggttttgagagttcttaggctttccagatgtaaaaatcttaaacgtgattaaaatgaactcaccctggatcaggcgtgcctcctccctttggcatgagctgagtgcgtgggctctgtcccctactgcccagcagaggacacccttgactgcccagcttggccctgtggtgtgccttcaggtttcaatctgtttttcctttaccaggctgaacagacgaaagaggagcagaagcaagacttgaacgcagagaggttgatgaggcaggtctccaaggatgtgtgccgactgcgggagcagagccagaaggagcctcggcaggtgcagtccttcaggtaaacacccactgggaggctccaggcattacagcgtctgtcagtcagtctgtctcctcaggattcagagccaccaccaccctccacccttaccgtccaccaggagcacatctcattgagaaaccttgtccctggatttagaaatgtacacaagcatcacagatctttggggactttattcactcatttcctagacattccttgaatatccttctctctctctctctcgtctcccaccttgcactgtgctgatccctacagtacagcaagagaacgcacacttcctgctcccacagagggcctccaatctgagagttccacagccactggagctccatatggagcctttatgggcaaggcaggaattccaagagcatataatataggaagaatctagtctgtgtgggcctctgtgcaggctccaggtcagctcaaaggaaggcatcattggaggtctccaggctgaggtgggtgtgagccacccagccgggctgtgtgt

SEQ ID NO: 33601 - DNA, 1175 bp, Mus musculus
gtgctcttaaccaccgagtgagccggctctctggccatgtggtcacgtcctcatcacgtgtcacattcaagccacgagcatgtgaggccgtcagtcacctgatagttcacacagctctgtgcctgcctgacagtgaacagttagtaacaggcaatcctcatgtcttagctaagaatagtcaactgttttatgactaattctacagtgaactgaataatatcaagttactttatagtgactatcatgtttttacatgctgaagttaaaacttgtctgtggtccttggacatttctgttgaatatcaggagacttggctaagtttcataaacttaatatttttgtagtggtgattttgctctggattcctgaaacaatcttttttcttgatctacttagttaaagagcttcctgctgtcacagcgtgtctttagtcacatgtgtgactcagtttcccctcaggtaaatgggtcaccagcttactcacacagcatggagcaggcctgccacactgacagtgactgttttcttctgtttcaccatagcctaacgatgctaagagaggcctctgacgaacctgcggctttgagagagtctggggttcccttggcagagggcagccgctgcacagaggacccgaagccatgccctagggggcctgagacaagccagtgtaggaaggagcctgctgaagaccctggtcagctgccatctggacttcccaccctggtaaacgttcgcttcagcctgctaaaacaaagcccctgtagacgccacccaaggggttacttgtttcctctcctacatcaggattggggctccaaagctgactgaaggctttcgtggaaatatcactactcagcgtcaaaagtactttacagtttcaaatgccaggaaattaatctttcctttatacttggcaaaaacagcactcgctccttgatatctctaaatgttctgtgaatgcttgttaaaagtattgtctgggactagagatgtagctgaactggtgcaatactcacagcactaggttcagtccccagcaccatacagatagccacagtgggcacgccgatgtatttctggcacttagaagatacagtgagaggacctcagtttataggctgtctgacatacaaggccctatctccaaaacaaccaatcaaccaataaccaa

SEQ ID NO: 33602 - DNA, 1200 bp, Mus musculus
gtgctgccacctctgagcatcagtcatcacattgagagtgcagggaatacatatggaccatatgcaaactatagagatccctagtgaataagggtcacttaaggaagtgttgaaaaataagaatcgaacatactgcattacattcaaggccaaagactagagagagttgggcggttgagttctggctgctcttgcagaggtccgtccactttcagatcagacatcttcttgtggcctccataggcacttgcatatatgtggctcgtgcacacgtgcacaaaaatgcacatacagtaaataaaaacaaagctagagtctagcatccacaggagaagggaggccatctcctgaatcagctctcatatactgccaaaatcatgtgcttgtgcaaaacttataaagtcactgctgtcatcaggacggctgctgccattcagtgacactggaaacgggctgcccgctgcctttatacttagaaggtgctgtgtgctttttgacagagtcttgctaagctgcaggagcgatttcatttggatcaaaacatgggcagttccgagccagatctgagatctagtcctgtgaattctcatctctctctgtccagacagacccttgacgctgggtcacagacaagcatttctggagatgtaagtagtcagagggcatcggctgccccagtgctgtccctgatgccccaagggaggacggggtggagggggtggaagggtgggagtgggggatgggttaggcggtgtgggcaggtgggtcgggcgttggtagtgatggggtggggggtgaggtggtgtagggtaggtggtgggggttgatagtgacgggggtggggctcatggctggagcaggagctagagcatgctccactctgcagatgcatgttaaaagtcacagcttcgtcttttcctgtgaaagttccaagggcatgtagttggagctttctctggctgcatttacaggtagatgctactgaaaagctagaactaaaaccacatttaactggagtcacttcacatgaacactagggaaataagaagcagaaaaggttaaagctagccaggaggggctggagagcggtgcagcctgtaagaggtgtttgttctgcctgcaggtcccagcacccatgtcagacagctcaccaccaccacctccgactccagccccaggaatctaatacacacacacaca

SEQ ID NO: 33603 - DNA, 1180 bp, Mus musculus
cattcttaaggttttttgctgtttgtttattgctgtgaatttgtggaccagagatggtctgtggcctaggctaggagtagtgctcaggtagagggtacaaggatgagtgagactcctgtgttagatcagtgcgagtgtggccttcagagggccacttggctcagagtatccccggccctggatgctgatgataatttggatcttgtttttgggagtactggggagtcagagaattcgaaaaagggtgacgcctgtgtgacgggcttagagttgccgtacactgttgtcaaggactgtagacgaaggggcaagggatggcttcggagtgaataaagaaaagagccacacccaagttttagaccagtcacttcttaggcgtttccagcaggtgctttagaggacacaaggatcccagctggccagtccctcgctgagtgaccccacggacataatgaaaccccaacacaaatccactgctgtcttttcagaaaccacacagattgaggatccgaggaaacagtggcggggcgagcaggagaagatgctcaaggactatctctccgtggcccaggacgcactcaggacgcagaaggagctgtaccacgtgaaggaacagaggctggcgctggccctcgatgaatatgtgcggttaaatgatgcctacaaagaaaaatcaagctctcataccagccgtgagtacggttcatactccacagctgaagctgggatggagaggtgacagtcactcacactcctgtggttagattttgagccctttccctcctaggcaagagctcctccatgctatggagatgaggggcggggcacctgggaagtgccccaccccactcgaggtgcaagctccccatttgggcttggacaaaccttcttttttcctgatacttctgcctggctgccttttgtttatgagtaaatgtctgtcagaacaagcaaaggaggccagaggtatctgatcccctagagcccgagtctcgatggttctgaactgcccagtttgggtgctcagaactgaactcagaaacctttgtgagcacaaacaccctttgcagcccaaatttgagtcatttaaaggggacgctcaatcactgttgttacagggagggtctgggactgttggaacttacccttcagtctcttcattcatgtgtcagtcatctgg

SEQ ID NO: 33604 - DNA, 1228 bp, Mus musculus
ctgtctcagcagcacttttaaaagcccaatcccacattacttaatgtgacagactggagacatttgcctaacttgtcaagttcctataaagccaacgctttctcctggacactaacgtgcacttcagagcagggtaattaaaggatggttgttttctttggaaaacagtctccaatgatttagagaatagtagggttgttgggccaattgaacataaagctgaagctgaaataatgccaagaggacgaacgttccaaatgctcattagcctaaaactgcaaaggcattcgatgaatggttgctgtgccctggtcaggttccttctagaaaacacccccaatctgtctgtcatctggctgtaaaacagctcgaggatgaagatctgtacctaccgactccacgactcaacgggggaccaccttccaggccagcccagcctccaggaggctcagagtgcagagagcactcagcagcctacatcctgtggtgggcagggctggagaggagaccagccttgggcatctgtggactgttgtcagggctgatggagggagggtgctaagggtgaggcctgtggctgcactagacagggacgttcttgctatttcatggctgcttctgctgtgtactgacagcccagtgggtaacgagacagagacctgttcatcacagactactgtagaatggcattctgaaggagtcatctgctaaaataagggaaagtgcctgctgagagtttactgggtcagccatttcaaatgcagtgacatggacattttccccaccagccaccaatcgtttcttctctgctgccttcaaggttcttagtaccaacaactgcctgtgtcagaagcagtttggacatgtttctgcttcatcttcatgggctgtacctgagtgtggaggtcatggctctcttaataggatgctgaatgcagaaagcatctagaaaaaggctgaacaggggcagtggtgcttgcctgttggaggctgggcacgcagtgagaccctgttgtaaaaccaagccaagccaaaccaaaccagaccaagccaggcccgggggatggcccagtggatctgagtgctttgggatctctgtttcagccccagcacttgtgtaaagatggctgtggccacgcacacctgtcatcccagagaggcgggtcactggccacacacagtggggaaaccccaagctccaggctcagtgagagactctgtgtcaaga

SEQ ID NO: 33605 - DNA, 1098 bp, Mus musculus
ctttgtatttgaatatagtatagtgaaatacacttggccccaaaataaatatttgatttttaaaaattgcttttgtttagcttacaacttctagtcaaagccatattgattggccccactccagccaatagcatgccttgtctacagtgcctccagaactccttgattgcagtgtagcagcactttcatgggtgcttatgaggcggagtcacagggaccagacagcttttagaatcagcatttagtctagtaagttggattttgtgttagaaatgggaacttaagaactaaagctttctgcttctaacttcctggtgtgccacgttctccctccccagcgagtgccttcctctctgacttcctcagctttcccgtccagagcctggaaaaggaccctttgaaagctttatctcaaacctccctcatttgcaacaaagtaatggaatttggaacatttgttgtaaatattttctttgttttattttgtttgagacagggtttcacagagattcccctgcctctgcctccgcctcccaagtagtgggatcaaatggtgtgctctgccactacccagtgtaaatattttctttgtataaatgccgctctgttcagttcacagctatcttcctgggtggctaaagactgtggggaactgtgggcagaatgtctgggttccagcaccatctgccccttagacgctcactctggacagtctcttcctttctgtggactgtagtgttttataaactcattatctctacctcatagacttttgcacactggggagttgaaatcaatgactgaaacagggctgagcaaggctctgtctgtggcatgcctcaggatgaccagaggaattctcggttcagtcaaggtccaagctcacatcgtttacgtacagcttccaaaattaattctgtgactgtttatcaaacatttctggtatgtgttactctgtgtgctctggaggatacaaagatcaaatgcggtcgaatctgaatccccaagggttgtctcgaggacctaacacaaggtggtcagtagcttataaagaacacagtttaagaaccttgggatccaggggggtcaaaactgtgg

SEQ ID NO: 33606 - DNA, 1146 bp, Mus musculus
tggagtgaggatgaagacggttggtgatgaggctggagaagctggaggaggttgctggtgagggtttccctgggaatgtcgggcatcttgtaagtagatgatcatgtattttactgtctggactaagactctccaaggatgggaaaaagacatgttaaggtgataggtacagaccaggattagcctagaaaaatgggagcacatggtcacctatttaaatattcctcaaatatttggaagtctgtcacgggaacagaatactaactagacttcatctgtgggagagccaggagcagaggactcagaagagcaggcttcgcttgttggaaagtggggctgggggtgtcttccttactgctgaggtgctctttattgctgtgggtgcaaggctttgcatgacttcttcctagggcctggtgccgtgcaggtcaggtgagcttgtgccccagtccattcttcttgtgcacttatgctctcccaagtgttaacatggacgcctgtgtttttgttaagcgtagctcagctttttgtgtcttccaagtcttgtactacggaaggctaggattcacttctctgatggcttttatgaaaggcctatctctgcagtcatctgatctcttgtaccagctgcagcatctgcccagtctgtattatgcataagcccttcctcctcagtcagtagagtgcactgtttgtctttttttttttaaccctttcaccacctccgtgccctgttcttgtctggagacttaagtacaggtcctgtgccttcctctgcaatagtatggcttggtaacagctgccctcagtcttctatatcattctgtggtaccttttcttaccacttttcctgctaaacaaaaagatgctttgcttaatgacagaacaagcttttaaactgaaagggatgtaaactttgggtgtgtctgttccttgctgtggcatggcctttccttggcttctaccagtgatctgttttattctttgctactttgtttaattcttgggagcactccaagacgcaggtgtgactatttctacttaatgaggaggtgtaaaaaggttaagtgatgtgtctgaggtgacccagtcagtaggtgtctaagctggctcccagcccaaggctctgtatgcactcagtcagcc

SEQ ID NO: 33607 - DNA, 1190 bp, Mus musculus
attacattgttagtattggtgtgaactctttttgtttgtttggttttttttgtttgtttttgttttgtttttttttcgagacagggtttctctgtgtagccctggctgtcctggaactcactctgtagaccaggctggtcttgaactcagaaatccacctgcctctgcctcccgagtgctgggattaaaggcgtgcaccgccacgcccggctggtgtgaactcttgtccgtctggttcacactgctccctccctgcctttacacagcgtcaaacccgtgaagtgttcggcgctcaactaagtgtgccattgtagcaactgtttgaatttcaaaacagaaagccatgcagtctttgtgggagtttatttatctccacgtccagaagaactcactcttgctttatgctctcctatccagatcagaaaggagtagggacatccatccgctcttcctaagtgcacagcacacatgggctgactctgctgtgagtgttcgctgctccccagtgagacagagttgttggccttccccgcttgtcccaagtgagaccactgccgcagcgctgagcactgcctcactcttagaatcggggttctgacctgggaacctcagaagttgttcctcagaagccacacaccttgttttttgagaagaggtctccttctgggacctggggtttccaaattaagctatggtggctggccagtgacctctagatgcctacctgttcctgtcttcccagagcacatgcctctcgctgcccagtctttaagaggtttacagagactgaactcaggggcttcggtactttattatctgagctgtctcctcagcccgcattggcattctgtgataggtacacgattgcatggacatgggtatgtggagcgtctgtttacgttgtggcgtctctaggttctcattggcagcatccctgccacgttggtctttcttgagaatgaatatcccaggcttgtgtagtgagtgtggcatctacagtgactggggaaacaagaaccctccttgctttcaggccttctgttctgaatctgttccccttctgtgcctttaagacaaagtgttatcttcaccacctttctcttactcaagtcagctttgtctcccttgagatggcacgcctctgtctgtctctcgtgatgcctgctcacagttctgacctgtatgcatta

SEQ ID NO: 33608 - DNA, 1230 bp, Mus musculus
ctcctctgccctaactgttgagagcaaaccctagcagattgtcaggcatagcttgtgagggactctgaggaccagctcagtgtcctctctcacacctgctgctctgtggatgtcagctctgcccgtgtgtattccaaatggcaatataaaacagtcatttttacatgtcaactacttaaattacattttgcatatcttaataagattatatatatatatgtatatatatatatatacacacacacacacacacacacacatacaaggataatcttgggtatcagttctaataagcttcattgacagttaagcagttcatccattgacgctgctggttggtgtatttttaaggaagaagaccaccatggaaatggaaacctgatttcaccccagtgccagaaatggccctgcagctgtggagaagcagcgtctatgctgtgtagaagggagtttgctgctccacgacagaatcactgcaagttaaccagtcatttggagattaaaaaacccaggaaattggttttcctttcccggctttaggacaatgaggaatcagttggaaaattggttatcttaagagttctaggctcagctacctggaagggtgtttatttgtacattttactgaaaaaaaatgtccagtacttgtgttcaagaaatgatggcatacagaatggcttattatgaattgataactaaaaaaagatatttacttctgagatacaaagctctcctggacattggtttcatttaagttaaaagtaatgcataaagccatccactctgacatctgtaaactagtcattttgaacaaggaatttttattaatggctcttctgggaggaaacagaatgccaattgggggaagttgaagtttgtgtaatagttctggaggccccgtgaaatgattctgtacataactgtattgtctaaaaagtcataaattaatagaactctgccttgacaagaataaaatgttcacactcagtgtgtaactgagtgcaaacatatttaatattatttaactttaccatgcctttatctgcataggaattgtcttgatgtgttctggtgtaaagtagacttgaatatataaaatacactaacattcgtttttcacagcattggacattgagcctgggccacatgcggcgagcaagccgtgccttgagctgcccacagttccacggtgtaggagaatatgatgcagttgttggtgggtgaatccct

SEQ ID NO: 33609 - DNA, 1230 bp, Mus musculus
taagggctggcgccagctacttaacagagatgcacattttatctctgtgcctctctccgatgatagatgccatagtaaatttaaaatattgagtatgataacggagtatgaatttttaaattccgcaattaaaacgcattgttggaacgccattaattttgagtttaggtgagccgtgggaagcagaactctctgccgagtctccctctgcggatgagtaccactttttaggaattaaagtaaatacaaaggagtcatctgttcttcagccagcttgagtttgtcagctaatgatgaggttgtcccctcttgcgtcatgctgattcccttttagaaatataatgtatcttatcagtcgctggcttccttccggcagagtacgtttccctgtgtgttcatttacgcgtgtgttccaggaaccctgtccagatactatgtctggatttcccagcgaacagatctgtcatatgtatctgttatttaggatttagcagtttgttagagcagcccagatagaccccagatagacgggaccgtgaggcagttacaggaggagggagctcggaggtgccggtgttggagcaagaggagcaggtgagagacagcgtcagtcaagatgtaccccatctgggtcggtacagagctggagagggagactcactccacccaaaccagtccaagctgtagcatactggagtggagctgacaaaggaggaacaaggtctgggggagagaaggaaaggctggggctcacagcgaaactgcatgcacgaaactgcatgcacgctggggatgggtgcaagagatccagttggtgatgccctcgctactgggttgggcttttgcatgtctgcatgggtgtggtaagaaataagtgcctgtacagagataggaggcagttctgaccaggagaactctagcacccggaggtagagtacatgaggcacaggctgtgtaagagtgtgacttcagggagggccacagagctgtgtttaagaaagaaaacaggtgtcttccacactgccaggtctgccaggaaccctgtaggttaagtgtctgtgggcttatcaaggtgtcggtgtcgcccacagcactttgaacaggggtgggcttcagagtggagcaagtggaaggaaagatggaaggtgaggaaggaggggtgttacgtagacggggttctgacgtgagcacagccttataggacagtggggcggaggcagggctgtgtag

SEQ ID NO: 33610 - DNA, 1169 bp, Mus musculus
ttgggggttacctgctcgtgatgtgtgcagacagctaagcagtaagcctcaagcagtccactcgggcgcacactaagcaggttagatacgtggttatctggttggtctgttgtccctctttaaggacagtgccttagttagggttttattgctgtgaagagacaccatgaccctggcagttcttttaaaaggaaatacctaattggggctggcttactggtcagaggtttaatccattcacccaggcaggcatggtgctgccgaggtagctgagaattctacacgcaggtcatgaggcagcaggaagaggctgagacatattgggtctggcttgagcttctgaaacctcaaagctcacccctggtgacctatttcctcccacaaaaccacacctactccaacaacaaagccacacctcttaatagtgcagtccctgtgagtttgcggccacattcattcaaactgtcattgacagtgtggggcttcaggcccgaggcccaagtgagtggttctccacagatgtacgaagcttgaaggagtgtcagtgatacagaggctgtggagagctcccctctccccccaacctgagagtcagacattaggctggaaaggcaaaagggcagattagagaccctggacagaggaagtgtgggagcttcaaggtgagactgagatggggagtcccagggtgagggatccccccaggttggggagtgcctgaacctgcaagtgtctgtccaggaggctcctagtattcagacaggccttgttagggaggggttctgggggaatagtgtgttgtggtttctcaagttaaaggggcgcaggactgggcaggagcacctggagtcaggtctttgtcccctcttcagatcacatggtctcatctgttgtcatgtcactgagtgtgtaggcttctgggtggtaaactgtcctgtctgacagccactcctgtcaccctgcagacttcattctctccatccacaggattgcattgcttgtccggtgacttgatgagattgagaacgtctgtttagaactcctgtgtcttagttctataaacccctcgttgcctgccatgtcagatgttacccaagatgatgatattgcttagggtggtttccactaacgagcctcatcttcgaatgataacttttgtcccaaactag

SEQ ID NO: 33611 - DNA, 1381 bp, Mus musculus
acaccgaagtacagcaagattgtcattgactttgattcgatcaatagccgaccgagtcagaagcctcagtgagtttcgtctcgttaaagccccagaagaagatgacaccccaccacgtgcgtgcacacacacacacacacacacacatacacacacacacaaggggctccccaagcctttcatcttgaagtcccacggaactttttaataacacaacactaaacatctaaagaatataaaacttggaatcttctcacccgtcacgtggagctccatctgtttcagctgttgatgtagtttggtttggaaactaagggacctgcccacaggagctggagtgaaggtctctccccttccgccgagcccgtctgccagagagtgtcagctctgtcatccaccatatttcgacagccgctccttgctgctacacggggtaggaggacatacaaataattgcttctcgttcttagcagggatgaacaggcacactgaggtgaacatctggcccaaatgaagcataccctgtcacgcccttgggaaaacaaataggaccgaacaaagctacatgaacacacctgctgtagagttgaggggacctctcacctggtcacatgaggttgaggagggcccagtgtcctggcagatgatcagtacagtgtccccctcaagtcacactttcctgccttacacagagcagtagcataccatccctctggagggtaggggacccctgcggttccagcctcttagccttggtttgttggtcacatagcactgttaaatttatccgaggcataagtagttcctagaggagacagtctatcactccccctagaccaggcgctttgcggtgacagctggagctatatggatgggtgatgagagacgttcccccatcctgtgtctcctgctgtgtggacacatgtcactcctgctccacatgccaacatggttcatttccaagggcaccctataaccagagagcacattaattcctgtcctataagagggctgtgggaaactgtgtacctggaggtggtccatgccagatcctcatttgtgccttcagcttcataggcagcatacgcctgctgccccattgtgggtgggggtgccccactgcgtactgtgtttttaatttcatttaacttctagcagacacgctcagtgtctttgataaaatagtgtctttttttcatgtgtttttatttcatttctaagattttttttttaacactccgtattctggagcatttttttacaatttggatctctgccagtattgttaaaattttattaaaatcatccagcaccaagacgtgtttgcttttatatttattctatatgcccagctctgcttgtgtagtttctgtgttgtctg

SEQ ID NO: 33612 - DNA, 1485 bp, Mus musculus
gtattgaaaataattttctaactgctttgtatgtatcacatactctaaattgcacagtaggcgtgtttattaaacagattggctgggaaagttttgaaatagtactgaatttacagtctcagtgctattcctgttgctgtgtatgtggtaggttataccgaagtaactaatcttctaatgaatgctgatattttattagaatgaaagcacagattagcattaatattttttatcctggaaatcctttggcaagtactgggcagcccaaatttagaaaactatgagatttcaaaccacgtaaacatggttctgttggacattttattttttaactgttaacttaggtgttcgcagttctgttgaatgggacttctgcaggactgtatttagcatgctgtaagtactttggggtgaaataggctccgagtctaaattctcagaaatgtctgtgatgtattgaccatgaatagcgtgtaccacatgacagaagtgaaattacactcttaaccccttctcaacgtggactggtctttacaggggcaccaataaatgacagatctggagagtctcctggtgcttattttagaagtcaaatcaacccaattagtatcttgttagtagatataatgagcctatttctttctaaaaaggcttgtggtctggacgtgcttttacaagaaatagtgaccttggggaatatgtaaacaagagatctttttctaagagtttggggggaggttgggggacctgtataatgacaaaaaaaaattagcttacaacaatgacaacaacaaaaaacaaaaacaaaagaaattgatattcaaagtattttaggcaaagccagtcaaaatgctttcatgatattttgagatgtaaatttttgtctgatttgtattgttcttttcgtttgccttcttaactttatatgtgacctgaattttccataacttgatgactatagattgcatctaggcattccaataaaagccaacccaatgtgtgtgcgtttatatgtttctttcaagtcttgactagccagaattgcttttgtgtttcacgtggatacagaaggaggcggatctggggctgtaattcatctacacccaaacccatgatagctctcattcctactgagtttggatccttgttttgtttttgtatttagtttcaaaatgacagctcggaggagcacacttcacagaggtctctaccctggcctactttagaaaaatgttaactccccctccacaaagccaaaccctaactgtaaaggaagaattgaaaaaaaaaaaaaaatcacccattactcctggaaatcgggtctcattcctgtgatgttggcattgagtgtgcttaattaaaacacttgattagaataatcagtttgggcccgataggttctcagcctcctggagatgtctaaatctacatatagacctactgattagggtttgctttgttcagcaattccaggctgacagacca

SEQ ID NO: 33613 - DNA, 1117 bp, Mus musculus
ctggctgacagtgccaacaacatccagttcttgcgacaaagtgagatcggcaagaggtaacccccgggccacccctgtgcagattctcctgtagcacaatccaaaccggactctccaaagagccttccaaaatgacactgctctgcagacagacacatcgcagatacacacgcaacacaaaccagaaacaaagacaactttttttttttttctgaatgaccttaaaggtgatcggctttaaagaatatgtttacatacgcatatcgctgcactcaattggactggaagtatgagaaaggaaaaaaaagcattaaaaaaggcaacgttttgccatgacccctctgtaccttcgaggcactgtatttaacaaaggttttaaaaaggaaaaaaaaatgcgtacaatgtttccagatattactgaattgtcgacctttgcttacaggaagtaatctctacttaggatgtgatatatatagatctgttcattttaaaatgtggggcaaagttactgtttatagaacccaactgctttcccgtgctgctttgtaaaaggacactggcacaagggacgtctgcttcggcggggatttaataatggattttactaacatggcttgccctgggagggaaaaactgacgaatagaatccttgtcactgataagcaaaggaaaccctgatttttttgtaaattatgtgagacaagttgtttatggatttttatatgaattacaatttactgtacatcaaatattagtctcagaggagttaatttatgtaaagtgtttaaaaagtttatacttaaaaataaaatgataaaaacatgtgaactgtgtgatttttttaaaaaggattgcaccttttgttatctgttataactgtacagtataacttattatattgtagaggtataacaacttatgcctatcatgtccagaagtgttaatatttttgtattaggttgaaaaaaataaaacaatgcgctactttctatcacttagatagataggacctgtgcagtcctcagcgggtggctaatcagagaacttcttttcgtccttctctttcttaccaagccactggcctcaaccattaccaaccaagaggcccagttgacat

SEQ ID NO: 33614 - DNA, 1227 bp, Mus musculus
cggcattgaggcttcatgtacacattatccatttcaggctaattttatgtttcttcttcataaataacattctggctttgttcctcccccaaatacacaggaaactaaaacctgatttgaagtggctcttcagtcaaatgagggggaaaaccaccttactgaataatggctaattatacataggattgtgtttcccctctgctgttttccccttgaaatactgtcttcagaccagcttggttcatgcctgtgttatggcttctccaagtccattgacaatctgccgtttggccgggaaggcctggaaacaaagagcagcccagtcatgacaaatagcacattatgaatcttaagccactaattgcagaaccctccccaattaagcatccaagcaaattaggcaggggatcattaacaccatgtaaggtcaaggataactcaattaaaacgaaaaccattttctcaggcggaatgttttctgcatgttcgtggccaccaaatctgttttctgtgtgctcccacccaccccacttcccaaaccctgataacagcctgtgttctcttcccagtccatggttcttctgctccatagccagcggcagtacatcttcgaatacgacatgtgggaccgcctgtccgccatcaccatgcccagtgtggctcgccacaccatgcagaccatccggtccattggctactaccgcaacatctacaatcccccagaaagcaatgcctctatcatcaccgactacaacgaggaagggctgcttctgcaaacagctttcctgggaacgagtcggagggtcttattcaagtatagaaggcagaccaggctatcagaaattttatacgacagcacaagagtcagttttacctacgacgaaacagcgggagtcctgaaaacagtaaaccttcagagtgatggttttatttgcaccattagatacaggcaaattggtcccctgattgacagacagattttccgcttcagcgaggatggaatggtaaatgcgagatttgactatagctacgacaacagctttcgagtgaccagcatgcagggtgtcatcaatgaaacaccactgcccattgatctataccagtttgatgacatctctggcaaagtcgagcagtttggaaaattcggagtgatatactacgacatcaaccaaatcatttccacggccgtgatgacttatacaaagcactttgatgctcatgggcgca

SEQ ID NO: 33615 - DNA, 1196 bp, Mus musculus
caggcagttctctgctgtctgtgtcaggggcctcggaccagctcgtataggctgcctggttggtggctcagtctctgggagctcccaggggttcatgttagttgagactgctggtcttcctatgggatcaccctcctccttggctccttcagtccttcccctaattcctccacaggggtccctgacttcagtccaacagttgggtataactatctacatctgtcttcttttaaccaaaatgagcgtcccagaaatcagtgagaactgtgggtggctgacgaaagcagccacaggccacttcaagcattcacctataaacacgatgtaggcaatattttcatcaatattcgatttattccaactcctttcagcagtctagattttacaaaaaaaaaaaagaaaaaaaaatgagcaaaaccagtaaccagtttttttcagaatctggtgcatcagccctagcgtgtccactgcagcagagctatgttatcccctccagtacgatccacttagcaaatgaatgctctcaaggtgctaaattgctccataatggctcaaaatgggtaattcaacctcctctatatatggactccttctctctactttggataggtgctctgatagctttaccgtacggcacctcatcagcttcccttgcaaagcaaccatcagataatttgcccaaagaccaagacaccgactcactactcgaaaggttatctgagaagaggagattctcatgcggacagaccaggatggctttcccttcccagtgttgcagagccaaaggttgacagttgggaatttcctggaatggtgcatccttctccaactcagtcctgagatgctataacgaaagcctgtgtagaagcctcattcctccctgctcacccttcagtttcccccagcgaagaagtgttgcaggtagagaaagcctcttgtttatgtctgggcccacgggtcatttccagatgcctagaacatatagatgttgacccagtgaggcatcacacttgtcttctggactctgacctacgatcaagaaaggaccaccctaagcaagagatcagaggtctggggcgtcacccacatgctcttgttcctcacagcgtccctccatcacagcatccctgcatccgtccttactactgcatcttgcaaacccacctgctcaatctcaagcagatttcttagactta

SEQ ID NO: 33616 - DNA, 1129 bp, Mus musculus
ctcactgcatagaagtgcatttgctgtctcaaaaccagcaaatctttccatgcaccgactgcatctttaaataagatgttatgtccgatattcatctctactccagatttttaggtttgtttgaccatggatattgaaatgaaaactattttaaaacagtttataaaattaaggctaacttctctaaatggtctaatttgttcttctagcaaattaactgcagcttagtagctgacactaaccaagatatttcttcttaaggtgcgtctggaatggcccactgacctcgcgatcaaccccatggataactccatctacgtcctggataataacgtagttttacagatcactgaaaaccgtcaggtccgcatcgctgccgggcggcccatgcactgtcaggtccctggagtggaatacccggtggggaagcacgcggttcagaccaccctggagtcagccacggccattgctgtgtcctacagcggggtcctttacatcacggaaactgatgagaagaagatcaaccgaataaggcaggtcacgacagacggggagatctccttagtggctgggataccttcggaatgtgactgcaagaacgacgccaactgtgactgctaccaaagcggagacggctacgccaaagatgccaaactcaatgcgccgtcctccctggccgcctcgccagatggcactctgtacattgcagatctgggaaatatcaggatccgggccgtttcgaagaataaacctttactgaactcaatgaacttttacgaagttgcctctccaactgatcaagagctctacatctttgacatcaacggtactcaccagtacaccgtgagcctggtcacgggtgactacctatataattttagttacagcaatgacaatgacgtcaccgctgtaactgacagcaatggcaacaccctccgaatccgaagggatccgaatcggatgccggtgcgggtggtgtctcctgataaccaggtgatatggttgaccataggcaccaacgggtgtctgaaaagcatgaccgctcagggcctggaactggttttgtttacttaccatggcaacagtgggcttttagccaccaaaagtgacgaaactggatggacaacat

SEQ ID NO: 33617 - DNA, 1134 bp, Mus musculus
atcatgcaccgagccccaggagcagcttagaagctgctgcacacgtgtttctcattgcccacttaaatcttgtactttgtggtcccagcagatttacagattgccctggaattcattggaaaggatacttttcttctagaagtcatatatatgttatatggggggaaaaagggcatcaattataatttttaaaattactagtcttggtaatgctccaaaataaatagattgcagcaaattaaaactcggggtgaacaccaggcatttagagaaataaattacactgaatttaaaggaagatggtcttggggctatttcagatctgctttttttttctttttttctttttcttttttcttttcttttttttgtgaatagcccttgattgtttatgatatttttacctttggcttgacttatctattaatcatgataatgttggccagggaaaacagagattcattcagtcttttgtacttttcccacagtcttgcgtccgtcatcagaggccaagtactaacagctgatggaaccccacttattggcgtcaacgtgtcgtttttacactactcggaatatggatataccattacccgccaggatggaatgtgagtctgctgcatcctgctgtctccgtgggaaggattctcagcatgaggctgggcgtccacccatcacccgtcatgttgtattgtcttttttaatagaaaggcaacaactctcagactcttaaaaacccaggacagtgcaggaagcagaggctgagagccatgtactcatttgccataaaagttcatcccgttttctgaggcgtgatagaatactgtggtcctgtcagagaatattttttgtctttgaagaattgtgttgaagtatttattggagatgtttcttactgtctgcaactgagttcagatggttccaaagaatagataggaagttagggaaatgcaaatagatagctcggtgactagagaaaggatggttaaatgcttgctatgtaattccatttgagcagaggttggaaactgtttcatatcacaattaggaggaaagattaattgtgaatcattttaacttgaggagagcattggtcattgtaaggtggcggctcactaacttagtcatactaag

SEQ ID NO: 33618 - DNA, 1139 bp, Mus musculus
tagaggaccccagaagcaagtcaaaaaaaaaaccagaaaaaactcatgtggactggaattaaatatcttctaaacaacaattgccgtaatttgagtatcacgtgtctatcacgatatttaagaggattagacgattgtgctctgtgagggttgatgtgagtcaggtttaaaactagtatctgataagttcaaatctgtaaactgcgagatactggtgagttttgagcagaccgagtgagttcctatccctgtgtttaactggaatagacttagaacccttagatatgtgaaggcaactcggttggtcggtttggttcaaccacttgtctcaggtaaaagaaaggagagttgtctgccgtcggcctgtgactctactttagtggccacagaaacaaagcaaatcctgtctccacgtctgcatgttgcttattagcggagtgcaaagctaactgaatgccctgggcagggagaagtcctaactgcctcgtttttgagcattcatcaatctataactcccacaaggccttttctctttagcatccattgaaaagatttttcccttcgttatccatttatgcctatctgagtgcattggagaccagagatgagattgagtcgtgaacaggccgtaggggtgttgaataacacttgactgttctctcccatgaataggtgtcacggacaagaaggctcagctctgccagctctgaggatggctgagggtcttctcaaacccactggtgcttttcatttctccagagaaccgaaagggaggaaatgggcttatattagtaacagggaagatgacgggctagagaacatacctaaatctcgggaaaagccccctttgaaatagttgaatctccattccagtaagccttaacagtctgtcagaattcggtaggtgtgtgagattggccattccgttttccctttcgtgttaattttagaagtggggtgctttttaatttccttccattccgtccgttatcccaaaggattaagtagtctcttggatccgaaagattctccaggtcatttgcagttttgggatgtcttagctgttgatggtttctgttgacaatgcggaggtagtagacctaagcacggggttccctcgtcacctcagtttccttttg

SEQ ID NO: 33619 - DNA, 1159 bp, Mus musculus
ctgagaatgctccatctgggacttgtccatgcattgccttctaccctggttacacttgtggtcttcccagccccagtcagtgcacactcccatgcatgtgtgcatactcacacttctccatcttggcacagtgattttgctacggtgatcttattcctgttactcatatgatcgactggaaacttgttaattgttcataataccataatggttatttgttgacaaacacatcaggatgctcagggagccataaacctaaatcaataccatcagtatcaactaaagccttctacagttcctcccgtggaattaccttcagagctggcttacgggctgcatttgaaagtcttatggacgagccagctctcacttctaattagacaatgttagtgcaataatgtcagaatacaccaccactctcttccttacaaataatgtgtgggtatttaaatatccattctgcaaatatggaaatctgtatcacacccgaagctatgtgttaaagatctgacaactgccagatagcattgcaaaggaatggaagcatcattcgaagggagggtggctatatagatatataaattaatctcttttaaggaactcactctacctttttgccagacctcttatggcttttttactctaacattcacaccctgaactaactttccttgtgacactatcactgacgatataaatcattgcctctgccacgaagtgctctctgaaacacgccttctatagcaggatggaaggagacaggcttcgggcttcttattaaaccaaagcatttattttctctaaggaaaagcagatgtggtatatgaaataaactttcaagatagcgaaattccatactagttatagatagtggggacctatagtgatagccaatgcagcgagatacagtagctctgatccagaaagggaaagcgattaggaaggccctgcgaagattgtaaaagattgcagttgcataaggcatcagacaacctgaagtttaatctttacgttaggctaaatattcttatctgaaagtggatggactaacactgtacactggagttcagctctactaaatagaaattaggctggtgaagattcaaaagagtcaacggttggcctggcgtatgatgagcattttacacgccaccaccgc

SEQ ID NO: 33620 - DNA, 1103 bp, Mus musculus
cacacacacacacggggacttagggatggttgaccagtgggtatgtgcacgtaggtgcagctgcctgtagaagccagggatgccagatactcaggctgttatagagagaggcttagatgggctctgggaatgcaactcaggtctgttgcaagagcagtccactctgagctgagccccagattgtaatatttttggaagcaaagctacagcatgttacaaacctttacccatcacacgagtaaggaccaaccaggatggagctcttagtggaccaaaaaaaaccaaaaaattaaattcagaatttcagaaaccaaaacagtgtagctgtttttaacgtaagccatggaagaggagcacgcgctgtggccttttgaaatgacaaaggtccatgaacgtgtgataatgcatttgagtcctgtaaagtgttgtttaaccgccacacctactgcattccacacaagaggtagagctcactgatcacgtgaagcccctgcttggggacagaacatttaagatatgagcttatccatcagctaaaaacctcccatcctccaccctggctctccccacgctgggactgagccgagggctgtattgcatgacttgcatccaccgctttcttaagggaagtcagtccctaagtttaaaaagtgcctttacacggcatctattgaaactcagcaagtttgagtccatttaagctaacataatcccagtgtatataagcaatcagttattaagaatcttacaaaccttttttgagagggggagctcatatctttcccagtctcaccctcgattttatctttagttcagaaataaccagtgtctgataccactttgatctcatctatcccccccccccccaaaaaaaaaagcctgcttaaacaagggataggatattggctagggccaaagcagggcggaagatggctcgtgagcaaactttcaaagtgggaatgtgtgaagtagatttgatcagccagtcagtaaccgacattgagcaggaagttcatgaaagggacttctggaggatgaggtcagaaaagtgaatttaaaccagtgttcggaagacccggcgtctgaaatgtcagtgcgtagat

SEQ ID NO: 33621 - DNA, 1949 bp, Mus musculus
atgcaggggacacttcttatataaatcactacagaaagactcagtgaagaattataatgggtgagaggatatccaaaatattcaaaaaatttccatagcagtaagactacgctatcatttctccacttttaagttttggcataatttttgaacacttaaatttgtctttcattcatcatgtcattaaatatgttgttcattgtcctagtgccctgactttgctgctatggaaaatgtctgcattattaagaaggtgatactgtccaagccatcaaaataaccttaattcaaaatggcctctgtcacaggaagtgttttggaatcaagttagagattcaattagtttatctacaatactgacttcttgcttatgaattctatctacttgcctagtgtttcagttaaatatatcttctaatagtataagaatattttcgccctttcgctgatgcaagagcctagtgcggtgctgtgagaagtatcggtgggagctacgctgactccgggccgtgaagccgaccggtttgacttttcatccctgccgaacccgctcgactacagccatgtccggggacgagatgatttttgatcctactatgagcaaaaagaaaaagaagaagaagaagccctttatgttagatgaagaaggtgatgcccagacagaagaaacccagccctcagagacaaaagaagtggagccagaaccaactgaagaaaaagacgtggacgctgatgaggaagacagtaggaagaaagatgcttctgatgacttagatgatttgaacttctttaatcaaaagaaaaagaagaaaaagacgaaaaagatatttgacattgatgaagctgaagaagctataaaggatgttaagattgagagtgatgctcaagagccagccgagccagaggattaccttgacattatgcttggcaacaaaaaaaagaaaaagaagaatgttaaattcccagaagaagatgaaatactagaaaaagacgaagctttagaagatgaagacagcaaaaaagatgatggcatttcattcagtagccaaactgcttgggcaggctcagaaagagactacacatatgaggagttgctgaaccgagtgttaaacatcatgagagaaaagaatccagatatggttgctggagagaagaggaaatttgttatgaaacctccacaggtcatccgagtaggaaccaagaaaacttcttttgtcaattttacagatatctgtaaactattacatcgtcaacccaaacatctccttgcatttttattggcagaattgggtacaagtggttctatagatggtaataaccaacttgtaatcaaaggaagattccaacagaaacaaatagaaaatgtcttgagaagatatatcaaggaatatgtcacttgtcacacatgccggtcaccggacacaatcctacagaaggacacccgactctatttcttacaatgtgaaacttgtcattctcgatgctctgttgccagtatcaaaactggcttccaggctgtcacaggcaagcgagcacagctccgtgccaaagctaactaatttgctaatcaccattgatttttccaaaatgtgttggagatttggctggacaggttaccatcagagtggatgtaccattgagttaaaaacaagatagaaaaactgccaagttgtttggcaagtgattgttctgaaataccttgcacgataccgatattcaagctgttgacatactcgttgcctactttaacaactgtcagagaaacgtgatgggggtaaggaggtactttttaaaatcgttcatagacttctgtaaaatgcaagattaaagttattataacagtaaaaaaaaagaatattttctatttaaaaatttgattataagccaagatgaatcaaaactgttcacctataatgttggtttatacaatgccttgtccatgtttccta

SEQ ID NO: 33622 - DNA, 1244 bp, Mus musculus
aactcactctgtagaccaagctggctttgaactcagaaatatgcctgcttctgcctcccaagtgctgggattacaggcatgtgccaccactgcccggcctcattttgtttgtttgtttgtttgtttttgttttgttttatttttcgtcttttatttttcaatttcatgtatttgagtgtttgcctgtctggatgaccttaacgtgctatatgtatgtctgtgccatcagaagcagaaggagtcatcagattatcaggtactctgaaactagagtggcaggtggttactaaataacacttgggttctaggggtgcaactctgtcctgcaaaaaggcaacaagtgctcttaactccatccctgaaagtatacatttcaaatatgattttcaatattatatcacccattattttcaattttcaaaaataatgagaataccatacttggcattctgaataggaaaaaataattcctataatatgattgacaaaaatttctggatttgctcaagtttatataaatattaatgatttaagatttttttcatcgcttctcggccttttggctaagatcaagtgtagtatctgttcttatcagtttaatatctgatacgtcctctatctgaggacaatatattaaatggatttttggaagtaggagttggaataggagcttcctccgtccactccacgcatcgacctggtattgcagtacctccaggaacggtgcaccccctctggggaataagaatagtcagaaaagggctggtgagatggctcagcaggtaagagctcccgactgctcttccaaaggtcctgagttcaaatcccagcaaccacatggtggctcacaaccatccataacaagatctgactccctcttctggtgtgtctgaagacagctacagtgtacttacacataatcaataaataaatctttaaaaaaaaaaaaagatttttttcgcctagcaaacctctaaaatccatatatatattctatggcttatttcaatgcaacaatacaatgcaaacgttgttaatataaaatgagataagtggatagatgcataaaatccatgtttttataggaaagtgactatgctgtaatttccctttcatgctaaatcaaactgcagattatgataataaacatttcacaaactgaaatgtatatggtaaatctggaagatattggaatgtaaacaataatccaaagagcatataccttgaaatctctatgcacagag

SEQ ID NO: 33623 - DNA, 1176 bp, Mus musculus
tctgggtgaagggagggactgtatgtctttagataaagtggtttgaaatttggtcagtttattgcatgatttcaataataaatgaatgtaaataaattttttttcatttttttaaactgtggcaactaatagtttccatctgttgtgcaatgccaaattactagtgtgagaggtggctgtcatatcaactaagactagtctcctctgctcagcactgttctctttatagcctttcttcttcctccctcagtgggcagacctgtccttcccgttctgcagacatggcaagcgctccattatgaaaactgtgctgaagattggacctaataatgggaagaatttttttgtatgtcctttggagaaaaaaaagcagtgtaattttttccagtgggccgaaaatggaccaggaatggaaattgttccaggatgctaatagttttctctttttaaagaatgcccgtctcataaactcatcaaactcatagcattcagtcccctttgtttaatagaaaacttatagaacacctgttgtacatacacattaagaacctgtagtatttgagacatattttttttcacttaactatgtgatcttcacagtttttgttgtaataatgaacacactatttcaccagaggcacagtccattctctttgaaatgcatattcaatatagttaataatgatgtcaataaagtactcttagaatgtttttggtcttttgtaagtttgttggtgagcagtaacttgtttgattttcaggagattatgtttacatcgcattataatatcctcattctgttatgaatacatttctcagggtaccaccactgtatacagcatctcattaaacgtattcctcattttcttaaactcaatttaagatataagagctcctttatgaaagataatacagtattctgtttagcgaatattaagttcttgttagagctacactgaaaccctcagagactttcagtgtttttatagaaaatttgggggattcaaactaacataatacctaggatagaagtcacacgcataaagagacattttgatgtttttctaatcgtctttctaatgtctgttgctaacttaaataagtcagttattttccaaatcttaatatatcactaatatctaatgataagctgaagtgttatcattaatggtgtgt

SEQ ID NO: 33624 - DNA, 2088 bp, Mus musculus
acctcagtttacacattggtcacattcatataattttattgtagttcattactctcattttccttctgggaatgagagtttgaaactaattttctagcagccaacaacttacacagtgatatctttgtgtatattcatttttacccatattaaaataactatatagatttgtaaaataatttagagattaaatatgttgtatatgattgaatatgtaattgtatttgacatgaaatttattttcctcattgataaatactctcagaattagcatctgcatcttggctactcttaaatgcaagagtagacactacgcacattctaaagtaacctaaaagggctgtttactagcaatagcataaattagcatttgttctgtttacctcatgtgcttagtgacattcatcaaacagctcttgtatgtggtggtacagttcttacaaatgcatgtgtttgaggttttcttaccagcagaaaggtcagaggcgcaccttgagattggcaccagcacgttccttaaacatttcggggtctctgtttctttgtctataaaaggatcctttactaggatagaaagttgtgatatgttttctgttcagcagatttcgaacaggaaaccaccttagtgatctgaagtcagaaaagtgatggaaagattaacagagttcataaggatctgagcttctgctacattttacacctacaaaagtgagctttatacatcgatgagatagtagatgtgtaaagtctgcaagcgtcagagttagagggtctgggtgtgtcctagctaaggaagccctcccaagcctagggcattaaagccacacctcagttcagttaacagttcactgtacctttgtgatgagtggctatgttggttgagcacagactatctaacactgacatttatgtatctgaaaagcccagttcaggtgtttggtaaggaaagcccaatatggcaaatggcctttgtttttagcagctgagggagcagctgctccggcatgccactagccctgtctctcaggaactccattgcgtgcgtgcacggctttatcagtctgtgatgatgctgtaacttgctaagttcgtatgtgtgataagcatctctggtctcagtgttttagagaagactcagtgcttcagtggctgagcccagaggtgattctatgaaaagaagatgattgcaagagtgttagtaaagaggttgcagttagaaatgaacttgaacatgtagcacccagcgtatccctctcagtcttaactagacaactgtgtgcttttgtgtctggccctattgcatttactgtgctcatgctgaaaggaaagtaacagctttagaaactgttgaaaataaaataggaaaacaggctgggttgaattcctttgctgggaattgttttacagctcttcagtggtctttctagccagttattcctgtgaagaattggactttgaggagctaaagctttgaatgggggctggtgcaggggcctgggagtggagagtctgctttcagatactttaacctcggagctgtgacctttgattgtagcaaacatcgatttcaaaagcttcttttgctttcagtcacaagcctgcgtaccttactgcgagactgccaatgcttcaaagatgtatgtttgaaaaagttctttcatagtttttatgaaatttgggaagttgtttacttaaacaaatgcacaagaaaataattcataaaaatactgaatatatatgtgcaaaatttttcttagctacaataaatgttcaacatttttctaataaagattttttttctgagtaaaaatatgcattttaaagacttccaggtttatgtgtttttgtgaagctgctaaatcaaaaagaaaaacagtagtgcacttgagggatggtaaaacttttatcttctagaaaaaaatgtagaagactgcacttgaggtttgaggaaggagtgtgcagtggggctttaggggttcattcactctgctacccagatgttcccagagtttgtgtcctcaaagggcaggctgtcagttgtgcttgtatcttgtccagtactcagcacaccgtcttgcagttgatagg

SEQ ID NO: 33625 - DNA, 1235 bp, Mus musculus
ttctgaacaataactggtagtgggtatactttaaaattagagtgtgataagcctatcaatatgtacatacatatacaattaataatttatagataatatttaatagaaattctcatgttagctcttctcagtgtggcttagtattgtaatctcttctagtagtacctctccaagatgaatgggaccctgttggtgtttctttactgccaccgcagtaccccacacactgagacactgtgatcaggactgatgtgtagccacatcaacttgtatagagtgctgtgcttggttaactgcttgagctcagtgcgcatatgcgtgttagctactttgaatagtgagggttggttctgctttggagctcttccgaaactgtttttctccgaaagactaagtcctcattcttttgaactcattggacagaattaaagtttcagttgcttatgtttacttttttcaataagtaagtcagctagttatgcttacaggaagaccgggatggtaacctacacacacacacacacacacccctttggaatgggctagattttacaatatatgtatccagtatttctgtttttaattaatgttggtacattcgtggtctgcctgttctgttttgtttcagtgttcatggagcgatagatgttttaagaataaggtttgttagaaagttgtgtgctgctgtccagtctttagagtccttaactgttggcttacatctagagaatatatttgattggaatgttaagcagttatttctttatttatctgcagagtattcaacaaaaaataatgtaagtacttatctaaatatattacaatagtttccttttaaacattatttcttaggaaagaatgtaatttcaagaaattacttgttggacaattagtcctctcctcaagggttccacggattgtaccccacccgctgaggttgtcactgacccaagaagatacatttttatgtattcagaacatctgaccttcatagcttagtttaaaaacaaaaaacaaaaaactcaagctaccagagagaaggctgtagtgaggaagctttctgtcctgcagtagcctgtttaagctctgtgtgccttgtagctctctagcattaagggcccagaaaggtgtgcacgctgtgacagcaggctatttcttgactcccttagcttctcttatagtgctgataatgaaaagtatggagtggcttacttaatatatcaagttgagataca

SEQ ID NO: 33626 - DNA, 1126 bp, Mus musculus
tactcgtaaaagctccattaacctcctaagcgtcagccataactgaaacccagcacaagtgactcactcagactgcatctttactagtgtagctttttcaatgaaatgccatacgatgaaacctaccttcctgtatctgatgttaatatttttctaaatgattagttgaatgtgtggttaaacctttttgataagctaacaaaaatgcagtgcaaaccaaaactaggttataacctataaaatcttaaagacaaaacaaaggatattccagaaatattctgcctctcagaaaacatatttataacagtgcctcataaatattaatggttttcaggaagtcatcttaaaggagatacttgaattgttatttaagtcaaagcagattttaaatgattcacttcgtgtgtttgcacttcaaaagcgggaagctcctttacaatggaaatatttagtaataaaagcttgtccgggacctgcaagcgaaccattccactctttgaagcagtgctgtatttgcgggccagtgttagggaatgagttccagtgtggctgtgtcccagtgacacgtctgatgggtgggaatgtgaaactgttaccaacactgaaaactcacagttcaggtccaaatcaaggaagatgattttcttttccttcctaatttaaaatttgtaatggattccaaaaccctcaggaatgaaacttttaacagtcatagcaaaatggaggtgggtgtaaattttatatatatatatatattgtatatgcttattatgaaatgatgcaaatgtattttccagattatttctctgttggtttgtaccattttcaaaagtgcctatctttcaataaaactctgtattctaactcacataaattgcctattcctttctttaaccttttttttattcctttttttttttaaatgtgcattggtggttgtttgggcgtatgtctgtgtgaggatgttggatgcccaggaactaaagttatagacagttttgagctgccatgtgggttctgggaattgttcaattccagcatcctctggatgagctagaaccatccctcctgtcctgcctagtcgtgaatataaacctagtgacatgacagaaacaattctgccaaa

SEQ ID NO: 33627 - DNA, 1191 bp, Mus musculus
gtgtgtgctgagtcattttgttggctcccaacaagtagtgtaacacactgtccacagagttaatcatagttacagagggcagagatgttgctaattaattcacatctttctacttgtgctgattggtttcccaaacccttgtgagcatgtagctggatagttggggacattttcagttgttagtcctgctggctttgggatgctgttgataaaggagcacagtgctgatgctttcattgggacaggggggcagtgcatctagttttggcaaagagcagtgtaaagaaaatatatgatgaaatggtatcacaatattatgtactctactacattaaaaaagtacaaagctctttaacattagcaaacttctaaaataacttaggctatgagggttgacttatttatttttttctctcttctatgtgcatgtattaatgtaattatatgtaaaaagaggaacactcagtttatctcagggtcagaaacaaacaaagtcctgtcttccattatgagccctgcccttagctaacacagcatttgttctgttccaggtttgaagagacagcagagttactgaaatgctcaagtcgctaactgtagaatgttctgcataatcgctcctaggactttggctacttatatatattctatatttaagaattctgtatataattttaatatacgatagtttttattaagaatttggattctatttgatatgtgagctttttcattcttaaataaatacttttaatattttaagctgtatatgtgccgattttctcttccagttttcttggcaaaactttctgtctcagtatattgctcttacagtgtgaagtcattacagcacgctctgtagttttgtgttgacattcactggcagtgagctaggtaatatgtttttgaaagtatgggttggaagacatggtctgcatcttgctggagatagtccaactgggacttgcatattgtactcaggaggctctcatatgtacaatcttagcgtatgtgttggtgaaccagttgtaacgctcactgaaaactaaacaaatctagttcttcatgggtagtcagtgctgctttatcactgcagtggtgacagcgggcgtcttctgtgtgtttgctgagggaactgtgtcgggtgtgtgaatactctgctctataaccctagaccgtcagccccgaccc

SEQ ID NO: 33628 - DNA, 1166 bp, Mus musculus
attgcttttgtggtggttacagcgtcgttcgatgccaaggcacgcttcatttcttacggcgtccccttaatacgaattcaaacatatccagtttaagacctccgctgattgctagttgctacagtctccaaacagactgtaaaattggttcaacactttccttttcgttttgtttttctgtggctacgctccactttccacatcgtattactcagtacacattgtctagacaaaaaccatagaagtttgcaattcttactcgatatatttctggtttatttttcgttctgtatttactaattaataattgtgactacttaatttataaatgagacatttatttgtaaagacccccaccccgcgcgcgcgccatattctcttcattaccctcaatactgcaattgaatacaaactgttgttcatgtcagtgtttgcactccgtttttgtttgtattttgagacaaggtctcctgtgtactccaggctggctcagaattcactgtgtagccccgactgtccctagctagcaatcctttttcttggccttccaaaggcttggaagtatggttttgcaacaggtcactaagtactcttctctttgctttggttctttggactttggcactttcactccgacgagaagagcttccggctacctttgtgaaaggtttttgttgttgttgttgttgtttttgtttttgttttgtttttacaatgtagagcaggtctcagaatgaacaataaataaatttattattttcaggttaattcagaaacttcttgcttatacagtttttctaaattaacaattacctaagtatcgtcattagtttcatattgctggtttatgattatccccaaatttaatgcagcttaaaacaacaaacatgtactatcttggtttctttgagtcaagtatcagggcaacgttcaacagagtagttcagcttgtttcttgaggtcgtagttaggctgtgtttgggacttgtgatactattgagagactgcactgagatggactaagggtgcacttccaagtgcatgcacatagttgccagctgccctagattctccgctaagtgggttttcttcagaaaacccccttagagtatagtatggctgttgatttcccctacaacagacaagctgggagaaagcatccaact

SEQ ID NO: 33629 - DNA, 1311 bp, Mus musculus
ttaacccctgtggatacttgagctagctaatggtgtgtttccttttccttccagatgctgtctatgtactgtgctactctttgattctactttccattgacctcactagtcctcatgtgaagaataaaatgtcaaaaagagagtttattcgaaatacgcgccgtgctgctcagaacattagtgaagattttgtaggacacctttatgacaacatctaccttattggccatgtggctgcataaaagcacaagtgttcgaacttcaactttttactccagactgaggctacccagggacagacttagtggcagcagggttgcatcagcactggtcactccagtccagcctgtgtgtaaaatccagcttgactgcacccccccttttttgtttcactgttttctagtttagaaatctcagaactaactaattttacagaacttttcttaatttgctcatcatgtttgcacaaaacagccactgtctaacacaactgttagagaatgttaaactgacatatgctctataaatggagtgtttgtgcattagattggtctgggaactatccatttccatccttttacaaataccatgtaatgtatgcatatttaactgaagagatttataatcataattattttattgtaaagattttaactaaaggttttccttttctcttgaactgagtttggaaatttatttgactttgaactaagaatattgttggctttgtcaaagttggatctgaccctagaaaccaataccagcttcccatttctctgaactttgaaaagaatgttgatttgttactatattaatatactatgcaaaactggccttatttgtataacatatcatttgattcatttttaaaacttctgggttaataaagtttcagtatatcacttaaacattgagaatataaaaatgtgtcagaatttagaagtcacatttataaacagaataaaatgtgattagaactcaaggaggtatttacttccttgtttctgaaatactcagtgttaactattttcctaatcttgatctcttgattagttaactaataatgggatactatgctgtgaatcacattcttcaaatatttatcaagggctttctctgtgctgtatcctatgctccactacagtactggtacctggacatgagttctgcattcagagatggcacatgcttgtgtaataagggggaaactgctgaattttttttctcttgttattttttggagtgtgattcactgatctctccctctgtctactcccgacctcttttctgtagctatctgtgttaccacct

SEQ ID NO: 33630 - DNA, 1112 bp, Mus musculus
ctgaacctctgaacctgtaagccagccccaattaaatgttgtttttgataagacttgccttggtcatggtgtctcttcacagcaatggaaaccctaactaagacagagtggcctgtgggttcccagggactgcctgccagagttgggggctgggataaagcaagcagtggagggaaggaagttaaggggaagatctctgtggtaattagggctcattagactctgaaactgaatccaaaatcttccgtgtagtactgtagcacgtcaggggctctgatgaaggaagggcttgataaatacggattgtgcgtgccacttaaagcttgtatggaacgctactactagcaaccataaagttatctcgttgcttcttcataactgtaattttgctactgttatgcactgcaatgtaaatatctaatatacaggatatttgctatgctacttctgtgggggtcaagacccacaggttgaggaccacagatctagagccttttgtatacaaagcaagcatggcactactgagctgaatcctcagctctagacttggctttggcttgaacatattcatcatttgtttgattgattgtttgtttgtttgtttgctctaggactggttgttctatttctgagatctctgagacccagcccaccaggaacacacaaatgtggaaccgagataggctgaggacttattaaacagaattctgctgttcctatcccagggttggaccaatgtgtagaaaattgcttatgggattctttgaatgactttttcattgcgggaaatattaaaaatgaacctgccaaccttccacactcctgcttctttcaagccaccaactcaagagatctgtctctgcctcctacgtgctggaatcaaaggtatgtgacaccatgccttgcttgtctttttatggacactgatttttatctacttttgatagctgctgaggtaggtttaaatctgagaatctgcctagcttttccatggtgacgatccattttaagttcttacaaataacaacagagctctactttctctgtgtgttttccaacattcctattacctacttttaaaaatcatagtcatcttaggagaagggttattt

SEQ ID NO: 33631 - DNA, 1146 bp, Mus musculus
ttaagcaaagtgttgccaaatgacttctgcagcttctgtttgtcacacttttattctttgtttggttttgtttttgttttttgagactgtgtactggctggttttgtgtgtcaacttgactcaagctggagttatcacagagaaaggagcttcccttgaggaaatgcctctataaaatcccgattaatgatcaagggggagagtccagcccatggagggtggtgccatccctgggctggtagtcctgggttctataagaaagcaagctggcaagccagaggaagcaatccagtaagcagcacccctccatggcctctgcatcagctcctgcctccaggttcctgccttgtgtgacttcctgtcctgacttcctttggtgatgaacagcaatgtggaaacgtaagctggataaatgcaacttgcttcttggccatggtgtttgtacaagaatacaaaccctgactaagacagactgggtctgtacatacctctggctatcctggaactcactttgtaaaccaagctagctcagactctacttcccgagtgctggggtttaagctgtgtggtactatgctggctgtgggcctgtgtactgggggcttttcacggagatctctggcccagctgggcgcaaggcttcaggcaaaggggagagagtgggagcagggagagggagttgtctccactgcctccacagcagcagctggctccacctcagtcacctcagttgctccaagacactgctgtaccagtcaccctgcactgagtcaggccggactaagccaatgagaggctgactagccagagaggagtgtgtgagtgtgagtgtgtgtgtgtgtgtgtgtgtgtgtgtgtgtgtgtgtgtgtggcttctggtggtgtttcaggagaacagacctcttcccaagtggcagctcttatgacagaagctctcagacaatggagtagttctcacacacctttattcctcctggatgagacccttagatacagttttggggtgggtcatggtctgaaggcaggtacttcccattgggttggtctgagagtttgggaataccttatctgcatgtgggagggcttggggtgctgcccctatgtgactgatggccacagacctctctatggggggactgtggggga

SEQ ID NO: 33632 - DNA, 2194 bp, Mus musculus
tgcagtgactgtttacaaaactgctcttaccttaaactctagatgtttacatcgttttttgttttgttttatgatgatgttggtaatttgtgcctttaactcggtttcctgaaccgccgagttaaagcatgtgttgtcttctttgggaatacactcaggggtctggaaggcagtttggttttttttgttgttgatgatgttgttcttgttttttaacacacttgaaaaaaaaaaaaggttggagtaagcagactttcacatccgacttggtgatgatcaacctgctgtgtatttaattttacatctttcggaagcactgccacgggtcgttggccagggtggccttccttcagttacgctgctgtttgaaaggtgaatttcaacacatttagtgcctctttcatttctcagtatattgtttgagagcttctagtgacacttctatgatggtgacaatgaatgtcacctggggaacccgtctgttactcacaggagaatttcttggctatgaagtggaatgttgtatggctgggtcgaggacaacagtgggcccaactcaaggctgttccgtggggcttgaagattctgtggcattacctccctggcctctgttcacaccagcttctaggctagcaaaggagtccttcttctaaaaggaggggttggtttttgcccatctacattttgcatctgctttccccagtaccagtcatagaaaactaaacataattctcagtttgaaacttgaaggggggttgaggggcagggaaacaacacaataaagccctagtgtggacgccttaggttggtcctgaggtaaaaatccccaagcccttgtgagatggaagccttagagaaccacctcgaagcacaagctgtgcacagagataaactgacactttgtctacattcaaaggaaattccatgagcattctttttaatttaggaaaattagtatctaattttctattcttagatcttattatctaagaatacaaatcatcaacaaatgtggacgacattctgcgaagttagatgctagctctgtagggttccttaatttcttttttaagaagtataaattttttttatattccccagggaaaagaagatttaatttgaacatttattaatacaatacctactttaagagaaccaaatgttgaaaactttaatttctaggaagtctcttattacaccccccttcccccaagataaaatgtctacattgagtgccaaaaaaagaaaaagaaaagcaatgtggtgagctggggccagttaaacatttttgatcatgtaatcatggtatcgatgacagaaattcacaaactactgccagaaggaaatatttttaaatacagcttagggaaaagaagaaaaaaaaagcctgaatttttttttggaagaaaagcatacaattatttttcttccaaccttagttcatcaaatttgggcagtaaaaattcaacatcctgaacagttttatttataatcttgaattgtcaatttgtattttgctactgacctgtgatcaactatttaaactttcatctctagggatatttaaagaagaaatgcatttatatgcttatataattgcaaataaatccactgtagagaggaaactcggagaattggtaattatttgtgtgttagaaatggacaccatttttcatgttaaatagattttaacctcgtatctatgcataggctaaggtggcacatgaactgtgcatgtcatgttatgggtaaagtaaattgtttttacaattcgttaggatactatatgaacatgattctatatattgaaatcagaaacctttccacacatgaaagtatcagaagctgccaccataatgactattttgtacttcaggctgctttggaaataatccccatcgccttgctttgtaagttgataatatcactatgcatttctacacattttataaatttgatttatgcagattttgatacactgtatgtttctgtagaaattgtacaaatattcaaaattttattagggtaaactcaagaagcttatgtataacttaattctgggttgcttgttttttaggtgaggaaaaataaaatattgtattttaatccatagcttttcagtgcttgtaattatttctatatataattgcacacttactcgggtttttaagaagagcaagagccaaaaataaat

SEQ ID NO: 33633 - DNA, 1202 bp, Mus musculus
tgctcatctccatggactcaagagctcgtatcctcctcagaacccacagaatcagcactagatccgaatggtacagtgacctataattgagatgaagacaaaattcctctaaatgtgattattttagcacaaaattctatcccaaatgagcggaatggctatttgcttttgcctccatttaaccactccgtggtagttagaggagagccacactgtgtgccgttatccttgttctgagacaccttgagtcccctccccaagaagtgctgcccagccagtgagaggactgagaaagcagggtctgttccgtgtccagagcggctgtctgcccccagtgtacttacagagctcgcctctctgtgcctctcagtcacatggatgctaaaacagacctacaggttggtgatactagttacagcccggcaccacaacagccctgaactccgtgacagtacattgaacttggaagtctcacactcgggtgctggcttgttacaaaccatactgtttcctgtgtgttggttctcttcatcctttagatccgaggcctcgaaactgcatactgtattgatagcatggggaagacgaatggaggcttcgtggagctaggaccctgccacaggatgggtgggaaccaggtgagtccccttccttcagggctggtcagcactgagatccaccagactcactggtcacagacagacgagtttagtttgggtttgggttttggtttgcttgtttgttttgtttttaagatccatctacccatccatttgttatgcctgcatatatgcctgcatgccagaaaagggtgccaagacttccttatagatggttgtgcgccaccatgtggttgctgggaattgaactcaggacctaaagaagagcagtcagtgctcttagcctctgagccatcatctctctagccctttgtttggtttttaatttattaattttgacttaataaaaaatgttcagtaaagctaaaatatttcacttaaatagggaaatgtagaaatgtctgcacacaagtgataaaagtatgttcttgtgggaacatgggaacgtatactaatgatgactgagtaagcctaacccctaaaggtttgcaaatggggtttactaagtgaaattggtttacttccggtaccggtaggtattttacacaaatattattttacacatattctcttgcttcctaa

SEQ ID NO: 33634 - DNA, 1107 bp, Mus musculus
tgagccaagatttgttagcatggtagcacattattagcatatgctaccttctttaagagagagttcttgatccactaaggtttaacaatgctgcatctcatactacccgtcagatttacagtgcacattgacaagtaagtgtgttagcagataaagagagtcgtatgaaaaaggaccttcaggcctggagctcagctcacccagcctatccactctttgcagaatactttgttttcatttgaatagttaatgtctcctggaaaggtattttcctggttacccaaacttgttgggtacaaatggactctctagtggaagaatctatcctcactggctgatgaattacctgtttttcaagctctcttatgtatgccattttaccatctaactggaatcttaccatctttctcagtctattcagggtcttcgtcttttctaaagcttttcccgattacttactccacagtgatgtatctgattcagaaaggttccccatgtgtcccacgacgatatctaactgtaatactgctagcattgcctgtttccagacatgctcctatgctactggtgggcagacaggcactgttgtaagctgccctcctggtcctctgctgactagtccctagtggagggcacttcaacgcttggtagtagcttttgtcactgtctccttggtcataagtcctcagagactttcttactttttacttattttatctatttattcattcattgtgtgtatatgtacactgcgcgtctattggtttgtcttgtctgcctgtctgcctgcctgcctgcctgtctgtctgtctgtctgtcttttggcttcatgggaggtggaagctccaaggactcatagactcatgttccagtgctgtcagcagttatgtcgcctatgttgggtttcatgtggatggcgctcacactcactgatttcactcttattatttgtttaataataaacaaattattagctgtatgtccccatttatagaaactttctcacggtcatggagaaattctactgaatgatttcagatgggtttcttgggataatcctgttttgtgggtcacctctgtcttgccctgttgccacacaaatcatga

SEQ ID NO: 33635 - DNA, 1202 bp, Mus musculus
atacatacacatacacgcatacacaatggcacctgcttgaactagcataggtattacttgtggccgtgggtactgcactgagtctgactgattcctcttccccaaaggtccagttcctctgcaaggaaggtagacacacagccaccatggggccagatgctcacacagccaccatggggccagatgctcacacagccaccatggggccagatgctcacacagccaccatggggacagatgctcacacagccaccatggggacagatgctcacacagccaccatggggacagatgctcacacagccaccatggggacagatgctcacacagccaccatggggacagatgttcacacagccaccatggggacagatgcaaagccaaccttctctctcattagcagaggaagctacttgactctctccaggcttcatttggggcatgcttatgggatgacagtaggcagcttaaacttctagaaaccattccatttcctgcttgttggctattgtgactcatctcagtttctatagttctgtgttattctaaatgcaggcactggaatatcctgacctgccataggccagggtggctcttgctgtcattctgcctgtctcctgccacttctgttagtagcccaatttggaaaaagggctttgctgtccttgtttcctctctcgttcattctccctccccctctccctctcctcctccctctccccctccccctccccctcctcctctccctctccctctctccctcccctctccctctccttctccccctccccctcctcctctccctctccctctctccctcccctctccctctccttctccccctccccctcccctctccctctccccctccccctctccctctcctcctccctctccccctccccctccccctctccctgtccctgtccctctccctctccctctccctctctctctctctctctctctctctctctctctccctccctccctcttctcctccctccgcctctgtgtgtgtgttatttattttttatttttaacttcaagcttttgaaactaggtgacctcatctctgggttggactacagttagatgtctcaaaagtaacggacttttctccattccagtatactatccagaagccggagattcacttccagaaagcactggcctaacgcccatcctttgccttgaggggg

SEQ ID NO: 33636 - DNA, 1201 bp, Mus musculus
gcctcttttcatgatatgaagttttaaagagttttgctttcatctctggagaccccacttttaatgctgtattactaactcaaatgagaaggatcacagcatttttcaacaaaatcgagagtcattcccctccgaaaataatgaggccctcttctccgatttaaatttaatctcggtaagaataacgagtactgttattttatttttaaatacaaacaagggagactgaaactttaaaacagagatcagaagccacatagtgtgtgatgggcatgatggagttataacttcagaggctgcatgggctatcaaaacagacccagatgtttaatgaccatgtgattgccatcagaggaagtgaccatggacaactgctttcttactgaggtactggtctttttcatatgagttggagtagactatgctgctaatggtcgctagtgtaggtcaccccttgaagctccccttagaatatcatggaaagtctttaaactgtaataatcaatccttttaagtcaatgggaacaaaagtgggtacattaggcgaggttcgtgtgtgatctgcactctacagcaggggtatatgtaagtgaggatagtaggattgtctgtggaaatgaccaggacaaggctacagacaattcctgtggaaatcaatctgaccaggcttggagtttgatcagatttaccctttatgagaaattcctaattgaaatatcttatgggtcacctaaagaaacctatagcctgcagctataagaagccatgacttctttttgggctctctggagggcaatttcatacagaaaaattttattcccagatcttagaatatacagagtccatgattttcatgaagattgaaaaatacttttgatatatctgcccacagtaccaacagggactaactattgaatgttttgtgatgatatgtgaactctattctattccgttctcattctatccaaacccatgtgtagaattcctcatggaaactgcagggcaaggtacccattccatacagatactgatttaggattataagctaaaggaggccaatttactatgaaataagatgtatggccaaagaatgtttccagtttgatttggattctttagcctgcagtgggatagagagtaaggggataattttcaaaccttcctctttaaggcaccagctgttcttgggataagaatctcc

SEQ ID NO: 33637 - DNA, 2729 bp, Mus musculus
atctcatgttgctctgcacctcactggctgcactccctgaggagtgcagtgggagtgcaggcttgagcctccgcggagccgtccgtctgtccctgggatcctcgagcgtctggcggttccctcagcaccacagagacgcattacagtccctacttctggagggactactttgaattgagccatctattaagactgcaaggtcttgcccttttataccagaactgttgtgttaaactcatgaattgtatagttacgcatcacctttctacattccaaaagagcttctctgtcctccctcccccttcctctggagctgtaacgaaacctctctggtgtgtccttttgaagcagtcctttctcatattgagatgtactgtgattttactgacgtttcatcacaagaagggaatgtttcttgtgccattaaccatgtagtctgtaccatcactaaaggcttgggaatgtgtgcacacaccactgctggccaagcagggaaaatctggaggtgtgaatgcaatctcccagcttgtgtgctgtgtggttcagaatctaaaacaaacttgactctaatcagttttattttttcctctcagactttatggataatgtgacctagtcttatgcaaattttctatttctgagatgactactatgacagagaagtgctgttcagcataacgaaagcaagcgctgctgccgtgactgtaaagaggaggaaggagtctgtttagctgtacctggtattaattgcatgttaaacactggaattttgttcttcaaattagatcattcttttatttcaggatgtttcactgctgacactggagatgaactgtaattcataacttgcactaaatgtatatttcttttcttaaaaatttaccatttttatttatatttttatggattaaaatttataaaatgcagatcagttaatattgcacataaataattttacctttttaatgtgactttttttaatagactaattctgacttacaaatatggaggtatgagtaaagattaccatgggcacaagggtttaagaagaggtagtcatgtccgtgacccagagtacacatgataccttctgatttctcactgccatctcctggcctatgccctttgacctgtccatcttgaccacaaactagaaagttgaaaataccataaattactagtactagattaaagccaaacttttttttttttttaagaaaaatcaatcaaaaatgaaaacaagaaaatcacagtgtggttataacctttgaatcactgggtaggtcacagccatccctgaagtgttctgtgatgatttcagtagatatggtgcacgttttacagattagttataatgtacctcagagtataaggagttgttattggcagtgttttaatcatggtcttaatttccaactggcaaagggtgtttactcactagactgcccagctagtcttcaagtatgcatttttcaaaggccaaatgcatttgtgcagacagatattttctgaaacaactggcatgagccatttttaataaatatgaaatcacattaggtctgtatgatcttgaagacttagaaaatcaggaagccatattcgagtgatccaaagttccccaaaattgctgtctgccagtgatattttgtctttttactcctgatggcagatttcaatattcctcgttgctctttggctaaatagagtggactcatttttaatggtagttctgtagctctgaaagtattcttgcagtatggaagacactgctggggtaggaactcttcagcactgctgattggtggctcagccccttctgagttccaggtcttcaaaggagacgccagtttctttgtagtttaacgcgatgaaactgaacatgattttttttcccccacatttccttttctttcatattctggtttcatgacccatcttcagagactgacatttcaggatccatattaaagcattcattttctttgttacatttctctatctgatgtgtcttactgctgaaacacatgaaaagtgacgtgtttttaatgcgttcagaggtttggagtttgttttttctttcttttgggtattactatctgttctgtttttctcttttcataaaggtttggttgatttccaaccaaataagatagtggataccatgaactacatgtgcctagctaattggcaaacttattgaccaatatactaagtgcagcgcctcatttgagtaccctttttaggaaggtatgatgaaaatgggcgagcgtgtcagcatctattaataatcgtttttggttttggttcatgaagaatgcttagtttgttaacctgtgatgttgcctagagctgtatttatctgtttttatttatactagtgtagtaaaagctgcatatcattacagtaaaaatgattactgtgatgagttaagatctattaaaatctctacttaaaagtgtggtttggcttttaattgcacctgtaccaacagctcttcctttgcgcagccgcactgtgtggtcagtgtaagccagcatgattgagaatgcgtgtacactgcactgcaacaggctagggctcagtgtacctcagtggccagttacctcctgccaacatgtgggagccagagatcaaactcaggcttaaggcctgctggaaagttcctctgcccactgaacaatcttgtcagcccaatactaaggggttgtttgtttgtttttgttgctgt

SEQ ID NO: 33638 - DNA, 1176 bp, Mus musculus
atttctgcagtctcctttccccattctgtgggatgcttaggagtttctgtattttccttcttttcatttatttttccttttcatgtaaatgtttcatctaactagagtaaatattttggtgcattatagctgaatcttatggtcaaggtagatttaacattataggaaatggccaaactgttcttccaaagtgtccgtcattttgattgagagttccaggtgcctgcttcctcatcagcatttatttggtagtgtcagtgttttggagtttatccactatgtaaaccacaagagtattgcagtaagtaactttgttattctaccctgagatccagtttgtttaagtatatttcagtgttttgaaaaagtctccatattattatatgtgccttttgaacatattgatcacatttttgacatctgtgcctgagaatttcagtacctggaccatccttggttccatttgtctccttattttcttccttctctttttggatctttcttggctttagttcctggcagggtttgtgattgttaactggatactggatactgtatgcagatagttgtggactttctgggtggcaatatcttcaccagagaactttcaaatttctccccaggaaacagacattctagaatcttggaagagaatttacaacatggttttaagactttctgttatttgtttctcttagaatcattttattcttagggcattgctcttgaggctttttgcagaaagctgcttatctgtgtactggaagtcttcagtggtaggcactgatgcctgctttttgcctcttagcattttaagatagctattggctctgctttttgtaataatgactgcctatttaccttttgcttctttcgagaatcaaacattttcggaataaagtggggtacagtgaaccacttcatctcttttctgcaggttatcagtccatttaaattcacattgctgtggtgcttttgtacttcagagtgtgagttctgagcccttcaaattgttaagcatcagcagtcaccttctggttttccagttactctgtttatgagtgtgtaaatggcacaagcacaaatgattgggactgttaggctctcctctttgttccgttgcttttcacaacagggccacctctagtctgccttctcggatgatgttctttgatg

SEQ ID NO: 33639 - DNA, 1177 bp, Mus musculus
aagttcacggtggttcgtgcaacaagttacactcgtgggtgggtgggtgggaatctccaggtatttattccaccttttggaaaagaaggaaataaattaaatgggtaaaattattctcattctggaaaagttcaaatggggaaacacagcatgagaaagcaaggcttgttgcaacccactgcaaaaggctgttgagggccagtttaaatctcaggcatcctctgattttagtatagatgaggtaactggggaatatagataacaaaattaatagtcaggggagtgtttaaatattatttaaagatggtaatgatagaattagcctagaatgagcaggataccagccagccagttctcctagtctggtgtgccttaccttttggtacagttttgtgtgtttgtttttgtttttgtttttgctttttgtttgttttggtttgagttttttggtagttgtcctgggaataatgtctttgaaacacagtgatctaatgaggcatagtctggaaactgtgaagtgaaaagaaggaagccgagagtgggggaggggcttgagaactgacgtcatcatcatcatcttagacggggttccagggctactctgaggtctgcttgtctcagagacactagatcagcacttcacagccttcctaatgctgccaccccttaattcagctcctcaggtgccatgaccccccaaccataaaatgattttccttgctacgtcatacctgtcattttgctactcttgtgaattgtaatgtgaatgtttgtgttttctgatgggtcttatcaaacccatgtggaagggcccttcgactcccttaaggggttatgacccacaggttgagaaccattgggagaggggagaggatgggggttttcggaggggaaaccaggaaaggggataacatttgaaatgtaaataaagaaagtgcctaatgaaaaataaaattaaaaaaaaaagaaccagtgcattggatgttgataaaatgtgcacccctgagtctccgcccaacctgctggatctgacttcctggggctgcctgagacccagaaatctttgatttacagaggccgtttccatgctgaaggttctccactcccaggatgttcatttggctcatagttgtgccaggatatagggctctaaggttgctaatcttttcccactgat

SEQ ID NO: 33640 - DNA, 1144 bp, Mus musculus
gtcatagacaattatgtattttatttgaaaagaagatactttatgtgatgtcaacatagttcgacttcatatttttattttttcgctttaaaagagacttcaactctcttataaataatagtctttgtaatggttcactttaattcggaaaactgggtttgttccaaggtcagcagcatcttagaggtagtcatgggttacaaaattctagagccatcctctaaactgttcctcttgctatgactcgagagatagggttttgcttcagcggtaaacgctcccgctccttcgcggcaagaaaatgaaaataaataaagggaacaaagggaagctggagggaaagaggagagataaggtacgaggctacagagagccagagggcagaaggcagcctggcacctgtcattgatggagagagtggagagcgggaacgtagcttagagtcaccgtgcacagcggctccagctctagcacacagcacggttagggttgtcactgtccccctttataggcaagggcgcatgcaggtcttcacattgtagtggaacaagggtctgagctgaattttatcgtagtatttggtgacttaccatggacccaactccacctaaaggatacaacgtggctcttcccaccgtgtttagggaggagggtggataggaactggaactcttcagttatgaggctagcttatccctgctgcagactgagagtgcagtgcaggggaggatcggggatgttgacctcggaggagacagggagcctgctgagggaaagcatcccgaatgaaggtccttgtcccagagtggacaatgcttattcactaagacaaagaccacactctggccttacaacgccctgccttaccttgttatgttgttaaagcttttcttatctttcccttgttccttttgagtttccgctcccatcttgttttcttttttcctaccatatgatgtcttaagaacaatgtgcagatctgctaggcaggtccttgggcttcttcagtcagcttagcttattctgtaaaccccaaaaccccagtgagtgagagagggaggaaaatgtggagggcgcctgagcgagatcacccaagcttgtcctctgtcctccacgtgccatgtgccacacaagcacacacagg

SEQ ID NO: 33641 - DNA, 1121 bp, Mus musculus
ccatgacacccctgcttgtgacatcctgaggcatgattcatactgtcgtatgcctctgaggcatttttatattgccctcatcctcaggggaagcaagatggcctgtccgattgcccggttcggtgggaaacaaggtgctgagggaaagacatcccgtgtgttgggatatcttctctcctcatgtctgcagcatcaagtaccactcccatattcctcagctgtatctgccctgcaacctgagggaaattgatcgagtgatcggaggcagtgaaatgacctaaataattcaatttctttctcgtcaattaatctcgagtagtatcatggatgacacctttgaacacaatttggattgacattatttcttaaaggtgctataatgaatttttcgccataggcacacctaggctgctccattttgattgctggtcctggctgaaagctataagtaagaaagagtgaacttgaaaatacagaagtgctttaataactttacatagacttggtgtatcagtagagagatgagtgtagagtcacagcttgcctgtgcagggtcttcgtgagaatgtgaggctgatttagccccaggccaactctaggaacagtttgattcatggtcgaatataaaatgaggtatcatgttatgtgatagccaacagcactctgtgtatagcacattgtactgactggcatatctggtacaccttgagtctttagacaattggggatagaatataaagaaaaggattctgccttccctggataacttcatatacagatcctcttgtctgtgtgacttcgtccaggataatttgttgtattaaatatggtgaacttgggttggagagatgggttcagtacagggcttgccatgtaagcatattgacctgagtcaaattcacagaatttagataaagccaagacactagataatcccagcatgctcccacagctgggtgggtggcagactggagagcccctagaaacccccaggtcaacttgtctggcataagtaactatggatgaacaaaaggccccatcttaaataaagtagatgatgaggaccaacatcagagattgtcctctgacttccacatggcaccaagctcatgtgcgtacac

SEQ ID NO: 33642 - DNA, 1201 bp, Mus musculus
taaggaaataaacttcagagcctgctgacaagttagtatttgattaactattaacattaactttaaaaacgaatggtatctgcttcagtgtttatcattaactatgttaaacttgtactcagatggacaagtgtgactttgtgttttcaaagaataatcttaatagtttgaaatgttcgggcttgggcagtgtcctcggtcacttagaacagtgctcttcagttcgctaaggggatgcactgacaggtactggtggtgagctgaataagggcccttaaagatgtcctcctcctgaccccagccccacacttcctgcttccttgctagcatcaaggactgtgaagatgaggacttacccttttgggtggacccagtgttgaatctgggaatcttcctgaaaggggacaagatggagatcggtagctcacaggtggaatcacagccatgggacgcagaaggccaagaaagagaggccagaggcaggctctcccctctccacgttcacatggaaggtctccctacaacactttgattttaggatctgggttcttcttctcacaaagtttgaggtaacttcttttggtggccacttgtatatgacattgtcatccccttgactgtccattggtgaaaaagggcctctgtctgcttttaggacatggcagtgattccaagtgccatatctccaggtgatggtcttccctctgcagtcagttcttagtgtattggaagtccgtagagctgtacatagagcagaagtacaaagagctgtatctatctccctgtgccctcccttcatcctacgaaccacctagaacatccagaggtattttcagacctgaaaactgtgctttcttaggtcttcacttattccttttgtcacagatttcaaatttcccccctcttaaacctgctccagattcagtgtagacccttctggatgatattaatttggtaattccgtgatcaccgtcgcttgcacagacgtacctccttagggctgaagtgtagctgggcctgcttcatcatatcaagggagacgttgccaggtgccacacattgtcatggcacttctgctgttatttattggtagtaaagtcttcttgaagcttctcctccttacagtgtcatttccgccctaagtgcttgtaaaccttcctttaatgtcatccaagaatttcctagatggtctgcaaattgc

SEQ ID NO: 33643 - DNA, 1160 bp, Mus musculus
aatgaccttgttctacggttctcttctgggtaagagagtaaggaagtcttacaaccaacttttccttttgtttttttttttttttgtttttttttaactttaagataaaagtagctgggaaatattgacatgaactgaagagtcacagaatggcaagagatcccattgtcttaaagagatacgtaatgtggctagaagtggaatcattcctgttaattgatttttttttatatatatataaaaacactgtatattatgttcctttgtgttgaattttttttttaaagaaatactttacttggatattcatgtaatatataaaggtttggtgaaatgaactttagttagaaaaaagctgacatcagctttcatctgtgtgagtcgacaccaatgtgtcataatattctttattttgggatattagtgtattttatagaaattttaaaaaagcaaaaagactactacaagttaagatgatttctttttttacctgtcttttctccatattttcagctatgtgattgaagtatccgtggtaatagcttcctggtataacgctggttaaactctcatctgttggtagatcactaggtgatataatgtgtgggttttgtattgggctttttggagacagtagatggatgttgtaacaagggcttgtcacaccgtggtggggatgagaagtcgacaatttctcatgccttttatggtaattttgaggactggatgaaaggtttcattattaaaaattgatgttcaacccttctaggcccttttttttttaatcaatctttgaagaatttgcgccttaaaatgaataagaacctcttggaggtggagaggcggctcagctgtttaagagcctgcaccattcttgtggagaacctgaattcaggccagaccacagctgcctgtacctccagcgccagggaacccaggactcctgccctcttcagcacggacacgttggacttgatttctagttggtaacactccagatgaatctccgtctgagggtgccttctatgaggcttggcttgatggtgatgatttctttttctctcaaactaactttattccccaagaaacttaaactcttcaatgagttctggatctcctaagacagtgtgtaacacttgctgagcttgatccctccgggt

SEQ ID NO: 33644 - DNA, 1131 bp, Mus musculus
tcatctaaaaaggatttttctttcctttgcccctcacccaccctgtttcacaccactccccctcccatcacctctctacctgactacctccacttgtttatcttttttctgagccaggatgtcactctgtagccctggatggatgccctgaatttactatgtatcccatgcttgccttgaactcacagcagtccttctgccttattgtaccaaatgctgaggttgtaggtatgagccattgtgtgtgtgtgtgtgtgtgtgtgtgagagagagagagggggggggggtatatgcatatatatgggggggttgtgtgtgtgtgtgtgtggtgtatgtatgtgtgtgtgtgtggcacatacatgtgagtgtgcgggcatgcatgcatatgcctttagtggccagaggagggtgagggtattggtaattttcctatttattgacttgaggcgggctgtcagtgtaccagaggtttgctattttggctaggatggctagccagtgacctcttgaaatcttcctgtctctgcccctgtctggggttgcaggcatgcatggacatgcccagcttttaacaggggtgctggagagactcagtaagtgctcccatctggtcagccatctctacagtcacaccctgttttcttagagtgatgctacttttctctgagctgctcagcaaaataacctggttatttaagtgcggtgcagttgactttgtatatagcagttcttggggattgtagctgtacttttgctactttgtgggttcttctttcttccatccttatccaccttttcaaccccctaacactaggtaggggagaaagagatccctgactctaattcttttctttttctttttgttttttttgttttgttttgttttttgtttttctttcactacagctactattaaacagtagccaaccttcccaaacgaccaacaacaaccaacagcattcaaccaccaaccagcaaactacctcttctcagggccatagcatttattatatacccccataagtccccagaattacaaatgtctcacagtagcagaacctatctggagctggcaaaatcatgcccctgctagggtgtgaggcaaatcatagtcagctgctgtggaccgtc

SEQ ID NO: 33645 - DNA, 1755 bp, Mus musculus
gcagccacagaccaccaagccaaaaaaagtacggccctcggccagtcgctacgcagcactttcggaccagggactagacatcaaagccgctttccaacctgaagccagcccatctcacctgactctgaacagcggcttggtagaaagtgaagacctgtgatgggcgcccttgttgaagctgaaaactgaacgccagcgcttccaccagcctactcctctgtcgcattatgggaaaggcagaagtatacttttgacttaggaaattgaaaaaaaaaaaaaacaaaacaccaaaatcatatttttcttacttaatagagagtctaagtaggtgatgcttatagaaatgtacacattgcacagaaaattcacatttattgtccaagttaagacttttggaactgctgtgattaaaatggtctgaaatgccaaaatgccaaaagaaaccaaccgttcaaaggtaaccacaattgatgttatttaagtgcctttaaatacaagctataggtgctatagcatggcagtgtgaatgttggaaagatacgatgactttgaagcacagcgtctacagatggcccagtgaacctcatgcgctatgggggggatgagaaagagaagggtggagacagccgagggaatgccttgtctttgcaaactgcttatgttacatcagaaagagggaagtccttgccttaaattctgttcatatcaggagttttccttgtctgttatcttatcaggaagcttgcttacaatctgtggtgaataaaagattaccttaaagttaataaagggttctggagaaagcagacatttattacagtccattccacaagaggcatccaaaccatgaccaaggcatgtggcatttgggggaggcaggtttggaaggcacagaaagaaggaaggaaggagctgctgcccacatggggatctcagatccatttaggtgaaacatcagggccaggccaggctctgctctggttttccccgaatccttgaaaacacaggtgtagaaaacactgcagttaacctgtcaaggactctagggggacaccaggaggtgtggagcgcatgcgtggtagaaacttccatgtagctgacgtgtgtagtagttgaagatattagtgtgtagagcaagttggacatgatagaggtggcaggggggccatctgagaagtggccggaagggtctagtctgcctgagggaaaaggagacttgatagagaacaagcttgtgcaagacagtgaacttcttttccattggcactagaggtaggtgccgagtggaagttactagttccttgtctccatggaacccagccttaggagggtcccaggctctgagcatctgtgaggccagctgcaaagactgctttttgaatgcacgagtctgcatcggctagcctgagttgattctgaccagacttgatgactttaagtcggaaccaattttttttttttaagtgagagaaaataatttggcctgatagtctaaaccatgaggctttaaaggtactctgctatgaaaagaaaacactgtgtttgttcctcatgcaaaacatatctattgttcattatttataaaggtgttgaacttcttagctcagttactcaagtcatacatagtacttcttaaaacgattttatatctgtaagcaccccgtatattttgtattactgcctcacttgtacagctttctacttttgtaagaacaccaaccaagcaagttttagcaggcttgaacactgggtggc

SEQ ID NO: 33646 - DNA, 1173 bp, Mus musculus
acatccctagattctgacccccagatatacctggcaaatgatgctactcctgtattgcttataatgaggcttatagccttgtcattggatacattgaattatgaaggaccagaaaatttttaaaatcataagagaaatttgtcctttttaagtcctctcaacattcacacgttgcattcatctttatatatttttatgtgtatttttaagcaactttaagaagcttgcccaagatcaaggctgagtctgtttaagcctcataggaagacacatcagattttcatttcatgttgctactccctaggattgaaacacaggtagtttctgtctgtggcatttacctagccactgaatatgctcccctatgggtgtccgaaccttcctcaagaccaggttccagttagtgtttcctgaactcctgaaagcaccttctcttcatatgagtagttgtagatgctttaaaaggatacactatgaaggccatctatctatgcttcgttgaacttgaaggctgacttggacttgtgtgtatgcccagcagttaactatacttatgcctttgttgtgcagggggttcccaaagaagtccagtagaactgctagaattgcctctgatgaggagattcaaggcacaaaggatgctgtcatccaagacctggaacggaagcttcgcttcaaggaggaccttctgaacaatggccaaccggtactgatggatcaggggcttaactggtactgatggaacaggggctagccaaacggtactaatggaacaggagtttaaccagtactgatggaataggggcttaaccagtactaatagaacagggccttagacttggaaccccagccccgccagccagatctcctctggttcactcaggctcacgttcataagacttgtccatgaggctctgtcattatctctgaattccagtatccctcttagtgagtaggagagacacggaagtactgatggcagcaactagggctgacaccacaacatgatatacagtgctataaaggacccacagagagtccatcttagctaggtggctccctgggaggaaataggaaggtactctgggatagctggtacccagaagcagtgaaatggaatgaaaggcttccacccaggataacctgggctagaaaacccactgctacggctga

SEQ ID NO: 33647 - DNA, 1208 bp, Mus musculus
cccttattttaaagatgaggaaagagattcagaaaggttaagtgatggaggaagtaatagtttaactttaaacatatgtaagtctcagtccagtaccgacacacccaaaaagtacatcattacttttcattactaagtcagcaagaggtatgtggataaaactctccagctagaaatcagaagttccttgggtccttgaatggattccctgtctcaatttcctagtgtagaagcccttgacagaaaacagtgggaactctccactacccaaacttgtaaatgcagaagacttagagattgtgtgtgtgtgtgtgtgtgtgtgtgtgtgtgtgtgtgtgtgtgtgtgtgtaataatttaaaaataatatataatatacattataacatataatttgaaaattatatgttagaaaagttcagtgattgatttagaagtgtaaacccagaactgttggaatgattttccaggccagacttccttctctccagagctcttagctgactgtcattcctcacccgcaacacgttcatgaacagtgaggttagcctgcctttgtcaccagtaagcacagagcttgagacgtcagtgaggtttgtgacttgtcgtacgccccaagtaatatgatatgttgcgggatgtcttttctgtattagggggctcagctcacaacccattgcatctcagtttgttcattgacagattgctttgaatgtggcattacctgtcaacatctctgtgcccttgtgacctccagatgtaggacttttttcaacttgttcttgtgtcataaagcaagcaagttgacatccagcaagagtcagcaacaccgtgacaacttatatcatgggaaggaaatgttcaaagattaccatgactggttttattatatatatacacacacattaagattaaaccatcactactcatagcaagaagcctgcatcagttagcatattcatattttatggcctcagagcaaaagatgctagcccagagttaaccaacatcaaaacctcatggcttcttcatagcttatttatataccagtcagattaaaaaagtagtttctaatacatgcatatgtggacgggtacccttggagaccagaggagttggaccccctggagttgaagttccagctgggtttgagcgctaggtgtgcatgtgctagaaaataagtgccagtctggttaagagcagcacatgc

SEQ ID NO: 33648 - DNA, 1103 bp, Mus musculus
catacaccaagaccacttgagcttgcctgggattaacctttgcttttctctttaacgtctgttccttggcttcagtgccatctcccaagccccgatcctgcctccgctgcccacctccctggctgctctcccactctgtctgaaaggtcacaggtacacacccaacttgagatagtatttagtccacttcccttctcacatttaggaagtgttccttaaatgctccggacatttcaggactctatttattaaacttcattttcaatttaactgcatatcatttcaatttccctttccttggcattgtatagctctgagaataagagttggaaacgtgcctatcacaagctgagtcacatttttttaaatgtgccccccccctcaagccattgttttcttttctttctttttttaattaaaaaaaatcctttattttaatagtaaaccttaaaccacatgaaacaagccagaaaactatataatgaattcatacatattcacatctaatgagggaatataacacaatgaccctagagcaccacccagctcaagaaagagaactttgacccatgccccagaagccctttgaacccagtcttgtgacactcagagttaccattgttcgcattaatcttacttccagccttctcaggcttgttgaggtttctcctcatgctgtggattcacctcatggccttgcagggcttcctgctatggaaggtgcttggcctctgggccaaatcttcagacccctgtgcagtgtttcaactgcaggtagtttttgtagtttcaaagggcctagtgacgtgcaacccacagcacgtatttgatctgtacagcctgataacgtctgcagtaaggagacacccttgacaaacctcatcagtcagagcagcaagtgtatgcatcatcttcaacatttgatcctctctctgcaatcctcccccctctcccaaaagccttccatgtcctactgctgtgtgttctcgcatgttctagagacacgtagaaagggaagcacaaaagtgcgtgctctcctccctgctccgctcatttggcatcactaccttaagacttgatcttgaggtgtgtgtgcatgctca

SEQ ID NO: 33649 - DNA, 1446 bp, Mus musculus
aaaatataaaagctagaagagctgggtagaggtcttacagaccctacaaaaccacagatatcaatcagtccaggaaactctattcagcaaaactttcaatcaccataggtggagaaatcaagatagtcaaaaaagctctaattcttcttcttcttcttcttcttcttcttcttcttcttcttcttcttcttcttcttcttcttcttcttcttcttcttcttcgggaaaacaccaaatgatggacgatgtcggtgcagcaggagggcccggaggactggagggggggcaggattaggaggccgaggcggcttcctcggaggattcggcagtgttcttaggggccccagttgtggctgagatcatggccatggctgtggctgaggctgtggggctcttggaggtaaagctgaagacaaggagtggatccctgtcaccaagttggaccgcctggttaaggacatgaagatcaagtccttggaggagatctacctgttctccctgcctattaaggagtctgagatcattgacttcttcctgggtgcatccctaaaggatgaggttctgaaaatcatgccagtgcagtagcagactcaggctggccagcggaccaggttcaaggctttcgtcgctattggggactataatggtcacgttggtcttggtgttaagtgctccaaggaggttgccactgccatccgagaggccatcattttggccaagctttccatcgtccctgtgcagagaggctatcgggggaacaagattgttaagccccacactgttccatgcaaggtgacaggccactgtggctctgtgctggtgcatctcatccctgcccccagaggcactggcattgtctctgctcctgtgcccaagaagctcctgatgatggccggtatagatgactgctacacttcagccagaggctgcactgccaccctgggcaactttgcaaaggccacctttgatgccatctccaagacttacagctacctgacccccaacctctggaaagagactgtcttcaccaagtctctttatcaggaattcacggcttatcttgtgaaaacccacaccagagtctctgttcagaggacccaggtcttacttcaaaagcctacaatcaacaaaattagaaaatctaagtgaaatggatgattttctagacagataccaattaccaaagctaaatcaagatcaggtaaactaaatagtcctatagcccctcagggaatatatccaaccgttacatctccaaacaacaacaaaaaatcaccatgggcaaattgttttaggtcagaattctaccagatttttaaagaagacttaatatcacaaactactccaaaatataaacagaagaaacactgccaaactcattctataaggacacagtcacactgataacgaaaccacataaatactcaaaatagaaagagaacttca

SEQ ID NO: 33650 - DNA, 1728 bp, Mus musculus
tgttgctggctttccagctggggcctcaaagcccttgctgacctggaattcatttgtaactcagactggccacatactgacagtccttctcttcagcctcccaaaaactgggggtagagtgtctgccaccacaccctgccctgtttttatcttttgtaagcatatgaggaattaaatgatttgggtaaagaagaatacttcttgttagcaagcatgtgattgttagtaagaataccatttgttcagcatgtgtctggtgaataacctgtgtccttttcatttcagcggttatgatattcctctcaacccgctgaacttggttcctttttatacgggcgctcggcaccatgatttccaccacatgaacttcattgggaattatgcctccaccttcacgtggtgggataaactctttgggacagatgcccagtatcatgcctacattgaaaaatcgaagaagcttgggaaaaagtctgattgagcacccccactcgacgccttcctcaactgcagctggccactaacactgcttctggggacttggctgccaagtgataaaaacgttaacgacctttaagtactcttccagatgagagctcttctaccttacgtccaagatctgtatatgtgggaacaaataagtaaatatatatacatatatatatatttaagtacagttttcatcaggaggttttaaaggccatattgctaacctcaccaaaaggtttcgggaactggaggaagtattaatgtacaactcaccacttcatgccataggaggctgaagttgacgttgccttttaagccttttacatacactggtcagttcggaaaattctcaacaataatgtttgccttctagtttaagacatggtgtattttagaaattacctgaagtgaagctatcacgaagtgagtgtatcacctggtgagcgagtgactgaaacctgctctggtctgggtttgaccaggttaggactattctttctgtgaaggattgtttgattgtagtaactctattggcatcttgtaaattggctcatttcctacgtgatgtacatagaatattatagcctaaagattttccagttacttgcggtctttttaaattgaggagccccacttccactgtccaccccttgtctttgtgtgtcaggtgatcattgaaatcgtatcttgagcttgaattcacttctctgtctgtttccggagctggtgaaataaatgtgatttttgtccgatccttctggttttcatgaagattagctgccatgttttattcttataaggaaaagcacagagatcattaaagtaagttttacaataaaggaatggttctgttttttcctggctgagctttgctggtggtcgcactgtgaccttacgtggctgatctgtagggggcgctccattgacctagggaacagcttgctggccttatgtggttttccacacgggcataaagatatacgttctaggccactcactgcatcccagtccttagggtttattgggttttgtctttttcatacaggctctgcctatcttaggctgaccttgactctgtaatcctgtaacttcagctttccagtgctggagtcacaggctaactgaccatgaatggctcggcaaggttttggagaggttcttataatgtggacaaggatggccttgctagtaatcctcttgtctcagcctcccaagatgctgaagttgtaaacactatgc

SEQ ID NO: 33651 - DNA, 1104 bp, Mus musculus
gtgttgcctgtgacatgtcttatcttttcattccttcatgcaggggtcacagttattgataaaccgttatgagcctgaaggacattttcagcgtatcattccatgagaaccaggcgtccacaagtatttctgaagggactgagcgcctggcctctccacttgtagccgcactttacgtctcagcagaagatgagaccatctgccttcagaggcctcggatactgaagattatttttggtagaagcactgtgtaggctttctctgcaccgagcagcagctgactgactttacaagagacctagactgcagtccctccactgtggtctttaggcaacagtcgctttcataaaaactagttcttatcagcctcgaatgactatggattattttgtgaaagagaataaagttaacgtgtgttcttgtaaaattaagttttatctttattctttctcctgaaaaatctcctgggaacagagaatctttggagcagattaaaatctatgtaagtatatgacactgttgaggggtgaaactgctggcttttataagtatctttgattacatgactataataaattgtgtgcatataaatgtgtgtctatatgctttcctttaaatatgtttgaaaagatgtttgattatctatttataattggcacagtactttgaattatgccagtactacattgtaaaacagagttgtattttttgatatttaacaatgctgaacactttaaaaaacgccacttctgaggaatgaatgaacatggcgtaacacactttaatatgtgtgatgccaaacttttttaaataaaatataaattatgcttatttattatttttttctttagtttaatcttgatcatgttttggtgtgtgtttttaattttttttcttaaagtaacacttttggcatgaacatacctgcaggttttttgatgaatataatgaatgtgtggaattcaactgaatttgcatggtcttaagaattttttctgtgtgtataaatttagctgctattaatggaagagaaagctttctgtgactaatcatgtgtattgagcagatagtttttctgagatcttcgattaatctctttaaaga

SEQ ID NO: 33652 - DNA, 1196 bp, Mus musculus
gttttttaaatgtatttgggtgttttgccttcatgtttgttttctgttccttgtgcatatatgtgcccatggatgccagaagagggcatcatatcccctagaactgacgtcggatatcgttgtgagctgccctgtgggtgctaggaattaaacatgggtcctgtagaagagcaggcagtgctctaactgttgagccatctgtctagcctcacagctattgacccttggtttaactcccttccccaactggtatttctgccttctgagatgttattcatgaatcagctagtgttatctaaggtcacaagtatactgttcctgctgtcggtcagatcattgatgggagtataagaaatgcgaaaggcatatcctctcttccatgcactccttgtaataggatgtgatcatcccacctgctggcacttgtcaagacgaacacacatcatgaagattagaaatacattaaggggaagcaccgttaccacagagcagcatatactaactagtatcttatgacggggggaaataggttgtttatttggctttcttttgtggtttcatgtccaggtttgctctatgccgtggggggttacgatggagcatcgcgccagtgtcttagcacagtagaatgctataatgctactgcaaacgagtggacttacatagcagaaatgagcaccagacggagcggagcaggtactagaagccccagccagcatctgaggtgggctgactgatggacatctgcagatggggtttgagaatgtgtgctgcttctcctggttctattaagtgacctgagtggcaggaagaagtagcgctttcgtatgttttcacagagtaaaagcccctctgcttcccttgtataatgttgtcttagcattccttcagtgagaccgatttctcgtgggccttcctctcccatcacatgccttcacagactgaatgcttcagagaatgttgtttgtgaaaggagtttattaaaggcttggtgttggttgcttctccttgactctcttctcctgttaggatagcttctgacccaggcccagccaggccattcccttccatttcgcagtgctgagcctccctgtcagtgccactgagtgagagttaggactcgaggtttgcatcccaagacatctgcatcagctgcactgcaccgaaagtttcttgcctaccttgctctactataa

SEQ ID NO: 33653 - DNA, 1135 bp, Mus musculus
tgcaaccctcatgtttctcagcgtcttctgcgctcgccctgctcccatgcctcccgtgcatccttcctgcttgtacacgtttccatcccgctttgtcttcttggagaagaagatgggtatgttaccctgtcctctgtagtgacatgctttctcctctgttctcatttcagtgtggaaataatgattttcagtttgagaattaagaaatcggtcaatcggcatgccagctgaggattttaaaccttctggggctggatagatggctcagtggtcaagactgcaccctgcacttgcagaggacctgagttgggttcctagtcctcctatcctttggcttctgcaggcactgaactcagtgtgcacaaacccacacttaagcacacacgtatgcacataattaaagttaaaaacacagtctttatggtaactaccttctgttctgaggtttgatgtttgaattgatcttcattagatacatcattgaggatccttttcacacggtaattgtcattgtcagccgagctctgaggtgtgagcccagatctctatgtatggggctgagcttggtgtgctgtgcaagactggttttgcagtctttctcctactgttcttactgtttgtttgaccttttcgtaatagggtgcaatgacttttctgtaattcttcatatttatttgaagtcagaggtagaggaatagcctgaaatattcacaccattggtctatgctaagccttaacgtgtctaagggttttggttttccccggtaactaacatgtgttatgtttttttgagacttgaggtttgctgagaatcacactctatgtgcacacctccctgtagttttaggtacaggtaggtgatcatgctgccagaatcacagaccacatgtgtgtgagtgtctccacattgggtgtggtttgagttttttttttttttttttaaagatttatttatttatttatttattatatgtaagtacactgtagctgtcctcagacactccagaagagagagtcagatctcgttacggatggttgtgagccaccatgtggttgctgagatttgaactcctgaccttcagaagagcagtcgggtgctcttacccactgagccatctcaccagccccgtggttt

SEQ ID NO: 33654 - DNA, 1236 bp, Mus musculus
atctgtctgcttctgcctcctgagtgctgcgataaaagacatgcaccaacatctcctgattcatgtattgactttaaattgtgcaaatttaaataccttttctggggtccaaaaaataaaaataaaggaaatatgtactaataagcagattgatttccttagcagaagtcactaagttcatttgtgaaagactggttttggaatatccctggggtataaaacccgagggaaacttctgggcaaagtgtgccttggggaatgcctctgaggactcatgtgaaatgagaccaaagatgctggtgcatccgtgtaacccgcgtatgtcttgaattctgcaggactgtttcaagcctagaagaaattgttgaaaagcaagaggacataattgtgtacctgaagcgacacaatgctctgctgagtaagcggttgttggagctggcaactcagccagccaggacttgagaggctcgtgggcatgagagccgctgagtccacagtgactgcagactgcccggctgccacaggaaaccccagcctttgccgacgtcgcgtccacagtgcatgctgggaacctgaatccagttctacctatgtagagctatgtatgtcccagatatgggggcgagcctctgagtggattataaaggtctggaaaacttgcgaatgttttgtatgttgtgaataatttaatttctggacgtttctggaatccagagtatagtttaagtaccctggaataatgcggttctttatcaaggacgtgcgacatgaccatctgctggaaacagggttttaaaccagtaagttcttgccacggttaagctgctgagagagggcattattttctgtggtcagttttctcctcaagagtgttgcaggcattttctttgtgtgtgggcatattggatgggagatgaggcctcctaagctgttttttgcttgtttgcttgcttgttttccagagctggggaccaaacccaagcaccttctcacacatgatataggcaaataccctactcttgagtcagttcctataaagatttccttcagccagccatgatgacttacagtgtcctccccgtctttgaaaatcgggggtaggagaatcaccaccggcttgaggccagcccagcccagaatgagaatttgctccaaaagcataaagcactttcctcattatagcaccaagagctcagcaggatgtgtgctgtgcaagttctacagtgtgtccttgaa

SEQ ID NO: 33655 - DNA, 1321 bp, Mus musculus
ccacagggtgaaggagagaccagattcctttgagctgtgccctggcctctgctctcaggagcatcctcacctgctatatttgctttctcccttgttgagagatacttggattacttgcttgttagattagacacctgtagcagggtagggagatgggtcaggagttaagggaactggctgttcttaaaagtatacccaagcaggctcatagccatctgtaacttcacccctaagggagttaacgcccccttctggcctccacgggcaaagcacccacatgcatgaaacacacataaaaattaaaagtagttgaagataataaataaaaatgaagcctaggtaaatcgatgtatccaacagcagctcgtactataccatgtttgtttctcccttgccttccgaatagaaaacctctaatttccttggctctaccagaagaagggtgaaagcaaagatacccaatcaccggaaaaacaacctcaggatggcaacaggatggcagctcaggagttactacgcaacagaggctgtttcagagtaccgtggatggcttttcagactgctcttcctggattctctttgacaagaaaatgatagaaagggaaaacagacgaggttaaagcacatgcgtttgtctgaataacaatctctcctgctgttctgcacgttctttgcgtataatgtatgaattacacatagtggtgggtttcacaaaggcatttacataccagtacatcacgtcctatggccgtctttccacacatgtgcatcatatacaccgattctttacaggcatgcatgccatatacactgactacatttgcacacacataccttcccctttctctcccctcaccctcctgcaggtctcttttattcacctgggcagttttgtttctattttaatggtttgtacacatgaatgattttattgcacattattattcttacatggattaaaaagaaaactactttaatatatttatgagtttattgtgtgtgaatgggtgcctctgtgtcatggtattgggtgcagctcagaggacaattttcaaaaggcagtttccttctaccatgtggagcctgtggatcaaagtaacattgtcaggcttggcaacaactctttacctcctgagcaatctccctggctcaagaaggaatgaggatgctcagtagagcacttgcctagtgtgctcaaagccctagtttaattaccagcactgaataaaataaaaaacggtggcaaaacacctaccataccaacattgactcgggtggagcggtagaggcaggagaatcagaagatccaaggttacctctg

SEQ ID NO: 33656 - DNA, 2323 bp, Mus musculus
ataggataatatttaggggaagtaaactacacagagcctatggttttcctgtgaattttttttttctttttcagtttagattgtgtaggattctgtgaggaaataaatactactgtagcaataagaggcaagtcttcaggcttggggtgttgcaacccccctccttaatgttgatactttgctctcatacatgtgaagtctgctgaaaggctgccctgtgcagcgggcagagctgacagtggccttcctggctttgccattaccactcaacactgcgcttatcttttctagggaatgggattttgatctgaagaaattgccaaacatcaaaatgaggaaactttgtgctgatgatgcagttcctaagaagcgcaaacagaaaaatattttaaatatagaaaaggatttaggagaattagaactatcagggccaactggagccactacagatgggaaactggaaccagcaagtgaatcaagtgacacggatgaagaaatgactccagtgcctgtcagccctcattgaaatacctgagaccttcatgttctactcagtgaccatggcacatagtcatttatatgtgggctggtgacatggcttagcaggagggggcttgcagccaagcctgactactgaagcttgagtcagagaatccatgggttaaagagaaaggatgctacaaattcacctgcacacaatgggaagtgtgtgtatgcatgcacacaaataaaatttattttagtaattatctgtatgtaagaatttgctattgaactcactcaaataagtatttgcagttttaaaatagatttatgatttttatttaagaattctctttaaattgcttttaaaatacagagattgtgttagtctgcttttcattatagccaaatacccagtactgggaacttagcttagagtctaaatagtaacctagtgcagttctgatgagacttctctgtctgtatcacagcatggcctacatcatagtcatagaaacatatatcggaggtggatggggcaggcaagataggaagccagcaaacaggaaggtctatatgttgccctagagtcctcttggctctgaacatcagcacatgggagagagccagttaacacttagggaaaacagcagtggtcttcaatggccgtttatccagaattttttagaaggggaatgtaaaaaaataggggtaaggaagatggcctggtcagtgaagtgcagcagagtgcctgagtcttcccagcacccacagtgatcaaggggctgttgccatgtgcccataatcccagtgctgtggaagggagggtgggtagagatggatgaacaagcagaagtgaagactgctgtctcaagtccccgtgagctaaagtactcagaaggggcagtgctaccaaaccgataaccaccgccctagggcctcaccccgcctcaggattgcactgatgggtttcagtctaaagcggcatttttactctgtgtcactgtgtattggaagtcacttggttttttatcttactgagaatcacacctaagtttggcttgattctcagaagaaagtttggccttttgaacagttgggactattcagggaccatggagactatctaaagaactgtggcggtggttaactaaactcattttgggatggccaaaggtagaatgctgtgctttgaattttaaatgtccccgtaggctcatgccttgagccctcagtgtccaccttctggtgctcttctgaaggctatagagcatttctgaggtggggcctggctgtcagtagggacaggtctttgaaggttttacataccctgaatctagccaaatctgtcaccaggcaagaagtccttgtcaagttgctgcaggaactgtgacaaacagaagtccctctgaaactgagtcagcatatactttccttttagtttccccccagttaagaatttggattacagcagcacaaaagtaacaaatccatctttcaaatatcagttcaggaagcacacttcggtgactcctgagtacctacaggcagagatcattgttggagagtaccagtcaaaaaggcttttgccgagtgagtgccaagtgacggaaaccatgcgtggtgatctgcttcccactaagttcttttccgaactttaagataattaactcacacgatatgtactcactgataagtggatatcagcccagaaacttagaatacccaagatagaagatacaatttgtaaaacacatgaaactcaagaagaacgaagaccaaagtgtggccactttgccccttcttagaattgggaacaaaacacccatggaaggagtaa

SEQ ID NO: 33657 - DNA, 1196 bp, Mus musculus
tttagaactgaactaatgaacgtaaaggtatattctctattgtcccagagactgtgatccgtgtgaagtgctagtcatttgtgtggtttctatttgcataattcaagctcaaattaattaagaaactgaaagtcactcagaaaaagactatgtgttcatatttgggccactgtttatctgtctttggggtttcttgacctgtggttgaaatggtatgaaatagtatgattgcaaactatctgtgcatgtacctgtttgcatgcctattacttagaaaaacacttagtttttatcacataagtaataaatgtatctaagaggaatcctcctaaattgcaatgtatttcattaaagtgaaaaaaaaacacttccttttgatagactagtaacaacaaatatgaaattataaatcaaatactgctaatattttaggaaatgttttttatagtttaaaatatctcaaatttacattcttatgagagattaaccaatctttattctaaacttttgagaatagaattttattaattccaatatttgaaatatttcataccttgtggaattctgtagatactttccatcattatcaaaggaaagacatagaacgtattcttcctgtcttcacatattttgcagcatgttgaacaatctctgtctaataacactgggcaacaatgacatattgttgctaatagtgatataatttatcatcatcaccgtcatcacccaccagcatcatcagacatagaatctgacctatcccttccaggctgcccccagtgccctcccacttctgattgtcctgcctctaactgccaagcactgggattacagggctgctgtaacaggcctgtcttatgcagacacagagatcagacctggagcttgctgcgtgctagacaaacattctgccaactgagtggcatcctcacacatgttatctaaaggtgtccactgcccataatagagctgtgttccaggagttctccagtgcagagctatagcaggtcacttttggaattgtattcttaaatgtgtttataaaaatgccaaaatctagcccctgttctggactgacttgctctggtttcttttgtgttgttgatctaaaacagtaagcctcatagttactttgttatttatttgaactctcttaataaaattgtgttcagacagttgaataaaatagaggtgac

SEQ ID NO: 33658 - DNA, 1210 bp, Mus musculus
tcccggaagtcccgtgaatgatgccgggggcgtgtcctcaggtcggtccgcgtgcggttacctgagaaacgcgcgggcttcagcgtggccgagttggctagcttggcttctgaggagaccctcgcgctgctctgcggcccgggcggcgccatggaggtggtggaggccgccgcgcagctgcagacgctcaagttcggcggctccggccaggggtcggcagcaccgcagccacctgaggatcgccgggaggccccgccgccgggggtgcagccgccgccgccagccccgagctcggatcccggcggaagaccaccgccgctgccagccccgagctcggatcccggcggaagaccaccgccgctgccagccccgaactcggatcccggcggaagaccaccgccgctgccagccccgagctcggatcccggcggaagaccaccgccgctgccagccccgaactcggatcccggcggaagaccaccgccgctgccagccccgagctcggatcccggcggaagaccaccgccgctgccagccccgaactcggatcccggcggaagaccaccgccgccgccagccccgagctcggatcccggcggaagaccaccgccgccgccagccccgaactgggatgcgggcggaagaccaccaccgccgccagccccgaactcggatcccggcggaagaccgactccgccgctgccagccctgaactgggatgcgggcggaagaccaccgccgccgggcggggcctgggtcaccggccggaacgccgcggagccgccgccagtgctgcaggcctcggactcctcggactcggattcggacaggtcgagtgcacgagaggccggaggggggccggggacacggggcctggggagcggggcgcgcgggcgtgctctgcggggcggcgcagccgagctccgtgccacgtgctctctgggagctgggaccccgggctcgccggagtgcttcccatggtcccagctacttctaggagttcccgcttcctttccaaacgtgatagtccccaaagttacacgtgaagttagtcacatgtttgcagtgtagaagcctcgacgttggtagattatttgtaaaattactctgctatgttattaccataggaactcagtttaacatgtgcattggggttagaaattctgactcttgtttcagttcagaattgctacgtttttcgtcgagacta

SEQ ID NO: 33659 - DNA, 1127 bp, Mus musculus
tccaaggtgagaagaaactcattaactagtctccttcataagtgaatcagacaggtacttggcctagagttaccattagttactgattgtcacatgcttgattattatttgtagagatttataacaaggtactgttaggccagaaagggcttaggttttgtataactttagtagttatatagccaatgtcaaaaatggcctctccccacaattatccttcatcccagtgttaccctgactttctcatggcctttcatccaaatgagttctgttcttgttttaagtcaaggatttaaaaataaacaaaataatctgggtgctgtggtgtacatctttaattctagcacttaggaggcagaggcaggcagatatctgtgagttggaggccagcctggtgtacagagggacttccaggacagctagggtccaaggagaaacattgtcttgaaaaaccagaacaaacaacaaactaatatcccaccaacaaagtcagtttgaaatgttagtttcctacttggaacaaggttttattttaatcataatagtacttgaccaagttttcaacttttcctctatagtgaaacagattcagatagctccagctcctcctcttcgtcgtcctcttcatcttcatcctgtgtatcatttcctcctgtgttgtcagatggagatgaggattttcaacttgagaaagaaaataagaattttcctcttaaaacaaaagatgaattgcttcttaatgtaagtacttacattgattgttccgaaaatgtacctcctcttggctttttgcatgtacctctgatgggctgcttctaaccctgacacttgatacttaactgttgaagcattggcttcactttggtggcttacttgttttcaaatctttagaatactttctaggctggatgtaggaccactagcatgcatgagaaacctaaagctctgtgttcattctctagcactaccaaaacaatgtggaaaatactgtactggcttttgtgtcatattgttttgtgtccttttctgtcaacttgacacaagctagaatcatcagagaggaaggagtcttagttgaggaaactcctccatgagacccagctataagcatttttttcaattaatag

SEQ ID NO: 33660 - DNA, 1096 bp, Mus musculus
tttcatgtttactaattttgtctgtaatgactcatttcatataatcatctaatacactagtgtccttcagcatattcagtgttttccccagactcaccagtctttcttttacccttctgttttgagaatcactcacaaaactgcagatatttcttaagtgagttaaggaaaagaacttgtgcctttgtctctgcctgttcctgtgacgttctagaaagagacttgttctattgttgttcatgcctgcagcagcaggagcatcttctcatgtgtgggtgtggagccaagttttatacaaaggccaggtatcttcaaagtgaaaatcaagtgcggaaccacttactgtgcacacacaaccttctcatttcagatcccagtgttaacacacgtgccaggtgtccctgtgcgtgtgtatgtttcctataggatgcctgcattatttgagattgataaaggacaccaaaaatagtttcagtttctttgtattttcatacaaaaggaaagactgggctcatctaatttctcatagtgttaggttctataagcacttaacagaatatgatttttttctagggacagaggatcggacgcttcttggaagaatgatcaggaaccccctccagaagttagtatgagccttttcatctaatgtttcacaaggcagcgtataccttaatcatatacattgttaatgattctatcttacttagtttaattctcatttttgtaaactttgttgatagacaaaatgttattactttaaatcaagtttactcttaagtttagtgactgccagtgtggaactgatagccttcggctgtgatgcaaaagtaagcctcctattggggatgtgggtagtgccaggagcagatgccaactctactccctcatgtttgtataacacagttagtcttctaaaacgtcatctcttgattttatattttgtgtctatgtccataggaccttagtttcgtttcctaaggtgggttagtaatttattctagacctgctgtgtgtcttatttgggaatcacatatgaatgagtcgtggttagtttcttccactccaggagatggagaattgggtattctaaaga

SEQ ID NO: 33661 - DNA, 1721 bp, Mus musculus
ccatgtttgatatgcataactttccacttccgcccccacccccacccccgcctccgcccccaccaagcatggggtgggctgcacctagcatggcctctcatcctgtgcttaacttaccatactccatgcccccaccacctcttcctccaccacctccacctccccctccctctcctggggaaaataattcttctcattttgggccttatttttagttgtatgcttgtatttcagagaaatatgataaaaaagaaaatttaacatatattgtagaactagattattttttataaaaacattgtaaaatactaaatcaaatgactcagttgtacattcatatatatttttaataactcagttgtaagctcatatatatttgtaacctttatgaaatgatattgctagggaaagttcatctcattcttaggaaactccagttcatgtaataattaaatacaatgttgtctcatgtcctctgctacccacagcaggtaaacagcgtgcatagtgatggttatgacacagggttcatcatggccgctgatacactgaacaccgatggaaaacttgacacttggtttataagtgcaagaattctttttttatttacacattgaagactttattgaaaatatttctaataataaccactattttgtgtggtttagctcactttaccaaataaaatagagcaaatagagcacatcttgagaagtctaattatatattacttcataacttaatcattaatcaggtataggcatttatttaatatacattagaactatgattcaatttttaattttattgacctactaaaggcaaaagaataagttgtctgctcccttcctgtaataacagggtctaaaatcacttggagtcctaaaaacaagcaaactcacatgtttgagttcttctgctcctgaatttgttatttttttgatacttgcttctattaccttttatatatatatggttatcctagtgcaaaaattcattagacttgattcccttaagcaagttagaagtgtgaaggaggaagacattggctgaagctctcataatactagtgggttagtagtcactgtgcattgacagacttgtgttgtctatgtagctgtcagttagttagaaagctttactgttccactgtgtacattaaggcatgtgttggtatatatgtgtattctgtgtctagtcacaggctctccagtacctgacatgtgtaacgtgtaataaaggcatattaaatgactgagtgaatttagagtttttaattaaatgagtgggttttttttttttttctttctggcattcgtgtaaatgttaaacgtggttaaggaatattggagcatgagtagtagacctgcagagtactctccatttattgactgaggagtcttgagtgctcagaagaggctatcatctaaccaaggccactgagctattacaatggcaaagagttgaatccagatttctcttctttctcagcaccgtcctcagttggtgcttctaacctttcattccttgacattcttataatactttgtatggcacacttattccaagcctgtcagctctgtttgcattaaggtgtcgcattgctccctacagaaagaggcaattacagtatttgtagtagagagctgcagatatctgtcttggtaccaggagctttacttagtctgtgtgctacatgtgtcaactttattatgttgggg

SEQ ID NO: 33662 - DNA, 1156 bp, Mus musculus
tagttcccaccacccatgtcaggtgacgtacacctatacataattaaaaataatgagaatatgtatgtatggtttgtgtattacttttaaagaaaggaagcatggggaggggggtaactatgtgagaccagctgagaaatgggctgcttcactgaaaccttgtgcatactgtatgatcttggtgtggtcagaagctagggaccacttatctgatgattgacctgataaagtgattgggtaggatatctgattgaagaaatttttgacagcagtttcctttcctttctatgtgacattgatttggttcctcggagcaatgtgtcacacagcagaataactgacacagtataacacagtataactgaagctcatactgaagctcagcagcctgttttaccttgactgtttgggcagcgtggctagccacgcccggtcacatttggcctttctctccactctggcttctttgtgacatgaaatggagagtggtagaaacctttcctgtaatcactgagcattcctgagtaggtacatcaattccagactcacacctcagcagagcggaaggtggcgtgggtgtgggcctggacatgtgtgcagagtaagagggccccttgtggggagaaagctcggacttcattctgctgtgtgacagattgctccgaggaaccaaatcagtgtcacatagtaaggaaaggaaactgcagcaagtgccacttacacactctcagtgtaagaatctgctccgacttgaatttaactaagttgatgtgtttgggatttataaaattttctcttcagaaaccaaccaacaattttaaaggcacttgactgcatgagaatgtcaagatgaaaatcaaacattggtcattagagatcagtgttaatttagaaaggctgtgcacatgtagtgttctttgatataaaagccatagaagacagtgctcagaacagagactaaatgatgtttcagtccgatttcgcttaatcaccttcaatgaagcatactcttgctgtcccacaagcagagttcagatgatgaagagtgttcagcgaaaggcagaaaccggcacattgttgtcagcaaagctgacctcagcaactccatcgaagtactggagagcttcaaactggccagggaaagctgggagttact

SEQ ID NO: 33663 - DNA, 1131 bp, Mus musculus
tatttgaaagaaattttctttagtcataaattgtgctttttttaaaaaagacaaatgggctagtgcaactacataagacattggggtgatgcacgggaagtgtacttcttagcacataatacatgcttacagatgctgccatatagaaatcctgtgggttggtgatatagcgtcagtgggcaaaggcacttgccaactggcctgatgacctgggactcgtaaggagaaaggagaggaccaagtcttgtccttgtgctctcctccctacctgcaccatggtgcacacgcacacctaagtgagtacagtgtgaaaaaggagtccctgcatatcagcaagaagcgtccctggctttactgcctaccagaaaatgcagaacaattgtaagaggaaccgtccgtctttgattagtgtgtgtgttttccctttgctgcctctgtgtttagtgtgtgtgttttccctttgctgcctctgtgtttaccagtttgggtgaatttgcttttgaattctcacgcagaatttacaagaatttgcttggcttggaagacagacacctggctgtggctaagaatcttcctcacagatatgatcatctaccaggtagagtggcagcctttcccgctccctgtctgcagggtgggctgctgcaagctgctcttagtgctagtccactgcctcacgtcttggagcattccgtggttgtgagattacagcccactttcatctccggtgtctcacagtgacacttcttggtgacatttgctgtgtccagtcatgttcctgctgtccctgtgtatagaagcaacaactcctcacacacatattaatctctacccttgtgcacattgaagatggcataagtaattttcagtgtttgtaactaatatttctccattttaaccaccttacagaatctttggtttccttatggcatttaaatagaatttgcttatgttgctctgccactacccaccttcccctttgtgcccttgcacctctctgtcaccataaagctctgtttccctccctctttcccttcctcagctctttttatccctcactcatggtcccctttctagtctcatgacctctgcctgcagtacccgcataggagagagaacatgtagtgtttg

SEQ ID NO: 33664 - DNA, 1182 bp, Mus musculus
taaaccaagtgtggataataatattaaattgttattaaataatattaaattgtaggtctactaaaacctgtgaggcctttctcctttatgattattttatagtatagcatttattttaactatcttagtaaactagtggtaattgcaagcatatatgagggtgtatatgggttatatgcaaactcttagtgtcttacattaaggacttgagcatatcttggtgtctatgggttcctggagctaatctccttaggagtcctacagatggctgcttctaaactttatcttgcattgattagattctcttcctaagtcccctctcctccagagatgatcatgaaagtgcattacattgcttattacttcttgtataataaactcagaagtaagcgtgtttgtgtgtgtgtgtgtcgtgtgtgtttgttttaatggcaatgcctttgtgtctttccaagggtcaatataagaaggccatagccagtctgcatcacttagcagctctgcaaggatccctttctcagccacagatcacaggacaggggactttagaacaccagagggcgctcatccagctggcaacgtgtcactttgctctgggggagtacagagtgagtaccgggaagctcatgtggcggcgttatcaaaggctgcaaagcaccttgggacatctctcccctatagtgggttttcaggtcaatgtttccttgagtttgactttaccactcagacctgttacttaatttgttgctgaaaatcacaatgatcgtattttacttggtgtttctatagcataacttacctgaaattgggcttcaatattacttgtttattgttctatttttgacacaaggtatcatgtatcccatatgagttgctatgtagtttaaagataggcaatgtatatgctttatataaaaagtcagggtattttttaacagtgaagaatagattaccgctcctccatttcatagatttaatctgactatagctttctttgcactcactgttgaccactgagcaatggtcatgggaggacaaacctccatgcacatatgctgcctgctgctttgctgtaaatgtttgcagttgtatttcttgttttcagtttagcacttcaggttagtacctgtgtcttgtctcctgcagatgacgtgcgagaaagtcctagatctgatgtgttac

SEQ ID NO: 33665 - DNA, 1155 bp, Mus musculus
taatttgttttaaaatcattaaagcttaaagccagatgttagcattttataaaactgagagaccagggcctggagagatggctcagcgctctcgcagatgacctaggttatagtcccagcacttacatgccagcttctaattatcggtaatgccagctccaggagatccaacaccctgtctcacctccacaggtactgaacacatgtggtacacgtacatatatgcagcctaaatatttatacatgcacagaaggtgagtgacaagcacattgggtttgttagagtccctttatagatcattgtgcatatttgaaataaattataattatttgatagaaaaaataattataattatttgatagagtaggaaagaaaattgagaaaccaactctagaaatcagaaaccattgtcatcgttacacaattaattgttgtctgctgtgtctcagattctgtgactttttctcctattgagggagcatgtgagacatttgtttgtcagacctcttgtctctggttcactaacagtctggccttgtggtaggtttggatctgaagcttctgccctgtaccagtaaggctatcatgccatactgcctgcacttgatgctggcctgctttaaggtgagtctaaaacggggttatcaggaaacacattccctttgaagcactcctggtaaactggcaagagctaacagctctgttcacactgttttatactgtacaaggcagatgagaaaagcttgtgggctggaaattgacaggtgggctggggaagtagaaaataagccctgtgcttgaggaatagaagtagggaaggcaagcaggtccccttgcttgttatggcaaaattgttgctgttgtgtatgtcagaatatattagctaaagaagaaggcaatataaatattggggtcaccagtgtataaggagttaattcttttagacatgagggtcagcaccgtcaaaggctcagtaccatcaaaggctcagtagcactggaaaggctccaagactcttgaaggtaccacaacccttggctacagtggaatagagccttggggtcggagtatagccatttcagtaggcttgtgtgcaaaaggcaacagtacaggttactgctttatgcagtagtcccacactaactaagcgttaa

SEQ ID NO: 33666 - DNA, 1194 bp, Mus musculus
agttctaactcccttagttgcttaaaagtcaatccgaagagtataggaagttatttctatttttaagacttcaggtttttttagtttgtacaaaataagattcaatccattttgtaaataaaaacccgaaagatttgaagttttaaaaaaaaacttatttttagtttcaagtagggtacatttgtcttctatttttctaatcatggcaaaggggcaaaaatccaacacaattaaatgcaggaatgaattttttgatatatttacctaatggaatatgtcttccatgacctcaggtgtgttttattgatatgctttggtaagtattacacatcaggataacattggacctttcgttttatttatgcacagttgaacttgggcctgtcctgtccctgctgagagcccattgcaggcatggtactctatagtctctgaaaagacaggatgagaaatatcggagacagcaaagtgcaggggaccctcctctctgctggggcctctggaagtcagtctggctctgtggactctcctaggcccttggggccgtgcatcactgcttgacagccatctggcaccctgccctgccctgctctgccctgccctgccctgccctgccctgccctgtacttgtctgtgtgatcaagaatgaacatgtgcaaacacagacacacacacacacacacacacacacacacagagcaactagaattatgttttctaggtgctgccaaagactaggttgttttacagatattttctaaaaagaacaggcattcttatttcttccaaaggtcactctagtgtatgttctgggtcttaacttatggaggcataggtcttaggtataaaggattttcttgttaaatcaactgtcataatttgaatagtgtcacccaaaggtcattgtgttcaaactggccctaacttcacactagtttagtgtgtcacacatacatttaacgatggttacttatagacagtcagtaggggtttctattttttttttaatttcacttatttatttcctgctttatgggccccagcaagctggagaatagacagaagaaaaataaagtgatttcatgatttgagtgttattgtccatattccattaataaaacaaaggtaaaaaggtcacatagtagtttatatttaacggttacattcctaatggatgccaagttcagatgtgag

SEQ ID NO: 33667 - DNA, 1358 bp, Mus musculus
agaaagaaagaaagaaagaaagaaagaaagaaagaaagaaagaaagaaagaaagaaagaaagaaagaaagaaagaaaatgagcttgtaattgaggtgacacataaattttgctgaaagacaaaaatgcctaggttgattttacttcttctcttttttgctttcttgaaaaaagtcacaattgtcccatgctgtaaccaagtctggcctcgaactaaactatgtatttcaggctggccttgaactctcaaccatcctgccttagcttcctgtgtcctgggagcttgagaactgtaattttattatcagatttttcttacttgttttcatcaatttgaaatgcccaatatccaatactttgtatttcatttgagactcatctccgccatgcctctgtcacacttctaacacatcacattaatttctagtttagatgtgatcaagttcaaattctgcactgtgcaaagtacaagttttagagcaggaccatttttttttatcacataaaagttgaaattactagaaaatgtgcatatggatgcttgtaaactgctgtgcaaagagaagagccctcaactgtaatagctatagaaagtaccaggattgttgccgctgttttgttttaccttaacaacaacaacaacaaaaatcaataatgaagaattatttatgaacgagatctcacattttcagattgcttttattattcattaatgtaaaatgataaagaagatctatctcagaggctatagctgggagcagaaactgtgaaatttgtgggtatctgaacaccaacccacatgcaaagccccacaagtgtagtcgtcattcaatgtgattcagaaaggaaagagtcaagggatatactggaatatgttagagaagtagttccagatatgctggaatgttagcccttgctaggagaaagctggttgtgcctatgtaatataggacaaaggtgaccgatttcatcaagtttggagtcaattctaacaataaaaatatgtataatttgtcaccggcatccccattattgctaattcattacagtatatacacatccatgcatacatatgtcaatgatgctttagctttcaatttatttattagctgtaaataatgtgtgggtatgtaagaatgcttgtaaacactggaaagtctgttgtggttatctgcagtatagatttgtggtgctaactttgtgtccgtctccatccatgattgtctgtctcactgagccaacttaactctgatgaaacagtacaatgaaataggcttttgaaagaagaaaactcacctgtgtgaagaaatggtatctgctttcaataaaactgagaacattttatcatgatactaagtc

SEQ ID NO: 33668 - DNA, 1053 bp, Mus musculus
attcactggccccaagaattaaggccaggggagtccccatggggaggggagggagagaaagaggaaggtttgtgcacacatgcagagaaagaagaggaggaggaaagaaaaaagaggaagagagcttgactgtttaaaacagaataatttagatttatagcttggccttcctcagaaatagatgctgagaatgttcttttgcattgcactgatgacgtcactgatacttaggtaaacatggaaacagcccggttctttaaatctgactttgaagaaaatggctcaatggacaatgtctgcctttttttgaatctggctaatgacccaacgtaagtaaaacttgtttctctctgagttactgcctacagaggcatctttaaagtaattttgttttcctctcctctgtgaactaagagtgtcaaaaggaaaatgctgctgtcgcagccttgttttggttgtggcttttgagtgacctgggacgtgtgttccctttcagcattgagcggatcatcactcctcgcctggctctgaccacggccgagtttctggcatatcagtgtgagaagcacgtgctggtgatcctgacggacatgagctcctacgctgaagcgctgcgagaggtaactcttcccttctttttttccttcttttctcaaacaaaatgtgtcaagtagggtcatcttgatcttttgtaagtttctgtttttctttaatcataaaagagatagtacaaggctgggtgtggtggcacacgcctttaatcccagcccttgggaggcagaggcaggaggatttcggagttcgaggacagcctggtctacaaagtgagttccaggacagccagggctacacagagaaaacctgtctcgggaaaaaaacaaaacaaaacaaaacaaaacacccagatagtacaattttttttgtctctgtcaacttggaaatagtagagagtgagattaaaattagtaactgtcactgtctctctcaagggctgaagaagtaagaaagcaccacaagcggatggtagtgtttcattcccaagaacttctgacc

SEQ ID NO: 33669 - DNA, 1688 bp, Mus musculus
tatgaaaaccgaactgtttatgagactttggacattggctggcagttgcttcgaatcttccccaaagaaatgctgaagagaatccctcagagcaccctgagcgaattttaccctcgagactctgcaaaacactagtagctgctgctgcttgtgtggcgtgaccctcttgtgaagtactggttctgtttcctgattccttttgcactcctccatcccacctgtgagtgggagtttacctgttaccctgtaattaaaaacaaaggctaggtaactattgtgccagtgttgacagtttaaactgctaacagattgagagatccctgctcagaaacctcacctttagtgctttctttaaagaagctgaggggtgaagtttgcttactgatgtatctatttgtacagatagtggagagctagttgctaataatgtcttgtttgggtctcccaaaccctacctctcaactcccttaagagtatcactgttctgaagctaaaatgcttcagtctcaaatttaggggcaaagtggagactggaagaattctcctttcagaagaaccacgaggctctggctgagcctccctctggagtgctagtgtacctgtgggtctgtcctctgctctgtgcagatgggttttactgtctgctgtgttttcttacgaaaagagtttcgttctgccagtgctgtgagttgggaattcctgcgtggcgactttctctgaggcccacagagaatcaggtaacattgcacagcctgcgttctcctgcagtggtggcacgccttgtgctgacgacccccactgggctacagtcacaggagaattgagacttggaaaaggcttgggtacaattaagaaaaaccctacatcccaccctcctcttgacgcgtttctggtggtttcggtttctgcgttgccctccagatcctgaggtgggccgtgagacgacttgctttaaactctgttcaatccccaggctttctgagtccgctctaccttttctgggtgatcttgtggcacatgtagcaatgtttctttcattcctgtcccttcctggcttgagctcttggctgtattctgtgtgcctctaccatgtctgctgtttgggtctctgcgctgtgtgttctcaggtgcagccatgactccccactctgtgcattccaccttccagttgtttttctctgagggggtagtgggggggtcagcatgattatattttaatgtagaaaatgtgacatctcgttataaatgaaaataaatgttaaattaaatggaagttacctgaaatgactctgtgttttctctcgagaggaacggcagcaagcaggtgggtaactcgagtcttcacagttgtgatcttcatgagtgtggcctgtgttagtgtgtaagaaatgtgagtatgcttcatattcctgaaggcttgaagaaggaaggcatctatgtgtcaaactgtagtgtctggtccactgcagcactcaggctgcagttattaacaacctttatcaagacagataaaggggctggaggggtggcacagcggttaagagcacttggctatttttcctaaacagttttctaagttcagttcccagcaaccacacggtggctcacatccatctgtaatggattcaattccctcgtgtgtgtgtgtgtgtgtgtgtgtgtgtgtgtgtgtgtgtgtgtgtgtgtgt

SEQ ID NO: 33670 - DNA, 1269 bp, Mus musculus
gaaataaatcatactggagagaaaccctataaatgtagccaatgtggtaaagcctttgctgttcacaattatttccaaatacatagaggaacacattctggagagaaatcttatgagtgtagtcagtgtggtaaaaagcatttgcacattactgtacacgttgaaaacatgaaggtgtacttactgtagagaaaccctatgaatgcaagcaatgaggtaaagccttttcacgacagagtcatctccagaaacatgaaataaaacatagtctagagaaactgtatcaatgtagtcagtgagatagataaagcctttgcacaacagagttatcttcaaatacacagaaaaacatatattgaagagaaaccctatgtaagaagtgtagtaaagccttttcacatggtagttatctaatacctaaaaggacactcaccagatagaaaccctgcaaacatagtcagtgtgaggaagccttttcacaatagtagcctctaaattaaaggtaacaacagcaacaacaaaaaaacatactggagatttattctgaatgtaagcaatgtggaaaagcctttgcatattacaattatttctgaaaacacaatacatactggagagtaaacttatgaatgtaattgctgtgttaatacctttgtgtatcattctctgaggacatgaacccatactgaagggaatctgggactataaagtatttggtaagattgttagccagcccagttgcatttaatacacaagatcattttattctgggggaaaaagtctgacaagtgtccacaatctctttaagccttttgcctatctgtattttgtttgcacctacaaactcatagataaaagccctctgaatttacactattaggtagcaacatttagatttcattcacctcttcaattacatcaaataagttatttaagtgtaaaactttatgggtctgtcttagtaacttttctgatgctgtgatataacatctttggtaacttatcaaacactttatttgggctcatggcaccagagatgtatgggattaccatcaacatggcatggcaacaagtgggaaacatggcagtaaagcaggaagtttaaagctcgcattcaagtgctgtgacatgtttcctccaggtggggtgtcatttactgaatctttcccattgagaagggttggttttctgaattccagctcaaatcctttccttttgggaagttaaccttttcatgaagaagaaaaaccctggaaatgagcctttaggtgc

SEQ ID NO: 33671 - DNA, 1196 bp, Mus musculus
ataaacttaatgcatccccactaaaatcagggagaggccatggctgcccactctccccaaacctcttaaacatagcacttgatgttctagttagagcaataagacaaaggagatcaaggggatacaaattggaaaaggaaaaagtcaaagtatcactattcacagatgatatggtaatatacagcagtcacccaaaaaaattctaccagaaaactcctacatctgaaaaacaccttcagcaaagtggctgagtacaaaattaactcaaagtaatcaatagcccacctctacacaaatgataaaagggcagagaaagaagttgagaacacagccccagcagttaaagacagacgtccctccttttcctgtttgagtcatcacaaggatggtatcttgtgaaagtggcctccctctcaggttacatcctagagagtagctcagggaacttgtatggccagacacacacatcaattcaaagcctctccatcaagagagaatgaaactaggaactccttctggaaggactttattcccgtttaagcttttagcttggcttgtcacctctaataaggagaggaggagggtatgtgtaggacatttaaaaagattctttctcttgtagtctccatgaggtcaggctgtatcaggattgcggaagatccttcagaatctctgtctgcatagtgcaccttcctctgagcacctgtctgggaagcttatgcaagcctgaggcagctttgttccatccttcagttttgctctttggaagccaagctgctaggaatggtccaagaggcctgtctccctcccgctgtgctggctcattttatttggatgtcattctctagcctgttttccggggtgtatgctgttgggtatacctggaatccaagggctagtgtattgagtccacctcagaggcagggtgctgactgtaggcttgggatgcagccagtgaactggtccttagtaacgtatggaatgacttattcctgtgacccaactcttttactatccagtgttgtgaggaagcacgattgtacccgacactacagactcagccccaattacaagagttttcggttgtttggtttctttccttataattctcagattgctgtgtagattcttatacagcaatagaaagcattctaaatagttgttagtctgcctggtctcagtattcatttattaga

SEQ ID NO: 33672 - DNA, 1238 bp, Mus musculus
accaatgtggtaaagcctttgcacatcacagttatctccaaaaacataaaagaacacacactggagagaaaccttatcaatgcaatcaatgtggtaaaacttttgcatgtcacagaagtcttcaaattcatgaaagaattcatactggagagaaaccttatgaatgttgtcaatgtggtaagacctttgcacatcacaattatctccgaaaccataaaagaacacatactggagagaacccctacaaatgtaaggaatgcggtaaagcctttgcatgtcacagtcatcttcaaaggcatgaaagagttcatactggagagaaaccctatgagtgtagtcaatgtggtaaagcctttgcatgtcacagcagtcttcaaaatcatgaaaaaaatcatattgaagagaaactctatgaattatgtaagcaatatggtaacgcctttgtacatcacagttatctctgaaaacataaaacacaaaagaatatattctacagaatataatcaggattttaaagtcatgtcacagttgtctttgaggacatgaaagaactcatactgaaaggaatctctgactataaagtgtttagtgagatctgtagccaacacacttccatccgggacagaatattatttactagggagaaaataatctgagatgtgtccacaatattttcaaggcgtttgcctgtctttactttgtatctacaaactcttatggacaaaagccgtatggatgtaaattaaaagatatccaatttaggtctcacacttctttttgatgacatgaaatagctcatccagatatgaaactttatggatgccagatatgaaactttatggatgtgttttagtaaattttctgagctatgagaaaacacaatgtctaaggcagtttataaaaaaaaccattaatttagtttatggttccagacggatgtgggatcaccatcaaagagccagggcaatgagcgccaggcgtggcagctaaggtgtgaagttaaaagttcacctcttcaacttgaagcatgaagcagacaggaggagctggaaggcgtgtgaggatttaagctctcaaagcccatcccccagtgacatgtttcctccagaagggtggcatttactaaatcttcccaaatgacacccccaactgtggggtgttgattctctgactttaagtctacatgcttgctttttattagggtaaccaatccacagggaagaaaatccctgtaggta

SEQ ID NO: 33673 - DNA, 1182 bp, Mus musculus
tcccagtcatagcctccctccttcctttcttcccagccccaccttacaaatctctccctccattgaccttctccccttcttttcagagaagagggtatcatcccatcctagggcatctagtcctagcaggtttaggcacaaactctcccacagaggcccaatcaagcaatccaagtaggggaaaagaggatacagaagcaaggaacagagactgagagccccgttcctctttttagggggaccacactaacaccaaggaatacatttgctacaaatgtgtaggagatctagttccagctcctgcatgtttcctggttagtagcacaggctctgcgagcctccatggtcccaggttagatgactctgtgggtcttttttgacccctccaacttacttacttctatccttcactctactgtaagactcagggatctacctaatgtttggctgtgggtctgcatctgcctccatttgctgctggatgaagcctctccggagacatttatgctaggttcctgtttgcaagcatagcagagtatcattaatagtgtcaggggtgagctctctcacatgggatgggtctcaagttggggcaattgttggttggctgttcacccagtctctgctccatctctatccttgaacatcttacaggccagacaaattttcagttggaggttttgtagggggattgatgttcccaatccttcctctggaaatcctgcctgactataggaggtggtcatttcagtctccctatggtaggaatctaagctagggtcatccccttaacctctcttatcccaagcctccagctacttaccagagatgccctgccatgatcgccattctcactcccagtctcttaccccacttcttaccttcctgatcaccttccctgttcccgtcctcctcttatctcctacccagttccctctctccatccaactcagatgactatttagtttccctttggaggtaggttcatatgtccaccctgggtcctcattttacccaatttcattgggtttgtggattgtagcatacttatcctgcacttcatgtcttatgtccagttaaaagttagcacataccatatgtgcctttctggatctgggttacctcactcaggatgaatttctcaagttccatccatttgcctggaaaattcaagaatctttg

SEQ ID NO: 33674 - DNA, 1213 bp, Mus musculus
cttcaagtactatattgaataggtagggagggagtgggcagccttgtctagtccctgattttagttggattgcttcaagtttctctccatttagtttgaagttggctaccggtttggtgtatattgcttttattatgtttaggtatgggccttgaagtcctgatctttccaagactttattgtgaaggggtgttggattttgtcaaatgctttctcagcatctaatgaaataatcatgtggtttttttttctttgagtttgtttatatagtggattacattgatggatttccatatattgaaccttccctgcatccctggaatgaagcctacttgatcatgatggatgatcattttgatgtgtttttggaatcaatttgcgagaattttattgagtatttttgcatcgatattcataagagaaattgatgtgaagttctctttctttgttgggcctttgtatggtttaggtatcagaataattgtggcttcatagaacggaattgggtggagtaccttgtgtttctattttgtggaatagtttgaagagtattggaattaggtcttctttaaaagtctgatagaactctgcattaaatccatcatgtactgcatttttttttagttgggagactattaatgactgtttctatttatctaggggacatgggactgtttaggctgttaatctgatcctgttttaactttggtaagtggtatcgtatagaaaattttctatttcatccaggttttccagttgtgttaagtataggcttttgtagtaggatctgatgacttttttagatttcttcagattctgttgttatgtctccctttctatttctgattttgttaattagtacattgtccttgtgccctctagttagtttggctaaggatttatctattttgttgattttctcaaagaaccagctcctggtttggttaattctttgtattgttcttttttttttttctatttggttgatttcatccctgaatttgattatttcctgccatctactcctcttgggtaaaattgcttacttttgttctagggcttttaggtgtgctgtcaagctgctcatgtatgctctctccagattgtttttggaggcactcagagctatgaggtttcctcttaggactgctttcattgtgtcccataagtttggatatgttgtggcttcattttcataaaagtctaaaaaatc

SEQ ID NO: 33675 - DNA, 1089 bp, Mus musculus
tggccataaatgtttcttgctgcccttatatggtggccagaatgttttatatgagaggaagataccatttaggttatttaagtcagattgttttcgattgttaaagttacagccagtagaggagttttttgttgttgttttggtttgcacttttttttttttttcaaatctaaaggggtgttctcatggaaatctgaaagaaaaaatttaacagataggtgtccacccggccggggagggcttttgctgaccatctgcgggagacatcttggttcccggaccccaccaagactactctgcacaggcgagagtgtggactacagaagctaacagcttctgggacaggcaggagccacagtgcttctaaggcagccccctttttgggctccagacatccgggcaccttccctgccagaggataggtgtttgcccggccccggagggctttgcctgagcatctgcaggagacatcttggctcccggactccaccaagactgttctgcacaggtgagactgtagactacagaagctaacagcttctgggacacgtcctgtttcaggccttcatcatctgccaggaagcaagtctgaacgccagatatctgtgcaccttccctgaaagaggagagcctgcctgcagagagtgctctgaccactgaaactcaggagagagctagtctcccaggtctgctggtagagaacaaaagaatcacaataggaacaagctctaaccagaaacaactataacaactgactccagagtttaccaaatggtgaaaggcagacgtaagaatcttactaacaaaatccaagaccactcaccatcatcagaacccagtactcccacctcagctagtccagggcaccccaacacatccgaaaacctagacccggatttaaaggcatatctcatgatgatggtagaagacatcaagaaggtctttaataactcacttaaagaaatagaggagaacactgctaaagagttgcaagcccttataggaaaacaggaaaacacattgaaacagatgatggaaataaaaccatactagacctaaaaagggaagtagacacaataaagaaaactc

SEQ ID NO: 33676 - DNA, 1533 bp, Mus musculus
gatagaaagtagagtactttctccaaggttgccaaatacatattgactgtatcttgtgaatacaattctcacttgatggttttcataattgttcttattgtatatagcttattgatggtagagaaagaccctttattggactaaaagggggagatgtagggataatctttatttgtcctgcatagagatgtgtctctgtccttccttgtatgcccaaggcactttctgcttggttacaataaacagcatatagcaaggggtagaatagaagggagagaacaattctgggatagagttgggcacaggtacatccaccaagaaacaggggaacctggaggtatgatgctgaggagaagtaatcagccatgtggcaaaacttagatcactgcaaatgagattatatattttgagctagtgggaacaagcctagcttaaggcctaagcatttattaataagtaataagcctctaagttgttcaggaattgttcccaggtagaagggccaaaggtttcctcatcacccagtaacatttcctccggcagggtagcatttactcaatatccaattggtggtatccaaatgataccaccgattgaaaagggttgatactttgaagcctacatgcttccttttgttaggtgaactaatttatgaggaaggaaaatccctgtaattaagcctttgggtgcttcaatatctgggttacagaaatgaagccttaagtcagtaaaacaatcaagagtaaaaattatgtttgttcaaagatttgttattacagagctataggaataaagacagcatgatactggcataaaaactgatgtgttgatcaatggaatttaattgaaaatccaggataaatgcaccatacttaaggacattgacaaagaagccttgctatatgcaagcacaaatgcagatggaaccaaagtaatacattgctaagttttagagatgatgttgcactcaaatctattgcatctggaggctatggatgacgctctgatgagatttaatgtgctggctcatcatcatactccacaaggtatcttctacattcctttttctttaagataccttggactcctttggtccagttcactgtccactcccatgatgccccagcagactctccaaatctatacttttgctttcatcttctagttgatgtgacatgaacgtgtatgcaaaaagagcattctaaggtcatttctttctccattatgtttgtggtttctgtatcctatatcctttggcatataggtacttatcaaaggatatatatggtaaattatgccttttctaacccagaaagcctgacttatagaaagctttgtaatatttactattgttaactgttctaagcagaaagcatgttttatttaaataatgcctttatgtagctgacaatttcactcttattgtctgaccataactttgacttcaaatttctttatcacaggttggtttctaaaatggcaaaatgaaaaaaaaaattttttttagcaaacttcgcttacctcatcatttga

SEQ ID NO: 33677 - DNA, 1102 bp, Mus musculus
cacaataaacggtcttgctgcaaattgcaagaggatttttattcaagagcgctctcgggcccatggtcatacaccacgcaggggtagaggaccgtggcgccccaagtagctggattagggggtatttaaaggaagaaaccacgacttaaggaggtgggaagggcgttgttggaaaataccaaaaatactagttaagagtcacaaggaagtacaaagtcacaggtgtcacaaggaatacctggtaattgttaactctcaagacagtttctaagagcccctaaggatagcacatttgcattgcaggttccagcaatggtcagggtgggtcagggtgactttctttgaatgaacactccttgaacccaggaagcgggtgggtggaggaatgtcgctatctgttttatgattagcataccttggagcactgagtttactactctttcaggtgctgggcataaaggcatgggagctccaccttctggggtctgcccgcgcttttccagttcctgcattcagatcttaatcttgtttgcagagctcccttgatcttctctctgaccccgcctcctctgtaccagctttaggattcactagctcaccccctggctcctctttcttctcctagccaggtgtgtctcactgatgtgcttggcctggtttggagcacaggtggagttctccctcagtgaggtcttggagttgtgcaagcgtgggaatcaggggtggaacactgagggaggatcttcagggtccccagggactgtatgccccacagagtctccaggaatgagtcccacgccccactctgcctacgtgcactcaggagtggggctcccagcattcctcccagccccttccagcccctcctagcccactgctgccttgcctgggagccaagtgatcagctgtatcttgtatgaccatccttactactagcttgtcttcccgccttgatctcgtctcccttcccttcccctcccctcccctcccctcctcccctcccctctttccatcccttccttccatcttcctcctcctcctcctcctcctcctcctcctcctcctcctcctcctcctcctcctcctcctcctcctcctcctc

SEQ ID NO: 33678 - DNA, 1161 bp, Mus musculus
aagattaaaaaaaagaaaaccctaacacatggaacaaaagaaacaaacagaaaggaagggcctccaaggaaaagtgcataacagatatagagactcaggttttcaaatgtttatattagacttgaggttgtaaagtcgactattaacttcgtattaactaggaagtctggaagggggaagaatgagattcagtttagcaaatcctgacttatgttcagctgtgtgaagtgacaccatttaatatttgctcttcctctgcagaagagcaataacaatttctagtcttcaaagagtaatgattatattcatccaatcactagggcattgatgtcgaataagtaacagcaatgataatgtttgctgctttgggcttcacattaattgatggcgaacacaccccagtgtgtttaacctccccatgattaaactttgcaaagcagtcattccagttggtcttggataaatgagaaaccgaagcagaaacagatgaacgaaatttgtgttactaaattcacccacaatgcatataaggctgccatcagctgatttcaaatatgcttaaagacatactgctttgcttgaagatggaactctaacacatgcctcttggtatcatttctgcttgaatttctagagtgtggtcttttgagtaaatctggttcattggccccaagtgaatctaaaagccatcagggatagattgttcattttaccagttagagaaaaaccaagcaccgattataaagattagctgactcaagactgtcagctgtgactttagggctctgagagactccagtctgtgtgtggagcctcctgtgacagagctgccgttgcctaagatgtctactaagatgatctgtttttttagatttattttttattagatgttttcttctagtttcctctccaaaaatcctctataccctcctccttctctatctctatctatttatctatatgcatatatgtatatatgcatacccccatatatatatatatgtatatacacatatatgtgtatatatgtgtatatgtataatgtatatatatatatatatgcatatgtggctacaactcttcctgctccccaactctcctactcccacttcctggccctggcattcccctatactggggcctagaatctttgcaagatca

SEQ ID NO: 33679 - DNA, 1209 bp, Mus musculus
caacataaatttggaaggacccatgttccaacaccatgccccacaaactagagccggttaccattagatatgctttgcctgagagaagtcatattaggtccactgatggacatcaggcggaatctcaaagacaaagtagaaagtccttccataaggtctgaggacatgccagtaaataaagttgtcattgtgagatgaaggagctcaaggagcacaataaaatatttccatgccaagactgatatggaagttttaatgactgataggcacttcaggcagacacacagcaggtgaatcctgaaagagaatattttgcctaagagtgaatggggtcaattttatagtcattaggaaatatctgtccttgtctcctgggaagtttgtttggcctcttatttgagtagttaggaggacagacaactatggtttctgacatggttggcttccttttctgaaactgaccattgggtaatgtacccagagctatttggagcggtttgggaagtgcacggggcggagatggcggcggagcagcaggaggcgttgagggagttcgtggcggtgacgggcactgaggaggaaagggctcgtttcttcctggagtcggctggctgggacctgcaggtagctccgcaaggcgggccgcttcgggcgggctggggaatgcggagtgcggcgtccgctccgcgattcctacgctgctgaagcgcacagttatccgtgcggggctgggccctgcctggcccaggcctcatggtatctggggtcgcttgccacgcgtcgccggcctggcttggaagttcatggacgcgggcgggcccggcctgcttttcagggcctccgttttccggcgggctcgcactgttagcgagactttgggcgctgcggcagtctgcgtggagtcgccgcctggggacgtggctgccgcggcgagtgcttgcgggtggcctggtggagtgccctgcttccagatggagccccaccaaggtcgcggtggccttccgattccgcttctgcaaggatgctgtgctggtgggggaaaccctgcagggcatcagcccacgccccactcttgcctaatcgcagggagaaactacttgtgggactgtggcgcacgtttgggatctctgcacatttcgtagttaagtgtaaaatgagaatttcttaggacttactgtcttgttcgctggcatgtagtaaatattcatt

SEQ ID NO: 33680 - DNA, 1212 bp, Mus musculus
ctacagagtgagttccaggacagccagggctacacagagaaaccctgtctcgaaaaactcaaaaaaaaaaaaaaaaaaaaaaaagaaaagaaagaaaaatatacacatgggtgggtgtacatcatgtttatatgtgcatgtgtttattcggctaattcatatggccatctgtgaatccttgttacttttcattcacagtgtaactgaaattaagaatagctagataatcattcataggttacttggttaattattgtctcagctctcatccagtatgtattctaaaaatattcccattgcttgggcaaatcatggctcttgggtccctacaataccgctccactctcacggatgattgctctcagctgggaggggatcctctaggctctgctgttcctaggatgagcaggggaaaagactgaaccctatgctttcagctttcacaaagtgattgtcatttctgctttgttcatcacctgattgaaaacttaaatctcaagtcgggtttatttaaaaatctgccccgctaagcttttaagtgtcacataacagccaaaatgtaaagtgatttgtcaatactagtgtataactaatcactgttcagtactctgtggtcagaggatgtaaatgggatggacagtaatttgatctttatcttccaaagccagctaggttccaggaggctgtgggggcatctctcaaagtcatgcagttatgaagaatcgcctgttctcttgtatttagaggctctggaagtcccatgagggaattgccagcttacgctgtagaagcgagtcaacacaggagcatgttccctgtgcttcccaggaagccatggctagagtgccctgactcaatatgtggaacaactgatgaaagaaaaccggaggagctaggagcccctctcaagccccggtgaccactgaggagaaaataaaaccaaagtgagggtgtgttggctaactgcacagtggagaaaagaataaagttaaacacttgatgtaaaacccatgagtacagctttccaggctactgtgtatgggtggctggctaccagatggagtactcatggctatcccactaattaaaggacttttgtgctttccctaaccataaatatactgttgtttttatggtttaattctattcatgcctccattgcttatttatttatttatttatttatttatttttgtttttcaagacagggtt

SEQ ID NO: 33681 - DNA, 1219 bp, Mus musculus
tgatgattagcaaatattctgcctctggagggctggaaggcttgaggaaaacatgaatgaaggaagataagagaaagcagtgcagctaaaacgtctgagcttttcctgggtcatttcccacagaaggggtgtactctcctgcaggaaaggatgtttgtgtataaattgtttgttcaacccagagacctctcagtagccaggagcatccactgaagaggcagcagtatgctacagcttgagcccagagactgtcagaccctgccagtccatgggatacagcaggtgagcatgtctgggtttccccttggccctacacccactggagaacaggagccagctccttccccagcagatcagctgggggtgaggagatccataggcccaagctacactcagggtgaggttgcaagatggctcatgaggaatgacagatcaggtgcaggataaggtgcaacctcccgtctcctctactgtgtccacactggcttgaatttattctttgttttcttgaggaaaattcttatatagcctgggctgctcttaaatgcactgtatagacgacaatgatcttgaaagtcctgatcctcctgcctcctcttcccaaatcctggggttgcgtgcatgggccaccccatctggtctcctgtgcttcagaacgaacccaggctccatgcacacactcttagctgtgctatgtcctcaggtcaaccctgagaagacacttggtacaagtcttttcatgccgttggatcttgttaatagtttattgcccccttagctgctgactgctgagttcagctggcacttgtttaggatggtgggtttaaagccttccgtgatcctgagaccccgtctcctcccagtcctctgtgtaataaggaagaggatcttgcatcatgctgataaaatgctagcctgtgatgctccacagatctagaaaacaatccaggtgagctgagggatgatcaggacaggaatatgcacaggacaggcacatggcaatttccaaacaaggtgaataggggaaatccttcacagcctgtggctagcattaaacattaaaaggtgagttgaagagcttggatgaaggcaccctgtgtgaaagatacattcaaaagataggctatttagttcagatgcagtgtcagaggtagactacttccccaggagctgttagccagggatgctcctgaagtcccctaaacagtacagactattg

SEQ ID NO: 33682 - DNA, 1114 bp, Mus musculus
tcttacaaatgtttctttccttttgcctctgtcctacccagctctctctttaaagaacctaggatgatttctagtttgtgcaaaccttctccttctgcctgcctcaccccctttttttttagacccaaagtctcacagtgcagcccagtccaccctagagctcactgtgccactcaggctaatatcaaactctcaggtctcttcctgcctgggctccctgagtgctaggaatgacaagccatattgagcctgtgtctgactgcacagcttggaaaagcacagctatgcagggggcaccagaaaactccatgaggaagggcttcagtgtcccttggactttctacttctgagtcccccaagacctcagatatgccaggcctgaggttaactccctccctccctccctccctccctccctccctccctccctccctccctccctcgccagagaagcctcctagcaggcagtgtgagccatgaacttggctccctgctctgcctcaccagagaggagtcggggttatgttctcacctcagattcacagccgaggaacagcaggaacttgaacctctgtcttatctgaggccaaattcttaaggcattaaagcatctgtttcttaagaacggaaaacgtctctttctttctacagtcagtgcccggcttttcccacagctaggaccttgcacactctaggcaagttccccagcacagatcttctatcacgtgagccatgtccaaaaggaaaacagtgcagaccgaactgaagggctggattgcagtgggcctttgcttctttgtgggttcttttttctcactctttatgcctctggtttcaccccatcagtcacaagatagaaaaagaaaaagggagaaagatactgagatctgtgaatctaatttctttcttcctgtttcttctttgagcacaactactaacaaactatgatcaaccaaccacactacctatggggccctagcattcatacacccttgaaaaagtttccagaattctaaacatcacacaaccacagaaactctctgcagttggcaaaactgtgcctcatgttccaaggtgatagcccaggaacctctgcagccaggtgttcattaag

SEQ ID NO: 33683 - DNA, 1592 bp, Mus musculus
attttcccttttccacttagaggcattatgcttttttgttctttgagacagggactcactgtgtagcactggctggcctctaactcacaaagatcagcctgcctctgcctcctgagagctgggattaaaggaaagtgccttgtgatttacagatttctgcacttgcgtggatgcacctctgcatgtggaggctggagatgtgtcaagtcagccctgaaggcagggccaccttagtcaacatagcagggtctctgtcacatccagagctcaccaatacagctagtctcactgggcatcttgttctgagcaatcccctgtctctgccctccaaggcaggagatatactcaggacactgctcctgtccccacttttatgtggatttctgaggttctgaattctggtcttcaaacttgagtagcaagcgctttaaaaagtactgagccattgccctagcctggcttttccttgacttctctgctgtgtgacatcaagcttttgtctcttttagaccattggaacttacagtcttctccctcccccagatcaggcctgtgcagtgctgggccactgtctgaccttttgtacactctgggcccaccttaaaggcttctattacttcctgtggctggggccaagcctagggttttccttgtgcttacacatttgaatttcttgccaggcacccccggaagtctccatcttccccatgccccgtcgcccccatacacacatgctgcttgagtttcctcttcagtaagaacaaaaggcagatgacttgacttcgcagtcacactgacccttcaccaagccttcacctgaattctgtctctgagcaaacattcagggaggctctgtatctctagagagggatttgtgtgtgtgtgtgtgtgtgtgtgtccctttttaggactcacaaacaagagagacaaaaggcctgtgagagttctctgtcttggggtacacctgagcattgatattcggcaaagtcttcattctttagccatgtgctagcatttgctagacctggaatgctggggttggaaggaaggactggatctaaggaactcagcagggagaagcgcttcctgccaagcctggcaacaagagttcaatccctggactcatggtagtagagacccaagtcctgaaagttgttctctgacctccacacttgggctatgatgtacaaacacatcacacttgtgctgtggtgtgtaaacacattgtgtgtgtgcatgcacgcacacacatacacacaatgacaaaattttaaaagaacaaacaggttgaggtcactcccacgttggatcttgataaaacaatagagttaacttctccagtggagaaaggtactggattctagcttccttcctgccatctacacaaatctacacttttcatctgtccccccaccccccccaagcctggtaaaagggaaacagaaaggtttagggaaaggcacggtggagggataacctttttgtgcactgtataaagcatgtcttcctattacccagatgctggttttgttaacacccctctctccccttctgactggttttaataaaaagctgttggcctatagtgaagc

SEQ ID NO: 33684 - DNA, 1099 bp, Mus musculus
cttggcagcaagctctccccactgagctgtctcactagctctgtgcctgtctctgcatttgcacccacaccagcatggcccctccccagcacttaggatgctctgctcactcaaggcacctaccctgaaacccactcagcctggctgtgttcccatgtggttgtcaagttctgcccacacatgctgctgtgtcccagtgtcctctcctcagccaggactgtgggcttgaattgttgtcccagtgggtcactaggtgtctctgatccaatgtggaaataaagaaactggaggatggcttagaggtcaagagtgtttcctggtcttgcaaaggactgagttcagtccccagcacctacactgggcagcatacagttgcctgtgaacccagctctaggggtcagccatggacttcctggactcccagggcacctgcagtcacacatgcacatgcccacacacagatgcgcacataattgatatttttaagtgatgcccagccatggtgccagtgccacttggtcctggctacttttctcttcagagagcacatcctggtctgcctctgttccctctagccgtgagcatccagtttcaggaagaggaccctcccgatgcccagctgctgaggttggataacatgctgctggctgagggtgtgtccaggccagagaagagaggccgaggagcagcagcaggcagcacagcaacaccaggtggctgtccaaatgacaatagcattgagcactcagactacagggccaagctgtcccagatccgacagatttaccactctgagctagagaagtatgaacaggtgatctttctacatgcaagagtttgtcttgtgaatgtgcactggccacagacagatgtggacatgagctccctgctctatggcagagcagggacagcccgccacagtcagtcactgcagaggggctggtgtcactgaaagcgctttcccctcactcctcagagctgacctgagtgtgagctgtgggggtggcagatgtggtcagctgtggagcccactgccccgcaccactggctgctgagtcacaggctggcccatcttttcccaccccaggcctgtcgtgag

SEQ ID NO: 33685 - DNA, 1165 bp, Mus musculus
ggggcacagaactctgtccctacacttaacctcagagccatgactccagctctgcggaagttttcttgtgtagtcacgggtggcctttgtcctgagttccagcctagctaactgcacatggctggttctttcccaaagagcttccagtctagctgatggactcatagtgtcagcattcctacctgtgcctctgctcctggtcgccaggaactgctgtagcctggggaagtgaggaggagcctccctgtgagcagacctcaaactggcgtctcccagactggtttcggacaggcctgtgttctgcgcctccctcagcttcaccagcaccctggtgttctgcaccaggcagccctttcattgttgttgtttgggggtttgaaacagtctcactgtgtagctccaggctgggcaggaacttacattgtagcccaggttggcattgaactcagagattcctgtgcttctgactcctgagtgctgacattaaaggtgttgagtcactgcaccaggcagcgtatgtgttcttcattattggtgacttgagtctgtatcttggctcctatgtcatctctgcaaatattgtgattccctgtggcctgttgagctaatggtgtcctttacaacaggaatggttctcttatttaaggaatttgcatttgtgtttgtctagagtacttttatgtatccattgtgagttgggtcaggggctgtatgatgctgtatacagctcctctatttgtttgaaccaggttctcactctgtatccctggctgggctggagcttgcagtaaactggggaagccagttcttgtgccccacccacctcctgagcgctgggattataggagcgcttgatggtctagacctctatgtagatggggctgatggggtttacctgcctctgccactcaagcctttctatattactcccagcctacgcctaagatggccccagactccctatgtaaccaaggatgaccttgaactattgtttctcctgcttccacttcccaagtcaagtggtgggatcacagacatgcattgccactcctggtttgtgttattagggatggaacccaggaggttatcgtgttaggcaggcaagtattctaccagctgagccagccccagggaagcagggccactgtgcatctcaggctgccag

SEQ ID NO: 33686 - DNA, 1187 bp, Mus musculus
tcccaaggccctacagccgcgatgacttttattgcccgggtaacaatttctgccttgtgaagtgactgcgggcgtcactcggccttggggcggggaccctccctcccccgccccgcgggctccctaaacccttcttaggctttgtgactcaatcgcccttaatggtcagttcctcgtgagaagtcactggcgaggagactgcccactgatgtggaacaggacaagtccctccctgaagtgatggtgctcaggtgggtgggaaccagcctgttgcctcgagcctggctaccatggctcacgaaagaaagtaggtgaactcccaaggtttttagtgcaagaaacacgcccgagagagctctagatgcagaccacagttactccctgcctagggccagagggaggagggactgacttccggatcgcagcaaggctagcgtaacgcttccaaattatagggaacctcctgggtgacggaacttccgccacactcaaaatggtggtcgcgcgttgcctcacttccgctggtggccggaagttgcgggtcctgcaagtatggcggcgtcgaaggtgaagcaggacatgcccccgccagggggctacggccccatcgactacaagcggaacctgccccgccggggactgtcgggtcagtgtctcagtgtcgtcctgttcgtcgcagaccaggcttttgttatgcggttagacgagagagggcagcctgcgggcttcagagtgcacagtgtgagcggaggctgagttggaatcttggttttctagtgcagcatcccggaagccagaatgttcatgtcccctagtttccagctggcttccacgggcctggaaactaagcctgcgagaagcactaacctggagtttggaggcttttgttttgttttaggctggcctcaaactccgtagcagagactgatctagaactcctgatctcttgccttcacttccgaaggctatgctcataggtatgcaccgttatacgtattttttttttaatgtttttaaatttttttttttttttttttttttttttttttttgcagatagggacttactatatagcccaggctggcctcaaactcgtggcgaccctgcctttgccaatggattgctgggatgacagacaggtccacccaaggcaagatgtgtgttgattgtaacatagcatagaaggc

SEQ ID NO: 33687 - DNA, 2851 bp, Mus musculus
tactgatctcttagcactgagcccaaccactgatccatacttaggtcacctctgtgggatctgggattgatggcagtgtggaggttctgtgggtcatggtcctgctcatgggtccactgaggatgtgctgagataggtgagtctaggctgtatccatccagggccttgcctggctgatttgccactacccatcactgctctgttgcaggtgggaccctcgccttcgtcagcccaagcttggcagtacacaagacctcctcggctgtggatcgacagcgagaatacctcctggacatgattcctccacgctccatcccccaatcagccacatggaaatagtgggagccggcccagccgaggacaggccctcttctctcccaaggcccttggtctaggacacacagactgcctcctagcgagttgcctgagacagctcaggccttggctgttgccttgctttggccaggagagtgtgccaccatggtgcccaggatcagaatgagggacctcccaatgggccttctctttcctttttgcctttagtttgcccgacaccagcagaaactcggaccttggggccagctctgcctggccagcgtgggtgggagctcaccctggacactgtgacacacccgggccaggctggcaccgggggctcccgaagttgagccgggatttcgttttcttttggcttttcccatcttagctccccagtctctgcctcttcatggccatctataggttgaagtttgggttttattgggtttttttttgttttgttttgttttttttgtttttgtttttttataatcacctcataatgatgatggaattaaaagtgaactgcatagacccagagtcactgtcatacacagtgcacttgggcaggctctaaccccagaggatgctcggagtggcaccagagatggcaggtaccaccctgactctagttgtctgttgctgctcactgcaacccctggcttccacacttagaacgaattgcagcccatattctgtctgaaatctagaggctccagagagatgctgagtccactgtgctggagccagagctggttgctgggttactttttgtggtttattttattaaaaatttctatcctttttctcttttgatggacacaatctcatgattcccatgcctgccaagaggcatccatccaggtagggcccagccacagcccttaggtctggagtcagcagagcttactccctctcaatccacagggacgcctgaaagggcccagtctacttctgttctgttttgtttccttctccccccattctcttaacaattggttccatggtgaaaggcagaagtagctgtgtgtccagcacgcacgggcggccttctgctcttgtgattggtcgccgtcgtttccccatccaaccctggtttcccttgacacagtacagttagggactttaatttaaacccttgttctgcggaccaccgccctctgcagacacgccccctgcctcctcctaataaaggctcatttaactccatgctcacctgtgtggaaatcctccatctttagaaatcatttggacatgtgggagttgagagttttggaaaacacttttgttgtgtgatacccaagttgctcagtgcttttgagtgtgtcacttcccagggtggttttgggggaattaacagaaattgaagttttttaaaaggggggtttttacaccaaaaataaaaaaaaagagagagagaatatatgcaagcatttcttagtccttgagtatttttgtgcctggcaagtcagttcctgttctccacccttcctaagtggcaatgacatagaccaaaagtcttctggctccttggaacggcagcaccggggtggcctctcagccagaagtcctcattcctatgcagtcactgatcagaccatgtcacctagaactggatgaagacctccacttgagttgagggtctgaccaagagggttcggttgtcctggtgcatccagacttccaagtcttgtgacttctcccatacacctgtcatccaacccttgtaggcccagtttatgcacctcacaagggacagacctccctggctgtggttcatacttgccaggatgacaagctgtggtaaaggtctctctaaggagggctagagtgaggtgccttagcttactgaccttacttgaaagtgctgcctgttcttctgcaccacactggcctatgcagcaagccctcaacatgataaggactggggactgaagggccatgtttgggggtgtacagagctgccacccccaccaatgctggctttatccctatcctgaatggattaaatcctgggttccttgagacccccctagagatagattagcctctgcttcttgagtgctgggattaatggcttgtacctccacacctggcttaaaactttttaaaaaatattaatggcatggtaactttcctgtctatacttgggaggtgaagatggaggtgatggttcctacttcattgatttcccagaggcaacacatcagtggctctggtcatcaaggtcacaggtaacaccatttcctctactaactgctagggacaggtttgaagggaggagccaagcacagaacacatctgtatttgtcgaaccagaccttttgacagatgtgtgacctaggtttggttgttgggacagtggtcctatgaacagcctccagacctgatcacggtcttccccaccaccccagggaagccaaagcttgccccaggcagtagtaaggattgtaaatgctggctgtaacaaacacctccatgcactgagtcagcctgaatgctgttgagggtaagagtggtcctcgccatgagt

SEQ ID NO: 33688 - DNA, 1131 bp, Mus musculus
atacgaccgcagccccagctcttgatgtgctcgtgctcttacatgctctcatgcagctctcctcctcctcgtcctcctctcacagcctcccctgactgtctcctcctctccctctttctctgtcccctagtgtaactcacatggccgttttgactttggactcttaaggacccaagtgggtgggaagaggtcagccagacaaggagaggctgctcgaagtaacctgcccaacccctgcccaccataagcctggtcctctttgacttctgtaggcttccagccagctgtcccgaggctcagccacagcacctcgtggtgttctgcacactttcagccagtcacccaaactgcagaatgcagcctcagctacggccctggtaagcaggactggcagacattccgagagagtcgtgggcaccggcaagggcaccgcctccaactggaaaaagacgcctctgagcacaggtacacctctgcctctatgggaacccactgccactaggccacctttccttgtttgtaaggtgcagtccaacacacacaacccagcagcctcctccttactcttattttttccttgagacagggtttctctgtgtagctagccctggctgtcctggaactcactttgtagaccaggctggcctcgaactcagaaatctgcctgcctctgcctctgtgctgggattaaaggcgtgcgccaccactcccggctcctccttacttataagggcattttcaaaggtaatacagagagcctgcatcttgtccccttcttgagagcatatcctcttgctcccatcctgaggcaagtgacactttacctccagtagaagggcttggctcatgacttccttttatctgcctcaccctcccctaacctcacccacctcaaccctttcaagcaattagtggtgctttgctgccctgctctagagattagtgacaccagcagccagcctttgcccatctctcttccactgccttctccctgtgtggaccagaacagaaccatgaacccagagaagggtggactgtgcagggtgctcatggagcagcaatgccacccttggaacatagaaatctctgttgggctcagccttccttgcagcctgtaggaagaacagctgg

SEQ ID NO: 33689 - DNA, 1231 bp, Mus musculus
gagccatcacactctgtagacctgagcatgaagtcagtgagagtggttcttttgagtttgaaaacttgtagccactgcagccacttatgtgtgtcctaggtaggacaatgcagcagatggccccaggtccccttgtgaggtagagagcaaaagctaacagtacatcattgtgctttttggtcttctggggggctgtatgggactgggttaagagaggggtgggcttcccattgggtagttcccaatgtgagaccttggctttggagtgctcacgtccatcctacccagcactcaggagctgagatagcagaccaagatctgaagctctgtttacttgtgacagagctctggggtcgagtagcactttctgaagcatccatgctacacctgagtactcagagatggagcacaccatctggtgtgtatggccctaatgaccagtgatgatacccatggtgcccacggtggcaagaggaggcacctaggggtgattgggcatctggggtagtctggcctgcctggtactctgccctgctaagcacctgcttatctccatttgacagtgacatgaagtctgagaagagacctccctcgcctgatgtgattgtgctctctgacagtgagcagccatcgagcccaagggtgaatggcctgaccacagtagccttgaaagacaccagcactgaggcgctcttggtgagccttggcagagcctggaagccccaccaccccaccttgcagagcttctgctgaggctttccccaattttgtgcttttgctctcctagaaaagcagcccagaagaacgagagcggatgatcaagcagctgaaggaggagctgaggctagaggaagcaaaactggtcttgttgaagaagctgcggcagagtcagatacagaaggaagccaccgcacagaaggtgcctgtgctctactgccccagaccccagagaggctggcccagggcagaggctcgacccacgggcgggatggcaggcagtgtatggcgttagggagcaagcagaaagtaattcggggtgggggggtgcgtgcgtgcgtgcgtgtaactttacacaccaactccttttgatgtctcttgctatcttatagcctacagcttcctcagggagcactgtgaccacccctcccccactcgtgcggggtacccagaacattcctgctggcaagacctcacttcaggttcgtgcgcccttctgcttgttgccctgcac

SEQ ID NO: 33690 - DNA, 1109 bp, Mus musculus
gaacagtgcaaggggacttcatgcttcttttattgttgaaatagagtgccatgtagttaggcaaactccttatcctcctccttccatctcctgagtatgtgcatgtccacattggatagtactattaatgtctcctccatgtagatgatttaggaagcaaatgggatagtgttccacctatactgcaaaagaaatgtggaggagggacgcgctacagtatggctaccataccagatatatggtatctatatgatgatgcattactagaaacaatccatagaggttaccccaggttgtgtgtcttgttctgcaaggtcccttagccttgagattgtgaacagtgctgccccaccccagcctggacctctggtcaaggctgagctggtacaaacagaagaagctgcttggtaccttatgccccactcctagtctggatctctgctgagctccagctggccttgcactcctctttaacctcctcccctcctcggtgctgggatgagagatgtgccaccatgcaggacttactcgaaccttttctgtggcatcatcttggactactgcagggtgagtctaatatactgtgttgttcttgaggaggaaggaagtactgacagtgtggcttacttgaagtgaatgacactgctctccagcgagactgtctccaagcccttaccctgagaggagactgtaggtctgtggccttcacgtccaacttggagtccagtgtctctttccaacctgtcccaggttggtgctggcacctgcccttcaggagtttgtcttctcctccctcttccctttgtgtcagttgccatgtacaggctgtggctaccctcccttcacccaacatggggtctcgacttttggaaagttgaggttgattttaccagctctggtgtccatgtcctccatgacaggaccactgaaaaaggactgaagtgtcacatatatagtatgtacacattacacaactaccaatgctcctgtcttccacaaaagccaagtagctgtgacagtgcagagagcgggctgtgtgggtggccttgcttcctctgcagagatgggggacaggcctcaaaatgtattcatggtgccaaagccagcag

SEQ ID NO: 33691 - DNA, 1331 bp, Mus musculus
ccttttctttgaatcaagataaatgtgtgccacatgtacagggccatggtggtggcactttgggatggaccggtccatactgtgctcagagtgtatgtctgccagccaaaaagcttagcatgaccctcacttctggctccctggggggctcaggcacacagcacctgaggtcacctctatccaggtcctacacacaccattacaatacagatgccaggcccctggactggttttcagacccataataggcaccgttcttccacagaagggccctgtccagtaacagctgccactgcttttctcccacttggattccatggcttctcagagctggccacacccaagaggcctgtgggactccttcctgcccagccatcctaagggtgtgaggggcgtctatggccctgtctttgttgtcccttctctagttagctgcctctgaggaaaagaaaaccgcacttcaaactaaacttgtcagaaggggttcaaatgctatatcctccctttcgcatacagaatgagtgaagaagcatgccgaacccgcagtcagaagcgcacccttgaacctgacctaacggaggatgatgtggagaacaagaaaatgaaaatggagaaagggtcatcagagctgacagtggacggagacagcagggtgatgccagagccgagtgcaggctcagcccaggggttgctgaggacaacagaggccatgggcacaggatctggcgaggggctgttaggagacgggcctgtggacatgcgcacttcacacaggtgagtgagaaaagacaatgggctgggttggagcctagcagaggctggtacagggcaggatgtccctgagtcctaggctgggacactgtcagtggcaggttcatgggttcattggggaggaagtcccctgtatttatttagtgggtctgccatctcttggattgtgggaggactgaaacattcctttggtgggagtgcctcagggaggccaggctaccacactttgtgtcattcctcaaaggaggagcctccctattctgcctggcttctgttatctcttctgtgggtttctcctgtatatcactaattagttcaagggaactttcctgaaacccaggcttccttcttttggtttttttcaagacagggtttctcggtatagctctggctgtcctggaactcactttgtagaccaggctgtcctcaaaactcagaaatccgcctcccaagtgctgggattaaaggcgtgtgccaccaccggccggcccagaacccaggcttcttgacactcataggtaaaaggctaaaggaagtcagactcaacctttttctcccag

SEQ ID NO: 33692 - DNA, 2168 bp, Mus musculus
aggcccaagttcagttcccagcacccttgtcaggcagctaacagcccatctgtaactccagctctgggggtctgacaaccctcttctggcatctacacatacctgaacacttagagcatttacaaataattaaaaagaaaaaaaaatgtcaggtaggagttggcaagatggttcagagggtaaaaagaaaagccagtcatgatgttttaggtttgtaattccagcaattgacatggagacaggtggtctctgaggctcactggccagttagcctaagcaaagtaaatggtacctaaaagaacacataaggttcccctctggccctgacatgcttttgtacacatgaacatgcacaaaaaacctgagtgtcaaccagctctaaagatttttgatcttcaagatgaatccattgaacctaggtgtttaaatagtgtatcagaagtgtaaactaaggccataactgctccaaagtatggttgaagggaaggtttttgttgtagataataagggagagtgcagccagaggcatctggaagagtccagaacagggagaaagagaagtagatgggacatggccagcagactggctttgtccatgagatgagtgggtcgaggaagaggagatgatcaagagaggaagaccaaagatgaccaagcacacaaatactcaaaagtgacaggtttataagggactaagatgctagggagggaagcccatgtgcaagagaagggtaggggtgggtgggagagacatgggcaattagaacccaggaaacctgaagcacagaactcactaagaagcagcacagatttgtcctcactttcttttgggtctggcaggcagagtgccatttggctttaatccctacactcaaaggcaggcagaacagtgatttggaggctagcctggtctacatagttgcaggtgagtcagaaaccctattccctaaaacaacaacaacaaaagagggggcaggggtctgttctgaatgtcacccaaggctaggttccccactgtggtgaagtgcactctggccatcctcctctgggtgttctcccatgaggcctgggatattctacattggccaccagagggtcagaacaaacccaggagtccaggacagctaggcatgtccctactaaatagagacactggaggcctcatcctggagtccgagtagccagactgaagggttagaaaggcacagaattgaagtgtttaaactgatccacttgtaactccagtacccatggagccaatgttctggtgtctatgggtatgcttgtggtacacagacatacatgtgaataaaacatacatacatgcacacatacatacactttttcgaagcagtgtgaagtttctttgggaagcaagttgtgtctgatggtatgttctgggtcagacatgtgaaggagtgttttcctgaaggggacacaggtgaaaggatgttttgctaaagcaaatatgaaaggacgcatggaggtagggagccaacagaccatggactatgctggatggtatcagtacactttgctattccttaaacatcgtttgttgtgacttcataaccaagaatattctggtgatgttctggtggcttctgtttcctcagacttgagctgattgatgtcagctggtacagactcctatggagttttgctgaggtaccaaccatgggagagcacaagatgtttggagagagaataaaaatgactcaactggacagtgactggagttcgggaggtggggcttgcatagctagctttgcaacactttgttggtctcatgcttctttgatcttaactttgttgagaggcacagcagagaacctttggtatccctgctgttcctggtcactcttactgactcctgccagttcagctgaggactggctatttctgctaggctgtgccaccactgctgattcatgtttgcaatcttgattctactgaactggactgctggtatgtatcctgacaagcagaagggatttgctccaaagaactatttctaaacaggtccacttccctgatatcctaataacctttcctttctactacctctggtgggctagaaggaaggttaaagcatttaagaacccttattaaaagtaggttttgaaaaaactaagcctacacagtgttctgtgtggtctggctgtcct

SEQ ID NO: 33693 - DNA, 1106 bp, Mus musculus
caagcccctagacacgcttgctcctgtacccaggtgcaacgcagaaaccagctggacatggtggctcacacctgtcacacctggaaggctaagaacactcccaagttacatgccagtaagggttacacagtgaaatatgaataacccagtaaaggagagcctggtccagcccttgtgctcctgggtagggaaggctctttgcttttccatgggttagttgactcttgactgcaggtgaaatccatataaaattagacaggtttaaaaaaaaaacaaaacaaaaaagccgggcgtggtggcgcacgcctttaatcccagcacttgggaggcagaggcaggtgaatttctgagttcaaggccagcctggtctacagagtgagttccaggacagccagggctatacagagaaaccctgtctcaaaaaacaaaaaaaaaaataattagacaggttttactgataggtggttgacttaaatttgacagactttaactgtctatccctggctgatcttgtattgtagctgctgttccccaaatctcacccaaggttatatagtgtgagctaccactgtaggattagactgggtttgtttgtttgttttgctttttgtggcttggtttctggatctccactggcttacataggaaattcttacatttcaaccccaagtttctgagaccgtaggtagcactccaccatgccatctcttcagccacttgtttgtagttttgtactttgttgggggtggaaccaagctcttgtgcacagcaaacacacctctcaaactgaactatactgcaggtgttcctaaattcaagaccccagtgctcaagactcaagggaggagcatccactgccttcggtatgccattgtgtgcctaagcactgacctttccgaaaggattcagagtccagctatgtgtctcatcccccacacctgggcatctctgccttccagagtctgcttaagctagatttcaggtagagtccactccttcctttgtcaacttgaaggctctatcgtcagaacaagcctggtcctacctcaccaaccctggatggtggggtttggagcaagtgaggtagatgagtcctggggctttgc

SEQ ID NO: 33694 - DNA, 1984 bp, Mus musculus
aaaggcatgtgccaccactgcctggcaacaaggctgatcttgaagtcacaaatttacattcctttgtctgccaagtcaccacagcttgctttcaaggggatttttaagaactctggcaggtggagactgggttcctgctcagggctttgtggatgatcctcctgcatctcaagatgggtttggatgtctgagggtaactctgtctcccctgggttggtatgagtttggccacccagggatgaacagtgacacctgccccatcctcagacctaaacaaggcatgtgggaacgccatggatgcccatgaagccgcacagatgcaccagaacttctcacagcagctgctgcaggaccacatcgaggcctgtagcctcccagagcacaacctcattacggtataaagggtggggaaacagacatagggatacgggctctggatcttcagctgggaggggtttactcatgtgtgttctccccacagtggacagatggcccaccccctgtgcagttccaagctcagaatggacccaacaccagcctggccagccttctgtgaggcctgtgtccgcaacttggacccaacactggagctctctgggaacaaaaccaccagggtgcccaccagtccctcaccattgtccagagctaagtcctaagagtgctgaagccatcatctgcctctgagggtgacagccaattgcacctgttccaggactcagtgccatctattgaagggactgatggcctaatctgtgtctgggtgtcacctgagaagaacagggtgacaatgtgtgtaggggcatcatctgagtgctcaaccgaacctaagtgcagctgcacaaagtggcctccaacccagggcaagctgaggggagagtaatggctctcactttcctcggtctgctgttcttccagtgtccctgcactcagggacttctgaggacctggaagtcagactcttaatctgagtggtcctccaaggtgacccagtgcaggggaggagtttgggaagaggtgtacatacgcagttgatgaggctgagacttcgtgtgcccttaagaagctccttgctcatattcagcagcacgtcttggcccagcctaagcatcaggcagaagtcccattggacctgaatgagagggttccttcctggcagctatttagctttcccatggaggacagttatgggaccagctcagctcctcttggcttgatagctgccctaagggtgacaataatgggggggtacggggcacagtggttcctgccagctcatggtatctaggcaggtgctcaccaagcaatgtgaagaccacttctcagagctttggaagccatgactgaagggacgaagctccaagaccttcatggacatcctttctgagccatgtggcagagactgcccatggccaggtgctcccaacccttctgtcttcctctagcccttgggtcccagggacctaccctcaatacctgcatcacagccctgcttatttatttaagctttttttttttttttttgcttctagggcattttgtacatacagcaattcaaacaaggacctctcgacttgccatctgtcctgatgttagagtgcttttagtgtccatatctcaggcatgtgaaaactaagcacagggtcacgacaaactccatagtctatgttgagtttccacctacatgaccccaccacagtgtccaacagctaaagattgaggggaaatcccagatgggctagcacaaagaggtattataacccaggagttactaagagccagccctgagccaggctaactgtagccctatatgagcccttaagccacaggtgacactctgagtgaaggaaggcatgtcatctattgagagggttggtttgttttcataaacatgggtggctttgcctggttttagcagccttttaatcgggaactgtaagctgagatctgtgagaagtctgtttgctggtctctccctttaggacca

SEQ ID NO: 33695 - DNA, 1197 bp, Mus musculus
gcatctgtctcctcttacaggcggtttcttcgagaaactctgaagatgtcaaatgcagaggacctgaaccgcctcacagcctgctcccttgtgctgctgggtcacatcttctatgtgttgggaaatcacagggtgagtccctacctagcctgtgcacctatctagctcgagacctgaggagcagcaccgtggagcatggtatttcctgtcctggaacccagggtgtggaaggcatggggtcctgggtcctgggtcctgggattcccttccaggatatatgtgtcgggctcacaagccttggaactaagagacagctgcatcctgccatgttccttgtaggcttctctgcataccatcccttgggaatccatggccctgtgggactgtctcagaaacttagatgagactggcaatgtcaaaccctcctgtgtctgtggcaccatcaagcacgtgactttacaagacttttttacttgaaattactataaaatgtagtgagggtaacttggccatggagagcagggagtggccttcatgttcctagtgctgtggcctgctgattgggcaagactggttggttactctgtggaactctggtgtggtgtgctttggaggagcacttagagtagcaatgtgggccagaagcctgcttgtccagcagtgtttcccactcaatggctttctgtaaaatactccctttgcctgtgttagccgaactagggagctagcagggcctgtgaggtcagggcagtcagagtgagcctggtggtgagcagcagggacagagagcagggagggttgctctctgtttggttgtggctggtggaggttaaggcctgaataacccaactgagctgcatttggttaggttgttttccattaacctgtacctagaactgaaatctggtttgaggcttttaaatttttgttattcgttcaatatttgttatttgggtatttcccaatttacttattttatgtgtgaatgttttacctgaatgtatgcatatgtaccatgtgtgggcctggtgtccacagaggtcaaaagcaggggtcagattccctggttcaggaattagacaattgtgagctgccatgtgggtactaaaaactgaacctgaggactctgcaaggacagtgagtgctctcaacctctgtcacagaaagtacccagacccacaggctggggaggtagag

SEQ ID NO: 33696 - DNA, 1099 bp, Mus musculus
gcagtgggagcttctgtccttgttttcagggtgtacatagatctccttgggaaagtccatggagtggggtttgagagaggccacagaaaccctgctgacagagaggggagggcactgactgcccatttataagttcatgtccttaatcctgagagagacgtgaggtgggcacagccaagagcacgggtgaggtggtgacagcccaagccaatccctgcttcctctatcctctgccagaccgacttccgctgagttgaaacattagggtgacttaagggtgccatcttctgctctattcttttgcgatgctcagaagtgtgtctgcatcatgtaaaacaggagctacgctacggaagctccattgggcacacctggtagatgatggaggatcccaagttcaagattgaaagggtgggtcaatggttaggagcactcccttctctcacacacattagaactcagatttacttctcagcacctacctcaggagtcataatttcctgtaactccagttcctcaacatctgatgctcccctctggcctccttggtggtacctggatgccagtggtgcacttgacatgtaggcacacacgtgtattgtcttttttttttttttttttttttagacaaagtctctattatgtagctctgactgacctagaacttcatatatagaccaggctaaagttcaaagttaagatggaagtatagtgcagtgcagagtactgtcttgcatgtgtaagaccctaagatcagttccagcatctgcccccctaaagatgtagacatagatcagaacaaaatgcagcactctaaagtgtctataaataaagcacatctccctgaggagcaaccgtattgatcctggtgccttacaaacctgatatcttgtgtcttttccagggcattattcctgctcagcaaggggatggtaagttcaggctggtgtgcagccgagttgcgggcatgaggccacctgcacaggcttttctacacaaaagcaggggctgtgccctaatgggcttcatttggggctctgaggtttcaggtggtagatgtgctattgagaaagcctgctgtggagccacctgtacccta

SEQ ID NO: 33697 - DNA, 1213 bp, Mus musculus
tggccggggtctaacacactctcgggtcccacaggccgcgtgtttttcctgaaaccgctgcgacctgtggccttggccggggcagtgcgcgcgtgcgctgcgcggggtgccacagtggccaaggtcgggcagctgttcgctgcgtggaagctgcagctgttggaccgctgcactgcaggctggctggcggatggcagcgcgcgctatcccatcgtgaatccgcgaactcgctgtggaggtcctcggcccggcgtgcgcagcctgggtttccctgacgcctcccgacgtctcttcggtgtctactgctaccgcgctccaggtgccccagatccggctccaggcggctggggctggggctgggccggcggaggaggttgggctggagggtcgagggatccggctgcctggaccccgctgcgtgtatagatctggaaggatgcgtgtttgggggtgttagtggctgatccagtggcctcatgcaccccctggataccgatcacgtctcagagtctcagagattccttggacatatgacacacccctgcggtgcactgcagactgatctagctacctgtggtctttggacattgaccatacctaaggtctcctggataagcgacctacccctgcggtgagctgcaggctgacccacttgttgtggttcttggtcgctgactatgttgccctctgaggatcccctttggatagtggatatttcatcttttagactttgcccagaagagtcatactctccctaatccccgggaccccagtagaccagcaggactctacggtttccaaaagatgaaccttctatggccttctgaaaaacaggtggacacccccctcagtcacctggaggctggacccccaggattaactggagacctgcccccaaaccttctgtatttcccgggagctggaaaactggtcttggatcgtcagctgtacactgactccatcacctggtgaagaaacagaaaaccacaggtcacaagatgatcgtgccctgtacgagcaagtgacccagattcccactctttcagagagtctctttacgttttcaaggtagcatactttgtccctgggtcaatatggaggacagacccaacacctctggtgtcacaggagagtctcctcagctggctcctggaacagcggccatgcctatccctcaggttttcctctgaccagagagtagactcgcttgaat

SEQ ID NO: 33698 - DNA, 1197 bp, Mus musculus
cttgtaagtagcagaatgagagagtttcatccctgagaagctgcacccgaggcagtcgctgagcctagaggtgtccttccctgagccagtggaaaatggctcaggcagacagaatgagttttctttacagacatgagccctctctttagttaatagtcacaccgtgttggaagggtgagcccacctccacagcaccttacagagggatcctaggctgctgctgttgccaggacagaaactgaccctcactcccttctgtttcagtgctgtgaagagcttggtggacagcagcgtgtacttccgtagtgtggaaggcctgctcaaacaggccatcagtatccgggaccacatgaacaccagtgcccaaggccacaggtagccctggccacctgccctcaccccatcctaaccagtgagctgtcctggtagtctttggcatctgtggcactcattttctgtaactcagctgctgtgaggaacacagtggtgccaggctcacagggacagtgactgagagacacagttcagagcaggtgtgggtgataaagagcagctgcctggcatccccaggatggtgaccagagcaggggccctgagactggcactctgggcccctagaggagtgatttagtgggaggtcgaggcttgtgggagctgggctctccaccctgtgtcatggtttctccggcttagagactttcagctaaggcccagtgcagtggaaagcacctgctggccccttttgtgttggccatgactcaataaacatagcttgcctgctcgagcctcagccagcctttgaccagtctgtcactggaatgagaagagcagcagaataaagtgctgcagacccctcccactgaatctgtgtcacacccaaccttccctgacagcctgtctggcctctgaagtgaccccatatccttacagcacacccaagagctcaggctatgggtcttggggccaaggtggaactcccctctagtcagctcgactgagcaacctcctggcctgtggcatcagtctcatacatttgcatattttgttccagccaggagaaactgtcccctcctccttccctggcctgaccctgaccctggaagactcagggctacctgcttccccacccaggtcagtgtagaggccgtcaccctgctgaactaacccatttctttgtgtccctgcagggacctgcta

SEQ ID NO: 33699 - DNA, 1198 bp, Mus musculus
agtactttgaggccagcgtggtctacagagtgaatttcaggacagaccagcagaagttacataggtactctgtcacacgcacacgcacacacacacacacggcacacacacgacacacaccacacacacggcaagggcaaaaagagaaagaaaagaaaaaagaaggaaaagccagcagacgaaacgacctcatgctccagctaaaactacagttcccagcatgcattgcgcacacccatcccattcttagcccgatgactgacttcccaggatgctcgtcaacagcattctgtctctaattggccaagatacctcagcgcttccccgcctccagcctcgtaccgctgtgcgcccagggagcggacatggtgagcaggccctctgggatccccggggtggagaacggcctaactgagctgagagggttccccaaaccgcgcgggctatttggaagtgtcgtgtagtcagtggtgctggacgcgttgggaggtgaagctagggctctggactggagtgagggagctgggattgcagctatctttgctttctgacagggtcccatgtagcccaagttgtactagaacttattcgtagcctatggggacctcggacttctgattctcctggctctggagtgctgagatgtcaaacttgtgccactattcacggctttctgtttgtcttttaaaatctttttttatttttcattattttatttatttaagtatgaatgttttgtatgtatgtctgtctaccgtgtgtgtgtgtgtgtgtgtgtgtgtgtgtgtgtgtgtgtgtgtgtgtgtgtgtgtgtgtgtgtgtgtgctgttcttagaggccagagaagacatgtaggattccctgagagtggagttagaaagggctgtgagctgccaaatggatgctgggaattgaacctgtgacctctggaagagcaatcagtactcttaagccctgagctatctctctagcgtcccagtccttttatttttttctatttacccattaaaaattatttacaaagggtcttacttgttggtgttgatgggcagtgatggcaaatgcctttaatcttagcacttgggaggcagaggcaggtgaatctctgtgagttcgaagcccgcctggtctacagagtgagttctaggacagccagggctacacagagaaaccctgtctcaaaaaaatccaagcaaaa

SEQ ID NO: 33700 - DNA, 1920 bp, Mus musculus
ggctagcagataaaagtgagggcagggtttgggaaaagctacagttaagacccataggcagggaggttggaggcagggccaacagacaggggaggatggaggccccctaaggcctgcggggtgtaacctaggtgtgggcggggtgtgagagcctctagattcccaccattatgtctccacctataattctcttcttcactcctgcaggaggctactcttgggccctgagctctactcctcccccactggccccatcccagccctcagaggctttgatccctgtagaccctgcaggagatgaggcccagcagactgcagcccaggttgcagggatcctgggtggcctgctcacgcccctcttcctcagaggcatgctggcttacatcatctggtggacagctgcctgccagctgctctccagcctcttcggcctctatttccaccagcacctggcagcctcttagcaggaaggcactaggctctagtgtctgattcctgcccaccaggattgggactgttccctgtgtgtgtgccttggtgcccctagatgacataagggttggtgtggggactccctaccatctctctcacttcagtgcctagatcataaaccccttgaagcaatctcccctgggccatgatccccaagtgtgtgtgtgtggagggggcacgttttacagaaatatcccagagactgggggatgagcaggggagacctggatagtgagaggggcctgggagagagtggaaacctcaagatcagaggtggctaggagagctaggggtgggactctggcccagcatccatatagccccggcatctgtcagtatccccaggagggagagacagtagtctccatgcctgtctccccagcacacttggggaagctgaggtaagagggttagcctagactagtaacaagactatgtaaaacaagaagaaaaagggggccgggggaagcttgaaagggaagagagggaagaggttgtcaccatcctccaaagctgtgaggatgactgctgtgttttgaggtcttggtgactaagggtcacctccaactccaaagttatttttttgctatgacttagtgtgtttacgtgtgtatttatgagatatgtgtgaccttcctacatatgtaaaatgtgtattgagaataaaaaaggagggcttctgcaatgctgccttaccatggtgccagtgtggtctggcccagtcatgttcaagagccagtgctcagtcagagccttgagcctctgggtctctgtccaagaggacttaggagtgtgactgcctatgtgctgtgaacacaggtgctgtgaacacaggtgctgtgtatgatacaataggtccatgtgtgagagcagggatcagaggacaacttagcatgtagatcctagccttctactatgagacagggtctcttgtttacctgagtccctcaggtcagctgtccaacaggctccagggagtctctggtttctgcttcccaccttgcttgtaggagtgctaggattatagactagtgctgctgtcccactttatgtgggctctggggacttgaactcaggtcttcatgactgcagcaaatatggctgacgtgtgtgttatgaatcaacaggatgtccttgaagggctatctggagtccctgcctcccaaactgaccctgacaagggctgcaggaccttgtggaagtctcatgggaatcagggatgcccatgctctgctgtggatttcagagtgtaggggcacacgacgtacagggccccacctccttcagctacatggctcagggctgactgggcctgagctgtgtttcagagcaaggtccttaggcttctggccgatgcccatttgctgagcatgatggagtatagctgatgactccagaggtagttgggccagccagtgctatgcaaga

SEQ ID NO: 33701 - DNA, 1156 bp, Mus musculus
agacatgggcgtggactgtcttcatcaggcagcatttctgtttatctctaagggcactgggcaaatgttcaatgtgaacagatctctcccttttgtcttccagtccacgaaccagttcgaattgcctacgacaggcctaggggtcgtcccatagccaaaaagaaggtgtgtgtgactgcattgtgacacctccctacccctgcagattcagcatcagaatggttgacttgctgcttgtggtgaggcttcaggcactttgcagagctgggtgtggagcatgcctgtgtcccaggtgttcagaaggctaggacaggatgattgcttatgcacaggagttccaggctggcccagatatcacagcacactccatccctaagacagcagccaggcgtaggcatgcctgttatcacttcactgccttcgggaggctgggctgtaagatctcaggcttgaagccagagagtgagtgtattcagccctacaatataaactatgcagtacacaggagagcagtccactcagaagaggctggctgctagagggccattaatccttacaggtctcttgttcagtcacttctcctttaacctgggctccaccctcctcacagagtttctctcatagtcttagtacagggcagcagcatgccaccccacagcctgttggctagttctaaccctggggtaagggacctagcctcaagaagtcccacccccagggatgtttgagggaagctggtggtgagtggcgctcaccattccaggcatctagggttagaacaccacttggagatccagtatacactggaacagagtggtctacccactgactttctctcctcagaaacccaaggacatggagttttcccagcagaaactgacagacaagaacgtgggcttccagatgctgcagaagatgggctggaaggaaggccatggcctgggctcccttgggaagggcatccgagagcccgtcagtgtgtatggcatggctgggggaagcctggggtgccttgggttggggctatacagagtatacagctaggtcatttttttactagctgcacacttaggtgcacaggagtgaccagctccttcctacatagacctctgaacagcttcttgactcttacatctaagcaacatttagtaatggc

SEQ ID NO: 33702 - DNA, 1249 bp, Mus musculus
cttgagagacttctcaaaagcttagccccagtttaatatagttgaggcttataccacacctgtttctgtgcctgggaagtgcattctgaggaaaccccagtacttgcacttgcagcctccactgtggcccctgcaggccagtgcgacggtgctgcagcagttcccatgtacagtgtctttctgaagcctcaggaaggatggtgtggctcagctgccatggatgtctgctttggagcccaactccacccatgcccgctacccctgtttggtacagatcctctcgatgcatcccagcctccccaccacagtgctgggcatttgaaatcagtctgtggaagtctggaaaggctgatgtcagggctggggacatggtggtcaggtgtcaaccatgagcacagcaggaggatcttgctgtagtgatactcaactctcctctcagcttagctctactttctgtttcccagcatgcccttcttcacagctgctgcagctcacaccacctcactctcttctggtgtcttggcaactaacgggtctttgtagcaatagagatgctgcactgccagtgggtcacagtctgactcttgaacacaaatctgcagggtgggaaatgacaggtcagggacaccaggctgcagtttcatcttcaggtctttctttcaccttctagcagcttccatgttggttgtgggttggaatgggactctggtccatggtgggctcttaagaggagttcccatccataagtggagcacacagacctgggtgtgctgctcacttcatatcttcagcttctctccagccacctgcatttgtgctgctccattggggcttcaagatgattgaggaattgtgggtagatggcccttgtgccaagactctggaaggtgagactgtcaggcagccccccaagttgagaatgacattcctaggcactcttgtcaagacaggatgaatagtggggagagagagagcacatatcttatgcccctcaacgtgagccatcttgatgctcctcacacacaccttgccatccttgccctcctggggcaccttgctctccagccaagctgctctaggggcagggctgtggaggacacctgatgtatactcatgtgaccttgttcctgtcacagtgtttgtcctgtcattctagttccagggtcacatccacaaggaccatggattccaaaagttgtgctggcctggcctgccctggctccagtttgttcctgttcctggatgtgcg

SEQ ID NO: 33703 - DNA, 1088 bp, Mus musculus
tggcacgcctggcagaggcagcaccctagtctgccatggagtgtctgcggcctcaaggcgccctggcaggggccaggggaccccagctgtctctgagctttgcactgtgtagagttttctagaatccttgggcagtgcttctacccaggttacatttctacgtgtggcgttgctgtccctggctgctgctgccctgcgccccagggacactgcgagggaaggctgcactagtcatccccatggggcaacagaggctttgggatcctgagacctgaaggccctgtactcatcccaccccattctcaagtcagactgacaacttcaaagagtgtttactgaagtcaggggccaccagcaccaggtttacagctcagtcctgagcctcagcctgggctggctcttggggccgagatctgggaggacgcgaccgtcggacagtgctccctgctttctgccgccgaagtgtctgccccactttctccttgaagcgtcggttttgttgcttgatcttggccagctcagctttgcgtttggcctccaggtctgggtcctgcggaagggagctgagaatgtaactgggcagcttcccagggactggctcccccacccctacccgaccccaggtcccacccacccttactggccacactcttatgcctgtccctgcatacccatgcctccctatactaccttcccctccaggatcatctgtttccgcttgttgatctctttcttttcatcaaaatgcgaagcctccagtttctaggggtggggaggggaacaggtcagtcaggcctggggcaggaagccccgcccacctcaccccactccaccctaccctgacaggctggccacacttactatttcgcactcccttcgcactacgttgacctgcgtgaggatttgtagaacctcagcctcctccaccaccagctctgccagctgctgctctgcagggacaggaaacactgagttgggctgggagtgcaaccagccctctgcacccccagctctggatgtctggatccaaccaaatgtggactgatgatatttagaaaaagcaaaatgctgccaagcttggcagcaca

SEQ ID NO: 33704 - DNA, 1824 bp, Mus musculus
ctgctatggatctgaacctgtcaccctgccactctggctgcagtatggggtttcttcccatcctcgggtctgcggactgggtggctgtgggctactagctttcctggccatgttcacactacctttgcctttcaggacagctacctcggtgatgagtttaaatcacagattgacgtggcactctcacaagactccacataccagggagagcgggcataccagcacggcggggtcaccgggctgtcccagtactagaaggcaagtgccctggtgggttcagctctctgcacacgtgtgcaaacagggtcttcccagacagactgggcaagtagatatggtgtgttggcaggtcctgcctctactggccctgacacctctaaccctgtccctgatcacaggtagcggaggaagagctaagctatgtggcttagtctatcagcatcttattctgggtaataaaaaataaaaataaatggatacctgttttccactgctaaaactgaagcaccactgtgtgagcagccgaggagaggagaggaaagaggagcgagagcgagcagagagcggccagggaggacgacagagcggagcgccgaggagcgggcgccccctgtgggcggcgagaggagagaggcccgcaccgctgcgaggccggcccagcgccgtgcccgccagagggagaggcctcgccaggaccggccccgctgttctttttctttgtttctcgtgattgaggggctacgttttagcaggacgaacttcgcgtttctgtgcccaagcgggcggccaggagcatcagtgcgcggtcccagcgctaaggggtttcatttaaagaaaatacggtgtttggggtttttctggtttttcttttttttttcttttttttggttttttttttttgtttgtttgtttggttttttttttttttctttttggttttcctttcctcccccctacccccttcaaagattctttcaaaggagtatgggaagtacttggatcggtttgtctctagagacctgactgttaaacctgagagatgcgagaagcttccgggaaaggcagcgctgagaagcctgagccccgcagcctgggatcaccgcctgcaccgcagccggaggatttgtttttgagtttgagcttcagaggccacaggcgaactcgtgagcacggcctgcgggttcttccccatcgagggtggaggcctcattgctgggcgccctgccccggacccccacctcccgcggcagccacccaacccctacccaggcacacctgcgccaacgcaatggaacttaatttttagtcaaatttgttttaagctttttgtcaccaataaaacatgaacaaacagtccctgcttttgcgtggggcggtccctgaaagggtgtcccgggtggtcaacggcagccacactcatccaccaccatgtcttcgtagtgtcgcaggaccacgttgtcactattgtcgaagaagagcacggagatgggtgatagacgctctggcacgcagcagggcgagcctgcacccggggtgggagcagctgcgtgcatgagcgcgcgcagcacagcgtggttgagtgcaggcggcccgccgggtcccctcagcgtttcgggtagtgcgcacgtgccctggcagaagttggctaggaagccacgcggcgcgatcacccaacggtgccagcccacctcacggaagctcacatgcaaccgtcgggtacgacaagtgcccactggaccaacttctaccctgggctccgtgtggcgccgcaatcgcggcaagggacacaggcgtgggtccagcgtcaccagcagcagggaggcc

SEQ ID NO: 33705 - DNA, 1187 bp, Mus musculus
aacatttctgggatatgggacccatgccaccaattccccaaagtgccttccctccctacagagcctggcgtgtggggtctcctgaggctctctacaaagcttgctgctgggactggcttaggcagtgggtgttggggggtcctggttgcttctttcccagatgctggagttcctggccgtggatgctgtgctctgcaccccaaaggcagcacagcacagacatggccttcctagaggctctgacctttgggaagcccagcccgtgaatgagtgtggggctaacccggcccatgtttctcatgtgttcagactcaagataacatcacggtcaggtgggacctgggccttaacaagaagagaatcgccttcttcactttgcccaagactgactctggtaatgaggatttagtcataatttggttaagaggtgattttaagttttaaaatatttgtgactataagtagaataaaattcctagtcccccatatcatgtcccttatgtgaactctgcatggtggaggccacgccctcttgaaagtgctaactctgctactccttcctgcaagacatgcggctcatgcagggtgatgagatctgtctgcggtacaaaggggatctggcgcccctgtggaaggggattggccacgtcatcaaggttcctgatagtatcctttgtcatatctgctaggaggatgggttctgtaacaggacccctggctgtccccagggctctaatatgtacaacttcttcctcttaatatacaatttcttctctctttccactttgtgagacatacacaccgtgacatggtagtgagtgcgcgtgcgagcatgcacatgtgtgagtgaaacagcctggagtctgtctgcagcagttcctttgcctgataggcaaggagagccggtctagtgatgaagtcaggggctctgtagaaggtgactttgaacaggaaactgacttaactcagttgccagattatggtgatgagattgctattgagctccgcagcagcgtgggtgcccctgtggaagtgacccacaacttccaagtggattttgtgtggaagtcaacctcttttgataggtttgtgagggccatacccttgggggccacctccacctttggtacctgtggctcgtgtgggttttacactggctgtttttataggatgcagagtgcactgaa

SEQ ID NO: 33706 - DNA, 1139 bp, Mus musculus
gctgccgcaacgtcttcctgctgggcttcatccctgcgaaggccgactctgtggtggtgctgttgtgcaggtgagctgcctgcagcagggctgggctggagaggacagtgtctgctgggaccaagttctgtgtgtattctggtcaaattagaaaatgaagtctggcctgatgtggtagtgtacacttttaacttcagccctggggaggcaaaggcagaagtttctctgagttcaaggccagcctggtctacaaagagaggccaaggccagccagggctacccagttagaacctgtctgaaaaactgaaagaaggaaagtgacaggtctgctgtgaactgaggccagagctgggcgtgcagatgctgctgctgccttctggctagtttgaggcctcctgggccaggtcccaaccctctctcctgccccacacctgcacaggcagccctgtgccagccagagcagcctgaaggacatcaactgggacagctcacagtggcagcccctaatccaggaccggtgctttctgtcatggctggtcaagattccctctgagcaggagcagctgcgagcacggcagatcacggcacagcagatcaacaagctggaagagctctggaaggtgagccactcatagacaaaagaaaagtaacgtggcaagcctcacactgggcaggagatattgggggtgggggtggggacatgacctagggctctgcaggggacatagtggatggtctgagtaattgggttaggctgttatgagattcctactccaaggagcacctgtccttatccctaatgacaagtcagggttccagattaggttggagttctgttctggctagctttagactctgaccttgttttccaaatgtgactaggggtgtcagttgagcaccctctaaccaggaatcccaagtagtattggatagaaaccttctaagcttgtccagcttagtctctttgcacttgggtggtcaagttccagttacctcagtatgcccaggttctctgctctctgtctcagtgaggctcacagagggcagttggtcccagaggaggtatgttgctacaggatatgagagagggacttggctcactgggagaatcatgagactctgacagccgaatctggggc

SEQ ID NO: 33707 - DNA, 1099 bp, Mus musculus
agccctagtcgtcctttccaccaggaatagacgagagagcccagtgagagcgttttctggtttgacacctcatggccccagcctgccggtgcacaacagagctatggagacccagtgattcaggggcctcccttagcctgggttgggcctgagcattctctggttgcacagtacctgccttctggagtcaggtgctcccacaaccttgttagaaacttgcaggctgaagggaaggggccaggattgccttgggcctgtgccactcaggcatctgtgttgccctcacactaaccaaacctgaaagctgcaggccagtactgactgttgatgtttgggcttttccagttactgtggaatccatgatcctgcctgcgtggtttactgtaataccagcaagaagtggttctgcaatggccgaggaaatacttctggcaggtagctgacagccatgcatgtgtgtttaatcagcaacactagggctgctgtgagttacggtgttgttggagcaaagctggaatgagatggtgctggtgaacctgggctccccctttgactggtgtaacttgaaacagatggtggcgtgtgaacgcttcgacatgtttatccttgattgattctctgcctcgctcattatgtgaggagtttggcttaattctgttctcaggctgtgcctgcctctcatgaaatgaggctggcatggcctgcctgtccttgttcctgggaggttgagggcatccagctgagccagttgacttgattgtctctggaaccaatggttcaagatcctaagtcattaggaacaactagactcatccctatatcatgctggctctccatgcaagtgtcagtaaacactgttggagagaaacaactgagccaggtgtgcctgtttcccactgccaccaggggtgtggcttgtttctgaggacattctgtaaaaagaatgccacagaaggttgtaggtaccaggtctacagtgaggcagggattatcatctttaaaagatcttaaagtcactttcagggaccaagacatcccattctcagaaggaggagtaagacctacaaagctaagaatggctggatggtcactacagtgg

SEQ ID NO: 33708 - DNA, 1140 bp, Mus musculus
tggagacctgccctcgatcaaaatgctaaggctctgagagcagtactgtgggaaaaagtgagcaaaccaaaagagactctccttgcctctgtgagccctcctcactcctgggaacagctgttgtaaagtgagataatagttacgaacttttacagagtccagcagccactgtggctctcctttggtgcagttcctgggcagcacctgctccagtggtcacaggtgagaccagtggcagccctgaggccctcactttgctcatggctgggactggctccacctctgcaccctcaggtgtttctctgccccacatgacctcttggcagcctatggcctggcttctattctcagccccacagcaccttcttttccctcttgtatggtggactggtggaggaagacctgaccagtgctcatggtgcccactctgagaagctgaggaaggtggcactcaggtcatcctggaagcctttgggggcactagcctctgagttgggtgagagcatggcttggatgtgcctggggctgcgggcactgtgatctgccctggacagaagggccttaggcaaggctgagaggagaactgacagagggtggcactgtgtgactagggtgaagcagtgatgtgagaagacctctggccatgtgtaagctgcctgtgaaaggagccctctctttagtggctgctgagccccacctgcccttctgggctagtgagagaagaggcccctagagccacaggtgccagattggtggcccacagcttcaacagtttggtggtcaccgaggtgggatgttctcatggtttgggacagtcggtctgttccatctctgcacagccttgtcctggtgggaagcaagcctgcagcactgctgctacctcaggatgcaagggtgccaccctgtgagggtgtggttccccagtctgtgtgtccctgcccatggagttagctgtgcactcaggtcatctgtacttgccactctctgctacctgtgtggtcccatcctgtgtgcctgtcggacaaggggtgagctcataccacacagagcaaaggtcaaaggccacaggatggagaaaggagggcttcttgctgaactgtcatctctttgtaagtcaaaatggctacaactcagcttgag

SEQ ID NO: 33709 - DNA, 2714 bp, Mus musculus
gggtcctggtggctgggcgtgtctgtagaaccgcagaacatatcctgggaacagcctttactttcactggagcctcctgagaaccctctctctctgaggatctttaaggcgtctgccaggccttagcagtggctaagtgggggctgtggaccggggtcacctttggcctggaagttctgatccccaccaccctaggtcatagcttgacatgccctctgcctctgctccgtaggcccgggccgcggcttcactgtttctctgtgccgttgcccactgcccatgctgggggtttggggagcacacaagctgtgtgtgtctctccccaagcacctaggcagccgcctgcatgagaaagctgccaccctttcattgctattccccttcccctgggtctgaagacacagcattgctttgtccaagtcacctgtccaggtctcaggcctttctgtcaccacggtgcggacttgaagggaatagtgggaactttatcatcaccatcaccatcatcatcaaacgtatgtggtggcacgcgtctgtcaccccagcactggcgagctggaaagcacacagaagtggggtgggactctcttccagctgtagaagtctgagcaaacggcctcaacagggccgagaggctgacagggtacctggagtccagttactcactggctgtctgagttctcagtgagccagggcaggacagatacagcccatggccctcctaagctggtggcctggctttcagtgccctgaagccaagagtgcatgtagctgtattaatgtgaccagttcattgccaagtcctatgatgaggtgacacgtccctgcctcagcgccccaggcagctgtgagcatctcatgagctctctggcccagccaggagccagcactcgggtgcatgcatgttcccaaaggggtcaccctcccctcccctgggcctagctgctgtcagggggactcctgggaggtgtctttgttttctagatataggtcacctgtccgataatacccctgtattgccaagacatcccaagatgatagctcaaggccgtgggggcctcagctggtgacatgcagatactgtgacccattgaactgtgctgggagcagccaccttgcaatgtgtacatagaccctctgcccacattcatgctctctcaggacaggcttagacacctggcccttgagaggtcagatgcgtgagccaggcctggttttttcccctccaccttacccatgtgtcaccagcttcagccaagcccctcctcagccatgtggctgtccagcccacttccctgactcagaaacaggactggggcatcttgataactctatgcccagctgcctcagttaaccttggcaatctacccaaagccccacagaacaacaatgcagctggacccagcccctttctatatcctaagaaatggcttgtccccttgacccaaggccctgtcatatccccttcctgcaacactatccagtgtggctctgggaagtccactggtacttagcctagccttcaactctttggaagactcttacacaggggggccccctagtgaaacccatgtgctactgcacagcacccaaggatggctgacagctatcacactgggcttgatgtcaagagtcctggcactccggtcaggacaagaacgggcaaaaggcatggggacagcaaacctgcaccagtgtcagctgccgttcttctcacagtgggcctggggttttttattttgcagagatttagcacaggttgagagggctgctggtatcagggtcttgatgcagctgtgtgcacaggcatggggttgtagagttgtgccctaggtctggctgctgtccctcagagctgtccaggtgaggacaccgtggcgcagtctaccccatgtggtctgcctctggtgtggtggtacctggtcctttttataccccttccaccttggctcccagggggcctcttccttcagggatctggtgggtgatttggcgaccctgatcatttctgtctcaggcatggccctcagtgtggcacaaatgcctgccacccattggtcatagccacatctccctgtcagggcagaagatggagggacttgtatcctctcgagcctgggtgctggggtactcccaaggccatggggtgccctgaacctcagttttcctctttctcaaccctgctgggctcaggggcccaacctcctggtcagggtagggatagcagcagaacccccacaatgggaccagcagtcccttctgcactcagcctttccttggggctagggatccatcacatggggtaaggcctagcctaatccaacccagcacttctggtcacagggggacatgaggacagggctgtggccataactccagaggccaggctcctgtttctcaggccccatctcaccccttagttggaaaaaggacgccatgggctggggtgcccctttgatatatgcaaatggctggttccacattcccctccccgtgcccaggctggctctgcccccggcatgcgcactccgctgcggatgtctgtggatcgtgcgcatgggcaccgcagttgggggtcaggttgctcagggcacgcacggccgcccgccccaccttctggcgcagacgcttctttgtatttttgcgccctttgtaatgaaatgtaataaaaacccaatgttttcgtctgggcctcttcctctttttccaatctc

SEQ ID NO: 33710 - DNA, 1500 bp, Mus musculus
aaagcttgtaccgccctacctggcccgagcatgcaggctggactgcatgtctcctgccccttctgggatagcactgctggcttttgcaccccagccccatggctcagcaggagctggggctgccagagatacctatggagtagagtttaagtgtatccccagagcagagatctccaagggtagagctaggggaacctgaagctgcagccggtaacctgtaagatcgctgtctcctttctgaacctctgttcctgacccattctcttccccagaccccatttcagtcctcaggcctggacacgagtcggaccacacgacatcatgggcttgtggacagagtatatcgtgagcgtggcagacttggctccccgcaccgtcgacccctgtcagtagacaagcatgggcgacagatatcctttttgcagaggatgtgtgtgggattgggagggaacaggggacaggcacacactgctgcctgtggcacacactgttccctgtggaccagggaaacctggggaaaggcctccaacacaggatgttggagcccagtgtggggcagagagaagggttaaggagagtgagcccaaacacagagggctggggccacaaggagagattcccagtgtagctttcaaggctgggagaagtggggcgtggctcagttgaggcagcatggacatgacagtgatgccacacagcctctgtagtttgaagggtggacacctgccaggatcccatcactagagtggctttgggtcactctcttcccaccctcaactgcagagtagagctgtccgcctgctcctgcctctcactcctgagactttggtgctgggagcgcctcggtggaaggggtcagtttaaccttgcctccctaaggcatctgggacccagcttgaggcccaggcctcctcggaatggcttgggagcatggtgctgagttacaggtgaatggatctggccccctgggggacccccacccgcagttgcactttttttttttttaggcaggaaatgccctttgccctcctggctagctgtctgcaggcccagccttgcgctgggagcaggggccactcccagtagctcccagcagcctggccccacaggctgtgcatcaggcttcctgggtcagagcacactctgaggttcccttaactcattcacgctgacagctgcccctatggcaccgtgtacctctcgcctcctgcggacaccagctggaggaggtcagtggaggggcacctggcctctgggaggaaacaatgtagattttatcttatcaactgtgtgtggagatgcaggacatagtcactggaaagtgaccaagtgattgagatgcttccaaaagatcccagaagtcaactctaaattgtggggaccatgtcttcagagccttcagaaccttgtttttcctctcttcctcctccttttctttctcctcctctttctcctcctcctccttctctttcttctcttcttcctcctcctctttctcct

SEQ ID NO: 33711 - DNA, 1122 bp, Mus musculus
ctttacctgctgagccatctctcagtgtctctcactaaatgtggaagtcatgcttcagctagcctgcgtgccagtgagccccaggaatcctccagtctgtaacttcttgaacttgggattagagtcatgtgcactgcacagcaagcactgtgctgcctgaactatctcaccgctcacagatccagttttctgtcctgtagtcatagttgtacctggctctgtagctctacctggcatgtgttccatgccagtttccccagtgtcacctccctctttcctttctcctgcccttcactctagcaggctgcagcctgccttggggccttagcacttgcagtgtgctctgtgtggcttcccaggccccagcactcaggctgcacacacttgtaggcttaaatatttcaaaaccttttttttttttttttgagacagggtttctctgtgcagtcctgactgtcctggaactcactctgtagaccaggctggcctcgaactcagaaatccgcctgcctctgcctcccaagtgttgggattacaggcatgtgccaccactgcccgacctcaaaacctatttttaataagcgttctgacatgctttaaccttccttctagtccatcaccctccagagatagtgaaaagaaggtttttaggatacggggaaagtgaacctgtttagaaacagttctttgggtcgagttcagtctctaattgtcaggatatcaggtgtctagttcagttgtgtcaggagagcaaacatgaatcagcagtggtggcatgacccagcagaaaccccaggcctcaatgaatcagcacaagtcagcaggagccaccaggaccaggaaggacaccaggagaagttctcggctgtgcctctctcaataaagtgaagatcatcaaagacgaagacttgagaccaatgaagtgttgaaaagccagctatgcaagcccccttcccccattactgtccattgggtcctgtttatactccctccaagcatcatgtgtcctcccactggtcttgcctcattaaaacgccatgtgagtctgtcttagcaaaactctgacagatccagaaatttccatttcactatgccaattggcccaagtctggagaagcggcc

SEQ ID NO: 33712 - DNA, 1201 bp, Mus musculus
aagatctacatcgtgggtggctacaactggaggctgaacaatgtcacaggcatcgttcaggtgtacaacactgagacggatgagtgggagagagacctgcacttccccgagtcctttgcaggcattgcctgtgctgctgtcctgctgccccgctcaggccatgggaggtagcttgggatcctggctgtgttccccacaagtgtcagacccccagcccaggggtccctacctcccagccccaagtcaacagagagagagatctggtccccaaggtttaggtgccatggcagccattgcccagtgggtgtctctgcactgtcctgtgtggttaggtcttggtatctctcatccctagccagacagatgaaagcttgtggacagaaaacaccaagtccagggaggagcaactctccttgtctcctgactaaactcttctgtttaaaatcctagcctggatttctgccgtgggatccacaaggcagagagactcttcagattaccctctgaactccacgtgggcatcatggaacacacatgcacgcacacaatcaaatgagtaagattgtaaatcagctctctggtgcctggacagcattcaggatgcaggagtcagagtgtgtcccagaggccccctgacaggtgacagatgcagccaagtcttcatcaccaacctccctggcccgcttgacttgtggattctggagcatcccaaaggcccctgtcccgttaacccagcattctttgcctgtgccacccccttttataagaagacagagctaataagtgaggcatggtgtggccttttccaataccctggaggctaaagagggaggagaatcattgcaagttctaggccagccaggaccacagccctgaaatgaggaaacccacaaaaaacaaaagcagagaaaccacaaaagccacctcaggtgaggaggcctgtgtcagctggcccgggaggagagccagctgggggcccatctaacatgttggctatagaaagccatgctcccaggtctggcccaccctcgggtggggtggtgggaggtgctatggccgtgagccccagcagcctcattcgatggcagccctgctttgttttgctgtttaaatcctgaactctcatcttcatattttgtttaatttttttcttgtttaaggaagccagccccactgtcttccaaatgagtatgttctctgg

SEQ ID NO: 33713 - DNA, 1308 bp, Mus musculus
ctcaccctagacctgtgatgactttccttacatctgtccaggtctcagtttcctcctctgtaaagtgggctgagtcatgccccaagggtgagagttttttaggtgccacccataaggaaggctggaatcttgaccaacatgggggtttcttccccagacatcccagagggttcattcctagaggatgaagatgaagaccctatcccacccagtatcaccacaaccatcgccacctcggagcagagcacgggctcctgtgacaccagccctgacacggtctcgccatccctaagtcctggctttgaggacctatcacacattcaacctggctctcctgccatcaacggccacagacagacagatgatgaggaagagacacatgaagaatagcctccctcccaccatcccagaaaggctcagggcagccgtgatcctcctagggtcacagtcggtcagcttggctgctccattctttcataggcaggattcctaattcctgccactccccctaagagcaggacttccctatgccagcacatgtgccccaggtggggctgagtacaggtaaccttgagctcagcttgggccagctttgaacagtgcttctgaggtccccagagaccaaagccagatcgtctgtcccccacaccttaggtgggcacaggagggccgagcttgtttctacccactggcagctgctgactcaactctgggctccctgccatctgtggagtacttttttcctgttgtgttgaatactggagaaatagaaggttcaagatagaggcagacctgactgtttcttgagggtccatcaggcatctccaggagctggccagttatcttagaaaacaactgaatggaatatttttgtacctgatgtttccagatgttgggaagttatcaataaagactgttgttaaaagggaacacttatagcaacagtggcttgcttctgtttttgggcctcacaccccagaacatgggcaggtcccggatggctccagggggccctgctggaggaggctggccaaactccagaccctgtgaactactaagacagagttgtgccagatgagagtcctgaggcatccaagttggggtcagagggcaaaacctgccttgatggactaccttctctgtgaaagtcttgttccctgctgaggccactccttggcctagggtttctggttcctgctatctagacactggagctagattgcagataccagctaccattctaggcagcttttacttttgtcatggggatttgaacttggttcttcaggcttgcacagcaggagcttt

SEQ ID NO: 33714 - DNA, 1399 bp, Mus musculus
gggacctacgagaagaagggagcagtaatgatgacaggcaagtcagctgcctcctgcacgtgctcacccactcctacccacctcccacagacgatccacgcagagctctcaaagctggtaaagaagcgtgctgcacagcggagcacagagaccgccctgtaccgaaagatgctaggcaaccccagccggctgcctgccaagtgtccgggaaagggggcctgggtgagcctgggtggggttgggtagggctggaggtggtgttggggacattagcccaggaagaagatgggactctggacctgcaggactcgtggtgcgggttggaggctcaggcagaggaagaaaatccattggaggagtgggtattgtttaggtgtgggtgtgtgtggtataaaccctggctaggaggcctgtgtaggtcacagtggctgctctggccatgcagccagctctcacccttccctttattcacagtccatcccgtggaaatggctgtttggggcgactgccgtggccctggggggcgtggctctctctgtggtcattgctgccaggaactgactgtccccctgctcacctggaccccaacctgtgctccctaactcccccaggctccctgtccattgccctccctggctgagatgcctcctatgggtttggggagcaaggattgagggtcaaataacccaagaagcaggaaggactgagaccctgaggggggacatggggtgcagcccagagggagggaccctgttcttctagacccagttgtttctatcccacaaccctgtcctctggggtcaggcctcggctgtgacagcctcagttttccctctcagtaggcctggggcagcactaccattccttcctgcccgtctgcaccctctgtccaggcttccccacagtgaattaaataaagcctcaccccacaccctactgctttctaggcctctttctgatgaaactgagaagctctgagtcacagctgagccaggtcccccacaaaagctgctttaaggagctgttgatggcctggcccaggccacatacagctgtacttgagaggactttgagagccctgtcagcgcttttcatttcctacttgaggttgggccatgttggggtcctgtgaactctggggtcattttgggtgttatgatttcaaaagagtcactggcctggcgtacatgaggccttgagttctacaagaaagaggtggaggaccatgcaggcatgatcatggcgagaaggtcagtgtgtatgtttgtgttactttgagttgtgcagggtccctgtatctgcagattaagaaggcagtgctgcagttcacaacagcagtgactgcagggtctgtcatgttacatctgaaacactagggctgacggctgaggggctgacc

SEQ ID NO: 33715 - DNA, 1833 bp, Mus musculus
catcattaattcttggcattttcccccagacaacccgtgggcaaattcttcaggaatacaggaaaatcaaaaaggtaggtgaggcagggcgggtgctgagaggaagactgcttggctcgggtgggtgtgtctcacctgccccctttgtccctcatagaccaacaccaactacagctgtgagaagcgacgctgcgaatacctgcaccgcaagctggcgcacattaagaggctcatcgcagagtatgaccagcggcagcttcaggcctggccctagcacagacaggcagacctgacggctccgcctgcctttcctagttttatatgaactcggccctttagctgccgcagagacatctatttttgtaccttttctactccgtgcctcctccaaggcccacgcctccaagtgttagaagccccagggagagtgagcagcgagtgccaggccctgctgccttcagatccccagcggacaaggttgctgcagtttgctggctgtgcccaaagctcttagcagcggcctccgcagcatgtgctcctcagtccccaacacactgcccttcatgtcacactgtggctgtgtggttctgtctgtccctccatccatttgtgggtcctgggatcacctccctgctgggtcccacttggggggtgctgagggtggcaccttgcttgccttctccagggcgcaggcctgaggcccccaattgctgctttctcactgtgcctcgtctcataccccaaatccaaatccaaggggccatcagtgtgcatgtgtctgtgtgcgtgtacatgtagtatgagtgggtctccacacattcagagggaagccattggggaggtggtgggggccactgctgtagggcagggaaagaatgtcaaagacagatgtctatttttttaaatggtgaagatgtctttgggtggcttccaaagagcctggctgcctggaggcacctgcctggcacagtcccccacccccagtcagctcttagctttcttttgggattcctagagtccccagaccctagaggaaccaagctttcaatagatgttggtttcttctccggggcaggaccaggctctgcatggtgcacttctctcacagctacactgcgcaggctcagggtagatcccaggttacccctctcctgccctgagaactccatccagggctattgattgaactgatggtatgtttgagttgtttcattgtctgagattttgttgtctgtctgagatttgggaaaggcagggccacactctggggctgcaggtggtggctggcagcttaagcatggtctaacttattggtgttctccccgcctttgaactgtgctgtggagaaagtctactttgagccatggagttggtgtttacaaagtcttcacttttgccaaaacgttacaattgacagagaggcggtgcctccaggtcctttcttagagtttgtcttctgtacacaaagcaggtgaaccgccaactttcaaagtctataataaatttgatggaatttaacctctctgtggtttgagtatgtcactgtaggggtggggtagccctaagtgagagcttgacccagagccccgagggctttggcaaggtgtgagcactgcagtgctgggcatgggcatgggcagagtgggctcccctgcagcacccaggccttcaggtgagaaggtgctgccctctactagaataggtgggacagaaagtttgcttgagactgacacccttttaaaaacaatagaccccagcgagaattacctgtctcttagagctgtcagtccagctagcatctgaggccatggaggccgagcatggccaccatca

SEQ ID NO: 33716 - DNA, 1098 bp, Mus musculus
gatcctcgtggatagcccggacgtggtctacagccccgaaaccatcgaggcgcgctacgagtaccggacaacgcgcgtcagccgcgagggcggcgtgctgcgggtgcgcgcggggcgcgggcggcggaggacactgggaacccgaggtcccgcgactcactcccaactcttccttaggtgcagcccagggctacgcgtttcaccttccgcaccgcccggcaggtgccccgactcggggtcatgttggtcggctggggcgggaacaacggctccacgctcactgctgctgttctggccaatcggctgcgcctaacctggcccacgcgcacaggtcgcaaggtgggggccgtggctactaggagaatacggggtgggggtgtggcgagcagaactgggggaggggcgtggcttgttggactagcgcgtctcagcaagccggacccctcagcccctcaacaccctgctctgcttgccgcaccccctcccttcccaggaggcaaactattatggatcgttgacccaggcgggcaccgtgaacttgggtctggatgagaacggccgggaggtgtttgtgcccttcagtgcgctgctacccatggtggcccccaacgacctggtgtttgatggtgggcaaagcctcgggacgggatggggttaagtgtgggagggcccagggtacgggatgggtcctgtgttaagggtccccgcaacccaggctgggatatctcgtcgctgaacctggccgaggccatgcggcgcgcgcaggtcctggactgcggtctgcaggaacagctgtggccccacatggagagcctgcgtccgcggccctcagtctacattcctgagttcatcgctgccaaccagacagcacgtgcggacaacctcatccctggcacacgtgcccaacaggtggggtcctcgacccactcccaggccttactgtcacctgttacatggccacatggtctctccctttggcaataattcctataccccggggcccaagcctccggacaacttaagacaacctccacctaatcttcctccttcctttcccagttggagcaaatccgaaaggacattagagatttccgatcc

SEQ ID NO: 33717 - DNA, 1193 bp, Mus musculus
ctgggctcaaggtacctccaggcttcatgcggtgctgggaggaagccggggtgagggtactgcagagcattcaccgtctctttgaccacacagaccatgtccatcgtgagctataaccacctgggcaacaacgacgggcagaacctgtctgcaccgctgcagttccgctccaaggaggtgacaaagagcagtgtggtggacgacatggttcacagcaaccatgtgctctacgcgcctggagagcggccagaccactgtgtgcgtgcaaccggttgcaggcgggcactgagggcaggggcttggtgctgtttggggctatgtgactttttaaatctctgcaggtggtgatcaaatatgtgccctatgttggcgacagcaagcgtgccttggacgagtacacctccgagctgatgctgggtgggacaaacaccttggtgctccataatacctgcgaggtgtggtgggcgcagccgggcggggtgggcagggtgggcgatgatccttcagacccgtcacaccctgcaccaaacaaaatctaggattcgctcctggccgcgcccatcatgctggacctagtgctgctcacagagctgtgtcagcgcgtgagcttctgcacagactcggaccccgagcctcagggcttccacacagtgctgtccctgcttagcttcctgtttaaggccccgcttgtgcccccgggcagccctgtagtgaatgccctcttccgccagcgcagctgtatcgagaatattttcaggtgcgcccctggtggcaggggagggctcagggctggcaaagacagccttaagatggtcttgctgagcctgcactgtcccctgcagggcttgcgtggggctcccgccccagaaccacatgctattagagcacaagatggagcgtccaggcccaggcatcaagccaggagaggtggtggccaccagcccactgccttgcaagaaagagcccacacctgccaccaatggctgcaccggcgatgccaatgggcacccgcaggcaccaacaccaaagctgtccactgcttaaatcaagtgaccggaccggacccttctacccccaatgcctccaaccatagtacttcagcccttgccaaagacaataaagcaagtctcaagcaagcctccttgtgtgctttttccaggaaggggtctcaggttgacctggaatatgctatg

SEQ ID NO: 33718 - DNA, 1245 bp, Mus musculus
ccacaggctcgggcgatatggacgggctgccgaaggtgaggtcctgcacacttgatgggtgggagggcagatggccaggggaggggtggggacccacgcgctgatcagcgccacccctagaattcccccggcgccgtgggcggcctgagcaacgccccggggaccccgcgcgacgatggcgagatggcggctgccgggaccttcctgcacccgttcccgagcgaaagcgtaagcgcctgcgtcgactccccacccgcggccgcagcgggccggaggggcctggcgggcagaccccggcggggcggccgcggggccagagcaagaccgtgaccgcggcgggccaggtgggggggcggccgcggcaccttccccctccttcccatcctccccgggttccccttgtccccgggagggtgggccccagcctcggccagagctgagccgcgctccgcgcgccgccctctctccgcagtactcccccggcatgaccatgagcgtgtgatagtcccggcctgagcccagggtcctgctggtgaggtctcggtcgcggcagcacccctgccatccggactcctggctagcccggccggccggcagggcccccacgaaggacttttatcattttctaaacacacatatacacacacaaactcaaaaggacctcagagaagtgcaggcctctggacctctgtgcacacaaggctggggggtgggggcaggggttctgccaataaatgccattccgttttgactttggtactgctgatgtcttttacttgacatggcctaaaaatcttgctatggcctaaatctgtactttgatgggctgggagcccaccttcccccataggctgaggcaaggcgtgagtttgaggccagcctagcctggtctacatagcatattccaggtcaacctgagaccccttcctggaaaaagcacacaaggaggcttgcttgagacttgctttattgtctttggcaagggctgaagtactatggttggaggcattgggggtagaagggtccggtccggtcacttgatttaagcagtggacagctttggtgttggtgcctgcgggtgcccattggcatcgccggtgcagccattggtggcaggtgtgggctctttcttgcaaggcagtgggctggtggccaccacctctcctggcttgatgcctgggcctggacgctccatcttgtgctctaatagcatgtggttctggggcgggagccccacgcaagccc

SEQ ID NO: 33719 - DNA, 1130 bp, Mus musculus
tgcttaccctggggagtgtgggtggggcttcaagaggtaggcagatgtgtgggcagagcctgacctgggcctggctggcccttaccattaatggcaaagtagaaagctagcccagcggagcaagagaagtaacatggcataaacctgaagccagggacttgtgcagggacagcagtggtagaatctgaggtctcagccagtctgagaaagtgtctgatttatgatatcaacttaggtgtggagatgtagctttcagaccaacaccagcatgctgtgccctgggccactccagtgtttcctgaggccacgtggagggccaaactgcaagaattggaggcaggatcaccatagtgggcaccaatcttctgaattcatttttttgggagatggtggggggtggtacaggatcttgtgtagcctgggctggcttcacactatgtggctgagggtgaccttgaattccttgcctccaggtcccagggatggcagggttaagcctccgcctgagcctgctttgggggcagatctttgaagttaaattgatggcttcagctaaaatgggaactctctcctgtacttctcaagctggcgtgtaaaccttcaggaaagcggggaccccgaggctgggggaagttggaaaagcagactctaggtgcttttgagtgaggactttggctggaagtcagaccagctgctgtgtgcacaggatgcttgtgcctgcgcccccaaggtgaccttgctgtatgctaggagagcgcctccagcctgcccttctccctcccactgtctagacagctcacccttgacctctctaccccttggagtgtctgagcccagagtcccctctgggaacatagagacaaagccttactctcagagcctggactctgagagttggggctgtgggggtccctgtggggtccctatgcatgccgatggcttctcaaatgtgtacccaggcaggtggcctccctccccagcccaccatttctctacatccacaggctggagagagcaaacagatagaggggctttggtgttctgtgtctggtgaaatgcctcccgccccccccccccaaagtacagtgtctggactagaaaacagggcacatagctcttttttttttttt

SEQ ID NO: 33720 - DNA, 2586 bp, Mus musculus
gccccagagctttgaaggacttttcagaagcctggtggctttggcctgggacatagtgactgtgacttttcctcccatctgtctcaggtatctgtgtgacttcacgtattatacatcgctctaccagggccgcggccgctccgcttttgtccacgtgcccccactgggtaagccctacaacgccgaccagctaggccgggcgctacgagctatcatcgaggagatgctgggtgtcctggagcaagccgagggagacatcagctgttgccgccagctctgacagccatgtacacctgggtgcggtgccgagagaggggccatcctgactcatctgcccctcctaatggaccacaagggggcaattgagagagctcccatctgaatatcatctggggacacttctgcgcccagaggccagggctagtggtctgcacacatgccatggggccaccttgaccctgacgcagtctgcattttcaggtgtatggacaaggagttgaagcttgccctgtggctggggcctcacaaagtatcataaagtagattagctctaatccatgtcttaaaccctagatggtccccgccaaagccacttgggacctggttgccttttctatcttctgtctgtttctgtctgtgtctgtctctctctgcctctgtctgtccccatccttctttgttgtacccaccttccttcagtgctagaacagaacagcgtaacttatgttcccattgttaagacttcaggcctaaccaacaagtgtctttcctttctcctggggagggcggcctcttttgcctcctgccctgaaaatgccatcatactttgggtctccatagtgggttccctttgctcagaagagcaggctgctatggccaccaagggcctggccgcagtagcctctggtgcctgtggggagccgaccctgccatgatctttcttgttctctttttgatattttaagactcttaaaattttagatactctaaactttagagggtatttgttgtttgtttgttttttctttggagacagggtctcaggtagcctaggctggcctcgtgtgaactcctgatcctctggcctcagtttcctaagcactaaggggacaggtgtttgccaccacacatggcccacctgggacccagaacctaccgtgtgaaccatcacctggagctgtggattttctccatcttgagatagccagcctctaatatcctgtgagggacctggggtgagaggctgcggtgcccaggcatgtccctgcatgtcctatcagccacagggatatctgctgaactgcatttggaagtgtgccagggactccagccagcctttgtctctggctgactttgaactgccaagccaggaggaggggctctcaggaagggtgggatgtagcatgtgacctggactccttccaagaccaagtacagttcctgccagtgaagccaagtacattgtggatgccaccttctcttttgtggatggatagagacctcggtgtccccacgggattgatggatctgaattctgaagtgacttctcatccctggatcttcttgttgtttgtgagactgggtctcctatagcccaggctagcctccaattcactgtagctgaagctgaccttaaatcctgaccctcctacctcggcctactcagtgcagggcttgtgaaagcctgtgtgctgggcctggctacttttaagctctagtgttccttgttctgatgtggtttcttcatgtcatcatcttgttgatcctgggtctgaagcttatttgtcgccacatggagatctgagtggttggctctctttctgaatctcagggttgagggcaccctggagtgccccagggtgatttgctgtccctacaaaggcatctatgggtgtgggcctgcagtttgaataacgagggctccccctcttaccctccccccagtcctgtgctaacaccttctccagagagagaggccctgcagtttcccagatagccatgggcaggaagatgggggctcaggagtaagggattccccagggctctgggcttttgagacatcatgtagacaaggcaggccttgaactcctggtcctgtggcctcagcctccccctgagatgaccaaggtggatctgactttggttcccgtatgtctttgtttttgtgttctgaggcagagttctacctgacctctgtagctcaggctggccctccaacgtgtggcagtcctgcttcagatgtatcagtgcctggcaagtcttccttaggaagaccatgggctgtgctccactctcaattttcccaaagtccctggcatgggaacaccatgctcagggaccccaggagggtgcacatgtcatgttctagtccccactgttgagctgagggggattccaggacatggggctggtagttatttatttaggtatctcttaaacacacaccccttgccctgatccaaaactacttgtttttttttttttttttttttttttgtcgttttttggcaggtagggctcagggtctgtagttgccaggtgtcacctagactggtcacattgacccttgaggtccaggtcacccca

SEQ ID NO: 33721 - DNA, 1291 bp, Mus musculus
accatcaagtacctgcgcatccctgatgagatcattgacatggtgcgggaggaggccgccaagggccgagggcgaggaggaccgcagcagcagaagcagcagaaaggccgaggcatgggcggcgctggccgaggtggggtccctgtgaggatgaggtgggggagggacacctgggcactcgcctctctgcaccctcttcaatcacatgtagggcatggtggtgtgggctcctgtaggctgagtacaacctggaatctcccacaggacccttgcgcagtggaccagggcacagaggggaagacccttgtccctgtctagggacgctggtgtctaactctgccttttctgttctgtgcaggtgtgtttggtggccggggccggggtggcatcccaggtgcaggccgaggccagcccgagaagaagccagggcggcaggcaggcaaacagtgatcactccctgcctgagccgagcccagaacggtgggtgaggcctcagggcacctttgtgtgaagccccacttggcgtctggtccagtgaagtccctcgctggccactgactcagtttctggaaggttccgagtctgaggtgcctgtggagccttagatgccctttgaagggctgacttcttccaggcatgtttgagtttcagttggagctgcaggctcagcccatggcggctcacctgtcctttaccagccataccctgtacatcttctgtttgaaaaataaaagcaaacaccatagaaagagccagctgttcttctgcctaagccctgagcatgttgtcctcagggcacctgggtcttatcagagggagcagttccctgggcatggggcttgtctgtgtgtcctgccagtggaggtgagagtagagcagatcctgcatttagaaggctaagaggtagagtcaggagttttaggccaactggagctacaaagcacttaaaaagccaggcctgtaatgattggactgtgggagactagggtaggaggctgtcaggctgcttctgcaggcagaacagttctgatcccatacaactccagagtgcaccacagggaaagtgacccagggagagcacagcacgggacatgtacgtgtgtctgtctgtgcccatgtgtctgtgtatttgtccacgtgtgtatttaccacatgcatacctggtgcatattggaaatgagatgacagccattggagtgcttggaatggagctcatccttgagtactctccaggtcccctgtgtctgtttcctgtccctaggggtcagtctgtgccacagtcctgcctgct

SEQ ID NO: 33722 - DNA, 1163 bp, Mus musculus
gaagctcaaaacccagcagtgagtggtcctttgggaaccagtctggttctggctgccgacatcaacatgggatgtcttgacagaagctatttcacctcttcacagtctgtgacgtgtaccgagatggtgccgtggctaccaggacgacattagcattagatatgatggagtctgtgtcgtgctgtcagggcagcgcacacaccacacagcacagctctagacagaactgtttccagggcacgggtgcacagcccatgcagtttaatggaagaatggcccacacagcaaggagggattcctcccacacactgagtcatagcttgagccctgactcggtttacccattagtggtccagtctgcagtcttccagaagcagcaagtaccatgcaaagactgtgaatgagacaggttgtgaggagtcatctcctgtcaggtaggacagggtatgtgtgtgcctggctggcctgaatttccttaagtgcttcctctgtagtcctgactcaatggccactatctcatggacccttctcttccttttgtgcccactctcagccagtgagaaggctctgaccatgacctgggctggctcaccagctcccagtcactctgaacacttgagtgcagaaacctgaacccatctcagctggctgatctgtgaatctgtgaccctgaccttttaaaatttacattattttaatatgtgtgtgtgtgtgtgagagagagagagagagacttgcctgcgtgttgtgtgtacacatgcaccatgtgtgtgcctggtgcccatggaggggagaagagggcatcagatcccctggaactaaatcacaagtgtgaactttccgtggaagtgaatgtctgtggaaaaagtagcctgtgctcaaaaccactaaggagcctttaatcccagcacttgggaggcagaggcagaaggacctctgaattagcggccagcctggtctacagagtgagttccaggacagccagggctacacagagaaaccctgtcttgaaaaaacaagcaagcaaacaaacaatcaaaatgctgagctgtctctccaacacccccccccatgttggacagatatatggatgggtgtgggagtgtgcagggaccctgcttgctgttggacagtatatggatgggtgtgggagtgtgcaggga

SEQ ID NO: 33723 - DNA, 1115 bp, Mus musculus
cctccccccaaacccccgcccgagccttgaccagttgttgcctcagagagccacacacccaggttttatccccttttgtaggcaagtgaccatccagaaagatagagtggactctcccctcaccacacacgtggggtttgcgcttcgcgagccatatcccagccagcaccccctcccccgccccccgccaaacgactgagccagctagtgctggcccaacgccagccagcccccggcgccaggcctgcctctccccggggccgtacggagcttggcggagcgcgcgaggctccgccctgaccttgggacttggccttggcgggtgggggatgggcgggcgtgcgctctggaggcggtggtttgagctgactggggacaggtttacgtaccaaattaagttttacctctgttgagactcactttccctatcaggcaaggagagcattttgtagtggcatggaaaatgtaaagaaatagtaagacctgaacatttttggttgcttttcgagacagggtttctctgtgtagccctggctgtcctggagctcactctgtagaccaggttagtctcgaactcaaagatcctcctgcctctgactcccgaatgctgggattaaaggcgggagcggcctgtcctgactgactttttttttttaattgtatttctgtaggaaaagggcttgttgagaggctggggaaggacctcagctttcagagtctgttctctcccattctgtgggtcctgtgaactcaagtcagctctcaacaagagcaacaagagcctttacccgcagagccatctcgacaccccatcagtcattcttcaattttattatttggagaaacttaacctgctggtcttggggtgcccttagcctctgggaaaaactcctactaaaccttcaaaacaactgcaataaggagtggagggattcaaaaagtctcggggcgctgggttgggctggaggccatgcagtgcggctggtcagtgggtggcagaaacagcgcccactctggattctgttttcgcttctgtcttccctggtcagtgtctggggaagtgacttgtacgggacgcatggcccagcgtggagactgtgcacccttcacattga

SEQ ID NO: 33724 - DNA, 1191 bp, Mus musculus
ccgacgagcagcatgctgaagaaagacgcgctgacgctcagcctggcggagcagggagcggcgggattgaaaccagggtcggccactgcaccttctgcgctgcgccccgacggcgcccccgacgggctgctggcttcgccggatcttgggctgctcaaactcgcgtcgccggagctggagaggctgatcatccagtccaacgggctggtgaccactaccccgaccagtacgcagttcctctacccgaaggtggcagctagcgaggagcaggagttcgccgaaggcttcgtcaaggcgctggaggacctgcacaagcaaagccagctgggtgcggccaccgcggccacctcaggggctcccgcgcctcccgcgcccgccgacctggccgccacccccggggccacggagaccccggtctacgccaacctgagcagtttcgcgggtggcgccgggccccctgggggcgcggccaccgtggctttcgccgcggagccagtgcccttcccgccgcccccgggcgcgctggggccgccgccacctccgcatccaccgcgcctggccgcgctcaaggacgagccgcagaccgtgccggacgtgccgagcttcggcgacagccctccgctgtcgcccatcgacatggacacgcaagaacgcatcaaggcggagcgcaagaggctgcgcaaccgcatcgccgcctccaaatgccgcaagcgcaagctggagcgtatctcgcgcctggaggagaaagtcaagaccctcaaaagccagaacaccgagctggcgtccaccgccagcctgctgcgcgagcaggtggcgcagctcaaacagaaagtcctcagccacgtcaacagcggctgccagctgctgccccagcaccaggtcccggcgtactgagcccgagcgcggggcgcatgcgcggactagctgcggtgggggggcgccccggactctttcgagactcggtgcccccggactcgacaagccggaccccccttaactctggatggggaacccgagcgcacgacccccgccctcgcgccgcctctctacccccagtcctgcgcgtggctgcccctttgtacctccgagtaggggctctaaggggcgcgcagcctcacgctctgcctttccttttttttttgccttttggaagagagaacgggagtgtccgattccgccctatttatgttt

SEQ ID NO: 33725 - DNA, 1127 bp, Mus musculus
ctagaggggcactaccactccgacgtggcgtaccacaacagcatgcatgctgccgatgtggtgcagtccgcacacgtgttgctgggcaccccagccctggaggtaccacacccagccaaggacatgggtgggcagggcagagcagtcaccctccgccctgacgcccaggctctatccaggctgtgttcacggacctagaagtcttggcagctatctttgcatgtgctatacacgacgtagaccacccgggggtctccaaccagtttctcatcaacaccagtaagtgaggtgaacatagccagagttgcccagtatgtcctcaactgtcctatcttgcagactcagacgggtgtccatgacttgaatggctttctcctggaaggggcattagagtttgggctcccctgcatacataggagttggccagtgacatttctcctcaacagtgtttgggtggagttggatcttgagtccctggttgtccccacagactcagagctggcactgatgtacaatgattcatcggtgctggagaaccatcacctcgcggtaggcttcaagctcctgcagggggaaaactgcgacatcttccggaacctcagtaccaagcagagactgagtctgcgcaggatggtcatagacatggtgacgtcacggcacggggcagtgatgccctacgagggttaggcttcccacacaggctgcatggcaacaggcacggggtttccagtggcccgcttgatttatcccagtcagtgggttgtcgggggttgagggtcgcatatttcatctataaattcaatactatattaggtgcctgttgtgtactgacttcacctgtgccctttgggtattcctctgtttgttatctacgttttctaagttcatccccctgccttcacttctgtgctgacaggcgggcatcttcagttgacaactgtgccgcccagtgtttccatcctccctctcacaggtggggatactgaggcacaggtctcagaggcgcagcatccttaatttactgtcctcccaggtgctggccacagatatgtctaagcacatgagccttctggccgacctcaagaccatggtggagacgaagaaagtgaccagccttggcgtcctgc

SEQ ID NO: 33726 - DNA, 1239 bp, Mus musculus
tcagacactagaggagagctgccaggagctgcgggccaaattctgggacttctacaaggtgggcgtgcccacgtgggctctctcaacatggctccaccccccctctttaccttccagacccacacccaaggccttggcccccacccacttttcaagccccgcccctcgtagccgccccccctctcacagtggccctcccacttttccacaggccgactggtgtgtgtggccagctgcccagctagtgaacttcctcttcatcccttctcatttccgagtcacctatatcaatgggctgacactgggctgggacacatacctgtcctatctgaagtactgggtgagctcaactccatggtgtgggagtgtgggagggcgtgggttccggcctattcctgtttgactgtccctctgctgcggacaggtccctgaaccccttcagactccgggctgtgcagactgaaactgaagcctggcagatgagttggccgatggatacactcccacaggagattaccgaagctggtcaaaaagctctgggccatgtccaaaacccaggctgactgcccctggaccagcagtcccttgagtccaccagagactgttcccatgtagaacagacgccagcacaggctgtccgccctccccccaacccctcccggttttccagtgggaccatgaagccctctgtctgcctggacaccctccacagccttgaagtggggtctggtttggcctcagaaaacttgatgcaaggctgggcagggtgcggaaattcattaaattctctttaatgtcaaggactgcgtgtgggtgggttcaggggctgggccagcagactcagcaaggtccattcgctttattgactgtgtgtagtgttcataacttctagggaggagtgggacacatttgacactcacgacgtcagaacaggtttgggggtatcccaaagtagtgaatatatcccctacaccccatttatcccaaagtataaggcagaaggcccaggcaagcaagaagccgtctgtcaaccaggtggtccatatggcgatcccccagcctcggggttggcaggccccgccatcttccatcagcctgctgcagagtgacatctggtcccctcttcacaactgacaactgtggacgggatggtttacaaaaacaaaatgggggtggggggtaaaggagagggagcagcagtgaccacaatacaccacggccgagctgggtggagctatg

SEQ ID NO: 33727 - DNA, 1171 bp, Mus musculus
gagtaccaggacagccagggctacacagagaaaccctgtctctaaaccccccccccaaaaaaaccctcagagggcccgggatgtggctcactgggagactgctcccccaacacgtgcaaagaaacctttagtccccagtgccacaaggctgaacgaactataagggtcttggcatagggctgccctcttcaggggtgaccggggccatacctcaccagacacctctcttcctttcaggcccacgatgtgtgcctcttggggccacgcccattgcccccttcaccacctgtcagagtcagcctgtattatgagtccctgtgtggagcttgtcgctacttcctcgtccgggatttgttcccaacctggctgatggtgatggaaatcatgaacatcaccctggtgccctacgggaatgcacaggtactgggggcggggcaaagaaactgaagcaggagggatgccaagggacaggaacacctggtcacctgagctcaccaggaacacctagtcacctgagctcaccaagatccattgctatcttgcaggagagaaatgtcagcggtacgtgggagttccacgtgccagcacggggagctggagtgtagactgaacatggtggaggtaagctggagtgcggacctgcggtgaagggaggcgggattggccactttctctggacaacacttgcctgcctctccaggcctgtctgctggataagctggaaaaggaggcagcgttcctaaccatcgtctgtatggaggagatggatgatatggagaagaaactgggaccggtgagttgttgggtgggaggttgtgccgccctggctccaatatctaggcaggggatccattcctgagccacgccccaggccctcactaggggggttctaggcagggctcctccccaagtcacacccctagcccttggcgtgactttccctcacgtagtttctatacaggaaaacctttaggtctatgagcaaagcctgggatcttcactatttgtagacacaagacacaggtgacaggagataagccaggccgagcctgcttcccagagcattgtgggaaataacgtccaaaggttcacagctctccaatcactactgtggcttatcaaacaaacgtcaggcctcccagcctcctggagcctgcgggacactcccagc

SEQ ID NO: 33728 - DNA, 1139 bp, Mus musculus
accccaggacatgccaggaaagactgaccacctctggctgcagttccttatgcagctatcatcttcaccaagtcacacctagatggggtgcagctatcagcctgggactcggccgagggtgcccccttcccaggaagggctgggatgggggtgccagtgacttgtaaatagcaagccctcgcgactaatttattactttttataagcaatagccaggctggcccgcctggtggactcggctgtcttgtccttggcccctggagcacagcctacagaccctgttctctgggtcaaggcaaagcactttgggcaacttctgtgttttctagtttgtcctttccgtgtgtgtgtgtgtgtgtgtgtgtgtgtgtgtgtgtgtgtgtgtgtgtgtgtgtgtatgtgtatgtccatcccattcccaacccaagacccacttgaaggcacacaaaagctggtccctactgagttttgacagaatttggaagctgcaccctaaagcaggcggatcaccaattctgtggcaggctatactctgaagactaccttctgtgtctgaatagctctcctcagactgtccttactccactctgcctgtgatcctgcatgcttcagtttaggggaagtatgggaacaaaggacttgggggatgaggaatgctctggtttgaggcagaatagcccatataccttgcaggaagtaactgacagacctaagggccatcaaggtggggaaggtgtccactgcagggtgggacaaagcacttgtcccaagtgaggaccatgcctgaccaccaacccctgcaccacaaagtctatgcccatgtgcacgaggcccagcatggtgagtgccagaggaccgagtgtggaccccagctatgctgtgtaattctagaggagtgtctttcccattctgtgcctctttacaggactaaccccagtgacttgcacacttcatgtgcactgagcacacctgaattccccccagctttgtgtgatccaagaagctgaggttcctaaggccagaggcatgtcccacaatggtccagtaagagtggcagcccaggacaggctctcctagccctactgtgagcatggccatgggggagcccagactcccatgctgtgtgatctagcagccat

SEQ ID NO: 33729 - DNA, 1306 bp, Mus musculus
tgctggtcacacagccggcgagctgctggaacaaaaactgctcagtcccctgctctttaatcctcatgctggcccctactgtccttagccctctgccctcagccatctcctggtccctccctttatcactcggtctgtctctccatctctgtaggcacagagcatcgcatatgaggtggtgtcagagctgcaggcccagcaggaggagttggaggcacgcctagccgccttggagagccgactggatgtcctgggtgcctccctgcaggctctaccaggccttatagcccaagccatatgccctctaccaccaccctggcctgggcctggtcacctggccacagccacccagagcccacaaagccactggctgcccaccatgggatcagactgtgggtgatggctgctgaccgctagactgctccatctcagccatcgtgtggccacagctagctccttgccgttttggacctccggactactgcatttagaagcttgggtgaactgagccgactggactggcactcatccttctgaggctgggccacaggatccaggtccccttagctgtcccaggccccaggagggcaaggagtagtagcaggggcctcaacatttctaagtaaatcaggagcttccagcccgctttctgttgacatgcagggggctgcaaacatctccccagaggaggtagatgaccccacctggggattccttaatggacggggacagacgtggaaagtcactgcacatgcattgagtatctactgtatacagggactgaaacaatggcttttcttcaggatctatctaactggagtaagatacaaacaaatgagaattcagagaggtgaggccacttgcctgtagccacacagcaatggtctgaggcaaacacacttgttaaacagcataagcggatagattctacttggggatcctgatgtcaaagtaaggacacacgggagggtgagaggccagggttacagacgagcagagtcaccacggtcacttcagaccttaggcttcagactttgggtacttggggaacactgagacacctcacaggcatgggcggcttatcaagagcagcctaagtcacagtgtcctctgatcagactttcagccacctgtcttgggagatagtggacctgtgtgggaacccagaggcccagtttggattctataagtttgtggggtggagctctggggtggacctgggcaggctttattcccctgctgctgtgggaaacaggcctaacccaacccccacacgggtcagacagtaggtgctcaataaataccc

SEQ ID NO: 33730 - DNA, 1159 bp, Mus musculus
gtgcttgctctgccccaccttcagtcactttcagcacccctctttttcccttgaatctgaggttttgtagcctggcctcttgggaggcaaacatgggtgactcttttgtttcacaactgtttgctcttttgtgcttttttgtatgggtctttctcctcattctttgtcccgactctgtagtattccctccagaactttccaagttcaaagcaaacaagttgctttgactttgtcaatgtggcttttcccaaaaagaggcttctgggtccttaaagaccttaataccaaccagggttgagacaggctcatcatggtggtctctgcactctgtggccactatgcctggcctcagcacctgcctccatgacctgatggcacctcttgggtgttggaggctccctgtctcactgtggcagagtaccctacctctttcctgtgtaacttctcttgtccccctcctactgtcgcagagggctgggacactgggagggcttcctggaggagggcaggcctggcgttgggattctgacatgccctcccaccacacacagggagcaggctgcactgcactcgtggtggccgtcgtggctcggaagttggaactcaccaaggctgagaaacacgtgcacaacttcatgatggacacacagctcaccaagcgggtgaggggcctgcaggccactcctgtctctgtgggtctccaccgtagctattccaaagtggtatcaggctcagcccagtgttcacaagtgtgcagcacacagagaagacatggccatactgcgctcccagctctggatcaagctgctaagtgcacatcccagactctccagcgtttgcacatggccctttctttgcttcagttccccgtgtataaaatgaggggctggaagtcagtcagcagtgtttgcctaacttgcacagagtctggattcaaaccccctcccaggaccacacaaaccaggcatggtggtgtgtgcctgccatcccagcactcaagccagaggcaggcgaacaaggccagcctcagctacatagtgagattgaagctagcctgagctacacaagaccgtgtaaaacagtggctctcaatcttccttaatgttacaaccctttaatatcttttttgatcctcaggtcaaaaatgctgctgcaaacg

SEQ ID NO: 33731 - DNA, 1222 bp, Mus musculus
cacttatctcggcacttgaaatcgaagcagagcgtcgctagaatcatccttagctagttctaaaggctggctgacggtagcctagggtgccggatctcatactggccccggtgtgttggacacaatccttcggactcttggtgaaaagctagtctggaatcgtcaattagtcccaatccagagacagtttctctgtagaacaaatggcctttttcctgctctgggattaaagacgtgagccacctttgccatcttggcctggagtttcagggagagcagagcagcctgccacatgtagaccctgaggcagcttcgtagcggagcacaagccttctgacttgcctcacactgggctcgagtgtatgagcccactttggacacccctgcctgtgggaggactgaatctcaggccggctctgcctccacacccctcccccacatagacaactttctctcctgacatgtctttcagcttcgggagtacaaggtggtggggcgctgcttgccaaccccaaaatgccacacaccaccactgtaccgtatgcgaatctttgcacccaaccatgtggtggccaagtcccgcttctggtactttgtgtcacagctgaagaagatgaagaagtcatccggggaaattgtgtactgcggacaggtgaggtctggggccccacaggatgccggtcgctgggtaccatcagagccagggcagcactcctcatgtcctccctactccccacaggtgtttgagaagtcacccctgcgtgtgaagaactttggcatctggctgcgctatgactcccgcagtggcacacacaacatgtatcgggagtacagggacctgaccactgctggtgcagtcacacagtgctgtgagtctccaaccctctgccaatttctggcacccaacccaagaactgtcgctgcctgtagcggctgtttaaatagtggtgcacacagcaaaggggcttcgtcgcctttggggggctgtgcagtgccccccagagtgaatcagtaggctctacagaatgtgggggcattctgggtggctggggctgattttcttttctttccacagaccgagacatgggtgcccgacaccgtgcccgtgcccactccatccagatcatgaaggtggaagagattgcagctggcaagtgccgccggccagctgtcaagcagttccacgtgagtgaccccgagtgtggggctgacgcagggctgc

SEQ ID NO: 33732 - DNA, 1222 bp, Mus musculus; identical to SEQ ID NO: 33731

SEQ ID NO: 33733 - DNA, 1190 bp, Mus musculus
agtctgttccagaagccccgcacctccttcctgtgagtcccccagctcctgccagtgcagcagccaccactggctgctcctccttcacatgattggccactaacgctccctcatcccacccctagcactgcctcacagttcagccctcagccagctgctgctgacctgccctaatgtccctgccagctccctgagctgagcagtgctcctctgaagagattcctgctcttgtgctgaccaagtcctttcctccctggccagcttgcagagcacaagcctccattgcctggcctttgcctgctctgaccttgttgtgaagcccatggaagcaaggagcatgtaaagctgggaccaatcgtaggcaggtgccccactccatccctgtcatagttctctgaaaggggatgataagtctcaagaccccttatgctgatgtagcaccactgaggtgacctgtcagggcacccacagttaccagccacagtctggttgagaatagcacttgtgcccaaggagcctgactttttggtccttcccccaacccaaccctggagccaaggtctcaccatgttgtccatgctggcctccaactctctggctcaaagatccgcttccaggtggatgatctctcagcacgtgagaacacttgctcctctgttcctagcaacagtgttgactaacttcctgatattccagcttgaggatcccctcctctagcctccatgggcactgcactcgtgtgtgtgcacatatttatacatactttaaaaagaaatcttcggagaatcctcctgcctcagctctaggagcagctggggctgcaggtacttgccaccgtatccaaacgtgatttttgcatgtttctctgttgctttcttttaacccacattgagatgcagttaagggctggggtgtggcttggagacagcagaggtttagcattcacagccctaaggcctgaaagctcctggccacatgcatggtgagcagggttcttgtgtgctctagctttccacaccatacccagataccgtggcacttgcccaagcacacccagcctgaacaaggcgaaggcaggaggatttgggtggggtgggaaggaggtattgcatgcctgtcatcctggcactgggatgctggaggctggaggatcaggagttcacttaccctcagctacatagcacatacag

SEQ ID NO: 33734 - DNA, 1165 bp, Mus musculus
cctgcagttgaatacggctagtctggtggacacagacttacatacgctcttacctctgttcatgctcgcctccggtggcatccttatcctctcccctgtaggcctcttgccctgtttccccagccgtgactgcccttgtcatccctgcttcctgcagatgcctgtggcctttctgacccagcccatgtggagagcctgcaggagaaggcacaggtggccctcaccgagtatgtgcgtgcccagtacccatcgcagccccagcgctttgggcgtctgctgctgcggctgccagccctgcgtgctgtgcccgcatccctcatctcccagctcttcttcatgcgcctggtgggcaagacacccatcgagaccctcatccgggacatgcttctgtcagggagcacctttaactggccctatggctcgggctagtgatagtcaccttccaggacatacatggaaactggggccttgtggggaccctggggatcagggccccagcttctcttttgagactgatttctttttttaaagactgtgaaatgtttgttttgttttattttttaaataatcatgaaaccaaaaagatttggatctcccaggccttgtcctggcagaccttcaacagtctggagccagcatgctgatgcctctggtgtcatgggtatctggaaaggccactgcagctaggcaggagtactatgggccaggaggatcccctggatacatggtccacggagggcaccatgggatgatgaaaacctggccaataataaaggtattcccttacttggtcagcctctgctttcttctgcagtattgggaaagtaaccccagggtctagtctgtgctctgtaggtcccagtagggtgggagactcgcctcactactgtggaggaataagaggccctggaaaaggctctctcaaaacagctttgtgattgctggatcaagccacacctgaaagcctggtgtttattcatgttcatgagaccaacttacctttttacattggggtcagtttgaattcaatttcttcccccaagtaacatattcctgtttctaaagttaccataaagaaggtggggacagattgagatgtgaatttaactgttgatgtgtggtgatgaagggagctgggggagtagcccagcagtggtggcacatg

SEQ ID NO: 33735 - DNA, 1173 bp, Mus musculus
ccgtgggagatgccgtctggtggggacccctctacagggccatgcagggcgtggtcttgcttactggctgccttaggggacagaaagcccctcgaaaaagaggttggctgtccaggccaggggttgtagagcactttctatccatgcatgcagcagactttgcattccccaggatcgtgcagggcctcagaacagggcaggcagccccgtttcccaggtgcctggagccccagagaagttgtagagttatgggaagggtcctggcccagtggacttaagcaggtagagctgtgggggctggatgtggagatgagttccttcccagaggcagatgctactgacaggtcaggtgggggccacccccatgttagagtttggacttgttggggacctgccttgctcccctcctccacctgtaactgggccaccagactttggcctcattcttgtgtctggaatgagttgctgggtctggctgggtctttggggagagtgaaggggactggggcgggctctctaggatcctcaggacctatggtgtggggcctcgtgtggttggtctccctctctgaacctaagtggactagcagctgtctggagctgggagggcttcaggaagtggcctcaaagccctggggtagggcaggcagaggaggaccctccccccatgatgcttagtgggctgtgttgtcaggtgagcccatccgggcacagcagaggcatgtgggcatgaagtgctgggttgagggcagcagggagccatggacagtgtgtgagcatggtatggtcacattggattgggaagctggtcactgttacagccccagctactcagaacacagcctggacagcatagcaagggggcagtgtccaccccatccccaaacagagatagagatagccattgtgatgagcatagcacaacaggcaaagcatatatcactttaggtgagatagccagaagaacttacaggtttatgggttttaatctgtcccaaccacacagtggagacgtcaaagccttccctgagcagagcccacccgcttagggcctggccagttccgcctggccgccctgatcccccatcactgcttggctgctggctttgttctggctttgcctgagttctctctgtcccagctgggccccttcctgggggcctctaaaagtca

SEQ ID NO: 33736 - DNA, 1208 bp, Mus musculus
tggaagaggaccaacgcatggctgaggtaggatctgtggctctagaacaccactcccgatacacactccttgtgcctgtgcctgggcgtgacttaggggtgtatgtggtccatcctgccagcatgggttctgagtaggcttggcctgtgggaaagcttggttttccagaaaggagccagtgggggcaaggctgggtgggtgtgaactttcccggtgggtgtggctttctgacagctctgggtgggcggggtctttgagtggcaggctttgacatgtagcttcctttgggtaagatatctgaatggctgtggctttgtgattcttaggactgttcaggaaaggcaggagcatgctcaccaagggcaaatcttgaagacatctagaatcattcgtgggcaggggaggagggcagagaacttccctagcatccactcctgaggttgaccaaggaggctgcccagcaccctacaacacagctgatgctcccaagcaacgagccaaccccaagagtcagcagagccgaggttgagaagtccaaccccgggcatattataaggcgcttaatgggtgttggctgagttaagaatacctggagagggtccagaagggtgacaggtcatccctggcatcctcttgggtggggctgaagggtaaacaacaggaggaacttctcggtgtgcccgtagatcctgctgctggcctttctcaagctcatcgaggaaggcagccacatggtgatgctggagtgtcctgaaacggtcaacacgctgttacacgagttcctgctgtgggagccagaacccgaggctgagccaaagctcgagccaaagcccaagccacagctgctgcagccagagccggctccaggggaggagaagtgaccagcggcgcagggactcctggatcttgagtagtagaggctcttagactgggcgtgggctggctgggcggggcctcatgccgatgggcggggcctgggcatgccccagagcgaaccaggcacagtcagtgttggagactcagtgcccagggcagctatggtgccctttccacgcgcgaccgaagggtgtgaccttgtacagagccccctccctgcctccccgagtccctgaagctgcagcgcgcgggctgccatcccactcggtcttcccctccgctgtgctccattccgcactgggaagccctaaggagaatcctggggaagggct

SEQ ID NO: 33737 - DNA, 1272 bp, Mus musculus
atccatctggccactcgagaacattgcagggctgaggtggccacattatcattgggatatgggggaactacctggactggtagagtggctgtgcaccctcagctgtagcatggtactcactgcaaggatggggttctgaggaccctgcatacttgtgaaggctaacggtgtctgtgttcactgggggccattattatttggctgtggccctactgacctgggcctggtatggccctagtagcatctcagcctcatgctgtgacttggcaactgccgccgtgccctattaaaccctgggatgccctggccagaatcctccacggtaccgttcctggagctgctccctgtgtctgcctctgaaggcctctcccctttcagatacaggcagaagtttctcccactctcaggtcttggtctgaattccaactgccttcctatgattgccttttgctgtgctactactgtgcattcttgggagtcacctggaccacccaggttcctgcaggtgggccatatgacctgagtctaggctcagcaggctgctcccggtgcagaacctctgtcctgggcacccctatgagtgaaccatgtcacatctggctgaggtgtggagtgccatgtgtatctggacccagaccagagaggacctggacctcctagaggcctcattctgggagaactagggtgctcagcctccagccacggatctggcaaggccccttcactgctctgacctcgagcactgttgaaatagacattttattgcatttctgccgttttacaaaaatatgacaaaataaattaaaaacaaataaataaccgcccatcctgtgtatttttctgtattgtggggggtctgctcgaggcccccatcctggtcgggagaacggcaggggcgcggcggggctagtggcgggctgtgggccagcaggcaggctgtgcaggggcatccgctgggacatccgcggggacacggggcgggttgtcgccgcagccccagggcgcgtcccagcgccaacagccagcaggaggcgaggcggaccctgcggagggagagcgcggttcgcagggccccacggcgcccactgccctcgcgacgcgcgccccggttaaggcctgtgacctgcgtcctccggccgcggttcgggctcggcggccgcgggctcgtccccggcgctcctgtgagcgcgcgcgccgcccccgggggccccgttggctgagggctcgcgcgccgagaatgcgaacagcttcccgggccgcggcggggacggg

SEQ ID NO: 33738 - DNA, 1187 bp, Mus musculus
cagggcgggattctaggctgtggctccactgctggtcctcatcagttccaaactgaattttagttaatttataatgagtggtggctcatgtctgtgatcccagcactggggagggtgaggctggaagattcagaatttgggctacaccgtgaaaccctgtctcaaaaacaaagaaagggaaaggggtgggtagattctcctgagaaagccccagcaggtctaatagcctccccatccccttctctctgagcagcagccccgagtttccttgtcttctctcagttcctcaggcactggggggggggggggggggatggggtggggcggctggtcaggggttcggagcctggtcgtagtcggctctcagcccgcctgtctcccccaatacgcagcggcacgagcggcaggcgcagcagcgctttcagcagcagcagcggcggcggcgcgaggaggaggagcggcagcggcacgcggagcagcaggcgcggcgggagcgcgacacgggaggccgcgaggaggcgcgcgcggaggcgccgggtcctgaccccgtggcggagcggggcgctgccaaggccaagggcagcgagcggccccgacggcccggagcgctgctgccacccggacctgtgctgcggctgaagcagatcatcccgttgcagactcggccgcccgcgcccaccgggtgcgcgcccccgccgcgctcgcccgcggacacgcgcctgcccgccttcctcagcctgcgcttcctcaaggctccggagcgaggcccgtccccgccgcggcccgggaagctgttcgcattctcggcgcgcgagccctcagccaacggggcccccgggggcggcgcgcgcgctcacaggagcgccggggacgagcccgcggccgccgagcccgaaccgcggccggaggacgcaggtcacaggccttaaccggggcgcgcgtcgcgagggcagtgggcgccgtggggccctgcgaaccgcgctctccctccgcagggtccgcctcgcctcctgctggctgttggcgctgggacgcgccctggggctgcggcgacaacccgccccgtgtccccgcggatgtcccagcggatgcccctgcacagcctgcctgctggcccacagcccgccactagccccgccgcgcccctgccgttctcccgaccaggatgggggcctcgagcagacccc

SEQ ID NO: 33739 - DNA, 1397 bp, Mus musculus
tcagcctcagtttctttctctctctgcaaaaaaaggtttccatgggaggtctttttccaaaagtggctgagtgaggcaactgggtcttgtctttggcaggtgtggggacccatccacaggaccaccgctcttgacccgggtcaggcaccagtaccacctccagggctgcctggatgccttgggccactaccagctggccacagacctggctctggcggccgaggccctgcgccaggctcggaggcaactaaatcacctcacaggtggaggaggaacggaggagatcctggatctcatcttccaggacttctgtgtgggcaagtgaggtccagagcctgggactcagcctcggagttcccacaaggtcatgatccaagatggcaaacctagcagagggcaggagagcactggcgtctgcagccctccacagtgaggagagagacatggatcagggatctgacagtggatacttcctcacccccgatgtcgggattaaggtcagcatcaccttgccaagtgcctgaatgatgtagtgctggatgtgaaacccgttgcatgttatatgctgagccacgacagggcttctctgtgtagtcctggctgtcctggaactcactctgtagaccaggctggccttgaacccagaaatctgcctgcctctgcctcccaagtgctgggattaaaggcatttcatttttaattaccaaaggagaatgaagagttcaggaaatccagaagcgtgtgtccacaaggatcagtcagccttaccttctagaactttgctgacgtgcttctatttatggcatcgtttgccaattaaatacatttttaaatttttacttgtgtagtagcatgtggtacctggaatgagtattgctgtgacagtttcatccaagtatctcctgtgctttgatcatgcccttcccttatctcacttgctcagtccctgctctcactaatctccttcctttccctcgaactcagaaatccgcctgcttctgcctcccacgggctggggttaaaggcgtgcgccaccacgcccggcttcttttttctttttggttttttgagacaggatttttcttttctttcttttttttttttaagaagcaatactgggacaaagcaccttgggtcatgctttctttctttcttcctctctttcttcctctctttcttttttttttttttttttttttttttttttgatttcttgttatatttaagtacactgtagctgtcttcagacacaccagaagagggcatccaattccattacagatggttgtgagctaccatgtggttgctgggatttgaactcaggacctttggaagagcagtcagtgctcttacctcctgagccatctcaccagcccaagacggggatttttctgtat

SEQ ID NO: 33740 - DNA, 1151 bp, Mus musculus
agagctctggctgttcttatggaggacccaaggttgggtcccagcacccacaaccagtggcttgcaagcgtctgtaactccagcttcagggactatgactcccccatgtggcctctgttgctactgcactgacttgctcataaccacacacagatactatatatatatatatatatatatatatatatatatatatatatatatatatatatatatatatatatatatccctgaggataagaattgtaactcagtagtgttgggtgtggaggtctagtcacagtattttaaaaaagaataaaaaaagaaagaaagaaagaaagaaagaaagaaagaaagaaagaaagaaagaaagaaagaaagaaaaagaaatgttaggcatttttgtcttttgtaaatgggacatgggaggagtttctagttgccattccgcttttctccatcaggggtctccgaagcctgcagagtggcaagggtgacacagactccagagcccagccctaagaactgggaaactccttttaaaactggagctggaggcgtggtggcgcacgcctttaatcccagcactcgggaggcagaggcaggcggatttctgagttcgaggccagcctggtctacaaagtgagctccaggacagccagggctatacagagaaaccctgtctcgaaaaaaccaaaaaaaaaaaaaaaaaaaaaaattgggactggagcttgtcaggatgaggtttaaggccagccttgccttcacaggaagtttgagactagtctgaggtgcatgagactgccacaaacaaataacatctgaaatggttgctcccacctgtaatctcagcaggaaagttatcggtttacagtgaagggtaatttacagtgaagggtggtggagtgagaactgagtggcactgagactcctctgcagccacggagctaggtcatgtgaccggcctgcacagtgaccggcctgcacgtctgcaggcagcaccaggcctgcgcttttctgcctgttttgagacaggtcttcatgtagcctaggctgccctccaatctgctatgtagctgaagatgacccacactcctgattctcctgcctctgcctccccagtgtacctcctcacaggcaggtacaggggacagaagccagggcctcac

SEQ ID NO: 33741 - DNA, 1174 bp, Mus musculus
gggctaaggacctggtaggactcctgcatagaatcctcagagaggggctaggggcatggctcaggggtggagttcatgtctagaatcccccagtttcatcccagtccaggaacatataaaaaggaagcagatcagctagactcaggtgacctctgccactctctctacccaggatccaaaaggagacttctagcacagtgcaggtgaactctggcagctccatggtggtctccagcctactggtgctcaaagtgtcactgttcctgctcttttgaggactcattagttggcaggtgagggacccagtccaggggaacttgtgaggaccccagacccacgggggcaggggggttggggatggggtgaagaggctatgcatgtgggatatacttgggcccagagtggcccagctcagggaggaggcatggcttgaggtggcgggggcagggtggcagttaacctttgaaccttccctttttcccaggtcacagttgtttgaagtcactatgggtcatagtgactctggagaggtcctggcagccctgaggatgtggaaaccactagggggctccagattgggtcttcctccgcagaactttaggactggggagtggggagggagttctgctttattgcttttgcagttattggggggggtcacatatttctggtgtctttgacctggaaaaataaagtaatttaaaaagaaagagcttgcttctaagttgctagtatcattgggtgcctggcttccctgctctgcttccccacagtcaggggccaccctacaagttgaggtggacacagtgttgctaatcacaccagtccccccccatcctatctgctggaatcatcaaaaaagtctgcaacaagaacagggaaacgccagggccaaaaagggggagtgggcgggtaggggagtgggggtgggtgggtatgggggacttttggtatagcattggaaatgtaaatgagctaaatacctaataaaaaatggaaagaaaaaaaaaaaagtctgcaacagacggtggaagggagagggtggcagctggctctcagatctgattgtctctctaaggagagagcagcctgagaccagaatgcctctgctgctccttggtctcctgcagcaagtctgagctggggtttctattagtcagggttctccagagga

SEQ ID NO: 33742 - DNA, 1223 bp, Mus musculus
gggcagtggtggcacatgccagcacttgggaggcagaggtaggtggatttcagagttcgaggccagcctggtctgcaaagtgagttccaggacagccagggctacacagagaaaccctgtctcaaaaaaaaaaaaccaaaaaaaccaaaaaacaaaaaaccctcttgacctcatggaccacacacaacagctgtaggttggactttttaaaagaggagttctgtgaccccttgggttataggaccagggaaagtgaggttggggtgctaaaataggtactacatggttgattccacagtcccccccgccccctgtcaaatgtcaatctgttttactgattccaaaaaagttagtgaatctcctatttataatttagccagctccccggtgtggtccctgtcagttttgtccctacaaagtacaggcaagcgtcttccggggctcccattccggtggtacactcccctctctcaccccctgcccccactcccagaggcctctgtgtccaagaagaaacgcatgtgtgtgaagctgatgcccctggggacagctgacgtggttgtgagtgacgtgaagctgagtgggaagactaagaccgtgcctggatacctgcgtgtggggtaggtggagcatcctatcccaccttctgtctctgccatgttgcatcctgattttaccggcatctctgcatgtggggatggcatctcgagggccctgtggtcagtatgctgattagcatgagggtgagctgctgaaagagaaacactcccaaacggtggccaccggagttaccctgctctcctccccttactccagggacattggtggctttgccatctggtgcaagaaatccaaagccccaaggccggtgcccaagccccgcacgctcagccaggacatgcgaggcctctccctggacccacccaaagagcccaggtgaggctcaggcacccccatgggcagatgggccaggaagaagacttcaggcctgactgaagtcactgtcccctgctccccagcaaaggaagccacccagagcggaccctgtccaggctgggctctcgggcctccactctacggaggaccgactccatctatgaggcatccagtctctatggcatatcaggtgagcacagagtggactctctggggttgttcctgggactgtgtcctgggcagacagggggctgggatgcggcctctccttggcctgccctaccaag

SEQ ID NO: 33743 - DNA, 1171 bp, Mus musculus
gggggtgctcctggcgtgcaagaaagggtcatgtcgagggaggatgggagctgatgtgagccctggggtaatgggatgtgacttgttaaggtttgggaggtagaattgggatttgggggctccttatctcaaagagctgcctttgcagctctctccacccccgggtgtgaatttcgactttctcggagtctggaatgctgagaagcctcggggcttggatctaggacaagctggatcaggcaagctccagcacaggcaggcgctgggcgggagtgggtcatgggcgcagggatggggatcttgcagactttctgggatttagcgggacggagccacacccctggagccatagccccgccttcagcacctgcttgttttcaccgcttggttgccgtggagactcgtaggtaccctgggctagccgctctagcttgagagtctcgttgggttgcgggctctctggcccgcggttcttctcgatggcctaagccttccggaagggggtcggccggtgcggagccgggttgaggggctgagagcttttggccgcggattggaaggtttggggcgggactaggtgggccgcacggaccgggcctctctgtgaacagtgactgtcgaagcctggaggcaacgcgggaggctcaggtagaatctgggtcccgaatgccagatagtctcgggactgtgggcgggcccgcgcctgtgggcggagccataggcatcacctggcgcgtagcccgggtcagtgcggaggtgcggatgggggcggaatgttgggactgctgagggcggggtcaaaggcttcacctgtagggagggatttgagggtagagtgatcacctgtgagctaggggggtggggtcacaggccttcatctggaggaggagcctcgatcaggttgccggactttgatttgaggctcccaatgtgggcggagaaagaggcctcagttggggcgtggcctaatgatgagggggatgatggaggctgtccttgtaggaacacccagcctctgaggccggataagcatgaggataacaagtgaattttgagacacagaggagggatgaggcgacattagggcatggcctggaccattggctgcgaagggcctaggtgtgtgcgggttactaggcgaccccaggcttggagggctgaagctcaaggg

SEQ ID NO: 33744 - DNA, 1145 bp, Mus musculus
tggcccggcgacaaccagagcgcctggcactggtggacgccagtagtggtatatgctggaccttcgcacagctggacacctactccaatgctgtagccaacctgttccgccagctgggctttgcaccaggcgatgtggtggctgtgttcctggagggccggccggagttcgtgggactgtggctgggcctggccaaggccggtgtggtggctgctcttctcaatgtcaacctgaggcgggagcccctggccttctgcctgggcacatcagctgccaaggccctcatttatggcggggagatggcagcgggtgaggcctggtggataccaggagggtggggacctagggacctcagggatagggagatgctggccaggggtgcttcatgactgtgaccctgagcctctgtcaccacagcggtggcggaggtgagcgagcagctggggaagagcctcctcaagttctgctctggagatctggggcctgagagcatcctgcctgacacgcagctcctggaccccatgcttgctgaggcgcccaccacacccctggcacaagccccaggcaagggcatggatggtaagtggaggggtccctgacatctatcccccgtgttctctgctctcctggtgcctgacccttgctttttgtgcagatcggctgttttacatctatacttctgggaccaccgggcttcctaaggctgccattgtggtgcacagcaggtaagcagggccctcccttccccatggcctgccattgctggaacctgtccccctgtgccccatgttccccatggtctttttctcctcctccccttctggcagagcgccacctagctccttttccacccccgaccctcccgccgtgccccgcattggctagcatctttgagggttttacatcctaaatcccgtgaccattctgctttgcctctagtgagtcatacttagtcctctctggcccccagctaaccacgctcttttacgccttggaacctttccatttgctgcaccctcaggcagccttcccagagggctcaagtcctctccagaccagaagactcttacccagatgtgccaccgctagatctctgccagtgacttagctctccctgcaggtactaccgcattgctgcctttggc

SEQ ID NO: 33745 - DNA, 1197 bp, Mus musculus
tctgttgacactttgagcagtaggtgtcttgcccaatgggctgagacaggagccatgtagagtggactcagcggccagttctcctttgccttcctggctcaccttcctatggccttcagtctggagccctgtgctcctctgttctccagggtccccagcgccctgagcattgttggttaacagagtccccagcacccccatctctagggcacagcatcctggcattctgacatttgcccccagcctctccctggcattgctccactgagctggacttactccaagagccagacatggagacacaggcagggtgtctaagagtagatcacagtcttcttcctggagttcacctctgtatagtcaggtgccagctgtgtactggatgcagccaggctgagtccctgattgagggagcccgagccactccgaagagtcagccaggctgtggagaagaacgccgtgtgactcagggttcctggctttaggcaagtcatgttactccttgactatcccttccccttctacagacacacctgctctcaaagctgcccatcccagacagccaggtccttaccatcaatcctgccctacctgtggaggatgctgcagaggactatgccaggaaactgagacaggtgggtcccgggacaggtaggaaagctgtaaaagactgcggcagagatgactgcttagggacacagactgtcaccatggtggggagacttgggctggagccttacatctcagggacactcatctgcagacctgaggttcttgtccactaaaatgggaaacaagcccccggactggatcagtcaggtgtggtagtgcatctgtgacccctagcacttaggagactaaggcaggaggctttttgaggcctgcttgggctggagggtaatgcttaccctcaaaaaaaaaaaaaaaaaaatcctacagacctcataccatgttgaagctgccctgtgcaggagtggccactgttgtgtagggaatgtgctgagcgggcacattcagcagaaggtggtctaagctgagatagaaccagatttcagcttttttgtgtgttacctctgagctcgcacacacttgacccaccatccttctgtcaggccttgcaaggagacgctgtccctgtgtttgacctgctgatcctgggagtgggccctgacggccatacctgttcgctcttccctg

SEQ ID NO: 33746 - DNA, 1172 bp, Mus musculus
acatataggagtaacacccatacacattaaatagaaataaataagtaaataaataaaaaagaatttgcaaaaagtgaagggcggggatggggcaagatggcttagtgtggttatagatgcttgcccccaagcttgacaacctgagtccagtccccagtacctcctgttgtctccatactggggaggcagaaaggaggagtccttggctacatagcatgttcaagggcagcccgtgctagatgaggccctgcctcctaataaaaacaaaaaccaaatccaattccacacctcgaagctttggatcccacggtgtgcgaggcggagcgcagagcaaggttccgtgggtcccgggtcccctgtccccagaccgaacagaccagtgtgagccccaacttgctctgcgtggcctctgaggcaggtcctggtctcgcacacagcgcatcctggaggacaaggagggcacgttgcccgccgccttggtgcagccgcgcacgggcgccctctgctggttcctggacgaggcagctgcccggctgctgtctgtgcccttcgagaagcattccacattgtagggggtgcgccatgcacgccgtgggcacttcgggtgttgtgggagcggactagctgcggattaaacagctttgctggaactattgtttctgtggttcttgttgggggagggacaacagagcagagcatacacacggatcagagaagcgtggcctggacttctggcccggcagtgtatgctctgttccaagtctggccacattctctgctccaagggtcagaactaactcacaggtaccaggctccttgcggtcccgagtgactgcttgtgttctagccatggtgaagagaagggttcacctggggcctcagccagagccttcatggccccctgaggatgcactgtctcctgcaagcttgttcggagccttgagcagggtgagctacctgataaggttctcctgatgttgtcacagggccccctaccgatgggagaagtgtctggggtgactcttgggatgctttctcccttagacagttttttctcttgccgcttataaagactgggatgtgggtccagagactggagtataagcagccagcttggagcatgaagtgggtcggtgcatcattgtcctgaccctgccagttccaaggaccta

SEQ ID NO: 33747 - DNA, 1111 bp, Mus musculus
ccaaaacagaacactctcagggcgtggtcaaagaactgtctgtgtctttaaagctcgagctaggggcggggcttccggaacctccccgcaagtgacgtcttgtgaccgggttattgcggtcggcggaaagcagtggaagcttttaaaggcgtagccttgtcatgcctctctccaggactcacagtatgacccgcgggccacttccctttaaggagcgtgtcaggggtgggacctggatgtgtccttcccgccgccgactcctttaaggcgcggccctcgtcccccggcagaaaagctgcttaaaggcgacgcgtggcgcgatggcggcgttgccacgcgggtcacgcgggctgccgctgctgccactgctcctactgctgccgccgctgggcggcccgcgcggcgcggacggctactttccagaggagcgctggagccccgagtccccgctacaggcgccgcgcgtgctcatcgcgctgctggcgcggaacgcggcacccgcgctgcccgccacgctgggcgccctggagcagctgcgccacccacgggagcgcacggcgctgtggtgagctgcgggcccttgcgcggtgcaccgggactaggcgggactcaagtctctaccggagggaggttgctatgcacttgggctcggctgtgcgctgcggagactcggtcctctttctgaggacctgagttatgtaccccagggattacgcacttgagggggctcggctctatatccatagtgcccgggctcgtccccactgcggcttgggaccccaagctgctgcctcctcccctcaggtacttaggaatctgttctgatttgctgccagccctcacagcgagctaccatcctagaacctctgactccttagaatgggccaggctggtgcttccagacccttatagcgaactccgggacttccagataagattcctgaggctcgggccagcattccacgctaacaaagttaatgaacttatctttgtgacagggtctcacaccaatgtgctttccaaaccagcaggttctgttcagttgtgtactagtgagctgggtgtcatctttactcccctgtcaccgatggatgggcaacaggcttggagt

SEQ ID NO: 33748 - DNA, 1804 bp, Mus musculus
atctcccataggtcagaatacaagagtcacttctctccccgcaacctgcgtgccttctctgtggagcccctccttatctaccctacacactacacaggggatgatggctatgtgagtgacacagagacctcagttgtgtggaataatgagcaggttaagactgactgggaccgagccaagtcccagaagatgcgggaacagcaagcactgagccgtgaggccaagaactcagatgtgctccagtctccactggacagcactgcccgtgatgagctttgaggcaactggcaaacagccaaagccactgctacacacctaaacttcatgtgcttgcctgggactatagggccactcaggcagacaacagagagctctacaagcacagaggtctccatgtcttcctgtttagcagccacttacacacaggcagcatttatggagtacttactgtatgccagaaatagggctgaccaccaagagattggtcaggaacaagcacagtcagttgggtccaccatgaaggaagttctcttgttagagcaatgaaagaggcatgattcccccttatcagtgatgaactgatcatcagtcttttattgttcagactgagtcaggtattagggatacatactcatttttaaaatccgtttgagtatttattgagggcttactgtatattaggtaccattcttagctctgggaatactgaaataagaaaaaaaaatcaagcaaaatataccaagcagctgctatgtgccaggtcttaggaagcactgatgagttaagtgtctactatgtgtcactcagtaggtgctggagatggatgtcccagtggtgcttatccttgtagtgggcatgatatgcttacggtggaaacagtcttattgaccctgtgtgctaggctacacgctgagcacaatgacagagtctaaacagaatgtaacaagcatttattgagcacctagagtatcaggcctttgactcccagttggttgagaaatagccaccctccaacctgtctgccggaggacactgggcttcccttgtctagaagggagcattgctctccttcccttggttgactgctaggttcaaggatactcatgaccttgcaagtcccccaccccccgtgtccctgggctggggctcccttgcccaccccttacttccagagcttctctctgcccttgtatctcaggtgtcccttggctgctcatatgtttggggccttgaggtgcccacctgtattggggtgctcctcttggcctgagcagtgtgtttaccagcaggccagggtgttgctgtcccttcaaaaccaaattgactgtcaactggacagtgggtaccatcttcttgggatgactgcttgcctgctcaggtcttggtaacttgctcatgtttgtattaaattcttattggttttcactgaagtctttgggtttggtgccccacgtccctgtccccgccggtcaagatttggggagacagtagggcttgtaggcatgtgttgttcagaccaccaggcactgaagggagtgtgggtgtggatattttgggaatcctatgcccctacctcacaaaggagctgtgggagagtctggtggatagattgtgcaaggtctcatggtggccattacagcctgttttcctatagaaacagactctacaacttgttcagggaaggagcccttcaggaggtgacagcagtcactgtctcccctggacagagaaactgggttgctagtttcagttcctgtctgatgaagcaggccaaaagcagcttgaaggcaaactcaaggccaga

SEQ ID NO: 33749 - DNA, 1190 bp, Mus musculus
gtgggtggataatgggtagatggatgagtgagagggtagatggatgggtggatagatgagaggtgagtagatggatttgtggtgggtgagtagtgggtggatggatggtgcattgataacatggtttgggggataatggtggtgaatttgggggtaaggttggtagatgaggggtcagctgggaagcccatgctggcagattgtccctctcttcaagttacctaagtcttcaggaattgtcttgtcctcccttgtctttggctatgacctcaatccctgtgtatcatgtcttcaggcctcacatttcacttgactgcacacagtgtttgttcatatttgaatatcttgccaagtctgccctgagcactctgtagccagcctaccttcaccatgttacccaggtgttttccccagagccccgctgttggacttccctgcacacactgtgcggtgctcaccctgtcaccctgtcagggccaaacctgtgcatagagggtggtggcccctctctctgacctcagcctcaccctcagcctcaccctgtttgccaaaatctgtgagaagacagttctgaagcgggtgctgaaggagctctggaagctggtgatgaacacaatggagaagaccatcgtcctgccaccgctcactgaccagacggtgagactcctgtcccaggacacttggccatctctgtgagggaagcccagggaatgcggtgcctccaagataagggatcaagacactgacactggggtttagggggtcactcaggtgtaatcaagggtgaacactggggacaattggaaagtcagagcccatagatatctcaggccaattgtttccctaacatccagtgaggagctggggaatctgagataagagccagatgtgcctgcacatgacactgataacacaggctgagggcccagggctggcagcaggatgcccaggggtggacactcacatggaggagggtggcgaggcctcagccaggtgcctgtagctgggcactcaggactggtcctctgggcaaggccagggctggggcggggcgacatcgcctcagtgtcttcccagagccactcacagtgacttattcccctctccccaccctgcccccattccggctggcagatgattgtaagtagagacccgtttgtccgtctgtctgtccatcgtcctttttcgtt

SEQ ID NO: 33750 - DNA, 1234 bp, Mus musculus
gtcaattgctcctgcctgcctggaatattggcttggctgactatgctaggatgtggaggtctgtggatcaattggtgatgtctgcaggggtgcagacatgcacagactcaaagacacctagtccccagcttggctgtcacttgggggcatgtggctcttcttccctctttcagtcacacccccttccatgcctcttcaggttatactcatggcacctccaagtgaggagacacctctgatccctcagcgctcttgcagcctctcatcctcagaggcaggagccctgcatgtgctccttcctccccggggacctgggcctccccagcgattgtcattctcttttggggactacttggctgaggatttatgtgtgcgagctgccaaggcctgtggtgagtgggtccctagatgaccatgccatgtaatagcaacatctattgagaaaggggatgctggggttttgaggggtgtggaattttggtaagggaggatcatgggatcagcccgtgtagttgacttgggtgaactgatgtgcccatcccttcaggcatcctgcctgtttatcattcgcttttcgctctggccactgaggacttctcttgctggtttcccccaagccacatcttctgcatagaggacgtggacactcaagtcttggtctacaggctacggtaggaagtgaaccccttgatttatcttcagggtagtatttctattcagtctatagtagaggctcttgaaaccagagaggttgggctgtttgctgtaggccacactgcacttcagtgacccaacttgggctctgggaagccagagctgagtgggccaccccattctgaaacccacagcttttatttccctgactggtttgggctggagacatgtcaccgctttgggctgcgcaaagatttgaccagtgccatccttgacttacacgttttagaacatctctttgctcaggttggtattcttcggtggggaaggctcaacccagggatgggggaccccaaggtaacaaatcccagcacccaggacggaacctcacctaaccacccttctgtggctgacccagcaccgcagtgacctggtgagtgggcgcctcccggtgggccttagcatgaaggagcagggagagttcctgagcctggccgtgctggacttggcccagatggctcgtgagcaggcccagcgcccaggagagctgctgaagacggtcaggtgagggcctcgggcc

SEQ ID NO: 33751 - DNA, 2555 bp, Mus musculus
tctggctcccgggacgcacagcggagtgcgcactgcgggggttttcccccctagcccacgtgtgtcatccttcgacccctgcttctaccgcgacctgctcctcgtgcaccgcttcctgcccttcgagatgctgctgatgtgggatgcgctgaaccagccccagctcctctgcggcaggcagagccccgcctactgagaggtttgggggagttgacatcccctagctcatgtcctgcctcatccacgtgcaaagggctggcttcaaggagaagttcaaagtgaggggcagaaaggtgggtctgaggagttcatagggcaaactcctaagtacgcttggaaaccctcttggtactgttcacagcaggaactctgagtctagccaactctgagtggctctaagtggccgctaagcaaaaactgctgtggacagagcccatgggttttaggctctgggccttggcctctctcaggcccccaaggaattgggcagaggaacaaggtggattttaaactgaggtgctcagagatcttgacttgacccccactagtgtctcccaagaacttggagaaccacaggggcaggaggggtcctgtgtcccacagaccgggctggcaggaaataaagtccatagaaggttgaacgtgattgtagggggaaggttaagataaaactcagggctctgccacgttttaattttatctatttaggaagggagccaggtcctgtcttcctctctgtttgggtcctgggacttgaactcaaatcttcaggcttggcagcaagtgcctccattaactgagtcatctcgccagtgcctttttagttttcagcactactcatgttttaacaccggctgctctaccccacctctctttgaccttcaatattaactcattgcaacatgttcacatctacagcatggctgtatgtggctcctgcctccccttgctcccttccctgtagctactttgtgggttctttttcttccaaaattgcaacccctccccaacaccagacaggagagaaaaaagtatagaggaaagaaaagagattacccaataaagtctcagcgcttggaaaggtggtaatgttacttttagacctgctgttactgttaatcctgctgattccttggggcaagttttgatcttccctgtcaaaatatctagttttttcttgtccttgtttcttcttcgaggatgactacttagcaaacctccactaacaagaacaacccaccctctgggtccctagcatttataaaccctctaatgagtccccagaattccaaacatcacacaattgcagaagctgcaaaatcgcatctgctatagcacaaagcaatgcatagtcaggtgctggggactggcagaagcattcccacaccccatacctgggatcaaaatgagaacactttcctataagatttctggttacttgtttgtttgtttttgtttattcaagacatggtttctctgtgtagccctggctgtcttggaactcactttgtagaccaggctggccttgaactcaaaaatccacctgcctctgcctcctgagtactgggattaaaagtgtacaccaccaccgcccggtaatatttctgttttttaaaagaaacccgaattctcattatgctcccccattcacttttgaggttctttcccaaaagacatggtggataccttgtagtgaatctcagcgcatctctgctctccccagcccagctctcgcacccttcatagctcctgaaacctcagctgtagaacagggaaccttccagaccaatctggtctccccacctggctgcctcagccctggttgagctcagttctgatcctacactgcctaccaccttgtagttattttgtttgtttgtttttctttagacacagggtctcatttgtccaggctggccttgatagccaaggctgacccttagagccaagaatgatcttaaactcctaatccccttgcctccacctcaccagcctaggataacattgtacaacatacctggtgtgtttggtgcttcaggagtgcttgtactgtctattgtgcacctactgtgtacttcacagccttgtaaagagctcctgacacgccttggttgccccagtagatcctggtggtgcctccggtctggtctgtgtgtgaccagagcagagtcacatcctcctgcccccccctccttgttgcttttcccaggggggaaaaaaagtatgaagttgcttttttatttagactttttgggacacagggaggaggtgggcacaggtcatgatggggcttcttggggacagggcctgtggtccttgcttactgcgatctatgaataaactagggatcctccaaggcaaactggattgttgcaatgacatagccaggaggtggggagcaattaaggacgcaccgcctgagccctgtgccccttcagtggggacacagacccaacaggtcttgctgggtgcagccagtaagacagcagcggtgcacagcgttggtggcggcactgcggcgctggcgctgagaagcctggagaggaagctgcggg

SEQ ID NO: 33752 - DNA, 1103 bp, Mus musculus
gaataaataatacagagcatattagcagaaaaaacacagctcaacaaggaagacaggcatagtttattgagtggccatgactggaacccccaaacaaccctctatgtctcgctgtggacacatgagtggtggtggaggcctttaatcccagcactaaagaggcagaagcagacagatactgattgtgaggccagcctagtctacagagtgagttccagaacagctagggttacacagagaaaccccaccttgaaaatactttaaaaaaaaaaaaaaaaggaacaagagtcaggaagtgtttatcaaaggtgtcagtgggcctcaggtttaaagcaagtgtgaactcagtcctggagttttctgatgctgtatgtaacattctcagatattctgggtttgatgtaagctagtggttgactaagaattgtaggattttttaataatttcaaggggccaaaaaacagccctcaataatttaaactctccataatcttttgagtggacccatgtggggacatgggaactgaaccgaggacctctagaaaagtaacgtgcgctcttaaccactgagtcatctctccagccccttaagatggtctcactatgtggccctagaactgaaaaagtataactcaaaagcaaaattctagacctttaggcccaggcttgagaatgcgacctctgtgactcaatgctccaaggtatgctaatcataaaacagataacgacattcctccatccacccgcttcctgggttcaaggagtgttcattcaaagaaagtcatcctgacccaccctgacctgctggaaccggctatgcaaatgtgctattgttaggggctcttagaaactgtcttgagaaataactcgcacaattaccaggtattcctcgtgacttgtaactttgtactcccttgtgactcttaactagtatttttggtattttccaacaacgccctccgcatctccttgagttgtggtttcttcctttaaatacccccttacccagctacttggggggcgccacggtcctctacccatgtatggtgtatgaccgtgggcccgagagcactcttgaattaaaagtcctcttgcagtttgca

SEQ ID NO: 33753 - DNA, 1102 bp, Mus musculus
gagggagtatggatgtctctctcccaggaactagaaggcacattgtaccccaggaaccatggactggaacctattgtaccccaggaaccatggactggaacctgaaaaacttacgatacatgcttcttagtgcaactagactagaccaactccgtggttccctgcatcccctgacctctgcttctgtgttaccagtacatactgtatacatcattgccttctgtgtacctgttcttctcagctttgactgtcaacttgatacagtatggagtcatctgaaagggagtctcaattgagggattgctcagatgagactggcatgtggtcatgtctgtgagcaattgtcttggttggtaattgatataggaggccccaattgtcactgtgggcaataacattccctggagaaatagtcctgggctatgtaaaaaagctagctgagtatgagccttcaagtgagccaacactgttcctctgtggtttctgttccaaatccctgcttcagtctgtgtgcaggtttccctcactgatggactgtgacctggaaatgtaagccaaataaaccacttagttacttttctgttgctgtgaagagataccatgagcaaggcaacttacagagattaattgggaacatggttacagtttcagagagtgagtccatggccatggtttcagggagcatggtggcaggcagccaggcaggcagacataacactggagtagtagctgaaagcttacatttatccacaagcatgaagcagagcacactggtactggcataggctttccaagtgatggctatggacgactcctctggaactttaagcaagtccccaagtgaatgctttcctagtgacacatcttccattttcattcgaaccattgtacattctttcctcacctaagtttcttttggtcagagttatcagagcaacagaaatctatttgttgcttaaaatcacagttgcagtatgggagaaagtgcagacagtacatctgattacctggtcctggaactgactgaagtcagcattatcttctaagcctgagatcaatggagaagaaatatcagctgctgccagtctccttatctgtagta

SEQ ID NO: 33754 - DNA, 2434 bp, Mus musculus
tgcagtgcggaaagacattcacttctggccactgtgccagaagacatttagggactcacagtggagcctggccttacaaatgtgaagtgtgtgggaaagcttatccctacgtctattcccttcgaaaccacaaaaaaagtcacaacgaagaaaaactttatgaatgtaaacaatgtgggaaagcctttaaatacatttcttccttacgcaaccacgagactactcacactggagagaagccctatgaatgtaaggaatgtgggaaagcctttagttgttccagttacattcaaaatcacatgagaacacacaaaaggcagtcctatgaatgtaaggagtgtggtaaggtgttctcatattccaaaagtcttcggagacacatgactacacatagttaattagagagggatagttttaagtataatttaaatatataaaagagctctacacattctagctcctcattaagaaacaaaaaatttcacactggaaaacgagcctatgaatgcagtatgtgtgccaaagtctcagtacatgccacagttggacgtgccaaaactctctaagttgaaagactatcaggaagcatttcagctctgaagacttactgaagatgatttccacatagagaccttgggaaagctttctgaccatccttgctagcatacgtgggaagacctggtgaagagagaaaaatctatggctgttggcctctcccatttcaccttggattttagcagtgtgagaaagtcttaagaaaggtgcagccttagtacgtatgcaaaccaccacagacccaaactctgtaaatggaatagctggattcttaccaagttaacaaatgttttcaaacccatgaaatgagtttccaaatctcacgaacctaagaagtataaaacctgttggtcccagtgctgcctagaagccagccaccatgggaaacatgacagtgtcctgtggcttctctcagttgctcagtgctaaatgtgtcagtatactgtggacttttgattcttagtcataattcggttggtatttttggggttttgtttagtctacaatttcaaatgtgcatactgccttgattatatctaccccaagacactcaacatttctccctcccaccttcatgtgcattccccaccccatccccttttcttagccaaagcttcagtgtgttgaagaacaaaacagctgcccccttgtccagcaagcagcacactcccagtccatagctcctacatctttcaatcccatttatgggttttaagcaatcgtttctcggtggttttaatatctatttgttgagggcagagtgagtcatgctgaaatatctgtttatctgaacctacctggttccactttcagtctccagtctaagtgggaccatagctgtctgcaagattcccaggctatgtgtgtattcaatgggagtgtttttccttgttgacaaattcttatttattgcaccttaacaaagttagatcctacagtaaattgaaatgtatttcaagagctggcaagatggcttggtggattaaggagcttgctgcctaccctgatgacttgagttcaagtcctagaaaaggtgaaaaggaccaactgctttaggttgccttctgacctccacacgtgccgtggcacgtgtgtatacaataagtgtaaaatatagttcaaatatgcagacatttaatcataattttaagtacttttgtggttaattttttaaaataaaaatgactttgaaaattgtccagtttgtagagactcttatgtattgtatggaagcatcacctgtccaaaataaaatttaaaaagctgttggcctattagcttaggcaaaaagtaggtgagagttgtggcagggagagtagattctgggatagagtcaggtacaggaggagatgatagagacagtcacatgaactgaggagcgagaactagccatgtggcaggacttagaacacagtaaatgggttaattaagccaaagctagttggggaacaagcccaagcctattatagcctaggcaatcactcatcaaagtcattatcattattcccaaagtcattgggaatttggacacagatgggaaagcctgcaagttgtaccagattttgtcactggatagttatggctgcactttatcattttaatatattccatgtttcttttctaatataaattttactttttcagcacaaagtttactcatttatacacaaatagtatgtttgttataatgggggagagtgagtgtatgtgtgttcaagtgccagaaaaatagcattggatcccctctagctgaacttagaggtggctttatgccacctgacatgggtgctgaaaaccaaaagtaggcgctctgtaagagctagtgttggaccctctctccagccccattggcatccatgtctggggaatgctttcactt

SEQ ID NO: 33755 - DNA, 1670 bp, Mus musculus
aaccagaagagtactgttttaacaccaactccactccagagagtgtgccctgtcttcctcttttgtaagaagttccgcttattaccaggtttccaccttgcaggaaatgccaagcagataatgaattcatgaccaaatattttgtgttagacaagctttgagcaccagttaagtttaattctttccttttccattcaaatggcaccagcttctctgattattcttattcttaaattgcatttattcctaaaataggcagggaatttcacactgagtatagttgcttaagtctgagggcatttggttcttgggaattagtcagccccacactttgaagcacaggctcaagtatctaatcttagctggttgctgttggggaagttttgtgaggctaggggttgtcacaagaaaatatgtggaaattttccacccagagcaaaaattaagtctcctatgggaagttataaagcacaactagattagcctgatcatactgagtctgctccacacggccctgtgcagaacagattgtctttaagcattccaagcgagaatgctggggtgatcattgttgcccatgtgccttctgactgagctttaatgctgttccatgttacatctttccttcactccagaattgttctctgaggagcaagcgtcttattccaggacttttctgctgtggtctaatgatatacccagcagggaatatggcagagtccaacccttttcagccagggctatacggcgaaactctgtctcaaataataaaaaggcttagttgccttcaatacattgagcattgtactaataccaagtgttgggcaacaaaaggtctctccagcagcaaagtagtgatagaaaaagaaattggcttaacttcatctccattgttcagggaacaacaaatggaagcttgactttgccaagacttgaattccttcgggaatgacactaataaaagaccaagacctcctgattgaactggatgtggagtgctctgtaggctgcacattttttggctttgtagttttcctttctcagttaacatctcacactgaaacattccacattccccagcagtgcggggccaactcaagtttacagtcctgactgaaagtcaccctgcttctagcttatctgaaccctgcccctcactcctatttattaagcatcacactaccagggagatgaactttgagcaaactgcaattgataaaatctactctgttctttatgttcttgctattgtatcatacgtaatagtatcactttttctacattttggtcaaataaatttttgcataaataatgtgtctggatttattcttttagttgacagttttgtaggtatatataatgcattctagttattccacatacacattcttatctctttcccattcctatgtatcctacctccatcaataccagtctctcagtgtagaacattcactggagcctggcaggattccactggcaggtacacaactgaaagcagtgactactccaccttttctgaatctatcatcaaactagttctgaaggatgggacccccaactccctcctctatcaacacctagctattgattgaacaactttggttcaacaaatgttagcagaatgttaaggtgactgtgccaatagctcaacaagtaacttctttttg

SEQ ID NO: 33756 - DNA, 1855 bp, Mus musculus
agaagatagagattcgatgagtagatggacagtaagttagcagggaatggttgaacatcagggggacaaatagatggatggatggctagtgggtgattggatctagggtaatggatggtggagtgattagttggacagttatggacagaccatttgacagctgtttgtgggtagtaggtagagctgacaagccacagtaagtaacaaggcaaacttgtgacttcaggaagggaacagcccgcaggggagcagccatggagtcaagatcacagtggagcagcagaagaggaccagcttcttccggtgcagtctcctgtgaggacaaggtctctgcccattctgagcctgtgctcagcccagctgactgtgcctgccccgggccagcctccacctctgatgtttggacacggctgcccggactcgattgagaaattgattattttttagtaaccgtctgatcttttccaccttcagagatggagagagttagaattttgctgtttttcctatgtcatctgccagtcaggcctatccgtcccctgcctcataggcacagatggagagaggttgggtgggggcccggcagcctccatttccagccttctgtccttccagcacagaaggtagccagcggtagtgcccagcctgcctggcccccatactccaagcaccaccaccggggccactgagggacaagcctgcacctgccttcagctgttctcagttgtggacaagtgacagccatgtccactgtctccttacgtgtcaaaccaaagggaagcacaaactaaggaaagctcacttagaggattttggaagaagtggaccgcttccatggccagagcaggatgggagtctgcgattcagactgaggtgacgtcaccaccattctcccatgacccactgtcattgggccacctgcctcagtggcaccaaaaccgcctccccaatcttctctggctggctctaatcggatgttcattttctatctaagatgatttttttatttttccagattcctaacaccatgaaatgaatctgtctttgattttctagcagcatacctgggaaattgggaaccagaatgactgccctgtgcccacagggcacctggtccctgagtcccagacaagcattccatggcacagcgctcccctgctgtctttacccagttgtgatgtgacagctctgtcctcctggggagactgattgggactgatgtcctggtgggagggtgtcctggtgggactgatgtcctggtgggactgatgtcctggtgggagggtgtcctggtgggactgatgtcctggtgggactgatgtcctggtgggagggtgtcctttgggagcacctttctttttactctaactcttcccccaagctccaagctgctgtcagtccaagctgtcagtatcaaaatctctcccttttttgaaattaaaaccaacgtaccagcaatagtcacctgccctcccctggagtctctgatgtaccatgtttacactgactagtgcactcagaaaattagattaaagtgcatttaaaaagaagtagttccacctgtgcagcaccaccaggtggctgtgattggttacaggttcaataggtgccttttagcaaaaagtggcctgaggcctagagaggtggctctgcagttgagcactcgcagctctaacaaatgagccagcagtcatctattgccagtgtctcctcagtttggggtgggacatcatccttccctccccatccacactaggattttggctggcatggtcttttggtggtcttgtgcttgcagtcatagaatcagtgagctacttgtcatgtctggcaaacactgcacacatcctcccct

SEQ ID NO: 33757 - DNA, 1286 bp, Mus musculus
tccgtgttttctagaatgttttacacctggctggtgaatctgctgagaccaggttttctgagacttgattaaagtcagggtgtcctttcactgggttttggttttggggtagttccctttcctgtttggacagcaacattgtagattgatatgctgaggtcatttctgggtgaaggccttggaaggatggcccccctcccacccccattgcggcatctgtcttcacttacaccacaatgccaggacagaaagctcacgtggaccaccacagaagttcccacagtgctgctctattttgggccacctggacatcagattgcatctgcaacaccacctgaagcaagagtgggacacaggacacaggtctgcagcacatagcctgtcccacagtccaccctgtagactgccatggcagatgttgctaatctccgttctcagtgatggcacctgagtttttaagtatgtggcatgtggcataagccgggttggcattcctggtctaaggagaccaaatgctagacgtggcccaggcagagtgccagcagacatggtgtagtggtgcagatgctgcagagctgtggcatctgagggactaaggggaccacttgaagagtttctgcacacgctgttgagagatgcagctccttttgccatagatactgaaagaatgacaaatccgtggagctgacatgtctggaataaagtgaataccagttatggagtgtgaatgttgtctgtcctggctgtccatcacagggacacctttccattctcgtccctgaagaatgaagaatgcactccaactcagcttgtgagacttggctgcaagtgattttacccactgagctgtgtcacagtcaggtggactgtgttcacacctgagggagatggtgtgtgcataccttgtctcaagtgtttagaatctttgtggatttggggatttttccagatttggggaatagggaacacaatgatttttgtaatatgtaatgaggtgttgcagtgactgtcacagatttgcatacatttgatttctgttcgatttgctcctgtgcacatagcctaaagtcatattaatttttttctgtcttcgaacatagcatacaatatacacagtctttttgaagaactttgtgcgtgaaacagatatatgagatttacttgtttggggttttttgtttgacttggagcggggttggagacatggggttggctgtcctgaaacactatgtagaccaagctattagattctcttccttctgtctctggagtgctagaattgaagg

SEQ ID NO: 33758 - DNA, 1527 bp, Mus musculus
tctatgacactgccaagggggtgtggcagtttaatgggttggctccgagggactcaggtctcaagaattcgggacataattaagaagctgtggagggctgggctggggcttagcactgcatataaagtttggcatggtggcctgagcctgtcatctcagtactgagcagaagaatcaggaattcagacctaatctcagaatgttaggggaggaatgcacctgagcctgctagtggtcagcttcaggagcccaaggttctctgtttagattagatgtgggatggagatgagagggagagggcagtgctatccggtgcagggtgcccagagcaggctttcggggaaattgaggctcaatgtcattcctctctgatgcaggtgagaagccttatcattgcaactgggaaggatgcggctggaagttcgcgcgctctgacgagcttacccgccactaccgaaagcacacaggtcacagaccctttcagtgccacttgtgcgaccgggccttctccaggtccgaccacctggccttgcacatgaagcgacacatgtagcctgggtcgactcggctagcccatgcgcgactgtggcaggttccacgcgcggggcacggtccccttgcaaacagactgctatttattggaccttaggacagagccggacaagtgtggccacaggaaaatgactctgccaccagttctggcccccacagtgactgaaggccccaggaaagaagacaggagtctgtgaagaatgttttcaaaatggtgcaataattgacttatttccctcgggtccccactagaggatcgaggctagatgccttgtgagaaatgcctttgagtttactgtccccaacgtttttataatattgtatataagactatgaccgattgtatttctataagggagacgatggcatctctgccgcctgcttcgtttttatacgacttttttttaattaaagttttggatctttggaggaatcacggtagtggtgtggctggggatagggtaggtcctgaggggacagggagcagtcagtgcctgtggccaaggtcaccagctgcagcccccagctgccaaggcctgtgggttcgctataaatgtaaacatggtgttttaggattgagcacaggttatttttaagtctgctactttgagccataatttgccccacccccaccccctgtatcccaagtgggaaaagccttggctccactgatgtggctgaccattcctttttttagaaagaaaaatagaaaagaaaattaaaaaccttttcctggtaccatcttggggtttagccaaacttatggagcgtgcaggtgttttggcgagcgcacgtgtgtgtgtgtgtgtgtgtgtgtgtgtgtgtgcgcgcgcgcgcacgctctcgagcgtgtgtgtgtgtgtgtgggtaaatgtatgggtgggtgtgtgtttccagcagggtttctctgtagccctgactgttctggaactcaggctggcctagaactcacagatccagctacctctgcctcct

SEQ ID NO: 33759 - DNA, 1385 bp, Mus musculus
catttcaccaggattctgctgcctccaaaaagacctttgagtcagtggtcctgcccaagtgcatcatgcaattaggagcaaaagagtccaggtagggtatccagagagtgagagatttggatactgttcattgtgcttttatctgatttctgtttattagctacactgaaaaatatttcaacctagatgaccaccttggaacctcttttcttttccaagggttcagaaagaccacttgtccaaagtggctagagactttgtggaagctcccagggctctcactagcactgccttgctatctgtggagagcctgccagtgccttcagcatagcctcagcatcctccagcacctcagggcagccgtgcttggtgctgtctcctgtaatccatttcgcccttcaggttgaggccgtttttttttcaagagctctcctttgtgctggtgaagctccttgcttggctgtcaggagagactggagagctgctctgtttactgatttatgtttgtttctttgaaataagcctggaccttcttagtctctatcctagaatgaccttgagctacttactgatccttgcaccctaacctatgtgtactatgtgcacggctggaatgacaggtgtcaagcggacctggagggctgaagtgtgtagctcagtcatgatggacaggcagagcctgcatataaccctagcttccattcccagtacaaaaccaaacaaaacccacttgtattgcacaataaataccctggtcctccccagccaattgtcctgtagcttaatttgaattgcctaaggcatacctgggcccagtggcagttacctctcatcccagtactgggatggaaggctgaggcaggaggatctcaagtttgaagccagcctgagatacagaaggagatgctgcctaaaaatattaatagtaataatatgttgattcctggggtcttgtaactatttgtctctgtagcccatcagttccgttgacagtgcctacaatgtgccttcagaaaagtgacattattagtaaaaaccagagacaaaagcactttgagttgtttggatatcaccagggttattttctggtggaaactactaaccacaaaggccagagctggtatagtgagtccagcgtgtgcctagcatgccctgccctgggcccatccccggggccacacagccttctctctcagcagcaggattaggagttccagttcagcctggactacaaaaataaaataatccattttaaaaacaagcagtgccggtgtgatggtgcacgcctttaatcccagcacttgggaggcagaggcaggcagatttctgagttcaagaccagcctggtctacagagtgagttccaggacagccagggctatacag

SEQ ID NO: 33760 - DNA, 1596 bp, Mus musculus
tctacccagaagcagcagctggagagaaaggcacggttgtgtacacactgctgggtggtacgtacagatgtgtggtggatgcatgtcagcccagcatcccatgctgttgatcttatcttagtctctaactatacaggtaccacatggtacctgtgcacagctcaggaccctcccctgcctcagctgacctattaattagccctgtttgatgggaaagcatttggctctttgccccagctccctggttcatgcatggatttggagcatagccgtgcacttcctctgcccctgacccatccttatcacaccacagccactcacccaggttcccagggcaacagtgcacattgaccagctccaccgctacactcgctcagaagccaaagtggaaactttatcttattttatggtgtttgagacaggatctctatggtgactgggaactcaaccatcctcctgccccattatacactgtttttggatggtggttttctgcctacccaatttccattggggaaaaccatatgaccagtgtacagcaataaatacctttagctggtcacaccccattgctcagtcccttgggatgtcagacagatgtggaactctgcagtgggctggtcccagcatggctaggaggagatagatgaggtgagggtgcctgcccaaggacctccagggatggtcggccttctgatggagaaagcatgccacagtgcttcccaagacatgctttacctggctcaggagtcaggagagacagtggcttctctgcagtcctgctgccctgcatgtgagagagctcttaggccaccaccttcctacctgggcttttctaacctgaaggagctagtgggctctgggctacctatccaactctaaggggttgttcagtcaggctgctttggggaatgtgaaggccccaggcagatgtccctgggcagccctgagtccaagatgtcagtaaagcacttggcatggtggtgttgtgtgggatctgtattgtattatgtgttcaccccccacagccacctgtgtcacctgggcctgacccagatgaggtgacaattcagaaaaatgtcttctgttgaaaagtgttgatgtttaaggtgtcaaatttaaagccagccctgggtcccctgagaatcattacccaggatgagtgtcagtgtgggcctggggttatacactactctgctgttgtgttctatcttggagttcagtctctgctctcacagagatcagtttggtctgtcgaatagtctccctaagcatctggacagtcactgctgctggtagcagctgaggtggctagcagcttgatgctaagggtatagttttctccttgaagcttcagagtgtgagccttaggctgctgggatgtgcacagaaattggatgtcttgaaagctctacattctcctgcctggagatcttttctagaaaggtccatcaatgtattaaataacctgcaggtgtctgggactgaagcagttgattgctttcagacacatgcaaaacagccctgaaacacgccagttggagtgagcacacgcctccctcaggtaaacagtggtgtattttcttcaacggacgg

SEQ ID NO: 33761 - DNA, 1177 bp, Mus musculus
gaggaaggagtaagatgcctgggctgcagttgctgggagccacacccaggacctctgcaagagcagccagcactcccagtttcactttagttcttttaaactatagtgtgtgtgtgtgtgtgtgtgtgtgtgtgtgtgtgtgtgtgtgtgtgtgtgtgtgtgtgtgtgtgttgaatgcccatgtgcatttgtgattacaagagtttcctctttctaccacacaggtccagggattaagttcaggttagcaggcttggtgacaacacttccctatttgcttgctctccaccaggtgtggtaacacctccctatcttcctagctctcaagaggttgaggcaggagtatcaggaaactccaggactacctgacataagaaagcagtgtttcttacccacccctccccacacagcatatagaaggaaccagctcttttctgtgagcacctcagtcgagcttgtgtgtcactagtctgtccaggctgtgtcccccattagtcagaggcactgtatcctatgatgctgacacacgggcccctgacagccactgttcagcactgaccttgaaccatgagtagacgaggcctgtggcacaggaggaatgcccaggcccaccactgagatagtgccaaggcagagttgtgaccgacaggcagggctcagccacagtgggcttcagctactgaactacccatgggatctctaggatttggctgagtcctcagggccgctctcagagctcataccaagccttgtttgtttgtttgtttgtttgtttgaggaaatgggcttggggataagacccaagacttggccagaggaggatgggaccttggagtgtgttatgacgtcagccccatggatgccattgtcttctgtttatccacccagcagctctctcacaacctctctccaccgcacacccacctgtccctctctgttaatccatccatctatactcccttcatccatcagtccattcatgtgtctacccactgtccatctactccttattctatccgtctggcctagtttctttcatgttgctctaataaagtatcctgtcagaagcaactttaagggagaggggcaggctagtccatcactaccctgtggaagtcagggtagggcttgaaacagccagtcatatccctgtgatctcgactgtttaagatcgggg

SEQ ID NO: 33762 - DNA, 1099 bp, Mus musculus
acttaccaggacagattagatacttgaccacttctagttccagtagcatggaagagccaaggttatgggctcccagcaagcatttgtaaatgagagcctcttagctggcagcttgagctaggacaaaaatttacttcaggacaattggtgggagcaccagcattgggcctctacacaacacagttcattttgattatgtttttgagacaaggtctcatggtgtagccatagctgtcctggaactcgtaaatgaagactagactgcccttgggcttacagagatctatctggctctgtctccaagtgcagagatgaaaaggcatgcatcccatgaccaactcccagcactctgtaaaagccaggaatgtcacagaaacttcttgagtatcctttgtggccatgtctatattctgaaaacaggcagagcttaggactagctgttttgcctttgaaaatgttttctgtagctgggtgtggcacagcagtgggaggccctgggtcctgtccttcatgcaatacaagttaataattaaataaaagtagttgctgggcggtggtggcgcgtgcctttaatcccagcacttgggaggcagaggcgggtggatttctaagttcgaggccagcctggtctacaaagtgagttccaggacagccagggctacacagagaaacactgtctgggggggaaaaaaagtagttaacatgttctacctctatgatggtactcattgctcgccctagtgtaatatctccccttataccatgctcagtcaccgagcaaccacgtgattcagtgcactaaaaagatgccatctactagtaacattgtaggttataagttcatcaacttgtctgcatggtgacagaatgggtcttctgtgctgaagaaccataggcctatacttaacccttatatttctgtcccctagggtgatatgttcttcattttcctggctggtggctgactgtattcatgtttggagggcagggggctcttttcagcttcaagtctggcacaggctgtccccttttttccttacttctaatgtgagtcctgccagggccttggctgcagtgctgagctgcgtgcatgcttagt

SEQ ID NO: 33763 - DNA, 1477 bp, Mus musculus
ttgtctgcctgcccaggtcccagggctggtggccgagttcctctgtcatctagaagctgtgaggcccaggtgtttcatctcctcagaagtgtttcttttgggccagtcacccaaatgtggagggcaaacctaaccaaagccagtttggtcccatgctgtgggagctcggtgctctactgatacagccttgggtgcaagtatgtgtcgttcaagtcaagtgattctgaaagatggagaaacaggctccagctgcagcttggtagtaagcactgcaggctcccagttccatcactaagcaccacagcacatctgctctccaggttctgtgcagccagctgttggctggcctctgggaggaagaacctcagcactgtgtggccacactgctcgtgagccattgatgctccatgcgacccttctctaaggttgtcagtgcccttgttggagtcatcagccccaactcagggagggatgtctctgtggccataatccggggtattatgtatgctactttaacctctcggccgcctcatcttccagggctctcgttgctccagccctgctgcttttcctctttgtaccttccctcttgtggtcgccactcgccttgcactctaaacacagctaccttccctctctcttctcttctctttctcatccaagaactcacagagaagcctgttctttccttggaccacttagaaggtgctgtttatatttctgcctgtccctcatgtctgcccacctggagttccccttcactcttagacttataagtaggtggcttcctgcccacagtgggcatctgttccatggaattcccatggaattccttgctttttggcctgtagccagtgtgtgtttctgtcttcttactgtagtctttgctttggctccatctcaccattgtcccctgtgcagctggcttgtcctatgtcctgggccagggaaatgctccctctaagtctccccttgtggattgtttggtgttttctttctttctctctctttctctctttctctctctctctctctctatatatatatatatatatgtctgtctgtctgtctgtctgtattctttctttgcttctcctctttttctttctgcaacagtgtcactgtgcaacccaggctgtgatggaactccagagatccctgttgcagggattaaaggtgtctatcaggttcccctgtagcttttatcacatcctgggctgcatcttagcagttggtgacagtttacaggtggtggtcatttctgtcactaccagaacattttgtacatggttatttttgtccatcgtttaaccagttggagtttgagtggtaaactgtcatttgtacagtgtaaccataagatatattacctagaaacttaagacttgtgtccaaaggaacccacatcttgtatttttaaaaaaatgggggggggcagttgtttccatttcttaataaacagtttgaagcgaggtct

SEQ ID NO: 33764 - DNA, 3098 bp, Mus musculus
tgtacccatgtctggggaggttctaaaccccaagtgctggcttctgtcttactcctttgcaaaaccctaatgggtttcacccaatttgactgctacagccagctagagattaatgttttgttttgcagacatgggaccccctcatcaccaccctggccaccgaatgccacaccctgggatcaatgagcacccaccttgggctgggccccagcaccctgactttggccctcctccccacggcttcaatggccagcctccccacatgcggcgacagggcccacctcacatcaaccatgatgaccccagcctagtccccaatgtgccctacttcgatcttccagcggggttaatggccccccttgtgaaggtgatgctgggccctggctgggaggctaagcacgggaggggatgctggttttgtcaggctgagttcctaccttgttgctaagatccactgggtggccaagtaggactcctcagggcccaggcaacagttatgctctcctacagctggaggatcatgagtacaagcctctggaccccaaagacatccgcctgccaccccccatgcctcccagtgagaggctactcgcagctgtggaggccttctacagtccgccctcccatgacaggccaaggaacaggtaaggacactgggtgctaaggcctggctgaggcctcactctccaagtctgtcctgcagataaggaactgcttcctctgaacaccacagtgggcatggagtggtggctctgtgctatccagcctgctgtggcagacactaacagcagcagtgggcatgtttatgaggtcacctgggatttggaaagggggctggacacctagcagagccccagctgcctctggttagcttcctagtgtagggaaccccttcctggccactgtggcccttgggggctgactccagcctctcatggggaccatgtcatgcagtgagggctgggagcagaatggcctctatgagttctttcgagccaagatgcgagcacggcggcgcaagggccaggagaagagaaacaggtgagctgtgctggtatcatggggctggcattgtggtatgtggttgctgtaactgccgtcctcacggtggcattcccttgcagcggcccctccagatcacgcagccggtccaaaagccgaggccgctcctcatctcgctccagctcccgatcctccaagtcctcacgttcctcctcccgctcacattcccggtctcggtcccgctcctcctctcgctccaggtccaggtaggcacgtggggacctcagaaagcccgagtgcatgctcctgcccatgccccattatcctgctgtccccacagaagccgcagccggtcacgttcctccagaagccgctcgcgctccaggtccaggtccaggtccaggtccaagtcatactcccctgggaggcggcgacgctccaggtcccggagccccaccccaccgtaagcaacaagtgtgggaattatcaaacgtacccctgttgctaaagagcggggtggcacacttcccaccactggctcttggtgtcaggggcctgttgtagggattgacaacttacaacatagctcttcattccagctctgcagctggcctgggttctaattcagcgcctcccataccagactcgaggcttggagaagagaataaaggccatcaaatgctggtgaagatgggtgagtatacccagaccagtgcccccttcctgcatgaccacatgttggcatcctgctgggggttcaagtagccactcccagggaacatggccacagccctgccttatatgttctttcccctctgaaggctggagcgggtctggtggccttggtgcaaaggaacagggcattcaggatcccattaagggtggtgacgtccgggataaatgggaccagtacaagggcgtgggtgtggccctggacgacccttatgagaactaccgccgcaacaagagctactccttcattgcccgcatgaaagcccgagatgagtgtgagtagtagttgtgggtggacacggtgggcttagcttcgtgcacgaaaggtgaaggtgacatccctgttctcacacagtttccacatttgggactcgaaaagaagagaaggaagactgaccacaggcttcagcttcgcagtgtggagggcttgtcctgcatttgccctagaggaggtgctgcagatactactcgcagtgcccagatagcaaaacaacaccatcccaccatcccccagcccagagcctaagtcccacccacagtgctgcacagcccagagagagaaggctgcctgcactgagcgtggcaaccagaatagcctagcctctgagctgtagaggtcagaaggaattatggtttggctctacttggttttgtgttaggaaaaaggaatactgaccccctgaggcagggattttctgactcctgactcagttcatcagttactttaattgttatcatccctttccacaaatgttagctgtttgcctctactacctggacataacttctgacactgggctaagcgcccttgggtcagggaagatggtgtccagagctcctccatctagtgcagcatcttagcttggggcttctatctggagaagccaattccagcacagagcatggggtgctgggctccagccagcacctcctgtgctgtcatttaatttgggttccttagccattcccagagagggggaggtgaggcccagaaggagcagcctggtgccattgtttgtacacaaacttttgaaacattcttataaataaaatgcagagtcctctacaatttttcagtatcatataagacacttgatttttgttttagatttcccatacctatgacgttcagatgtgtctgactcaggataaacaagcagacacacatgtgctgttaacaattgtggattttactgttttgccttccaataaagccttttgtaaaagatttcctctagctgtggatgagagatactgtgcaggctgctctggatagatgcaggctgtgcccaggcaccaggctcatacctgtttcagcacctggcatggagtgttcccatggggcagctggtcccatcttggat

SEQ ID NO: 33765 - DNA, 1215 bp, Mus musculus
agtggacttgtacccattgtggatgccaacacatggcggcttaggtacctaccattcttaatgagtagggaggggcattattggccccatcttttaggttggttctgttgccaaattctatagggatgagctacctgaaatgaaaggagagaagacatacagacctgagtgccagccccactcagggtttccttgcttaccaccatcacatatcatgcatggatgtttaccatcagtcatagtctggacagttaggtcttagacagcagaaccagcctctactcttggtgacctatacctactatttacttgcttgtgtttagattggtttggtttggttttgagatagcatctccccaagctgccctcagcctcccaaatggtcacaggcacatgtgttagcctttaccccctgccttgctctgcttaggtgatccatgagcaccctgcctccttcacattttcctgttagcttaggccaggctgccttgcctgctgtgatgatggacgataccagtgtttgtgcaagggccctgctcataccacctgtcccttgtggttttcccaggagcaagtaacgacagccgtggcacatgcagtggaacagcaaatgcagaagctgctggaagagacacaactggacatgagcgagtttgacaacctgctacagcccatcattgacacctgcacaaaggatgccatctcggtgaggctcagtatggggtgggggtgtcgtcgcctgcccgactgaccacccactcaccctggactgactctcaggctgggaagaactggatgttcagcaatgctaagtccccaccacactgtgagctgatggcaggccacctgcgcaaccgcatcactgctgatggcgcacacttcgagctgcggctacacctcatctatctgatcaatgacgtgctgcaccactggtaagtacttgaccacttggtccagagcccacacctgtcagggacccccaactcctccagtttccacccttgctgcacttgcacactggttcactgcttgtactcccaggacagtggctggcaccccacaaggcaggccttgggcactgctgcctcctctctgcctctgtagccatcatgtgtctgcttcggtctgcatagccagacacctggccgatgcactgtctgctcttccatgtcttagggctacctttgctgatcctctctccatcagtcttctctt

SEQ ID NO: 33766 - DNA, 6415 bp, Mus musculus
tgttttgttacaggaacagaaagtgtgcccattttctgctctgtgcagttttctttcccttacctttggggtgtgtgtgtgtgtatttgcgcacgtgtgtaccagcagtatgcaggtggaaaacagaatccagcttcctgcatctccctcaatagctcccccttgtctttttgaagtaggatctcactaactgcctaggatggctgcctggccctctttaagatctgccaatttctgtcacccaagcttcctgcctctgcatacatgcagctacacccacatttttttcacatgggtgctgaggctttactgatcagctccacctttggtgcttttaagacaggatctatgtcctgtaataggtagcctagggtgtcttcagactcctgatccctctgcctccacctcctgagtactagaatacaatgtgtcctccatgccgggattggaagccaatatgatttggtagactctatggttcatccttttcagacttcctccaagatccttcccttggtggccagctgatatgcctgttaaccaccatgtctaacaaagagccagctgggacttgtggtttccacaggatgactgaggactggcagcagtccaggaagttgggtgtgagttgagatctgaggaagctgatgcccagggcctcctagtgtccgagctgggcctttgtgttctcctgatgtcttgaggataggtgtgctctggggctgtgtttcactctctagaagccctgcccaccactgatacctctcgaagaaagtggcagtagttgataatgtcacccatatccttggctttgtctggtttgatgttttcacttctgttttgtgtggggtttggagctgaaacccttggcttcatgcatgctcagaatgctccgcctccaagctgtggagatggctcagtggggaaagtgcttgttgtgcagttgtgaggacagagtttagacactaggaggcaggggtgggatccccgcaacacactgtgccttgctcctgccagacaaactttttttttttttttttttttttttttttggtttttctagacagggtttctctgtgtagccctggctgtactggaactcactctgtagaccaggctggcctcgaacacagaaatccacctgcctctgcctcccgagtgctgggattaaaggcctgcaccaccacgcccagctcacacaaacatttttgattgcctttttaagaaaaagtattacatatatgtttgggtattctacctgcatgtaacatgtgtgcctgggtaccctcaaaagtcaagagaggccattgggcccgctgagactggttttccaggtgattatgatctcccatgtgggttctctgggagagcagccagtggtcttgcctgctgaactgtctgcaacccttgggtggctggttgtgcatctctgactcgggagatagtactcagccaccgcatcatgcagtggggcagttaggagggttagaggtcatgtgtataaagcataaactgctgaaatggctctgagggtaaaaatgcctgttgccaaacctgccgcccaccagtttgaggccaaacaggactgcatgaaactctgtttcaaaaaaagtaaccacctgctgcccatggtaataatctgcccgagtatagatgtgcccctcacccactgatgccccctgtccatcttcacaggcctatgtgtctcagtggccctggacgctgctgctcttggcagtcagtggcttctgcaactttgcacagaatgttattgccttcagcattctcaacctcatcagcccacttagctactcagtggccaacgccaccaagaggatcatggtcatcactgtttccctcattatgctgcgcaacccagtgaccagcaccaatgtgttgggcatgatgaccgccattctgggtgtcttcctgtacaacaaggtgagcattgggtgctactgtcccctagcaggcacacccttgggacaaggagccaagggaaagagaggggagggatttctagctgtaggtcccaagggtgccttacagggtgtgtgggttgtacgtgctagacagaagagtgtggcagtaggcgtctaagcacaggccttctagaactcactatcctcctgcctctacaccctgatctctagggcaatcggtgcagaggccagaagccttctttgtgtcttacttgttttagaacagtcttgtgtagcccagagtggccttcagcttctgaccccctgctccacctcccttggagtagaatgacaggtgtctgtatctgtatctgtatcctggtttatgtagtgctggagatggagcctcgagcatatatcttgtagacaagcattctactacagaagcatccctagtccttggttttagggtgaccttttttatgctgatgttcttccctcccctcccctcccggtgacttctcttcgtttttttttaagtctcatgtagcctgggttggcttcaaacttaccatgtagctagccttatacacctgcccttcctgactctgcctccatagagctaggatgacatgcccccccatacccaaagttcccttgtgcttttcattgctctcttcacacagaccaagtatgatgcgaatcagcaggcccggcgccatcttcttcccatctccacgtcagacctgagcagcagagagcacttgcggagcccagtggaaaagccccacaatggtgcattgttcccccagcagggtgacttccagtaccgcaatatcctcctcacagaccacttccaatacagccgccagggccacccaaactcctatgctctcagccgacatgatgtataggccaggccaggccttctgcacccccttcttgagctcagaagcttcagaatattctggcagcctgactgagcacatgacacttggtgggccatcaggggagctctgggtcctggcccctggcccctgatgggctgcaggatgtgatcatagcatggacacccacaaactcggggcagaaaagaaccacagagagaccctggtttacgcctccactaagaggccactctgcatttgtgtacagggttgtccctggcatattacagaggtctgatctgaacttctggtgagagtagggacatgctctacagaactggcacctcctggctgcaatcctggaagccaacaggagatggcatctgggatatcatggagaggacagctgggatacagcccagaaggatggagggctgacatgggtggcattacctgatcccaccaatgatacagagccctagaataccccaaggcagttggccacttgcagctagtgctgcccaagggcagacttatagtgaccatcagcccatcagctgtgaccttcctctgccttgtgggtgccaaagcagggcctggggggcccttggactctagaggagcagcttgtctgctccccactctcctgatggcacagaaggccaaggagtggtgatgacagtttcctcagaacctaagtttctctggggaacatcttgtcggccatgggatggaaaccatcttgtctcatttcaaaatatgggatgtttgttgctggagccagtccctcccaggtcagtggtagcaggcaatgccgaagggtactgaagttgcagccacagaggtagaaggaggtattcatacccgagtacagtgttgcttgtcagtgaggagaccgcatgtgtatcagggttttaactgtgctctggcaaatgggacaccaggcaggtcttggttttttagttaagaatcactttgaggctgggtagagtgcctgtctagcattcgtgcagccttagattctgtccacagaatgccacgcagtggtacaggcctgcctgccttcctagcactcttaaagcagattcaggaggatctagaggacaaggttctctacaaagtaagttccagaccagcctgggcttcaatgagaagctgcctcaggaaaatgatcagtttagggacctgccatagtggcatatatcgaggggctgaggcaggaagatggccatgggtttaaagtcagtctgggttacataatgagactctctctgaaaaagttgaggggctggtggcccatacctatggtcttaggtactcttgaagcagaagcaagagacttccccaagcctgtgagctcaatgccattgtggcaattgacagcaggtaaatgataggaaggggtatcaatgggtctcagggttttttggttttgagagagggtcttataatatagaccaggctgaccttgaactcatgggatatatctgtctctgcctcctgagtgcttggattctttaaaaccatgggcaccacatccagatggagtcatcccactaagcctcccaggctgaccttagcatttgtgcctcctctgttgctaagaactgagctcacaggtacatcatggcaccccagtccttaactcctgatttgttgggtccctctgcttttgattacttggggttttatattgaaggttagggttttttgtttgttttgtttttcgagacagggtttctctgtgtagctagccctggctgtcctggaactcactctgtagaccaggctggcctcgaactcagaaatccgcctgcctctgcctcccgagcactgggattaaaggcgtgcgccaccactgcccggtttatcatattagtctcctgcttgcctgagacttggcacccccggcctcaggacagtcccgtctgccttgcctagtcctagctggtttgcagaagaagtcccttggtaaggccgtctgttgggttctcctcactggggaaggctggcctgagacacctgtcactgcagaggtctctatgggtgaccctgactcagctctggactcagaatgaattatgtcttttaagattaccaagatgttcctataatttgtgtattaatgcatttttcctttttcagggagcaaaatggcccgtctcacttttcttaacggtttataaattaataaatgggatatttagttctgttcataggctcacagcaagtatgaacactggaatggatgagacaatcagggtagaccagattctcggatcaaaagacaaacagctggggctgccgctctggctacagtgcttacctgcatgcatgaagtcctggccaccctcagcactgcatacacgaatgttactccattactcaggaggctgaggcagttaggatcaggagttcagtgtaacatagtgaattggaagccagcctgggctatatgagagcaacaacaaaacagacttgatccacagtttacatctgtccattcaaagtcacattagccctactcctgtgtcttacatcccactacattcacctctccctctccaggactgacccgatccacctctgttggggtttatttgagaatttatgttgctgttcccacgtaccctttgaaattgcttagccaaaacgctgatcctgacctacccagctccttcattttacagaagaagaaaatgaggcttagtggatgtcttctcactattagtgcacttggagcttttatttatttctttgagatagtatctgcctatttagaccaggctgaccacagaatagaaggcactcctccagccttagcctccgtgcctggaggagctgccatacccagcaccttaatttatgtcatttattctagggaaacccaaaactttcttgacagagtagaggagccagatgaactaaggcagcaaaatacatggaacttgatttctctgtatgttgggaggactccaagcagtgagctcttcatggctagaccccagccccaaaaccttgggtctgaaacaggaaacctgtcatgctcttgctttccattgtcatcttgaggctcctgtgtcatagactgtactatgggagtagctgtgctcctggttggcatttaccaaaaataaatggtggtctccaggggttggagtttggttctggtttgtcagggagggtcttgctctgtgctcccatcaggacaacccacaaaaatccagggctgggaagatggcttggtcagcctttgactggcagatatggaaatcaagagttgggatctctacaacccccaaaagctgggcagatccagctccacctgccatcctagtgggagagtcaggtaaaggttccaggatcatgggcaagagcttactattggccaggttcatcctgaaaccatgccttatgtataaggtggagggccagcaagatagctaagtaggtaaaggcaattactgctgagcctcaaaatgtgagttcaatttctagaacccacatggtaggagagaaccaactcctgtaagttgtcctctgacctccacatttgtgttgtggcatgcacacacccacacaaaaaattttaagtgtgctaggcac

SEQ ID NO: 33767 - DNA, 1225 bp, Mus musculus
caggagacacttaaccctggatttctctcggttggtctgtgaggggaaattgacacctaccgcacagcttccgaggacccggcgtagtccagaggatttaccgcaatcggtttcttttcttctaaaagatctaagccctgtctacgccccaggcacgcggcttccacagcctcaagtgggcgggcccgcgtcgcccggcacctcccacggagtcctgccagtcaccggagagaacgtaacgcgcttaacccacccgcgggccctacggcccgccttccgggcttagccccgccccctcccggaaagcgtttaagtgagggtagggccctcgccgacgacgtgtacgggcgcgtcggcggacgcgcgacgatgacgtatggggcggtggccaatggcgagcggcgatgacgcaagggccaggggccaatggtgagcggcgtctgccggcgcgccctccagggctgtcccgccccctgcccgcgtccggcggtcgtccggcgggaaggggcggccgctcgggcaggatggcggcggcggcaaccgcgggtcccggcgcgggcgcaggggtcccgggcgcgggtggcggcggcggggcgcgcgagggtgcgcgggtggcggtgctgtgtctactatggtacgcgctgagcgcgggcggtaacgtggtcaacaaggtgattttgagcgccttcccgttcccggtcaccgtgtcgctgtgccacatcctagcgctgtgcgcggggctgccgccgctgctgcgcgcctggcgcgtgccgcccgcgccacccgtgtcgggccccggacccggcccgcatccggcgtccggcccgctgctgccgccgcgcttctatccgcgttacgtactgccgcttgcctttggcaagtacttcgcgtcggtgtcggcgcacgtcagcatctggaaggtgccggtctcctacgcgcacaccggtaagtgctgaggcgggctttgcgcgctgtctggggcttcgaagtgtgggtacgagtgcgcgggccgtctgactgagacgccgccaaggtgcgtcggattctcacgttggaaaaggtctgaggagtttaccgagcgcctagcagaattgactccagctattgggatcgagaggaagccttacagaaggaaggttcagggtcgggtgtgcaggttgccaggactgcccactgagtgccttttcctctcttgcagtcaaggccaccatgcccatctgggtgg

SEQ ID NO: 33768 - DNA, 1189 bp, Mus musculus
ggcccagcaatggccaggggttaacgggtgtgaagacacacagggtaattggtatgactggacacagtgtatatcgctcgaccctcatggtgacgatgggcgcttgaacattctgccttatgtctgcttggactgagcacctgacctggccatcatgtgcattcccacctcgcaagggttaggctggccagctgagaaggcgagcatgaggctcgctctccaccatccttttgtgaaatgctgctaccagtttactaacgattgcaaaggaagggccgctcgggggaggggcagatagatggctgaaatctatagtaagccagctataaagcgttagtcccccatcccagaagaggtgcagaaccactctaagcaccgaaggcagggacctcagtagcaggcaggcacaggaaccctgtggaagaggttaccttaacagcaacagacacatctcttctttgcatctcttgctctttggccctggtgtctctgaggcacaggctactctcgagccagtggttttttttgtcgccctcgtgttgtgcgctggaagcttctctgctgtggtgaaccctggtgttgtgtgggtgggccagcctcacccacactgcacagtcgtctgcccatttgtatatggtttcagttcagtcccagttcttaaaagaaatgctgcagaaacttgagttttctcatttatttcattctcttttttcccctaccaccagccaaatgacttttccttcccttctttccttttctgcacaactctagaaaaatgccatctttctagagtctttaacccacaaagttcccgagggtgctactggtgtgagttgccctggtgggctagggaagagccgtctgttggctggaaacactcataaccattcctttagattcgtttgccttatggtcataaacgcgatttgcaaaaacaaggagccttagtgaatgtacagtacctagacttctgtgttcgcgcagaagggagcaactttgctatttggtccagtaagtggacaacttgtgatataaatgtggaaataaaaaaaatatttgcacaaaccagttttggaatcatttctcatttgcacatgtatagctaaatctggcctttcctacaggggtaagtgcctggagcccacatccatacctactatgccagccttggtgacatccctttagcttt

SEQ ID NO: 33769 - DNA, 2970 bp, Mus musculus
aacagtctggggccagtgaggtcttacttccaaacgtttcctcctcaccccataactgggtctacctggggcagccaaagattgctccaacatttggaggagccggtcctcctcccttgggacaccagcctcttctttagacactaagctgttagccataacatactcagcttctccagaagaggcctgtggaagaggtgctagtggtgatgttagcagacacctctctgtgctttcaagccacttgttaataaagtgactttggggccactcctttattgttgcttgtgatgttggcagcgtactctgaaggtttgggtttctgggtctctctttgaaggaggggagctcaagcttgaggtgcatgaggttcagaggcgactacgccatcagctctgagatgcgttccatctagagatggccatgccggcagtgctgagggactttaatcagcatttgaaagctgtagcagctggcttgctttggggctctctttttggattggtttctttcttttctttttaaagattgttctgttttatatgtatggtattctgcctgcatgcatgtctgcacacatgtggatgcagggcttgcagaggccagaagtcctctaatctgcagctagagttacagccagttgtgaactgtcatgtgagtgctgggtcttttgagagtgacctgtgtcctgagcccctcattttggcttttttttaaagacagccccaaactgtggcagatgaccttgaactccttatcttttcagtagtgagacaagatcccaattgagtactaccataccaggtttttttattggctggttggttagtctttgagaccatcttgatggaatctgtgctgattgagaactttccattctcctgcctcagcctctttagtgctagaatcccaagtgtgtactaccaaccctagtcataatagcattttaccccaggcttccccgggaactatggggaaaactctggtaatgtgggaactgggtcaagtctaagttcaggctgcacagctgctgcagacattgttgattgtgtccttcacacccgcagcatgcctgagcctacccacttgcctagcattgtaacatgccactctgttggctgatccccagccttggatagttgggatggctttctgcctttctcagcttaggactgtagtttcaggaaaaaaaggttccattcattctgaagaggaattgtgctgaaaaagaatgctgtcatagggtttgcacttattatctcatttgagttctgataaagtgtttttggactacttactgtgtgtgtgaaaaattgaaacccatgaatcttcttggtttttattattatttatttatttatttttggttctgggctagggccttttgatgccactgaaccatatcaccagctctatatgtgtgtctgtttggaatgttgttcagaaacttctcgtggctggagatgtagttcatgtagagtgacatagtataattttacaggaaaggactgagagtctggctcaggggtggagttcctgcctagaatttcccagtgaggggctggggtgtgtggctcagggatggggtccctttcagaaccatttgagactctcaagtcagatgttctagaagctgttaagcaatagctctttcccttgctataaccagatatatgtaacctgaagtgacaacccactttgtgctcctgaaggttaaacctgttatcccaacgttaccactgggatatggagtttcagttaaattgtctctcacgcttaagagctacaagatatgaagtgctgtcttctgcctcccaccacccagcctgaacaaataagccctctttttatcccttctttacaacactgacaaacacacaggtcaagttgtccacaagtgatcatgctgggatgctgcagagcggaggactgtgttgtactgggtctacctgattatagtgtcgcacatacagccacaagcatatgctgtgtgcaaataaaaaacaaaagagttaccatgacaaacattcagtctatctactcctatccttacccagatagccttatgaaagtataccaccaacagagaactgaagagttcaactcatcacctaggaccctctgacttttcagatgatggctgcctgtaggtcactgagcagctcagaagggcagtgcctctgggctggcagcagtgttcactccaaagggccttcaggttctctaggcctcacgctgagcaaggcccatctcgaaggatacaagagtcgccaagacagcaccaacagcaagaccatgtggaagaagccatggtatgtgaggagcagggtccagggccaatcatccagggtgtagccattctgtagcatctgactggacaggcacagtacagccctgccacttcgcagcatcccatggatgctctgagctaatgggcatttcctagatggaagacataagcaaatccttagccttcattgtcttcctggcttcgagaacaaaatgtgcccgtggttacagtcctgccatgtgtatgctgtggtttatggtagcttctctggtggggtgcatagcttctcaggggggaggctctggattgcttggtcctgccccagcagggaagcttctgtttgctttactctaagtttcttttctttctttttttttttttttttttttttggattttcgagacagggtttctctgtgtagccctggctgtcctggcactcactttgtagaccagtctggcctcgaactcagaaatccgcctgcctctgcctcccgagtgctgggattaaaggcgtgcgccaccacaccctgcccattttgatcctttaatgattgtaacatacagacttgtaagctagcttcacccacccatggtcgtccatgctcagaggcacctggagcatagccctctagggaaatgtctgtggtgcatgaggtttctttgtgcattattacctta

SEQ ID NO: 33770 - DNA, 1828 bp, Mus musculus
caccatgacaaccatggagcaccacatggcatgggactaggcacccagcactccggcctgcctgccaaggccaaggaagagctgggcgaaggatccaggaagaagaagaccaagaaagcggattaggggttggccccaggaatccactgcgtgcttggtagaaggatgtggactcaaagaaactcagaacttaggggcattcagggctcagaccctcccctccccccgccctgctctctaccaccctcaacttccccatctgcagtttggagccatcagcaattccaagggctgatgtgggctaaattagtgtggaggaattcaacagatgtggaaaaccctgccctctgccagacccctcaaaaggtcacagcctttgggggcacacagtctaggcccaaagccctggctggtaggctcttggttttcattctgtgttctgtctaattatatcttgtaactaaaagaatttaaagccacatggagactcaattatctagatcctctcgagagccaggtgctggggtcccatgtccttccgcactcaggacctccctagaattttgtgactcctgctggacatctttaggcaaatggccttccttctctgagccttctgtttctgttctgtagcatggagaccccaggtcctcctgtgtacaaaagggtctttataatttcaagcagttgcttaagcagcgtgctagtgagaaggagactggagcagcatgaaggacagtggcaggctgcttggtatgtaggccatttgtgtttgaggccagaaggtctcaccagatactcagctgagcatgagcaggcacatttagggcagactgctaacaggaggggggcttgagttcctaggtgcccacaggtaagaggtgtgggtgcagagcagagggtccaagagccaacagccttggttactcacaattgggctctgggtgtatcaggtgtccctcatgcctgatcagcatagttcattcagtcattcaacaaacacacagatccacacatgctcgctatacagtgtcatgctgctcctcttaggagcgagccttatacaggggaagggccatggtcgccaaagtctccagggcacctgagagaggtgagcatggggtcctgctggtctcaggcttatgtgaggctcagatctagttgaagtacccagtgtagcccatttgttgagaaaatgctcctcataactttgcctggaggtagggtaggccctgaggctggaagctcccgagtttcatccccttgatgtcaatcaaagctcagtgtgagtgatcagccaataaatctggtgcgagtaaatcaagctctttttctttattcagcctcaaaatgtagggatccagcagagtctgttttagagatggcccaggcctccagggataggagatgggtctgaagcctgggaagcagggtcaagcatatctgagttctccaagataagtgggaaggtgcacacctgtccagaagctgaggcaggaggatcactgtttctaagcctgcctgagtgaaaccaaaaagtaaggaaggaaatgaggaagagaggagagagagaatggggagggggatggggaaaggagggagggaggggagggagagaatggggaaggagggggaaatagaggaaggggcagggaagagagaggtgaggaggagaggggaggggaggggaaaactccttttgccactcagcacttccactttcaggaatgtgctgcaaaggggacctagtgatcatggcttttcacagtagctaaaatttggaggcaggaagaaaggccataaacccctgacagcggatgggtctggt

SEQ ID NO: 33771 - DNA, 1192 bp, Mus musculus
acacagtgatacttccttgaaggtagaagaccctgtttccaccttagaacagtcttgctaagatacgggatgttacccataaccctgcacagagctccgataagatttagcttccaggatctgtgactttccctctgcatgctaatcttagagtggaaaggacttgctggagcaaacctctgactgaggcttaggtaggaggttggtcagagttgaagcctcatagagatatctagtctcaggaatacaggggtaggctttgtgaaactgcaattctagcctcagtgctcggagatctagggagactccagagggaagaagtacttgactcccaggggtgcataggagttacagaaacaatacttttcagcagacaataacggtgcatcatctatctcctggccaccccatgccactcactgcgtctattccacaggacaactcccatagccatggtgactgtggggaggacttcaagcagatgtcctacaaggaggacagaggccaggtgcccctggagtctgactctgtggagttcaacaatgctatcagctatgtgaacaagatcaagacccgctttctggaccaccctgagatctacaggtccttcctggagatcctacacacctaccaggtgaggcctagcccacggcattgtttggcattaggagatgagagtggagtccaggtcctcacaaactagctacactcttatgcataccacaacccggccagactctctccgtagctttccttagccacatcgcacccccagtgatcagtatggttctggggttcaggagtaggttgaggtagaaaaagggttctggttgagaggtttgtaggccagccactggtgcagtagcagtgagaaagaatgctgggcacagcccctgagaggtccaggggtcaaaatacacagctctgattctcatacaggaaactttatgaaccactcaacagctactactaaccctaataatggtccacatttgacagcacagctctattaatgttaatgtgctggggaagcagctgtgttatgtggatgtggaaccctcaggcagtgacattgtaccagcatagcagtaccttcagggagggcacagatgtgggatactggtatggttttgtattcttgggggcaaatcagccagctgggtgcagtttgctaccagactgtgtctgaggc

SEQ ID NO: 33772 - DNA, 1116 bp, Mus musculus
gcttgtataggtgcctgggaccagactgcacttggctccccacttcctcccaatggcctgaggcctgccagaggtgccttttctgtgtcttcttttatatgcatattagtcttttttgaaaagtagagatgaaattcatgaaccttaaagtacaccataaagttcaccactgtaaagtacataattctgggccaggtggtggtagtggccaacactgggaggcagagccagctaatttcagagtttgaggacagcctgattgacatagctaattccagagtactcaggactacacaaccatgtctttaaaaaaaaaaaaaaaaggtaccgttcaatgccatgaaatctacttaacaattaaattaggacaactgtcactttcagtccttacaggttacgtttctaaaaagaaacctggtctccatcagcactcaccctgtccatccccagcctccgacctgcttcctgtctggatttgcctgctctggacacttgtcactagggtctgtgtatttagcctttgctagtgttcccttgtgtttgtcagtggctgagtagtaatgttcccaagtgtggttttttccatttcacccacttgtgttgtggacatggggtggtttgctttgggaatgaacagactgtgtacaagtgattgtttggacgcctgctcagctctggatcagcctccataggctccccagataacatggtagtttcatttaactttctgaggaacttgtgctttctgtagcagtggctccatttcctgagtcctgccaatacttgactttccattctatgttcagttgttttgtcagagatgtttgtcagttttgactgcatttccctagtgctcattgattctgttgagtgtcatgtttgtgtactgactggattttaagatagattatttattactatttgtgtgtacatgttttgtctgtatgagttttgtgtaccatatacatgcagatgcctatggagaccagaagagggcgtcacacccctggagctggagtttaccagtagttgtaagctgtcatgtgggtcctgggacctgattccaggccctctgcaagagcagccagtgctcctaaccattgaaccgcctgtctc

SEQ ID NO: 33773 - DNA, 1227 bp, Mus musculus
aaaaaaaaaaaaaaaaaaaaatgccttacagctgtatcttataggaagcatttttcaactgaggctccttcctccaatgactctagtttgtgtcaagccagccagtacaccatctgaccacctcctgtgtttgtgtctttagtttacaggcaatgggtcgtgcgagatgaacagtgggcagaagaatgaggagaagagtctggaacacaacaagaaacgctctcggccttcactcctgcgccctgtgtctgcgccagccaaggtacttgtccatgtgtgggttctccccgcacatggcagaagtggtgtggaggcccaagcagcaggggagcctgaggccagagcctagtctggtaggaaagcaccatctcctgctgacctggccatcactcgcctgctcgctctcctggttcacttgatatgaggagaggaggagggggaattggaaggatgggtgtggtgaactgctcattctccttttcactgtcatgactctttcgtaggtggggctgcagttgaaatgtgcagttgtgtggtttggttactgcacagctgaggagtgaaggtggctggcaacagttcctgtcctgctcatcacccatgatggtggatttctagacctgtcactctgttttctagttgactttctacagtaataaaatgatttggcatttctgtttatttagttatgtgcagcagtgtcgacctcaagtcacaattcactactggtatcttgacacccaaactgtcctgggctgcccttgaatctgctcccatgtcatccttttcatctttaactcactccttggggcagtatgcttcataccatgaacctgggtcaaatgcaggtccaagtctggtttattcatatgtgtgtgtgtgtgtgtgtgtgtgtgtgtgtgtgtgtttgtatgactgtggcatgtctcagagattagagaacaacttcagggctcatttgggcattgactttttttttgttttgtttttgtttttgttttgttttttcgagacagggtttctctgtgtagccctggctgtcctggaactcactctgtagaccaggctggctttgaactcagaagtccgcctgcctttgcccccccccccccccccccatgctgagattaaaagtgtgcgccaccactgcccggcgacatggttctttacacttactcattcccctgcctctcaagtccagagacagtgtcttcacatagctttaca

SEQ ID NO: 33774 - DNA, 1617 bp, Mus musculus
aaatatctcacagctgagaacaacagctagcactactagggagagccaccactagggagagacgtgccacaagggaagaaccacttcctgctggggcccagcctttgaagacaaaagccaacactgcttttctttggtttgtttccctttgtctctttggccccacaaagctgctctcttctgaagtcttggacagagacccagcccaccatgggtgcttccaggatgggacatagaagagtggaagcaaatgaagagtttaacatcatcacaaagccacagaccaagtcagggcttctggatattcccattgctttttaacagttatgggtcaaaccttagctgttgagaaagtaagagcaataaagcttcctacgatggaaatgtatcctgccacctagctgggtacccatatggacagcaacccaaggacccaaacaaacatctggagactctcatatggacattacacatgagggacctgaaggagggatgaattggttgtttattctcaaagtcactcttgttttgttttgagttgtttgaatttgggggattttgttcattttgatctagaaatctaagttttttaaaaaatctaatccttaaagctctgaaagaaaaatcaactccctcgatcaacacccctcagcagcagtggccctgcaagtcaagcacccgtggaggatgttcctgggtgaacagcttccttcatgatgaacactgagaccacctgattccaagtttccactctctagatccagtactatgacagggactacagaaatatgagtccaaacactatatgcaactcacattttctatggaccatcaccaagccacaaggaaagggcttcatggaactacttcagcactcacagaaggtatgattcccttcttgggcctatagaagaacttgaacagttcacagaagtccaatttgaacacttgtatgactacattgaagccactggaagaaatgggtcaggtatctctgtgttcttccctgcctcactgttgaaagtgagggagctgatgaacttagtttcccctcaggacctgtccaagtgttggcacgaacctcttcattgtgcatatggaagacactggacccattttctttactcttcactattaatgttgtgtttacattgatgagaacaagagctaatggcataccctgtactgggctgtttgtattgagttgacatgtgaccagcgaaagctgcattcaataaatgaagtacagactgtttcttcctcttctccctcccacccttgtaagaagccacatgacacacttggtctagaaggcaaagtcaaatctgtgcacagcacctcacactttctgttcttatatctcatctttctcttgtctaaaatgtcacctttgtttccctcccaattcaaggaaaattcagattttccatggtgcatctgtctcaccactgtagccagatgttttacattttaagtatgcaaactatgataaacagtatcattcaattgaatagcctgtctttaagggatatcttgtcctgtagagtcccatgatagtccaatcaatgagaccactacatgtggtatgttcaagggtgttcccctaaattaatacaa

SEQ ID NO: 33775 - DNA, 1179 bp, Mus musculus
gtgaaggttctatgtcccagtataggggaatgcctggactaggaagcaggagtgggtgggttggagatcagggggagaggtgagaggatagggaatttttggaggggagactagaaaaggtgataacacttgaaatgtaaataaagggccgggtgtggtggcacacacctttaatcccagcacttgggaggcagaggctggggaatttctgagttcgaggccagcctggtctacagagtgagttccagaattgccaaggctacacagagaaaccaaaaaaataaataaataaataaaaagtaataaagaaaatatctaataaaaatgggaaaaaaaagccctcttcattaattagtaaagagtggggctggagacccatctctgtccttccagagcaccttagtttaataactagtaccaatgtggcagctcacaattgtccataactccagtttttgtggagtctgatgccctgttctggcctcatgagcactgcacacagagagtgtgcaaacactcatgcaagcattacatcagtatacattaaatcaaatatgctttaggaagtaaactaaagaggatgatcttccaggacaatcccaggactgtttactgtgaaccacctttggagtaaatggcttccaagagctcactcacataaagacactttactcaacattgtctctctgagagaacattttaattttaagaaaaaaaaaaaacaccaaaaggaatcgtgacatctacatggaaaagtgaaatatttgtataaaggaaatgtataaaatctgcattaaaaagaagctcattacagaagtggatgctcacagtcatctataagatggaacacagggcccccaatggagaagctagagaaagcacccaaggagctgaaggggtctgcaaccctatatgtggaacaacaatatgaactaaccagtacccccagagctcatatctctagctgcatatgtagcagaagatggcctagtcggccatcactgggaagagaggccccttggcattgcaaactttatatgcctcagtacaggggaatgccagggccaagaagcaggagtggatgggtaggggagcagggtggagggacggtatagggaactttcgggatagcatttgaaatgtatataaagaaaataatctaataataaataaataagt

SEQ ID NO: 33776 - DNA, 1155 bp, Mus musculus
aatcccacaatacccagatgagggatgggaccagttttgcatagccttcagaaatcaacatggccccaggcagcaacccaaggcaggggcatctgcctgtcctttgatggtaacatacccaccatgctgcagggccatggactcatggccctcagtggcagtacagcccaagaccccacccaccatgaccttaggtggcttcgccagctacttacatcagtctgttcttcactactctccagtccccagttccacctctcttcattgtgtacatatccttctgcttctctttctctttcatgtcttcaccacttacttgatcatcaaggcccttgggtttgtggcgttatctcaggagtactgtgccccacctaggcagtgtggcttcaagcagggtttgtctcaggcaggtctgcctgcctaggcctgtgctttgctggactggtagtggactcaagcttgttttccactcaggcccatgacaccagactagtggttgtctctgatttgtcttgggctctctttccacctgggccatgtgacctgaactagggttatctgagggtgatctgactgcccaggccttggcaccgagttagtattcacctcaggctacctcctcacttgggccacatggcaccaggcagggctcttttgttgttgttgttgttgtttgttttttgttttttgtttttgttttttcgagacagggtttctctgtgtagtcctggctgtcctggaactctcactttgtagaccaggctggcctctcatttttttttttaagtaactaaaactaaaatatgtaatcagagtaaaattgtagaaaagctgttttattttttgccaagcccagtgtgaccatgatgggaacagagtgatagggttcctgcccctaagacagcaccactgtgaacctccacaagtatagatagctgctgttggcataaggctgtgtgtgtgtgtgtgtgtgtgtgtatgtgtgtgtgtgtgtgtgtgtgtctctgtgtgtgtgtgtctgtgtctgtgtgtctgtgtctgtgtgttagcaataatgttcatactttctaattccttcaaggtatgtcttccctgtaaacattaatgctccatgataattaagtcagtatctgacagagtctggtgttgagccca

SEQ ID NO: 33777 - DNA, 1194 bp, Mus musculus
tatcctttgagtagaggaaggacactcatttgtttgagttaattttatatccagctactttgctgaagttgtttagcaggtttaggagttctctggtggaaattttggggtcacgtaagtatactatcatatcatctgcaaatggtgatattttgacttcttcctttccaatttgtatccctttgacctccttttgttttctaattgctctggctaggacttccaagtactttattgaataggtaggaagagaatgggcagctttgtctagtccctgattttagtgggaatgcttcaagtttctttccatttagtttgatgttggatacagtttgctctatattgcttttattatgtttaggtatgggccttgaattcctgactttccaagacttttatcttgaatgggtgttggattttatcaaatactttctcagcatctaatgaaatgatcatgttttttttttcctttgagttagtttatgtagtggattatgttgatggatttccatgtattgagccatccctgcacccctgggttgaaggtccctttgatgtgatcttggattaggtttgcaagaattttattgaataattttgcattaatattcatagggtaaattggtctgaagttctttttctgtattgggtctttgtgtggtttgggtatcagagtatttgtagcttcttagaatgaattgggtagagtaccttctgtttctattttgtggaatagtttaaggagtattggtattaggtcttctttgaaggtctgatagaactctgcactaaacccatctggtcctgggctttttttggttgggagactattaatgactctttctatttctttagagaatatgggactgttgagatcgtttatctgatcctgatttaactttggtatgtggcatctgtctagaaaattgtccatttcatccagattttccagttgtgtttagtataaacttttgtagcaggatctgatcattttttgcatttcctctgtttctgtttctatgtctcctttttcatttctgattttgttaatgaggatactgtctctgtgccctctagatagactagctaagggtttatctattttgttgattttcttaaagaaccagctcctagtttggttgtttccacttgattaattttagccctgagtttgattattttctgccatctatt

SEQ ID NO: 33778 - DNA, 1099 bp, Mus musculus
gtatgtatcttaggtataggttgactatcaaatatatatatacattccaacattgcccccccccaccatcaaaagacaatcaagttctctatttcttagagccctttcagggctaatgctcagtgaatgtcttaagtcaagacaccaagccctctgcttgcatagcacattcctctatggaattctcactcctggaattgggagaaaggccacaccgtggcctggagattacactcgagacctcttcctctctgctgtggcttttgcagaccacaagggtgccagtttctcatctgttaccttttctcattgacagtagccgaaatgagcccagagctgccctctactatgctgaaaataccttgtagctgcacagctttctattgtctcttctgtcacaaaattaattcatttattcagtaaacatgtatggagttcctgtcatatgccgagtactcttctagacctcacggtttactgcagctaactacagatgacccaactccctactttctggagctggcctttgttaggaggtctgagaggaggggcgtggtatgcaatggtatgacaggacttgtcatctgtccgtggtgaccttcgcatttacagtggtaaagaacaatgagcatttggacccaaagcctaaaattctaacacccagaccacccagttagaatcagagtgaggagcttgtggtctgaagtcacactttggggtactatccgggctcaactctattcaatagtgtctccagtgagatttgagtccaaactctacccagggaccacctcataggagtatggtttcctatgagtacacaccacacctaaagcattcaccacagttggtatccacattgtcactcttagtgaagctgggcaaaccacttttcctggctcttgagtgtccccctgtataaaagaactgctggtgacagctctccatatttctttttctgattgaatgagcatcacacctaggctagttatgcctttgctctgtgtagtctgacccactaaaataaggctatgcatatttaagtaagtgtgtatgtgtatgcatgcactcacaatgacacacatattgtgtatataca

SEQ ID NO: 33779 - DNA, 1099 bp, Mus musculus
ctatgttctttcacactcacaggaacacatcactctttccaaaagcctgaagtctataagtgggaacccagagtacagagccatggttgagattgtttatgacttctctaaaagttttcattgtgtggagtggtatatactccagactgggtaggctgcttatacccagtctctgggagtgaagataagaacttatctgtatagattttacaacagaggtcttcctgagtgtctgtataggctgctcagtggttaagagtattcattcaagtttggtttccagtacctttgtaaagcatctcacagcagtctgtagctctagcttcaggaaatacaatttcctctctgtcctctgaagacacctctacacacacacacacacacccctacatataattaaaactaactttacaatatctagaaagtgttgtatatgtgccctacatgcttaaaggcccacgcaagatattgttggttatattattataagcccacttgcttttttttatttttaatctagtgataaccctgaaacttaatcatctcacttatctgcccacttactctgacctctttccatctttagggatcctgaactcactgggaaccccatatattatatatgttagttatttgagaattttatatgtgttgtgatcatattcattcctcttctcaaactcttcccagatctaccctatctactcaactttttcaaaaatttatttatttatttatttatttatttattttacactccacagtttatttccctcccagtctaccctctgactgttctacatcccataacttttccctctcccccaccctcccactcacccaccagacctgtaaacttctgggacctccagtctcttacgtgttgggtacatcttctcagattgaacccagacccagcagtccactgctgtatatgtgttgggggcctagtatatcagctggtgtatgctgactggttggtggtccagtgtctgagagatctcaggggtccaggttatttgggactgcttgtcttcctacagggtcgcccttctcttgatctttgacaaagccaaaaatatacaatggaataaagaaa

SEQ ID NO: 33780 - DNA, 1196 bp, Mus musculus
ccaacaataaaattaaaccaaggatatataacaatgttatagaaaagtttgtaaagtagtatttctcttccttccccagtagaaaagagtaaatgtcatttaagctttgtattacatgacttactttccctctgtgtcatacagaagtcactgatgtataaggtcaagtttactgccaggattcaaggccacaatgtcttgttccctccttcccagacctggttctcactgttaattttttattattattattattattattattattattattattattattattacagctgtttggtcttatgtgcctaaactacttggtgaagatttgaaagtgactgcaggcttttccatggatgtcacatagatgtttttatttcagttattgattgcatcaatcatgagaatttctcattttctcctagggaaaaaaaaaagagttattttctcatttcaaattctccctaactaacataaattataatataaggtttgcattctttatgttctcttaaggaaattttatttatagcttattgttttggatagactttactgatgttcaccttgaaaggacatgtgcctacaggcattttgagcatggggagtagcatgggggtgggagatgttaaaagttctgaagttatctaaataaatattctgcctctgtatttttctgaacacaaaatgcacagcagccaccattcctagaaacatatgccaattgtagcttacattttgctgaatttgagaagctggtatggccgacaatcagatgctcagaatgaggactttaaaaatgtctttgtgacaggttggacacacttaaaccttggtcgagtttcagagaggcgcaacttggtctttcatcataaatttgaaggcaaaaagatacatggaaatctctaggtagtatgaattgttaagtctttctgttgagttacagatactgaaagggaaaaaaaaaatcttagatgtctttttattcccttaacaaatacttccttgcttttgaagcagttgaagtgtagtgcactggagcttaaaatgtcttgggtatagagtaaaaagacttggtttaaattctatgcccttgcatgatccagcgaaagaaactttctctctgcaaatagtcactcagtgtcttgggaggtgcatgtctcaatgttgagccaagtacatatttgcaggtgctg

SEQ ID NO: 33781 - DNA, 1124 bp, Mus musculus
gttacagaatgcacagcttatcctgtgctggcctcagggcatggtatcagcatcctagtagaaacttcccggtttttttttttttgttttgtttttgttttttttgtttttcttgaacagcagaggaattgagtcctggatgctctgcttagctgtgtgagtttggataagattctcaacttctctgatcctgagcagaatggggatcactaactacagtttgaacatgttcagtttgtgttcactgctcagagtaaagaagcacttacaatagcctattgagggtttgatgtacattaaacattcataaaactgcaagactgtagattccggaacattccagagcagaaggtgctttattattcatggtttctagacagagagattgaggtacatgcggctaagttcctcctccatactgccacagcagtaggaagctgagctaggatttgagccaagaggaacttgactttaggctttcctgtgtatggtggcagaaccatttggggtttccccaagatttctcagctaaagggcatgtttctatcaagaagactccctattgcagttaatattgatggtcaacccagtggaattttgaatcacctaggacataaacatctgagcatgcctgtgagggattactatgattagcttaattgcattgcaaagacccatcctgagtgcaggcagaggcattctccagttggcatcctgaactgattaaagggtaggaagtgagctgagcatttgtttacatgtcattctgcatcctgactatagacacagccacctccacctcatgtacttatcaccatgctttccttgccactccctggggctttgtgtgggtgaggttccctagctgagacccagatattactaccttctacatgctagcttctcagccaggtccccaggtagatatgcatctgttagtgcctttccagcctagtgttccctttgacactgttgagaaaagtcaacacaaataagccctaccatgtgactcttttgtccaggaagagctcatgctcacttatctaggcgtgcctccatggagtgctggaggagttaaaaaaagaagtactcgggctgatccaagtgctttttgtggacagggt

SEQ ID NO: 33782 - DNA, 1117 bp, Mus musculus
ttccttaacaagacaagccttcattagaatcacttttagtgactttatctctacagcttctctgatagtgtggtaaggtcacaccaatattagaattcatgggaacatcccataagtgtgtcaaattaaacctagagacttctgatcttgtccttgagatactcagttggagaggttgggaaaaatgtgctgagtgaagaagcacaatagcagataacaattgagtcacaattgagtagaaaggcaatggcattgagtgttgagctgaagatggtaatgggaactgcacactggagctggctttagcctttaaaactcagtgaaagaggcaatatttacatcagacccttggatatgaagttcttaaaccattattggaagggcttatggaaggtcaggccatgtaaagttgacaaggcaaatacctaatttgaggtttgagaagaaaccagtgagagtctattagcagaagcattgcaaataaaatgaagaaaggaatacactctgctttgacccaaatacctcaccgtaggctccgtcttcagatactggcagaaaattcaggttctgacacatgaacttctgtgaacaatgctccttacctctgacttatgaacttctggaggacccactcaattgtaacagcatgcgttgtctaaagatccctggctggcattgttgccataggatagaggccaacagatgcttctgtaaacttttccagtcttaatcattggctcaacttaagcttggcattgatgttgtagatatttaacattactcatcataaaggcagcctacttggaacaaagtacacttgtgacatagccacaatctaaaaatagcactttctatttgggctgtgctgggggacaggggtttggtgacctggaacctctcttattggaagtttgtttaaatggacccagggttatagagcaaacaatcttttctcggctttggataataacactgagtgtaatacagacaattctgttcttcgtgagtgtctcctatgtcagctacagagaggtgaaagcagactgctcagagttcttccatctgggctgtgtgccacaattggagcctgctctgtgctccaccctctaccctcatg

SEQ ID NO: 33783 - DNA, 1172 bp, Mus musculus
aaagtgatttattgtgggtctctgtttaatggctgctcctttatggtatttgaaattattttatgaatacaatcctgatggacagttttaggagactcatttgttgttaggtaatgttggggactttgagccataaaatagaatgtctcatttgatagccaactagacttacctgccatgaagcccagtatgggatttgtacagaaagaaaagcatggcttatttaaatgtttgagttcaccaactaagtatatggaacaaatcacttggtaaactcactgttcccaggattctgattttcttgttatcttaactttggctttttttttttttttttttttttttttacttaaatgtgtgtgtgtgtgtggggggtgtacgcgagtgtgcacacacgcactcacgtgctgacagttctttcactgccacagtactatcagttgttttgcggttgtgtgtccccccacccccatccccaagtacctttatctcttatcaagttctcagaagagagtttgttctaggaatggagtgcaatggaggcgtttactctgcagaggtaattttggaattgcaggtaatcacaggccccggtagaatggaaagtgcagtctcacccataatttgagcctctcttgccacattatgggctttgctttggacaggcagcagacatggatggaaatggagtcctgactactggcagagcttttgcccttaacagtgccttttctgaattaccaaggccaaatggaaagaaagggcttggctaatctttccagctctccatggtagctctagagtttaggaggatttgcatagcacatggtcttgtgcgagtttctttctttgtgtttttttgtttgtttgtttaattcataaaggcatctggtcttgagtgttagtctgtagttagattgctattgcttcagatgcattgatgtatatgaataaggttaacatgtgtggctgactagaaggcatcattgcctccttcctttagtttccagaatagttgtgtggatccttaataagccaaaagtatgtaccagttttgctgacagatacagattctcatctgggagaggcatttattgttctttggaaatgcaggtggaaggataaggggtggatttttttctacctctactgtggtgactggttcttagtag

SEQ ID NO: 33784 - DNA, 1133 bp, Mus musculus
tggcccaggtctacccatagcaactagctcttatgaaagacttacaggggatgaaggaagagtctaagagactggccattccagcatactggcactcaaaggacaattttcaccaagatattggtcctgctggagtcttaaaagcttgatttagcatgtagacttagactttgttcagaacctgcaaaattctgcaagttgtttcagtacctggaaccccagagtctgttagattgcatctgtgaccttttactcataagtatagtgcatatgtaggtagtttaaggagaatggctactgtggtctaggaaaaatgatcaacacagagtctcatccttctcttagggctttaaggattgatcttcataggtgcagtaggaccaaggggtaagagactgaaggaagaaaatatttagggctgtggtcctaaggcatgaagggaggcttataaatttggggaaatccctttggtaggggtggcagaagaagttgaggcagagtattggattctgtaaggtcagtgaggcaggaacaatgacaatttggggatgtggctttgctttatgtgctgggcactgtgatgttgatatctggaaatcagtaggtagatttcagtagagttaactgttcttgcttttagtgtagcaagtagtgatttgattgattctgttttttgtttttgtttttgattttttttaatggcaaatgctttgctctgtgccgaagtcataagggttcttcatttgtctcattggtgatcagctgtagcaggcagccattcactcctgcaagttgtgtacaactgtgcaggtatgttcaaaggatgactttgaagtttctacattagtgggagtaaggaagacagcagtgtggaaaccccagtatacattgtgtatgaatagtcagtggaatggcaactggaaaaggagaatttctagaaaaggaaagcttggagtcagaaagttagtgccttgactgggccccttactagcaattgtgcctcagtctcatgctctatgaaatcaaaatggggcaagaatggttgttgggcaagttccaacagaggtagttgattatctcatattactattaaacatagacagatgttttggtgtccatgtttttctccatag

SEQ ID NO: 33785 - DNA, 1148 bp, Mus musculus
gccgtgaccttccaaggagcatctatcccggccccgcgcccccggtcccgcgccccaggcccgggcgaggccctcttcagcgcccgcttctcgcggagccgcgggcgggcggcgcaggcccggggggtgggggggagggtcaccgcaagcagctacggtcggtcccagtgctcgttcgccacgctggtctctcggtccggctgagctgcctccagcctcctgcctcctgcctcgcctcttctccgtggctggggctgccggtgtacttgcctggccgggccggttgcgggcaggccctgccctgaaggggttaagcggtcaggggcgcggaaggtgaagccggcagagctgcggctccccgtttcttcctggcgctggtttcccggatccaacccagggcggcccccaggcccttgcccatgcgaggcgcccagggcttggaagagtccttctggcgtagagcagctctcggcagccgcctcggaggaggagaaagaagggagagtgctcagtcccggcaaggcggacctttcctattgatatttggagcccaaggctgtcccgaagtctgtgcttggcaccgtcggtcggtcgggttagaacagctccagctgggatctccaccaggacccactgcacttagtaggcgtcagtggcaccacgcggttcagctctttcggagtgtacctctgcctggatgtagtcaaggccaaggtaagagccctgatgtgcgagagaaccatcgtgggaacgctttagtgagcaatgctggacaacttatccaaacctgtggctggtacccggtgtgcttaggatgctagtaaaaaggatgggcacaccgtttctgacttggctttgagtcccggaaaagcaggaggtggaagaccccaatctctagtgtccccaggatctgtctcagggcctgacatgctcttaggtgtacaagatattgataggcaagagcgagttggtgtgtgtgtgtagggggcaggttcttagtaacacctggaggtattgttttcccgccaccctgggacccttcctgcttttcttcgacgttcacctgccttttatgatgggatgcccagagaactttccaataggttgaaaagaggccgggttgggtgtatgcatccacattttccaaa

SEQ ID NO: 33786 - DNA, 1191 bp, Mus musculus
tttcatgtataaaccactgggtcatatagctaatgagagtagaactaaagccacatgcctggctctcatccaccaataaaatccattctgagtttgtaacatttctttttccactctctgatatataaaggtcattttggatttttcttcttgcataagaaaatacaggagtgacagaggcagatggtttgctgggctccccaggcaggagtaatcttgcttctctctgggtttccatgggcctttgtatatctctgtgttgaagctctaagcatattgtcttacagctggagctgggattcacactaaagtcagagtgtatcatcctccctctgcatgttccagggttacactgggccattgtgatgtatctaaacagaaaagtgtagcttagggggacttgctggctagtgaagctctgaccactgagagaagaatgggaccatagagagagtgtatacagaactcagagaaggcactagagttatcatgccaagtttttaactccaggtttggtgttggtgctgtgtgatgtgagatacttttcaggacctctctgtacgctcattttctcatctgtaaaaaaggtgaaagcaggatcttcctgtacttgctagttttatgtcaacttgacacagctggagttaccacagagaaaggagctttagttgaggaaatgcctccatgagatccaactgtaaggcattttctcaaatagagatcaaggggaaaggccccttatgggtagcaggtagtctataagaggctgagcaagccaggagaagcaaaccagtaaagaacatccctccatggcctctgcatcagctcctgcttcctgacctgtttgagttccagtcctgacttctttggtgataaacagcagtatggaactgtaagctgaataaaccctttcctccccaaacttgcttcttggtcatgatgtttgtgcaggaatagaaaccctaactaagacaaattggtaacagcatagtggggtattcctgtgacaacctgacgatgttttggggaggactgtggaaggacttttgaactttaggcttgaagatccattccttgttaagagctctgtcagatgttgtgtaggagcatggaagataatgttgagaacagtgcagaagatggaggtctggcttgtgaaatttcagagggaaaattaaagactcttttcag

SEQ ID NO: 33787 - DNA, 1109 bp, Mus musculus
atcttagggtttcattgctgtgaagagacactatgaccaaggcaaacaattggggctggcttacagtttcagaggtttattccattattaacatatcagaaagcatggcagctggcagacatagtgttggaggagccaagggtcctacatcttgacctaaaagcagagaggaggagactgtcttgcgcgtttcgtggcgcttgagcactagaagacttcaaggcctgcctacacagtgacacacttcctccagcaaggccacacctctttactagtactacttccatgggccaagcatattcaaaccaccacatacgggaacaagaattatcattcttactttgaagaatagctttttaaaataaaagtaactcttttccacccagatgattcttgatagcttgctgttttccattgccaggcaagttagaggaagtggctagccactggacattactgtactgagccagattttccgctgtatgacctacctacatgtaaccttagagtattttaacagtactgagacttgacccttggcactgaagaatgggtgcttgtagtcctgctgacttttaagatatcagctcaccagtcttgaagctactaagattcaaagttactatttgcccactctccaccttctcccagctccttgctccctttctgtttcctcttttgcctttcttaattctgtgtgggtgatctgttgcagatctggaagcaaaaggctcagtatctgcagcacaaacagaacaaagctgaagccacaactgtgaagagaaaagcatccagcgcagaaggttccatgaaagtcagaggtagcagacacttttctctactgctttgctaggaggccgggagagcagacagcttataatagaagtaggccttgatacctacgtattactgaatatgacaggctacataaaagtagttcaaatttagaaactgtaagaagtcacagacttcgctaaaaagatccagaaagtaagccagggatcaggccttctgcctccatgtaatgcaacaagcaggagaatgcaagttcaagccttagcaacatagcagatgtagtagacaagtctggactacactgagactacaac

SEQ ID NO: 33788 - DNA, 6918 bp, Mus musculus
tttctacccctaccttaatgagcactgcccagcactcctcatgaggtgaatagcactattacatactgtccacagaccatgacactgtgtatcagctgcatgatatgatttcagtgaaactagaaaacatgccgtttttcacaacactactctggagagagcagtccagcttagcccttgaggagccgcagctgaaagcagctcgtgtgttttgtccacttgttcccatctctctcctgagcatgccttgtctcggggactgcagtgaggtgtgccacagctgagtcctttctccttatttacagtcaaacacgctggacaacattgcatacattatgcctggactgtgacttccaagacgcctgggacagaagactgtctaccccttcgctagtctatgtatagatgactgttccagaccctccactgacctctgggtgtaggttttaaatttttataatctatatatacgtatataatgtacagtatatacataggatataactactttgcttttaataattttatgaaatggcaaaggtttagctaaaaggaaactttagcatgaatgtgggcttggaattatttttttgtgaaaaaaaaatctgccttaaaaaaaatcagtgtaatttggggactaggggcttattctgggtgccatgtatatctcctcatagactgctaaaatgtgattttttttttttttccaagcttgggtttacctccagacccatcactgaccatttgccttacctgtcttataatcagaaatgtagtaaagatcttgggaggaggccagctgactacaaacttttggacatggagtaacctgggtggggaggtggagcttaggtggactgggtaggggactcattccaattcctactaaagagatacctgtgtctccagttttattgtaaccacggttccacagagtcatcggtaccatctatagcctcagctatgtgattcttggcagcagagaaataaataccttgcagaaaccaaagctgttggtgccacctgttgaacctgcttgtctggccagcaaggcttggtgtataaaaaccaaagctgccatcttccactagcagcattggttgcccaacaaatcctgaggattctgctgcttagctgtttggtggttcttggttcagctctggttcccctggtgggtacattgtgctctgcattccacacagagctggatcacaaagaagttcttggttctcaggagggttatctatatgtgcgtgtgagtgtatattttaattatgtgtatttaactctttagaatttcttagattttaatttatcctgtaaatttctgtatatataatttaataacaagcctccaccagcaggagcatgtggagcatacagatttgtcatttcttaatgtctgtctaaaagctccaagacgtccatatgttaaggtgttgtgactcagaaaggaacttcatggccctcaataatgttaggaaagtgaaatagaaaggaatgtcaccattcctaatttcccttattcccaaagacccagacctgcttccccattagagagaagatagctgagtgctccagggttgcttgggaactcggtgagagattcccttccctgccaaaaccaagctgagttaataaccatgctttcttctaatggcctggatggaacgaggcagcatcacagtaaacctttggggaccatgtagccagctggcatcctagggaactccttcccatagcccgactgctgtcacagctaagcttctcacaggactgtgtcagctcagagcagttttgagatttaatctgagaaatagggaaaggaacagaaatatgtgggaactgaaatcaagcagagcagaaatttccatttgagttaacatgtcagaacctcatttgaccctgcagaagtttcctgtgagaaatggtatcaaggagaggccagggaagacatgtgtggtagaggaagcagccagtcctccattgcccttgctacagacagtagtgaactcctaaggagaaccggctttttcgggtttgttttcctctgaagcctagccctgttgtatttgtattaaagatttgtacacatttgtataataatctgtaccttgtggtatttggtactattagaggaaaaattttggattcaggccttcttgctgtttttatatcattgttttattttgtttttttaaataaatcctagtggtttgatccaaatcctattacagttgtataaagaaacaatattttgtacttatattaaagatctcatttttaatatttatagtccagtcttagctgtcttttccctaattgggctaatcgtagtcggtataactctactctaccctgacatttctctataagggagtgggggctgaagagatggttcactggtgaagaatatttcctgcccttgataaggacccaagttagatcccaacactcatccaattgaatgtaactccagtttcagaggatcagtcaccctctgtagcctccttaggcaccagcacacaagtgcatatacccacacagaggtacacacacacacacaaacacaaaatttaaaaattttaaaaccaaatcctgaaataaaggtcaagttaccatgttcctatctatcctgggccatgcagcccttgggtctcaggttgaacacaccttatatgtaaaggctctcaaatatcatttgcatgtattataaaaggagagaatatgatagttgtggcatagcaaatgaaaccatttaaaatattgctattggcctaaatcaaaaagtatccatcaatcttttgtcagagttgcatgaaaattctatgccaaaaaacagacagttcatatcccaggagctttccagagtcttgtctattttaaataaaaaaaaaatgtgatgtcacctccttgtctctgagtcaacagccacatggcctgaagtgaatatgtgctaatactgtgaacattgaaatatggaaatttgacctttcatggttaaggaaaaagttaatggaaaaacaaaatgttaaaagtcataagtagcaaaaaaaaaataataataataataaggctgcatgctatgatgcacatacttctccaattccaacaccccagggatctgagtttgaggccagacaagggatattgtcaaaaaaaaagggggggtgggggggactgcagcaccgggtttcagtgtggcaaagtcctaggtatgagccctgccaaaatggaggaggaagtgtgatggcccacagtacttgtttaatctcagattaaatgtggtgagagaatcgattcctccacgttttcttctgacctctctgtatgcaccatggaacacacacatatagagttaaaaaaaaatttaaaagtttaaaacataatgccttacaaagatacagcaaggaggaagcaaccattacggaatgccttatgagtgattttcatgtcacctcaatactctgaaagcattacattatggatatttacagctgaggggaacagataaggaaaaagcacttttccggtttgccaggtgagagccaaggcagatgaggtggcttatgaggtgaaagcatttgccacaggacaggcagttcattctctgtctcaagagagcaaaaacccaggcccttgcctcctctggctcttggagcggggagacatcaaatggaaatttcgagtccgacttgggcaaggaggctgtcatcctcagggcttggtccccaggactaaaggctaagacactaatactaatacctgtctgagtatgcgtaacctgacccaggtctttccctggccagagacccagtttcaggatgtcaagacttccaggctccacagtggcgcgcactgaagcttcaggggcgtggcttagaagccggccctcccaggccccgccctggtgtggcgtcagccacggcccaggggcagcctagtagggggcggggcctcgtggctgcgctccagagcccccgcctgccggcaccaccccgcgggctggccaacgggtcacgtggcgggtcggcggcgccggcggttgctgtcacctgattctgggagctggtggcagcggtagccgcggcaatggactttctcctgggaaatccgttcagctctccggtgggacaacggatcggtgagtccccggagccgcgcgcagtcccgcccctgtgtgccgctctggccttggccctgggacctgtcggagtccgcagtctggcagacaggagggaggctaggcggtgaggctggcgcggcgctctgggctccgcccaccctatgacccacctgattgacaagaacacgggccaatcggaagtcttatatggggattgatgcttgatgtagccaataggcagtggaaggaggcggtcctgggcggatgtggttcagccaatgtgtgcgtgctggggtccgagtagagggagaaagtttgggttaaagggactgctgtgatgagaaggcgttgggccgcgccaccaccgggcgcgcgcagactaagagcccctcccgggctggcggcgtcttgatcattcgccgcgtcaccgactcttcacattccgagacgccggggtgtctaggttcggccgcgcctctgtccccatggtcgggagtctcgggtttatgtgacgtcgcccccgtgatggtcctcgcccatagttaaagggtcatggcccagccttcctggacttgtttgatcattaaatgcattaataagatagcactgaggatgtttcctggcacatggctaacgcctgtcattgtcaacgtgttaccacctactggggctggagcccatgggaaggtgccggctcccagcacctactctcgggcaaaggccaggcggcgacgtttccccaggaatgggtggtctgggcgtgacatccatacccccttacctgaagggtcccgacggcattgtgaaattgggaaggccgaatctgaaagctaaggcttcccctgaaactgttaacccagctctgtgttgtaaccaacactgcagctgttagtagctcttttgaggttctcatcagttctctgcaagggagctctgatgcctgaagcccaggtgcttcaccataaatcgttgtttgagacctggaaagagaaggcagtcttcttcgcagatttcctatgtaaaacaggcaaattagtctggccttcaaagccagcctcaaagtcctgagactttttggataaagtcttttgggttcagtcttttaaactgcctgtcagttcaaagctcagcatctctcctgccctgaaagttgcctgccttgggcaagaaatacttctgattaagagtactgctacatcagtacctcagaacactgactaaatctcactgctggaccctttctgccttggggttcatgtcagacctatccaagactcagatgggcaggtgtagggttcccagttctctttgcaactggctgggaaaccacacgttttgaaatttcccaccagaagcagtggttcacatctgtaatcctatacccaggagactaagacaggaggattgacacaaagtcccaggctagctgattctgaaattagttgcagggtaacataagctgcagagtaagacccaaaaccaagtgaattgagacaagatggcaaagctgtaaaagagccaggtatggtggcacatgcctataatcccagcattcaggaagctgacacaggatgattttgaactcaagtccagcctgggctacagagaccctaacttaaagaacaacaacagtatcggtgttacatactcttccgtgtatagagatagaagcactggagattgagtctgcatttgtttttgagacagggtctcgcagtgttgaccaggttggtcagaaacttcaggactcaagaagtcgtctcccatcagcttccaagtagagaagacctgactggctgtgatgattaatgacaagcaggttttagctgcttgtattcttataatccaagcccctctttgctgcaggagtaaagtggtgtcttcccaggtctgctgacttcctgccctgagagtggagtctcatagaattggcatcctagaggatagcagtcattaagtggtgttaatcagagcccagtgtcactggcctcacaattcacaaacaccttgataattgctggtctcacagtctggagtgctgccatgccacatgctgccatgaggagttgggctcattcctggaagcactgggcaccatcacctcctccctaaggccatttcccaactcctcatccaatttctgctcttttgttctgtcctcaatctattaccagtaggcacaaaacagctctaacctcaagagaaatcagagatagttcatcctatccctggatcaaatatgaattgccgtgacccaagaacacagattcacatcacaccgaataagagatgatttcctgtttttgtagccacagagaacaaaagcaagctataaatcagacactcaggttacagcaaagcatgaaaatctatgctacatgtctcaggtgctagctgatgacatttctaactcttgggttggtggacactagttttctaagttacctggtaagtcacagaaatgttaggtcagacacagagatgagcaataagcagttactaaatgatctaaagcaaggtaatttgtctcaagatctgcagcattccaactctccacaatcacacggttgtaatcaaccttctaacatctttaacacaggtatagctctcctgggaacttcagtttgtaaacttgaactctcttgcttgagggaagttataagaaagctggtccctcggtgagtgactgtgcagtgagagggtatggaaagcagctcctgctctctagtattccttttccacctccatcacactgatagcatcactgtccctgcaagtctgtcttcagcttg

SEQ ID NO: 33789 - DNA, 6918 bp, Mus musculus; identical to SEQ ID NO: 33788

SEQ ID NO: 33790 - DNA, 1229 bp, Mus musculus
gcagatcctggccttggactggaactgtagcagacatgacaccgagtgtcctgtgctctgtgtgactttaaagtcatccaccccgggctgtgtgagtctgaccttgtctttttctccttcagatactgcccctgcagagacaccccgagggaaaccccagatcagcactagctcatcccagacaccgctcctccagtgggtcctcactctcagcttcctgttggcaacagtggcagtgggaatttatgccatgtaaatgcaatactggcccccaggggctgtgaactctgtccaatgtggccttctctctgtaagggagaatcttgcctggctctcttctcttgggcctctaagaaagcttttggggtccctagcccactccctgtgtttcctttctctctggaatggagggagatacctgacacagttccctcaccaaaagcacatccagccagtggcctgaactttgaaaccagcagccccaaatcctgcagcagagccccaaaactggcctgtaaaagcagctgttctgagcccagtgcccatggttgtaagcatccatgttgactgaccacgactgctgtcccccagtgccatggccactttgatatccgtttccagacatttctgtctcgtatttctgtcttgttttttattatttccccagttctaccagagtaatggtattttgttgttttgttttgtcttgtttttcctaacaaagtggggctatcttttgaggggtgggtgggaaagaattatttaatagttgtaaccttggtctctaacttctgtgtgaaataataaatggcattatctaacagtcactagaagtgcattcatgtctatgctgtctatgagcagggccctgctcatcttgtctcttcagtgtctggcaggaagagggcaggtgaaggtagcattggtagctgccatggttggctgtgcctgagatttggaagtgagctttaagcagttgggcaaagcagttgggcagattttccagactgtgtttgtgtgtacacagatgtgtgtgtgtgtgtgtgtgtgtgtgtgcatgtgaaggccagagatcaacctcaggtgtgtttatgaactgtaggatctcactatgcaactctgttggaggaactccctatgtagaccagctggccttgagctacaggtatcacaggcctgcctctgccttcatgccaagattacatatgaaagctaccacacctggccaa

SEQ ID NO: 33791 - DNA, 1180 bp, Mus musculus
ctcagttcccttttttttaatcccctaacctcagcaagcatgctgtttggctgctctactttcatccccagggctgaccacgtcttacctccctgctctgagtcccactctttctcctggatttggattttcaagcccctctgccacttggtcccaccctaccttctccattcctcagcaactcaagtgaaccatgctgttttgatcaagcaattgtgttggttctctactctgtctgcattatgagagactttccagtggtccccaagggcactgtgatctggcctgattgtatggaaccttcttttcctctctggatctttgagatttgaaagactgatatagtcctgtactcttaactttcctgagtaagactgtgtgcgtcctcctggtgctgagagctgttggtgtgtgtatgttgacagaggtcagggtgttcctgatctaggtctaggcccagcagtaggctggaggagatgccccttgctcatgtatgcacctgttccctcctaggccgaagctttgctgggtctgtcagcccacaggaagaggaggaatttcgtcgcctggctgccctccccaacatatatgagctcatctccaagagcatttccccctccatctttgggggcatggatatgaagaaggccattgcctgcctgctttttgggggttcccggaagaggtaaggggtctgggaggaaggtgctgatgacaaggctgctgcaggaggatatctgtgtgatgaggaccaggtgtgttcttccatgtctcccaggtccctcagcctgctggccctggggagcacagtgggaaactctttggtctaatgtgagagatgccaccttgaaccaaagtttctgaatgagacctgtgaaatacctgacacttagaaattgtcatatgtccttttcctcttcctctttccttccttccttcctttctggtttttttttcttttttttttttttcttttagatttatttattatatcttaagtacactgtagctgacttcagatacaccagatttcattacaggtggttgttagtcaccatgtgtttgctgggatttgaactcaggacctttggaagagcaactgctgagccatctctccagcccctcctcttcctttttctttttccttacctttccttctctctctgtctctctctctcct

SEQ ID NO: 33792 - DNA, 1577 bp, Mus musculus
ggctggagaaagcttgacttctagggtcacagggacttaagtcctagctcacttaattgctatatgacccaaacaagtgacagcctgtgcctatttcttcctctgtaaaatgagattattcctaatactaggtgcataaagtcgatatatgtacttacctagtacacaagaggcatcatcacatacacacttttctgaagtcaagggagaatggaggtggatattttttgtctgtttaaaattgtctatgatccggtgatgcatcaggtcccttgggtcataatgatatacctgtgcatctgtcttgtgctccctcctacagaaatatccagagcacgctatccgaaaggtgctgcagctcatgctacgcaggggtgagatccaacaccgtatgcagcgcaaggtgctctatcgcctcaagtgagcccattgcccatcaaccctcaagcctgaaatgctgccaccaccctatctcccagtcagtgctccaaacctccttttgccctgcctctccacctcagactgcagtctgcagcacatctgcagcccctggaaatgtactttggtctgttggcctcatactgtgtttgagtgtctgaggactctctgctctgggtgtctatcccctgtcatgccttctcaacaagatgagtctggagcaggaacaggccctggaatgtagatgggtctgtatattggctcccgggccactcactgccaagcttctttgtatgtacagaggtaataaagcaattgagtccctggctgctaaggtcagtggacccagtatgatagtagtgctgtgtgaatacaaggttgactctttcagctttcttcagcagcacctaatgtgagaactggatcattcattgagttgtctgcctcagtttcctaatctgcaaacaaatttgatgaagctgagctcagtgagtgagtggctgtcagtgaaaacccaagtagactccaatgtagaatgtctccagggctttatttatagcaagtgggcctcagtggtgtctggggaaggaaccagacgtcagggtttatcagttaaggagctatgagtacctgagcaagcttcagcacagtaggaggtattagtgacaacattgttaaaagaagacacccaacacctcgtattaccaaaatgccgaaaattatgattttagaaatctataatttataaaattaaggaaaagtcagtgaaatatttaagtatttgttatgtaaagtacatttataaatgggaagctagtgctgaaaacactgcagtcaccaacagtaaagttactgtaggaggaaggcttgagagaacaggaagtacatacacaggcctttctcgtagatggcgtcctgtgctgaaatggctgttgcttgaggtgtttgcttttttttttttttttttttagttttttgagacagggtttctctgtgtagccctggctgcctggaactcactttgtagaccaggctggcctcgaactcagaaatccgcctgcctctgccttctgagtactgggattaaaagtgtgggccaccacgcctggctgaagtgtttgcttcttactccctcctgg

SEQ ID NO: 33793 - DNA, 1195 bp, Mus musculus
caaggacactagccaacagcatgaggcttgatgtggttctctcattattgttcttatccagaactattaagagttcctgtcaatcccccacagccaaggtcgttcacaatgcaaactgctccattgtcagtgagctcatcttgttacagaagaaaagagtaccccggtgtggagacttctattcatatattagttgctgggttatcccaacaaatattcagatgtgtgtgtgtgtgtgtgtgtgtgtgtgtgtgtgtgtgtgtatgcacatgagcaagctatatgcataggtgctatgagattgcttatcttcatttttaatttattactgattcattttgcattttttaaacacttaacttctgctgcaaggtcattggtaaataaacacttcatcgtttatgttcctcagagatttattatggcatatatatatatatatagccatacactacatgacagcctttctgtcaatatgcctgattatatgggtggagacggtgccataagatgatatcacatagtggtgtttcggctgtctctgtttttatgcatgtacacccatgtttgcatgacaaggaaatcccctaaggatgagcttctcagaatgcttcccctgtggttaacgaacacatgatttattttaaaaacactataataaaagctgcatgtctatctttctgggtgttgatgtggaatatagtaattatccaattatttcatgagaaagcaagtttgtgtgcacaacatgttgacccactaaaatctcatggatatggtcttatgcatcactaacccaaggagaatctcagacttcacatcacacatttatcttagagtacacttctccaataaacacagctgcagtggtactaggagacatgacgtgtggatgctgtgtgatttgctgactaaaaccaccgatacatagcattttactgtgttttctaccttcaaattgctgacagtttggtggaagagagaaaaaaacagactacacttcaaggttttgatattacaatgagtcttggcagtagctgaggatgccacttgtaaggtgacagccatggtcaggtacacacccgttgttgtacccaacatggaccagatggactttaaattcattaaataattcattcctggctttaaattcattaaataattcattattatcatttcttgtcagaaaatatga

SEQ ID NO: 33794 - DNA, 1300 bp, Mus musculus
aggggagactggaaacatagctcagagagcacaattctcccattccagaaaatcggattttctcctctgggggaaaaaaaaaattccatgcaccctccacatctgtcaaagatcagaagtcacctctggccttggacagggtccttcactcctggagctggtcacaggaacagcagtcatggcaggaggtactggggcaatccatctaagcatgagtcggtcagaatggagacccacagatcactagaaggtttttagatttttttaaaggtaggttttaaaagtgaaaattttatacataaacagttttggaggaaaaaaaccacaaaaacactatgaatcacataagcaagacagtggcactaaaattttaattcattaatctgtccaatactgatgcaatttatggcttttttcttgccccaaatcacagacatgtgtatctctggggaacttcagtatgattgcactaaatgatctttgaatagaggccaaattaatctttcaaacatgatgatgactctcatcagtactcagtgatcatgaattcccaaaacctaaaaggtgaagcagaaggctgggacaaagcccccgtggggtcagcagtttcccacagggttcaccacgcaggcaacattaccttgtctttcaaaagacgcctgccttctgcaaggggagacccagggacgctgaactcagagggagggggctttcttacatcatttgcaatctggaggatttaatttataggtctttaaacacagtcagcttacatgcacagcaatatgaaaaccacactttgaaggccatgaacacacacagcatgcagacgagatgtttctgggggaaaggagctgagttaactctaagaaactggaattccaccttagccaggattgaagtggagaaggtctgcattagctttttgtattaatgaagttactggctcctcatgtgtctccaggtaactctgcttaactaaacagcaaagccatattctctaaaattcactgttgaatgcctgtcccaggccaaactgtctgtctgctcttatttttgtaccatattgctcttaaaaaaatctcggtttggtacaattcataattcaccaaaacttcttcatataattaaaaacactaaattagtttaaaatgaagcaatttatatctttatgcaaaaacatgtctgtctttgcaaaggactgtaagcagattacaataaatcctttactttaatcacctgttgtcctggaactggttcattcggatgcctagaggatgcctagggggacaccggggac

SEQ ID NO: 33795 - DNA, 1212 bp, Mus musculus
ttgaaatcttggaactagaaaaggccttttggggctggtgaggcgtctgcggtgaagggtgcctacagttcttctggttggttcctcaggcatgtcaggtggctcataaacactggaactcttgctcctggggatctgacacattcctccgtgggtatgtgcacatgtgtgcacacacatgcacacacaaagagaagttttttaaaggactttgttggtccagctagtgtgtatctgtgtgtgcgtgcgtgcatgcgcctgtgctaaatagagtaagtacctttgcgttaaatcccacctgctttctgccctgtgttccttatggcttggatggagatggggatctttcataatgctgaaatggggaagctcccattggaaagatttgttactgttttcaccaagaggaacagaatgacctgaaacatggatttttatcttttggccttggtttcagcatttaaaaaaaattgattttttttttttttggtgttgagtgtcagtgtgactagttgctcaagagtctagccttgagagtttgcttccgggcagcagtggtgagaggtgttggatcactctgacccccacccatgggttaagcattgatggactcattgcagacagaaggttgggagacggtagaaactgggccagtgggacatgtgttgcccctgcttcaggctgcctctatctaggtcagcagcattctactgtgctgtgacctccccaggaccaagaacaatggagcaggccaaccttggcttgaaacagccaaaataaatcatcttttaggttgtttttcctgctattttgtgatagtgtagaaagccaactaagagggatggagggagggaaagagagagagggaggggggcccttttgtctatcagatgttaccagttttgattggcagtacgttttcttgtcctttcttgtctagtgcagtataactgggattttggaatacggtgcttgcatttttctagtgcactaccactttgacctaataaatgagatctgttgtgactcgggctgcttgctcacatcctgccaagaagctaccatgaaaatgctgctcaaaagttgctgtcactgtctaggtttagtggcccagcattcaggatgcaaatgcaaacagatctctctgagttcgaggccagtctggaccatacagtgagttccaggccagctggggttaacatagtgagaccc

SEQ ID NO: 33796 - DNA, 1244 bp, Mus musculus
caatatgtaaccccgccgtgcctagaacttcctgaataggccagactggccttgaactcatagagatccactgcttctgccccctgagtgctgggatcacacccagcagagctttgaactttttaatgatacaatgaaataacaataagacatataatgcctttcttgaatctctgcataggccaaatataaaatcttccttcacttcaaaacagaaataaagccaagcatatgtctcgggaaaaaacaaaaacaaacaaacaaacaaacaaagccaagcatagtagtgcgtaactctaattccagaccttgggaaactgatccaggaagataaggagttcaaagccagtctgagctatgtagaaaattggaggccctttttttccaacatcttagcgaggctgctgtggtccacacgactctctgagcttcgccatgccgcccaaagacgacaagaagaagaaagatgccggaaagtcggccaaaaaggataaagacccagtaaataaatctggtggcaaggccaagaagaagaagtggtccaaaggcaaagttcgggacaagttgaacaatcttgtcctgttcgacaaagcgacatacgacaagctctgtaaggaggttccgaactataagcttattactccagctgtggtctctgagagactgaagattcgcggttccttggccagggcagcccttcaggagctccttagtaaaggacttatctagctggtttcaaagcacagagcccaaataatttacaccagaaacacaaagggtggagacgctccagctgctggcgaagatgcatgaacaggttcaatcagctgtacatttgggaaaataaaactttattgaatcaaaaaaaaaaaaaaaagaaagaaagaaagaaagaaagaaagaaagaaagaaagaaagaaagaaagaaagaaagaaagaaagaaaagaaaattggaggccagtcttgtctacacaataagatcctgtttcaaaacaagcacacacagagaactaagtcagaggtaaaagcacaacatgtattacactgtatcacattatcaaacccgaaagaatctcagcacaacaatgtaatacactatatcaagttatcaagcccgaaagaatctcagaatctctggcctggagagacagcccgtctgcaaagtacagactgcacaagcacagggacatgagagccatccccagcaccaggtgacacccgtgtttgtcctctgacttcacct

SEQ ID NO: 33797 - DNA, 1147 bp, Mus musculus
cggtcgtcgccgtaatgtctcgagtatacgcgcatagacatagcaggcattggcgcgcgcagccgccgccacggcgcagcccggtaccggcccagcgcacgccgcgggtctctcgggctcagggcagagtgagagacgctctctgcaaggcatgtctcggggctcgggccgccgtcaatatagctttactgcagcgacacccatgatgaggctgggcgtctggggcgcctcatccctctctcccactgcgggcctccccaagcttggccgtgtatgcacggcggcgggtcctgttagtgcagcccgtgactcgtctcacttgcgtgctcctggtgtgcctccgttttacgtcccctgcgccctggtcctcggcgggtgggcgcgtctattctgaggtgcgtggtagtgatggcggcgctcagcgaggctttcctgtcactgggtactactactcccagcccgcctcggagccgcccgagccacccctcggtctttagtttacgagtggcaatttgacttgctctgctgcatgtctggagggatcgaggaaagtgtggagacgccccggggatttagggatcgcagtttggaaagcaagccagccaaacaaataaacaaaacccacccgccctaacaaatatgaggctgctggagagggcgaggaaagaatggttcatggtcgggatagtggtggcgatcggcgccgctaagctcgagccgtcggtcggagtgaacgggggtaagtgccgcacctccgccggctgcagcgcgccggctcccacttctgaactcgtcggcgagtccccgggaggagcggccgccctggctgcggcacagccctctgtctcgcagcgggagagaggggggcttttagcaggttcttctcacttgctagcccaggagggaattaggaatggggcaggggagtgggagtgcaggttgccttttctgcgggcaatcaatgacttctgctcagtgccggagtgagggtacagaaactgaaagttactcctctcgttcttagtagcatcccatcccaagggactataggttgccaggagttctttatctatcctggaatagacctcattatccagtctatttccgactcctcccttttgccgccccccccccccaaaaaaaagtc

SEQ ID NO: 33798 - DNA, 1144 bp, Mus musculus
atggaagcgccagtttatctaagattaaaatatatgtgagaatactccttttaggtcacttactgtgataaatacattttctatattaggtatgttgtacaaagcactctttagctttttcatttctctaagaattgtgttaattatcttatttgtatagtcttacactatgctgcttttatagttgggcaaatgaggatggagaagttaacaaacctgtttcaggtcccacagctaggaattcctgacctcgtcaggacacttccatccctcatccaaaattaaaactctattattagctctactgaaatcccagtgccatgttggttcttcaccaaagtgattggcttagtacttgtaagtactaaggagtagaagtcagcactaccagaacagattgtgagtgcttgcagttactaaggggtgagatactgttctggtgactgaatgggtgagcctggtcagtaagggaagtcatgggcctacagagctctctgaagagttggctcttgaatgtgaatgacacatgttcttactcagcgtggctgggacttgctctgtgggatcaggatagcaaactctggaagatttatgagacaggatctggtggagagggtgagctcagatactgtgtggagacttggtcgctggaatggttttaccacagtggggagcagaagaaactagccagggaggaaacaactgtagttcagccagcaaatagcttgaaaaattgcttcttgtggcaagctggtggcaaagttattgctttgtggtgccccagagatgcaaagtttgattgggtggtgagtgacacaggctgtttctatgtcctgcattatcctagagttgtggttctcaacttcccaatgctctgacctttactatagtcccttgttgtgataacccccaacataagattgtttttgtttttaactcataactgtaattttgctattgttattgttgtgtccggccagcagaccacaacctgggttttagcctggaaaggcattttggaaacctggaagagaagaggggctaggtggcgagagaaaggaatgtagccaagacagttactctgatcaaggctcaaattttattgttgcgacactagttatgaaggaagggggaggggacccga

SEQ ID NO: 33799 - DNA, 1196 bp, Mus musculus
ggaaaatattgatggttccatggctacaaaaataccatttttatccttgactttgaattgtttagcctgcatcacttcgcacaatttcatttccacagaaagaaacccactttataaaacctttccagaaggttgttgtcagagattccttagaaaaaagaaaagtcccggctaaaaaaagaaacaggccagggagttggctggaccggaggcatgagcagtgtttgcagagctcagacactgtcccatagttttagtgtagccttcagctaacaattaaaactctttgtcttatcagtcatcgcccaaccctaacagatgggtgaagagttaatctgatttatattttccccacaactttctcatcacatacaatagcctgtgattaacattcagtggacttgcaagatgattgatgggccttaatggtcctctatacatccctttaaaatcatgccagggtaaagcccagggccgaggtgctccagaggacctatagaaatccaagactatttggtactctctccactagaaaggaatctgctaatattgtcatgtttttccctgccaggaccctccttgcctggtgtcatatattttttttttttttttgagctctctcgggaggagattagtctgaaacaacaaagtagccagatgtctggttctaagagagtcccagaggccaggctacagtaggcagtagaaaccgcgtggggctgaagatcaaagatacctgcgcattacttatgggcacatagtgtgtgttgttctcattattaacagtcggagaaaatttgttttcctaattaacccttttgttggaataaccttaaattttagagagtttatttcagtttggatcaattttcttttgtgtagctagttgggagtttaccatccaaaaaaacctgaaatgaaaagagctcatttgatttaaatctctcaactgttgttcttagccccagcagacgagccatcagaagggcatcatcgtcatctgctgtgaccatgggggcattgcagttgtgagtcacagtgtaagccactggtgagggtctggttggcttctgtgtgacaggggctggctggcttctgtgtgacaggggctggttttcagtccctcataacaagctgttgttttggagttggatgtgggagcactgcttcctggttttcaaatgaattgagaatac

SEQ ID NO: 33800 - DNA, 1108 bp, Mus musculus
tctaaatgagttttcacaaaattaatatttcttctttaaatgttgcattaggagctggtgaggtgggtcagcaggtaaaagatattagctgccaagcctgatgacctgggttccatgcctagggcctatggggtggaagaggagaacagagacacacagcttgtcttctaagttccatattgcaccatggggtatgcacacacgcgcacatacatgcatacatacacacatacatttttagaaatgttacattagcaccacatattgctgttctttttgagagccagttcaccagttaccaccactcaggacttggaatggagacatcgaggggcccctcgtgaaaaaataatctccagtatgtgtgttaggaaagagacgagcttggtattgaaagtgtcatttctaacttatattctaaatctgaaactctagaagaactgctccagctgctgactctgaagactatgaagggtggacaggccttgttgttagtgacgccagtgataccctttttgaggaaaagggcctggattgggtggctgatagagggccatggcagctctgcgactgcgctatgttgtgttatttccctgaagacggtaggaaagctactttactgctaatgaaaaggtgaggagagccgttgctgagggattgatccattgccctcttaagcagctctgagatctcctgccctaatggatggaaaggagcagaaatttcagagtcgagaagaagctagagtctaaaacttgaaagaaaccctagattgctttgacagaggttgtcacttccgttttgtggacgcccttcttcacacagtgccaagggagtttgtgggccagattttctcctggtgtgctgagagctttgtccatggttggcattgaatagagcgtccattaattgatcagagaaatgctagttgtatgccactaggagatattgacacgccctgtaaggaaaatggggtccttcactgccaggttttcttaaccctttaaagtcattgactttgttttaggctgtcgttcttaactgtgactctataggctattaactttctgtattcaaaaatacaaaataagcttaacaaatttgtgtt

SEQ ID NO: 33801 - DNA, 1133 bp, Mus musculus
gattttgccaggaaacatggaaggtagagtttttgccagaaactcagggtacccatctgagatggtaggcagctccctgctctctgccagatttctgacctggaacacgtgccacacttcccacataaggaaatgtgacctgtggtcacatagacacagagttctccatactgatgaggtacctagatgccctgagagtttagccaataagctcctccttcctccctacaaaaggttttgaatctctggtccaccctgagaactttgtacacatccattttccacagcggacaaccagtaatccaggactgtctcttccatcaagaacgacctttgggaacatggagaggcctttgccttcagagctgcagttaaatctcccttagaaggcccatctgtgcccccagacagctgccacatcaccttccctgatgagctaagccagagctcccagtcctggcccctggctagacaccctcctcagcccttgggtccccaaccgtccttggcctcattcaggcctgtggaccttcaacacttcatccccgactcctctctgctgtccccagtggcgcctgggtgactggggaatcagggaataccagcttcggctttccatatcttggactgtgttttcccatccccggagaggtgtctcagtgctcccctgaagcccagcacccaggtgttggttaagtgccgtcaagctcccggcatttcagcccccagcagctatgcccagtggcagggtggaatgaggacccacatgtgtgtggatgcatgtgaccttcctgtgtagaggacaggacgacctgtgggagttggttctctcctacagtatggtttccagagggcaagttcaggttgtcaggttctgcagcaagtaagtctccttgctgaactattttgcccaggtccccagttttgaccttttgtctccacgttccttgcaatccgcattgatcagcagtcattgaacaagattgagtagatgcggggtgaggagtgtctgtttggttttgctgatctcctctcgggtcatgggactgactgtaaggcatagaagcttccagatgcacttttggagacggaagggcataaccattgtaggaagtttaaggtcaagctttgga

SEQ ID NO: 33802 - DNA, 1194 bp, Mus musculus
gcctctaatgctgggaaacctttctctctacagtttctctgtagggtactctgctatagtgttagaaagctggtaacttgttttttttttttttttttttgtgtttgtgcttcttgtgactgtggatagacctcatttagacatattttcccaaatctcttagggagaagttagaaatgaaattgctgggacctgaggaatgtgttttgaattcgaagcagccttcaaacttttgcagtgtcttaggttcccagaggactgtgtggagcccagttgttctgcatccttgccagcgcttagttttagcaggtttgcatttagtcattcttgtggtcatgcagtaacatgacgtcatggatttcatttgctgcccctcactggctaaggatggacagtttttatgagtgttgatttgctacctctatgtctttggatagtgactgttcatctttcttgaccatttaaagaagaaactgaactgtcggtttctttatacttgggtgtaggtccttataatggacccaaataatttatcagatgtttgtaagtcattcttcctaactcatgtacacacgcgcgcgtgcacacacacacaaccttctcttttattattagcagtgacttacaaggggaaattcattgtattacgcttatctgtttttgtctttcatatcttgactttttgttacttaagttctcggtttacctaaatagccacaaagattttcctcccatgttttctctcagttttggctttaacttttttccttaggtttgtggtccatttggagtccatgcttaggatttgttactatgcttatggttgtaaaggttaaaattctttaaatgatacatttgtttatttatacagatgagtgttctgtctgtatgtacacctgtatgccagaagaaggcatcagttcctagcagaggtggttgtgagccaccatgtggttgctgggacttgaactcaggacttctggaagagcagccagtgctcttaactgctgagccacctctctagtcaaacttaatttttttttttttttttatgtccagcttatcaaacttgcccctggtggcttttctccgttgcctttgtacatgacatttttccctacacagcatctgacataaacacaccatctcttcttttagtttataatcggaatatacactgactatctaatccat

SEQ ID NO: 33803 - DNA, 1119 bp, Mus musculus
ttagtaagtctactatgcctgtgtgccatagctactctctgaaattatagaaattagaataacaatttctacttttatgcttctgtaagtaaatattttattctttcattaaagtgttaataaagtttaaaagggaaagtataggaaaactgcacaatataataatcataatggtagctgggcagtggtggcacacacttttaatcccagcacttgggaggcagaggcaggtggatttctgagtctggccagcctggtctacagagtgagttccaggacagccagggctacacagagaaagcctgtctcagaaaagccaaaggggagggggaatggtaacatatagaggtactggcttatatatttgtgtgtactgatacaattgcatatagggatcagatggctttgctgcaaagcatgccagctacattctgcactgtgatggcgacgctctctgcagctcttctgcaccggccacgttagtgccccgtgtgaagcaggtgctcggagctgtgcggctgaagctaagtacactgctgagtgggatgattttctaaactaaaaaataaatgttggcagtttgaaaaaaaaaaagcaaaatacattacctaaagataatgttttatacattgatggtaagtagcttttatgagacaaagttctcagtttaatcagaatttctataatcatcatcttgtaagtgtatgtcacaagtctactggcacagtgtccctcaattactaaatgcatagctaactctggcagcgtgcatgcctttgtggaagactcacatatactcaaagaaaagggcattttccccttaggtttttcccatagttgtccattttggtttcctccctgagagagctgtaggttggctcagagggatgagagctaagaatcgctgggtccaagtgaattttattcagtcagttgtacctttcgctacacttctgtccatagctagttaagtcgcttccttcccagtggatatcaaattttgctcagatgccttttaagaaacaggaagttagctgtcttgcttggtctctcatggtctcttccgtcctcctgggatttagacactgacagctatttggcaagcagctatttgtgtag

SEQ ID NO: 33804 - DNA, 1177 bp, Mus musculus
gccattttatgaccaaaagatggcatctgtagagctctacagctcttacattctccaccccacccccacctgtgtgtctgtctgtctatctgtctatacatctattcagggtctcacaatgcagccctggctggcctggaattcattatatagactaagctgacttcagagtcacagaggttctccaccaccagctatttttttctttttgctggagtcccctctccagagttcctcaagctggactccttagcatcattattttgtagataatcacctgagtttgtcatacatattctactcccaaagtcacttccctcattcagttccagatgccgcgctaactacatttctagccttaactttttttacatttgtctatgtgttttggttggttgattgggtggtggggttttttgttgttgtttggttttggtttggccttagggtttttgggttttttttttgggggggggtgttttggttggttttggttgtttgtttttaagacaaggtttctctgtgtaccctggcttttctggaagtcaaattgtagactagcctggcttcaaactcacagagatcttcctgcctctgccgtccaagtactgggattaaggcaggtgctaccaccaggttcttagggcttccagtgacttgggtcctggtgaccacagcattgttctaatatctccaaagcttagttaaaaataaaaggtagtttatgtaaacacaaaggggagagcagaatgaagctcattgtgtgagtctgttttgccactgtgagagaccacgtgtatccgttctacctaagctttatgttgaggtaaaatcttgattgtttcctagaaggacttcatgctttctcatttctctctgtcactgaggctctccccaagcgcagcctggtatccatgttctagtgcatgtgcgtgtgtgtgtgtgtgtgtgtgtgtgtgtgtgtgtgtgtgtgtgtgtgtgatttaagaagcttccctatgtgtagcccatggaggccttagactcatggcagttttccagccttagcttcccagatgctaggattgcacacatgtgccaccaggtctagctcatctttcctgttcttaaaggcttacactaaataccacttcttctgctggtggaattcactcagtacatattacttaagcctggg

SEQ ID NO: 33805 - DNA, 1526 bp, Mus musculus
aacagtggattatgtgttcacattccacagctggttccaagcacattcctgttacactgttccaaatcgttcctgttggcaagacacaacctgttacattaagcgcacttgagacatctgagaagatttatgaatcatttgacagatgttcacaacatctcttaagaaatcaaatcctatcgccttaggagccagagaaaataaacatgaggccgtgggcatgagctaatgttacatgtccacactgctagtcaggtggaagaagggctggtccagaagagcaggcaggaccttccactcaccgagctgtcaacaggatgagtccgggaactgggcaccagctttggaaaggactccagaaaagcctacgctgaacccaaacaagaagctaaagcagcatactgaacagtggtgggagcgtctttcctgagcttcctgcttagtgttggaacaggcatcacgggtctccccagcagctgcctttgctgttggtagtgggggctgtggacccacaatcaatcattccttcagaattccctgggcttttcagtggtgttgggttatgttatggttagcattggtgttgtagatgatggtagtttatgtcatagttaccgtggttggcgctggtgttatggtgttagcaccaggtcctctgtgtcactgtctcgggacttcataattctgagcatagctataacactggtgtcaggcctggcagagatccacgctgcacggcctgtggggaccatgctggggacgaggaggcagtgagtctgtttggtgagtgtgctgcctccatggagcacaaaggttttcaagtctcacccccacagccttggggctttagaggaagtagacactgtctgcctgccagagttgtagacgcaacccttccgtcatttgaacactggtttccccgccgaccacatctacctctctgtgcgtgactgcgacaaagttcaactgaagatgctatggtaactttttctcttttgctttaaaactgtcttttgttttcaaacaaaactgatttatatcatgagttttgggagctttagtaacatgtctgtggctacttctccttttacacaaatatgatagcatatttttcatggtaaggaaaaaaataaaatcaaaatttgctttaatttatgctcattaggattgaactgtcagcttaaaatactttctatgtttctgcactgccaatgtctgttttatgtatttgtttgtccaaatgtacctataaaaagaatacattagacagttatgtttactcattccaacctggaattggttttaaacggctggaactttaaggaacggcactgcagtctttacgcatgttacaaacgttaaggttctgtggattttttaaattcttccctattctgttttaaactggcacacctctggttgacgctcagtgtttatgctaaaaaccaaattttttcaaagagatggctaagtaattaagtgggttatttataatgaatggaaaatttaaaaaaaaaattctatga

SEQ ID NO: 33806 - DNA, 10390 bp, Mus musculus
cagtattaagctgaaaaaatttcctacatttactatgaactttgttttcaaaaacatggattttacttagaatatgagagtgtgtgcctggggttagcggtatgtgtgtatacattccatttggaggccaggggttgactttaatgggctctacaaagctcctcacgtgacctctcagggaagctggagctcagtgttttggctaggcgaggctagttagcaagtcccctggggcctcctgttggtgcccctagtgccagagttacaggtgtgtctccgggcacctaccttctaatggtcctgtggagccaaacccagggtctcacactgaaacaataggcccttacccaccaaaccagctttcctctcatactaggttttgttttggggtttgatttttaatgcaaaatagatgctctttgtatttctgattgtacatgaaggaactggagtcgtgggatttagcctctggttggactcgagaggactctgggccttcaaggttaatagtgtctgtagcagtgtttagctgtagaacaagcagcatgtgtacacaatacggatgtgtggcttagaggtgagcagaagatttgtttatactaaactcatgaaaaagtactgaacctgtcacagtagttaccattttctctataaactcaaaacaacataaataaaattgttgtgtagccagtggcagttgtaatttcagctcttaattaagattgcagagctaagacatgaactggcagctcagtggaaacattgacatttgctgagcaaaataatcagttgatgaatttctttctttaatctttgaaggcttgcgggtatcagctgtgaatggcccaggattacctgagtacttggcttcttgggtaaagagaattgttttccttagattattgtccctttgatttgttcatgcctcctaagagagtgcttaacttctggagtctctgttcctaaggtaaaactctggcatgtatccttacgttgccttgcacagtctgtacctttacacttttgttgaactgatgaaaaatctgccgcatggcattccagcttcaccaagtggctaagcctgcatgcatgggactggggagcagcttcgcagcaccgagtgggccgggcggacactggggggaagtcagcagtactatctatagagaaagtgtagttttattgaaaacaaaaatgtagaattggaggagcagtgagtgtttaaaataatatgtctataccagcttttaagtctcatgctacataagaggtcactgaacttcactgaaacaaaaaccagtttctagtctctataatttttgcttgagtgactagtatttttctttatttactgaatatttttgagaggtagctattgcacaagtaaagtttgtaagatatgatggccaactttgatattcctggtccagtaaatttgggtatgcaattctgttctgtgtttgactcttagaaatgaattttcaagacttttccccttgttacttagagcactcctgccataattgtaactgaacaattcaaaatctaacttaactctctggctttgagtgggtgtttagctacctgtaaactgaggataaagcagtacctgctagggctagggaggtggctgccagaaaagggtttgctgagtaagcataaagacctcaggtcccggacctgcacccttgtgaaaagcctggtatgacagcatgcctgtcttaactagggtgtcattgctgtgaggagacaccatgaccaaggcgactcttatcaaagaaaacatttaattagaactggcttctagtttctgaggtttagtccattatcatcatggcaggaagcatggcagcatccaggcagatatagtgatggaggagctgagagtttttcatcttgttctgcagatagccaggaattcacacaagaatttaagacctcagcccccctcagcccccccccccccagtgacacacttcctctaacaaggccgcacctcctaatagtaccacttgctttggccaagcattcaaacacgtgagtctatggggtcatccctagtcaagccgtcaagggccctataactctagcactggagatcagagacagacagacagacgagggcgggcgctggagggctccttgcccacccagtctagccaaaccagtaagcttttggttcagtggaaaaccctgaatctaatagaagagaaagtgggggaaagcctcgaacacgtgagcacaggggagacattcctgaacagaacaccaatggcttgtgctctaagatcaacagtcgacaaatgggacctcataaaattgcaaagcaataggacaaaacagcaaccacagattgggaaaagatctttaccaaccctacatccgatagagggctaataaccaatatatacaaagaactcaagaagttagactccagagaaccaaataaccctatttaaaaatggggaacagagctaaacacagaattctcaactgaggaggtcccggggactggaccaccaaccaaagagtacacatggaggaacccatggctccagcctcatatgtggcagaggatggccttgttggacatcagtggggggggggggggcggctcttgggcctgaaggtgtttgatactccagtgtaggggcatgccaggacagggaagacaagagtgtgtgggtgggggagcaccctcatagaggcaggggagggaggagatagggggcttctgaaagggagacctggaaaagggaagacatttgaaatgtaaataaagaaatatccagtaaggaaaacaaagaacaacaaaaaaagaaaaaccctgtctccaaacaattgggtggatagagacggaggaagactcagcatcagcctctggctgccacattcgtgtgtaagtggcacttttgcacacaccaataactgcctcattgtagtgaagtttaagtgaatccatacagtgaaggacttaggtacagtatgtctatatcactttttaggtttcaattaggattttccagagaaatgtttagatgtcagttgttgatgagtgggcctgctttgttggttcgaagttgaattaacttaaatattctgtcatatttttgtttcacaacaatttgctacaagttatttaatgtttctattctgtttttatcagtaaagtgggcatgttacgccttctcccagcgccctaacatgtggcatttatagatgtcagtacagttgttagcagagaacaagtgttcattaactgagccttggtggtggcagctgtaagggtgtcgtgtgtgacacattaggacaggtggttaggaatccctgctctgtaaacagctctgaggctgtgccctgacctgctggggctggggagatgcgtgtgagacacaggtcctcgagtcctttcatgcttcattccttacagatatgttaaaggcccaagagttttgttttgctttttggtgaataattaactttagtgtgtacatgtattactctttcccgtttctaatcagggttgttaaacatgagcctgcggaagcaaacccctagcgacttcttaaagcagatcatcggacggccagttgtggtgaaattaaattctggcgtggattatcgaggtaggattttcatgtttgatcgtaactggtataaccaaaataagaaaatgtgactaacctcttaaatgtgctcaacagaccagaaacattgttcattgacaggtttttgtttgttttttgtttgttagttggtttttttaatcttctgcctctgaggcggttcgggttgttgttgttatttgcagttcctcttatagtaaaatgcctgcctgtggtgtgcttttgacttgcagtgtttgtgaattctgtctcctgtctgtcctgaggtcaggtctgcctgagttcccggaaagtagctagggagtcatcagcaactccgctgtgcagagctgggacgagaggacacctgggttcggcagcatttgttttggcagaagagttcacagttggcaagcttttatttagccagaatcatttcacagtgtgaccttcacagccacgtaatgaagtcgccaaagatgcttttctgttcctgtagagaatcctttttaaggcgctctgggtgctgtcttgtgatcccagcactggggaagagacaggaagagtcagagtttgaggataatttcagctatctctgattttgaggcaagcctggactcaatatgaccctatctcaaaacaaaaacaaccaacctgaaaggaaatgaagaatactgaagacaaggcagaggccatcggaggtggacatagtgtcatatggttggagctgcatctcagcaactcataagtagttctgggaaatgatagcagattctgtttaaaataatgacatgcctactcttctcaaattgagatgtgctaagctgcttaggctgtctcacagcgagatgactgattcagcagagttgtgtggctatctcggtctcttctctaaagttctttaaacttttcctttccccacacattgacatgtgtgctaagcactttaatacgttgtcactttgttctctataaactctgagattttgtggttgttctcactaggaagtgaggagctagcacttactgaagcttgactggaaaccggtgttaagaaattgctgactcagcagataagagcactggctgctcttgcagaggacccagattcagttcccaccacccacgaggcatctcacaaccgtctctaactccagttccaagggatccgatgcctcttctgacctctggaggcagaagacaatgcacatgcaggggagacactcgcacatataaaatgaaaataaatatttagtaacccactaagttctagcacagggtatagtagttctagtaggagggttccacccccagcactgccaaaaggtaaggggctagagaaatggctctgcagttaggagtgcataatgctctccaagaggacctggattctattcctggtgctcacattggcagctcccaacctcctggaactccagctccaacctctggcctctgaggacacctatactcgtgtgcatgtacctacacccatacacaccataacaagtaaaatgaaatctttaaaaacatagagggggaaatcactttgtttttgtcttagttttttgacgtaaatagcctgttgccaatattttgtgtatgtttggttacttgcttttgagtcagggtcgtcctatgatagccagctatcttcaagccctttttctttctgcttgttccctcccagtctcaactcacaaacagtgaataatagtgatgttacattttgaatgaccctgttgtctaattccatatcatgcagtgcaagtttcctactcgtctctgaatatgctttcagtgtagcatagcagagaagaagcaaactgggagactgtcttaagctttctttggctaggaagttattgttcttgatagttgacagtccagtctgattctttgaaagtttatcccttctcatagaattctgttcggttaatgtcttgtgctcagattacacacacagagatttgaaaagaaacctctgtctagaggataatgggggcagagcagagagccaggagcatattaatgaagttaagatcttaaatgggactattgacttagttaattgaattgaatctgtggtgtgtttttattctcttttaaaatatcagttttgcttagagatgagaattagaagcttactagcttcatcttttgaaaaaaatcttctggtcagattttagaaatttatgccatcttaacacgagtaaaaatccacccgagctgttttccttgaaagctccctggcatgtttgtagccgtttttctctattagttttgattttaaaaatagtccaactctgacaaaacagaatgcagtgtgttgtaatgcaatatgttgctctctgttcccaagctgctcctcgctgagagccacagctctgagatggtctctcaggagcacctgctgtctattatcttaacagattgtggagacttcctcttcaccctgggtccattcatctgctgcagtagatgttgtgaaagactgagacaaactgccagatccctatttcaccgagcgagcgagtggctgaagtaacaaatgtcacctcgatggaggctcatttgtccctgcatagttgccatgtctgtcccgggctcccatagaagggcattttggttggaatattctaatgcttatacttttgtgaaggctttcaaagttgctgtggtgagcacacgtcccaggagggagtgacagttggctgcctgtcttgtggtggatgcacagctcctctcatgctctgcccgcccagccttcattcacaggggcaccgaggaaaggcaggcgccttttgtgtttaagtctattgagttttgtttacagtgtgaatttttatattatgtgtctgaaggctaatgaataaagtgattgtcagttctaagatatagcctgtaattttgaattctgtcttacttttctccaggggtcctggcctgcctggatggctacatgaatatagccctggaacagacagaggagtatgtaaatggacagctgaagaataagtacggagatgcgttcatccgaggaaacaatggtaagagcttcccttccattgagtgttcagaataggccgttcctgcgtgtaatagggagctgcggggcgtctaagtgttaaggttctctttacttttgcttgtttgttgtacttatattttaggtctttagtataaaccaggtctgtttgtgagtgggaagaggattttccatggaggttggaactagaaattctctttctcagttgctgaggggtattggtatactaagcaggcccattagaccagggacccagagggtgtgcggcacacaaccacatactgtactctcgcagtgctgtctgggagtggaagccatcctgtgccacaaaacgcccttgacatttagcctgtcctttgtcctttttctgttcaagatttaggtgccttttgtggagctttgtacctttccgtgtgtcagaagtaggacagaaggcgtggctctcaagttctcttcttaaaagccttaaaagttaggtctcgttaggaattaaatatcctgacttttgtagacataccttgcttgcagttcagtagaatttcttctatttcatgttattcttacttgccctcctccttttgcttggaaatattatgctcttaagtagcccccatagcaggagccattcctacactgacatccacctagcctgtctggtttcccaggcagtggctttcctcctattctgatggctcctacactttactgccatcctcagtaacaggtgtcattattcctactacttgtagttgggtcttaaagaggatcctagttcacttgattgaagtctgtgctggactctttgaggaaacatctactgttcactttgaacaagcttgttcgtatctgaagatgtgtgggatgggagagggagggtacaccttaggtgacagcctgaccagagccccttttgtcctatctctgtgcagcacacattccactgtgctaagaatgactggcgaaaatacatgttggatgacaccaaaggtttatactaatctcagaataaggactttgctttcttaaaaatgttttctcatttttttcctcctatggaaattatcagagtaaaccaatttacagagtaaactggggagataaacgaaaataatgccatttctttcttttacatttttttcatgtgtatgagtgtttgtctgcatgtctgtaagtacatcatatgcgtgcctggtagttgaggaggccacacaaggtcactggactccctggaactagatttacagttggttgtgaactgctttgtaggaattggggacccagccctgttgctccgtaacatctgcaagttacatctgctcttaagtgatgggcgtcgtctctccagacacatgtgctagtcattctgaatgtgacacctaacctaacagatctggctgattcgcccttttcaaaacttgtgatatagctatttacaaatcattcttacattttaggcactttcacttttctaattcccagtcataatttgtaaagtcagtaacatgcatagataagactagttataatcaggtaagatgtccaagcccggtctagacgcaaagcttgttttatagagaccttcattgcatggtagaaacagtcttttaaagtgttcgaggtgtaggccaggacccatgaatgcctttaaaactgaaccgatgctgtgcccctcgagtgactgctcgttctcttgtctttccagtgctgtacataagtacacagaagaggcggatgtgaagacaccaggaggcagtgctcttcagagatggatagatgaagtggttttggttctcttaccatcttagttggcctgttttcatggtggctggtgggggtttgtttgtttgtttgtttaattgacattggaataagatagaggtattgcattacagatcgactcttaagtttttcacatttatgtctcagtctttatcatttctgcctgtacagaatgctaaaactaaaacagtttgtttctccaggattattttacctaagattcctgccctgtcattccattggttgattacgtattcagctgactaagtggtacatcccggaacctgtgatcaagcattctggaggcatcctttgtctctttctctactcaccatccgtaccatttaaagcaggtagatagaaagtcatatggtttcagccttgggctataaagggacaagaggtcagaaaatcagctgtttatttagtcacctagttagtggtggtatctccacaaaggagtgcaactgtagagtcaggaattggaaaggtcagccacgtgaggtgagacactgcctggaagcctcctgtgcagttagactcttcatgttaacttgctccctgttgagagtgttggtgcaatggctggttacgccagccaggggaggagctctactgttcctgagaaactggctgtggctgaggtggtgcaagcccagagtgcttagactcagtttccaggcactgagcttcggctgcgaaagtttctcctgctttttgctttagcaagtggccttggggaaagggttgtattcttggccttcaggtcacgtgactcccgctgagcgggcttgtgctgtctgtggactgtgtgtgggtgctttggttgcatggacgctagggctttccttaccctccttcaatctaaacagatccctgtctcgggaggtcggacagttttagagcaattgcccggctggaggaagtggaggcagatggacagctaaggagggagggtgtgctttctggagaggtgtatatatggcatttgtctaatttaaatagtaatcagaaacaattaataactcaggaaagagaggagtaaggtttgatggtgtgcacactgaaaataaaacactttatcctaagcttcagtaattcatcacttcctgacaggggcttgcaaaggcaccagtgtgtaagtacaaatcaccaatttgctcttttataaatggcttctttaaaggagaaaatggatgtctctcggagtggagcacacatgttctcatttgttttttagagtgtgtgaggccgccaggttactgcatcccttcattcatcccctcagctgccctgaaagcagccctgctgttatctccagcagtctgtaacatcccggctctgctcatttcttccctgacctcccctccagcctgcaggtctttatttccctcttgccatttctagcttaatagcgctactgcagaatattgttttcatccatggaaccgcttttaatcaagatggactttgggaaatgctaccatttttatggtaataaccatattatgcatctggaccagcacatgttgtcccctgtgcataccttcttgtgatagaattctgaaacaaattgtaaatggtaaaattactttttttttaactgtagtctcctcgtggtctgtgaatggttttcagttggatggtagcaaagacaattgttgtagggtgaaaatttttcacttgagtaaatacattttccgtgtccctatgcccccaaccacagttgccaccatctttctcttgggccgtgacaaaacagaatgtctagcaggaaacagaacttgtgcttgctttccagactatctgccttcatattttgttttggtctgtgagctattccttggctaatcttgcagactgaatcaattcttacttcaaaagtgtttatcccaaacagagctgtagacgagtacaaatacagatggcggccatgtggtctgaaccatgttccccc

SEQ ID NO: 33807 - DNA, 1099 bp, Mus musculus
cacagacacacgtggcatcttgagaactcgtttttcttggagccttgtgggaaacacccagtattattaaggaaagagaaagagctctgtgtaggatgcagaatttgtaaaaatgctaactaaagacctttggggtttccaggagggacttctacaaccagtcatggttaccttgtgtgggtggggtggggcagagggactgtcttctcttgcctgggaagggaacttgggggtcggggaagcttgcaaagtaggttctttcctttgttctatttgactcactatttttacagtattgtagattctcactttgaagatggtttttattatcaatagatagaggctctccaatcttacagccatcttcctttcgactcatgcctttgagaagtagtaactgaaggcctactttgtacttggtactgtcccaagagatgggggacacggctacaaatgaaacaaagacctgctctccccattgttgcttgagggattacctgaagacatgaggacattggacactggccacatgaacagttgggagagaaaaggtttctgagaaagagataaacagtcacaagggcacatggcagtccaagtgagtgcctggaaatgatgtcacaggtatggaggtcatggctttgaggctgggattggatcttggtgatcacaagaagcctcgtggaggccttggttgaggctgcgaatactgggatttgacatagtcttgagagctttagtctggctgctgggtgagactcccagccagaacaaaactgcttctttggcctcagcaatgtccactaagggggtcttggtagaaatggagaagatggccaaggacccttgtacagaagaaagaaccaataaaatctgtgagtggatgaaatataggataggaatactgagaggaagctgaagtgtttggtggggttctaagctcttctcttggagatgtagaggggtgtccatttctgtcgagatggctgttttgatggaggagctgtctggttgcttggtcatgggaagatgtgcccaggctctttatctgagtacatcgaacctggtgtactaactaggttggaattcatttcaaaga

SEQ ID NO: 33808 - DNA, 1207 bp, Mus musculus
ctgtagaacaggctggccttgaactcagaaatccgccagcctctgcctcccgagtgctgggattaaaggcgtgtgctaccactgccgggcagcagtgggctttttatcaagccacttttctctgagtgtttttctcctctttctctagttcagctcgtactgaatcactgcttaaaatgagagactcgtaacatgagctattcttttttcttttttttttttttttgtctttgcctgtttagcatgtttaccttgagtcagctcttggtgtagctggctttggtgtggttctcgggtggaagggaaaagtgtgcatgtcatcgcccctcccccgccccctttgagtgtctcaaatgaactggctgttctctttgggagtaacctggtcttcttgattccctccagatgttagtaggcaggacgaggcggagggagatttcagcgaaggagagcagtggtacggaaactcctctgagactccgtcagaagcgtcctatggggaagtccaagagaactataagctgtccctggaggaccggatccaagagcagtccacatcccccgacacctccctgggcagtgccacacccagcagccacacgctggagttggtggcacttgatggtgaggttctccgagactcgctgcagtgtcaaggtcacctttcacccggagtgtcctctgtgtgcgatgatgacccacctagttccaataaacctctgagcagcaatttgaggcggctgctggaggccgggtccctcaaactcgatggcacagccaatggcagggtggagtctcccgtgaatgttggccccagtctgtcattttcccctccgtcccaccatgcccagcaactcagtgtcctggccaggaagctggcggagaagcaggaccagagtgaccaattcaccccaagtaaccgtttcatatggaatcaaggtaagtggttgccgaactcaaccaccacctgtggcctgtcccctgactccgccatcctcaaactgaaagccgcagccaatgctgttctgcaggacaaatctctgtcccggactgaggagagcctgaggtttgagtctttttcctccccgttcagctcgcagtctgccagctccaccttggcggccttgtctaagaaagtgagcgagagaagtctgactccgggtcaggagcacccgcctcctgccagctctttcctgtcattggcctc

SEQ ID NO: 33809 - DNA, 1182 bp, Mus musculus
ggatcagaaatttactcctcagctaattagagaattagaccaacctggactacatgagactctatttcagaaatgccaaacgattctcaaaacaaatcaagtaccctaaattggtactcagtgcagcattttccagtacagcttcagtctctgagtatacacctctcctctctttctgtctgagcccacgagaagggcacgatgttgtgagtctgagacacctcactggaggtcacagttgacatgaaggggacacctggctgagacatgttcattgggctctctgattttcccagatagctatgacatcagagatcctgtttgaaaatccccagcccagactggaagcctccagatactgggagccactggggagatggctctttcagtgaagtgtttattggagcaagcatgaaagcaagggtttagtccccagcatctgtgtaaaaagctggcatggtggcacaaacctggatggattcgtgaaggtcactggccagactgtgctaattgtcaaatcctcggtacaatgagaggccctgtctcaaaaaacagagtagacagctcctaaaactaatgctcaagggtgacacctgacctgtgtgtgtgcttatacacaccccaacacatatacacctagcctatatgtgtgcatatgcacaccccaacacataaacacaggaacacatgctcacacaaagagcatcctcattaaaggaacaaattacaagtctcctatcatctttttctccaagatgccatttttcaagatataaattgaattctagctccccaaattataaccaagcagctacttgacagaaacttggcaccttgcttgttggcaagcgatatcttttttgtccccggctttccaaaataaaagatataagtcatttcgactatttttaatctggaaactgacaaaaaagttttgtgctgtctcccacatcctattagctctatagaatcgtcaccaaaataattttaagtagggaaagggagggccttccagtgtcccctctcactttcagctgcacagagacagctttggaaaagacagtcacttgctcagttgttttctggcttatgagtgtctcagccatagttgttacttagacatgaaaaatgcccacaaaagtttctgtgtcatgggttcttgtttcccagaagccattgttc

SEQ ID NO: 33810 - DNA, 1193 bp, Mus musculus
tgaaggatggacaagtcagacaggatggagacctgacgaaggagccacgataatacttgacctctgtgaccaactattggattgagaaactgacaagccttggttgatagcaagaaccctttcagtttacattgtgacattctgttgtaaaaatcaactaaaatgctgactttcagcaggacttttgtgtatagttaaaaaaaaaagagatggccaagccagggacaaattatctattaggaaaaaagaaaaaaatgattgtaatcaatccttttgtgtggggtgttggcagaaggttggcgctgatagtctttctgaagtgggctttcatcaggctcagagcccacgttgaatcatcttctcatgggttttcttaatattttaaaactacttgtttagaaatgaatgggttttttgtttgtttttaaagtacaggttaatcgttatgacatgcatagtaatctttctgaaactgtatgctggctgtattactgtcagaatgatggcaggcatatgctctttgctaaatatgtatatacagaatatttggaggttatgaatagtctaaatggctagtgggtttacagagtatctgaggggcggggtcgggaagaaaacgacggctgcaaatgtagactataccgtaaagctcagcttgctgccttaaacagacaagctggtgtctgaatttgctgtgtttcagtttttgtagagttttatctgacttcttttcttctgtcttatccgctccacggcacagttaagcagctggttaattcctctaactgtgagagcagatgagtaattccttctgttcgcaaatcaactggcttcgtgtttcagtacccagtatatgaaaagcttgaattgaatgagcagtttttatggagtttacagtacagacataggctttgatttccaaataaattgtttgccaaacctggtaactctgttcattattcgcaggattaaagatctctctattggaatccatttcaaaggttgttttttttgtttttgtttttgttttttgttttattttgatttgtttttttttgtactatttggtttcttttcttctgttaatttttttattctcctttgctcttatacagcgagtacttttattccaacactagcagggtttttctctactggaaatttttaaataaaacctgtcattattgcttact

SEQ ID NO: 33811 - DNA, 1206 bp, Mus musculus
atgcaaattgcccgagtgagtggatctttgtgcccgaaaccctcacatgacctttgtccagggcttgggtgctgctgtgaacactctcttcccttcctcttgtaaaactgccaatcctgctgcctcaaggccccacccacccttataatctcatttaaccccagtgagctcctcagaggctccaagcccaaatacagtcgagcagagtgggcactacgcctttaacgtatgcattttaggagaacggagcccagtacctggcgtcatagaacacaaatgttcatgatctcagcatgggcttgcatctctctaatgaagtcaccgagttgtgaggctgaacagtgtacgccaagcatagactacctgtacaaagacagacttaggtagttactaccggacacacattaattagctaattgtggcacagttggagctaattttaaagtcagcttcctgtcttgtcttttgcaggcgctaactgggatcctcgctggaacaggagggacagtattttctacctttccaaaccgcagaccaagaagctaaggagaatctatgtaaatatactgaaatctctgttggctctgcgcccaacaccccggagctggcacctcaccctgtctgaggagcgtgtagaactagaccagccgctatgaatgtgaccagcttgttttcattcacaagtccagctgtgaagagactccttgggtggaaacagggcgatgaagaagagaaatgggcagagaaagctgtggacgctttggtgaagaaactgaagaagaagaaaggggccatggaagagctggagaaggccctgagctgccctggacagccgagtaactgcgtcaccattcctcgctccctggatggcaggttgcaggtgtcccaccggaagggactacctcatgtcatttattgccgtgtgtggcgctggcccgacctccagagccaccatgaactgaagcctctggaatgctgtgagttcccatttggttccaagcagaaggaggtctgcatcaacccctaccactataagcgagtggagagcccgggtgagtgacagagtcctgagtcccactgagatcaaaacaaaagcacctttctgtttggggttgtaattctaaaatatttggggggaaattctgtacgtatttgtacctgtgtgtgcaaaagagaaagaacgcaggcatgctcagatgtccgtca

SEQ ID NO: 33812 - DNA, 1196 bp, Mus musculus
gagtgggtaattagcagcttgtcccgagactcattttccatgcctgcttctcccctacacatctgccagggcaggcctgcagttttcattgcatttattagtagacaatatatttttggtatgttggcattagcaagacacaaaggtggagacagatgagaatctcattatgccgtatacaggcccttctttgggggcaactaacgttatcaatctttaacgtcttatgatatgtgtagttatttgttctagggattgaatccctggcctcatggatgctaaatatgtggggtacaatggaatatactttcattctgtgtttattcttccttcatcatgtgcaacttcttgaatccatacaactagaaagcaggttaacactaataacccaatttatcgtctttcattttaccactggactatgaaaaagcaagtccttgaaaccatggcttctccttgacagttggtttctgtagtcctgcgggtgcaacataggcctgtaggttagaaagggcattgaccttactcagcagtgattcctacaatctaaatgaccaaccaacccctaagacaagatgtgtccacttagtggtaccactgttatgggtgtactaagtgctctttgatttgatgtgagacctgctccaagaagagaatccatgctgagtactgcaaacctggggtgtttgtttgcttgttgttttggtttttgtttttaaagaaacttcattgttggagaagtcataagagaacaggagagactcatggatgcacaagttgctgagaataaagattgcctgctctgaagcgcaaggaacattgtggaagagggggacagaaagaatggaagagctggaatacaggaaagactgtgaaatgtgatctcgtagctagacacaaccgaagtcctgaattctcagaaggggcaggtacctgcatgggtctgcacaacaatagcccagtcagcagtcaggcctggaagaagaggggaccaggggccctactcctcaccaatgaactctttgccactgagagattcagggagaagggaagttattgtgtgcatttgtaacccactgatgaccccagcagactctaatggctggttccaatccaatggttataccagtggccatggttaaactaaatgagtcacagagctgaaagtctgggaaagacactgctattgactggga

SEQ ID NO: 33813 - DNA, 1176 bp, Mus musculus
aaacttctttctttattttatgtgtatatgggtattttgcttgcatgtatgtatatgtaccaggtatataactggtaggtgtggaggtcagaagagagtgtcaaatcccttagaactggaattacagatggttgcaagtcaccatatgggtgctgggaaccaaactttgggtttctctctctctctctctctctctctctctctctcttaattttattcacattggtgttttgcctacaagtatgtctgtgtgagagtgtcagatcttggcgttatagacgcttgtgagcggccatgtagttactgggaattgaacctgggtgctctggaagagcagtcagtgctctcaactgatgagcgatatttccagctcataataagtgctcttaacctctgagccatctctctatcccacatgaggatattttgagtttgatagttctttatagttctcagaagtgtggcacagtgttacttaaatcagttctctccgcatctggcagtgactgacatagcgtttcttgctgtgattgtccctattttgctctagttttttcaaaagaacgatgttggactcccgccctttcttactggctcttgtactggttttctttccttgttttaatcttcattcctctatgtttttaaaaaaacacattttacttatttctcttttgtgtgtgagtcaatgtgtcacagcacgcctgtgaaagtcctaggacaggctttagttctcgtcccaggatgtggctcctggggatctgacttccaggctggagaggaagcgtgtttaccaactgagccacctggctagccctctctgttcttgaatctgtaataactcttcccccagaaaagtctggccctttgttaagatgtccacactcattctcccagaaggggtcagcagagctccttctcagtgagctacttgttgccataggagagcaacaaaccccttttggtcttgttgatgtagtaaagtttccatggaacactgtaaatcttttaggctcagctattcagactggagttatatctttatctaacattaacttaatattaactttaaacagctttcaactcagtaaatttcatttaaaaattatatttgtggatttattttctgctgaatttcttactgggaaggcagtcggtcaccaagtttggcctcat

SEQ ID NO: 33814 - DNA, 1239 bp, Mus musculus
accacacaatccaacctggtgaaccagaagttttactggggttacttatgggaatatgggtgagaggttacagaaacaggaatgactcaaatgcagctgcatccacacacggggaccccagcacaggagatagctcagaaagaggagccctggaattcattagacttgcatgtagcttggtgggtcagagaacagtgactttaggcagatggctggtctgtgtctcacccaggaaacccagctggtctgtcttccaggtagcttggttggtctgagcctgtgtaagcagcgtggctgagctacctcttccaggaagtcccgatggtcaaagagtgtctttcaacaatttttcctgcctaagtaactttggggaagaaagagttcatgtggtcagtttcaggattttcctgatgcctttttttttttctgttttctttgtttgtttgttttgaaatttccctgagtcttactgagtttcctttaggatgtaatgtttttcctccctttggaatgctcagcaagacaggaaagtttatcttgtaggacttcactacatgacattgcgctccagcctgcattcagagctcagagaacaaacatgggagtctggtctctccttccatcacgaggatcctgggactcgaacactggtcatcaggcttgatagcaggcttgtttccccacacagctctccagtcacttctccctgtagcctctcttaagcttttgtagacattctgtatgaagtataacatgtgacctgagagttattaataataattagtattagacttttaaaaattgtgtttgccagtgaccacaatggaaatcagattacctgattaattccagccaacaaaaccattgaagcttatgaattcattgctaataaattattgtactgtcaaagacatacatgtgctcatctgtgcttctgacatagcacactcatcacatatttataggtaaacaaaactgttcattgtctgtcttaggtttgcattgctgtgaaggaaaaccatgatcaagtcagttttttttttttttttttaaataaacaccaggccaacttttttttttttttagattcatttatttattatgtgtaagtacactgtagctgtcttcagacactccagaagagggagtcagatctccttaatggatggttgtgagccaccatgtggttgctgggatttgaactccggacctttggaagagcagtcgggtgctctaacc

SEQ ID NO: 33815 - DNA, 1181 bp, Mus musculus
aagaaacccaagccttctgccttgtcagctagtgcattctaattctgcaactctcttttctgcaaacctaatgaagctttagtttttccatccaaaacctttgggttaggcctcttgtgtgacataccaaagctgggatactaaaaatacagtacttcatgtgctgagatcaaacgtgagaacacagcaaagctttaatgtttgtaaatcaagtagtgctcactaaagtttttcactttccctgatgtgtttgcttcacagatttgatactctttgtgttttaaaaatgtaattttaagcggtattttgaactgtatataccacggacaaaggttcctgctgctttctaggtatctttgagagtaaatggtgctgttggctgtaagggtttgtatatacacctactaaacatttcagaagcctgggtggtgctgtcaaatttctcctgtttccaaaacatgcctctaacgttgcatactgtgcttctttaattacagctctcctttatgagttgctgtatgagaaggtattcaaaactgatgttagtaaaatcatgatgggactagaagcctctgaggtggctgaggagagcaacagtgagatatcagactctgaggacgacagctgcaagtaagagcacatctcagtcctaaagtgtctttctagtgtcatccagggaaacattttcgtgtgttaaggtgtgcatccgtaaagcatttatctgcaggagaggttctttgttgctgccatgaatttgacctagtgctataatggttttgcctttcaaaattgtttttagttaatgagaatttatatgtatgtaatcgataaacacgtagactagatttgatctgtgtgtacattgtaaaactgtaaagttaccttgttttcacatccagtgatgaagtgcggttgctttggtcttcgggaccttttcatagtttccttcctttgcttctgccacctcttttagaataaggagtgcttcactgtggagttgtcacgaagactctcagccctggatatacaggcatacttttggacatccaagcatgtttttagtatgttttttttgctaattagatatattagggacatattatttaaattttctaaagaagcctcagtctctgtagcatagagtgagggtgtttaagtatttcctaaaagaaacagtatga

SEQ ID NO: 33816 - DNA, 3789 bp, Mus musculus
aactgggctcaaacaatcctcagcctaaaacactgttgtcttttaatatgcttccaacccaaaggcctttcatctcagtatctgtcaaacttgaataacgtcttctctttactattacacacgaggcagcctattaacctgtgtcttagaattgttgtatatagttcttttaatatccatagggtatatttttgaattttttggtgagtatttgttgaatttgagatagcatacagtagatgtttaagaaatagtaggaagtccggtgagacggctgtttccatcaagaactcctagcactgctgtaaatatcatggtgcctactggaagggaatgtagatgctatgcattttggaaataatctgcatctgttaaacctgcagaagttttttaatgccactttaacactaatgcactgacagattctaaatattttgtgagaaatgttgaaatgtttaacctgataggcttctctataaaagagtgttttgtttttttccctgcaccacaagctgtgtttatcactttacagttgcatgttcaacttgtcatagctggaattactgtataaaaagaactgattgtgacttgtagttcttctctagaggatgctgctagaacgtggttttgctttgcattttgtagttcttcccgtcagtgctgtgtgtagtcctgcttcttccagtctgcagtattcactagaggcgccctttgcatgttgcactctgttctcatttggaggttggactcagaccagttagcacagtattctctcatctgtgtcactttgtaaaactaactgtactctgtatttcttatttgtacatatcaatgtgagaaatctcccttttttatgttgcaattaccttgtgatcaggcagcttgagtgctatgcaaatagtaagtagtgtagtggtgatttttctttgcatgttgtgtgtgatatacctagccagaaatagatgtggcttttgttttgggggcagattactttcaaaagcaaatacaattcacttgaatttgacaaactgaagcagacaagtgttctgggtcctctgataatttggggtgtttggctgtcagctaggctcatgaagtccactgtactgtaatgatggtatttacctctgtgctattttaattaccctcgcgtctgtggaactgctgatttgagtagtgattagcatttagaaattttgtaatgtagagttttagagagagcactttgaaagataaacattttattatgatggtgctaggtacaaaatttatagcatgggatgtgaagaaaaaaaatgagaacccattgaaaggaagaaaggaatttgttgtctgcttctaagctagagtggttgtaaaggttctgctctgccagtgttcagtatcagtggctgaattatggataagaactgtagagaatcttctgtttagtccgtgctttttatgtagaattggttttatctaatagttttactatggaaatcgccttttgatattaaagccagattttagaggtttgatatgtttggtctcaggagctcaaaagaagtagctttttccagtgtcttttgtgttactgatttgggaaatgttgaaagattggacagggaagaatagcgcttggtgtcctcatggtcattctgtcttaccttagtggcttgacagtacttactatagctcctgagggaagccaatcaacttctgttttcctacctgacctgcagggcatgatggatcagtgatgaaagaattgtagcctgtggcactttgttttgacctctggtatagaactctgacttttatagttttaaaatgatcaatctttgtatgaaagtcagttttctttctttaggtatcagaagattttgccttattctgaggtcggactagggccaagcaagctttttccttcatatgagctgtcatactgtattttgacctctttctgcacgaaaaaagaaagaaaaatgacagctggaaaaagtcctttgtattggcacatgataaatcttgatgacgggctatattctgaacaaacgcttgcactgaccaaagcttgtgtttagcgtgtgtttagcataggtgctgtagttggagtgggccccacctctgctcctttcagtgttcttgctgttcaagttattcctctcagacatcctccattgtcccacgcactccttggcagcagaatgctggcagcttgtgaccctcatgtttcctgtaagtctgtttcatggtagggttcatacctgcctcagcctgacaggagtaggttttccgcaacccactgtgctgagacagttgatgtgatgcaaactattcttggagtgtgttgttttctttggcccaagggtaaactaaaatacctgtgaactgcaaacttgcttgtgattgacttggtgcaatacagttcctttctaaacgtttctggtttagagaatactcagccatcctggaaactagcaatatttattttgcctcatttactttattttcagttttagatgaggtgaaggttttctttcagttagggtacttggcaaggtccattctagtgtagctgaagaggaagctatactattttctgtttactgtattttgctccctattttatgctttttaaaaatctttcacagtgactcacttgattgagcatattgatttgaaagagctaagattttcctgcttaatgtcagccattggctctcctgataattgggactttttgtttgtttgttttttgttgttttgttttttttgtttcccctttccctaaaattataagtttagagaatcctgtaagaggggtgggtgcatgtcttaatgctgagaagcagcagctttggggttgaatttacttgaatggtttaaaaagattgcattgttacaaagctagaaaaaatttatgtatgaaaaatgatcctagccttacactgagtacaataatacttataagcatgtgaagatgtgatctttgtgatgttacttgtacaaacatatatacatatctatacatatcttttgaagtgttgaaaggaatagtactttatattctttatcataccacttttgtaagtgttgaatatattgctgtttatttttctatgttctgtttcgtagccttaagaagtgtttcaaacgatctgaatgtataaaacaagtcaatgccctacatggtgtgatgctgcattatatatacaaccgtgtgcatatattaaattctgtttgtcgagtctgcttgggattctttggtctttgggtaacccaatatatcatatgtaaatctgaggatgaatcttagtaaactcttgaaaatgacatggtttccatgtatgtttcatgctggaagatacttacagtagaggcaactgaaagtgggattcataccttattagtgctggttcccttttatgttctgcactgcaaaggttagagcagttgatggagctcgtcagtggcggcgtatgtaccggcagtgtaagtggctggacgagaaaggctatgtatgccccatccctttcagtacactcaagagggatgcagaagacccaggctgtgtgtgtgtgtatgtgtgtgtgtatgtgtgtgtgtgtgtgtgtgtgtgtgtgtgtgcgccccatccctttcagtacactcaagagggatgcagaagacccaggctgtgtgtgtgtgtatgtgtgtgtgtgtgtgtgtgtgtgtgtgcgcgtccccagtccccaaaagttcaggaaggtgttttctaaagactgaacaaattggaaacagaaataatgttatcagattaactga

SEQ ID NO: 33817 - DNA, 2381 bp, Mus musculus
ttaaaataaacattctcctttgcttattaagtcacttctgtatgctgggtcattttagatagtaatagagcataacactaatgagaagctagctgatcaggtgggtaagcgcactattactattctataaacagtgctaagaaaatctaattagttttcaagctgacaatctgttgccttttgtaccaggagcttaaaaatgggatttatgtttgtgtacaatttttatgcattaaagcgtcccacagagcgcatgctctagtagagcagccctgcatagaggacaaatgctcactgtgtcacttctctttctttttaggatgtagaacaaaagaagagtggaaactactttttcttggatgattagattgagtctgaacttataagccatttacttactgggatttttatcatataaaactttaatcaggttttatggccccacatactctggagcttgaagtatgattttcttaatgtgacatcaaaaagccagttgtcttgtaaattgttgtttaagaactattttgttcttaagattaaacctctgtgcatactacatgaacatggagacatttcagattatcagttacctccagattttcacaatctacggggagattttcagttgtatattatattcatgtaccaaatgcttcctggtgttgcccatctttaaaatcttggataaaatctgtacttacctgtttgctaagtgtaccagtataacagaactgcccccttctaaaaagccagtcacagacttgctgccaaagtctgatacataagcatcagggctatatttgctacttgtgttcagtgtgtgcttccaaggaacagtgtctgctacaaacaccattgttggaagatgttgatgaccaacttatgcattgtttttaatgagtttttggtgcttttgaacatctgtcaaaatttatttcagtgccctaatttaactttttttttttagttcttacattctataacaacattcacagtaatgttacttttataaatatataatcactgatcaagattagggaggaggcatttctgaagactatttgcttcctgcagaactataggcttgggctggggagatggttcagtcagtaagtacaagctgcacgctcatgaggaccatatttgagactttagtagaagtgaagtccagcagatccctaaagcccactggcctgccagcctaacacagtctatgagcacattcagtagaaggtcctgtcttaaaagctaagtggacagtaattgaggaagacactctggcaccaacacacacacacaaaacccaaccgatacagtctttatagttggtgcctaagtatctggattttagggtttcggttttaattttgttttgagacagcttgtcgtcctatagcccaagctggcctcaaattaggtatccaaggacaaccttgaatttctcagcccactacctaggcttggattacacagtgctgaggatcaaacccagggctttgtgtgtgctaggcaagcactctaacaactgagctacatccccagccctacatatttagactccagagtcttctgttgagcaaccaaggacaacctaaaacaacttctccagtgagtgcagggaaatagcaatacaaagtgtccattgctgcagtgcatactcatttgttggatacaaaggacattatccacattttactaatatgccaaactggaattatgaggaaggtggattacaatgaacagggcaggcagaacaggaaaattagaaagtatttgacaagactttagaactttaaataataggtctgattaatttgcagacaatgatagaaagtttgttttgactgatacccattaggctttctaaaaatgaatttatataatccataaatatgtatctgttgtaaaggaacacaaagtatatggaataaaatctccctttatcagtttctgagcttaccggtgtgtggtcattctttccttcactatgtacttaatcttgttatgggaatatactaaaatatatttgtgaatattacagatacaaagttcatccaccttaatgctaatgacaatatgtgaataagagtatttttgtgcaaatgaaatttgaaaatacaaaatcagatattaaactttttttgacttctttgagacaggtttctttatagattggctgtcctggacttaagagacccacctgcctctgcctcctgagtgctggggtagaatgcacgtgccaccactgcccagccagatactaaaactttgacatagcagtaggaaggcctatgctgctaacaggagtttgtcaaagtgcagagtttggctatcaaaaagagtaccactggaaatctgtaatactgaatgaacaaagt

SEQ ID NO: 33818 - DNA, 1316 bp, Mus musculus
ggatgtcctgtttcacatacatatatatacttaaaattaatcttacactggattaagggaattattttggtttggtggtagaaaatgaatttttctgagacaggagctcacactgtaaaccatgcttgtctcacagtctagcacttgccagctcggctttctaactgttggactataggcattaactaacctctgtacctggcctgtgttcattgtcgaaacacaccaaaaaaagcactagtttttgcatatgtgcagacttaatattaacaaaggtacaaggtatgtatgtatgtattcccaaaaatcagtctctttttttggttggttggttggttggttggtttttttgttggtgtgtgtttgtttgtttgttttgtttctcaagacagggtatctctgtgtagccctggctgtcctggaaatcactgtagaccaggctggcctcgaactcagaaatccgcctgcctctgcctcccatcattattttagatttgtttatattttctttagatctttactaatctcatggcaattttttcccaacaggcataaatatatttttggatggctatgttccaacagagaacctgaggttcagggatgcgtcgcttgtttttaaggtagctgagacagcaaatgaagaagaagttaaaaagatgtgcatgtataaatatcccgggatgaagaaaaagatgggagagttcgagctagcaattgtagctggagagttcacggactctgagatcatggtgatgctgggggagaatggtaagctgtggtttgtgatgctgaaagtcggctctgtgctaacttgtgctcctggggaactgactcgaggctacacccgagtttaaatccttacagttactgttttaacttcacagttttgtggtatttactaatattgccccactgttgttgaaacaggctaatcattattttcactaaaaatatgcagtttctgatcagctgatttttctgtgaagtaaactagtaagcagtcactcctgcagagggactgaagcaataggcaggtggtgactcagtcaggccagctttcatgatttccttggataactgtgtttagaatttttcttatataaaattcagagcactctgtttaccttcataaatgttttattagtggctgggcagtggtggtgtacacctttaatcccagcacttggtaggcataggcaggaggatttctgagtttaaggacagcctggtctacagagtgaattccaggacagccagggctacacagagaaactgtgtctctagggaaaaggaaaaaaaaatggagattgcaa

SEQ ID NO: 33819 - DNA, 1125 bp, Mus musculus
tgcactggaacaataagttcctcttgctttttgcatggatcctggctccatgcagttcattcggggtccccaataagctaaggctccccagagtcttatatcacctcagtagcattttgcctgatttcacatcatgtgtgctctgcagctcccttcctgttccttaatccctgttgtcccctcctgtggtgttccccatcctggttatgtgatacccacatatcttcataagacacttcaagctaggttccacatgtgagagaaggcagacagtacttgtcaggtctggattattttgctgtcttagtgttactattgctgcagtaaaacaccatgaccaagaaggaagctggggaagaaatagtttatttggcttacacttccacagcactgtttatcatggaaggaaggcaggacaggaactcaaacagggcaggaacctggaggcaggacctgatgctgaagccatggaagaatgctgctaactagtttgctcagcctgctttcttatagaacccagaaccaccagcccaaggaaggctccacccacagtgggctgggccattccccatcaacctttaattaagaaaatgctctacagggttgcctacagcctggtcttatgaagacattttttaaattgaagttccctcttctcagatgactgtagttcatatgaaattgacataaactcactcaatatatttttacatccatcaatttttctgagaattatattttcctttgtgcctgaataaaattccattgaatacatatacattctcataatccattcataatagtgggcataaaggctggttctgttttcttgctattgtgaatagagcagcaataattagggatgttcaagtgtctctgtggtagtttttatttcacattagtaatattcacatgtagttacttcaccctgatttttaaaaaacgatcccattaaaataatacagtctttgacttacagcttttcaatttggactgaattaactagcccaatagtagatgggctattattaaataacttaactaatattaaataactgaattaaaaaacaacaggaaaaaaagagtagaatgttctgtaagttcctgctcttggctctgcctctc

SEQ ID NO: 33820 - DNA, 2032 bp, Mus musculus
ggctcacaaccatctataatgagatctgatgccttcttctggggtgtctgaagacagctacaatgtacttacatatattaaataaataaatcttaaaaatatactagaatattaaacatagtagctttacaagttctgtggtattctaagcttggattcactttcttagtaatgtgttagcagtttgaatatttcaggaggaaataggcatcttgctatttaacagcaataaattatttggagatttgatagtggttttgaaagatttgttgtctagccctggagaaaagtctcacgctgttactacttacatgctgcatcatgtttggcaatattttaatttttgtatcatttttgacttgtcatgagaactaattgttgtttgtttatagacacagaaacgtaagatggacggtgcccctgatggccgtggaagaaaaaagaagctgaaactatgaatgcatttttgtcttataatcactaactggtagttctttaatttacgggtcttcataagatgtgctgtacagtgctcaactgttatgtcattcagacatcaggtccatctgcttactgagctagaaacatagtatgtagtttcactttttttaaatgcaacagctgtgctgaaattttttttatcattaacaattgaagtaataaaacaggcttcatttattaataaatgtttcatttgatttatttttctaatagtttcatttgtgaggattgtggctttttatcagctactttaacacttgtatggcttaaaaacaagcaaacaagtaaaaaaatactgcagataacatttgattggtcccttcagcttggttgtgtaattaattacttcacattctttgcctttgctgatttttttttttttttgtggtactattgagtctcatctggaaagattgtaaattgcattcttgcttattatagaatggggaagacaagtattaataattttctatgcatatttctgttatactttctgttcctatggttctgatgtgaatgtgtcctattttgttggatgaatggccttttttagttgtatagccaaagacatttagtattttctggttctttaaggtgatgtattattttgtaaaaggaatttttttaagtatttggaaaatattttgacaaatggccttgcagcagccacaagataatgtcagaagtaaggtgatttttttttttttaaatttgaatgacccagccaaaatgaggtttgaatttgtcatactgttataatactaatagaatgtaccctctcagtttatagtatttttgagtttttagagtaaatgaaaattttattttattatattttaaaaataacttctaagtcttagtagcaagatggagtataattccagtttttattttctatggaatagactggtaaactggagaccctgaagcaggaatacccagaggcctttatgtgctacacatcatttgtataaagttttatatgtgcaaattgggtacataagcagttctccatttttctaagggaatgcaataaatgtagcatcgtgaataaatataacttttataatccttaaagtggtcttttctttccatttctttgaatttttttccccatttatttaactttaacctttgactataagagagtctatttttcttagacctctatgaaacttaaattttgtgtgtgcatgagtcactgaaaagactgatgcccgtattgtgacagtcttatttgtcttaaatgtaggattgctggtgtgtcatgcagatagtcttgggaaattatagagtactttgaattttcatgttctcggagttaattaatattgaacatcaaatgtgccctcattttggaagaaataattgaaaacattttaagatggaagaaaactctataaacaaggtcacaaaattgaggtttggaagatggaaagagattgggaggtgctgtgcagtggaaggaagtagaattgagcatgatgtatctgttgagacctggagatttaaaaatagaagtataaaggga

SEQ ID NO: 33821 - DNA, 2474 bp, Mus musculus
gagggtggattacgttgtggtggaccaacagaagactctggccctgaagagtaccagagaagcttggacggatgggaggcagtccacagagtccgagacacccaccaagaatgtgaagtgaagacatgccgtcgcctctgccggcagacgagatctgagtggaaagagagatgccaagtgaagatgttcccactctcagtggagcctcgagccagcaggggcagagagaaggatctctcacacatgttcaagcaaattaggttgtgaatggtgctgtgtggtattggatttataacgtgtaaataacccggggaaatagtgtttttagttcacagagaagcttctgtccctaattaacacacctgtagtattactatactgatgcacttttcatttaaaaccttggtttgggtcttcccgatctaccttaacagactttccttgggaggtcttttggcctcctcacactactctatataacaatactaagtgaactgagctacttgtaattctggaaattccagttgaagctacagggctaacaccattaaaacaagaagtaagttgacacattcgcttttctcttgaaggtggtagccattagcttaagctgtagaacatagttggacttgtccttcgttgttttccaaaaattccggggatattgtatatagcaggtcaagacctagctctctgactcatgtacacttaggttttaactgtaggactttgttattattattttttttgttaatgacagtgttgggttcatcgtgtgaaggttctgctgggtaggatcttgcacctttcaaagactgcctcttagttacactagtaagcccccaaatcatccacagcatggactgctggcctgctcttactcctgtttatgtgttaaacattatctgcaaaaggcagattatacgactgaccaatcaggtacgtacaaggcactgatgtgctaatacagtgattgggtcagacaaagtgcttcagttagtgtgcgttcgtcctaatcttggtttagaattaatgaaacagttggcgttcactgtcagcagcatagtgtgattttgaatgaattaggcaggaattcaagattactactcttagctcgctcgctctctctctctctccaccgtagtgctcttcctagggttttctttcttctacttaatatcttcttggccttatatttaaatccctatgcaattaatgttttatatctgcgtttttaaaaaagaaatgtcattttaagtgattcttgtatgtagcaagcacctattgcttttgtgagtaaatgaattaagacttttgtactgtgatttgtactcactgccccagttccccaactgttggagccttgctgctgtgaaacgctgtagtcaccatagttgtgtccaccacccagccgggtctgtgagtctcacctgtcacgtgacatcgtctggtgtggatgttggctctgaattagtgtcactgcagttacacgtgtctgtctaggctttgcaagatgctgtagtcaccatagtcgtgaccaccacctagccaggtctgtgagtctcacctgtcacgtgccatcatctggtgtcactgcagttacacgtgtctgtctaggctttgccgcaaccttgagaagcagctagcattttccgttgttcacacagtaaggacaatgtctctgcattgatctgaggctcactggtggcctggggaagggacacagagaacagaatgtctgcagctgaggcttgtctctcttcgttcagacctcttacctgttgcctgagtacacaatgcaccccgctttctggcccactggccacggtgctgtgcctaatctgagttctcccctggcttttccagtcagtttgaaagctgtgttcataactagatgaagtgtagaatagtaatattagatgcttttaaatgttcgcttctttttaaacaaaaactaaaacccagaactgaattttgaggtggatttttaaataaaaaaagattgagtttgctgtgtgagctgtgttacttttttcttacttttaatatactttctatttttttgagcaagcaacaagtgtcaagaaaacacatactggggttggagagatgattcagtgattaaaagcactggctgctcgtaagaaaagactggatttcagttcgagcttgacatagcctctcacaggcaatcataattctggttccgggagtctggctcctctcctggcctctggacactcactgcagacgcgtgcacagacatgcatgcaggtgaaacacccacacacatactaaaaatgttgttatgtatgtattctcttgggaacatgacacgtagagagccagagagagggcccagtgcttacagcacgtgttgcttctgctgagaccagggattcatggtagatctcagccatccatttctccaggtctagggacccagatgccttcttctgacttcctttggcact

SEQ ID NO: 33822 - DNA, 1157 bp, Mus musculus
gtaatttggattaagagtaccaaacagcatgcgactgggaaggacgtgaggatggagggtcccaagctagcttggggcaagctagttaggggatggttcagagaggaggactgagctgagttcggggtggcttatgtgctcagaatagcatctgttacagggccaaaggcggaaaagaagacacaccgaagaggatggcaaacctttgaggagatacaggttgggttattatgaatttgagctctctcccatgtagacagcagacagataaccagtaagcagagggcaccgatatcagaggatggtacatctaaagattcactaaagttggtactacattgattattgggcttgaaactcgagtcattgttgtaagacatgatggccacaccgtaagttgttatgtaattttctcagctaaccttatggatactgtttcattatcatggaagtctaatagttaaaatggtttttcatgagatttttatttaaagttgatttgagcatttgctttgaaggtttcaagaaaactcatctgctttgactgttactcaagcaagactgggaggcagtgtacagctgtctctggggctcccgagacagcagggtaaaaataggacaaactttaagaatcccagatattctcagataacaaagactggtttattggggccttttttgtgcttggacaaaacagagaagcctttgtgctgtgattagcaagggtgctgatgacagatctcctgtcaagcatcaggctttattctatgactaaatggtgctttgtcccgccatccagagaacctttgtatgtgccttgttaaagtgtgagtttatgtaattgcttttgtttttcccgtttcattggtgccagattcaatgagagtgactcattttgtgaccgagacaaacattcacatttagaccatgttaaaaataaacaaacaagaggcaggtgctgcctgcctcggttctgcatctccgggctgctgtttcctgtctcaggagttcaggtctcaggtagtggctactactcagctcccgtggtcactggtccactgtgccccagggcagtttctaaaggccttttggatgttggtgacaggaaggtccaaattaggaaatctggttagatgggaagtagaaagtgatgtgta

SEQ ID NO: 33823 - DNA, 1206 bp, Mus musculus
acatgtgcatcagctcactgtgctcttgaagagtgtcttcctatcagtacctcatttgcctgctctgcaaacggaggctaatggcaaatgttcgattggactattgaagtccagcagcctctgagtcgtgtagagtgcagagaacacgcctacagtgttgtgcagtgaagctctttgtgttgttagagctcagtgtggaccaggctttaaaatctcatgggccgacagcaggcttcttagcagctaatagctcattggaggaaactcttgcttccgaacactcaggccttggccgcctctttaacaagaggtagctgttctcttagaagctgccctggtctttcttctcttccctgctccctgcatccactctggctggcttttgttattaatgtggagcagttgaagtcattgacttgggtgaaggccaggcagcattactgaagtcatatattactttcctggactggccatgagcaggatgataggagtcgggggccagggaagccgcctctctaggcagcccacatgaaaggtgtgtttgttttctccatcatatttgtgtaagtagatctgaagcccattcactgtctctagttttccccacgggctgctcttctctgcttaggctgactactcctgtgtgtgtcgcatctttctttgtcctttgtgacgtcattgcacaaactcctgtctactaattgcaggtagaattgttgagtgagcctggctgtatctgtaggcactttataatatgctaggtcaggtctgtgctttggtgttggcttttgtttttctcatgttagtggaatactgctgggagagagtccttagtgacagtcagtgaaagtcttcctcctcggagtgtggttgaagcacacacttgtttgttctgctctggtatttggggcctgggaaacggcagcggaatgttattaggcattttcctgaacttcctacctgctctttgctggaatactccttgtttggctctggaaaggttccatgctttgatgagcacagacgctcgggggatcggaggctgttttgatggtctgttggcatcatgaaaggagatattgtttgccaggggagatacagtctgggaaagagtgctcaaggatcgtgtgacctcagagtgagacagaacagtggtctttgcctgtgccattgagcttttaaaaaattgtttgtaactaataataa

SEQ ID NO: 33824 - DNA, 1147 bp, Mus musculus
ctttgtcttttctatccagacagtttcattgttatttctttaacagtcctccattggctcagctcacacttactgcacagctagtgtgggcatgatttgttcttggtgcccagtgtcagacagaggcatcttgaagggtaacgactgatatggagccagtgaatataaaacatgctgtctgccagccctaacagtggagacaaagagcagttaaccccggtcacgagaaaactgtggtttcaataaggtttcaattccttatgcctcaaccaggtgatgcagttgccaagaagcccagccggactgcctcatcaccctgtggatgagtgatgagagccaagaagtcccacgtactttcttcctgtcaagcaagccttagagtgcttcggacagacagcagcaaactaggaagtgtttataaggtctctccattgccaccttgaagaaagccaccatgtccctggttctgggctcagcctttccagttagatcaaattgatcacacagcatgatttcagtcccttaactgtgcgaatctttctgtgtataattaatatcgcctcttaaactgctgctctcagaaggcacctggtgtctccaggtgtggtttcttctaatgccttttgactttctttccttgagctaggttttgttttttgttttttgttttgttttgtttttacagatttatgtatttattatatgtaagtacactgtagctttcttcagacaccccagaagagggcatcagatctcattacggatggttgtgagccaccacgtggttgctggggtttgaacctaggaccttcggaagagcaatcagtgctcttaaccgctgagccatctctccagcccttgagctaggtttttgtttgtttgttttgttgttttgtttaattaggcagttgacgattgaggtacccgtaaaagaataaaagtagaagaatgctctggttggttctcagtgtcaaagtattgctaggccgcttcccttgttcagtttattcctgtgtacagtatagtaacttagatttctctctcttaaaattataagttctttgctttccacactttattttctgtcaggatcttatttttttaatttgtttatttttatgtgtgcatgtttggctttttatgtgtt

SEQ ID NO: 33825 - DNA, 1489 bp, Mus musculus
gcctcccaagtgctgggactaaaggcgtgcgacaccacgcctggcttctatcacttttttttttcttcgaaatatgtgctgtcactctgtagctggggctggcttggaattccttctgtagatcaggccagacttgaacttttgagagatcgacctgctctgcctcctcccaagtgctgggattacaggtgtgaaataccacacccagatttttaactttaattttttaaaagtatcttaggagatatttggtaagttgacctttgtccagcaggtttgaagctttttctgggaggcagactttcttctgggaggttttgtgtgtgtgtgtgttgtgcgggtgcctatgtaaacccataaatgcttctaccaggacagacagggtaaactatggcccctgtagagtgatgctcacattataaagatgccatatctgtagcctgggatctgtgtctgtccttgacacgtgatcaagaccaaaactttgggttctaatattagaattgaaagagaaggcttctagatgtgttcatttgtactgttttgtttgtttgtttttgtttgtgtgtgtgtgtgtggggggggggtggtgatgagatacaggtgtccagttctcatttcatgaggcgggtttgaggagcactgctcatcggagggcctctcagtgtgaagggtgtgtgggatggatggctctgtggtgaggcgcctttataatctgtacccagtatgatgctttcttactacgtaccctctcagttcattttgcctccttcttctgtccagtgctagggattgaacccagggtttcacacatgtgagacaggcgttgtggctgcactcccagctcatgcctctttgggatggagtgtttccggttagagacagtagctctgacctatcaaagactatgaattgaagctgggtgcctgtaatcctagcccttaggcgggcgaggcaggaggatcggtggggctttgagggtagcctggaatatctagacagaccttgtcaataataataataataattattattattattattattattattattcagcaatgacggtacatttactaggctcaccaaggggctatagaggtgtctcagcggttaagagcacttgttgctcttgcagaggacctgggttcagttcccagcacccacatggtggttcacaaccatatcatccaggaaatccaatgcccttttcggggctctgtaacactgtgtgttccatatacacgcaggcagaaacactcacacacagaaaacaaaacacatctaaaacataattgaaaaagtagactcaccagaaatggggttccccttcccagttgagggctttactttttcttttgtctcttcaaagcctgttcttaatactttcaatatagggtctcatggtgcccaggatggttttgaactcctgattctcctgccttagccttctcatttgctttgtatgtatcaccacaagacttactta

SEQ ID NO: 33826 - DNA, 1197 bp, Mus musculus
ggtttagtccattgtcttcatggcagggaacatgctggcacgtaggcaaacatggtgctggagaagttgagaatattacatccagatctacaggcaacaggaagagagagccactggacccggctcaggcttttgaagccggaaagcttagcgtggtgacacacattctcctgcaaggccacacctcttactctttctctctctctctctctctctctctctctctctctctctctctctctctctctctctctctctctctcgttagcagcactactccccaatgacaaagcattcaaatctatgagcctataggggccatccctattcaaaccaccacactagtaataatgattacaatcataatcagaattaattaagtgttggaggagttgaggcaatgccatctcaaaaatagtgcttcagttcatggactccttgaactgagaacactgggcaggattcaagcagctgctttctctgagttcttcctacctgcctcaagactgaccctctaaaattcatcacctagggtactggaagggaaaagtggaagatgacaccatgctccgatggactgtcacctcttcttctggggactgctctagacaacttgtccgcttgaagggtgtttctacattgcaagaccactttgagccctaaggcttgccccagccttagagaaactgtctctactgtgccctcccaacaccctcaagattcagtcctttctctggtgcagggtactgtgtaagcttgaatctgacccttatggggccttttactttgtttatttttctcttataaatttagttttatgtgaatttaatttgtggctcagccaaggaactcaggaaggtggtggaagccaccgttcattcccctacccttacactagctgagaattatggaaaataacattcaattgttgacacctacgaccctctatacctgtgggtcatgacctacataggggtcgtgacctgcacaggggtcacacatcatatctactgcatattagagatttacattacaattcataacagtagcaaaattgcagtcatgatgtagcaatgaaataattttatggttcggggtcactgcaagttgaatttaaagggctgcagcattgggcagtttgagagccactattctgtacacaccatcattctatagtcgatttccattcccactcag

SEQ ID NO: 33827 - DNA, 1529 bp, Mus musculus
cccaccaggaagctgtgggccaactggtgggggcggtggaggaggcttcaatacagttggcagactcgtattttgaccctgagagaactgaaaatgtatctggtcacaaaacatccaatactgtggctgttaaaatgtcaggctgtaacctatagcatatctatcttttatttttcttttcattagacccgaatactttaagaaaatatactcagtggttgtttttattttcttgacaaaaattcatcatggaaaaaaaaaatctacctcttaaactcatttgcagttacagttagacatgtttggccacaagtatttagaggaaaaggcatacctgctccctaattaagctgcattaaatttggtagaaggatttaaatggtgtattttcagttgtactgaacaaaataattcacttatcattctttgtacaaaaattgatgctagatatatcttaagaaaaatgaaattcttatttctggtataattaccccaatattaaattcaagtctttgaaaatagtagagatggtgagtctctggaggcgatagcaccttccaccccagctgccagtctctgggctgctgtctccgctgtcctcggcgttgcactccagattcaggaacaagtgtcatttacacacgtggcaagtgaattcacacaaggtgcatgacgccagagggcaggggttttaactgaactttgtaggatttccagttgtccaaggactttaaaatcctgtttcagggagtgtatctcctatgtgttttaaaggaggtgagtctctgaatgtgccttgcagtactgtaattcaaaaataggttctctttggctgcggcggaaagttttctaaaacaaagcgttaggaaggaattttgtgctaacattaaaattataattttttaaggtattagatatttcagaagtaagatctggtggttctaaactagtaagtgtaatggtaaatttctaactcttagaaaaattcggaggaaatgaagctagtttaagtaaaaaatctttaattgatttgttacttaatcttcacattaaacattgataacatttttagagttgtatatttggatttttttcctttgagacacatgccttacacataaaatataatctgcttcatgaaatattaaaatgccacacctcacttccctactgtcctgttttggttttcctttttgatcctggggtgtttgctatttaggtgggtgtttaggtgtttaggtgggtgttttttgcacgcgcgcacgtacatatgtgtgtgttgtagcaggaaattggaaacatgtcagtcctcctgggacttgactatatagtactcaagcattgtcccaaagatccgtcttcctggccattttagcacatccatgcccatgtattgttctgaagatcagtcacatttattatgaaaacactttaaggaaataatggtctttggtggcttaaggtttatctttttcccaagcatttgtggcagtaattaaaaacagctcctcatcttcgtcctgctgccc

SEQ ID NO: 33828 - DNA, 1134 bp, Mus musculus
aaagcgggggtgggtgggtgggggggaggagtggagggctctgcagtttcctgtgagcacgcctataatcctagtgctgagagacagaggtaatggagtcgtggcttcaaggccagggttccattcattatgtctcagaaaataacaacaacaaaaattaaaaatgtgccatgtgaggcttgtcaggctcccagaaaggaaaaggatttcagaagagtcaggcaaaaaattgctagcaaagttcttgttctcctctcaaaattttttgtgggctcgtctttcttttccttttggactttttagctctctgagttaaataataaaatcagaatgacatagcagaggccttgagatgcggcagctctctgccctctactttctttgcaacgctggagcctctttccattgtagcaagtccacttccgggaaggcgggtcctccccgaggagggggcggaacatgcgggattcttcctgttgacgtgttcaacctgggcgctctgacatagcaggatatccggtctcgctcccaccgttggaaacgggctgcttctgccgttctagcccgcggctcgccctctcctccgcgtcctcggccactgcggtgagtggcgcgtccccgtgaggccgcgcgacgtgggtgggtctggagaacgtgaggggccctcgggctgctggcgggtcgcgagccgcgtggctcttcccgcgcccccgcctcctggcctcccagagcctggaacccaatgtcgctctgctgtcaccaggatctaagcttgaactcaaagaaatctctcctcgttggcacaaacagattcgaggaaaaaaataggtctgagatgtcttagtgggtacagaattcatccacggtcacccgtggccactcagccacatgctccagacttcccttttaaacactgaaggaaggccccgtggcgtggccagcatgattaaccactgattagctctgaagactgtcctgtccgaaaggattggggcaccagagtgagaacacagaagcctggttgtctctgttgtagtttttctgtgtgctgaaaaccagcactgtaaggtttgatgtctgtgtgggaaacaaactccaaagcatctgacttgtcgaaactgttgcatctaggca

SEQ ID NO: 33829 - DNA, 1108 bp, Mus musculus
gatttttaccacttccatactttctgtagagacaagaaattatatcatgtcgctatagaggttacgtttgcagggaggggattctgcaggaagacgtaactagacgtgtaaaacagagcctgtcactttatttaacagaatggaatgttctggctcctggtggggtgtggccatcaaagctggcatgtctgcactttgaatccttatttccgtttactgctgttagcttttgctggttgcagccactgggagaccttccgctggggctctcggccacacaaccacgttcctgttcacagtacctctgcctgttctgaggttgctttccaacgttccctttgtttattacataccgtgtcctttctttagctgtcccagatgtaattttttttaaattttatttgcagaatgatttttaaactgtcaaatgaaggagttatgaacctcggctaggataaatgtgaacaaataaaatacttcagatatggctcgatgtccttgtacttgagtttctgcctgcttgagtttctgcctgagaccatatgttgttcctttgacaattttgtagggaatctatcagcagacgaccatttcgagtaagtaaaattttatgagaaaatattttgagataagaaaatgtgtagagccaagaaattttttttttttttggtgtttttgagacagggtttctctgtgtagtcctggctgtcctggaactcactttgtagaccaggctgacctcaaactcagaaatccgcctgcctctgcctcccgagtgctgggattaaaggcgtgcgccaccacgcccagctcaagaaatatttcttaaaaatagaagtacagtgctgcattccaaaaatatttgaaataaaaaagatagtttatgttagggtttccattactgtgaagagacaccatgaccacggcaactcttacaaaggcaaacatttagtttggattgggttacagtctcagaggtttagccaaatattatcatggcagaaagcatggcagcatgcaagcagacatggtgttgaagatggagctgagagctctacatcttaatcttcagggagcaaggagaaattgtgtaccacactagtcatag

SEQ ID NO: 33830 - DNA, 1226 bp, Mus musculus
gctaaaaactccctattgcataaaatagttcatttggtgttgaaaagataggaatgctggtcatatgtgtgtgagaaattaaaaaacaacaaacaaacaaaaaacttgagaaaagataggaataagaaggaaaactggattaacagaaataaccagctcgcagtgttttccctctaaatgtgtattacctctggcccacagctgcactttggggacatatatgaaagtggactgagtctaatgtaagtggattaagagagactagttaagagtttggtctcaaagtttatttgtacccaggaaatgaacttttgcaaaattaattgagagtatattaatatcagaatcatgaatataagagttttgtatatgtgataattattaacctcggtattttatctcagttgttttcccagaatttctgtaaactcaactacttagtttgcagaattttagtcattcttttaacaaattttaaaaatttagtttgtagcttccatttgataaggagctgatatcagaaataatagtgaagtcttataataggaaagatccactaatgcagctggtggctcttaggctgggctgctttgacttgtggaattatctaatgtattaatgtaagccttgatgagtgacgttagctatatggatgtgtaatcctcacattgcagacattttgcaacccttttgtgaccttgttacagatatttaaaattgtgttcaagttctgctttgctgtttaataaaaagctgtttcagaggttttgtgtgtgtgtgtgttttgatacacttgctaagtacatgtgcattgggtatccagggtttgcagtatcacattgtaatagtgtatcttatttaagcacccaagactgctacagggcagtctttagtagcacagtgttgcagaagcttaccctttattgaagttctagggaagggggctggcttagggttaggctccttcccctcacttgttcccaggctagagggctctgctgcatagattgttctgtcatggcttctgcatcatcagttacactattcattctatttacaggaaagagtttgtgagtgcccagaatctaggtatgaagagttctgtcttgaaatggtccaggcctctttacatccaaagcctcggattggctgagcagtgtgatttcttccatgtgggaggaagtgaaggacttgtcctagcagtcctagccacagcttgatctctt

SEQ ID NO: 33831 - DNA, 1140 bp, Mus musculus
gaaggagggaatggaatgctgtggagagcctgaaggacaataaaccctgctacaaacttgaccacattgtcaaggagcggtaccccacatttatcgatgctctgctggacctcgaggatgccctgtcaatgtgcttcctcttctccaccttcccttggactggcaagtgtcacatgcagaccattcagttgtgccaccggctcactgtgcagttcttgccctacgtcatcactgcccaagccctgccctgtccaataaaggcatttattatcaggctgaagtgctgggtcagctcatcgtatggattgcaccctatgctttctcccatgatcatccgacagatgtggactacagggtcatggccaccttcactgagttctataccatgctcctgggcttcgtcaacttccatctctaccagtcactcaaccttcactacccaccaaagcttgaaggtcaagcccaagcagagacaaagatcagcgaggacacatatgcattggactctgagagctctatggagaaactggctgccctcagtgccagcctggcccgagtggtggtgcctgctctagaggaggctgaggctgatgaattccctactgatagggaggtgacagcacaggaggaagatcggaggaaagagctggaggcacaggaaaagcacaagaaactctttgaaggcccgaagttctttctgaaccgagaggtgccccgtgaagcattggccttcatcatcaggagttttggtggggatgtatcctgggacaagtctctgtgtattggagccacctatgacgtcacagactcatgcatcacccaccagtttgttgaccggccggggcagcaaacccccatcattggcaggtactatgtacagccccagtgggtctttgactgtgtgaatgcccggctcctcctccctatggcagagtacttccccagggttgcagctgcccccacatctttcacccttcgtatctgagaaggaaggagattacattctccctgagaagctgaagctcctggctctgcagtggggagaagacccaggaaacttggaaaaggaggaggaggaggatgaagatgatgacaacgaacgtgatgttgcatgggaaaatgaggaggaggaagatatgg

SEQ ID NO: 33832 - DNA, 1182 bp, Mus musculus
catagatctgccagcttgggaacttctccatccacatggctcttcgggaccttcggcctgctggtgagtggcttgctggggctggggctgggtgagcagggtgaggagggggtctgacctactcttatcctccatgccagggtcgaaaaccaggaagatcccataccccaccaagaaccccttcacctggctgttcctgttggtgtcctgtcccaactacacttatgaggtgagggactgtactgcctttgtcctctcaggtctgaggtcctgcacatggtgaagtgcaggagtgggctgtggggagtgagaaagcttgacctcagtgaggctgtggccgtcccccggggctgtgatgctgggcttccctctctgtcctcattctgcctgtactgtccacaggtgggctcctggattggctttgccatcttgactcagtgtgtcccaggtgagttccttgtccctgtgcggtgcgctgcccttccagcaaggcagcctcattctgataccccattctgcccacagtggccctcttctccctggtgggcttcacccagatgactatctgggccaagggcaaacaccgcagctacctgaaggagttccgcgactacccgcccctgcgcatgcccattattcccttcctgctctgagcagctcctcacggctctgcccagtaatactctccacccctcactgcccctgtcctgatgtgtggctggccatggctctccagcagcaacaataaaacctgcttacccaactgactgtgtgttctttaggggtacagggaccacaccattccttcccatccttgaagtagcacagatgaagtttaggcaggtgacccaaagcttttatttcactgataggtccacaggctggcgggtaatccctacagggccacctcagggcccacctctccttctccctggccttgggctacccgtgcttccttcagtgcccttcgcttcttcctttggagcagtcgccgctcacgttcaaactccttcatgcgtttcacgtaactgtgggcagaacatagagggtctcagtgccataggttttgtcttgagtccattccagccacctggaagcccttgctaggggtgaggcctcccccaggaattctgacttggcccctgtcctaggtggctccagcctcttcccatgcccatgtgg

SEQ ID NO: 33833 - DNA, 1068 bp, Mus musculus
ctctggcacatatgggcaagcaggcctgggtaccactgcctggcataggaaccttgctctgaactcaagcccaggccctacagggcagcatcactgtgtagggttacctccgtgggggcttcccgacctgtacatgcacacatacacacatgcatacactttctgtgtgccagcaccatgtcggcccacccatgccttctcaaggacccctagcagatctgggatcgtgccatggcctctgttgttgggagcatgtaggtggcaacagttggcttctctggcctgtgatgcccccttcttctggaaaaaagtggcagatctccgcatagcccttgggtctcccccagccagcatgggcagtgttgagcatcttctctgacctgctgggtccgatgggtcagatcccctggggctcctgcctccttaccctgcccctatgcatattttctggcctcagcctgcaggtttctcctttggggactgtggaccccaggggtgcaggcagggtatgtgttgggagggtatgtgttgggctttggtaggctcgtccatgggtgagcacattgtgttggcctgatgtggtaggagctgtgaggagtgaggcggtggagagggaggtggagggacttgggaactctgcaccagtacctctggaatttgtcacctccctgggaacacaaatgcacaagggaaataatccagtgtcccttacagcttagaagtggaaatggatgatctgtctcggagattctccagatagctggcatttccccaggctgggtaacctgttggccagggctgcacaccggggctgggcttgcggcgcctgccatggctgtgggccttttccttcttcatgcccctggcacttctgagggcctgtgcccacccaattaactgcctgtatgagggtagccctcaggggaggactgtggctcctttggtggggactcgggctgagatggttttatatttagccaggccaggccctggtgccactcgggttacatctggcgttggcgctggctgagcctggtcagacacaggctcccttccagcaccgaggca

SEQ ID NO: 33834 - DNA, 2246 bp, Mus musculus
catgaccttcgggtctcccttgaagagatctacagcggctgtaccaagaagatgaaaatctcccacaagcggctgaaccctgatggaaagagcattcgaaatgaagataagatcctgaccatcgaagtgaagaggggctggaaagaagggaccaaaatcacctttcccaaggaaggggaccagacctcgaacaacattccagcagacatcgtctttgttttaaaggacaagccacacaatatcttcaagagagatggttctgatgtcatctatccagccaggattagccttcgggaggtaaggtgctaggtgggtggaggagtcataaaaagagatggctgctgtgagaataatgggttgtggggttgggggggctttggagtggggtgtcagcgggcctggtctggtagacctgacccttctccggacggtctggaggagtgaagctcctaagccagccactgcctgacactgtccttttgcttccctaggctctctgtggttgcactgtgaatgtccctactctggacggcaggaccatccctgttgtattcaaagatgtcatcaggcctggtatgcggcggaaagtccctggagaaggcctccctctccccaaaacacctgagaaacgtggagaccttgttatcgagtttgaagtgatcttcccggaaaggattcccgtctcatccagaaccatcctggagcaggttcttcccatatagccacctgcactcctcaaggactgagccaggggctttcagagctgcagatctccagaccgttccactggttgcatactgcgggagggcccagggagggcttttgctctgccgaatgttttccacagaatatattacaatctttcaaagtcgcgcactagactacagtggtttttcgagcgataggcaggcggtgggaacagcagccctcctggaatggacccaccctctgcaccccagctcctgcccaagggtgtgaggcaggcctgcaactggactcttgccctctgttgtccttagtctggctgtcatgtgacagtggtccgccatctcagttgccagaccctgtgcactagtcagtctccactgtgtgggaggttcttgttttatctgtatttgtcccatgccttgttcctcctccccagaagagtcctgtcttgtcttggccatctcaaattgagaccaattccctaggactgccaggccagcatcacaagcaatacctggttgcaggaccacagggccagcctccttccaggttctggggcctggccagccaggagatcccctggacctctggctccattgacatcagatggctggcttacagtcacagtacttgctggtccagaggtagaccttggccacacctggcacttctcagaggcacaggtgattttgtgtgtgtgtgtgtgtgtgtgtgtgtgtgtgtgtgtgtgtgtgtgtgtgtaatggactctgaactctagaaggatacaatccttttggattttgcacagtcctagatctaatcccttttgataaaagggtctttgcttctgatgaaaggagcactgtggaacgtatgtaaatatgtttttataattccattggaagctggtgtgcactcagacgaaagcagtccctgtcaactactgtccagggctgtgatgggatcagacctgggcgtgaaagtatctgttctttggagctagcctggtgttctgaccattcaactcattgtaagttgccactaccaacacaagaccaaagtgtgtgacttgtcattatgcagtgtgacagcattaaagactgatgctaaacctcaggggagcagtccttcgactctgtttgagggctttgctggggggaggagcggcatggttactgttctcattctcaaaagaaagctctgtttcccttcctgggacacattggtttcccgttcaggaccccagcatcactgtggtgacggttggggtaggagcccgccctgagtgccttttctaccttgcaagctcctggccacatctggggacctagtaaccaccagggctgaggattacagtgccatctgcctgaattcccccttccaacttggtagggtaggctaggctagcctagagctaggatgcacctgcccagagttggctgctctggggagaaacccacttcctttccccacttgataggggtgtctgagaacttctttgaagaggtaggttgattatagagcaatgtgttggttttgtctctgtgttctggtgg

SEQ ID NO: 33835 - DNA, 1180 bp, Mus musculus
ccttgagaggcttgtactctagtaggtgggggttggggatgtgtgttcccaacaggccttatgaggctcggaggttgtattgcccattaggtctgaagtagcctgtgtcctggtaggttgtggaggactgacagacacgtggtagctgggtttccataaggtattaggaggcttgtgcccccaaacactgggagctggaggtcaggagcagcttctatttctccatgatgccctggaggcatgactccaagctcgaagctgagaagccgcagggtgggagggcgacagtggggcagagattcaagtagaggcgggtaggaaggctgggtgggagtctagggtccattcactcctcagtaggtatcaagtgctctctgtatatcaagctagctctgagttttaccacgacagaaatcctgctcgtagtatgtggacctctccttggccctgggtgtcaccagtccctagggtagggatgtgttgggaaagaagacccagggaggaaggcatgagcatcctgccctacctctgcaggtgatgttctgcaccctcaacacccacaaagtggacatggacaaactcctggggggccagatcggcctggaagacttcatctttgcccatgtgaaggggcagcgcaaagaggtggaagtgttcaagtcggaggaggctctggggctcaccatcaccgacaacggggccggctacgccttcattaaggtgcccgggtgggtggcacacccttagtcagtggccagggtctgtaatgggacctagagtggagcttccagggttgatgcctgcccctccacagcgcatcaaggaaggcagtgtgattgaccacattcagctcatcagcgtgggggacatgattgaagccatcaacgggcagagcctgctgggctgtcggcattacgaggttgccaggctcctcaaggagctgccccgaggccgcaccttcaccctcaaactcacagaacctcgaaaggcctttggtgagccatccttgcaccctggaccacccactgggatgaccttgagctcttaagaaatacaggtggcagtcctgggaaccaccagcaggtggcgcccgagcctgcaatgcaaaatggggacagccccaccctacccaagaactaagtgctggctgacagcccagcctgaaggaagttgtccccac

SEQ ID NO: 33836 - DNA, 1741 bp, Mus musculus
tatgagaatgatcatttctgggtgttggggactaaagagatggcttagcagtttagagcacgtgtgactcttgcagatcacccaggttcagttccaagtacccataatgggtggctcacagtcatctgttaactccaattccagaggtccagtgttctgacctccacaggcaccaggcagacacttgtacacatacacatgtgcaaccaaagcagtcctctacataaaataagtaacgacaaaaccaggagctggggatgcagctcactggtagagctgttgctgagtccctgggagccgtccccagcacttagggcatccagtgcctatcacagtactgttgacgttattgtgctgtcttgtccccgccctccacagccgtcggcctttgaggagaaggccattgagaaggtggatgacttgctagagagctacatggggatcagagacacggagctgggtgagtggggcacccacccatgcctgcaaggtgggagtgggcttccaggtctcacccaggctgagttgagcctacacctctgcccatcatgacatctgtgcctccatcttttccagctgccaccatggtggagctgggaaaggacaaaaggaacccggacgagctggcagaagccctggatgagcggctcggtgacttcgcattcccagatgaatttgtctttgatgtctggggagctatcggggatgccaaggttggccgctactaagactggaactgaacctggaccttgagataacctggcttggcctggctggggtttccaggaggggtgccacagccgggacctgggcacacagccgaggctcgtaaatcagcagcctgggaaaggcatggggtgcaaatgccctgtggtcctggccccactccaatcagtaccaccacggtgcccagcctggttggggtccccggccaacccctgccgggttccccacctacctcaatagagtactcgcatgggagggaccaacacactgggcagtcacctctgtccccaacatttcccaccatcagctggcaactgccccttctgtccccctgggcctcagttctctttggggtcatgacctccctactttactttttttgctttgtttattttcaagacaaagtcactatgtagctctggctgtcctggaactcattctgtagaccaggctggccttgaactcacagagatccacctgcatctgcattcacagtgctgggattaaaggtgtgcgtcaccactccctgctctccctgctttcttgacaccagaaatgcagaatggcaataatgccttcccttgggcatctcccacctgaggggagccctctcagttggggtctgttacctcccatttgagtggacactgctgtgaaccccggttccttgtctttagacaatgaggagggagggggagggaggcagtgggcttttgtgtccacacaccctctcttggatatagagattttactctgggagctgtttggctctggggaaggaggggtggccagggaaagaatgcagcagctgaaatctatctcctggattccaaattgaattaggaattggctgccctgctgccccctccccctggctggaggccgtcaagcttccaggcagtgctggagtttctggctggcttggggttcagacctggttccccactcacccaggcctcacatatgctcctcttgtgtgagagcccccgtgtgtggcagcaaggcctgttgccct

SEQ ID NO: 33837 - DNA, 1208 bp, Mus musculus
gcaatctctcaccagtctggcattgcctcattcagatgcccatcccatacccctatttgaaccgcccccggcttgcccattctctagttgagaggagatggacagcctaggactgagagccattaaacagcaagagagcaggagggctatagctagccttctttggcttgctatcctcaatgtcccagcttcttacccagtgctgctcaggatgcagggtccccatggcctggaacttggctcctgctgcctgctccagctactccctggctcccggcaggccgctccctcttcctggggcggctcctcggctccgtgccgcctccacccgcacttcactggcctccaggggctgctccaccccatgcatgtctgctctctggggctgggagccttgagtgggcaaaactgctggcaacagtcagggcaactgggcccagctccttcccgccaaggactgaggttctctgaattggtttggtctctgtgacccccctcctctcagcggggcaggagcaaacccccacaccctcacccgggcctcttgcccgcctcattaataaagtggataaaatctaaacactggaaaatgtgagcatcgcctggggcaggctggaagggctatgagttcccgtggggggcgggggggggcaggagagtgagtgtgtgtgtggaggagtgttgtcctcattggacttgaggggttgggagttgcctgggtgtgatgggagctagcaatgcctcctacccttgcctttatggttgtcacagttgggcagaggtgggcagcctagaccagggcaacagggagtcatcctaggtgaagagaggtggctaaatgactcaggggagccaggctatcatctgtatcctgccttatggggaggtaggcaattcatagggcaccctgcatccatagctatgtctcaccttctgtcttgaaaaggggcacacatgcagccactgtcagcttagtcataatggggagtaaacactggatagcactcaccattgctgactgtaacatctatcccccctcccccatatgaaactgatgcttacctcagcactgggtgtaaatctcactgtcactgtaagtctgttcccagccccagagcacacctcctgatgtagtctcccttaaaccaatgcccatggaccccgagaacttgtcctgagacacataatcacatctctaaggcctgttt

SEQ ID NO: 33838 - DNA, 1200 bp, Mus musculus
tatccccgcttcctgtctgcagaggccatcggcatcatgagaagggtaggcacacctcccgcctcccgaccacctccggcaaggtaggctgggaaggggtctcgggactggactcagatatagatcaactcctgtgcatgctcacagctactgcggaggaacccggagcggaggctggggtccactgagcgcgatgcagaagatgtgaaaaaacagcctttcttccgggtgagcggacccctccccatcctctcagtcaccccaaggacctgagtattcttctcagttccagttcattcccaccccaaatctagtagctgtatcttaaagagctttgtagccccacacctcacagccaccatgattcttcacaaatgttacctccgtttgtctgcaaccttcatttcccttaattgtcatccccactgcttctccaggcccaaatcatcatcacagggcttaccctggactacctcaggctccctagatttatctgagttcccagtccctccccatcttatctgcttcctgctgatctctagacttcccttcagaccctcaaagtccatcatgactcactctgtccccctctccacagtctctgggctgggatgtcctgctggcccgccgcttgcctccacccttcgtgcctacactttcagggcgcacagatgtcagcaacttcgatgaggagttcactggggaggcccccacactgagtcctccccgggatgcacggcccctcacagctgcggagcaggcagccttccgggatttcgactttgtggccggaggctactagccccaagcccctgccttacccaagagttcttgattttttaaaaaacaagcctttggggtttactccatacatgcattttcagcctctgtgtgcatctggactggagtgtgcttggagcaggtgacagaggcaaggcagactcttgggggcaggactgatggggcacatttgaaaggtcaagatgggaacatgcagtagtgggcttaggggtatgttggagagcattggggttttaaggccgtgtgggtagaaggtgttgagattcttgggatagtttgggatagacgcttgcaagagtctattggggtggtgacagagatgggaagtgaatccaaaactttgctctatttatggagagcccgaatcttagaactaaggttgcggcgctgtgcgcatgc

SEQ ID NO: 33839 - DNA, 1187 bp, Mus musculus
agagctcccctcttcctgtgcgtactgacataggatgcagttcctgtgactcatctgtgactcctcccctttccagagtgaactctgacatgtcttcctctctgctcatggtgtaacagtccactagagctcacacagtcacaggcaggaggttcggactcaagtgtccagtcttggaactgcctcgggtttggggtcagggtcctaggttaaaatcatcctctaacagatgtgcttccagatgctgggaaaggcaggccttccttagaacttagcctcctgatctgtcagatgcccttggatctcgtcctcttacgactgtctagcacattaaagaggaggtcgagtcagagaattattcacagttcttgatccctgtggaggcttcaggctgtccctagacttcccagccacctttttaatgaccaagaactttaataaccaggaacaaaagctcaaataaggaagagtttatttattaatctgggttgcagagcccagtgtgtctgccttaaggcgcctctgtcctgatgccactgcggtgtcactgcggttggtcgtcggtctgcttgtctgcgggctgggcttgccgtcctctcactgacagggagggaagcctctcaccactgatcagaccccatgcttcagtcgttacaccgagcctgatgagcgggccagtgcttcccaagcccgtccccagcatggactcagactgtctgtctgcttgagccttgcacccttacccatttcccaaaatgagaaaagaatccaatcgctcaaaattgcacagcggtgcaactcaacagatacctgagtgaacctggagggcatgggtattggaggggcagctgggctctctgacttctgcctcctgtccagcctgatgtgtgagaagcggattttggcggccgtgaccagggcaggacatcccttcctggtgaaccttttcggctgtttccagaccccagagcacgtgtgctttgtgatggagtactcggcgggtggagacctgatgctgcacattcatagcgacgtgttctcagagcctcgggctgtgtgagtctatcccagcaccatgcccctcctgcacaccacccgaggccccgcctttctgccccacctcctagccctccaccctcaggccttcctcctgcacagctttgggaccccccaccaccccccggggt

SEQ ID NO: 33840 - DNA, 1171 bp, Mus musculus
ggctgacatgtgtatgcctggaaccctagtactcaggaggctaaggcaggaggattcaaagccaatctgggttatgcagtaagttctaggctagcttggtctttagagtaagattgtatctcaaaaccaaaagaaaaacacaaaaatgagcaaccccttccccccaaaccccagtctgaattaaaggctttattgtgaaaggcaagctggctgagggagttgaggggctctgacaggatatggagcaagccctcccctccccctttcctgccgccctctcctggtttcagctgaggtcagcaccgtgctcaagctggacaacacagtggtggggcaaacagcctggaagccatgcggccccaatgcctgggaccagagctttaccctggagctggagagggtgagccgtgctcggggaatgggaattagaaggggagtttaggcgtcagacacaggaagtgatggccctgtttcttcttaaggctcgggagctggagctggctgtgttctggcgagaccagaggggtctgtgtgctctcaaatttctgaagttggaggacttcttggacaacgagaggcatgaggtgcagctggacatggaaccccagggctgcctggtggctgaggtacagcctggtttctgacttctgaccccaagatgtttcctgcctccttgcctccaattgcttagcatggggaggttaatttcagaggtttctgaatcttcatgggaagtaagcctcacgaaggctgggattggtgccaggcgaatcagcagcaacagaccacatacgtgatcgtgttcccagaaggctgggcctcgtcaattgcatgttggtctggcaataggcaggactcaatgggtagaatgcttgcctagcatgcacaaagccatgggccccatttctagttcagataaaactaggtgtaggtactggagagatggctcagcagttaagagctctggctgctctccagaggacccagatttgattcccaacacctacatggccacttacagctgtctgtaactccagttccaggggaactgacaccctcttttggcctcagtcactaggttctcatgtgttgcacagacatacatgcaggcaagacactcatatacattaagcaaacaaacaagcaaacattaacactagatataatacaa

SEQ ID NO: 33841 - DNA, 1673 bp, Mus musculus
gttagcatcctacctcaggaagatggaactatttttgcaggctagggaagatgagagacaggcctggctggtgtgtgccttgtacttggtgtataagggattaataaagtgtgtgtgggggggggggtgagctcgtctcctgagaattccatttagcatcttaactggctggcttgctggcctggcccaatgggaatcctcttcataaaagctcttaatgattcccctgtgtagaccacaaaaggtaggggaggctaggctaggctgggctgggctgggctgggctggtaggggaaatgctgcttgcttcttgaccacaacaactcctttctcaacaccaaggcaggtacaacttcaggtccaagctgtgggttccaggagctccttgggagggtggtctgagaaaccttattagtgccaaaacttgaatgtcagtgaggacacattagccaggtgaaatgatgtcaacctgtaactgtccgttctggaacagccaggactattagggctgtctaaaaaaaatcttgtatatacagacttgaaaacggccatgagggctatagtgacgaatctgtgtgataactatcacttatttgatttgtggtgttggggatagaacctggtagatcactgggccaggtccccatttgtagtatggtagaccttagaatgcttgggctgggtggcattggatgggagagtggtgtgtagcagatgggaggttgctgagaggatggtgacaggacagtaggctgaagtgggaagtcctgtacaccactgagctctgcctgtccagggcttgcccctgccaccctttccttatcctccttctctgccaagtgggttttcctacgtggttctcagatgtgtttctaccttaccctcttttctgttctcagtgccatggcagaacaggatgtggaaaatgaacttttggattatgatgaagatgaagagccccaggcaccccaggagagcactccagctcccccgaagaaagatgtcaaaggatcttatgtctccatccacagttctggcttccgggactttctactgaagccagagctcctgagagctatagttgactgtggctttgagcatccttcagagggtatgctacactggtgccaccctgttatgccctcttcccagagtaaatcctacccatcctgagcttctcctgtgccttggataggggatatgtcctccccgtgagtcagttatatcagcagcctctatgcaagcagatggttggggtctggcagaagagtgtgcagagaggcagcagccagtgtcttaactcacacgcttttttctttcttagtccagcatgagtgtattccccaggccattctgggtatggatgtcctgtgccaggccaagtctgggatgggcaagacagctgtgtttgtgctggccaccctgcagcagattgagcctgtcaatggccaggtaggtgtgggctcttttctgggctagagttaccacatgacagtacagtcttgggcctcataaaactacttccattttctctgtgggcttttgaatgtatctgggaagtgaaattttactgactgcagtcaccacagtgactgctgacttgttttgcaggtgttcttaacactaccactatagatacattgtaggatcttaagatttacactggagtccag

SEQ ID NO: 33842 - DNA, 1118 bp, Mus musculus
gcctgtttgttgctctctaggtatcagtcctggtcatgtgccacacgagggagctggccttccagatcagcaaggagtatgagcgcttctctaagtacatgcccagtgttaaggtaagcctcctcaggtgctgtgctgggtaccacggggccttctggagccctgctggcctcagtgtcagctcaagcagcatttctcaatcttgaggtttatgctaacttatgttccttatgagcctgatgaattatgcccaacccacaaggcttgtgctggtcccacatacctcagccttgccctgttttttcggccccgcctgggttctgagggagtggggctggagtgtcaggtcccctcaggatgggtgggacctatgctgtaaggatcactgcccccagatggtggaaacagctttctttctgtccccataggtttctgtgttctttggaggcctctccattaagaaggatgaagatgtgttgaagaagaactgtcctcatgttgtggtggggacaccaggccggatcctggcacttgtgcggagcaggagcctcaacctgaggaatgtgaagcactttgtgctagatgaatgtgacaagatgctggaacagctgggtgagcatcctactgtcctgtccagctggtttcccactcatagagtcacagccgttttctagggggcctgatagggcaggcagaggtggctcttatagtgggtcacatgggtggccagaactcagggtttctaggagaagcctaaggggaattctgaggttacagagtatgtgctgcttctggaccctaggccccatgagctgccagccctttagggaatctagaggagtagagtggcctcagccaccatcaggggctgggagagatgggcatgtgtcctgggaagcagctgcagctctcacgccagtggctgtctctgcctcaggctccctttcctgaagcgtggctcaaggcgcactggcagccgctccatgctggcagcgagtaagtggaccgcagctcctcccatgcttgcgctcccgcccatccgagcccagcccctcaggcagcggggacacccctgggcccactccaccacggctatggtgccagtgttgtccggtcca

SEQ ID NO: 33843 - DNA, 1139 bp, Mus musculus
ctcaggcttgcgatttgttggcatcccatccagacatgcgccgggatgtacaggagatctttcgtctgacaccccacgagaagcagtgtatgatgttcagcgccaccctgagcaaggagatccggccagtctgcaggaagttcatgcaggatgtgagtagggtgacgccccagctggctggctgcctgcccaccgtggccaacacctcagcgcagcagctttggccctctctgatgggctgggccactctgcgacaagcacactgctctcatggcctggaggatgctaggaggcttcgccggcctccttccttcccctggtttgtcaaactgggagctgagtggtccacacctgagccagaggcagagcttacatccggcttttgggagagaattgtttactgaggttgggtgcaacaggccctctgggaatcatcaatacagaggagctgctctctggaaggttccgggcacatgagacgcccagaagtgagccctactcgccccttcctgcttccctccccacacagcctatggaggtgtttgtggacgacgagaccaagctcacactgcatgggctgcagcagtattacgtcaagctcaaggacagtgagaagaaccgtaagctcttcgacctcctcgacgtgctagagtttaaccaggtgatgcttccttccttccttccttccacaccaagatatgggcctgtggggtgattatctatgcgcctaaacacccttcttcttcaggtggtgatctttgtcaagtctgtgcaacgctgcatggccctggcccagctcctagtggagcagaatttcccagctatcgctattcaccgaggcatggcccaggaggagcggtgagtgcatgagtgagtgatgtccaccagggccaaggctgctcacacctgggactcgggtttaatgcctctgcttgtctcccgctctagcctgtcccgataccagcagttcaaggacttccagcgacgaatcctggtggctactaatctgtttggcagaggtatggacattgagcgagtcaacattgtcttcaactatgacatgccagaggactcagacacctaccttcaccgagtgagcgcctcctcccagtgtgggcgggctcaggacctcccccacc

SEQ ID NO: 33844 - DNA, 1395 bp, Mus musculus
gctgaccatcacctccatcgcccagctccttgtgctgggctgcacctggggcttcggcctgttcctcttcaacccccatagcacatggctatcctacatctttaccctgctcaactgcctgcagggcctattcctctatgtgatgctctgcctgctcaacaaaaaggtaggctgaccagagctggctatggaagagcccagggtgggaggaggcagggccaggcctgagtccctagcccagctccttttttccccataacctggtgccttgtgttcacaggtgagggaagagtactggaaatgggcctgcatggtcactgggagcaagtacacagagttcaactcttccacaacaggcactggcaccagccaaacacgggtaaggggctggcctgcagtggggctgggagggcaggcctaggtgagctcagcctcaaaggcctccttctctgcaggctctcaggtcctcagaatcagggatgtgaaggcgagttccatgaaggacagcagcacatactcacggctgtcattctgccttctgttcctgccacctttcggcctttgaccccacttcatataaagaagggatgcaaacccagcaatgagccctgccacggggcaaggggtcgctggtcctgcttctggttgtctctgcctcaccacagctactgcctaccagagaaacagaatgcagccagcccagacctgcagcccactgcctggtacacgaggcaggcagtcctaggacaaagggaagagcccttgagacctgggctctttgccagggtgctgggttcagtttccttaagctaagactgtggatgccacgtcagccactgaagcccgcctgctgctgaggctcacggtacagaggcctcgctgctccacatccagggcagaaggtctcacagctaaagactaggttttgtaatttttttaacctgtaaacctttcaatgttgacacacaaaattaaatatcatattgataaaaaagatggcacgtttgctggtgagaagtttgctggcttgacccaaccccatgagatgttgaccgaaagggatggggctggagccatgcattcacaataaaagtttattcttacatcactaaagctttggaacaataaaaagagacatcgatttgtcacctagaaagaggttctgaagcagcaggtgggaaagagagtggccatgttgccctggctacacatacggttaccggctctgctcaactgtaaagacaagaaagacacagtgagtgaggatagagggcctttgctcctgaagccccgctcctgccctgagtggctccaggtactcactgtatgtggagatatctatttcctctggaagctcagctacattcacttcaaaccggtcctgaacatcattaa

SEQ ID NO: 33845 - DNA, 1689 bp, Mus musculus
gcagtgactggggcagttaagattggaattaagcagagcatgatggcccactctgcttggggccttaagaaggatctcaagttcctgagttagacatcgatgacatgcctgtgactccagcaggtagaggcaggaagagcagaagcccaaggtcataatggaagagcaccagtctagaatccccagtgagggctgggggggggcatggctcagcagagccttggcagtccctgtgcctactgttgtttacgtgctgttgtgacatgcagatgcacagggtcataaacttcacctccttgttttctggctactgtgtaagtcttactgcatcccgccagctgactccccagggagcccgcgtggctctccagtgtctgctggtaggcagagtggtcagggtccttcatttagtttctgtggttcaaaaccttagcaactctgtcactcattaccccagaaactcatcgaggctgtggacaagctgctggaagaccccatggagactgaaacccaacaagtagctgcccagttgctctcgaacctggaacaaagccttcggaccttggctcagtttttacccaaaggccccttcacctacacgtccccttcaaatactggtaagccttcttcctgccccaccccaggaaccatccttggttcccccaatcatgtccctgtctcttcagaactgtccctgatggtgaaggagcaagacaacaaagatgttaccacagtgcaccacggccaaacttggatggagctggactgggctgtgacagctggagccaaaatctcagaaaatggtaggggtccagagagggcgcctgccagggaaaccagggtgaggtctggagaggacagggagacaccagcccactgggaggagtacagagaggggacaggagttgagccttcatgtctgcccccaggctcctcggtggcaggcatcctgtccagcccaaacatggaaaagctgctgggcaacaccccgctgaacttggagcagagaagggcctccttggaggacttctatggaagcccgattccgagtgtctcacttaagcttctctcaaacatcaattctgtcttcctgaccaacacgaacactgaaaagctcgcctcgaatgtcacgttcaagttcgactttacttctgtgagtcctccaactggagagaggggaggggtggggatgctctgtggctcaccccctaaccaaagtcaaaagtcagggcagcgcctcttgacctacatggtacgagagaactaactcccaaagttattctgactccttcctccaacacacacacaaaataaatgtaataaaaaacactaaaaatacataaaaaatttaaaatcacagctgtggggtgtgtgtggtgacacatgcttttaattctagtacttgggaggctctctgagtttgaggccagcatggtctacagaaattcaggataaagctcataaagactctgtcccaaaaaataaaacagcaaaaaacaaaactaaatagataaaaaaagaaataaaatctgagctgggtgttgtggcacagacattttcctctcaattgctgggaggcaggaaattcaaggttcaaagcctgcctggagtgaagttaaggcccacctgagcaacttggcaagaccttgttttcaaactcagtgctacagttggttggcattcagaaag

SEQ ID NO: 33846 - DNA, 1183 bp, Mus musculus
cagaggtggtacaaaaacaggaatgcagtgcccagccagaatagccaatcgatgaactctgggtctaatgagaccttattcagaaagatggtgaaggaggtagagagagaacttagggaatatgcctgcatgaccttacagagacacctgtcttgatctctagcccccacatttgtatgcaaacacacacaaatttagccacacacacacctaaaaccttttttttttaaataaagatttattttatttctgtgaatacattgtagctgtcgccagacataccagaaaagggcatcagatctcattaaggttggttgtgagccaccatgtggttgtcaggatttgaactcatgacttctggtgaaagagtagtaaactcagtgctccaaggtatgctaatcataaaacagatagcgacattcctccacccacccacttcctgggttcaaggagtattcattcaaagaaagtcaccctgagcattaccagaacctgcaatgcaaatgtgctattgttaggggctcttagaaactgtcttgagagttaacaattaccaggtattccttgtgatacctgtgactttgtacttccttgtgactcttaactggtatttttggtattttccagcaacgcccttcccacctccttgagttgtggtttcttcctttaaatatccccttatccagctactcggggcgccacagtcctctacccctgcgtggtgtatgaccatgggcccgagagcgctcttgaataaaaatcctcttgcagtttgcagcaagaccgtttctcgttggtgattttggggtgtcgcctctcctgagtcagaacgtgggggagtcctcacgttgtgggtctttcactggaagagcagtctgtgctcttaactgctgagccatctctccaggcccccctaaaatcttttttattttaaaattttatgtgtatgagtgttttatctgcatgtatgtctatgtaccacatgcataccagctgctccagaatgaaagagtatcagcttccgtccataaagggcagcagttgggtggcaactcctatgtcctgtgctgcaggctcaagttacctgggaggcagcagagctctgtggtcttgttcaacatcaaggtcagacatccttgtgctgacctgagtctcaggaatgggcatcctgacttgtttaagt

SEQ ID NO: 33847 - DNA, 1201 bp, Mus musculus
ttctctgggaggcagtggcgctaatggtggttgggggtggtatggggagaggtatgtctgggtgtcgagtgagtttcagcccggaggggtgctttgggcaaccctggtgcagttgtgagacatcttctgttagtggtaccctgttaagcacggatggaggctgtcaggttggatctaccggaacgagctttctctcctcttccaggtgttcctgaaatagagctgtgtggctcagttgtcatcgtcccgtttgagggtcctgggatgaaagtccagttcgtgtgtgtgtgtgtgtgtgtgtgtgtgtgtgtgtgtgtgtgtgtgtgtgtgtgtgtggtgggagggtagtgtgtacttatgcagtggccagaaaatgtcctcaaatggcatcacttcagtgcaccccaggcacctatgtgaagatggcaccccgccggcaaacagcccctaagctcacccatcccaatctgtacacttctcggctaggttagcttccagccctatcctcgcccagcatcttattactgtaccttcctcatctccccaccccgccttctcctcagctttggcatctttgtggatgtccctcctgtcccaatgtgaaccagagagcccccttctttcccagcctctctgggacccagagccggatctgtcttcccatatccaaacatgtggtgcgtttgggggagttgggggaggggttcaagatggccgccaagatggctggcagcctctttatctctgtctgtctccccctctctctgcttaccctcatgcctccagtggagtagggagggtcaacgtggggagagagttggacagtgtagggacaggtgtggaggacacctgagggtggatgtctgttctgggcctgttgacctccagtgctgctgagagagaggccattggtacctgcttctctttcctgcaccccaagggcaggcgtgagtctttaatccgaccccagacccaactctatctggcccacagcctgatggctacccctgctctcccccctccctagaccctggcaataccccatcaatcatggaatgtcagagtgttcctttgagggtccccacaagcatctctggcatcctcttcttcatctgcccagttaggaactggggaccttggtgtgtgtgttgggggacgcctgctaagacaggtcctagctttggggacaggtgacttcctt

SEQ ID NO: 33848 - DNA, 1137 bp, Mus musculus
acggaatacaaccttcattatcatatcgagaaaattatctgtgattttcctaactagcaatttgcctgccatgccgttcagatatgacttgcccattaattacagagatgaaaaatcatctggaaggcggaaaagaactaattccgtggctggcggcatggcacctttgcactgagccacagccgtgcatgtggatatgtgggtaccagccctcccgctggcttcccagcatctcccccccccccccccccgctggcttgggccgccctgttgcttttttccgtctgatgtgcttgcttactcccagtcatggggacgggtgtaccccactatctcctgtgctgttggacatccttggacgtggagacagtccccggagttgtgggagtgtaaggagctggggactagtgcacctgggccaccgagccaggggggaggaggtggaaggccagagatgcggagccaggcttctattcccagcctgccctggggaacccccttctcctagggggcgctctggaagccccacgaggggggaggagcctgtgagcgcctggccctgctagaggagtctgtttgcatcaagccctctctgatctccatctgcacatgggactctgctgcctgctgtctttcttgtctgtgttgactattccaccaggctgacaagagaccctctggtgcttcggcctcaacatgggcatctagcagaggggaaggaagagggtcaggtgggccccaaaacctctaaagcatacacccctgaaagaagagtagtgggaacgggagccacctcccactcccaccacagacaggagcttctggtctgtgtccccgccctctgctggttcctcagccagacctggccaaggacactgaaagctctagtttctgtgtgggcttctcccagggatcagatttctagtcgccagacacttcccctcctccagcccctctgtgaggacactggaggaggagctgctcgaggtaggggttcccctgtgagctggagatgcccagcaagacttgcgagcctctctgcctgtgatagaaccagatgtctgctactaaggacagaaagtggggtcctggggtgggggtggggctctctctccactgtcagggaagacctggtgt

SEQ ID NO: 33849 - DNA, 1130 bp, Mus musculus
tgagcatgagtgggaagccagcacaggctacagagggagatcttacaaagaggggaaggaaggaaggaaggaaggaaggaaggaaggaaggaaggaaggaaggaaggaaggaagaaaggaaggagaaagggagggagggagggaaggaagaaaggagggagagagatggcttaagagtcacaagtgtgctgcgctcgtacaggaccagaattcagttcccagctcctggggatcggacatctctggcacctacactggtgcacacccccctccaacacataaacatgattacagataataaaagcaatgtagggcaaagggaggagggagggaggtgggctggcacaattggccctgtacgataaccctttgacctgccccctcccccctttagtagcaaggcaagggctggtttaattatgcttacattcttatgtaattctgtgcacatctggggacatcaaaggtacccttgcgtgtgaggacgtgtggggacatggtgccacatgactgtgctacagggtttaggctctagagagggaattcgagggacccttaccctcaccaggaggctgggagcccttagaatgtgagcagttgctcccaagatcccacggacactgaccctctttctgggatgggatcctccgtggtttaggcttctctgggccctggggagcgagtaaccttgtcttgttcgcctccccttccaaagtggggagaacataacagttcagtcaacaaactggaaacgccccagagctaaaaataacaacgtccccacacttacccagagacttaaaaagtcacacatggactgtgagctactagtggcccaatggtatccctgatgttggagcctgatgtgcatgctagctagccctttctctctcccccgtctcctctctgttgtcccaggcttccaccctcttgcctcagcctcctgagtgctgggatgatggacaaggttcttcatggtgttctttatgggaccccctggaatctgtaggatgcccaacaccaccctagagatacactgcctcagtgtcaacagtgtcctccacaggtaccacggcagcacccagtagtctctccaggccaatcaattccaaggcagaactgtccagctg

SEQ ID NO: 33850 - DNA, 1077 bp, Mus musculus
tttccagcagtctgacagcagcctacaactctagggacaggttcctaacctggtttctgtggggtacagcacatatgtggtacacaaacatacatgtaggcaaaacacccatatatataaaaaatgaaagcccccccccttctagctttatcttccactgaactagaacataaccagactacttccttagcaccagctcctgctcctgagtgctggctgacacatggtagctgcttaggagagcaggtggaaagactactttgtctgtttttctgtctgtctgtctacctgcctacctgcctacctgaggcagtggagatatggggcctgggatttccacagccgggcaagtgctgcactatgaggtgctgcaaccacaaacccaacgttattctgagcctctcaaccacactttgccactcaatgtgcccctgcagagacatggttccaaaactgtgacctgcatacatatctcgtcatttagccagaagtgaacctcatcaggatttgaaccttggacctgaggatgctcttctgtggctttgtccctttgccttcctgagaattctgcttcttttttttccccctttctgggggacttcgcacctcccctgccagcatgcagtcatcggggggacaagagtgtcctgtatgccctctgcctggcatgggaggtgaagctgaggtgaacaggggcactgtgaggtggacacacaccatggctgccctggtactgaagtaccacagtagagagcagagcaagcaggcaggtcggtcagagcttcttagaagaagggaaactggctagaaagcctgagaaggaagtactccctaaggtgaggaagaggcagggctcaggtacggaaatagaaggtgtttgtggctgagtgtgggtaggaagctggactggacctcagggctgtcattgggtttgaagggtctgtgttcacctgtggagggtagtgaggcccagcatgacatctgctgctggcagaactgaagtgctaagctgccagggatcggtagggtctctggactaagcagatgtggggcaggggtggcccagtcaggcagtcc

SEQ ID NO: 33851 - DNA, 1099 bp, Mus musculus
ccaggggcggggagtggggctgtcactgaaccatacctccagcctttacatttttaaaaattcattcatttatttattttgagacagaatctcacaatctgtttaaaatcctgactggtttggaattcagtttgtagaccaggctggccttgaccctatgacagtcccatttctgcctccagccagggcagccttcaacatttctctatcgaatgcttccatctccagttcctgctctgctgggctctgggacacactcatacacagccctgcagagccagcacccaatgggagaggaaagcatatgatgaaaatgccgggttcctccctcggcatcagagccgtgggagatgaagaagtaggggcagggcagagcgtagcatactggagttggcaggccttcctgggctctgaggaagcatgagagcgaagtccagtagacaagggggtgggcaggatatgcaaagatcctggggaagggctgtgtgggacctcagtgaaggctttgccttttggtctaaggaaggtgggagccatggggtgttctcagagaacccgagggaatgattcaggggttagctggctaccccgacctcacttcagagaagggaagaagtgactttatgacaaagatgtcacagggattcactgcagctgtctgtggggaagtgtctgcagcattgagtatgcactggggacctgtcctcgtcctagccttcttgggaaaggactcaggcacctgctctatctctgccagactcccttgtcagttcccatgtaggctccaggaagaccaagagcctaatcagttgatccagacccaggcctctactccagactggctgtggtccctgcacagtgtccacttcctagaagtggaggtgcaggtgagtccacagccaagaacaggagacaaactgcctcaggatggctgtttcagggacgggtgagtgaggccaggaggggcccagcgcccccatcttgttgcctgtcacccctcctcagactctcagactcccagactcccacccactcagcatacagggttgccgtagcaactgcaggctagggcaggctccaggcgccccctctcctccag

SEQ ID NO: 33852 - DNA, 1681 bp, Mus musculus
gcaggagaccaagacaggagagctgctgagaatttaaaggccagtttgggttactcaaaaaccaagcagtcaaaatgaccctgtagttaataccacttactgtatgcttaagtggttcggagactgggggtgcagctcacaagtagaataaattcttagaaacacgggaggccctaggtttcatctgcactctagaagaaaacacatagtttagatgatctaaattatgtcatgatttatatataacgtatatgagtatgttattatgtatgtactccacctctgtgcttggtgacctcgggagtctagaaaagagcattggaattggagttacaagtagttatgagctaccatgtgggttctgggaactgcaccagggtcctcagcaaggacaagcggttttgaccataaagtcatctctctaaatcttatgttgtagtgttaaaaacacaacatccctcggcctgcaggaagcctagagtgttaacacaatgaggacagacccctgactcactcagaacagaaaagggtcagggcttctgagatctggacctggaaggtggctgccactggtggataggaggggttcttggggtctggtcctgctagagagtatacttgcaccttcgcaacctctgctgtccctggggccttaggtcatgaactggatgggactctgcatcgagaatgtagacttgggggaagactttgtcccgtgctgttgtccgtctacccatcactgtcgctgtggtgtccctgcctgatgagggtctgataagcccactgcgcgcatttgaagattgttgttctcgtaagagtataataataattttacctccctgaggggggaggggtggcagaggatagacttggccctagattgtttcaaggtgacttgactttggggacctggactcacatggggcaggggctcacagagcctcctgtaactgttgtgagccatttccttctgcctctgaggctctcacagttggaaagaaagctctaggaaggacaggtgaagcctacccggatgggctgggaaggagaggggtggagagcgtccgaggggtctatcccagagtaaatgggagggaggtggctagatggtcaggggggctggcggataagacgagagctggttctggtgctgaaaggacagaggacagtcaaccctggatgggttctactgatggacctgcctccgtgggaaggaaggtcaggggtggctggagcaggagttaaatttaagctgagctgatggtgttggtgaactgccgatttctgagcataggctctgggcgtcacaggggactatcccagtaaggggcaggggaggggggctagaaatttttgtgagcaagaagggaggaaaggagaggtagggttgacacaacagggcacttgctgtcttaggagtagagggaagttgagctttgagatgtaccatgtcccttagctctggaaggtgaggggcagagtgggggctatacacagaggtagacttggcatggaacttatgagggagatggcaggaggtctgagattcagtcaacaaatacgatttctcagtatgtagggattgctctagaagttgggtgtggtggtcatgaactagatatctaggtccctggatggcagtttcctacccagataaacagtttcttatgagcagaatgat

SEQ ID NO: 33853 - DNA, 1255 bp, Mus musculus
agtgatggcctgggaggagcttgtgaccaaggaggccatcagtacacccttggtccctattccttctcctcccaccccgactgcctgtctccaactcaccccgagagtcccttagataggaaagaggggacttgggtgtccctggtcccctatctgtggcgccagccagctggattctaattagctgccagagcagagagacaggaagcagagtctaggggcggggctggattcctgcccaaagctgaagctgaaatcaggttagacaccccttgccctcctggagggatgaagatgtgtggtggtgcagaggactgagttagggatgaggttggagcagctctgctgtgggtgggtgcttggcagccatgctgacctatcaagctgcccccccccccgagctggtgacagtgacctgggacagggcagtgtgcacccccagggtgcagagggcccaggaggggcctcaccactaacagaagatggatgccctctgtgcttgctgaggtcagctcctgcccagtatcattcccctgtcctccttcaggctggtgggccaggccgtggtaccctggtgatgcggggcgaggccccccccacagtccgctgagatccctgtgcccaaccctggccttcgccatggcccgcttggctgcagcactctggagtctctgtgtgacgactgtccttgtcacctctgccacccaaggtaggtgttgggaagggctgggtctccaaacccagatgggagggtgggtaatatgaattctttatgggttgcagcctccaccccagatgaagttggaccaggccagagggaacctggtgatgccactcttagcaggcaccactgggggatgttgaccacccagcaggccagggtaccatgtgctgtcttgcttggggaccctgaggaccaagacatgccttctggggggccacccatttctctgtctttccctcccctcattcatcacatctctgagtctcactgggaccaaggcttaattaaagcatgcctgctgacgtttatttaaaaacaagtaattacccagctctggcctgggatcctgcacacgccacaattagtgccctgagcacgctgcccactgtcgattacttagttaccatcgcaagtcgggtaccagctgggtgcagagcaacagaagctaagatgggggtctgttatccttgccctctccagagaaggtccccctccccatacgtccagtcctgtcctctggaaagtcacagg

SEQ ID NO: 33854 - DNA, 2105 bp, Mus musculus
ggggtcaaagtgtgcccagagtacttgaggtaatagacagcatggggcccaggctgctttgtggtccacccaggccaccataggttttgagggaatggcagctgcgtggcctcactcctttgaacctcagtttccctagctgtaatcagggtgccagtaggcctgacttcgagggcctgcactgtccctgcatcctcatgagcactggccgtcactgtgactacacttcacttctaactagttactgttattgccatggtaatcaaaataagaatagcaacatttagtgaacccagctctccagacaggcagtcccaagactggaaaggtccctggtccagtccagagtccaaaccaaggtacaagaataaaagaagaggccatgggtactgagtggagtttagagacttaaagccaacaccaccaccaccacaccatttgtctaaggagcacaacccaggaagacgggctgtggggttaaaggtgacacagggcagaggtggcaggtttagactgaggaaaatacaaatgagccttcgaagacagtgcacagacagagcgggtgtcgtggatagggctgaccacaagtgctcctgggcaggcagttgagttagctcctgtacccccgccccaggtcattggggttggggtccaggaatagccaaagccagggagctgacaggcacacacctccatgactttccctgagcatatcctgagtgctaggccctgggcgaggcgctggggagccagacagtccctgcagaacccaagccggtgcccagaggggaatccaactgctcagccccaggaccttgggcttcagaggctggggtgaccccagtgctggtgaaggtggggcaggggtggggggcaggggtcccacagctgggggaggtggatcactggagtgtgggaaccccagacattgaactaacactggatttgctttgcagctgagcacagcctaactctcccttcctccccaggtgccacctgtgcgtcatcaagggcggtgggcagggtagggtgcagctagggcttctgggcctttggtggactgggcagaacagctgaaccttgagacacccctccagcccccaacccccacccccgagagtgtaggagcctgtctgccacgtgctgtccagcccagtctatgtcccctccaattctgtgcctcttgtctcccctaccctggctctgtctgaggccggggcacctgcctgcctgcctctgttgttctgtgtctggctctactagcctttctttgtgcgtttcaggggtctggagggtttaggggaacatagctggattcaggtggggcctactcgaaggggaaggggctcagcctatgctcttggctgagtggggcacctaggccccggagacacccttctctcctcccctagttctaacagggtaatttagcacacagggtgaagaggagccctgtggttctctactgcctggtgtgtgcccccctagccagagttcagctcctgtttggggctcctctttatacctggggcccttcctgcctgagggctctgtctacctgcctgtctgtaccatacccagtctctttgtctcttccctcctgtgtgtccccctgacccttctcactttctcctcagcaccctctcaccccatcctaccccaaaagaagggacttgggggtgggggctgaaatgatgctacggaaggggttgggaaagcaggaggaaagacaggaagagggggcgtgtggccagaaaagaaacgaaagcaatttaatctttttttctcttttttttttcttgcacattttttttcaatttgttttctctctctcttccgatgcttaaagtagaagtggagcagaaaggtaaacgcactgttaccaatgctaacccctaactcacactttgttccacccgtaccatactcatgtggcccacccctcccccccttcttctcccccaccctacttggtccagtgatttccctgccccgggtgtcctcccggcacagctgggctggccctggtgctgcagcaccaccaaggccaaggtcatggccacgggcttctccaccctccagatactcacggaagctcctctctg

SEQ ID NO: 33855 - DNA, 1127 bp, Mus musculus
tttcctttgagggaccagatttctcctctctctctggctcctggtggcttaagttcttctggtttggcgtttccaaggcccagagctgttgtggagcacagagagccagtctcctccaactaccctcctgaccagtcgggtctagtactggggagggttgtcagctatcccagtcccctgggagggggcagcctaccaaaaccctgggatgggggttggggcgggcttcctggagagggcgggagtgggttctgtctctgcacacttgcaaagctgcagtcagggtttcttccgggctgagaggaccagggaggggcggtggggggtcacagacttgctctggggacttccacaggccccataatttcttgcagagagccccatggcggcggtggatgaggctatccattacgccagggagtggagggtggcctgctagtagtagggcaggaagccatcaacagtgagatggcccttcagggtccctctagccttgaaattaaggtggtctgtggaggctcccctaccggggaggtgggcggggtccctctgagctgctcccctccctttccttcccaccttgcccatctcagaggcctgggcaccgtccctcccttgctctcctgagtcgagtcggccctgcactagccactcttcttgcaggcttggaactacgccactggatctcctctccggttgggctgagggagggaagaggtgtgtgggagctgggtgctgaggaggggtccttgctgcccaaggcccctggcagacccttcctcatcttccccccttccttggaatgacctctaactgtgtttttctccactggtaccctctgactagctcaggccctcttcatgaacacacaccctggcaagggtttctgtgggacagaggaaagacctggggaacaggaaaaaaaaagggtgggggccaggtagtctggtcagagggtacagataaagctgacaggaacgccagggctgtgttactggctgccttgcgcctagtgacctggtgccaagctgccccagtgctgtgaagggagagacccagcttacacattccccaaccatgctagcctgctgagtaactaggcactaaacctggctcctacccagggg

SEQ ID NO: 33856 - DNA, 2142 bp, Mus musculus
ggggcggggccccccacctttctgacatcagcgctgcctcggtccctcctcccgagccggggatggtcacaggtaaatcggggtccggggcaggggaggtggggggttggctggggtggtctggggctttatcctagcacctggttccctcccttgccccctccgagctggacctgggactgcccctggaagggactctcagtcgggcctgggccttggagtgaattctctgctcaccccctctctcctcgccagcactaaccttttcttcccaggtggtctccagagcgtctcccttggagccaggactttgtggatatacacacacccctccttgtctctcttccctctgcacagctccctcacccccaatgtcccgggagtcctgttgttctccatgcccccactccaccctgagccaccagagaccctgccggctggggcagcactggactcctccctaggagctgcttccctccgtcctttcctcagctacctactgaggctgccagctgagaggagcccagacagcatcagggacccgaggagaaggatagacagccctaagcctccctgccagagtgggtgtggaaacatcactctaccttgcagcttttggaggaggaagaaagtgaagtttttggttttgttttaagagaaaagaaagtctacccctgcatggttggtgaaggatgggatcccggcccctagtttttccatagaggcagagaagagaggccagggtgctgatacctaaaccttgaggctaggtggcatcgcagcagaggaccccactccccaccccctcatacccaatctgggagagctccggccaaatcctttatccccagcctgtagggtctctagcagccaaggaagggaagaggcgccaccttcccacactaaccctgctcttgatggtctccagggttcacagctccagggagaggggcagctgggcagggcgggagttccagcccacaaacccccttcccatcaccagcccgaccaagcaaccatgactgcagcagcaggaggggacagcgtggtttcctcccccaccatgtgaccaacttgcctctctctcccctctctccttgcctctgctcctccccacctcctccctgcctacccacccacccacccggcccagtcttcgtgtgcccagggaccctgcagaaggtgctggagcccacctctacacatgagtcagagcatcagtctggtgcatggtgcaaggacccgctgcaggcaggtgaccgtatctacgttatgccctggatcccctaccgcacggacacattgactgaatatgcctcatgggaggactatgtagccgcacgccacaccaccacgtacagactgcccaaccgtgtagatggcactggctttgtggtctacgatggcgcagtcttctacaacaaggagcgcactcgcaacattgtcaaatatgacctgcggacccgcatcaagagcggggaaactgtcataaacacagccaactaccacgatacctcaccttaccgctggggaggtaaaaccgacattgacctggcagtagatgagaacggactgtgggtcatctatgcaactgagggcaacaatgggcgcttggtggtaagccagctcaacccctacacgttgcgttttgagggcacttgggaaacaggctatgacaagcgctcggcctccaatgccttcatggtgtgcggcgtcctctatgtgctgcgttctgtctatgtggacgatgatagcgaggccgcaggcaaccgcgtggactatgccttcaacaccaatgcgaaccgtgaggagcccgtcagtctggccttccccaacccctaccagttcgtatcttctgttgactacaacccccgggacaaccagctctatgtatggaacaactactttgttgtgcgctatagcctggagtttggacccccagatcccagtgctggtgaggatcggctttaagggatgtaggcctgtttgcatgcattactccagtaccaggatgtggggcctgctgtaacctctgggggattaggaggtaaagaaaatcacaggttgtggcaaacatcctcccttcttcgagttcatactgcatgtgtctactgtcttcaaggcttggtggggtcacggtac

SEQ ID NO: 33857 - DNA, 1650 bp, Mus musculus
agaccgaccaagggtgggcatcatgcctttttccaagtgtctgctctgtcttttccttccttggctcctcttcatctcctctttggcctttttgtctatctgcaggaattgcctcattccagtgcctcccagctctggggctctggaatcctcggggccctgacctcagcaactgcacttctccctgggtcaaccaagtagcccagaaggtaccagtaactgctgccccttgcaggcaggccaaccagaacccagggttagcaggagtagtgggaaaagttggagaaacacggggctgaaagccagggcaagggttctctttctatctagaccttgtgtggggaaggccagcaggagaggatggcctgtgcaggagggcggggcatatgaagagggaatgtgcagcagtgaaggcccctacccaccagacctgaaggcccctcctccccatctcatgcagatcaagagtggagagaatgcggccaacattgccagtgagctggcccgccacacacggggctctatctatgctggggacgtgtcctcctcagtgaagctgatggaacaactgctagatatcctggatgcccagctccaggccctacggcccattgaacgagagtcagccggcaagaactacaataaggtgggcctgtgggaagggtctggcttgtttttcggcacctgctgccaccctacaatgaccagtgagggatgtgggccctcaggggctgctgcactgtcccgagtagtccttacgaggtagggttcctgaggaaggtctctggaagagtagtctgttaaggctagaggagaacattgcctgcagactccatttattactccttccatttctttctctagatgcacaagcgagagagaacctgcaaggactacatcaaggtgagcccaggaatgaggggccctggaagggagaggaagggacatcaagtcactagaggatgtgggagacttattctattgtccttgctacccacaggctgtggtggagacagtggataacctgcttcggccggaggcgcttgagtcatggaaagacatgaatgccaccgaacaggttcatacagccaccatgcttctagatgtcctggaggagggtgccttcctgctggctgacaatgtcagagaacctgctcgcttcttggctgccaagcagaacgtgggtgcgtactgcaactatcccaggctcagtctcaaactctggcagagggtgttgattcctgggcctgtggttttgccacgggcctcagggtttagcatgagtcctgcctgagggtagacactgacagcatgtcttccctgcccacacagtcctggaggtaactgtgctgaacacggagggccaagtgcaggagttggtgttcccccaagagtatcccagtgagaactccattcagctctccgccaacaccatcaagcagaacagccgcaacggtcagtgtcccacgggctttcctctgcgtgcatgtgggccactttgcatcttgatctcggtatgggacacacagtagtcatgtgtttaatgggggtgtatctgccactagtgtggatgttccaacgctctgcagaagtctgggttctggctccctttgagatggaggcatagagaggctagggatctgcccaagg

SEQ ID NO: 33858 - DNA, 1068 bp, Mus musculus
gagagatcgtaagctggctggtgctctgctgtccgggtgggcttgcttggtgctggcctggctttgcatggcattctagagaacacacagcatgggcgatgcctatgaggccagctcataggcttggggtgggggatcaccagtcttacctggggcatgaggccttgcatctggctccctccggccccaaggcactctggagaagcaagttggtatcacaagccttccagagcataaggaagtgagcctgcactgccacatgggtaggggccagcttggtggccagttgggcagcactagagggccttgtggcccacagccttgcctgggtcctggcctttggctggcacctggccacgccctgaatgcacctctttctgtccccagtaccaaggccgtattaatgagctgctgctgtcagtcatcacctgggttggtattgtcatctccctggtctgtctggctatctgcatctccaccttctgcttcctgcggggcttgcagactgaccgcaacaccatccacaagaatctgtgcatcaacctcttccttgcggagctgctcttcctggttggaatagataaaactcagtatgaggtgaggcatacttggggccaaggctccgcagcggggagggctgcagctcgagggcagccactgactgagctgcccttgcaggtcgcctgccctatctttgcgggactgctgcactacttcttcctggccgccttctcctggctgtgcctggagggcgtgcacctctacctgttgctggtggaggtgttcgagagcgagtattcacgcaccaagtactattacctaggtggctactgcttcccagccctggtggtcggcatcgcagcagccattgactaccgaagctacggcactgaaaaggcgtgagtcgtcctgttgtccctgtgttctccatcttcttcgttcttgagtggctggctttctttgggccagggcagggtggctgggctttcaggcatcttcccactctggttgtgtttctttgtagctgctggctgagggtggataactacttcatctggagcttcattg

SEQ ID NO: 33859 - DNA, 1105 bp, Mus musculus
aaagaccctggggagctggtcccaatacacacccctgtcagcctattgcttttggcagacgccactgcagcagaggaagaagaaagtgggaacagaacagagaccctgggacagacccctcagctcctttgcctacctatccaaccaggcccatccttattgctccctctgccctgcagagcaccccttgggaggccgggaagcctgtggcatggacaccctgccacttaacggcaacttcaacaacagctactccttgcgaagcggtgatttccctccaggggatgggggtcccgagccaccccgaggccggaacctggcagatgctgccgcctttgagaagatgatcatctcagagctggtgcacaacaacctgcgaggggccagtgggggtgccaaagggcctccaccagagccacctgtgccacctgtgccaggggtcagtgaggacgaggccggtggaccagggagtgctgaccgggcagagattgaacttctctacaaggccctggaggagccgctgctgctgccccgggcccagtcggtgctgtaccagagtgatctggatgagtcggagagctgtacggcagaggatggggccaccagccggcccctctcctcccctcccggccgggactccctctatgccagcggggccaacctgcgggactcgccctcctacccggacagcagcccggaagggcctaatgaggccctgcccccgcccccacctgctccccctgggcccccagaaatctactacacctctcgcccgccggccctggtggctcggaatcccctacagggctactaccaggtgcggcggcccagccatgaaggctacctggcagcccccagcctcgaggggccagggcccgatggggacgggcaaatgcagttggtcactagtctctgaggggcctcatggacccgaggcctggccagggagggaatccaggaggggctctggtgggagcagagactgacggaggcagtggctggtgggccactctctccaggtgcccctctgcctgtgggccccacagcccccttggggactatgacctgggccccaggtgccagggttagtagacagggtttccac

SEQ ID NO: 33860 - DNA, 2707 bp, Mus musculus
ctggagactgggccttataccacgagaaagcccaggcccaggggctggggctgggtggggcgggaggggggctggtggttaatggtggaactttctctgaagctcctttctcctttgctattggtccctgactcccaagcaagcctgcccctcagcccccagagtgcacccaatgacccccctcccttggggtgactcctgatgaagcacaactccccacagggcccctaacccactggagtgaccatatttgggcagttcccagtcctgtgggctgggctatctggggaacagatttggggtctggggctccctgaggagtgggtcctgggtttggatctttctctagggggtcctcttacccctctctcttcctcccctattgctgtaaatatttcaacaaaatggaaaaggaaaaaaaaaaagacaaaaaaaaagtaagaaaatctcatcacttgaagccaccgggcacctgcagcccaggccagcccggactttctccggaacagtgcagcggccagccctggcagccaggacttcctgtatgtgtacatcccagccggggtgggagccgccagagcagctttttacactccagagacagaacaaatctagaagcaacagcaaaacaaagaacctgtccttcccagcaccggtcctttcacctctgctctgtccaccctgcatcagtcagccctcctggggcgtgtacctcactgcctgccccagggccagaggcctgtctcccctgccccactggccaggagacaagatatcttcacacccaaagatgcttttgccaagatggctgcactatccctttgagttcctgcttcttgtatatcacttcaggactcacagcaggcaggaggaggctggtgtcccatcctgagaagggcaagggaaggaaggtcagatgtggttcctggggctgagggtgggatggcagtagtgatgtcatttcaggggtgggggacaaaggtgagaggttgcatttccttaccctatccctaccccaagccctctgtcaggcttagggtgtcctctaaacacctccagcccagcctgccctccccccagttttttggggggggtttcataatcctgctgccatcatccagaggtggcaacacacctctgctgacttcatcctgtctcttccctgcctccttcctcacaagtgccatgagttttcaagcatccttgggtctcagcttgctgctgccatgagcttctttgcattgtgggggagggactctaggtaggagctgaggaggaggtggatgggtggctggaaggaccctttttgctgctagaaatccctctcctttctaaggagctgggactggcttgtccccaatcaatgagggggaaaggggccagaccaaagataatggtttgccccatggaggggaacagatgtgaaaaggcagggtttattccatctctggttttcttctggtaatgttttagcttgtcttgccagaagagcaagagtgaagtctagataggggagaagagacaggatggggacagttgccaggcaggtgtgaagagagcatgaaatggctcatagcccttgcctgacttaactggatctggactttgctgtggctgtatggagtggctggcctaggagccagaggacttgactcagcccaggcccaaggccatcagacaccaataaagctggaagaagctgtggggtgaggagctcctcggggactggcaggcacaggagtcctgcgtcctttcttcctatacagcccttctccaaatgtgggctatggagggcaggctgtagtgtagtagggcccatggtttctgcctagctggaatcactagcacagggagcaacttgcttctaggcctcagagctacatggcaggtccccaagtggggctggatccactacaatccagcgtaagccacccagagagcccaggtgtcccctaccctaaccagacctggtgccttgacgcccccaccccagcggggacggtacagagaagggtcttggtctcctcctcccttccttgggctcctgaattcatttgctcctgaatcttgctcattctttttctctaggtctttttcttttgagttttcctagctattcaactttccgttgtgtccttttttgctgtctctgtgttcctctcattctcaatttcttagtccatttgggcctcctccctgctcccacaccctactccctcccctccttggtctccttttcgatatgccaaaccaattttgggtcgagtgcatttaacgagaataaaacaaaaggctcataagaacgtttcagaaaaaaacaaaaagttttaaaaaaatgttgagtcaaaaaagtcaaacaataaagaaattaagatttcttgaaatgatagagtggtgtgatcaattggtggacaaaaagatgcatagtataattcccttggtccctgagatacaacattctgaagttggatgagcatggtattacaggcctataatttcaacctgtgggaagctgaggcaagaagattatcagtcttggtcagcctgggctacacagtgaaaccctgtctcaacaaaattaaggggatggggagatggttctgtggtaaggaacacttggctcttgcacaagttccagcttctttctgttcccctatagtggcacacaaccacctgtgactccagttctaagggatctgaactctcc

SEQ ID NO: 33861 - DNA, 1150 bp, Mus musculus
atcttgccctatcaagttctgttttgtttcttaacggtgttatggatggaacccagggctttgtatgccgtagacaagtgctctacaattgagccacatccccagccctgtaaaaatctttttgttcttttggttgtgagcctgtacgagttgagctattctctccagcgacctgtaatgctttctgttttattcttaaataactcaggctggtctctgagtctttgcctttctcagtagccgagactctagttgtgtgctgtcacatcccacacgattttgttttgggtcttgcaagctctgtcctctgtcttgcctgtctagcaaatgatgactgaggcttgggacagtagctcctgcagaactgtcactttctctagaaaatgcagtgctagaaacatggacaactgggaagatagttgtcactgaggtttcaatgcctgcccctccaagccactgtggtcttcagctggggcccagcgtctggagacagggccttgactccctttgcctcccacaggacaactcaaacctgtacatggtcatggagtatgtagctggtggcgagatgttctcccacctacggcggattggaaggttcaggtaagcgggccccatccctgccaccctaggggccaccaaaccgtccagggacatgtaggagtccagtgtgcttggaaatggaaagtgagctctgggtgccagtgggattttgtgtatgtgtgcacatgtgcttgcgtaccgtttgttgtagctgtgtagccaaagctggtcttaggctcacaatcctcctggtcttgcctcctgaatgccgtcaactcattcagctcctgtggggtttgttgctgttatgctaagcaatttgtgatgtttcagtcaaccaagttgaaagaccagtcatggtgacttaggggtcagaatttgaattggcatggctggaggtggagctcagcaccattttacaaactctagcacagaaaggaaaaaggaagtgaggtagcactatgtagtccaggttagccttcagcttctagtctgagtcctccctcagcttcctagagccacaggagcccaccactacagctaacaagatactagtatgttacttaacaaacatgtatctctatatatgagattgttgttgttattg

SEQ ID NO: 33862 - DNA, 1736 bp, Mus musculus
ttgtgatggtaaggtcagctaatgtgatctgggtggttttgattcctatccaggtggaagctcccttcataccaaagtttaaaggccctggggacacgagtaactttgacgactatgaggaggaagagatccgggtctccatcaatgagaagtgtggcaaggagtttactgagttttaggggtgtgcttgtgccccttgggttctctttcattttttctttttctttctattttttttccggttgggggtgggagggttggatcgaacagccagagggccctagagttccatgcatctaatttaacatccactccacacccccagggttaaggagagcaggaaagcgctccagatactggggaaggggcaacatcagctgctccccctctcccttcttctccacccttccctgcctgttttcaatgaatttcttagctccagccatacccaatcttgctggtgtatccaggggcagggtacggaaagagggccccaaattcagcctccttcccgaccctagcactggatactaaggatgaacgaacagtaacgccaaccttcccttccatgcagccctacctggaaagggagattttatgacctgtacagagggctgcttgccagtggggttttttttttttttcatttaaattaagttccaccagtgcctcccaccctccaaactgtcccaccctccccaaacaccctcctcactccctaaatccattctgatgagacccgggtagccaactgaccctgtcaaggaaggaactgggcttggaatctcgccctgagctgctagcctcccggcccccctttccagtggtctcatgccaattgtcctgtgcatcagcccccttaagaagcctcccccatcctgggcgcctcgcttctagcttagctgtcagctgtccatcacctcttgccgtgcgtccccactcactgcaaccccaagtctgattgtgctttttctctcaatagaaaggtggggagctgctggggaaattaccccatttatccctgtgtttatccctctcgtaacttctcccaaaaaggaggagctctcaggcctgggtgggggccccgggtggacgagggggtcgttcaacctgtgtgcttcgaaggatgagacttcctcttgaacagtgtgctgttgtaaacatatttgaaaactattaccaataaagttttgttttaaaataaaagtgtcgctggttttcccgacttcgatcacacccttggggtgttggaaagggaatttcgaacctcaatgtccaggttctggagaccccggcctcgggaccttggagaaaccaggtttggctggaattcctgtacttcctccgcctggccagagaaaggaggggtggggtgggcaaactgtcctttgaccctgagttcggggccctcaaatctgctcccacccctacttcggtctagtccgggacagagagggcactggagagggccactcggaccggttcggccaaacagcagcaggattagcagggtaggagaaaaggggagccccgcgcgcccccaagccctcatgtaggcgcggcagggccgctggtgaggtctccgcggcttcccaggagcgaggcgcgtccggccgcggcgcggctagttcccggtaagtgcggtcccgagagcgctgagcgcggagaggcgtggagagggggctgggcgccgaggacgtctgggtcccgcgcccaatggctggagggcggccgaa

SEQ ID NO: 33863 - DNA, 1082 bp, Mus musculus
gcttcagcaaggccactttgaggatgatgatcctgatggccttctaggctgagcacccagccatgtccccaccccaaccagtccagactgcacccagggcggctccatagtccaggagctgggcatgggtacactcaaccttcctaacagactccagggagggggtgcccttctccattctcccccttttctcacacccctgaccttagttcacccctctccacagcagtggagtatggggttggaggacttggttggctcatttacctggggtcaccctttctccccagaccaggacatttttgaaaaacaaaaaaacgggagcttcctgtggccccaaacccctcttcagttcagccagatgtatcttatatgtgttttgttctgcctattcatcctggtggtggttttttcctcgtcccaccacccccgtgtcctcccccttgacccccagcctctggggaacaggtgaggtaagggaccttgggtcctcttgtccttccctttctgtctgtctactattgtaccacctggctgtattgctttttaatattgcaccgaaggttttttaaataaaactttaaaaaaaaaagttcattttctgtatggaggaagaaggtgctaaaagcctccttgaagagtttaacattaagacagtaatgtggtgaggcagaatagctacggcttccctcagcccactactcaatgggctcaccaagtatacagatagaacgtctcggttctatctccaccaccacaaaaagagacggtttttgtggctgggcttggtggcacacctgttatcttcacacttcagagagggaagtcggatcaggagttcgagactagacttacctacatagttaaaaggcagcttgggctacaggcactcagtcctgtctcaacaatgacaaaatcagtctaggactggaatagttcctttgtcttctgccatctcattccagaaccacctgctcaagtgtttgttgagtgactaacagttaactgcacacttgctgagcgttttgttgtcacctctgtagtttggtgaagcagacgtcataaaactcattttatagaca

SEQ ID NO: 33864 - DNA, 1169 bp, Mus musculus
ctcaacacagacctgctggtaggcccgcctggcgcagagaggtgagcagggcctgaaagaggtggagaggagggggctgtggtcagcagggttagaacaggacacagcggaaatgtgctctctcaaaacgcagcctctgccttggtagagaatggtaggcaaacccactcactgttactttgttctgtgttctgtgcaagttggttgtcttggctagatcttagtttgctcatccctaaagtaggaataccaactcagaagtgcctttggaagggccagtgagattataattgaaagcaattagcccaatctcgaagcccgcgaccttgaactcgtgatctccctgcttcagctttccttgtggtaggattaccggttcctaccaccaagccttgatcacaaagggacttagtgtgcatgcaggtgtgtgaatacaggtgtgtgcagctgccccatcgtctttcttcacatctttccttcactccacgctggccacattgtctctcttctattattccctttaacgtctggctcacccgggcagtactgtagccttagcctcgaacaatggtctccaactcagcactctggacagggcacacccttctcggcaagcctcttgaagccacgcccagctcagtctctaggggaaacctcctcaccctagacctctcttccttttcaccgctttgttctctccccttaactatttgcaaacgcggcttatttatttgttgttatgtctattacttacctcctcccattggaacttaaagtctgattgcatcaggtctttacaggttgaggatgtggttcaacagcaatattgcaataacctagtgtggcccagggcttgggttccatcccaagtattccttcccccaaatactttatactcacctcagaagctgtccacgcaagcactaacatgatatactgttaacatgatatactttatagtcacctcagaagctgtccatgcaagcactaacatgatatactgtttaagcgggtggggcacaaacatacctgggaagtacaacctgggaccaattttgaccttgtctctattctccttgcagggtccccgtcctctctctcagtctgccatggaagcagctcctaccggtaagcattggagtccccaagacctggggtaccgtcaccac

SEQ ID NO: 33865 - DNA, 1096 bp, Mus musculus
catttcacaggctgtgagtcgaattttgtaacaaggtcagagaacttttatggttgggaggacaagaaataatgattttgtttcttcactgatggagatggaacccaaaaccttgtacacaatgaacacttgctctactggggagccacacggcaaccctgccatgccctagccccacgccaggggactctagacaggaactcaatgctgaggtaccatccaataacagtacttaaagacaaacaaacaaaccaaccacattcttttagattgtttcttatgtgtgtgggtgttttgcctgaatgtctgcctgtgtaccacatgcattcagtgcctatggaggacagaagacattctcagttactgggactggagatacagatggccgtgagctgctatgtggatgctggaaaccaaaccccagtaagagcagtcagtgctcttaactgctgagcctctccctagctccgggaatctgtctcaaggggttcagaaggaaaatcacatgcaatcctataacccctgttgacagtcagggaacattctttgtatatttgagccttggctttgctcgaaactgaactgcctctctccctccttctttccctctctctctccctccctccttccctccctcactttctcccttcctttcttttttatcaaaaaacaaagccatctaagcatctgtaatcctctttgtctttcagtggtgtgaaatatgacaggtgtccatcactgtcgatgagtacagactggagccttcatctttactgtatctgtaagcccatttcagtggttgtcaagattgttactgtcctctgggaactcagtgacatagagttcccagaagctgggaatgtaggggcagggtggatgagaggtggctcttcggggacagagggaggaggaggaggcgtgtagctcaccgttcctgcagacagtggagaggcctctgctctgtatgcagaaggtgtagtgagtagcctggcctctgagctggtgtcttggtacttctccccaggctacaacaggtgtccctggggggtcatctggaagtcgccaaactgctggcccagcaaggggtactgtgaag

SEQ ID NO: 33866 - DNA, 1133 bp, Mus musculus
tacatgtaggcagaacacacacacataaaatgaaaatgaacaacaaaaacaagcaactgagttaagcaacaccaggaactgagcaaccgaggaaaacatcagctgctaacctttggcccccacgcctgtaccggtgaacacttaaacaataaacaaaagcactgttaataacgaggtctgacaaacgcccatgcacccgtcactggactccttactcattcgtcccgtcccacttccctaacagaaaacatccagtccagaaatctcagtttgggaccagggatggcttctgtcgattgttttgagacagaatctccctctgtagtcaattcttgaactcgtggttcttctgcctcagtttccccagtgttgggagtttaggtatattttcaccctcttctacctcactttcaacatattgaacccctttaggaacatgaatttgttttcaatctataatgctttccatctttattacctcactcctaggatgttctgcagtaactcttattctgtgactgtgggagactgaattttcatcccacatatattaacaactttgtctttagctgcaggtggctagtagcaagtgtatcagtcagtgctgttctagaaagttctaagactgtaatccccaggaatactgtaacaggatatgtgacttacagctggcaagggtggctttcagaaccattgtggaaagcagttgcagaaaactcagccacgcagactgtcagcactacccagtcttctcgtgtgctccaggtccagtggctcctggataattacgagaccgctgagggcgtgagcctgccacggagcaccctctactgccactacctgctgcactgccaagagcagaagctggagccagttaatgccgcctctttcggcaagctcatccgctcggtattcatgggtctgcgcacgcgccgtctgggcaccaggtttgccccccctccaccctcatctgcccttggccaggggggtgtacactctgcccacgtgacccacctcaactccaaggggtcttgaaccacagggcaaagaccctcttgccccttgttaactcccttgctcagctctgcttgtgcctaccctggggacatcccttgggccatcttccctttcct

SEQ ID NO: 33867 - DNA, 1105 bp, Mus musculus
aaattgagatctttttacccctgtcctagatatagggattacacgtctgcagtctgctgtcatgtcacatcatctcgagctctgaaatgattcatttttgctttcttgcagacagagactttgccacagagcacgtgtgttctttgcccatagtcagccagcaaagaagctgcatagctcacatgcaggctgacgagctccagaactgagtgtcccgtagccaaaaccctttccttccctttcctccccctccccctttaaaaagggcctcatatgtagaccaggctggcctcaaactcatatatatcttcctgcttctgtctcttcctagctgggatcacaggtatgcaccactgtagggcttatataagacctggccctggtgcatggcatgaaaattctactctcctcccttttgtgtgtgtgtgtgtgtgtgtgtgtgtgtgtgtgtgtgtacagagtgcaatgtcaagtgtagtttctcaggattgtgtgtgtctgatgtcctaaaaggtgggagacatagaatctcctgtaactggagttacagatggttgtgagccactgtgtaggtgcagggaactcaacccaggtcctctgaaagagcaacaaatgctcttaaccactgagccatctctctagctccaaccttgttttctcagagaaggtgtcttactgggacatggagctggtgaggcgggctggtggtgagccctagagcatcttgtggcttcccttccccagctctggaattacaagtgtgaattgccatacctggggacaacacaagcccttttgcttacatggtgaccactttattgattgacctatcactgaagaccctgatgtttttttttttttttttaagatttatttatttattatatgtaagtacactgtagctgtcttcagacactccagaagagggagtcagatctcgttacagatggttttgagccaccatgtggttgctgggatttgaactccggaccttcggaagagcagtcgggtgctcttaccaactgagccatctcaccagcccgaccctgatgttttataaagaagacgtgtgtgtgtgtgtgtgtgtgtgtgtgtgtgtgtgtgt

SEQ ID NO: 33868 - DNA, 1402 bp, Mus musculus
tcttaaccactaagcatctccagccccatgagaccttgtctttataaacaaaaacaaacaaacaaacaaacaaaaactagttgggcgtgatgacccacacttgttatcctagctcttgggaggcaaaggtagttggatctctgagtttgaggccaagtggggctgcagagtgagattaactgcaccccttcacatacacccccccccaaaaaaaaaacaaaaaacaaaaaaactgatgaagctgggaggattcagagccaatggttgtagggtgggaagggaaagggcagggtctggctgcacagatacacactctgccctctccccacacccaggcccaccagcgctgatgagcatcatgaagaactggtactccttgttcaccccagtggaggcggtcaccatagtggcagtgacaggcaccacgcatgccactttgctgcgactgcagctagatacagctgggcgagaggagctctgggcttgtgcccgcaccttggcactgcagtgcgccatgaaggatccccagaactgcgccttgccagccctgaccctgtgtgagaagaaccacgcggcctttgaggctgcctaccagattgtgctggacgctgcagccggtggcctcggccacgcccacctcttcacggttgcacggtatatggagcatcgaggcctgcctctgcgggcctacaagctggccacgctagccttggcacaactcagcattgccttcaaccaagacagccaccctgcagtcaacgatgtgctgtgggcctgctccctcagccactcgctggggcggcacgaattgtcggccattgtccctctcatcatccgaagcatccactgtgcacccatgctctcagacatcctgcgacgctggacactctcagcacccgggctgggcccactgggggcccgcagggctaccaaaccactagggactgacagggcaccactttgtcagcttctggatgccgcagtagccgcgtacataaccaccagccactctcgcctcacccacattagcccacgccactatggtgacttcattgagttcctgggcaaagctcgagagaccttccttctggcaccagacgggcacctccagttcgcacagttcttagaaaacctgaaacagacgtacaagggaaagaagaagttgatgctgttggttcgggaacggtttggctgaggaactgcagaaagccgggagcatgggtgtcccaggcccaccttcctcaaacaggaggcccatggctacttgcagtaaagttacagaggtgggaggcagagggtgacatcattccaggtgtgtgcctaggagtgtgcagacaaacgggacatgcgatctgaggatccgaagccatactgctaactagaccctgcagggagtatgtgc

SEQ ID NO: 33869 - DNA, 1157 bp, Mus musculus
ccattgagcaatctcttcaggccctgagaataaacgtccctcatggtgcttgcttttttttaaaaaaatggagacaaaagtagtcccacggaaggtcgtttgacacgctgattaagcgctgggtgtctgtgagccgtggataggcagagctgagagttccaagtcatcgcttcagtaacggatggacgatttccggcaaaaaaatagccccatcaccaagcatcttggagctagaactcggccttgggagaagttacagccactctggaagacgctaatcgcccgataacctaggagcgcgtgcgcatgcgcacgcggcaggacgcaactccgccccgcagcctgtgcaggattcctcgtggccctgcagggtaggcaacatgacactggaagcgatccgctactcgcccggctcgctgcagatcctcgaccagctgcagctgccagagcactgccactatgaggcactgagctccgtgcagcaggctagtgaagccatccgcgccatgaaggtgcgcggagccccggccatcgcgctggtcggctgcctcagcctggccgtggagctgcgggccggcgccggcggtcccggactcgctgctctggtggccttcgtgcgagaccagctgcgcctcttagtcgccgcccggcccaccgctgtcaacatggcccgcgccgcccgcgatctgggtcaagtggcagcccaggaggcggaacgagagggtgccactgaagagaccgtgcgggaaaggtacgggatcctggaccagtcttgtgtgctctgcccagctttcctctctaccattttctttcccatcccacttccggtccagccacttggttcttactgcttttctgttgcaccggtacggctcctgcctgtggctgagactagagtctagagcattaaagcactggagttagaacttcatctccaggttcctgctccttcccctccccttctgtaaaaacaccttgtccctgattctgccccttcctgttcatcaactgcctctcccaccatgacgtcatcatcacagaggtaaagggtttcctcctgtttactgctgtgcgtcagccccagctcctggctcacttatattagtgatcagagtggaagtgtcctcaggctctcagaaccccacctcacctttaaa

SEQ ID NO: 33870 - DNA, 1137 bp, Mus musculus
atgtggctgaggagagtttgagtcatgacaccagctttgctctgtgttggggctgaaaccagggtctcacacatgctcggcaagcactctaacagttgaatgagcacattcagagtattttagaaaaaagcctaagatgtgtacaggcaagcataagagttggggttggcaccactgatgaatgcacaccctccaggccaaaggacctctgtcttcccctcccggatcacatccgaacaagatcggctgaccctctaacctcctttttatgcctcatgtaaatgggactggagcagtgttcttttgtacctgactgctctgaggatacctttaagatgctttctcatgctgcaatgcatccagaatgtcactgtgtggtggcctctcggatgtttatcatgggcctttagggatgatctcttctccactttctgttgtttccctcggaactggtcttggagtggcctgaccctaccagtttctaatgtgtggagcagggcatgcttttagaggtcagtttatagagggttgtgggaccatatgaacggtggccatctttgctgtctgtggagggggaggggttacaggactgtggagttgactgtggccagggaatcttcctcccacctgcaagttccagtgtggtcaactgctaagggtggagccttgctttctcctcactttgagacagttgggccacctcagctccatcctctctgtctcccagcagctcaggccaccagaagaggtgtccttgcatccgggtaagaaactcctagtacagtctataaccggcgatgttctctcagcgagctgccttgagcaagcggcacacaccttcactcgtggtcccatttatttgaaatctggttagaatgtagaaaagaggggctgtgatggtccccacggagctaggatccgttgaaccccaactttcctagagcatcccctcatgctgccatctgcttcatcaaatgccagtgtcatctttccaccctccttatgctagtgtgcctccctactctggctgtgaattctgactcttcagtgctggggctccggtttgtgtccctctccacacattggccaagtttgtaaaactcaagaaggatcctggagtcaccataacatcagggc

SEQ ID NO: 33871 - DNA, 1143 bp, Mus musculus
tcaggtcttcatgcttgcacagcaagtgctcttgtccactgagccatctcttcagactctggggcaccatactttttaaattacctttttatttgttaatttatttagtactgaatttatatctgatacaacatgcatttggaggtcagaggatgacttgtggtttcttcttatactgtgtaggtcccagggatcaaactcaagtcaccaggcttgatggcaagcacctttatctgctgtgccagcccctcaagacataacattttaatgagcacctactatgtagtgggcactgagctatagcagagtatttaataccacagtggttacttttatgatgctcacagttgaacaagaagccttgctattctctagtcacaagtcctgcagggaagggacaagtcctggttctctgaggggcaaataaggaagtctccatgctggggtgacatggctgtacatgtgtgagaccttgggttcaatccctggcactgtgcaaatggatttatgaacgagtaagacgatttttctctgatgtggtggcccactgagtccttaataggactctgcctggaagggtaagaaagatgctctgactggggaaaaagcatgtatggaggccactggagcagcagtacacacatggccgtgtgtctgggaatggctcccactggctgctgtgtggagcacagttcagaacagggaacagtcagatgccttgaaactcagctaagaactgatttcaggcttccaagtcaaggctgtgtgctgggggagaggctggtggagatgcaggtgaatcggagagcaatcccgtggcagcctcgcctgccctccctccctcgcctttggactcttcctttcctggcaaggttttctgggtaaggaaagcagcctgcattcctgccaagggtatgcgctctggggggatctccacagatggccattgggattctgttcccaagaggctctggccagcccctggccttcagggctcctggaacccagtcaacagcctctgctgttaataacagagctgagctgatggccttcccttcagtatccctcagctttcatggttccttctcaagccaagtgtcgtgccaccgcagttggcatggggtgagaaaaccaagttttttc

SEQ ID NO: 33872 - DNA, 1196 bp, Mus musculus
aacactcaatttcctctcttctagctgcttcagaagtagtaaagatggcctggtacctcatgcacacatgcaagtgttgcagctgatatttatgcttgtgtttatcgtgtgttcatgagaccctgtcatggcattctcgtggaggtcagagggcaacttagtgtcaattctctccttttaccatgtgaatccccagggattgaactccggtcctcaggcttggtggcaagcacctttactcctaaatgatcataatggaccctataaatatgtataatgtaaaatgatacaagaggctgaagagatggctcagcagttaagggcactgactgcccttttagaggacctggaatcaattcccagaacggcatggtagttcacatccacaactccagtcccaggagagactgcctgggtatagcaagaacctttgtccgagtctccagtgtgtgttaacagtgcatggtggtcagatctgggtcattagcaggtcagttatctcagcttttgatcaggcagagtctggcttcaggcttgtctgattccaaggcatcgttagaacattgtttctttttacaattcagggtctaggctatcctgggacattctgtacctaacaatatccccatgaacaactgatcattctgctcctacctcccagatgttgtgattacagttgtgtgctcctggttttatgcagtgctggggatggaagccagggttctctgaatactaggcaagcggtctagcaactgggctacccctaccccaccccacccatttctatttctttactgtcttttttgtggttgcctccattgtagtggcttgactgcagttcctgcatgtctgtcttcttgtgtaaggtccagaaagaggcctttgcctaatgcagctgaaggtgacacctaagaatggcccctggctgagcctagaaatgagtcctaggctgaggcaggcaccatggccactccctcacctgtgccagcaggtgcagctgagatcttaacaatgccttggggtctggctgtgccaagtaactcctccctctggctcccagggtccatctagcacctatgacaatggctgggaccttcccacatcttttgtctcctggaagccctgtctccacttcttctgttttgtggctgtctgattgtccctcccctccagacagaacggaagagcaggccttc

SEQ ID NO: 33873 - DNA, 1153 bp, Mus musculus
acaccatgccatggaagaaagaggggtcacaaggctttgtccttctatgaggacaaagtgtggcaagtgtggcaacatctttctccaggggtgttgtcactgatgaagtacctgtgcttctgtgggcaaccttaaactcactgaggaagggagggagggaggcagaaagggagggaaaagaaatcagaagaaggacaaggggactgggttagaaagggacacagagaggaggagacaagaaaggggaaggggcttgaatatgacccacacgtgtagctagtacatgctaatagaaactttttaaaaaagtcattggtgtaggcctgcgagaggtaggggtgtcctccagcccgaaagggaggtgactgtgtgtatgaatggggtagagatgggaaagactgagggacaagggggtgggctggagatgttgggctgagttgctgggagaggacagagtgctgatcacaaagccattggaggtctgctccttaaccctcacactcccttcgagtacatgatcctggccaccatcattgctaactgcatcgtcctggccctggagcagcacctccctgatgatgacaagacacccatgtctgagcggctggtgagcaatgaggtggaaggggtctgggtccctgggctgagacatgtgtgggagaaaggctgctttgcaccatcatcagtgacctgggagcatggaagcccttactgcccaaccccaccctggggacatggaagcccttaccacccaaccccacctggaaacccagcagacctggtatacaccagggcacagtgaccttcgcactgtgaagacatcatgctcaatccaaattctgtttcctgtttcatgcagagacacaaaattttcatgaaaaagtgatacataagtatcaaacagagcagttagccactgtgaacttagtcctcaaattcagtcactgggatcccattctgcacacttccttgaccttagttttcctccattctcatcttcctcagcagaagtataggacacatccacagttgacaaccatgtccttatatctgcataactagaagtgcagacatctcgtgttgccataagaatgttttttatacccagcacaagtaccaccaaatcctcagaatcagtcagtatctagagatc

SEQ ID NO: 33874 - DNA, 1273 bp, Mus musculus
taatagtcaaatacagatttggcttgtttatttattgcctatttgttatttttgctatacttaggatgaacccagatccctacatatgctaggccagctctctaacactgagccatggctttgccctgtactaggggattctacactagggctttattcctggagtacacacaccctcagcttctcactagtggattctaggccaggttctactgctgagtagtgccctcttggccttcatagtcttcaccaaggcaacagccacatctctaactgtgggagattggtactcctaacccagggagtaggttgttcttagcattctttcattgtgacacagtatctgaggtagctcaccttgcagaatgtgttcctttggagttagtttcagaggtctcagcctttggtgactaggcccattggaaaggggagatgggcacacatctacgggtgtgcttcatactgcttatgtcactgacaatgctgtctctcccttccaggatgacacggaaccatacttcattggaatcttctgttttgaggctggaattaagatcgtggctcttggctttgccttccacaaaggctcctacctgaggaatggctggaacgtcatggactttgtcgtggtgctaacagggtaggcgactgcatcatattctttagtgtgtttttcccaaggatatcaagcagtggttagtttcatggcatgtgtggtcaggctggacttggagacctgtgcccagtgttcgttagcacactctgtctcctacctaccacctctgtgtcttcacccttcatagcagagagtgctgttgaatagaattgaaacaatggcctgttgtagctggcagcttctacagtgcatcgtggatatggccatgtatacctccctataacccaggagggcagaagatgctgctattcccaacccactggccaagacagagaagcaccctccatctgctgagcagtgaggctggcatttaaacctacaaaccaagggcctgagaactcctttgcttggtgatgtagtaactgttcatggtgctggccattgaggattattggctgcatggactatggtttggactttggcaggttgtgcttgtgtttttaagggagtttctgatgtgaatgcaaggaatgagctgtggctgacaagcaaatgtatatacacttcccatctcaacacatggttctgaactaggaatgacttctacctaatagcagtttgttgctcattgaaggtcaaagctggtgttttctgatt

SEQ ID NO: 33875 - DNA, 1134 bp, Mus musculus
gcttgatgacccaagttctattcctgggacctcctgctggaaagagagaacacacaaccctacagactgtccctgacctccacacatgcaccatggaacacatacatgtacacacacatatgaataaataagtataacttttagagtgtgtgtgtgtgtgtgtgtgtgtttctgtgtgagtgcatttgcttgaaaccaaagattcgcacatgctaggtaggtgttcttctattgaaccacactcccaggccctcacttgggttttccaggcagctgctatactgctgagtagcaccctaactcttgaccaccctaatgtggagttcagtgagaagcactacacagtattcctctctatagcatcttcatcttcccaaatggggagagtttatcccaatcaaacattcagtctccagaccccagtccccagtgaccacatcctattaggatacccagccagatattaagttctaatgcttaagtttggggtccacagcatccaccccatcctgatcgtattctcactttccctgctggttatagtcagacccccctgaaaattctaagacctgcctctgtcctcgggtgtcccaaaattgatttggaaaagaccccagtgagaaaatggctgaccttgggaagcatctcagcactctacccctccctcttccccccttcaccctctccctctctctctctcacttcttcctttcttcctcatctctttccctcttccccttctccctctcacttcctcctccctctctccctctttctccctctctcccctcctctcttctttctctctctccctctctctccctccttctccctctcttcctctcttcctctgtccctcctctttccctcttcctcctctttcttcctcctcttcctccttccccctcttttccctcctccctcttctcccccacttctctctccctctgccctccctgtcaacacaagtatgatccccacacccatctcctcttccccatctgagcttagtggtgcacctggcatcttgcggcagtgtgtggcagtgaccacgctaacacatggagcttaagtgaccatggagtgtgtggtcctgattggaggggcagaaaactgttcagagccagaggatgg

SEQ ID NO: 33876 - DNA, 1150 bp, Mus musculus
tggtcgcagatggtatggccactacttaaagcatcatgcagccagcgtggtggtgtgtgactgagcacagaactgaggtaggaggattgaaagtttaagacgcgtgccacataaagaacctgtgttccctcaaaaaaaaaaaaaaaaagatatgcatgtgtgtgtgtgtgtgtgtgtgtgtgtgtgtgtgtgtgtgtatacacacacacacacacacacaccacatgtgggaaagccaaggccagggaaggtagatgccagtgccatacaccaggaactgcaagagcaaagatggagccctacaaagggcagagaagagctggggcaggaactcgggaagaaaagtcaccgggtgagatgaagcccaggtttcattcctactcagtgacgctgaattatctggggacaagctggcatcacgtgcccctcaaggcatcctccggcatcctaagtgtcctcaggtccatgccagtcaggcctgggggaggaaaccctgctttctgcaaagcagctcacgccccctggtggctgtgaacagagcagccagattatgggctgcgcagaaaaccctggacaaggtggtgatgagtggggcccatgtgccagagctgggctcatcggccttggaggagaaaacatagagaaaccgcagtttgtgcagtcttgaggtgtcagggacagagaccatctttcctgcagccacggctggctctgcagaattaacacacaatgcttgcaggcagagtcttcctcccagccccggagcccctccccagtgcctcagaacccaggactgcaaggctacaggggtaggggctgccaagcttccatctgtttgccctggcaggagggagggagaatttcccagccccacctccggcagggaaaagcggaagtctcccaccccaggcacaaagccaagagttcagccaccatgaagctggctggcatgtgtcaccacagtccgatccagccatgagctcatccaagacacaggaggctggcatgggaagacaggccagctacactccaaagtgaaggcagccatccccctgcagacccccgtcttccccttcatccactgtacatgtggctcacaccattgtaatccccaagcaaaggaagggacttgtttgagctacattttaca

SEQ ID NO: 33877 - DNA, 1180 bp, Mus musculus
cagtgtttcatagaagaccctgaagtgacactccacagagaggcctagggacttctatgttgatagagacatctgtctacctgttataaagcgtggtgtcactcctatgatcctagtacttgggaggtgggacaggaggatatgaacttcagggccagccttggctacatagtgagtttgaggccatcctgggctacgatgctattattattattattattattattattattattattaacatcctcttgatccacctttgtattgttatgagagtatcatactgatttttttgatatacaaaatctgacccaggtctatgggaaaggggcatttgtacaacctgtaagagtcagctttctccttgccctgtgtgggttctgcggtgtcaggcgtctcacagcctaggcagcacaacttgtgactaggcaggactcaagggcagccatgagactctgttctaacaggagctggccagtacaggttccagggtcacacactgagaagtgggattcccaaccaaatgggagcttatacaagggtctggtcgtgtatgtcggctgtgttttagcccaggctgtgaaatccaaccagtacctgcagacagtgggggctctacagagcatttgacttcatccgtttccatagctataaccaaatacctgaggtcaggttacttataaaaagtggaagtttctccaacttgtctggtgaccacagagtcaaacacaccaacgtaacgccagccgctctgagggcttcttgctgcatcagacatgatgagggcctcccgtggtgacccagagctgtcatgccagctccagtctcttctcactcttataatgccaccatggggcgcatcctccccccgcccttgaggtcttatctaaccgcaactactacccagaactctgaaaaccatcatcagacaaatttagagattaaggttcccagtacctgagtttgtgtagataaggcaaacattaaaaccagagcagaaacactaaaaaatatgaccaagatgcgtcaggcctacaaggaaagcatctagagaaatgtggagtggcagtcaagggcagtatatgctaaggtcctggggtcgatcagaagacagccagcttgcaagccagtgaggagagggggcaaagggtcagtgacaggctaagaggactaaggagca

SEQ ID NO: 33878 - DNA, 1176 bp, Mus musculus
tcccggtactatgtcagggagcttgtgactgcctgtatctccacgctagaggacctgtaagttttctggcttccacaggcatttacacacatgatacagatacacccataacacatatacataaacatgtatgcccataggcacacacacaaaagtaaatatatctacacaaactcttttaattgacaagaaagcttggctgcattatcgtgaagatgctttatggtaaattaattgctcagcatatcaggggataaagattgctgcaaataaaggcacgagctgtggctcatggcattttgtgcaatggcagcacttgggaaggctgagctgggaggattgctgtcattctgaggccagccagtgttacagggagacgctatctcagggcccaggcctttgctgctgtcgccctctctgggctctgagatcagacctgcagcctggctctcagccaagccgctgacttctctgcctgtccttgtccctctagttctacggagcctcggtggcctatgaaaacgcccttcgcgtgttcaacattgtcttcacctccctcttctctctcgaatgtgtgctcaaagtcatggcttttgggattctggtacgtggggcctgagggtagtgggtggggggagtacacagggtccagggtgcgggaggtgtgtgctctgggccccaagacctcgtccccagcaaaagtctacaccccacctgcacagcctcaggccgacctaggagtagcagggagacccaatctagatttcccttgggtgagtggtgtgtggattcagctgtcctccagatgacctggtcacgggtactgatgtcaggaaaccacgaccacagaggacaagtccccagtattcacagcggccaggcctgtctctccagcgtttgggaggctgaggcaggaggcttgggaattcaaggccagcctagggcagagtaatgcttgtcagaagaaaagacagaaaggaaggaagggaggtggaaagaggaagtaaataaagaagacagttgtgaccacagcccaggagatctcaggacacccaagtggaatccccaagatcggaggtccgtcagtctggcctgtaccactgcactcaaaccaccgtcttcttacttttcatcctggtctttagtgaattttatttacatgtattggtgttttgc

SEQ ID NO: 33879 - DNA, 1219 bp, Mus musculus
tagagtttacccagttgcctgttaagctgagcttgggtctccttaaaatcgtaaacagagaagcaaaagccacatatgtcctgcttctgccaggtccttccaggagcctacttctcagttcacggccccttcctgcacccccttttccctacagccttcagtttcctggcctgtgggcctcaaagtcacccctcctcccggctaagaatctgggcacttggcgacccctcccccagggccctgcctttccagcccgccgccacccaactggcaccaattaatttccaccccagtctgtccactcacatctggccgccagctgctcgccctagccctgcgggtctctggggggctcccagagacgctcgcagttcttttcctgagcccacccacgagcccagaccaccccaccgagtcagcagatttgaaaaggcttccaaatgtctgaagcaaagatctgaagtcagaccgaagaggatgcgcgaagctttcggacccacaaatgtatggtgggggaaggaagacaggttctcccaggtacctgaaagccacagaccaaaaccttctggcttccagatgggaactgagagagtgctcctccaactcatcagctccctaggaccctgaagtgacagccatgccccccccccccaagccccatccccgcctccccaagcccactccaggctgccgagtttccttttcctgtttgccctccccaagggttggactagagagagcgccgggcccctttgaaggggctcctgggagggtcttccaggaagagggggaggggacagactggagaacaataagacctctgtggctggccagtggggcgccagttgtatcctgttaacccttggggagcccctccaagccctggcctctttggggagtggagggtgctcttccatatttagtttgtgaaagtgttcaggacaaaggtgtcctgggttaactggattgccttcctagcttggagcaggaatgcaaatcacgcaagtgcatgcacagggctggatttgtagcctgagttttagtgcaaaaaatcgggaccttttatttgcaaaaggccaggctcagccacctgtctcaatatgccaattaaactaatgagtaggggtttagagacggtccatcgtgcttagtgtgcaagcatactgatatgagttcaaatcccagcacaatgtaaaaaacagggtatatctggggaaaa

SEQ ID NO: 33880 - DNA, 1423 bp, Mus musculus
aggcccgtctagaagaggtggagggggaggcgacgtcggaggttcccgatcgcctgcagcttcctccggcacaaagcgaaggtgccttccctaacctcgcccgcgtcctccaaaggcgcttctccagtctcctgaactgtggacccgccgtgcccccgccgacgccccccacgtgcgaggccaagccagcctgccgcccggccgacaatatgctcaacgtgctggtgcgagctgtggtggccttctgagagctctggtggcttctttcgagcggcgccaccggagcggagaacgcacacccgaggcgaaggccggcgggggccgtgaagaagagccgcggcccgagctgccgagaggccaggggaaggactgaggagcgaggggcgcgggcgccttctcccagacgtgcgtccataggtgctattaaaggactgtcccttccttggcttggagaagggacacctagatcttgaatctcagggtcgaactctctaggggccaggctgccctttcaaggccgtttcactaccattcgcgtttcggcccctacaagtgggcacgcttgtgcaagcggtcagagttgcgtcatgggacagacgcgggtgcttcctgttgccttgcgtgggtgtggggcctgggaggaggccagggtgtggacccgccctagggactgggaagtgacttgagtcacctcgcccccacaggctgctgtgggtgagcctgaactgaaccaatcaaatctgcgatcagagttgaagtggctggagaccccgggactggtcaacctagatgatcgcctggcgtggaccaccgcgggacgggtgggccgctggtcgtagttgctgccgtagacacagcttcttcgggcaggaaagaaaattttttttttaccagcgtgtttaagaaagtctgtttacttttcccacggtgggttgtttaattagcaactacctggagttttacaatgtcagctaggaaaataaagaccatcggtgtaaaacgcgcggcttgtctggcttgcttccctggtgggggaggggtggggttaaggggtcagccgctccctaagcctccggaactggtttgactgggtgcggagccagagggaggccgggccccatttctttgccacaagtttacctgcttaagctagccctgtaatttgggagtgccttagaaattaacaaactctgggggaatagtgtgtggaaagcttagtttacaattggggaggggggtattgggtgcagtgtttcaagaagagctgaggaattttaaatgatggcgtttctccccctcgaccggaattgcgtagggcccccacgggtagagtggcggtgactgaactttgaacctgcgttcagccccttacacgatttctttagtgtggctcaggcagataattgagtgctaacttaagtta

SEQ ID NO: 33881 - DNA, 2427 bp, Mus musculus
gagagggcagtgcctacaacagctttctcagtgaccatgaggaagagcagaacttgataggcatagaatacagctttcacacagacagccccctcagcgaaggtcctccaatacctgcccaggacccttccatggatgtcacactcccctcctgtcacatacatacccccaccaccttagtcacgagctactgtctgtccctccccagaacctgcaggggtgctgcatgctcccagcccctctgcctccctgtcatcccacaccttttccccaaagcaagctgggctgggtcaagagaggacaggcatcaggtgggatctgtgaccttcctcaacactcacggggagccctggttccccttcctcttaggcatttcccagcaccaggcccggctaggggacgggcaggactcaacaagagcctgcccctcactgtggctgcttgggactccacgggcccaggggtcttctggacccctcccaccatcccccagtgcttccatgtctccaaaagcgccttcctgtccctctcgtctgtccctgcaccttggggctggggtaggtggggccaagagggactgtctactttacaaactgaggaaacaagcccaaaaggcttagagaaactctagaactgaccctctgtgacagcctccatcacgccccttttagtcccaccctgctctgcctctgtgggccccctcagcccaagaggtcattccaagagagcagtgctcctatgggcaggtgagggtctcaggacaggtttccagtctggcagaatttgtgggtgtgcgtgcgtgcgtgtgtgcgtgcgtgcctgcgtagagtgtttgcttttaaaaacatgaagatcaagaggcagcaagaccagggtcggaaccagggagcaggctgggagactgctgcccttctcccatccgaccctgggcagggctcccagcccccaccccctgtacataactttttgaaacatttttttagcgaatgaaatattgaagtataagatttccttttatttttcaaatcaatgggaatgtgtctgaggttccctgggtccctgggctgtggaaggcaggatgcagggaagactgaatgtgtgtgtgtgtggactgtgggtgcatgtttccacaggggcccagtcccagtgccccaggactcctgtggatccaaccagcttcctctcccccgggactaaagttttagggtgttcacaggtcccagttagctgagcccactcctgggggatgaggcagggcagggtccgcatccattgttactggtttgcggagcttatctctggccgcactcctttccactctagctctccaggagcagtcttttgggtgtcttgagtttgacatgtgagcacagggtttctgttactcccctccattaacgtcctttcacatctcactggttctgttctagccctgacctcccccccctccccaactctgcattctagctgccttttcagaggcaggggtttgcaggattggagaaggtgggatggagccttttgagtcagatctggagacctgtctccaggccagcagcaccctctaatctgccatgatccctcttaacatctgatggtgtgagggtggggtgttgggtctgacttggcccccagtaccttagccctgggtggccaagtggaggggagtagacatccctagctaaagcacaagcaccttagtcataccccctccctccgccctcgccctggcctgttacccacctcccccagcaaagatcccaaagcacaatctcctgataacttggcgagcagctgagcctggccgggatgagcgcaggctgtgctccctgcccaggtttagtaagggggcagttctgtggggcggagagggcttgtagagtgggcagcagagcccattggttccaagcacctcaggaggtggccctgactcccggggcttgggttgagggaagtataaagccaggggtgcaggggagaatactactcacttaggagagccaaagacagggttgtgccttacctcaggagccacccctgcacccctcctctggcagtcagctgcttgccctgccctcctgagagctgcatggtccccaccccaagcacccaggagagtaaaaaagtaacccacttagcaggaaagacaagtaggggcaaacccagtggctaccctcccacccatccatgcctctcatggggacaggccatcacccactggcccatgtgaagtgccaatgccctccccacccagagccgagcccccacccttcccaggcccacaagtgagattgcacattaactactgtatggagaggagcggtgttgggaaatgtgaaccctgagagtcagtgatgctgataagaataaacaagacgcctttgtaacagccctgctgtgctctgctcactggagagggacatgcta

SEQ ID NO: 33882 - DNA, 1154 bp, Mus musculus
aaggcaaaggggcttgagtgactgtgcataatagtatctatagtgttcttgcaccagtcccctgcagaggcccttgggatgactcagtcataaaggcatggctgtgaggggacagaagtggaagtggcactgccattcttagatgtatcgcagattttaccatgtggctgttgtttgtgactcccacatgctctcctgtaggaggtgaggaggttgcttgggcagggcagggcctatgttggtttctgccacctgacctgtcagtatcttatctcttgtccttatgcagctgctgccatggcgcagaccttacagatggagattccaaacttcggcaacagcatccttgagtgcctcaatgagcagcggctacagggactatactgtgacgtgtcagtagtggtgaagggccatgccttcaaagcccaccgtgctgtgctggccgctagtagctcttacttccgggacctcttcaacagcagccgcagtgctgtggtagaactgccggccgctgtgcagccacagtcattccagcagatcctcacattttgttacacaggccggctgagcatgaacatgggagaccagtttctgctcatctacacagccggcttcctgcagatccaggagatcatggagaaaggcactgagttcttcctcaaagttagctctccaagttgcgactcccagggcctgcacccggaggaggccccatcctcagagcctcagagtcctgtagcgcagacattggggtggccagcctgtagcacgccactgccccttgtgtcacgggtcaagacagaacaggagttggactcagtgcaatgcacacccatggccaagaggctgtgggacagcagccagaaggaggctggaggcagtggtggcaacaacggcagccgcaagatggccaagttctccacgccagacctggcccttaaccggatgcctcagccactctcaatggccacagctacagcagcagtggctgtggttgcagtagggggatgtgtgagtgggcccagcatgtcagagcggaccagtccaggtacctccagtgcttacaccagtgacagccccagctcctaccacaatgaagaggacgaagaagaagatgcaggtgaggagggcacagatgagcagtaccgtcagat

SEQ ID NO: 33883 - DNA, 1072 bp, Mus musculus
tcttttggcccagtctggccaaatagagtcaaaataggtgtgtgccacaatgccctccaaagccctgcttaattgttgcattagaagtagattttgacgtgcaaattggtttttcttttttggagttttgatatcgttttgagattagctcaggccagcacacttctctacctcatctacccactgctgtgactacccatatgcaccatcatactagactagtatgtttctttgtttgtttttgtggtgcacaggtataaccccctctgtgtctctgtgactttggggctcaggtgtattgcctggactgccttctgcaaaagccagtggtctcgtctcaggaaacatcctgccagacccctttcctcagtgagtcaactcaatatgactgagtctgaaactcagtgacatcacttcagaagttccatcctaacttgtcctgaggtcagctatctgaggaggtcaagacagttctctagagcttcactcttgttttagacatggaattagatttgaggaatgatgattggttggggttttggttttgtttgtgtttttgtttgttgttggtttgttgttttttttttaaataacatgtataaaggggctggagagatggatcagtggttaagaacactggctgctcttcccagggacctgggttcaattcccagcacccatggggcagctcacagttgtctataactctagttccagatggtctgacagccacacacagacatatatgcaggccaaacacaaatgcacgtaaagttaaaataaattattgttaaaatgtgtatgagttttccctgcatgtatgtataccatgtacttgtggtttccagggaggccaggaaagggcatctgattcccaggaactagtgttagaaacagtcgagttgaattgtgtggcctaagctgatcttgaactatattcaagctatcctttccacctcagcctcctgagtagcttcaactacaggcatatgccaccatgcctggtccagtcctagggaaagggacacagtaatgaacctcttgggtgaactttctgcccctatggggcctc

SEQ ID NO: 33884 - DNA, 1696 bp, Mus musculus
gaagaggggggggactttgcaaaagtcaccttacggttttctgggtttaactaaagatagagcagttagcatttttagcctttgagatgggatttctctactagaatttggggcagtaaggaagggactttatggattagggagggacaacaaccttttcaactgtcaaagggaggactgaggacctgggccacagctaaggagctggcatacaatgtgaccacctccctaccatcccctcctccaggtgtgctgtgatcacagagtttgctcgaattcatcttggggccaagggaatccagagtgagtggaggttcaggcctggggggaagagtatcactcacaaagttcacttcccacttcatccacacctcatttaggttcctgaaagctctaggctctctgctctttctgcctttctcctgggggttcagggaaacaccttcttgcatgaatcatcaggattttgaccatttgaaagttacggtgaaatttcttaaaaggatcattgatagtctggtttttgcctgagtgactgcagtcaaggttccaggagagaaggactcagagaaaatagctgtggacttgtctgatcaagaagaggaaacagctggaaagaatgaaaatctggccccaggggactggccacggactgctgcagtgggtgagatctgtgaggtacgggcctcagaaagaagtggccacttgggagtttgggtgagaggaaggagctgaggggctctagaaagtggttgtgggagatccaccacagcccagaaaaaaaggagacctggacatcagtcagagggatagctccctgggaaagcacatgccacaagacccttgagagtttgatcctcagaatccagttagttaggagccatgtgggtgctgtaaaatggtgggaggagagaactgattgaattgtaaatgaacattaaaacagaaataagacatgtctttctttgcctccttccaataggaaggtctacgagtgctggaaggcctggcagcttccggtctgcgctccatccgttttgccctggaggttcctggcctccagtctgtggttgccaatgatgcctctgcccgggctgtagagcttatgcacagaaatgtggagctcaatggtgtggcacatcttgttcagcccaaccaggcagatgcccggtaggttgattagccattgtcattggtggtggtaccggagatagagcccaggccttcatgcgtgctaagcagtggctgagcaacagctccagctcccaagaggtccctggaatgaggctttctggggactaatcctaaccctgtttagccttgggtcatactctttgaactcttttttttttttaagatttatttatttattatatgtaagtacactgtagctgtcttcagacgccccagaagaaggtattggatgctgtgagccatcatgtggttgttgggatttgaattcacaaccttcagaagagcagtcggagctcttaactgctgagccatctctccagccccctctttgaactcttttttttttttttttttttttttttagatttatttatttattatatgtaagtacactgtatctatcttcagacactccagaagaagcatcagatttcgttacggatggttgtgagccaccatgtggttgctgggatttgaactcgggaccttcagaagagcagtc

SEQ ID NO: 33885 - DNA, 1431 bp, Mus musculus
tccctgcccggccgcgtgcgcctcttcggtcggtcgaggacagtcgggctgtgggcgctgtgggattgcggggcacacgccccgggcgaggtcagaagctgcaggccagctgggccggggcccaaggtgcccgagagaggtaccctcgggaggactggggtgggggtggtgctcctttcccaagtggtggtgtgaggggcaggcaggcagggacgatgagggcgacagatgtggggacgtgtttaggagaggaaacaacccacaaaaaaatataggggaaattaacctttttttttttattgaaccaagtgcaatgcatcagagagttttcctatctttgtatgttaagagattaagaaaaaaaattctatttttgttgtaatgtcctcgcggctctggggacgctaaaagaactgggcctgccctgcccttagcggggatgaaagctgagtgttttccttttttttgtttttttttttgtttgttttcctttttgatagttttctgggtttttgtttgttggtttggttggttggttttttttttgtttttttttttttgttttgccttttttcctgcgttgacgaggataatctggggtttaaatttgtttcgtcgttcggtttcggtgggagggctgaagaaaacgtttaaaaacacctcgacattaaaaaaaaaaaaccaacacaagatcaaaaggaaaaggacgagagaaaattatttttaagataattaaacataaaaaccctggtgcttattacattataaagtacgtttttaaaaacccacaaactattatacatacgtttatgaatcaattaaatactctgcacttgttaggaacacgcatatcccttctttgttgagtttaacggaacgggacagcggcgtgcgccccgcggctgggctgctctggccgcgggtctccccaggcgctccccccttcctcgccccctccccctccgggcactggggcgcggcgggggtccccggccccctcccccgcagaggtcaatgccaacgaacaaacgtcccttttccctccctccccactccgagcgcccttctttgagccagacgccaacttgaccctcaccagcattaatcaggagcgcgctcagcaagttggtagtttcctccccgaccccttcccacgtaacaccactattccccctccctccgggaggttcgatgctccaggacaggtccagccacgctgacaggtcgatttgcccaggcccgcgcccgcacgcacgcacgcacatagcccggcacacacccccaccctaccccgcaaccagccctgtcgactgccttacacacccgcccccgcgctggccggccgacctagtgccttgttctcacccccgtgctggcggagcggacgccgcgctctgggtcccagaggggccgggtggctcagacgaccca

SEQ ID NO: 33886 - DNA, 1129 bp, Mus musculus
acagaatctctgttctttgctagtttcccaagacagttctgctcttccacaccctcagttctaagcttctctgtaaagctgggccccagggctagggttagtctacttcaaatctgtctccccgagggagggcacccggcaatgtctaaggacatttatagtcatccaataggctggccggatgcaccctgtaatcccagcacttgggaggctgaggtaagggcatttagagcgtgaggccagcctagctgttacatagctaggccctgttgcaaaacaaaaacaaccgactaaagaaggggtagatgtttgctactggcatctagtggtggagccaggaatgctactgagtaccttccaaaacaaaggctgcccttgcctcaggaagccaagtggcctcacacacaaccctgggcccaactgggggaaatgatttaatccagggaaccacaaggctaggcaggtctctagaggcaagggatctatgaagaagaggccatgccctcaataaatggtactataggcttggtagccgtctgctctacccacaatgccgataggtcagctagcaactctgagctcctcatcccgctccttgccatcagcccgagagcctgaaagtgccatccaacaaacgaggccaccggaagcaggggctgtcacaccaccactgccatgcccatacctgcatccacgtcattgggccatccgctagactggctgctgccagcggccggagagcggcctgtcccaggatagaacacatcatctactggactctccatctcactgtcgtcgatggacttggggcgcttggtgctgctgaggaggaggaggaagaagaagaagaagaagcaagtcaagtgggccaaagttccaggcaccccagttctaggagcagagcatctccagacctgctctccctcaggttgccaggacaccctgaaggaccatcaaagaacaggcaaagcacctttatctgccttccacaccccacccactctttcctattagctctcagctgtgccgtggaactcagtcattaaagagtgttttaagccaacagtggtggctcacatctgtaatcctagtactcagaaggctgacacagggggactacagtcaattc

SEQ ID NO: 33887 - DNA, 1186 bp, Mus musculus
caaacattggccagtccggacaaggcagttcttgcatgccctttggtctgcaccctcaggggcagcaggacactactggaaccagctgaccctagttcacagctgctgtagaacatggacatgtcatgggtgcgacagaaggggggggcagcaagcccatggtgtgtgtgggtatatgtgtgtgaagcaacattgtgtgcatgtgtgtgtgtaaagacgagagagagagagagagagagagagagagagagagagagagagagagagagagagagagagagagagagagagagaataggtgtgtggacaagctctcgtgcctctggttgctgaggctgagatgggagcaagtggctggcgaagctggtggtggctccaaaccacacttcagtagaacaatctcaagagaaaaaaattgctggggggagggagaaggagaagaaggcggttttcctgtgcccccttctaacgctgtgtttctccttctctctttccccctcatcccgtcttccccctcctcccgtcctccctcgccccgcatgctcccggcttgccgcctgcaggatgagttccacccgtttatcgaggcgctgctgcctcacgtccgagccttctcctacacctggttcaacctgcaggcgcggaagcgcaagtacttcaagaagcacgagaagcggatgtcaaaggacgaggagcgcgcagtgaaggacgagctgctgggcgagaagcctgagatcaagcagaagtgggcatcccggctgttggccaagctgcgcaaagacatccggcccgagttccgcgaggactttgtgctaaccatcacgggcaagaagcccccctgctgcgtgctttccaaccccgaccagaagggcaagatccggcggattgactgcctgcgccaggctgacaaggtgtggcggctggacctggtcatggtgattttgtttaaagggatccctttggaaagtactgatggggagcggctctacaagtcgccccagtgctcgaaccccggcctgtgtgtccagccacatcacattggagtcacaatcaaagaactggacctttatctggcttactttgtccacactccgggtaggttgctctcatcaaccccctccctaattttatttcagttgctggtatttgttcagtttattgttctcctgtttctgaacagcactgc

SEQ ID NO: 33888 - DNA, 1189 bp, Mus musculus
gtagactatggactgctttttgttcttgaaccaactggtatccacggtttgcttttttcatttgattcttaatatggatatcttgccgtatagcccaggctggccttgagcttacagtggtcatcttggggctacaggggtgaaccaccatgctctatcttggtagttttgcttttgtggttgtttgatggagacaggatgtcatgcatcccaggctagctctgtattgaagataggatccccttgtctccactcttaagagcttggaccatgggtgtgaaccaccgcctagaggtactggcttttctttctgtggccctggctttgcacacacctcctattcctaacataaaaaacgagacagacacaagttgggttacttttggcaccccactggggtcctgggagatttcctggggtgggcctgactgagttcagagccatggttcttttgggttaatacattccccaaaggagcttgggttctaggcctagacatgagtgtcttatgcactttccagggctgccagatggagggtgtcggggcagaggtcaaggactagtcagagtggggttgggggaatttaagtttctgctctgcacctcctggtcttcggttttcctggtctgtaaagcacatgcatatcttttagccctgtaatgcagctcactgccatgatgagtacatgatgtgtgcttgagaagtgtccctgttatagtggttgtcatcatctggaccctccttgaatagagaaggttgatcatgaaagcaagaagagttggagccctttgccactgtggcaatcctcatgtacgtcctggaggaggaagcaagaacttgggaggacaaggctcagctctttttctcttattggggtcctgtagcctccactaagcggagggtgacagatttcacagtagggtaaggtgactggcgtgaaatgaggagatggcctttccagtctaatgggaactaggtgtctcttggtaaagagtatgtaagcacccctggatctggatggagttggacaaagcatggagacttggttcatcatgagatgtctccactgctccaagccacttacaacgctgcactgattgcgatggggatccacaggacactgtgtgagcacttgacagtgtgggcaagatcctgaggtgactctgggtccatgtgttttgactgcat

SEQ ID NO: 33889 - DNA, 1752 bp, Mus musculus
cagatttgccttggtctgccctcactgtctgctttcctatacagggagcagcgtatcgcagagtgcatggccaagatgccacaaatgattgaaaactggcgaaagcagaagcgagaacgctgggagaaaattcaggctgacaaggagcggagggcccggttacaggctgaggcccaggaacgcctgggctaccacgtggacccaaggagtgctcgcttccaggaactattacaggacctagacaagcagcaacgaaagcgcctaaaggaagaaagacaacgacagaagaaggaggcacgaattgctgctatggcctctgctgaagcccaggactcagcagtgtctggtgaacccagctcctgaaagctcccttcccaataaagccagctgctgacaacccatattctacacattctccctcaagttgtgacttcctgggtcgcccggctcattccccaacacctgggcgggagaatccctccacctggctgtgttcacacctggacactaggccatgccatgaactggggctttggggagagagaaaggggaatggatgggcaaataatgaaggagcagatggcaggagaggaggaggcttctgtttaccaacattaatctccagtaattagccaattaccagggggagtacagccaaacagactgcatgatagaaggagcagcagtccttctagggttgagctgaggcaggggcccaagtttccagagggaggagatgctggggcccgtctgtaaggctcctaggctcctccccgtttctcagcatgcccacttcacctgtgcccccggctagctcagactcacaaacagctgtgagaagctccagtaggcatgaaccattattagggctcatttttaaaactttattcacgtcaaaacctttatcagagatgtggttctgtcctggggaaggggtggccttggccttcagaactgatgataaccccttttccaggctggaggccaaggccagactggggagaaggcctttggcttctaacatagacttactccagatggaaagatctgggccactccaatagaggatcaaagcttagggctccagcttcccctcatcatggtggaggaaggagggttgtccttggggatgcttcagggatggggaagcaggcaggcgcccctccatctggctgcagggagctgggacagaggccaagaggggcccatctgtcgcctcatggtcttgccaacaacttttgagtaggctgggctgttaagaggacggggacagctgtctggcccaggtcttctcggactgatatgggaatgggggccacttcaggagggtgggaagctgggctgggtttttttttgttgttgtttttttaatggtttttgatattcttcctcttaaacatgaatatatatatgttatatatatatatatatactttctcttataaacgtctgtggagtggggagggagggaaggggggaggccctggcctcccagaatcactcatcatcaaagttctgactcaggaggaagttggcagccaaattctcatttttttcacacgcgaagtaggcctggatcaccaggctctctgggaagcccagtgccttcagctgtgggaagatgggcaatggtaagaagggggaggtactgggctacccaccatgaatggctcttcagccaggcctcttaccctttctatagcctccttctcctgcggtgtcacctggatatagttcatctgtggggcctcc

SEQ ID NO: 33890 - DNA, 1145 bp, Mus musculus
gtcagaactttgatgatgagtgattctgggaggccagggcctccccccttccctccctccccactccacagacgtttataagagaaagtatatatatatatatataacatatatatattcatgtttaagaggaagaatatcaaaaaccattaaaaaaacaacaacaaaaaaaaacccagcccagcttcccaccctcctgaagtggcccccattcccatatcagtccgagaagacctgggccagacagctgtccccgtcctcttaacagcccagcctactcaaaagttgttggcaagaccatgaggcgacagatgggcccctcttggcctctgtcccagctccctgcagccagatggaggggcgcctgcctgcttccccatccctgaagcatccccaaggacaaccctccttcctccaccatgatgaggggaagctggagccctaagctttgatcctctattggagtggcccagatctttccatctggagtaagtctatgttagaagccaaaggccttctccccagtctggccttggcctccagcctggaaaaggggttatcatcagttctgaaggccaaggccaccccttccccaggacagaaccacatctctgataaaggttttgacgtgaataaagttttaaaaatgagccctaataatggttcatgcctactggagcttctcacagctgtttgtgagtctgagctagccgggggcacaggtgaagtgggcatgctgagaaacggggaggagcctaggagccttacagacgggccccagcatctcctccctctggaaacttgggcccctgcctcagctcaaccctagaaggactgctgctccttctatcatgcagtctgtttggctgtactccccctggtaattggctaattactggagattaatgttggtaaacagaagcctcctcctctcctgccatctgctccttcattatttgcccatccattcccctttctctctccccaaagccccagttcatggcatggcctagtgtccaggtgtgaacacagccaggtggagggattctcccgcccaggtgttggggaatgagccgggcgacccaggaagtcacaacttgagggagaatgtgtagaatatgggttgtcagcagctggctttattg

SEQ ID NO: 33891 - DNA, 1745 bp, Mus musculus
cccccagccaggcaggctggtcttggtgtatgtatgtatggtatgtactgactggcctaaaattctttacttctgcctaccttctcagtgcatcaacttacatacttgcctgtcccacccacttttcttttggacatgatctcactataatcctgttggcttggacctccacaagtagtctgtcttctcagagctgggatctaaggcatgtcctaccacaccctgctgccccacacattttggtggattcaaagactaggaaaggtgggaatagaggcctgtccagagccaggactgccagaagtcactgctgaccacctgtctttccgttctttcccaggtcaagtccgggacaatctttgacaatttcctcatcaccaatgatgaggcctatgcagaggagtttggcaatgagacgtggggtgttaccaaggtgggtcagagctctttgtttactctaggggtcatctgggaggactggcagacagatttgagccaggtattaaaagatatggttggttggtcctcacaggctgcagagaagcagatgaaggacaagcaggatgaggagcagaggcttaaggaagaagaagaggacaagaagcgtaaagaggaagaagaagctgaggataaagaggatgatgatgacagagatgaagatgaggacgaagaagatgagaaggaggaagatgaggaagaatcccctggccaagccaaggatgagctgtagaggccacaccacctgccttcagggctggactgaggcctgaacaccctgccgcagagctggctgctcccaataatgtctctatgagactcaagaacttttcattttttccaggcaggttcagatctggggtagattctgattttgttcccctgcctcccccattacccccccccctttttttttttactggtgtttgtctttaattctccttcagccctcatctggtttctcatttttgaatcaacatcttttccttctgtccctccctttctccatcttttggtcactaccctccaactctaggaacaggggtgtagaggagaagccctaggcttgagatttcatctgctctccttcctgcatctcagaggagggcaggagaagggggtggtgttttccctccccccgcactgaggaagaatggggctcttctcatcccctttctcccttgcccccaggactgggccacttgtggggcagccagttctagcacagctcacactgagagtgtaagaactacaaacaaaatttctattaaattaagttttgtgtcttccctattgtgtctccttctctgggaggatgtacatcaggagctaaaagcagcctttctcaggtgcgggtgacgtatgtttcagctactggagtttgcagagtctcagaaatgtcatttatatgtatcccatagtctctaaatgggagagtagccatcaggtcttgatcctaaactcatagacgtgtaagttttgattctagcacagacctcattgacagactgactagaatttagtgaattcaaatattagccatcttggttaaaagtgggatggatctgttggactgacacctaggaaagctgagcaaagttcacagtagtggggtgcatgctggtagataatagtcaaagggactgactgagctcagggacagtgatctactttccccaagggcccatggttctaggactgagctgataaagatagattccaggattgggttatgtagttcagttgga

SEQ ID NO: 33892 - DNA, 1097 bp, Mus musculus
atagaattcagtggtttcagagaacacaagctcagttcccagcactcacacagtgtcctgtgactcccgtgcccacttcagacctctgcaggctcctgtgtatgcatggtatatagtcacaaatagatgaggttaggtctccctttctcaaaggatagagcctgccatcagcctgcatatgcttcctacataggtccggacatctgcggtcctggcaccaagaaggttcatgtcatctttaactacaagggcaagaatgtgctgatcaacaaggatatccggtgtaaggtgtgcctggggtagtcatttaaatggctgtcatgggaggtcccggcagcctggtgggagggactgctcacctccttccctcttcaggatgatgaattcacacacctatacacactgattgtgcggccagacaacacctatgaggtgaaaattgacaacagccaggtggagtcaggctccttggaggatgattgggactttctgccacccaagaagataaaggaccctgatgctgccaagccggaagactgggatgaacgagccaagatcgatgaccccacagattccaagcctgaggttagtgttgggagggtagctccacctctgtcatagaatggaggacatctgggtccactttgacctccacgtgtactcctaggactgggacaagccagagcacatccctgaccctgatgctaagaagcctgaggactgggatgaagagatggatggagagtgggaaccaccagtgattcaaaatcctgaatacaaggtaggcttgggtgtttgggtgtggctccctggtgggatgtttccttgggtgctatgattaatgttgcactgcagaaacaaaccaagataggccttggggtcctagtcggggttgttggctgtactgtgggatgtgtctgcctctctattcatctggttttcttctacagggcgagtggaaaccacgtcaaattgacaacccagattacaagggtacctggatacacccagaaattgacaaccctgaatactcccccgatgcaaatatctatgcctatgatagttttgctgtactgggcctagatctctggcaggtg

SEQ ID NO: 33893 - DNA, 2002 bp, Mus musculus
ataggaaacgctcgccatcggtgggcgttccctaggtgcaggacagacggaacgtgaaagttgcaaataatccttacttcttccctctgaccagagaggatgggaaagggccgaagctaaggacccgtctcggtcccgcaccgcacggttaacacctggtaccgctcgcgcggattctttaaacgactcctagcgagccagagactctcagcagcaagggcggggttgggctgaggttcagtcacgtgaccgtgcctgagtgggctagcggcccccaccccaccagggggcgtcccccacaacgcgtggtcgaccctcattggcccatagtgcgaccaatagaaatcagccatctgggatcccagcgttccgagccacagcctaacttgctgagccaactgggaagcaatggaaagggacagctgtaggtctaaaccagtcaaaaggaccgaggggcgggctcagcggctgtgtcaggttcgggtgagaggtaggtgaatataaattgaagcggcggtggccgcgtccgtcaataccgcagagccgctgcctgaagatcgtcttaaaaggcctgtgtgccgccgccccctcggcccgccatgctcctttcggtgccgctcctgcttggcctcctcggcctggccgccgcagaccctgccatctatttcaaagagcagttcttggacggaggtaaggtctgggcccgtctcgaggccgcttagcgactgctgggccccgagacctcggctgcctcgtcgtgtgtaatgtaattaccgttcagagggccaacactgtggccccagagggactagggccgcgggcggttccatgtgtgcgtccttgtgggactaggaaggctcagccgtttcccgcccccagagttaggattcgtccaaggacctgaagcccatcgagatgtcaagtttgaggttgggatgggaatccccttccccacccccacctgcttgtagctcctgacagacgttggttatgggggcgggggtcggacggccccgctaatctgactctatgcccttccctttcagatgcctggaccaaccgctgggtcgaatccaaacataagtccgattttggcaaatttgtcctcagttctggcaaattttacggggacctggagaaggataaaggtacaagggagtgggtgcaggacaacttcctggaggaagctgtagtcagcacatacatcttgttggggcttttcccaggaacacgggagccaaggacaggtggaggaaggaagggaggtcagccgtgcccctctaggtctagggtattccgggttcacctgatgacagtcccatttcatcacagggctgcagacaagccaagatgcccgattttacgcactgtccgccaaattcgaacccttcagcaataagggccagacactggtggtacagttcacggtgaagcatgagcagaatatcgactgtgggggcggctacgtgaagctgtttccgagtggtttggaccagaaggacatgcatggagactcagaatataacatcatgtttggtgaggggcccccagccagtgctgacctctgccggttggacagtgggtgcagactgaaaccctttgtaaccagaatgctgatcttcataccatggaaagcacttgaatgatgaaaatttttgtcctgaaggacaactttattagttggtgtacaatattacttgaagacttatattgttcatttgtatgatattttctacgtgttaataattttagaaatgatgctaatgacagggtctaaaaatcagtgaaaaatctgagcatgtgcatatttcttctgtactcaagtatgaaagggtgtgctagtgtgaaggtcagagggcaactttggaaatctcttttgtcatctgggttctaggatcaaatttggattgtcaggcttagtggcaagtacctaatttaccactgagccatttgctggccccagaatggtaatcgtttcagatttgtagtcttttatgccttt

SEQ ID NO: 33894 - DNA, 1197 bp, Mus musculus
ctggcctcgaactcagaaatctgcctgcctctgcctcccaagtgctgggatcaaaggcacgcaccaccactgcccggctgagaattcttgaaggatggcagtgatctgagcctgctagtggtggctggatgaaaattattgggggaaaccaatagaatttcagtcaagccttagagtgattgtctgtaatcctagcacttgggagaagtaggcaggagatgaggaggtcaagtctagcctctgctaaagaagacctgtttcaagatataaaacaaaaatcccaaaagaaaactacttttgcccttcaagtcatcaaattgacttcactagttaactaaaagccactggggtcaaactacatgcagcatcctgaatcccttaagtacatttgaggctcatttgccacacttaagatggcgacgaccagcttccaagtcgccctttgcgccacactaaaaatggcaacgcacgcgctatcgcgacttccggttccagttccggtcccctagtcaggtccggcggcctgcacacgccaagcacgctgggagtagccatggcggataatcccgttttggagctgttgctgcggcggctggaggtagctgatggcggtctggacagcgcggagttggctacgcagctgggtgtggagcaccaggcggtggtgggcgcagtgaagagccttcaagctctgggtgaggtgagtccaggcgtgccgcggctcggcctcgctttcataccggcagccccattatttctggtgaagggacattacgtgctggtgcaccgtggggtgcgctggtgggaagtctggaacagttttcgtttctcaagtgactaatgtctgttaaggcgaaaacatggcacatgtaggggtgtgacaagacgagtcgcttcccggaaaggggttgcaatctaatggggaaacacaaatgaccagagtgatatgaaggctcagagaactagctgtgacagttgacttagcgttgcgggacagagagccgggatcaggtacagatggaaactgactcgaggccaatggaggaaaacgatggcatccaagacatcagtggcagggcattggtgtgggattataggccgcagagaccatcagggcagaattaaatggttctgtaaggttcctgttttccccttttatctccatgttagggccttctgctgctagtcaaaagctac

SEQ ID NO: 33895 - DNA, 1217 bp, Mus musculus
actggaaggacccactcatactggaggagcagctgactgccgatgagaaactgatcagggacaccttccgtaactactgccaggagcggcttatgtctcgaattctgctggctaatcgaaatgaaggtgccttggtggaagggtgggcatgctgggtttcacaaccatacatgatttgcatgtgctgcagtccctggagtcagggactccatgagactgagacagggtctgattctgacacccatctctgcagtttttcacagggacattgtgtatgagatgggggagctgggcgtgttgggacccaccattaaaggtaaggacatttctgtgtatactatgcagcctatacccacctacaacatcttgaaggaccatcccttttcctcagtcacgcatttcatctgtaaaatgggcaatggttatctctcctgaaaacagctgtgggtttgagaggaacaaagtcctaaccagggcagccccctgcccacttccagaagggccatattacagccctactcagtcccagggctgatctttggcctttggtctacccgttcttcttttgcaccagggtatggctgtgctggtgtgtcgtcggtggcctatgggctcctgacccgagagcttgagagggtggacagtggctacaggtcgatgatgagtgttcagtcctcccttgtcatgcaccccatctatacctatgggagcgaggaacagcgacagaaatatctgcccggactgggtaagcagctgttgccaagaggaggaaagtcagatgtcggtctggaatgcaggtcccgcctggtgtccctccacagcctgccttctttcctacagaccacctgtgtccatgtcaggtcctaggactcagttgtcttccttgatctcctgccagcactgtcggttcctctctccccccaaccctttgattttacctctggtcaccatcatctccccttggatttgttttctaggcctctcacccctgtccaaagtttaaagtcttaactgctaaccagatccacgaggctcatgagcggacctttcctctacttctttggctactcagattttatttgtagatatggtctcactgtgtagccctgtttggctgggagctttgtagaccagtagcatcaaactcaaaggtctacatgcctcggtctcccgaggagggacagcttggattaaaggcatatactatcatgcctatc

SEQ ID NO: 33896 - DNA, 1164 bp, Mus musculus
ccgggaaaaatcacctcctacttcagccagggcccgcagacctgccgccctcaggccccccacagatacttccaggagcgaggcctggaggcagccagcagcctctaggagcccacgtgtgcaccacctgcccttctaacccaggaataaaagctgttcaagaagtggaccgagtgctttgtggctaaggtctggtagcagtgcctgtggccagcagctgattcatcaaacaaaataggcatttctagattggtgacgtttgctttttttttaaagaatgatttatgtatgtaagtacactgtagctgtcttcagacacggcagaagagggcatcagatcccattatagatggttgtgagccaccatgtggtatcactggatagctcaatgctggaactgtgtagaccaggttggtcttgggcacattgtggcactcacctgcctctgcctcccaagtgctgaggttaaagacatgcactatcatagcctttttattttttttaattgtaaaactatttttgtctttgtgtgggtatacacacatgtgagtatgcacgtgtaaatgcaagggcccttggaggtcgtaggcttcagatttctctggagctggacttagagaaattacggcctgctctgttggtgctgatctgaactatgtgcttttgaccactggctttctccatcccgcatatttttctttggtgctccctctttgctttgtcttgttttgagacagggttcctaagtagtcttgactgtcctggaacttgctacgtagaccagacaggcctgagacacagctgcagacttggaattaaaggagttgtatgtatatttgtgcaacacatccatgcagttctcaaagaagccagaagagggcaccagatcccctgcaactggagttggaggtgtttttgagccaccttgtgggtcttgagaatcaggtcctctgcaagaacagtcattgttgctgtcaaccagggagccatctttccagtcctctgcctcctctcctcttccttctgtgtgtgtgtgtgtgtgtgtgtgtgtgtgtgtgtgtgtgtgtgtttgcgtgcatgcgctgttgtggtattgcatacctttaatcccagcatttggaggacaggtaggtagatctctgagttagaggccattctggtcta

SEQ ID NO: 33897 - DNA, 1173 bp, Mus musculus
ccaggctccagcagcaacggggcggagcttgcaaagtgaccctgcccaccctccattacaaaccacgcccttggagatagtcctcaaagactacaattcccaggagagaagagcagaccagcggcgacagcagcgcgtgcgtaaacgaccacgccggagggcgcatcgagggcggatcctgcgagccgattggtcagcatcaagagccactgcagttttcgcggaaaacgcgcgctgggacctgcgcttgcagtgttgttttctacaattgttggctgtcgcagaggcagcatggatctcagcgagctggagagggacaatacgggtcgttgtcgtctgagttctcctgtacctgctgtgtgtctcaaggagccgtgcgttctgggcgtggatgaagcgggccgaggccctgtgcttggtgcgcttccagggccgcgggctgggaggcgcgtgggtgaaaggggtgcagttttcagggaaaccggagtgaggatcatgctgggccttgggatccggaagcgatagtgggatggccttgggccgtggtgatgatggcgcaaggtggcttttacgtactgtactctctggtgggaaccctgctctcagaactcttgacttgtcctcttcctaccaaggtcccatggtctacgccatctgttactgccccctgtctcgcttggcagatctggaggccctgaaagtggcaggtgagcctgtgcagaatgtctgcactctgggttcctgggtatgtgcaggggggcaggagagatacagaggggaaagcggaatcgggaaacaaccacttgtccccttttcttttaactttcttcccagactctaagaccttgacagagaacgagcgggagaggctctttgcgaaaatggaggaggatggagactttgtgggttgggctttggacgtcctgtctccaaacctgatctctaccagcatgcttgggcggtgaggcgtcccttcatgagtggggggaagagcaaccaacacaggcaggctgcgtcctgcctttgcaatggtgtggactaaactctgtcctttaccagagtcaagtacaacctcaactccctgtcacacgatacagctgcggggctgatacagtacgcactggaccagaatgtgaatgtcactcaggtgagctgttgggttacagccctttg

SEQ ID NO: 33898 - DNA, 1199 bp, Mus musculus
cagacgagaaatcacactcagagaaaaagtgcccagttccttgagacccagcctgcactgagctgggcagggatctgaagtcagccagagagggtctgtttgtagggccttggccaagtgaggccttcgggggttggggtggggaggacaccttttcatagcgtaactcccgtccacctgctagtttacccttttgtcgctgcagcgtcagcagctcccaggtatcaccttcaccgtgcgggccaaagtattggtagtctgggtcgatctgagtaggggacaccagacctaggagcactaggggagtcagcaacggagccaagtggctccgggccatgcccggattccaaccgaccccaacgcgccccgtggccgaggctcgcgaggagcccacagcacagacaatcttggcgtccgaaagggcacaccccacccaacccttgtgaaagcgtgtggaccgggccacgcggcgccttcccctcacccccccggcagccgcaatggatccgaccgcggcgctgtcccgcccacctccccgcgcactgcctggtgtggtttgggccacgcataaaaggttctccggcctagggctctctcggttttgagatctctttcctgtctctacccgtgtctggacgtccgtgtgtccggctcttgctcacgcaggtatgaaaacccagaatgcacacgaatgggaggagccccactagtgtggtgcaggcctcatcacgacctctatgcttggaggtctttgttttccatgttcaatggtggccgctttgtccttgcccgggaaaccaaggcccgagccctggcttgcaggctggatcaccgagctcggcagtccatcgctcttagcttagccgtcctattctggaactaggagctcacttccccctccacccgcactcggtctgactccataatttgggtagcagcggtgacccatcattcgttccctgtttaggggggcgggtattcagaggccttgcagactttatactgggagggtgaatatgagcgctccttccacctctctcggttttactatctagacttagcaccaaaagtgaccttggaaaggcaagacaaaggatcttctaaggctctaaagaccaagcttgtgtgggtctctgatttcagtcatggcctccggcaacgcgcaaatcggaaagtcggctcctgacttcacggccaca

SEQ ID NO: 33899 - DNA, 1099 bp, Mus musculus
gagacgctagtgcgacttcagctggagaacaagagactgtgccagcaggaggccgcggaccgggagcgacaggaggaactgcagcgccacctggaggaggccaaccgtgcacgccatgggctggaagcacagcaacggtaagagcctgccttcttgtttgaaagcgcaaccaagcgcaagcactgagcactgttccctgccaggctgaaccagcagcagctgtcggagctgagggcgcaggtggaagagctacagaaggccttgcaggagcaggggggcaagaccgaggacgtgagtgcctgcctcctccctgcttggccctcccttgtgctccccagtaatccccctttctccctccccccttgctgcccgatgcctgaagaaggccactgtgagtaccacgggtccagggaggcgcaccactgttacctgcacagcttctcagaccttgtccccgtcccctcactccccgctgcttctcttccccagcccaccctgctgaagaggaagctggaggatcatctgtaagtgcagagaaccttcactcctggggtgggaactcttgggacaaaggtgtggagaattgtgggtgaagagacccagtcagctcaggtcaagtagagtctttattttgagactggaagttgtgtacctgaaactggtcttgaattcctgatcctcccatctcccaagtgctaagatagaaggtgtgtactaacatgtcttgctctcaagggtgatcctgtgcttgtttttgaagtgtactgattttatgtgtgtgagtgttttgcctgcatgtctgtgtaccacatgatctcatggagttccgaggaaggccgtaagctgctgggcggtggtggcacacgcctttaaaatcccagcacttgggaggcagaggcaggcggatttctgagttcgaggcgagcctggtctacagagtgagttccaggacagccagggctacacagagaaaccctgtctcgaaaaaatcaaaaaaaaaaaaaaaaagaatagttgtgagccaccatgtgggttatacttggggtcctccactagaacagcaaacggatcttaactccctcctttgtattattattaa

SEQ ID NO: 33900 - DNA, 1127 bp, Mus musculus
tattataatgaaggttgctctcctgtgctccacaccccccccaattcctaggtcattcagaccctggaacccaagcagaggccacccactgtggtgtccccagaattccataccttgaggtcacagctctgggagcggaacctgcggatacggcagatggaggtgggtatcctcatcctatcatgccatgtggccctcagccccacccagcccctgactcttgtctcctggcagatggactatgagaagagtcggagacggcaggaacaggaggaaaagctgcttatcagtgcctggtacagcatggtgagtgggttcctccccagggaggtcatgtgggtcatagatgtcataccaggttcacatggctcaggtaggctcacttaccctgctaattataccatttctctagggcatggccttggagcatcgggctggggaagagcacgctcctgcccatgcccagtccttcttggcacagcaaagactggccaccaatgctcgccgtggacccctggggcgccaggctctgagcctccgccccactgacaagcactgacaagacctcgacttcctgctgcctgctggagtcttccagtttacatttacccagctgggcctttgaccttgattgagcctgacttctgccctttgcttccttagatgggagagaaggggacaggcaggtagcaggtgtggaactattccttttagcaatgtgattcttcttgattcttctcctgggcctcgtgtactacctgggaagagcctgattttatatttgaaaagaataaagactttaaatctgtcatgaatgtactctagacacaatgacgaagaataaaaactgcactggggacacagaccattgcttttaaaataaagtttttacatgtatgagcgtttttgcctatctgtatgttgtgtgcaatcgatgtgcttggtgcctgcagaggccaaaagagggcatcagatttgtaactagagttacaaatggttgtgagctaccatgtgggtgctgggagttgaacccgggtctccaggaagaagagccagtgctcttaaccactgagccatctcttcaagccttaacttgcattcttgtggggattttgtttgcttgtttt

SEQ ID NO: 33901 - DNA, 1204 bp, Mus musculus
taatgtctgccaagcatctactaagtgcctcacaccaatttgtaataaaacacatgactgctcacaaagcacaacggctcttgaagggaaggtgtgaagatgggagacctgagaggtcaggaggtcagataatgtgtccatgtttgcccacaaaatggaagagctacattacacagacctaccccatgagttggccccagggcccacacctttagtggagatacttcagtattcagtaagcccctgaccccgaggctctgatgggcccagcaaggtggcaaatctattccctcatctccacagatgtgcaacatgctgggcctgggggacatgaatgctgaccaactggcctccaagctagaagagacgttgcctgtcatccgatctgttagcgaacagttcaaggaccctgtgagttatgatccagttcagcaggtagtgagaggctcctgaggacgggatcagccagatcccttcctctctcctgtcttgtgccctacaggaacagacaacgttcatctgtgtgtgcatcgccgaattcttgtccttgtacgagacggagcggctgatccaggagctggctaagtgcaagatcgacacccacaacatcatcgtcaaccagcttgtcttccctgaccctgagaaaccctgcaagatgtgtgaggcccgacacaagatccaggccaagtacctggaccaggtatgcccacctgcccagccaagagtcccctgtcttttactgtgttctctggggactggggctgcagctcagtagagaatgcttgcctagtgtgtgtgcatgcacgcgagtcctgagccttctgtattcagaggactggagctcaactgggaagcctgacacccaggccatccctggatttactggccccacttaccttacccttagcttctgccctaacctcccagccctcagtctctgctttctgctctctaacctgattacagatggaagacctatatgaagactttcacattgtaaagctgccactgttacctcacgaggttcggggagccgacaaagtcaacaccttctctgccctcctcctggagccctacaagccccccagcacccagtagccacccccatccctgctgctgccttcataccctcctctttccccatggggcagagtttgcacaaagtcccccataatgcagggggccacttaggaggtgggagggg

SEQ ID NO: 33902 - DNA, 1190 bp, Mus musculus
atgtcaaacctggagatgcttccattctaataggaggtatcaagttagatatgctttgtagacctagttaggggccacacaagttcccaagggacaattgaaaacacaggctccaaacaagatccgttcagttacagagttctggtggctgcctgggattgttctcttagcccttacagggggcctgggtcccaaacgatggtcccattctcggggagcttctggctgcttagctaactcgtatctagcaggattagggaaccgaggaccagaaggaaagggaccggcttctgggctccatcgcctggtggccaggtcagaaccctttggccccacctaagctccgcccactctgcgttggcttctgggttccgacctctcttcccagcatgcattgctccagacgaagccagtcccgcgccaagcgcgcggtctgagagcctttcccgacgtcctttgcacggcatctggccacaaaatggctgcccgagggagacgggcggagcctccgggtcgggaggcgcccggcccggcgggcagcggcaggagccgatgggctgagtcgggaccgggaacgtcacccgagagtggggacgacgaggtgtcgggctcgagtccggtgtccagcggtgtgaacttgtttgccaacgatggcagcttcctggagctgttcaagcggaagatggaggaggagcagcggcagcggcaggaggagccacccccgggcccgcagcgacccgatccaccggcctccgccgcggcgggcccagggaatccgaagaggaagggcggcccaggccccacgctcagcttcgtaaggagccgcgggggtgggggcgggcgccggggcccgcgttggctgggggagtcgggcccgggaaggggcgtcatggtccaaggcagtcctccgcccggctgcctggacggtcccggtcgcttgctgagaatctcgagcctggattccggaccagaggtgtttctgggcgggaatgggaatccttagatctcattcgtgggacctgagaaccgggaaattgcattggaagcagcgctctggggttagggggccctagatgctaggattcccgtttgatttgtacccagactttgaatagtgaggcccacatataatgtgggggaaaaagaggagacacatttaaatcccgagtctgctgtaatcgttagactcg

SEQ ID NO: 33903 - DNA, 1187 bp, Mus musculus
gcttgttgggcatctgtcttccaaccattccttccctcctccgaccccacaggtattaacaagtaaaggtgacgcatgggccaagtacatggcagaagtgaaaaagtacaaagcccaccagtgcggggatgatgataaaactcggcccctggtgaaatgactccctcccgggtgctcactacctgggactctctgcgatgtacataatatttaatgcggttccggcagcagccttctctggaggactgatacacagaaggaaacgaaggcgcttgctgtggccgcagaccgttctccaggactctttttttaccttgagcacttgcctcctcagacttttagaccagtggtttactgtgccctttcttcccatcaccttgctctctctggctctgtctcttcttgctgtctctctccttttagcagtcacttctgagaagtaaagaacctgacttagtgctggagtttgtgcttggtttatcttctttgcgatctccaagctaagcctttccccactggtgcataccacatctgcccgagctggggtggacccattgtggaaagggaaggggaaggttctgtaggcaggggcacatgctgcctgtctcaagacatccttagtaactgtgactattgaagtctggtcttgtttttagttttgttttgagacagggacttatgtacagagttctctcctgcctcagcagcatgccttccaagtctcctcacagcatcagtttagctgtgactcaggttagtctgggttgagtgtgtttgcctagagcacgtggcgctcgctggtcaatctctagcacttcaccttttttgcagtacactaatcttagcttttggccattatggagctgttatttattccccagattctgaacaactacttactatatgtcaaagatgtcctggtttctagggaccggagcactgaacagcctacattttccctgtcctcctagacaagtgggaaatcagagaggatgggtaaccttttcagtggtgactactaacaaggataggatagaggcatttgttcagggaggaggggatgtctgtttttaggccacattttatatttttggttgtgagcctaacccttaatggctgagctagccttctagcttgtaatgtcacttttcttttctttcttttttttttttttttctttttttctt

SEQ ID NO: 33904 - DNA, 1104 bp, Mus musculus
ctaatggagtcaactgttgctgccttggaagccagtaccagttggatcttaagcacacatagacacacaagtaggtcacaactagagcagcttggcctctattttagagtgtgtcagtaagcagggcaagctgaaatccaggcccctcccttcacagagactaaccaggtataacccaggaatagtgaaaggaactatacacgggagggtgagtcagctatggcttctgcctcctgtgcctgttagttgaatagtccccttaagtcgcttagcctttttaaaaagtaaggtttttcatttatctctatctgctatatgtgtgcagatgctgtgtgtgtatgagtgtgagttgattccctggagctagttgtcaagccactggacaagagctgggaactgaactctggtcttatggaagaacattaagtactctcaaccactgagccatctctctgatccatttctcaactgttttttatggtttaggtcttttgtctacttatttttgggcttttgagatggattttctctgtgtagccctggctgttctagaacttactatgtagataggttggccttcaatttacagagatcatcagcctctgcctctcaaaagctgagattaatggtgtatgtcagcacactgggcttacttttagccatttttaatgctagggaagcatcgtctaaattcaaggtgagccagggcttacactgtagctcagtgatgcagggtctttgcctggcattggagatgttccccatatgatcttcagtactgcaaaaaacaagacgtttgactgtaaccctgtgagtaaaactgctttcattggtttcctgagagtagttagcgtttgtttacaactatgttctacagttctggagatggagcctattttctagtgtgtgctggcaagtacactaaccttgacctacattttggaggccttgtttaaaaattagactggagctggagaggcagctcactggttttcgagtacttgctgttcttgtagaggacctgggtttggttcccctggagctgttaataggtaggtttcttgttgcctgatatagaagtctgatagattaggtcttttgcaa

SEQ ID NO: 33905 - DNA, 1192 bp, Mus musculus
aaagtacttgaaagacaatttactctcctgagggcttgccttgtggctacccacatcttgagcttatgcatcttcacttcatacccctctccacttgtaaaagcagtgatttggggcggattcctataacctggaacagttgtctcgtagtgaggctatgtgcagaataggcaaggacgacttgaagagggcctgtcactctacaatggagtgcgtacttggcattcatgaggcctgggttttgtccccagcaccccaaagagaggctcagggtgccatgcagaacatgcatgggagaggaaagaaagctggtgagccagtcccttggtggggatggttgagggaccagtagacccttgctcagcctgactggcctcctctccctggctgccccaggcattctcatcaccaccatcgcttccaagggtgagctgcagatgtggccagagctgctgcctcagctgtgcaacctgctcaactcagaggattataatacctgtgaggtaggtgatgggcagtacctggcctgacccaagcagggactacagcttagagtcggctcacagccatccatctctctgcttagggagcctttggagccctacagaagatctgtgaagactcctcggagcttttggatagtgatgctctcaacaggcccctcaacatcatgatccctaaattcctgcagtttttcaagcactgcagccctaagatccggtacgtgatgttcctcagagcagaatggtcttagagttggtaggcagacgcaggagttcatatgtgagccttgccttcactgcctactaggtcccacgccatcgcctgtgtgaaccagttcatcatggaccgggcccaagcgctgatggacaacattgacactttcattgaggtgggtcaccaggctccaggtggatagggtgaggctaaggggtcctcaggcagctgacctttcccttttacacagcacctgtttgccttggctgtggatgatgaccctgaggtgagaaagaacgtgtgccgggcccttgtgatgcttttggaagtgcgaattgacaggctcatccctcacatgcacagcatcatccaggtgcgaatgctcaataccaagggctagtgggtggcttgggatggggaatcccccgcagttgagctaggtctcagcctctctctgttgcccagtacatgctgc

SEQ ID NO: 33906 - DNA, 1206 bp, Mus musculus
ttttaaatcagtattttgcttgcatgtatgtatgcctgtaccacatgtgtgcaatgcccacagaggccaaaggaaggtattgtgttccttggggctggagttagagcaagtcatgatcgtgactgctgagctatctctccagcctcaagaaggtgtatgatttctaggccagtcatggcttcacagaccgtttcaaaagagggagaaaactgtgtctcctactcatggctgaaaatatgttgctcattccctgaagggaagtgaacagaaacaggacagaggaatatgggtgtgttgagcatagtctgccacttgctccgtactcctattcacacctctgctttcttttcaagatgggtacctagccagagtccctgcatccttacaaccagtctctttcccaataggttgatccctatcctcgtgaatgggatgaagtactctgaaattgacatcatccttcttaaggtcagccaaggggcatccacagctgactgtgggtggccaagaccattgggtattgggttggaggtctccagccagtgctgagagaaatatgcctgggctggtccctagggggatgtggaggaggacgaggcggtacctgacagtgagcaggacatcaagccccggttccacaagtcacgcacagtgacattgactcacgaggctgagcggcctgatagctctgaggatgctgaggacgacgatgatgacgacgctttgtcggactggaatctgagtaggtagtaggctggctcctgggggagggggagaagcgggtggggagcactttatgaagaactggtctcagggctgaatacctgccccacagtcctccctaagcttagcctccttgtccccttcagggaagtgctctgcagctgcgctggatgtccttgccaatgtcttccgggaggaactgttgccccacctacttcccctgctcaagggcctcctattccaccctgagtgggtggtcaaagagtcagggatcctggtgctgggcgccatcgctgagggtgagtctctccatttcgttggcactgcctgacctgacctgatctgacctgagcaatgcagatggaggcagccccatagcacaggcaattaaatcttacttacttattctttttttgagacaaggtttctctgtccagctttggctgtcctggaacttgctctgtagattaagctggccttgaa

SEQ ID NO: 33907 - DNA, 1308 bp, Mus musculus
tctttctttctctcccccccttcgccccccctcttttcgagacagggtttctctgtgtagccctgactgtcctggaactcactttgtagaccaggctggtcttgaactcagaaatccgcctgcctctgcctcccgagtgctgggactaaaggcgtgtgccaccacgctcagccttctcttaaaagccctcctgtctcctggtaattgcaggctgcatgcagggaatggtgccctatctacctgagctgatcccacacctcatccagtgcctgtcagataagaaggctctagtacgctccattgcctgctggacgctgagccgctatgcccactgggtagtcagccagccacctgacatgcacctcaagcctctgatgacggagctgctcaagcgtatcttggatggcaataagcgggttcaggaggcagcctgcaggtgagccctgacccctgacccccattcttacggtggccctcaccctgggaaatgatgatgcctgtgactgctgacaagactctgatgtctgttgtattcgtactggctgatcctggatacaccctccctagctgcctgtggtgctgctccatcccctagggttgatgaagctttccttcctatcttctctccaccagtgcatttgctaccctggaggaggaggcatgcacggagctggtgccctacctcagctatatccttgacactctcgtttttgcctttggcaaataccagcataagaacctgctcatcctctatgatgccattggcaccctggccgactctgtgggccaccacctcaatcagccggtgagaccctagacatactctgtccatgctgtgtcctttaacatctggtgccttggtttgacctgtgttgcatgccaaggacatggccatgaccttgtcaggcaggctgaagctcttagccctgtccttactctgcttccagtctagtgggatgaccaagtcagctcagtcagtcaacaggttttccagggagggatcaaggattaaaaagaaaaaagaccattagacaacactgtagcatgatcccaggcagttctgaggctggggcaggtttatttttttcctagtctgtttttgttttttggtttttttttgtttgtttgtttgttttttgctttttcgagacagggtttttctgtgtagccctggctgtcctggaactcactctgtagaccaggctggcctcgaactcagaaaaggcgtgcgcctccaccgcccggcttttttgttttgttttgttttgtttttttcctagtctgttttcataccattttaatttatac

SEQ ID NO: 33908 - DNA, 1785 bp, Mus musculus
ggtcagccaggtctatgtagcaagacctggctcaaagagaaattaagagtgtatgtaatacaatttattttttgcggttttgggaggcgggataggtaggggtaaaatggggttctagagagttttcaaagtaaatgcttaccaatgaactccaaccccgtgtcctgggaaacaggctgtagtatagtagaaggctagtgaagtaaggtctgtgtggtggacatggtggacagacctgtacctcagtatttgtggtcagggtgtgctcgagggggactgtgccacctccaatggcttagatggaaggagtaggagcagccctgccatttccgccatctttcccaactccaggattccatgcctgaggtccggcagagctcctttgcccttctgggagaccttaccaaagcctgctttatccacgtcaagccctgtatcggtaagctaccctgtttgcccccgtcccatgacctcaacattggccttaagtgatggagacataccctgggaggcccatgaccggactgggatgtattcgtactgtctgatggggctgcccagtcagttctgggagcttggcgggcctcagtggcctttctgctcagttggggtttttttctcccctccctgctctgctctttgcattagctgagttcatgcctattctgggtaccaacctgaaccctgagttcatctctgtctgcaacaatgctacctgggccattggggagatctgcatgcagatgggtgagtgcctcgagagtggcagactgcctgcctcttcattgctctgtctccatcctattggtcaggggaaagaacatactttgatccccctgacaagtgaagtcaaataactgaagggccatttatgacgtggggtagacagtttgttcctactgaccggaccatctcgtgtaattgtttttctgaaaggtccactgggatcagtgactttgacttcctgtccttggggaagactgggtggagtggtcatgttaccttctgggtaatgacttcagagactcctttgggtggttctgttgtgtgttggctgcggacttggtggggagcatcccgagaagggtctttgttctctcgggtgtggtggtatgccagtccgcatgtaactgggatcatggcgtgaggtcagctatgcccagctggcactctgtgggtggagtgggccatgcagggctctgaatggctgctccctaggggcagagatgcagccttatgtgcagatggtcctcaacaacctggtggagatcattaacaggcccaacacacccaagacgctgctggaaaacacaggtgagtaccaggccggggctgagggggccgttcccggaaggaaggcttctaagacctgaaatagagtcgggagggacgaaggaagaatactggctttagaatatatggatgggaagagatccaggctgggtggggagaacacctctatgggccaaactcaagggcccaggatagccacaggatcgttcagttggggcctgtggggcggggctcggtgcctcctgtcagaggccccgccacgtaccgtcccggggccactcggggttgcaggtcgcctgacgagtccctctgccattccagccatcaccatcggccgcctgggctacgtgtgcccgcaggaggtggcacccatgctgcagcagttcatccggccttggtgtgtgcctgcctgggtgggacctgatgggggtgggcaggacagctgtaccctccagcgccaccccccccccgcccccatggatgcatgtggga

SEQ ID NO: 33909 - DNA, 2651 bp, Mus musculus
aggtctttaagcactggggccgatgggagagtgaaaaggaagaagaccctgagccccaccctccctttcccttgcaggtttttgtctgcgtcatcgtcggagggtgtgctgggaatgtgctgcttccagaagtcactgtgccctggtcgaggggggttagggaggagtcagtgggacctaaatccaggtgcaacgcagtctgtgcatctgtccatctgtcggtccacttgccccaccgggcctgatgagtgggcaggtgggtggggactccattctcatcctacaaatagggaggggggtgggacttcttggtgggcaagagttctctgggctctaatctgggtcatctcgggcagcccacttgggccagctatgtgggagggaggaatccataaggcctaccgaatccggtgtcagataaggcaagggaattacaggtggggaggggggttccttgtagagaagcatacactcacatgtacacatgtggacacacgcatgtgcgggcaccacagccagctaggctgggccaaacgccccaccatttcctcgactgcatggagacagtagaattagtgaacccccaaattatgcctatggcctctgtgtaccttgcatctagagtataagaagcttctgctgttctgccaaaattggcgggaattgggggggctgggaggtttgggggacctcagctgggctcccggggccaagggaggagggtggtcattttggggctgccatctcagcactggctcacttggacctgctccatacacttcctgccagcttcatggcagcctcatgtagtgtgtccccatcgttgtcacatcctagccagcagcagagtggggatcattggagcagctgagactggcttgaggctaccctgttcctgtgctccaaaggtaattaaaggcacaggcctgggactagttttccttgagaaagctaataatggttgccagagctgctttcctggatctcttgaaacagctttaaggatagttcagttctctgcacctgagaaccccattctcaagagctggggtaacagcatgtgatggtgagaacaaaggacgaagtttactgggtccagcaagatttgaaagcttggaggagcagggtgtacccagggcctcaaactttgtcccttttgggacttacgtttatcacagtgtccgctggactcagaccacgccagattggtacactgactcaaaacctttgaagaaatttgttggcgatgccatcggggtgggaggggcttcccgagaggagaggggcatgattatttccagattagctgtggaaatgagtcttgtaaggtccctgaggtttatcctccatccctttctttgcttcctacatatttgggagcccattatatcttgggctttgactggagttctgcattttagggcctgctccatcatccctccaaggacttggacctttatcctttccaggccttgtgtcctttcttaagtagggtcaggccctgcctctgttcccagggacacttagtgcacattccataactcagctactggtccccatcccctccagcctgaaacttgagcaggtctctggaagccatttgtaggaaaaaaaaattttttttaaagaaaaataccattagctttctggtaattccacttcttaggagcatcctctgctgggtcttggggtgtattgatggattgactatctgatgtagttgtggcccctctttgtccaatggggagggggagggagttccaactaccttcaggaaacgggagcctgattcttgtatttccctttttttattttattttattttattatttttttaaaagaaattatttaattttttaatttattttttagttggtttttgcacaatgaagtttgagtttcttaacctcccttgtccggggctgctgacatggactgaccttgatctgtagccctccctgctgccattcccctgagtctttattaccatcacccctgggctcccaggtctatccatctgttactgtgctgtgctggggactagcgcctaggtggcgtgagattccactcgtgtagaactttgttgagtaaaggtcagtttcttgtgaaacacttggtgtctcatttcctggtccttggctttggtggtggagtggtgactgtggatgtgacgaggggtatacgtggcctagcagtacacagaacacctgcccttttctcctagcttctgagggtgtgcgcacacacaagtggagatgtactgctgctcctggtgctctacctgactgaggcaggaggatgtcaagtttgaaaaaatggagataaatagaattccttttatgaaaaaatgaggctagtatgaaaattgaggctagcggtagccagtttagctggatacatagttctgcttttattcccagaacttgaaaagtaaattgagtgaccaaggaatctccctcttctttcatctttatgaggtgggagagtgcttagacatggtaggtgtcctccttgacagttaacaacctagtaaaggcctgccgtacagtgaactcatttgcaaagctttacagcagacataacacaactttgggtcactaggcagattggaaattctttgtgatcttagaggccaggctgaatggtggtgg

SEQ ID NO: 33910 - DNA, 1207 bp, Mus musculus
tccttgccaagggcatcagctgggtgtttcccaagcttgaaaagagcaataatgacaggtatttgtgcaggaacctctggcagagggtagaggggtgtgtctcactttgtagcccaggctgggcttgaattcatcctgcctccgtttcttaagctgaaatatgaaggatggatgaggggaaagcaggaaagatatttgaagcaaggggaatagcatatgctaaaggacttggagaaggtggtggctgtagctggttccaggtgggtcacaaggaaggctgagctaggtgctttctatacccaaggctagcagtctctaggccaagggtgtggctcagtggcagggtttgcctagcattctcagtaccaacagaaagtcagggacaagctgactgaggacttcaggcaagatctcaaggagaccgactgatagtaatagttccccaccactcattccttagggtgccttggcactggccctgcctgtgggttctaatgtggtacagtcactggcttaccatcccacggaaccctgcctactgactgccatgggaggcagcatccagtactggcgagaagagacctatgaggcagagggtggagcaggctgaggcttacggacctgacaccaaggatgcagactgactcagaaaacccaaccaaagggccatttattctagagatgctgctgaccaaggagtgggcctagggaggggctggcatgtaaagtaataaataaaggtgtggcaaaaagcctcagtctttaccaatcttcttagtcttcattcttctcagctctgaaggcatctgccttttgggcgaatgtctcagccaccagcaaggggaaaaccagagaagcatcagcatagacctgcagaagacctcagtgagccctggagccatgggcagcccacggaccctgcaccctgccctgccaccatctacctttactggctgtgcgtccatccggatcttgccccaagagacagcctcatctggccgggctccggagtctgagccatcaaactcctgggctgtgttgatataaacagcgtagtctgctccattcctctgtgggtagaggaagccctcgtcagaagccgtagaaggctgggtatgatgcagaggaaggcctagagagcttttaggaagggcccatcagtgcctgaggctgccacaaaccatccgcaggagaccacacctacctc

SEQ ID NO: 33911 - DNA, 1270 bp, Mus musculus
gtcctctggctgtgctagaggtggggaagggggtgaggtcagctaggggtggagctagggtgacgccccaaacgtaggggaagttgggcttgcacttgacttgtacactgcctagcggggtctgagggtggagcctaacttaggcaagttacagacgacttgtggaaaagaggccgggagggtccttagcatgtgggaatgttagagcagtctgagaggatgcggtagggtgagaggtgcaggacacacattggcatcagaagcctgctgcttcgagtaggctctgagggttggtgttgaggtgcttccccgggaacaaggtccgagctgcaggtagaacctgatatctgaggaccttggtggtgggagctccttggtatacttgtcactgacccggtcttctcacccacctttcttcagctgaagtggtgtgcttgggttgctgtctactgctcctttatcagctttgccaactcgcggagctcggaggacactaagcagatgatgagtagcttcatgtgaggatgctgaataaggggatggggtcccatgcgtgctccccagcactgacagctcttttccatctcaggctctctatctccgccgtggtgatgtcctatctgcagaatcctcagcccatgacgcctccctggtgatgccacctaggagggttggatcctggactcaggcccaccttctctctggcctagcctttggctgcctccgccctccctcagctgctgtcctaaactttcctgagtgtggtctctgggctcccagctgaatggaaggaagttggctctttctttggggccctgcttctgctttgacaaagagataaacctgcagacttcccttttaccttctcccccccccccaaacccggccactgttatgagaaacactgttcatgtttctacgtagtcacttgttttcttattgaaaccagttgatataaaactttccgctctggttggcttgcactgttgcttctcttttgttcatggggtgctctgcccagtgaagactgccctgtgctggggcccctgtctgactttttgaaaaaatgagttaatgttaatatttcacaagcctcgggtctagggttaggcatcagggtgattgttggccctgataacctaaccaatctaggttttggttttcttggtgtgtgtgtgtgtgtgtgtgtgtgtgtgtgtgtgtgtgtgtgtgtatgtatttgcttatttattctgaagtgctatgtatgaaattcagggctttatatagg

SEQ ID NO: 33912 - DNA, 1218 bp, Mus musculus
ctttctacaataaacgccttaaaaccatgaaaaaaaatagaatataaaaagtgtttacattgatgtaaatgaggcattatgaacttttttcaaacctagaacctaaaaagatttttgtagccgggcagtggcagcgcacacctttaatcccagcacttgggagacagagacaggtggatttccaagtgagttccaggacagccagggatatacagagaaaccctgtctcgaaaaacaggaaaaaaaaatttttttttgtaatggctaaaaatgtataatggttttctggttttacattttagcgagtgaattggaagaccaggatgtttcaaatcagtacagaatccaagaggaaaatgtaaggtgagcttacacactaaagaaaacagaatcttacatttttaaattaagcaaccaaaagaaactcctatatggttttctttttaaaaaaaatgttcccgcgtcgtccccacggcggcgcggggtctctctccccccgccgggcttcgggaccggggtgcggttcggagagccgttcgtcttgggaaacgtggtgcggccggaaagggggccgccctctcgcctgtcacattgaacgtggaacctggcgctaaacgtagacgacctgcttctgggtcggggtttcgtacgtagcagagcagctccctcgctgggatctattgaaagtcagccctcgacacaagggtttaaaaaaagaaaaaagaaaaaaatgtttagcaaagtattttaaatgatacatattgaacatttaaatattattacatagttgtcatggttagggttgcctgtgaagagacaagcatttaattgtggctggcttacagtttcagaggtttagtccattatcatcatggtgggaagcatggcagcatccaggcaggcctggtcctggaggagccaggaattctacattctgattcaaaggcagctaggaagagactatctttcattcagggcagagtctgagagaactcagagcccacctacacagtgacacacttcctcaaacaaggccacatctcctaatagtgccactttctatggccaagcattcaaacacatgagtctatgggggccaaacctattcaaaccgccacagtggtgcacatcggtaatcacaactttgaagacaaaggcaggaggatcatagtaaatttaaggcaggaggggggctttctccaggccctggattaatgt

SEQ ID NO: 33913 - DNA, 1422 bp, Mus musculus
ctttttcataattactcaagtatttgatgaaagtaatgcaagttccttaaaacagtgctgctaaattttcttttgtgatacatgcctgctacacaattattctttttgtaggtaaccattcaagtcttgaaccaacttattcaaaagattcgagaagatctcccaaatcttgagtccagtgaagaaacagaacaaataaacaagcattttcacaacacattggagcacttgcgctcaagacgggaatcaccagagtctgaggggccaatctatgaaggtctcatcctttaaaagaagacagctcagcatactcctttctacacatcagaaagggcttaactaggtctcccttccatagattgtgcctttcagaaatgctgaggtaggtttcccattccttacctgtgatgtgtttacccagcacctccagacaccttcaggaccttaactcacttcataattgtttaagtctgtctgatcacccaagtagcatgactgatctgctctttaaacttctgtgatctgtgaaaattgaaagcaaaacccacttattctggctactaatggagctctcctttcttatttttattttgatgaattgttgattgtgtattttcttcattaatgaggaatactaacccaaacatacttgtttcttcgttctctggtcctatgtgagattactttagaggacaggagtactgtgcgtgaaattcagcgtgggctttccctgaatgcaagataaagcctatgtgtaatatattccctacaactagaatatattaatgcatgttgaagaattttaaagcaccatggtcagaagcagaagctatattttgcatatttggactcagctatccattaagaactatgccattatctggatacatcaaagtaatttgattctataaaatagaaattttgtgacttaatgtaatttatgtataacctccactattgtaaatttatgtgaaatgcatcacaactacaactttttcatcagtggaataataaagttgctgttaacaattttggattatctttgttttttgtacaattgatgaaggaaattagtagattacctgtggaatggttgccatgtagtcttgtgcttactgaattctcttatttaatgctgaaggccagttttgacaggttaaataagtaaaccaagaaggaggcatggagtcagtgattaattactcagtagactttttctctgagggagtaaaacttgcaaaaagggtgagggagcaaaacttaattctctggggccaatgaaaaagggagaaaacatacactcacatgcacacggtacacgaagcaaggttccaacaagatccaccaactttatttttctcttagcctttttataccaccttagacaaaaattctctatgaaaggaaaaaaggttacctcat

SEQ ID NO: 33914 - DNA, 1149 bp, Mus musculus
catagtcatttactttctaccctttgagttctattaactgttatccactgcaaaaagaagcatcattgataagggagaaagctataataatctgtggctggaaggatatttagaagatagtttgttactatgtccacttagcaaaataatagtagtagactctgccttagccctttttcttcgtaatccttgggttctttgccaggtttgcagtaccagtaccaggcatgaattctaccctgtggaacaaaccttaagtccaagtagaaagccctggttattcctaaaatattcattccactattgtaccaatgggcgaattttgtcaaactggttgttactgtagcttaaaaagttcacagctgggtgaaactgtttattctaacttttttacaaaaacactgaattattttgctgatattgtttcattatgtatccacttagaaactgttgccttttttgttgatagtgtcaggctaatattttctactttctgtgttgcaggtagattccataatgaatttggtgtccacattgattcaggatcagccagaccaacctgtagaagaccctgatccagaagacttcgctgatgaacagagccttgttggccgatttattcatctgctacgttctgatgatcctgaccagcagtatttggtatgagttatctcttactgtaacctttcctcacgcttaatgagcagaaaagtgtttaaaatggtttaatgcagcttttgcattggtttaaggtgttaaaaaacttgttactgaattaaagttcatgaccttaaaaaaatttatttacctatttagtttttttgaggcaagttctcactgtagccatgttggccttaaaattatgatcctgctgccctagcttcctgagtgctacaaattcagttgtgtaccaccgtgcacagctgggattttatttttgtataaatgaatagttaaattgttggcactcatgaagaacaagtcaggtattccagcttctcttgaaaacctgagaattgcagaaaagcttgctttcctttagttggatattacgtaattgttctgtgttctgtgtctttttcaacagtgtagtgcatttagaatgtttagttgtttatcataataaacttaatgagacataaaatctga

SEQ ID NO: 33915 - DNA, 1251 bp, Mus musculus
aagccatcatgctcaggagtgcagtgccctccatcctgacccctcttcagtggtgctgggtcatcatgcatgcttgagttcttgtaagaagtgtggtagctgaagagtaacagaagctgccagcatcgtgtgaagccctgtgacgctcccttacaagtatgggtgctttacagatgctgtcactgtaggggccatgctagtccctgtactgtttccatttcagtgtgtgctaccaaatagagcacatcttgttatattctagtgtgttgccgtaagggcaaagtccagtgagctcagcacagggagtcatggaaagtgatttgccccttaaatgtattgtattctccccctagcatttatttcttacgctagagtctattcttgaagtttaacaatgagccaaatgaaatgaagctgaaagtgcttcttgaagcatgagtggttgtggagtaagaaggaaacgaatggaggaggagtaaattgatcctgtcacgtgtactaagatttttctaactttttcttggcagtgaagaaacaactggtgatatcagtgattccatggattttgtactactcaactttgcagaaatgaataagctctgggtgcggatgcagcatcaaggacatagtcgagatagagaaaaaagagaacgagagagacaagaactgagaattttagtgggaacaaatttggtgcgccttagtcagttggaaggtgtaaatgtggaacgttacaaacaggttcttatctttttgttgtcattttttcttacattatgagatataaactgaaaatcttattttaaatgtatttttgttaaattgaaaaatatttttttttaactaaaaaagatctagataaaagtactaccatctttacggattagagattcagtattgtcgaggtaacagtgttacttaaatataactatagattcatgcagtctcagtcatatctacctctctgactgttttataaagtcaataaactgattctaaaatatgtgagaaaaagaagagaacctataatacccacagcagttttgaaagactaggacaaaaggacctaaatgcactctcactgaagtgaaggtagatttgtggtattgacatataccggttgtgctggctgtattttttgcatgtcaacttgacacaagctggagtcatcacagagaaaggagcctcagttgaggaagtgcctccatgagatccagcattatggcattttctcaattagtgctcagtggg

SEQ ID NO: 33916 - DNA, 1182 bp, Mus musculus
tttcttgtttgtttgtttgtttgtttgtttgtttgtttttcgagacagggtttctctgtgtagccctggctgtcctggagctcactctgtagaccaggctggcctcgaacccagaaatccgcctgcctctgcctcccgagtgctgggattaaaggcatgtgccaccacacccggctgcatgcctactttcttgactgcagtcaaatgtggacttttggactagtttcctagtttgtagaggttgaaaagtttgaagttactctatgaaacatactgtcttagttatgtaagccttgcaagctttatagccctggtgaggagttaggctttttttttcttgtatttttaatttaaattttcaataaagagacttgtgaagttgatttttatgtgattaaaataagtgttgtagattcttaaaactgtgtaacaggtgtttggttaaataggaccaagataaatgtttaggtaaatgaagcattcttgtcttttttttttcttccgttggcatttctgtaggacaaaaacaagctgatggatgctctgaagcatgcctccaatatgcttggagagctccggacctctatgctgtcaccaaagagttactatgaactttgtatcctttgactgttgaaggataaacacttgggccagatttatttattgtttggtttattttttgttttgtttttgtttttgtttcctctatgtagcctggctgtcctggaacgcaggtagatccacctgcttctgcctcctgagcgctaggagcaaaggcgtgtgccaccatacctggtttatatttatttcttgataaggccaattttgttgttgttactagatttgtatttaaagcagaacctatacagatttattaagaaaaaagtgagaaaagaacttgagagtgggagggcctttaaggcctactctatattgttttatttttatttatttatttacttatttattttactttgtatgtgtaagtcttatctgcatgtgtgtatgtatctggaccacactcataactagtgcctgcagaggccaaaagaaggcattggattccccggaactgtagtcacagatggttgcaaaccactgtgctggtacttgaacccaggtcctttggaaaagcaaccagtgctcccctccctcccaccctgcctcctctgaaatggatgc

SEQ ID NO: 33917 - DNA, 1157 bp, Mus musculus
agaatgtgctaggcaccagatagaaataaatggcagagatgtgcttttgaaacattctgctatagttctttgggctcctggtgggaaagaggttgtgttaggagctttggaggtaatgcaaacagattttgaggagaatgggcagaaattctgcacaaagaaagaattttgccatttaatgttcatggtgtgctccgtcatcggatttctggggtattgctaagttagtgtgtgtatgggatccagacggttaactttgtcttttctgcagtcttggggattgaacccaaggccttcagcctgctagacacaaactccccaacctaaattattttaaatttcctgttttcttgttaccctcagttctccttgaagtattgatttgtgctttctcatcaggtttaaatactatattcatcaacatgatgattctgtttattttacaatttatgttgtattgtcatattgcacatgcaacttataagtgggaaaactaaccaacaaacaggtccctataaccagtagaggtaaatactctcaaactggatataataatagctgacatttatgaagcgctcgttactgagtgctgtgcatattcataactttgtgtgcttttttatttttctagtctgtaccaaaaatttgtgattgcttatagcccatttataggttatttccacatagtagccagcgctggaaacaatccatatgtctatattgagtgaatcaataaatgtatacacacacacacacacacacacacatacacacacaagtatatacagatactgggatattacacagtctttaaaaagagagaaattctgataaacgctttcatacagatgaatcttggacataatcctagataagccagatacaaaagggaaaatgctgtgtagttctatgtatataaggtacttagagtaataaaagttagagaaaagggtagaactgcttagctgacggacattgggagtgtatgctaatatttctcctatataaattaacgtttcttaagatacttgttttttaattaatttataattaaaataagcatttttcattaaaagattttaattacatgtgtgtgttcatttgtatgagcatgtgactgcaggtgcttgtagaggccaatggtgttggcttccctg

SEQ ID NO: 33918 - DNA, 2107 bp, Mus musculus
aacactggcattctatgttgggtggtgttgggttcatcctgtgaacagccaggctgatattgttcgccttcctgacagaatgaccattctccctccggtggataaactgaagaccgtgctccacaaggtgaaagactttcacctgaagttcctggagcagtactcatgaggacgcctcaggcaccggagccagaccctcccaagaccacccaggccttcctcaaggactctgcctcagacctcagacaggccaccaacgctgttcatcttcatttccccaaggagacttctttctttgtgccttgatgtttgagagttcttcgagcaaacagtggttttgcaatgtctcacaggccctgtttttgtttttgtttttgttttgttttgttttgttctttttttaaatgcaaccaaagtagagtcaacctgctcggcagatgtacttggattctctgaatcgctattctgtttggagagttcctttgggtcttaagcagccagagtacatggaaatgagattatgtcagatctggagaaacaagcaggtgttgggaaatatgtgacttgacatgataagggctgggaatccagaaatcaatagtgagatccatgaaatcaaaccctgaccagtgtgaaaatgtagccttttggacagtaagcctgcaagtctagtgagaactcagagaaagctgaccattctggtctgaagataggcagcgcatcacaggcaagaatatcgaagtcagtagtaggacaggggtcacatcagataccagctcaaattgcactagctatctagaacagttttctccaggtttgcctgagccttgatgcataccatcgccctctgctggtcgcagcagagataagcaagggctgaaaatggaggcaatcctttcccaaggccctgaaagttgtttttcatggtttcaaactgaatttggctcatttgtaactaactgatcacggtgcctggttacactggctgccaagaaggagcgcatgcaatctgattcagtgctctcttcacatcagtttcctgcctccctccctcatctgcggacagcatcctatctcatcaggcttccctgtgtgtcacaaagtagcagccaccaagcaaatatattccttgaattagcacacctgggtgggccatgtgcgcaccaaggaaacaggtgctatagggagcgccaggccaggcttgtctcttaactgtctcgttcttcagtgagagtgggaaagctgtccggagctcccgcgcaggagcctgggtacccacgcagcgagtcaagggagttttcggagccagagagagaaagatgtgaaggctgtggagtaaggctgaaaccagcctcctgccctatagtcccacactgcagggggtgcgactttaaaacagaacttcaagttgttaacactcacaagcattgcattactgtgaaggaagtagccgcatccataacaggatgtgatggtctacagcttttcctttaaaagctgaaaaggtaccatgtgtgctcgctaggcatataatccagatatgctccagagttctgagattcttccatgaaaggttaactagaagctagaatatttttttatatttttgtaacaattggcttttttcatggggggaggggagtagagggttagtatttatagtcctaacaagtccaaaaatttttataagtgtcttcagattataaataaccctccaaattttgcaatgtttacatgttttttttttaagatgacaaatatgcttgatttgctttttaaataaaagtttagctgttctaagagattaacttcaagtaggatggctggttatgatagtttggattttctacaggttctgttgccatgccttttgggtttcagcatcactcgagtcgcagcatgtgggtggggctgtggaaacctggccaggctggacctggtcagccacacctcagagacattgtttccatttggatgtgagcaggcgcaggcctgcatgctctttcctacttagcatcatcagttcttccgcctccttagcatggttctttgtaacagccatgctgggaagctctgaacaataaaatacttccagagtggtgactga

SEQ ID NO: 33919 - DNA, 2250 bp, Mus musculus
tcctggctcttttgagacagagtctctatggtggcttttatttaatgtttgcatgtctgattttttttttttttcctagtttggtttggttttattttattttacttttggggggggggggtcattttggaaaaatgttggctgatgtaagtgtttatgggacagccaagcaaagtgataataaatggctgagtatgaggtactgggaagtctttgaactctctggagagcagatccctcagccagcactgttgagaagtacagtggaacatatctgcagggacgtttctagcgtttaaatatttattttgtgtgagtgttggctacatagcaaggccttgtctccaaaagtgtttgctcatttgtgcacacatgtgcacatatgtatgtgtacacatctcctgtttttgtttcatgaaggaattagaagatctcctgccatctagaccagaagttcctaatgttattggagagacagaagaagtggagcttcaggaatttgatagcactcgaggctctggcggtggtcagagacgtgaagcctataatgatagctctgatgaagaaagtagcagccatcatggacctggagtgcagtgtgcccatcagtaaactgcaggccactgcacaggtgggttttctttccacatttgccggatttgccagctgctggagtacctgataagtccagatggactgatggacatctgttgatctatgtgtaacttctaaaattggtatcgtatccacagagtgtataatttaaactaaccacagagctttacatcttcatttcgactgttctgtagcagagtaaagcacttgaaataagactccctttcacatgtgggttataagtttcagtcctggtatctgcttgatttttatcagttttgtgtagactttatgtttcatattttaaactcaaatccagcattgtaaagtttgtacaatttgtcctgaagctttgtgtttggctgcacctgcataagctgctacaaatagaataaagaattcatagcctgtatctatcatttagatgcatggaaaaatgggctttgcacacaatgggtttgaagctgactgggaacaatggaaaaaaattacattagccatggttgtaaagttttttggcttttttttaaaaccattttgtgaaaggtttctgaaacttgataataaaaagcagttggtgtaaattattctgtgtcacatttttagaaagaacatattttgaactgtaaaagtatccttacactgaggagtgaatctttaaacagcctctaaaaacccatcagcctgaggcttttgccttgggtacctgcccattttatagttaaataacactaatgttggttgaaacaggctttattcacttcagttgatgctctgtagcatcaaaaacatccaagttacccaactcctagattacctgcatatcgggacaaacccaggcctcatcctcttgcaccccattttttaaaaataaggtaataggtcagtagttaaaccatgtttacatagacctgttaaaatgctgttttaattaaatgttatgaaaagttgctctgtctcattaagttgaatatctgagtttgggtgagcgtggactgtttggttttctgtgtagaaaactaagattcttaggttagcagaggttctcatgcagagtggccgagccagcagtgcctgtgggttcagtttgatccatgctctgatgagcgcctcacttggattacagctgtcctgatgggatgatgaaagggtgtgtgtccatcctctgatgatgactttgtcactccttgggtgtttttaaaacatttccctttgaggtccaagtcataccaggtacacatcttttacatttgtcaaaggaacaacaggacaaaaatggaaattcagatttttcaatgtatcataccatctctgagcctaatagcactagagtacatttctagagctattagaacttggatgtaaaatgtctcaaaactaatcaagacctgtgagggttaaattactgccctatccactctacctccattgtacaaaaaaatattttgcaacaagcctgggcaagattcaaccacataatagttttgtatttgaggtaacttccccacaacactttaagcctaagcaatgcagtgataatataaactttgtagcctttccaataaaggtttataaaaccagttcctcagcattcttcagttcttctgctaggttgtgtgtgtgtgtggggggggg

SEQ ID NO: 33920 - DNA, 1067 bp, Mus musculus
tttttggtgacaggatttctctatatagccctggctgtcctggaactcactttgtagaccaggctggcctggaactcagaaatccacctgcctctgcctcccgagtgctaggactaaaggtgtgcgccaccatgcccggcccaagtttgaaatttaagcaagataaaatttctttgtacctgtatgaagtgcaaaattgagtccttaactttcctggctgcaccttattgattgagcttttttataaacactgattttagactcccttcttgcctcattgggatcatgtaatagtttctggcatattccttgagagtagctagctctgctaataaaaagctttgaaattagggacagtggctttttggctctggtagtgaatggtaaaggtaagattctgaaattgacttaaggaatgctcagcagggtaatgtgtttttgtattttaatatattttgtatatactttgtctataggtgttccagagagatgggaatgatttgcatatgacatataagataggacttgttgaagctttatgtggatttcagttcacatttaaacatcttgatgctcgtcagattgtggtgaaatacccccctggcaaagtaattgaaccaggtaaatgatttcttcttacccaggttctgggttttgttacaatttgtgtttatagtgggtaacaaaggaatattattgactatctttcttgggtaaaattcttatctaatttccttttttaaaataataggatgtgttcgtgttgttcgaggtgaaggaatgccacagtatcgtaatccctttgaaaagggtgatctctacataaagtttgatgtacagtttcctgagaataactggatcaacccagacaaactttctgtaagctggtttttaatgttccttaagcagctgatttgtggctctccctttggtttcctctcatttccttcttttgcttcttttgcttgtgtttcttttctcttcattttgttttattatagggtctcccgccacctgcaccccaggctggcctagaactcacagttatgtgtactccctatctgttt

SEQ ID NO: 33921 - DNA, 1101 bp, Mus musculus
acactcttaaaaaaattctaagcaaggtttagtctttgaagtaaactgcagtaccaactgtacagtctagtaattcaccatcaagaatattcaaggaccaagtataggtcatttgcaagttcttttaggttcagtaacccttactggaaagaaaaattaaaattttacttggactgtctctgctgatagcgtacttgaagtaagagcttaaaaggtttgcaaaagcattcatagaagctccagcagctgactgtccaaggagctaaggaaatgtcaagataggttttactctgtaatcttgggctttttgagttaagggcactgtcaagacagtttcatgttgggtgctcttttttacaagaagcttgaatgacgactctttgcaggggaggtcatcaatgaaaaagaccgctgtaaaaaatgtgaagggaagaaggtaatcaaagaagtcaagattctggaagtccatgtagacaaaggcatgaaacatggacagaggattacgttcactggggaagcagaccaggctccaggagtggaacctggagatattgttcttttgctacaggaaaaagaacatgaggtaatttccttttgatttattcactttttttcccctttctattttactcagaattgatcttacttgtgagaaatagatctgttggatgctttgaagttaaaactgaacacaaatgaagttaagggagtcaagttaattttcagctcatagtgagcatggctagcttacagaaactgactggacagataaaccaagtaaggtgtggccagaagcaccatcagtgcccttactgtagattagcactgtgccctttagtgatcttgttgtctctgcacctcattttcctttatgtaaaataagccattagactagatggtgttaggcaacataatttcactttagatctccttggatgcacagtgggtaggttcagtcttcactcttctcagcactactatgttaattttactctaattactaagtagccagctaagttttctgaggtcacgagtttatattttaaagtaatctgttttattggtgcgaaggacttactcatgttatagtatgtataagag

SEQ ID NO: 33922 - DNA, 1471 bp, Mus musculus
gtctggctactggccatcaaagacatttgataatagtttgtaaaaaaagaaagaaaaaatgtttcagtatcttctttgttgttttatttgtatttttcttcagtaactttgggtatattattagtaaatactattgaagtggaaaacgttaaataataagtgacattttttggaaggctgtaactttagaacattgcttctcagaaaagtgaatatcttaaattgtttgctgtgtataactcttatccaaaatcttttttgaaggcataccgaaagttagccaaagaataccaccctgataagaatccaaatgctggagacaaagtaagtcattgagttttattcttaaactgaaacttaaaatatatcaccctcccagaaaggaaagtccatttatgcctacagagtgaatttttcgctgttattttaatttacttgaaaatgaccttagtaaaacctattgcttgtaatattcttcaaagataagaaaaattatagctattgagatagctctgtgttccaagtcttgctaccatataagcctgactacctgagcttaatccacaatggaaggatagaaagttgtcctctgacccccatacatactcccacactcatatgcatatataatagtgatggtgataacggtcagaggactatagttttacaacgagaattctaagatatttagcagtaggtgatgaagaggaccaaaaggaaaccaactgaaactcaaggctttttattgaagttaagtggcttctgaatttctgaagtctttctcacatccttacactaaaaaatccaatttttttacttttactttatagtttaaagaaataagttttgcatatgaagtattgtcaaatccagagaagcgagagctgtatgacagatatggagaacaaggcctacgggaaggcagcggcggaggcggtggcatggatgatatcttctcacatatttttggtggaggattgtttggctttatgggcaatcagagtagaagtcgaaatggcagaagaagaggcgaggacatgatgcatccactaaagtgagtctctttaaaaatgcttctccaaacggtgttccttagagggtgactacagaatattttgtcctttgtttcaaagttcttactttaaaatgtgttcttattaagtgacattaattagatgtattttgcttcaggccttaaaagggtggaagggtgctctagaaatacaggtcagttgataaagtgcttaactcacagacacaaaattctggacgtaagccagattgggtggtctttacctataattacaacactggagaggtaggggcaagaggatcaggcttcaaggtcataaatactcaactgaatagctagtttgaggccaacctgggatacatagaagcctgtctcaaaacaaccaagatcttaaagaatagttgatttttcctgagattttttttttcacatgctgtt

SEQ ID NO: 33923 - DNA, 1099 bp, Mus musculus
agtggatgctcacagtcatctattggatggaacacagggcccctaatggaggagctagaaaaaaagaatacctgtcatggtctaactctgcgaacaatgacttgtgtccttatgctcggcaagttggtggagtgacaatttctctgccagctctaacatgaggtgctgctgttgtgggtttggcctaattcttcttgtattctagtgttaatttgggtctctcaaaactgtttgcatgagagagtccacacatagacaccaaggaaacctgtctccagttaatcttgattggtaaataaaagaccccagcagacagtagctggggagaagagacgtggtggggggcagtttaggtttcctgggcttgggaccacaaggaaggagaaagaaccatcatgccttagaagagtgtgcaggagagagacaagagctgccatggcacagagaatcaaggaaagtaccctgggctctgggccaagggaacgtggcccagagggctgactagttggagttaagagcatccaagataggacatagaaagtagtaagcagtaactcgaagttatcaataggaggtagatcctaacagcatggaggataagcatctgcccagctattgagctgcttacggcatgttaagatataaggctgtgtgtgtatctttcattcgggaacacaaatggtcagaggtaggtagggaacccatgctgggatgaattaaaaattcatactccacgctgctttctaggtcttctcttgatgaacagatgcccctctcacctctttagctggtttggatactcttgatggcgaacctcagtttgtctgcttcagtcaggtttaacatagcgagggtgagctctgttaagtctgtgttgtggtccccggaactaggctggactcagagcagaagcccgtgcaattcaaagcctaggatggctacctgtgtatgtctgtgcactgtgtgctccctggaacctgataagtgtcctccaaaccaatctgcttgaggagattcctagcaccatgctgagggaagggtctagccacatgtctcagaggttctaattctaccacaaaactcctgttttttttttttt

SEQ ID NO: 33924 - DNA, 1176 bp, Mus musculus
atatgaagttaagctgtcttatgtgagttattataccctacaaagtacctgtgttaaacacacccttcagtgaaaaatgcaaagccagaggatagtaaaaatctccagtgcaagaaagtactaagtacaaactatatgataccaacacattgctgtcgttcatcccaagttcactacaagctgtcagctcccaagtagccacagactgcaacctacacatcccactgtctcaaagacatgggaataaactgttatttgtttgcagaagagagttatcaatataaatattgaacaaaaaccaaaggatgtttacatttcacatcatggatctgaaaggctcccttagctttgctttaggagagtctttgtcactctcctacatgcgttttgtatcattgctaagcattaaggaactgcagtctgcactgaacatttctatactttggatactacctaatgatggtacttgcttgggtcaggaacatatcagctaagatgagaaaaggctgcttgtagttccaggaataattaacattcagagattacactttgttgcaaaatgatgtctgccatatgcccacttttatttactacaagtgttaagagaaatgtgcctgaatcacattgattgtggacagaaggaactttattttgttctgtttaaagatccaagagagatgatctagtctagttttgtcaatgagaagacaaaaccctgatggtgaagtagctccccatggctccatcctcctagcccagtaaccttccttggcttcttctctccctgcttagcttttaaaagtcacataattccaaacatcagcctagatgttccatgcaaaacttgttagttatgcttacttaaaatgtaatgctgtaattttgtatacaaagggggtttcaccctccctttttaatttatataacactgttatcccatcagttttgttaccagacttccttggcacctgcagaatatgtaattactgtgaattcttagtaaacagtgctggttagcagcacataggctgatgccagaaagaaagctctgtgctttcacgtttgtaatttttttagttaaaattaacaatgtacattatagaaattaaatattgggtactgtatcttgagttttgagaattatttgagtctgaaccactgtaagagaacaagctg

SEQ ID NO: 33925 - DNA, 1101 bp, Mus musculus
aatggaatactgtctggtctttgtctctaataggggcagaagtaatgaaagacaaagataaaacaggattagctgaattgattgttagtgaattttaggacatggttttatgggtatattatatattttgtctgcttttacatgtttaaagttctccagttgtgagctattagattatcataagaatatcagaaaaaatctttattaataggttgataagtagtccattgtggtgtctggaatatagaatcttcccatttcctctctgtgcctctttctgtcctgtctttcttctcataacaccttaggatactaaagctgaggactctttttattcttgccaataaaactgggggaaagggaacactgtcaagtcatctagacaagagatactaagagatactgcttgcctggctagaagatggggagtgcaggacactgacactacccgcaggctgcaagcacaagtgagcctcagggcagaagacatcaagggtagggaggtgtgtagccacctggacctcccatagaacctgcccccagctgccctgcctaactacatcaccctgactctgggcaacagcaggatacccaagacaaatcttagcaatggtccactttttatggctcttcagaaaccaaaacaacagcaacttgcaatgaatatttgcatgtaaaactatttgggaaaaaaatatatgtactgtgtgacactgcagtttctgatgctactaccacaaatgactatataatggagaggacagaatggtgagtgtgaggtagagaggcagtgcaaagacagaaccacatggacgtccatgatccatgctctcgttgaagttaaaggacaaggaagctacttttacagtggtgactgcaggctcagtcttgagacttgagaaagagggacatagaaggcttctgtgacaacccttgcctccaccaaagcccctcaataaaaagtaagaggctagaaagaaaaccttcaaagaaaattgctaacgattttatcaaggatgatcgccacaatgatggctctggcaggagtgcagtggaggggagtaagccattgagagtataatatgggcaacacaatctgga

SEQ ID NO: 33926 - DNA, 1099 bp, Mus musculus
ttgatgtagaaaggctcagcccactgtgaatgggcacattcctcatggagatggcactggactgtatttaaaaattttttaaataaaagatagccaagccggtcgtgatggtgcacgcctttaatcccttaatcaggtggatttctgagttcgaggccagcctggtctacaaatgagttccaggacagccaaagctacacagagaaaccctgtctcgaaaaaccaaaaaaaaaaaaaaaaaaatagccaagagagatggtgcacattaatagtacacactgctctttcagaggacccaggttcaattcccagccccacactgggcttcaattccagggcctctggcctccctgagcaccagcatgcatgtggtacatagacatacactcaggcaaaatgctcatgcagaaaataaaacaaatgcatcttgggggtgggggagttggaggggagaagtagctaagcatgagcaaaagcaagccagtcagagaatgagcctgtaagcagcatttctccatgggttcagttcctgccttgctttccctcagtggtggattatgaactagaaatgtaagccaaatcattttctcaagttgattttggtcagtgtgggattacagcaacagactgatgctaagacaacccaggaacagccatgggtgacagacaccaataattccagcttacttaagaatttgaagcagaataagtttgaatttcagggcaggctaggaggccttaaaaaaattgtttttcacccaaaaggcataagtcaagtagagcaaattttttagactcttatgagaaagaactaaagtaataaaagtaaatatacaattatcttttaaaaggtcaacaaatatctggggagatagttcagtcattcccacaagaccttaggacctaggtgcaatccctagaactcacatgaaaagatcggtgtgtaataaacttataatctcaacactaggaaaacaaaaacacacccttggagcttgccagcctaatctatctgcaaattccagaacccagtgagaagtgttatctcaaaacccaaagcagatgactcttgagtaatgacaccgaaggtaacctctaa

SEQ ID NO: 33927 - DNA, 1197 bp, Mus musculus
agacccagtctgcattcagtcgcgcctgtctctgcagctagaacaaagtttcacttttctggctggcgtggagctttcagcccactgtggcgaggactgggagtgaggattcctcaagcagcgctgtgcctggcaactgttggagaaggttcagtaggtgcaacaacccttactgctggccgggggaactcacccgggcacctccagggcccccgcgggggtctcccttccaccgagatcagcaaggctgagcagacgttttcaagcacctgagcttgaggtcctccgagaggggatggaaaaatcggacctggggagctcaaggcttcgagaagacaccggcagggaggggtgggccgcgcgcgaggcccgggaagcgagtggcgggcggggcacgcgggagggcggggctgcgcgtgcgcagtggccccgcggccggcacgcggcgctgcgctcgctgcttaaatgagccggggctcccggcgcgcgccacttcaagggagcccgccgcgggagcgtccgccgctggctttcctcagcccgccgagaggcggcggccgtcggggacccggcacggcgggccgaggcgctgcgcccgctgctaggaagcggcggcggccggcgatggggacggagcgaagctaccccgccgggccgtgaccaccgcgccgccgcctcgggcgctctcggagcgccgacgctgaggaacatggccctggagcagctctgcgcggtcctcaaaggtaagcgcgggtgcgggcagcgcccccttgcgggccaggccgcgctccgctccgctccgccgccgccttcgcgccctttgtctgggccaggccgcccgccgccgctgcgagctcgctccgggggacgccggcgactccgcgccttgcaaagtgtgcgaagcgaaggccggtggccccaggttgccaccgcagaaagtggtagcacacaaaccacgaaagccccaactccgacgcgccgcagcggtttcggagaagcccccaatgtccgcgcctcccgcgggtcccacctgctgcggccgggaggctgcggcaccactgcgggctcggggctgcgcggcggccctgcatgccccccgcgccccgcgccccgcgctgccttcccgggatcgccgagtcccgctgcctcatgagtcctgtgcggaggatgcacgggtcggcagcggccggcgagctg

SEQ ID NO: 33928 - DNA, 1488 bp, Mus musculus
tcttaatataattagtttagactggtttgttagcatcagtgttaatagcgattctgttcttctagcatctaatgtttactctcaccttcaagttggttataaatgatagtaatgtaagttacaaaacttttcttcttgattgttaaaatcaattaatatatccttaattttaaaatagctatactattttaaatacactataaatattatacctgttatatactaaactggtatcagaagtgaatcttactattttcttagcacttaaactactttacaattgtctttcagaaagccgatgacagagaaaaacgacaggaagcacatcggtttcattttgatgctatgtgactttgctgaagtagtacatcctggaaatcacttgattagtgaaacattaaattttgactcctagtttaaaaaaaatgatggatctgagatatttataaattatgccttccttgtcaattattggaaaatactgaaataaatatggcctgaatatctcataaagtctgttttaagcactttgtatataataatttaggttcttaatttagcagcactgagcatttgtgttcctttgtggaatgtgttgcatgtacttggtgtatctgtgtttacaatgttgttagactgaggatggtgaaaggacgtgtaaataaaaactatttaaatgacctgtggccagggcgttgttctgcctaaattgatcttgtttttatctttaaaatgcatactttcacaaatatgtgccagataaagttattcaagtaacattcttcactgcagatcagactgctcatgcgtggcacagaatgaaactaaatagccaggctttggaatcataggaggacagcttgccttagatgcctggttctacaacttagagttatctgaatatggctgctgcttagcgtctccgtaagcctcagttttgtttgtatgatgaggctaatatgcttgttcacttgagttgtcatgagcatacattgtatgatgtacatgatgtacttagctcagtgtctgagcatacagaaagcactcgtcaagcagctgctgtcatgattgctactgtaggtgatcttattctactactgtatacaatggattgtcaccgaagacataaggactctttggaaaacttaaattattggtggtacatatcttacatagttaacttgtttaactagctctaatactatccaagagtaaatgtatcctgaaagctggtatttgaatactaatccttgcacagtaacataaatgatttgctctcttgaaagaaagctgatagaggcaaactcttcaggtgccagcatgccatacagttctgtctcaaaagacgggaaaggtctgtcccatttctacagacctcaggtttcatgttagaaacttcacattgccaacatttactttaaaattatttaaatctagatttcaggagagaggtgataaaattattatcaaagctaacaatatgctgat

SEQ ID NO: 33929 - DNA, 1198 bp, Mus musculus
cttctgtgaatcacaaggcttggtggctacaggaaatacacgcatgcctgtaggctgacatttctcttaaacctgtacattgatgctttatcttgcagtgctttaaactgtatcttactttgaaattttaaaatcttacttaagcataattttttttttggtattctggtaagtattgataagagattatcagttgtttctgcttttccaatttttaagttcaaatctgactcccctgaaacatagtttgtttaagtgcattcatttttacatgttaaggcctttactttttatttgtgttaaattgcttttaagtggttcaaagatgtttcatgttaaaccttattaatatagagatatttaaagtttgaacttatttttctagtttaaatacttgtgaggataaatgtctttgctttgtggactttttatgggaattttaaatctttttattgttgttaatttttttttaattctccaggttacataattttattttcatgaaaatatatagtgaagtcccattagttatctacttgattctaattttcaatagacattcagctttgaatatacttgtgtgttgaattgttgtgtccggccagcagaccacaacctgggttctagcctggaaaggcattttggaaacctggaagagaagaggggctaggtggcgagagaaaggaatgtagccaagacagttactctgatcaaggctcaaattatattgttgcgacactagttatgaaggaagggggaggggacccgattcccgctgaataatctctggtccagtagaaaggtgcacgtgtgtgtgtggctccgcaggttccagcagtgggcgtggcagaacgaatgagcaggaagctccacccctgagcaagcaggtttcagactgggggaggggagactacattgaatgactgcagagttataaaaactcctagcaaatgtgaggttagtcaatataatttcaaagaataaaacgtgatttaaagcttagaattttttcagcaaaccattctgtgttgtagtaattatttaatctcaatccagggtttttaccccacctttgatcattcagttcccagataaaaggcacaacctttgtatttataataagccttagtcagcactagagctgggcagatatctaccctctaagctgttagaaactatgatcccgtaagtcgtctcc

SEQ ID NO: 33930 - DNA, 1134 bp, Mus musculus
gtttaaatttttcagtatgagacataactgaatgtagagtgaatggctttggggtgtgtgagatactgaaacatagctgggtttctttatattgtatggctctggggtgtgtgagccttatctttcttgtttgaggtatttgaagtgtgatcattccaccttctaagtattagcataagtaacatggtctagacttaagaacttagatctgtttctcattggaaagtagttgagctcctgatcactcgagagcgttaagagtagtgggttgttagaccttgtattcactgcaccttggtgggtggaagacagcatttagggctcttctatgattgctaagatcttttctgctcttctcgtactgaaattttgaccaggaatcaatagggtcattcagaaatgaaactgaaaatttcattgttggttattgcatcttcacttatttagaaattttcatcatttttctgggtgagaatgacttaatttgatgagtttcctttttcttttaggctcagtttatgaacctcttaaaagcattaatcttccaagacctgataatgaaactctatgggataagttggatcattattacagaattggtaagcaccgattactagtattcaatgttccatagtcatatttcatgttttgttgagttattattctataatttgaagatggggtagtttctctgtgtaagtacctgaatattctagttgtgtatttatactggactgttaaagggaatccacaggtcatacctggcccatgaataattttgttaccactatcttttaatattttaactttcctaagtattaatatattgtatttattcatttatttatttaggtattttcagacagcatctctgtgtagtcctggctgtcctgaaactctatgcagaccaggttgactcaaactgacagaagtcttcctgtctctacttcttgagtattgggcttaaaggtgtataccaccacaacaactttaataggctctagaacttgagtatgtttttgttttggttaatgaataaatgtttcatatgagtgtaagcctgattgtttacatatggtcagtttctaactcactgaagcaaaagatacactctcagattattgctcccactaa

SEQ ID NO: 33931 - DNA, 1196 bp, Mus musculus
ggtatagatttaaatatgaaactaagaatccaaagcatgcggctggatctgttgtctctgttgattctagtacagcttgttttcctgtttgtaatccaagtaggattcacttacaataaaaacaatacaaaccaatgtctgaaaggagcaaggcctgtctcccacatctcacccacagttcaactttctctttagtcatagcttggcctttctggtcaaccattttgtatcttttcctctttaattgcattatttaaaatatcaagtacgtcaaaatgtccaaatatcagctatgtatgcagtgcctgtgagattcctttccatgttacagaaataatttttacctggaccacaggctctcatacttatcagtaaaggttagcattctttggtctgactgccttcaccatgttgagctataacctgtgtttgaatcagcaatgatagctaatgactgagtttggtaatttacacattctctctatttgttgttgaagaaatagctttaacaaccgatgacacctttgatttatcctaacttcatgcactggaagctatcctttagctgattaaaaaacagtctgagtccctgggttctgctctttttctgaaaggtaggtggtgcactgaaagaatttaagcaaaatttatcactagagatcagtttgaattgctgggacttggatgaagaatagaaaccaagtctagaaaatactggtaaatgaatctgcatctctggagctggagagatggctcagcagttaagagcatgcactggtcttacagagaggaccagagaccccttcctagcatccattgtctggtggctcacagcctcttataattcgagttccagggtccaatgtcctccaggcacctacacttatgtgcaaatgaacccaattaggcacacagacataattgaaaataataaaataaagtatctacaacgttgtatgttttgatcaatgactaatattctataacaaattaagccagtgtaacagacttattttaaaatgacatccagatcctagctgtgtaaacttgaataagttacgtcatctttgtatgcgtctgttgatcttaaaacaaagctgatagcagttactttacagagtcactacaataattctagtgtgctgtatgccttgaatgcctggtgttagtgtgacctagaatcctgatatgtcact

SEQ ID NO: 33932 - DNA, 1165 bp, Mus musculus
tgaatcaaaatagtttcttcctttatctcatatcatactagctaaactgtttgtttcttcattaaaatggatgtactttattagacatcttataaaatcaaaacatgatttataagaaaagaggaacatataaacataatatttaatgattattataaaattatttcaaaaagttcagaaaatattaaaaacataaagaaagaaaagtaagggggtgagaaagatggctcagtggtcaagagcactgactgctcgtctagagaactcaagtctagttctcagcaaccacgtagaggctcacaactgtctggaagtccacagttccaggggatctgatggcctcttcatggataccaggtatgcatgtggtgtacaaacacaaatccatttatctataaaacaaatatttagcgaaaactaaggtctttaataatctcttacacattgcattcagtaatggaaagtttttgggttgccttgtctcataaaaagaatgccatatggtttacaattctctgaaatgtatttctttttctatttccaggggtgttcctggtcagttatatttgtggatctcgatgctcacaaccgcaacaggcagacattgtgctcactgttacccagagaatcacgctctcatgtgagatgatgttacagcacactgaaacaaattctttttttgttgttgttttgttttgttttttttgtttttcttgttttttttttttgtttgttttgttttttcaagacagggtttctctgtatagccctggctgtcctgggactcactttgtagaccaggctggcctcgaactcagaaatccgcctacctatgcctcccgagtgctgggattaaaggtgcaccatgctcagcttcatttacagtttttattttgctttacacactcttcaagaaagcacactacagtgtggagttcctgcaggataagaagatgtaaaatagatctgcttctgtccttcagcctccagggctcatgcaggaagtaaacagtgataggcgaagctgtcctgtcctttaagcctttggttagacaacagagaaatagatattatttctcttttggagaaattagcaaaagtagcctaaacaaaaggaacagtattttttaaatgggggcttcggaaaatatatatcatctaagca

SEQ ID NO: 33933 - DNA, 1102 bp, Mus musculus
ccatgctgtgttcctcccctatatccttattgtatatgttctattacctgccctcctatggccttcaccttcactctcccttgcatcttctgacctgctggcctctacagacactccagattgaacatacaaacctgaaaactcaaagctagcatctgcagatgaaagaacatgcagtgcttgtctttctgggcctgggttactcatatatatatgtatgtataattttcactgtgcattcatcagttgttgggcatctaggttgatttgttcagagctattgtaaatagaacaacatggagtgtggatgagcaagtatctctgtggtctgtagagttctttggatatatgctcaggagtagtgtagatgtcacatggtatttctcactttttgaggaccccacactgatgtctgtagtggttgcacagtttacactcctataaacagtgcataggattactctttccacatcctggccagcttctgctgtcttttgttttcttaatggtggccattctacctggggtgtctaccaggctgcagttacctgaggtgtaccacaggtattataagcacattgttgtacagatgagtggttttcttaaaaaaccaaaacattttatttaattgttactagggctagacatttttcattaaaattatcaaaaagtagaaattttgctaatttctgtgaccttatgagaagcaccttggaggatgaggggttcactttggctcacggacttcctgttcatcatggtgggagtagtatcgtggccatgtgagcgtgaagctgcatgcccacatggcagtgggcctggtgtctcgcctgtgctctcctttccccaccttgttcagtacaggatgagtgcctacgggatggtgccacccacacttaggataggccttcttccaaattaatctccactggaaatgtcctctcagtcaaacgtatgccccagtgctctcagtgtttcctaatctgatcaagttgacaataaaaattaactattatgaatctcaagtgtattaattactaaattgtaatgtaaagaaagctatatgccttgaacctgggcagtgttccacaataatccataa

SEQ ID NO: 33934 - DNA, 1299 bp, Mus musculus
ctgggggtgcctggggacagttgaagcagggacacagaaaccccgcctaaccattggctcaggttccttctggtcagcgctggtctactttggtttcgaacttagaggacaaccccacagtccccagaagaggtaccacttccaggcattctatcacacccaggatcttaggatcccaggttcccaggtgcttggtcacaccaggatctcagcatcacaggataccagaatcacaggatcacaaagaaagctggactctgagaagtactacctcaactgggattacaggaaggacaggctccaatcagatatatcgaggtcagggagcacttgtgagaaaatcagatggcaggaagcaagcttaaaaacagaagcaagagaaaccaaggttacttggcatcatcagaaccctactctcctaccatagcaagtactggatacaccatcacaccaaaaaagcaagatatggatctaatctcacttctcatgatgatgatggaggactataagaaggacataaataactcccttaaagaaatacaagagaacacatccaaacaggtgaaagaattgaatcaaatcatccaggagctaaaaatggaagtagaaacagtaaagaaatcacaaagggagacaactctagagatagaaaaccgaggaaagaagtcaggagctattgatgcaactataacagaatacaagagatagaagagagaatctcaggtgcagaagataccatagaaaacactgacacaacaattaaagaaaatgtgaaatgcaaaccaaaaacatccaggaaatccaggacacaatgagaagaccaaacctaaggatactaggtataagagaagaaagaatattttcaacttaaagggccagtaaatatcttgaacaaagttatagaagaaaacttccccaacttaaagaaagagatgcccatgaacatacaagaagcctacagaacaccaatagactggaccaaaaaaagaaattcctccgaacacataataataaaaagaccaaacaacaaatgaactaaacaaagaatattaaaagcagtaagggaaaaaggtcaagtaacatataaaggcagacctatcagaattacaccagacttctcagcagagattatgaaaggtagaatatcctggtcagatatcatacagaccctaagagagtacaaatggcagcccaggctactatacccagcaaaactatccattaccatagccagagaaaccaaggtattccatgacaaaaccaaatttacacaatatctttccacaaatccagcccttc

SEQ ID NO: 33935 - DNA, 1099 bp, Mus musculus
ggggagcagagagagggtggagaggataggggattttcataggggaaactaggaaagggaataacatttgaaatataaataaagaaaatatctaattaaaaaaaagtgacagttaaggtgtgctcatctgctcttttgatcttgtgaagaaggccagtactccaaatatattttagtcatgtgagctaatttctaggctcttaatttcatgattagggagggaggtcaaacctaccatagtctgggtgaaaatatatacttgttcattttttcattcacgggggaagggtgattcctgatttgttttcttaaaatataaatatgtaaaattctgtatgaggacagtcatggtggcacatgcttttaatcccagcaaagacagaggctgagtcaggcagagcttagtgagttcaaggtgactctggtcttgctgtcaaattatgggcagccagcgctacatgtgagacctcgtgtggtgattgactattatgaaaatatctcctactttcgaagagactaaaactttcactggatgtcacagccagagttaataatagaacttggagtcacagtttaagactattatcatactgtgtgttcaaacagtttttctctttctttcttgttcatttgttttttgagacaagatctctccatacatccctggctgtcctggaacttactctgtagaccaggctgtcttcaaactcagagaactgcctccctctgcctcgagagtcctgggactaaagacatgtgcccaccatgcccagcctcaacctgttcctttagcctgccttaaggggacaatgcaacaatccaccttacttgccttggatttcccttgccatcagcatttacaacctaagctaatgcacaactgtaatcttaaattatgcatccttccgtgcacctgacacatcccaaatgaatgtatcattttttgaaagcagaaaatacagacattgatagcaaccttcccaaatgactgaatatctaccataaatgcatagtgttgaacacatttgggtagtttgataaacaatgattcttataatactatttgttatctgggtactttggagtcagtaacttaata

SEQ ID NO: 33936 - DNA, 1184 bp, Mus musculus
gaatttttctctccttgttgaagatatgctgggaaacattgaccagccaaagtatagacagatcatagttgaggtttgtattttttaaaaaaattagatcaccaaaggcttactttctgtctgctcaccgaagaatagtatggaaaactaccctctcctccaagagactgagaactctgcccatcacctgtcagctccttcaataaagtcctcaagaagatggatatccttgacctgggtcagagcatacctaccattcaagtaccttaaactccatcaggtgacaaaaccaaacagaccagccacccagcttcactcatcataggcagccactgcatcagcattgccacaacagcaggggtagtttttagttttagctttttcctattacagaaataatacagtactaatgtagaatgttgcaacagttcagagcaatacagggagcaagagatcatggctgctcaagttttgaaggacatctttcagaacatcagcctatgaagagaagacattgtgtagcacactagagtgcatgcacctgtgcacacacagtcacacacctgtgcacacacattcacacacttgcccttcctgtgcacacacattcacatgcttgcccttcctgtgcacacacagtcacacgattgcccttcctgtgcacacacattcacacacctgtgcacatacagtcacatacttgcccttcctgtgcacacacattcacacacctgtgcacacacagtcacacacctgtgcacacacattcacacacttgcccttcctatacacacacagtcatacacctgtgcacacacagccacatgcttgtgcaacacagtcacacacctgtgcacacacattcacacacttgcccttcctgtgcacacacagtcatacacctgtgcacacacaatcacacacttgcccttctgcctccatgagatgttgtacagtgaattcaatggagaactgagtgtgtggccaatcctcccattgcctctttctctggcagtgtctctgtcagacattctattcttgcaaggaagctataggtcttgttgacatagaagctagatttggcccctgatcagcccgttatttctggagctacagctaaacctgggtgacattcatgctcatctctgatatcctatcatgttgaatagtatggtccagtcatt

SEQ ID NO: 33937 - DNA, 1100 bp, Mus musculus
ttatttcttggggggcattagagattgaacctatggtaggtactctaccattaagctatagcctcagctcttatttgtatttttttattttgatactgagtctcagtaagtactctgtgctggctctgaactcttctgtagctcactcaagtactgcaccagtgatcctcttgcttagccctccaagaagtcagtgttacacacctgtgctaccaggtctaccttggtttgtttctaatgtatgctggatagttttatgtcaccttgacaccatgtacagtcatctgaggagggaaactcaattgagaatatgtttttataaaatcaggcagtaggcaagcttgaatttattcttccctgctaattcttgaactggtagagtaaacaaacctgatcagacatttagacgttgtgccagctagttttatgtcaacttgacacagctggagtcatctgaaaggtgggaacctcaattgagaatatgtcttcataagatactttataaaatgtagggcattttatttagtgattgatagggaatggcccagtccattgtgggtggtgccacccctcgtctagtggtcgtgggttgtataacaaagcataccatggggtgaccactcaaaacagaagcagcagtggagtggagccaacaggaacattaaaaacaacaacaacaacaacaacaacaaaaactgtctgtgtgcttcagagggtggtgctggagaagtggccctagctccttagaggagcctggaagagcatgagggaatcccagataactggacattgtgctacttagacctttggaatttgcttttgctatgttcaattacaactgtgccctggttcttccctcatgaggtaagaaagtacttaacttatatttagttttataggagcccacacttaacagattgaaatgtaaaaagagattttaggtttaaaaaaaaacttaaactgaattttaacgtgtttgacttgtaaaaatgatggatttttaaagtttgtaaaatgttttctattgtgatgttgaggttaatatgtgatcttggggatgtacaagaaaggaaaagtaaagtgacatgtttgtgtgttag

SEQ ID NO: 33938 - DNA, 1104 bp, Mus musculus
tctctactttctgaggctgaactgacagacaaatactgtatcatctggcattacatgggttctagggatctgaactcagggtttcttgtttgcccagcaagcactttaacagtcttgctatctcatagcccatagtctgtttcttattagttattctttggtttaaatataacacttatccttacaatatatctcagatcactgttgatattgactttttgaaataattttgctacctacgtttacagataataaagttctgttgttggaagatatcagtggctcaattttaaaggagatgaaaatcctctgacttctttgttgacaaattttcatctgtaactgaaataggaaagttataaataaaccatttatttctctacaaaacaaaaatagatgtgtcagtaggttcttttttttttttttaactgaagtacagtagatacactctggtgctcatatcctcctcaccacctgcctttgcatataacccttctaaaagaggtttatcgtaagccaccgtggtgtctaatattgactgttaacttgacaagatctaaactcatataggaaacaagcctctgggtatttgtgcaagggagtttcatggttgtgttaattctgtagaaagactcaatccaaatgtgagcatcaccattcagagtgaataaaaaggagagagtggggcaagcatgatggtgcacgcctttaatctcagagctgaggaggcagaggcaggcggattactgtgagtttgaggctggcctggtctacaaagtgagttccaggacagctagaactacataatgagaccctgtctaaataaatatgtaaatagaataaaaacgatggatcaattgatgtctctctgcttactgacagcgaatgtaatgtcatgagctgtttcacactccggctcccatgccttccttaccattttggactgtctgtacctccaactgtaagccgaaaataaatccttcctctcttaatttgtttcttgtcaagttcctgtcatagcaacgagaaaaggaagtaaaggcaggcccaagtttaggtttccccgattaatatatacaaccagtaatgatttttctcttcttg

SEQ ID NO: 33939 - DNA, 1175 bp, Mus musculus
tagaaactccctacccctgagctctataaaattcttgtcttcttcacttccagtgctgcccccccccccctccccaagccccaccttagaggaaggctgcccttgtacacaaatgaaagagcttgctttaattaacgtggccatgatgatttgggtcggcgttctttcttctcccagctttgcgattacaattgctttcctcactttttagggtttgtttgtttgtttgtttgttttagtttttgtttatttggtgctgggaattgaacttagggccctacacatgctaggcaggaaccctatcagtgaactatatttgcagaccaggtttaaatatcttttttttaaagcaattaccttgtgtcactccgtttatatgccttatctccacatatcataaaagcctcacaaaatcagtacagagctgttccattttatgaaggaggaattggctatcagaggagatgacctgttcagaatcatacagcaagcaactcatgcatctgagctcaaccaggttaacctcaaatcatgctggtcttcatagccaacatctggggtacatttctgccccccacaagtgtccaggactctgccacagctatgggagtaagttttgaacactgaaggattaacagggcaaggtgaaccccttacagaattgtgtattacaagggagattcaggggtcacaccttggcttcatctttcttaagaccaacaggccactgtgttagttactttcctgttgctgtgacagaatacctgacagaacaaagttaaggaagaaagggtggatttttttcgccatttaagaggcagtcaatcatgatggttggaagctttcagccaactcctggagtccctaatggatcaataagcagagaacaaggaatgctgggagtgagaggggtacattttgtaatccattctgatctcaaatgtaccatctttctacctcagcctccccaaaactaggattacaggcaaatggcactgtgcccaacagtgtactacttgaagaggagtttcaagtgactgtcctccaagccaagcaaccattagctggagagatttagccatactcccttgtttcctaccgagttttgtgtacaactctgccttaattgcatgtggcctggaagaggggctaaagtacatagattcggtaagaat

SEQ ID NO: 33940 - DNA, 1195 bp, Mus musculus
ttcccagggataccaaacccactggagaccagaattctaggtttaatgactttattaagccaacatttctgtaataaacaactacttaaacagactcattgctatcttgattatatccacagattagggatattttgcttgatcatttggtgcctcaaacaagctttgcctcataattaaattcagcttatgttcgggcctatagtttgctgtcaatgagaccaggtctggtcttgacaggaaagccaccatcaaaagctgcatttagaacttcatccaggcagcttgctgtaacaaaacttagatcctgtctgacgttgcttgggatctcttcaaggtccttttcgttcctctgcggaattatgatctgcttcagtcctgctcggtgtgctgctaggactttgtctttaattccacccacctgccaggcaaaagaagacaactctcaaggttcatgttcactgccgagcgcatctaccttttactgaaccatcactgacttagacattcagcccacctcccaccttgggatagtatgagctgggaggccactgaaaagcttaatggtaacctatattaaaaccttttaaggagagaacctgtaacctcgatggctatggatagttttaattgtcatttgcagccttgtgtttaggttgattgtgcttggttctactattcctagctagaagaaagaagtctgaagattttaccataaagaaatgacaaatggaggaaatatacatgctgatttaaatgttatgcaatgtgtacatgcattgaacatcatgctatctcaatacataccatttttgtttttacaaaataaagatttttaagttaaccaaacagaactgctcttacacaggaagctcagtgtgttccaggattattgtcttcattaccacaaagcaaggcttttgtgccacctaaaaatgagaacactccaaactagactcttgtaaggtatttgtttttgttttgtgacacaatcattgtagattggctcggccttgaactcctagagatctgtctttctctgttccctgcccccaatgctgtgattaaaggcacatgccactagtcctcgcccctcttgtggctataaataaataaataaaaataaataaaaacaaaaccctaaaatctatgcccataatgattccttcacaaaagatggagtctaaattctctt

SEQ ID NO: 33941 - DNA, 1140 bp, Mus musculus
atttcatgttagtcttggagaaacaagaaaaatatgatggtcatcagcagttctttgcaattgtacaactgataggaacacgcaagcaagctgaaaattttgcatatcgacttgagctaaatggtcataggcggcgattgacttgggaagcgactcctcggtctattcatgagggaattgcaacagccattatgaatagtgactgcctagtgtttgacaccagcattgcacagctttttgcagaaaatggcaatttaggcatcaatgtaactatttccatgtgttgaaacggcaatcaaatatttctggccagtgtttaaaatttgcatttgacttcacagagaataaggcacccatctgcttgccaacctaaaactttcctggtaggtagaagctagacatgaaggtaaataaaaagaaaagctgttaatacaggaaacagttgcatgtagtaacactaatatatttaaaaataattcaacagtaaaccactgaaaaaaatatatatacccaagatgggcatcttttgtattaagaaaggaaacattgtaaaatatttctgaactttgtgtttgttgtagattgattgtattgttgacaattttttgggggtgtgtgtctgtgcacgcatgcgtgcacgtgtgtggttggttttcttttaactgacaagccatctgcgtggtcatagaccactgttttccccttgtgagtcaacacatagtgctgctgtgggtttgtttttgtttttctgttttgtttttgttttttgatgtgtgtatttgctaatttttattctagtttttcattaaataaatttgactttcttttctgtaattcaggtttttctcacttttgtaccttttaagttagtgtctttttgatattcataattgcttaatgtcaaaagtttgtgttcagtacatactttcttttccttcaatcaatttattagaaatatttttaatttagcccttttgtgaaaataggaattccagaaaggcaaggtagcagagcagcagtcaaggctgaagtgagtgcaggatgctcttgtctctctcggtgactgtcccatggagccacacgtcaggtcaggctgactcttagaaagggtaggttagggagtaaactctgatttatata

SEQ ID NO: 33942 - DNA, 3674 bp, Mus musculus
cttcttaaagtctattttcttgaggtaatttgtcctgttcactaaacatggcgtgtgctcccctgccttcatccctagagtgggcctgctctgctcttgtggggccttctcagcgagccattatgagagtgaagaagtggagccactagatggcatctgacacccgggctgtcaccagtggccagacaaagtcagactgaggagcaggtgggaagtcttagaggacgtacagccccagcatgctccctgactggcgtagctccgtagtgcactcaccagccatggccgccatgctcccaccctggctccacagctaccttagcctcagaagacaaggtaggcactgaagcctctggtgaggagacccccccccccccatgtggcgtttgtacagctttgccaaaaagttttctattctcaaggatgacccaagccaataaatagcattagtcctttcagaagggcctcaaagcccctgcatttcccttcttttgtctacttagaggtttcttagcagcaattcctgagtctttcagaaccagttatctcagtattgtctcttctcggtgtagcttgaagtctgtgtctgtgaaccccctcctggtcattcttagtgtcttggctctcacctggaccttcaaagggctttgtgttctccatccatgcagtctccaggcccttgtggttaaattcactgccctgtggattgttgttctcccggtcccgcaggtaaccgtggacttggtgctggtttgttatccgtagtgcagggactgtgtagatcacagaatgctgccaccatgccgtgtcttggttcatttggtccctgcacccatcaggagatgaacagagccttctaggtggccatacttacgtgatctctcctgaatttgttgatgatccagcctgctgggaagctgtttgtcatctgtccctagggggtttcagacctgcaggctgtgtgagtacagaacagagacttctggccagccccaggagttgacccaccacagtcccccacccagtgcctcagcttgggagcacagcaaaggtgccaaggtggagctgtctccagggcttcctggtgtggtcaatcccagcccagcactgctgggaaccaggagagccgggagtactccatagctgcctcagcctgatgctggcctgaggagcacaggctctcaaaggcccttcggctagcctgatctttgagttgtgtgcctctgtgttcttagtattgtttctgagagatacctgcccatttccccttgccccatataggagggaggaaaaagctggaggaaaccaaaaggcattaattactttgtagattataatgtgaaatataattctagattctttgtgaaatctgtcacatttaggtataacatttacagcccagttatccagccactgaagaaagctcacaacttgcttctttgcctcatccaaagctctgttgctgctaggtgcttgtagatgcttgacctccatccctccagtgcctcctcagtgaacttgggagcgtcttggaattcctccctgtgtggagtgcctctgcctcctgtgtatcctggcatttggttgaggcggccagtgcagctaaggctgatacctttggtcattggacaaggtgtcgtgtgtgtgtgtgtgtgtgtgtgtgtgtgtgtgtgtgtgtgtgtgtgtgtcctggtccagtgtggttgacaggctcagctgtatttctaggacatgttaggcatgaaagagagctccacctctccttgccagtcccaagtacctagccctccccctgggaggggcatctactgcaggccctctgcaccaggctcacccaggcccttgcctgctccccatacctctccagggctgtccctcctcagcattctgagccacctcagctgggtccatcagttgcactgttcgcccgaatcgttacttggttcctctgatccctttagttaaaacacccttcgttctgttgctaatgcttctctctggcttcccactttcccctcccagatttggaaacttggcttctgcccaccacatgggagtagcctgggaaatcactggttgccatttcatcattaatggagtagctacagacagcaaagccattggcctccctttctctgttttccttcttgaagcgctccattcctttcttcttgaaggcctagccttaattcagtttctcagcaggtggctctcaaggtgaaccaccccttgggcttacagagaaaagggcaacccttgctacccttgctaaaaggcaggctgtcaatctgtcaccgccctgagggatggactcagtgctttagaggaaagctggtggcttgtcactgccacacgccttgagtgcagggccctggtaggtggtctggaactggacttccttaggagtcgccactctcctgactaccctccactctgtgacaccagtcctctcactaaccctgtgggatcttggctcccagaacctcagcctgcatcctgccatctctcacctaactctgaggtcccttaaatccttcttggcccttggcttgctactgcctaccacctgttcccacaatcctccgtgacaccgttccctccctcattggctaccttacagctcttccctctccctaattccaggggactccaagttcatctagagggccattttgcatcatcctcttcctctgtgatcttcgaccagagcatcacgttcctaccctctgagccatgtgtccgcggctgctgccccatggccgcacttgactgtctgctttctcttgccatgatccttactccagccacccagatctaggttccccataggccctgttcatgtttcttcctctcatagacatgcccttcttccctacagcctgcctcctcaaaggcccagccctgagttctctttgtgttcagagcagaagcagctctatgctattctgtggccccatggcaatttggtgtcttgcttctggctcttaccactctggccggtgtagctgcagccaactgtgtactgtgttgcctccctctagactgtgagctcctcgtgggcagggaccatatggtcactctgtatctcttgtggcacctaaaagtgccttgcacttggtaggtgctcaataaatgtctgttcaagtgagagctggagggtggtgctttcttgactgcggctttggcaagaggtccctggaggatctatggtgatcgtgttcagagacgggacccacctttgttcaatttgggggtgggtccaattgcctggctcgatctgtccccctttggaggtgggggtgggaggaattcagcacataccatcctggacagagttgcctagccctggaatcctgaccagatggaaccatcccgagcagtcagttggcccaagcctctcctgacagccttccttgggattttccccattgctagttggagccgaggggtgatccatagcagcctttggcaccgttttctaccatggggaagatgcatggtcaagagactcctggccctgaggttctgagctccccttgtcaaggaagcgctttctcacatgtcaccaggcccaggattctctgttgctgaagcagtttcatgttggaattaatcccttgagatcacgtgtgtgctcctagtgaagcgcctcactgtccttagcaaagcatggc

SEQ ID NO: 33943 - DNA, 2453 bp, Mus musculus
tacttcaaccttattgtttctaaatgtcttcaagaaacttggaagcaggacagtcatttttgttaattccagaaaccaaaggcctttattctctcctaactcagtaaatgaatccagccttgggattatccactgtgtagctaggcaagcccctaagatcacaatgcaagacacagtgaaaaggttatacattcccactctgtaaattatacaaagtttcagttcctctaaagttgattaaatagttcagagtgaaacagacaaatagcctcacacacacactcacagagttcagatctgtactttattctcattgaaatcaaagtatgttgctccaaattatagatatgtgtagtggttaaaaaaaaaaaattcagcctggctgttgacagtcatgtcctggggaactggtgaattggtctaactttgtcttctcttcacaggagtatatcaaggggatctgcgagccggagctggaggagaaagagtgctaccccaaggccatgcactgcatttttgtcggggcacaaagcctctttttgaagagcttaattcaggatacgtgtgctgacctctgtgttttagatactgggcttcttggcatccgaggaagcgctgaagctgtggtcatggccaggagtcacattcagcagtttgtgaagctctttgagagcaacgagaacctccccagtaatcagagagagtcggaaatcaaacgggaattcagacagtttgttgaagcccacgcagacagttatacaatggacctgttgattctgcctacttccttgaagaaggaactactgagtctcacacaaggggaagagagtctgtttgaaacagatgatgatgtcattactgttggagatgtacggccaccagagtacacacagagtgctgccacaggaccgagtagtgctagagatgaagttgttgtacaggaagattctagaaataaagctaggacccctgtttctgagcttacaaaacacatggacacagtcttctctagttcaccagatgtgctttttgttccggtgaatggcctaagtccagacgaagatgctctttccaaagacagagtttgtcacaagaggagatcttctgatacggaagaaaggcacaccaagaagcagttttccttggagaatgttccagaaggggagcttttgccagatggtaaggggtcagctggaaatgaagttattgacctgtctgatcctgcttcaaactctacaaatctaagccccgatggaaaagacactacagaagaaatggaatacaatatccttgttaacttctttaaaaccatgggctattcccaagagattgttgaaaaggtcattagggagtatgggccttctacagaaccgttactgctcttagaggaaattgaaaaagaaaataaaaggctccaagaagaccgagactttccaccttgtactgtgtatccagatgccagtcagagcagaaatgcaggggttgggagcaccacaaatgagctcacagcagactccacgccaaagaaagcacagagtcacacagagcaaagtatggtggagagattctcgcagttaccgttcaaagactctaaacactgtacctcaaattgcaaagttaattctttcagaacagtgccagtaggacaaaaacaggaaatctggggttcaaagcagaactcaagttgtactgtcgacctggaaactgatggccactcggcctctgccgcctctgccagccctaaagacatcagttttgtttcaaggggagcttcagggcaccaacagagaaacccagcttttcctgaaaatggttttcaacagcaaacagaacctttgcttccaaataatacgaagcctgcctgtgaaaagcgttctggctcctgtagctctcctcagcctaagccaaattatcccccactttctccaccactgccgctgccccagctgctaccttcagttactgaggctcgattgggagggtcctctgaccatatcgattcctcagttacaggggttcaaagatttcgagataccttaaaaataccatacaagctggaattaaaaaacgaaccaggacgagcagatttgaagcatattgttatagatggaagtaatgttgcaattacgtaagtcactctgcagatcacccttacacagttttctaagcagtgtctgagggtgtgtgtgtgtgtgtgtgtgtgtgtgtgtgtgtgtgtggactgtcctttgtgttccagtgaatctgcatcctttcttgggggaagaccagctgcttgtaaagttttgcatttggttttgaaataattgtttacaaaataaatccaggcagcaggctcattgatacccaccccaacaaggtttatgttcccaaatgagtcacataccgcctttatattttaatatgccttagtcagcacagtagctgggccacttcctaacgtccatgcggtt

SEQ ID NO: 33944 - DNA, 1190 bp, Mus musculus
tatgcactgtatgctgtgtttaacttctgtgtatggaatatggcacagctatgttaaaaggtgggaggagaaaggatccaagaataaacttaggtctgtgaatgtagttcagtggtagaatgcatacaagtttcaccctttggttcccagcacaggaagaaagcaaaacaagagccttgatcctgtatcttaaatgtttacgagtggggaatgggaaggtggctcagtggataaagcacgagttgcataagctgggaacctgtagtttgaatccccacaacccacgtataaggtgggcaggcacagagaccacctgtaacccagtgagtacgcaggaggcagaggctgggttccacaccatagcccagctgcccttgagttcatgtccacctccagcacttcctcctaagagctgggattaaggcagattgcaggtgtgagttgccgtacccattttttattgttttctagtatgtgcatttgtgtcgtataaatttccttttcaagctaggcatgtttgtctatgtgtgtgatcccggcataggggaggcagaggtggaaggatcaccaagctaaggctcacctggtgatcttcttagtggattgtactaggtcagttgactgtgttgagactgttggaaagaccagtgagagtaacataaacatccctttcagggctgctcctgtctgccttgatagttcatgttctttttatttaattcaatgcattcctaagaaacttcccctggggggctgtggtgcagctcagcagcggaacacttaacttacttagcaaggccaaggccctgggttcatcccagcactgtgaaaaagaactcacgtgtctggaagatccatggccttccaaagaaaggaacagaaaaaggaaaattcccttgacctatgagttacttagaagagtgctgttcagcctggggaggtggcgcacgcctttaatcccagcctttaatcccagcacaccggaggcagaggcaggcggatttctgagttcaaggccagcctggtctacaaagtgagttccaggacagccagggctacagagaaaccctgtctcaaaaaaccaaaaaaaaaaaaaaaaaaaaaaaaaaagtgtgctgttcagtttctactttccaatcattaggagattcttcttatctgtaagtgatttgtttgattattttgtggtc

SEQ ID NO: 33945 - DNA, 1101 bp, Mus musculus
cactcttaagtaactggtgtggccatgggcaagggtactggtgctggatcttaatcgtgattccatcggtcacaaagtattcacttctctggaggggtgagaactttcccatctaaattgctcatggagcagaggacacttagattttctttgacaaaacatctaacaataagcaatttgaagaaaagttgatatctcttgtgtatctaaatgatatttactggtgacatgtcaatggaaatggaccttaaaatgaccttttacctgcagtttgacaaaatggcatttcaccctgtttctattttatttagggatgattttttttttttaacatatatgagtattttacctgcatatatgcctgtgtagcacatgcatgcagtgcccttgaaggccagaaaagggtatcctctggaactaaaagttacagagggttgtaagccaccaatctgccatctggaaaagcagccaatgctcttaaccactgaagcatctctccagccccgaacaacacattaaaaaagcagtatatcaaactagccatggggacacaaactttaacagcagcatttggactgtggaagctgagaactcatgagtcagttcaaggccagcctggaccacagaagacctgtcttacaaagcaaatgtgggccatggtcacaaagaatataaaatagtctcccttagctaatcttctgaaggagaaaggaatgttttatgaagtttgttgctgaaatcagcattgtgtaccccgccactccagcgtgctgttcatgaggctgtgtctcactctgcagccctggctggcctgaagctcacacttctgacctgcctcgctcccctgaggttagggttgaagtttagtgtcatcacacacagcaagaacctttatggaacattcccttttaaaggaaattgtcatttaagagtaaaaggagcactctccctttaaaaaggaaagtgaaggaaaaccattgctaacagtcatctacctaagatgttgagggctggagagataggtaggtcggcagttttaagagcaaggacccaagttcatttgccagcacctgtgtcaatggctcccgacacctctgccag

SEQ ID NO: 33946 - DNA, 1187 bp, Mus musculus
actccgaaagggtaaaaccccttttaaagtcacaagcagactttcagacaggcaggtaactcatgaaccagagctagctagcctaaacataggcgtggtggcctgtgcctttaatccagtggttttcaaccttaaccctaagaccatcagaaagcacagatgcttcaacaataagatccataatagtagcaaaatcagttataaaatagcagtgaaaattttatggttgtggatcaccacaacatgagaatcggggttaaagggttgaaacattaggaaggttgagaaccactactttaatcccagcactcaggaagtacaagctggctgatctcttgagtttgaggccaagcctattctatatagtgttcttcagtccacctggagctacagagtaagaccctctctcaaacaaaacaaagaatgttggaatgaagccagtgaattagagaataaattggctacctaatatctcacagagcaaagaaattttactctttagggctatctcttctaccaactccaagagttatcatcttggttgtcgaaactctgcatttcaattaattgattgattaattttcaaaacaggggtctatgtatccaaggctgacctggaattctatgttatgaagaatgctgttgacttttttgttttttggtttttttttttttggttttgattttggtttttcaagacagggtttctctgtgtaaacctggctgtcctggaactaactctgtagaccaagctgaccttaaactcacagatatctacctggcccagccattctttcgtgtttaaccacatcattgttgcaggatgttggcccatgtttctaaccacctacagatattagttagacattgtttgctcagggtttctcagcagcaatgtgatttgggtcatataatttgggtgtatggggagaagtgtactatatctgtaggatgattagcagcgtctgtcttccaccctctagatgctggagatgccaagaacatcttctcaagctataaaagccaggtatgtttcctgatgttgccagatgtctagagaattacatctgcttgggagtaactgaatttgatagctaagagtagttcccactatctagaatgtgcaatttactggatttgtgatatacattacaatttaataagacacttgtgtttataaggcagag

SEQ ID NO: 33947 - DNA, 1216 bp, Mus musculus
catggttacctgaatgggctacacacatttgtgcagttgggggattcagagtgaaataagaagccatatctaggatgtagccttgactgagctgaatttttttggcttgctgaaacctgggtttaagatctcagacacactctttgctgccagacctccgccatcatgggtcgcatgcacgctcccgggaagggcctgtcccagtcggcgctgccctaccgccgtagcgtccccacgtggctgaagttgacgtctgacgacgtgaaggaacagatttacaaattggccaagaaaggcctgactccctcccagataggtgtaatcctgagggactcacacggggtggcccaggtccgttttgtgactggaaataaaatcttgagaatcctcaagtccaaaggccttgcccctgacctccccgaggatctctaccatttgattaagaaagctgttgctgtccgaaagcaccttgagaggaacagaaaggataaggatgctaaattccgcctgattctgatagagagcagaattcaccgattggctcgatactataagactaagcgggtgctcccacccaattggaaatatgagtcgtccacagcctctgctctagtggcataaatgctgttgtgtgcacaagcaataaaatcactttgagtaaaaaaaaaaaaaaaaaatctcagacactaaagaggagccatgggccgaagactcaccagctcagacgttcactaagtctaagcagggaaggtgtgtggtgaagtgtgctaagcagagatgtgggaagtggcaaaggaaaaccaccccaaagagaacaccaatccttagctcttccctgatctcatggaggaaagagacctcagatcaacatgtcttctggtttttcaggagaagctagaaacctggactttcagaacacatacatttcttaagcagtcgacagtcaatccaaatgagtatttccaaaacacggggaggggagacacacatgtgacattttcactgagttggcctggtcatctctagagtaggagagatttagtgcaaaggagaggatgagaaacacagcttggtcaacaaaggagaggtccaaccatgccagagctgtagagagaggaaacagcccatcagctctgcagaggaaggcctggtgtcttataagacattttgcaacaagattgcacaatcagtgatgaaatggaagtgtcttagctcc

SEQ ID NO: 33948 - DNA, 1748 bp, Mus musculus
ctacgtgttcgtagctacactgggtaccaaggtgcgcgccgccggcggtccaacttcgtccgctcccttactaagagaagtaaatttcgcttagctctgcacactcccgtttccaaaattaatctcgccttccccaagccagtcgcagtaatcgaggaagagacttgccttgtcattatggttccttacccacgtccatgtccctaacaattaacgaagtaatgtgaaatgtttctcccgacccgacccccctctgaaccctgccacttactgaaacttagtatgcccccctgccccagtttgaagagggggtcagattgtttttttgtttctgtttccgaatggggcaggtagttttaataacagattttgctcttcaaacaccgcgccagttaagctggagagaattcgtccccgcttgttagcgaaggaaagactcaccttcgtggtgactggtttgactatacataaatatgtatatgtatcatttgtacacgaagaactcttccaggtggacgctggctgtattccgtatttctgtcctgttcggagtgatcgtgaaatctaaggctgcttggtgtttgttctctgatgcttgtcaatgccccgtgttctgtggctccaccaaccgccaaggaggttcttcgggacgcttcttcttcctctgtaacatacgtgtgaatagccaaattttaattttgctttaatccaataaagtcaaagtgggacttttatttttctgaaacagctttctaaacttcgccttttccgggttgcgaggttgaggcgggcggagaagcaagagacttggaagctgcaaggagaggccagggcacaaggccttcttcgcagagccatttctgcgctgtctcccgcagcaggctccctttgcctttcctgtgtcccctgctttggtggaaagtgagatataagacctaaatcctgctaggcgtgaccgagggcctggaagcagtttcttgctcaccctcaattccaaatgcatcaggaattattcccaatcctagtactcgaacccgcctgccccgcgtgactgtcttcacgcctactttccttggatgtctccagctctatccgctccgcggcgcccgaagcacctgacactttgtaccagcgcctctgaacccgaggtccacccgccaaacaaacccgggcggccggactcgcgattgcgctcattcgcaggactttcaaggggttcgtccagaagttttgattgtaccgaaacataatgtgcaaagcaaaattgaaataaacgacttcgttttaagtctggaacgctgaccctgtgttgaacgcgggtgacgcaacgccagaagcgggaggaagcggagggtccaagaccgagatacgcagcccgggtgggcgctggtggtcctgagcccttctccagggttttcatgggctgaggttcagtttcaagtttcaatgttttttgagtgaggggtgggggaagcagggcttaacagtaccgcgggcaaaatttctggcatttctgtcttctgcccccacccccatctccggctctttcttagcttaaagtgcttctggcagccacgcccttcccagggctaggggcccaggggactgtaggggacaaaaggggggtttctgaagtgagatgcagtcgaatgtcagtctcttccagccccaccgttcccttcttttctcttttcagtctcaccgggagaggggccttatgggaaatttaataaaaaagcgaattcttt

SEQ ID NO: 33949 - DNA, 1136 bp, Mus musculus
atttttgaagaacatccatgtatatttctatagtagctaattgacattcctatcaatacttgtgtgaaagggtcataaaaaaaataaaataaaataaatccctgttttcttctcattcgttcctaaatggtatgagagatgaaagatgagaggtgagaggtgagagatagagagagagagagagagagagagagagagagagagagagagattgggattattggcttgcccataccttccattcatttctacagctgcagcataaaaactgtatttctgatcttaggaatggttgctggcagggagctggggagctgctcagttggctcatttctcaagcaaaaggagctgagttccatccccaaatcaccggctaaagattttaaaagaagaggaggaggaagaggaggagaaaaccaacaggcttggtggtatacatggaggaagtggagacagttgggtccctgggacttgctggccagccaacctagaatagttggaaagttccaggctagtaagaggccctctataaatgaatgaatgtggcagtactatagtgtaccagttgaagttatcgtctgccaccctacacacatacgcacacacttgcagggatgcttagaaaaaagaggaagccagaggaataaactaaaagcagttagctgacccttttgccgtttgccattttggtggcaggggcgggggtgatgtgttactaatcctgcactactgtttaatatttcagctttaacctctttctgctcgaagactgaatccagaagctttaatctggccaccacttaatgagagggcatttgcttttcttgtagttctggagttcacacacaggaaatctctgggctttgtaccaggctagatggtagtgcctagtgatgatatgtgtgtgtgtgtgtgtgtgtgtgtgtatgtatgtatgtatatatacactaatatatccttttgtaaggcatattagtaacaaaatgagaagtgacttcattaaattgaaatgtttgatgtctcagtatgcaaagtgagtttgaatgtatacatcgcacacattgctcttcccaattggggatttcacagcatttgaggattaaggttgtgggtcatttcattttcctgccatttta

SEQ ID NO: 33950 - DNA, 1179 bp, Mus musculus
aatagtgtctgcatttgatggctgattatgggatggatccctgggtggggcagtctctggatggtccatcctttcatcccagctccaaactttgtttctggaactccttccatgggtattttgttcgctattctaaggaggaatgcgttggttttctttcttaagctgctcttgatcgccgcctgctggcccatcaactgggtgaacccgactagaggagaagcgtgacctcccacccaagcaacaaaatgcagtctagctctcactctgagcaaggggccacaagagcagatgtccatccgctgtggccagagtttaagacattcaaatcctaggcgagtattcaggtaaaaaactcaggatcctcgaaatgagtagctggggggaaaaggcaaaagcagcaaggtaagactcaacttggccgcgtgcttgcttgtttgtgtctatgtgggaatgtatacacatgtgcctgtgtgttcaccttacctgtgtgcacctgcgtgtgcgtgcacgtgtgcatgtgggtctataggtgcacactggtgcatgagtgtgtgtgcctgtgcgctctaggtgtagtcctgggactggcgactgtcccgtgtagatttgttgctattctgccactgaccagcagatggcgagagtgcagcgggaaagtcaaggctgcaggcgctttgctctgggctggaggacaggggagatccaggaccagagagcactttgtgctatagtggcccatgggcagtgtgacccacattgcaggcaactccgaggacgtccagagccagagctgcgggcatgctgactttcctgggagacggtcaaggctggtttctacaactcccttaacttttcagacttcccaaagaccctctgttcaagtgcacttctctcaggagctagggcttgcatctaagaaaggtagacagctcagccatagaccagatgcaaggatgcgggcagctggattgggacagccggccctggtgctggactgttgtgaccttgagactcaccgctcctcttattgccatttcctcactccaaagggagttgtgctccaccacttggctgaacccagtcaccaaagtatccagggcaatgctcaggctatgtccccgaaggcccccaaccatggctctcaaccaggcctcagatctccttgcctggtgctgc

SEQ ID NO: 33951 - DNA, 1175 bp, Mus musculus
gcaccagacactttgccccccccccccccccccccgccagccttcttccaagaacccatggtacatgtatctgttatgtgcccgagtcatgcagatcccaactagcactgatccggggtgtctggaagtccagtctctagggcaggatgaacattccaaatcctccagaccccaaattcaaaccactcctatatccaaaagcttttgagcaatggcatgattctacaagtggcatgtccccacctaacccattgagatgtgtaacagtcagagagcaggtgtgctagagatcctgtctgagctgctctgcagtccgggtaaagaatgtatgaaggggatgccctgcttagcctggagtcccactcctgacttctctctttatgtaaaagctccagaatttgagtccaatgaacttcctccccccaagcatcgtggacgggtgctgggcagcctgtatgggcagatggggtcttgagatggcatgcttcagcgaggtctgtgagggcttgagaatgggagagatccttttgcatgtgaaggagacttgccaagggctgtcccaactctccacttgtcccatgtactccctccagccagaccactgctgagtcatgttcagggatgctgactgcaggcagacttcagaccctatcttctcagcctggtgtgtactcttagcattctccctgttggccagtggctatgggatgtcatgtaacttttgagtctatgtcctccttagtgaactggtggccttgagtagccagtgagtattcaataggccagtaggttagtatgctttgaagtgtgtgggaaagtctggtcctgttgctacgactggcccattccccaggccctgcttttgtgccttctgaggggccttttggggttggccaggcctgggctgccctggctactcctctgtctttcttgcatttggcttctctctcagctgaattctgagttcctgagagcagtaatgattcttataacctgtgctctgctcctgttcacgttctggacttgacagatgcttagtaagtgctcacctaactgaatattagagtacatttaaaggaccctcaaggtagagtgtggggctccatgctcttaatcccagcatgggggtgggggtagggcccacacaaaaaggcaggtggatctctgagtttact

SEQ ID NO: 33952 - DNA, 2350 bp, Mus musculus
atgggcagagctggcccaaggtcgtctacagctgcccctattgttctaagcgggactttaccagcctggctgtgctagagattcatctgaagaccattcacgcggataaacctcagcagagtcacacgtgtcagatctgccttgactccatgcccacgctctacaacctcaatgagcatgtgcgcaagctgcacaagagccacgcctaccccgtcatgcagtttggcaacatctctgccttccactgcaactactgccccgagatgtttgctgacatcaacagcctgcaggagcacattcgagtctcgcactgtggccccaatgccaacccccctgatgggaataatgctttcttctgcaaccagtgctccatgggcttcctcaccgagtcctcgctcacagagcacatccaacaggcgcattgcagtgtggggagcaccaagctggagtctcctgttgttcagcccacacagtccttcatggaggtctactcctgcccttactgtaccaactcccctatctttggctccatcctgaagctcactaaacacattaaagagaaccacaagaacatcccgctggcacacagcaagaagtccaaggctgagcagagcccagtctcctccgacgtcgaggtgtcttccccgaaacgacagcgcctctcggggagcgccaactccatctctaatggcgagtacccctgcaatcagtgcgacctcaagttctccaacttcgagagcttccagacccacctgaagctgcacctggagctgctgcttcggaaacaggcctgcccccagtgcaaagaggacttcgactctcaggagtccctcctgcagcatctgacggtgcattacatgactacatccacccactacgtgtgcgagagctgtgacaagcagttctcctcggtggatgacctacagaagcacctgctggacatgcacacctttgtgctataccactgcacgctgtgtcaggaggtcttcgactccaaggtgtccatccaggtgcacctggccgtgaagcacagcaacgagaagaagatgtaccgctgcacagcctgcaactgggacttccgcaaggaggctgacctgcaggtgcacgtcaaacacagccacctcggcaacccggccaaggcccacaagtgcatcttctgcggcgagaccttcagcaccgaggtggagctgcagtgccacatcaccacacacagcaagaagtacaactgcaggttctgcagcaaggccttccatgccgtcatcctgctggagaagcacctgcgggagaagcactgcgtgtttgacgctgccgcggagaatggcacggccaacggggtgccccccacctccaccaagaaggcagagcccgccgacctgcagggcatgctgctcaagaatcctgaggcgccgaacagccacgaggccagtgaggatgacgtggacgcatcagagcccatgtatggctgtgacatctgcggtgcagcctacaccatggaggtgttgctgcagaaccaccgcctccgggatcacaacatccggcccggcgaggacgacggctcacgcaagaaggcagaattcataaagggcagccataagtgtaacgtgtgctctcggactttcttctcggagaacgggctccgggaacacctgcagacgcaccggggccctgccaagcactacatgtgtcccatctgtggcgagcgcttcccctcgctgctgacactcaccgagcacaaggtgacccacagcaagagtctggacacgggcacctgtcgcatctgcaaaatgccactgcagagtgaggaggagttcattgagcactgccagatgcaccccgacttacggaactccctcaccggcttccgctgtgtggtctgtatgcagactgtcacctcgacgctggaactcaagatccatggcacctttcacatgcagaagctggctggcagctcagctgcctcctcccccaatggccagggactgcagaagctctacaaatgcgccctgtgcctcaaagagttccgtagcaagcaggacctggtcaggcttgatgtcaatgggctgccctatggcctgtgtgccggctgcatggcccggagtgccaatggacaggtgggtggcctggccccacccgaacctgctgaccggccctgtgccggcctccgctgccctgaatgtaacgtgaagttcgagagtgctgaggacctggagagccacatgcaggtggaccaccgtgatcttacaccagagaccagtgggccccggaaaggtgcccagacgtcaccagtgcccagggtaagtgcagcctgacaatcattcccgacctgtccttcttggggaccagtgggtat

SEQ ID NO: 33953 - DNA, 1179 bp, Mus musculus
tacccaaaggaccaataggatttcctttaaggttgggggccagggaatggggggctaggggctgagggttgatggaagttgactcccagatgtggttggaattaggggacttggattccttttggcctgtgggactgtggtcatttccggtgactttgtacaggctgtcccccacccccacccccaagggaagtggctgagagctgcgcctctgacgaaggtgcactacatccagtcaggttgaggcaggtgtcactgcgaaaaaggacacttcccttgggtgctctgccacccctctgctgtgtgtcctctgtggatgggaaggtctgtgtgtccacttacttccggccccctcgtcactcctcccctgcagcagttggccagctgcacagcctcagccgagagctgtggagaagctggctctgtccttgcttctcagcggccctgggaattgcctctaatctctcctctgccttcccctgcagatggtgatgacgacccacagctctcctgggtggcttcatctccctccagcaaggatgttgcgtcacctacgcagatgataggagatggttgtgacctcggcctcggcgaggaggaaggcggcaccggcctgccctacccttgccagttctgcgacaagtccttcatccgcctgagctacttgaagaggcatgaacagatccacagcgacaagctgccgttcaagtgcaccttctgcagccgcctcttcaaacacaagaggagccgagaccggcacatcaagctgcacacgggcgacaagaagtaccactgtcacgagtgcgaggcagctttctcccgcagcgaccacctcaagatccacctgaagacccacagctccagcaagccgttcaagtgcagcgtgtgcaagcgcggcttctcctccaccagctccctgcagagccacatgcaggcccacaagaagaacaaggaacacctggccaagtcggagaaggaagccaagaaggacgacttcatgtgcgactactgcgaggatacctttagccagacagaggagctggagaagcacgtgctcaccctccacccgcagctctcagagaaggcggatctacagtgcatccactgcccagaggtctttgttgatgagagcacgctgcttgcccacatccaccaagcccacgccaaccagaaacacaa

SEQ ID NO: 33954 - DNA, 1099 bp, Mus musculus
ctccaagaactgggtagttagccaaggaaagaaatcaaatattatttcaatctgcaaagctcttctttctgttctcctcttccctgtcgtcttctgggaatcttctcttctggcctctttgtcccacaatcagaaccctctggaacctccagttctgtagagcaagtctgcctgctccagattgagaaactggatgaggcgctcagctgccgcaacttctctcaatgaaagaaaggagccggcgcttgagacttaagaccacagggagggtctcggtggggccaggtgcccctgactctcctggggctttagaaggaaggagaagccaagtgtctggcaacccacgtggtgcagattcagcaccagctattctgtccaggagcaagactggcaggaagggagccggccccaacgccttcccgcgcaggcctccaggaaatgaacttttcagagcagggctgggctgtggccagaggttatcaagagagtcgagcaggacaagggcctaaagacttcacgctccacagctactctcgtcctgctcctgtatcatctaatctatctctcaacgcgaccaggcaggggctgcactgggtacaaagcagcaggccatgcctgcagaagcgagctggggagggaaaaggggacagggaggagctgcaggccctcgcgcagcttctccctgaggcatctgctctccaggggtcccttcaaacccggggttctccgaggaattagaaagcaagggggatgtgtgtacttggctatctatagctcctcacaaacgtgcgcaccctggggagtcagtacggaagacagcctgggtgcccgcggcgcggctgcccagggtggtatcggacgccccgctccaaggggcgctcacagcagccgctgtgctcccctggggaccagcatcccgccggcgcggcacagacaatgaactcctggcgaggctccctgcccagctggcctcggtggagccggcaggaagtgcgggggcccgggccgggagctcggcctgggcccggggcggggagggggcgcccggcttgctctctcttcgcgtccccgagtgaccaggagggcaccggtgaacgca

SEQ ID NO: 33955 - DNA, 1153 bp, Mus musculus
aatttagaccttctagcatggtggcacagacctttaattcccgcactagggaggcagaggcaggcagatctctgagtttgaggccagcctggtctacagagtgagttccaggacatccagggtcacccagagaaatcctatctcaaaaaggccaaaaagcaaaagccactctaatgaactgtagagaggacagaaagttagtatttgtgctcttacagatttgcctgtgtgtattgtttcagtctaataaatattggatggagcacctgtgtgccagccactggacgaggccagttcaaggccaccttgaactacttagtgagttccaggacagccagggctgttacacatagaagccctgtcttgaaaaaatcaaccaaccaaccagataaataaacaaatcttaagtctattgagtaagattagtgttaagaatatattgattattattaaccaaataattactatatgtataaatacaactagtagtaattgcagagactactattaggggtatgatggtttgaataagaatgtccctcataggcttatgtatttgaccacttagtattgagttctcctatttgagaaagaataggaggtgtggccttgctggagtacgcgtgggtttgttagaggaagtatgtcactgagggtgggatttgaggtttcagaaagcccacaccaggcccaacatctttgtctatgatcaagatacagctctcaactactgctccagtgccatgcatgtcaccatgctccacgatgacaatggactaaggctctgagactacaaacaagcctccagtaaatgcttcctttataagggttgccctggtcatgttgcctcttgaaagcaacacaacagtgtaagacaatgaattatttgatgtgctgaggaccaggacagttgaaaatctgtaggcttgctctctagcatataacaaatacagttttgttttgttttttcctgtggaaaaccttaactgtggttagacatacagggcttagcagcattttgtgagatgtgacttgaaagtaaaatgtgtttacatttcttatgtagaaacctcagtgcttgtggaggttttgacgtttgtgatgacatggtggcaaaggacatcatgacgcccctggtggcactactgagaga

SEQ ID NO: 33956 - DNA, 1176 bp, Mus musculus
tataaagcttcggagaagaggagcttaggtggaaatgggaggaaacaaggcacctcctggcattgtcagagaaaattgatcagtgtcccagtgtgtaagttctataccaggaaaagtgtgtgccaagatggaatgaacaaaggcatttgggttaggatttttgaaattacaccatagcctaagccctgtggaaactgcttttccctcactgttatatgttgttcaattagttataattagtaaattagttgaattagtttcagctagtaaaaattacttgtttttactatctagtatttccttttattataccagaatcagtctgtttattacctggttgggttagaacccatttttaataaagattccataggcaatttctttgtcttcattcttattttttcccaggcaccatctggaacctaaaggacattattccatctaagagtcaggcagaaatcattaatgccatcctaggtgccttgtctgaagttctgggtatgaatactggcaacatggtcattcagatgaaggaagctgaaacccagcggctaaagactgccgcagagagtgaggacatcctagcaaatgctaacggtgatgacttggttgaagatgatgaaatggaagaaatccctcataaaagaaaactcagaaggaaaacatttatttccgatttacttccagtgagtcagatggatgttcgatctgaattaatgcattttattttttattttatgtgcattgttctttgcctgtatgtatgtctgtgttagaatgtcagatcttggaattaaatacagttgtgagctgccatatgggtgctgggaattgaatgtggccctctgaaagaaccatcagccctcttaactgttaagccatctctccagcccctcaacgtgagttaatacatcagtttccttcagcaggcttccttagcattacaaaaaaatattaggcaatttttcaattagagttgtatttttctgttgattctcattgtaacattcgaaatgtacccatgtagaagaaacgaaaaccagcatctcttgtccaaaatggaaacctttctgtgtgggagctttcagagcacttagcaatagcatcctgtcttcttgactctgaattcagttacctgtctcctcagggagtcttcacgctgaccttcctctgctt

SEQ ID NO: 33957 - DNA, 1863 bp, Mus musculus
agaacaagctggctagtgagactagccaaatcagcaagctctgggtttgattgagggatcctgcctcactgacaatggaaaagaaaaaaatggccacattctcattttcctcttcttcatgttcgatattctatttaatctggagtaaaactttgactatattctttgaaatgtcttgtttaatagtaagtgaatgactagtggataacaagttaggtgataatgttctccttctctctgaatttctctcaccagatacggaaagaagggaggggcaagtacagtccagaccagctgtgtgttctcgacaatgtgaagatgaatttgagacggtttattgcttaccaggaaactgttgagaaaagactgacttcttaaaccatcaagaggaccagagctagggctggctgagcatctgcgtgcctagctggcacaacagccctgggtctatccctagttcctgaggaaaaaggagtaagagaagctgcttctcctgatggatttagtgctgagaatactgaagggtttcccttgaatatatgtgcttccaaagcctttttttcttttttgagacaggttctctctaggtagcccctcctggcctggagctcacagaggtctacctgcctcagttttctgattgctgggctttaaggtattcaacaccacacctgacctccaaaagccttctttcactgcctctgttctccgtgttagtttgaatgtgagaacctgtaggaaatgtgtgttacatctccaacatattttagccactgaaaatgccccacatttcaggtgctagggtcggcattcagggccttgctcctgtgtcgtgagctctaccactaactccaccccagccctcaggtggttcttaatggaagggcagtaaagagacttcaaacaagtacgtccttacattttttttttttaagaaaagaaattaaatcattgttgggatgtttttttaaagccaataaatatcattttatattagctaactcctaacagaaatgtaaagataagctttataaaatatttttgtcatgaagtactatataccaatgatgaatcttttgtgaagtaaatgacttgaatttgtcactgtgtagatagtgagatgattgaattctgtataggggtctgagcagttactctgggtaacagcatttcctgtcttaatttgatacagaatcagaaattagtagaaaatgctggacatggtggtgcacacctttaatcccagatcttcagaggcagaggcaggaggatctcttgagttcaaggccaacctggactacagatggagcaccaggatagccagagagaccctgtctcaaaaaaaaaaagaaagaaagaaaagaaaagaaaagaaaagaaaaaattagtagaaaatatttttgaataaataacttttaactggatgttttgtgtcatacagattattttttatagcctaagtatccgccttcctaggcagtttgcttcgtgtcagagcttacaaaggaaagcagcatgactttcttgatgacctctccttactgtaaaaaaggagggtaccagatagggctcatgctgggactgtagtccacattgtctggggacgccctgggctgctcccgaatccatccctctgcctggccagagtgatcagaagcaagctcaaagcacaaagtaggctgtaatttcccctagatctgtagctgcatggaccacttactaggattcattcatgtgcactgtggcctagtgagcagttttccctgtgcagagcaggctgttaggaagccaggattatttatcagctctgaggagtcactgagatggtgaaagcagagatagtgaggttttctggtggggtgg

SEQ ID NO: 33958 - DNA, 1194 bp, Mus musculus
gtcctaaagcttggtgagaacagttgtcataggtgagatatggaaaaggcacataaataatgagattggaagtaaatgcgtgtatttacacactgagagccagcatgatgctctggctttatgcagcttaatagtcaggtcacatctcattgaggcagcacacgtgaagtttaataccagaaggctctaggaaaaaccaaacaaaccaaaaaaccattcactaatagaatttaatatgtttgaggttttgtttctgtcagcattatctcatgtcctggggcctgagatctgtgaaatacctgagggtatgaggttgctaaaattgacactccctgcttctcctctcctctcctctcctctcccctcctctcccctcccctcccctcccctcccctcacctcccctcccctcccctcccctctcctctgcttcccttccaaaacttaccatcagcacactgatgctctgaagcagagagggaaagggattcttgttaccctaacttaaagttggtaagcataattgtcagctacaatagagacctgattgatgcttcttgaaacctcacacgtgtccctacagtgacatcgatcttgtggtgtttgggaagtgggagaacctgcctctctggaccctggaagaagcccttcggaaacacaaagtcgctgacgaggattccgtgaaagttctagacaaagcaacggtaagttcttagcattgtgtctttgtgagccttattacctgcaggagaaacttggactctaatctcgaatagcacagttggaatgtgactcagtgaatcattttttgaatgtcacagtgactatgcataaagactgtcattggagaatcaaagtaacttgtccaggctatacatttctttaagaataatacccaatttttcatgcgtaatgaaatataaaaatagattactagctgggcattggtggcgcaggcctgtaatcccagcacttgggaggcagaggcaggtgatcttagtttgaggccagcctggtctacagtgtgagtttgtttctgttaaatagcccctagttataacaaaagatattgttctcttattttgcacttgagatcttgtcaaggccttttttttttttttaattaaaaaggatatgtttttattttgtgtgtgtgttttggggctacagcagagggctttggatcctctagagc

SEQ ID NO: 33959 - DNA, 1119 bp, Mus musculus
taaatatatatattataatatattgtgggcagtgacttaggaagacacctctcatcaactgctgtctttgatatacatgtacacacacacacaccagaaataagagtacatttaaagcagttacccatggaagctcagctataactgacacatgttctttggataagagctttagttttgcctgtttggcagtggttgccagtaaccagactgctaagtgagatgaattccctgatgtggctcacactcagccttacctacctggtctatacccatggtgcattgcatgagctttgtagcatagctgtcaactggtccaagatgatgatgatgatgatgatgatgatgatagcgagtgctcgtagaagttgggatctcacttataccccctccttcataacagagaaaatccaaaataatttcttcctttttttttttttttctgttttagttacatcccagggaagatgcttgcatccccaatacaaactatggtgttctcttaatagagttttttgaattatatggacggcacttcaattacttaaagactggcatccggataaaggatggtggttcctatgtggccaaagatgaagtacagaaaaatatgcttgatggctaccggccgtcaatgctttatatcgaagatcctttacaaccaggtactgcgattcggtgtctgtaggcttcagaggggcgtcacagtccacccatgctttactctgttcagatgaaaatgcttatttctaagtagcacttgttcagaatattcttatcatactaaaagagacacatactccagaaaaaccacctgctagacttgcacataagttgaggtagtgtccatttgactttcaaagccaagcagagaggaattcactgtggggtgggtttgcagccatctctcctcctgtgggctgccatttccagctagttgtcagcagggctttagtgaggtaagatgggggctggagagatggctcagccgttaagagcactgaatgctcttccaggggtcctgagttcaatacccagcaaccacgtggtggctcacaaccatctgtaatgggatctgatgccctcttctggtgtgtctgaagacagtggcagtgggca

SEQ ID NO: 33960 - DNA, 1165 bp, Mus musculus
agcctttattcataataaccagcagccaggtttacttgtcttcgtatccatttcttttaaaggtaatgatgttggaaggagttcctatggggccatgcaggtgaaacaggcctttgattatgcctatgtggtattgagtcatgcagtgtcaccgattgcaaagtactatcccaacaatgaaacagagaggtaaaagtctagcccaggccagcctgtgtgttgagagtggttggtacttcttatcttcaacttaatgtacacctcttttgtttttttttaacctgtgcagcatattaggtagaataattagagtgacggatgaagttgccacgtatagagattggatatcaaaacagtggggcttgcagaataggcccgagccatcatgcaacggtaagacctccttgatggtggactgggtcttagaggctttttctatgttttgtgtatttaatgggaagaaacgttttccaatcttttgccactttttcaggaaatggtgttaccttgatagtagatactcagcagttagataagtgtaataataatctgtctgaagaaaaggaagcccttggaaaatgtagaagtaacgcctcggaacctcttagtaaacactcttcaaactcttcatcaggtccagtgtcctcctcctctgccacgcagtccagctctagtgacgtcgtaagtatgacacatgctgccccagcctgctctttggagggccctcacaggcaccagggatatttccaatacctttcattcttgtactttttccctaacatttttttttaaagaaatttgaaaatctagtgaaggtagaacccgtcagtggctgtagcattccatactccattagcattgacctgcttattatattcctgacactctgtcccgtaggcagctcctcttcctctttgatctgcttcaaagatggcagatgtcacacttcaccccagcctccatagcatgcatcctggatttagatggcttgcttattctttattcctcactaagttttatgaccatgctcaggtcactcagagctctagtaagagaatgtcctctcactaacccacagtccccagtctcgcctccagagggcatccttgtccttgtaaaggattttctacatcacatattggttttccatgtcggggttcctaga

SEQ ID NO: 33961 - DNA, 9888 bp, Mus musculus
tcctccttatcatgttgtgtgagcagtaggatccttgaggaagctttcatgttgtacacatgctgtcaggaaggggagctatagagttcacccctgttagtcctcgttttctagcctctagaacagtgtgtgatagctgggtgtgatggcacacccctttaatcccagcacttgggaggggaggtaggcggatctctgagtgtttgaggccagcttgaactgcataggaaggaagggccagactggccagagtgacagtgtgggagttgtcagtgggggaccatgttaagtgcgcgcctgcccctttctagtctgggagcggccctgcatgcggtttgccagggggcagctctgctccgattctcactgctttcttcttctgcagcatggatcagcaaggctcttccgttcttccagcaaaggcttccaaggtacagctcaaaccagccatggggccttgatgacaagcaaacagcatcaaggcaaatccaatactcagtattaccatggcaaaaagaggagacacaagagggacgcgcccctctcagagctttgtagatagtcggcgctctgcgacagactgtcttctgtgtgcaatgatctcgtgctcaggacagttgcacagggactcctgggacggcaggagcctcacactgttcagacgttgatttagcaactgcgttttttcccagctcgccacggaatggatcatgaagactgacaactgcaaaaacaaaaagcaagcaaaaaaaagggggaaaggctgcttatgtgataagtcatgtgctacaacagggtcattttaagatttaaagcttgaatgtaaaataaatatatttctcattggctttatgcagagttataggggctagtgctcagtgtgggtagctgacaggaagagagcagtgtcaaggagatgggtgggcaggtcagcaggagcatctcatgggaagtcagactccgagggaaaggagtttgtgcatggttttttttaaaaaataattttgcatatatttgccattttattgtgtgtatatatagaagaccatataggaaattgatatttgtaatagtggatttgttaatactttttacataacattactatttgaattgtaaacagatttttttctcaggattagtttgaagaataattgagttgtcactcttaacacatgcagggaagtgattagctctggtcctgtctgttttcttcagcattgaaatgacttcatagaacccttgtgacctgcttcaaaattctttcctctctaagcaaaaggtttatggtggcaaatgatgtttattttattttgtaaaaaagagaaaaatgtactgtgtacttgtgtatacactgaacaacctctagctgtctctccgaatgaacacacctgctctggatccagtgctgttgtcttcctgggcactgggccgtagcaggccttgtgtgtgtttcctagcagtcttttcttcccctccctcctcttcttcctcaaaggaaacgaaaggcctccctgggcctgggctgttcctgtcacagtgtggctgacctctagctccacagcccttgttagctcgcatgctggttcctctgaccctgcgttccatgtgcttgtggcgtcctctcattctttctaggttcctgcttactgctgtgggagagagtaactgtaaacagctttaatgaaatcatacttataaaaactattttcttatactccactttatgcttttggtattgtcgatctttaaaaattaaatggtctttgataatggatcgatttttgtattgccttattaagaccaaatacttcttgtcatcccattctttatcctctcctttaatggaattgctgtctttaattaaaactttgtaaacactggcttgttttaatcatcctgtaacttaggctgtggtcagctacaagcgcagatgtgtaatcctgttactcattgccagctgagtcttgagactcgggtggggtacttaacacaatgcatcgtacacgctctgctcgctcgctcgtcagcagagtggtcttggaggtgaaagccctcgtgtctagcatcagtgtgtgtgtgtgactctgttcagtacggccgtttccgagatgggattcttttatatgtgtatgtgtgaagtactgttggcatttaggcatttcttttctatacacttaggaaatactgaagaccaatcagaccattaatggacacttagtgcaactttttataatgagaataatgctataaagtaagaccaaaaccggtgtcatcactgaaattaacaattttcaatatgttcatattttaatttacaatgggaaaaaatgtgttccacaactggaaactcacagtactgtgtaaactgtgtaagattttaaatgtgatgttattttgactgttctcaattttagagtcacattttattctgatcagaatttttatcaagatgttgaagttttgttgttttgaaactagtttgtcataacatattgtgcataatcacagtatttattttgtagggcttgtggatgtgtagacttatgtttactgctaagggaacaattatttataaaaaaaatattaaatccagtattagctgcctatttcagacacttaacacctgcagagatctgtgttacatttaccacactgaagtttttttaaagaatcaccctcattgttgaaagtaaatgtactcttaggtgggttattagtgtccaataagcatgtgattatattaaggtggtggtagcgggaagataatcttgattccattgggaatcttaggttttcgtaaatttattgggaaaatagtttttcctgtactgctgatgtttctttttggtaaacagtatctttctaaaagaaaaagcatgaaggagaattgaggtgtgtatacatttccccagatgaccagcattgtattcgtgaatactgtgtatctggaatgagcagtgtgcaagctgttcatttttcaatctgaagtaaaatactttcaagaacttttagtttgcctgctcatttgttctgtacattgtatcttttgtatctgactcccatctgtcttgaatttcaatactttgggtgaagatttttgtagctgtctttgaaacgtatcttaaccattctggttggtcctttggtacccatggatctctggtattcatgggtattcatagaggggagtttgtttataaacattgcctccttgtggtgatgtttatctggtggtcacacttgtgtatctgccctaaggagcaattaactactactatgtagccgcagtgctggcagcctggagagggagccacaggaaggaacctccatctgaaagaaagtttctctttgctggagttacagtgtgccctggatggtcgtccctactcttcagctgcttttgtttgaggattctacacttagttttcaagtctatcattctatagaatcttcaacttttaaaatcatttttaggagattacttgtatatgtgagtatctgcatggctttatgtgcaccctatatatgtgcagaagcccagagagaccaaaagaacatggtgaatgccctggagttagagtggcagctgtttgtaccaccttgtgggtgctaggagctgagcatggtttccttagtagagcagccagcactcttgaatgctgggttattactgcagccctaggtttttggccttcatgtatgccctctccggtcttcaggcagctgaccacattatatatttgtcccgtttggagaacattttagtttggattacattgggagcctctctcacagttaggttgttgaattttcccggatattcatgtataatgctcatggatcataggaaggtgatgtctctctgtgggtggagttagggtttgtctactgggaggatgttaggacaggctgttgtccagctggcctcaaacttgaggtcatcttgccccaccctccccagtgccagcactaactgtgccctgcttgtgaagggcgtctgcaatggtgtcttgcttcggaatcttcagtcacctgtgttcttctcatcccctcctgcggcagtgagtatgtatggtgtacagtggcccctgggttagtgcttgaaaggcaagagagtcagaaagaaaaggtgaaaatgggcactgtggaatcctgatgccgtggcctgtcctgtgcttgtttgagtgaccttcctgataaccagggagaggctcaaagaatgttctctggaagttaccaccgtgatgagtcctgcgttctttttttgcagtcccagagtttggctggtgagcagttaagaactgctctgttcccttcatcctatttgcttgaggttttgtattgcccagaaacaaagaatattcacagagaattggctctaatacaattaactttaagaagtaattgttaagctattagataaacccagttatcgttgatagatgctgaaatgttacttggcaatctccaagcccatgaaacagttgttgaggcgagctcatctgtgggtctctagccctagctgttctgggactcagagatccacctgcctctccttcccacgtgctaggtaaaagggcgagctacaatatctggcttgaaaccatcttaatgagaaagcagcatccgccggaagcagttagtgagccaaggcttgtgtcagggttgctctttaagctcggcctgttacagttgtaatttctatgaggtagcagttcatctagtggggtgctgagaaggtgcggggcgcctgggaacagggctccttaagagtattgtcattttgtctcttcggaacttcaagagctccagagtgatttcctgctcctgtatcaaattgcctgtaggtagaataagtggaaaagagccctctcagtatttcacatagctcagacctgggagcttctctgtggaagtcagctttaagacagtctggtcaagccgggcggtggtggtacacgcctttaatcccagcactcgggaggcagagacaggcggatttctgagttcgaggccagcctggtctacaaagtgagttccagaacagccagggctatacagagaaaccctgtctcgaaacgccaaaaaaaaaaaaaagacagtctggtcagttaaccgattgcttagtttactctaatcagaggcttgttttgagtaagtatttgacctactaaaggtttgcccttaatccctggtccaaaagaggcaaccgagagaggggcagcagagggggcctcagctggctgtcctgggagtgtgaggcctaagaatgtcctcaactttgtggggatggaacaagaaatcatgtattgtagtgaatctgtttgatagttttacatttcaattgggttcttttttttctttttttaaatagggaaatgggtttatctgtagtctgagccagactgacattcctgtcccttgtcactccctcagctgtgtgttcctgcagcgtccctgatggagagggcctctgttacggagtctcgaggaactttacattaaaagtgctttggggatggtggggctcagagtggctgttcctgggttggggtgggagcttggagaagcactacagccagtacccattggggtgtggagctcgcctcagtacccagacttgagtcatcattctcattcttggactggagcgcaaactcattttcctctttccctgggttccatgccatttacagctgtacagtttagcctcttagattttcactatgaaacttggtcgctaggtttagtctctggctttgtttgtttgtttgtttgtttgttttcgagacagggtttctctgtgtagccctggctgtcctggcactcactttgtagaccaggctggcctcgaactcagaaatccgcctgcctctgcctcccaagtgctgggattaaaggcatgcgccaccacggccggctctagtctctggcttttaagattccctgttacattacactgaggtttccaaatctttgaaagttcagcaatcctgtgactctccacacttcgcattgctagggagcgctgctgcttccatgtgtatcgttaaaggggggaaggaacagtagcgaccggtgctggttttggacacagtggggaagaccactgaggtcaacactcctctctggtagcacatcctatagacttgcttataagtcgggcgacgtccacttgcttgtgtctaaccagctctctgtttattttctttgatagcattgccttcagtgttaagcaacgcagacgctcatgaggtgctggaggtctgagccctcaactctccagtcttgtctagtttccgctgcagaggcactaaaggaatttaccagaaagagatttgatacaaatggtttatgaaatctcgacatttcctgaggccatgtgactagccaccagtgacgaaaacagtgaatttcacacccggaagcttttttttttttttttttttttttttaagctcacagtgtcttcaaagatgtcagttgtttgccttgaaagtttataaattgctcttctatgcacacacaccccatcccacggggctcattattcacagtctgcagttcaataaaggctttgtgctttcatttatcttaagaactgtgggtatgagctttgtaaaaccggaatagctacttaaagaaaacttctaaatacggcagcatttagacagtggacatttccttgctgctgacggcaaaactcctttgttcttaacaaatgctgccagggggagacattccaccacacccaggacgaagctggaaacctttgggtatttgtagtagtggcccagctctttggttgggttgggttggttttggttggttggtttgagataggaactcatgtagccctaactgattaagaacccatttcccaagtactgggatcaaaggcatgccccaccatgcccagttttatcttgctccttaaacttaacagctgtaaggaactgcattactctgctgtaggtttggtggagcaaggctcggagcagtgaggaaaagggctgtggatggggctggatgatggacgccttgtccagcatgctggaggtccagggtccgaacctcagtactactggatggagggaaggtccgaaatggtggtctgagaggcagggttattggctggttttaggattgtgcaagggagtggctaggttgtagtcctttgcctgcgaccccactgagaaagccaagctgattggtgtcaagtggccccgctgtggatagactggccaggagacgccagctgtgcctgcagactcctgctcacttcttgagagctccggagaaacaagaacgcttttcggtagtatctgaacaaattcatagtaaatgacaggatgcgctcattataacacagggtagttccaccagtctacctagacactgaatttgtgcatgtgtgctccattgtgaagaaatccaggtaaatatctaaatagttttgattttttttcctttgactcccgagtcctgcttagtcatcctagagctacattttaatactgtcagtagcctaagctaatttttgtgcatattcccatatcaacatgttggggtgtgggagtgcctctatcacagttggtcatacagtaccacagctctcctgtggtctgcacatgtgcagaagtagtccttactgtatattgtactggccggtggcagttgctttggtaaatcattgaggtaaatgccctgacactaagacaccagtggacttccatgcagtgcccagagctctcagcataccttaaacacagactttagaaagttgatagaatgacactcctgagccagggttttggtttttttcttgttttcaaaaagatttattttatgtatattagtatactgtcactctcttcagacacaccagaagagggcatcagatcccattacttgtgaaccaccatgtggttgctgggaactgaatgcaagagcagtcagtgcgcttaaccactgagccaactctccagcccttgaaccaagttttctaagaaagtaaaaatcccctttttttacccacaagatctttctatgtacactaggatgactttgaactctggtctttctgccttgtttcctcatgtcaggattataagtgtgtaccacaccggcttcaggattactttcttagccaaagttgttttgggaagtttcttgtctttgttgtttgttgttgttgttgttgttgttgtaaggccaggatcttaagtagcccagactagcttcaaacatggtatatatccaaagatgatcttgtatttttggttcccttggctgcccctcaaatgctgggatgcaccaccacatcccgataacttgttgctagtaatcaaagccaggcccttgtgcatagtaggcagacacgccacagctgagctaagtccccagcctgtcttttggttcttctccttaaatgtcacagtgcagcagagtcatcccgaacagcactccactccctttgccattttccacttttaaggaaaggagccttgctttgggcaacactggggaggggggaaggccaattctttgatcattttctaccatctgcctgttaacactccaccttttaaaccaggtggagtgtcaatcccagcactcgggagacggtggtggtgcacgcctttaatcccagcactcgggaggtagaggcaggcgaatttctgagttcgaggccagcctggtctacagagtgagtttcaggacagccaggacagccagggctatacagagaaaccctgtctcaaaaaaacaaaacaaaacaaaaaaaagcactccaccttttgttgttttgtagctctgcctgtcccagaactcaccatgtagaccaggctggctttgaacttacatttcaggtttggggtaaggaggaagggctccccaccagaacaactggatcccagttatttgaagtagacagggccagagctgctgtgtggtttttgaggctaaattggggggagggggcggggaccaaaagccatctggtggtgaggaattccacagtcttctggtgcacaacagtgtttgaaagctgttctcctcaggccacattcttgagtcttgcggcttgagtctttgctggcattccatagtgagccagtctgggttgaccagcttaactaagagatgcaagatttttggcttttaattgggaacattttgccttttaagtaaaatgttttaaattccttgtttgtctaagaagaccattttaaaaccaaggaactagggatctgaaataacccacctgtgtaaaacacacactctgtgtgtgtgtgtgtgtgtgtgtgtgtgtgtgtgtgtgtgtgtgtgtgtgtgtgtgtgtgtgtgtctgtgtctgtgtctgtgtctgtctgtgtgacttaatttcattttatattgtgtgtacatttaaagcctgtaacatttaaagcatttaaaaccttttggaagttgtgggattcagaggaactgcccaaaggatggatacaagtagatggtgccttttctttcttttgtttcttttaaaaaataaaggatgtattttcgtttttctgtgtgagctttggctggtttctgtatgtactgtgctcatgcaatgctcaccgcggccagaagagggcatcagatcccctggacctggagtgactgctgtgagccatctatcttgagttaggaatccaggtccccttcaagagctgtaagcactcttaaccgctgaggcatctcttcaacccctagaaagatgtcttaatgtttaatgttaacaataaaagagaaggaggagctgattaaaagctgaagtggcctcttgaaatggaatatccattttcagaagattgaccactcagtttcagcttcgtacctccagcttgcacttagggc

SEQ ID NO: 33962 - DNA, 1121 bp, Mus musculus
gcattctggtaaatggagttgaaaactgtgtatattggtgggtagtctcaaaacagcagagaaaatgtctgatctacacttgtcacttttttccatctctggcttatgtttgaaacggacatgtcataaacagagttttagctttaccactgactcttagatgctagacaaagatctccacctttctagtgtattttctcttgttaaccacagactacaagtaaataggtctgctgtctagtgtccgtttataggatcagattggctgcagggacagagttctaaggaatggggctcatagcagcagcaaagctttgaatttgcaatcaagcattttttgatgcaaatcttttgggacaaggctcaggaagtttaaagtctagaaatgaggtatgatgtttcagtttttctgtgtgcactttatttattttggagtcagggtcagcctagcttggtctcaaacttctaacctcctgtttcggtctccggagagtttcaattacagatgtgcacgactatctccagctgtttctgtgggaaagcctgtgtagacaggcttggacaactttgtagcacttgccttttctccagtcttctgagctgactgcagagcttcaagaacaatccacttggcaggaacatgtgttcaggactctggcctgtgaactgagcccctcaacaaatgccaaattgttcttatgcaaatgagtcaaggcaaaagccagcttcgtgagatgggtgtcttactgtgcttagctccagagcattccgagagatgaccaaacaccccactcctttttggaaatgacttcactgccacagaacgcactacatcatggtcttcttagctagcagtcaccaaggaacctccagagtctacaaatgatataagtgccgcagacagggtgctaaccagcaggtttacccgggactttagtccaaggctgagtagtcagggacgcagaggggagagataggaactgtttgcttgtgctgtctcctgtggagtttcatcagcccaggaaagaaaggctgattttagtttgcacaaaggaatctagtagtggccagggcttcccagcaaggcatctctggggagttagtaaagctcctggtgatgc

SEQ ID NO: 33963 - DNA, 1237 bp, Mus musculus
ctgtcttgaaaacaaccaaaagaaagaaaaagaaaaaaaaagatgactacaggaaccacttcgggaccttgagtgtttccccctgtttttcccagctgaacaagtgaccaataacctcaaagaactcacacagcaagtgactccaggtgatgttgtaagcatacacggagtgcgaaaagcaatggggatttctgttccttcccccatcgtgggaaacagcttcgtagatttgacaggaggtaggtgccctgtttctgtgggtgagacttttgtgaataaaagggaaatggacccttttccttaagatgacattgaacactcttgtctggtttgatttgttttatttaatttttgagattagcatacaaagtaatgggttttatcttggcatcttttagttttctttccatcttgtttaaagaatgaatagatttgatacgtttgtcaaagctgctgtgatgacttaatgccaggcttctccttggctgtgagtgtggcatgaagggctggcagcagtggttctcctggatgctagcacagtgggacgaaatgctgagtgctgtcttcttccttcagagtgtgaagaacctaaggagaccagcactgctgagtgtgggcctgacgcgagctgaactagcctggtatttgattctattatgtacatagtttttcattctgaacttggaggtgcttttcagaagatattaactatttgtaaattgtgttttaattaagctttgggacagttccttttaatgttccaaagattggccttgtattaggaaataaagctgaacctgggactgtgaggctcgctggtgtgtcagctgaattaccctttgccttgctcggccttggttctgaggatggacacctaggacacacaccagcctttctcatggtcatctttcaaaggagcagtcctcaaattaattccccaagttttcatatttaccactcttactagaacaattataagcagctagttataagctctgccctaccagagctcatctgagtgacattcagaaagtagccttatgagatggcctttcagactgccactaatgatggtctgactttttattattatttttattattatattgttgaatgtgtattatgtacatacatacatacatgcatgtagcccctcccccttttggggtttttttgtttggtttagttttgtttttttgttgtttttttgagatagggtttctctgtgtagccctga

SEQ ID NO: 33964 - DNA, 1117 bp, Mus musculus
gcaggacttggacatggtaagcacactgctcaagaaacaggcagtttataaatggctttgaagtgctagacattcactgtttgagaccagggattagccagtatgacagctgaactccattccccggaaaggacagcctgctgtgggtggagaacaatgaaaggaaagaaataagtcagctatcaggatccaagggagttagaacgtggccgttctctactaattttggtaagactcggaattcctgagctgaggatgaagctggctgacaggatggagaatgtgcatgagagccatgcactgggagtcgcagaaaggaaagccttccctgttgcatcttttatcaatatttgtgaactctctagtccagttcaagactgtttataatctagaatcattcaaatgagactagaaccaagaaatgtttcctgctgatgtagaggaattctggtgtctagaatgttctatgacaaaattagaggagtcttaagaagtcatctgttttttctttttaatttttagatttttttttatttatatgaatgtttcgcctgtctgcatgcatgtataccacacacatacctgttggatcttctggaactgcagttgcagatggttgtgagctgctgagtaagggctagtgattagacctaaggcctctgaggagcaagtgctcttaggcagccctggaagtcataactgttcatggtgaccatgaccccagtgccttagccccctgtcggtacctgcacaactggtgaaggttccctgggtgtcatagcaagcctggtcagtggcttctgcttcaaaatcctgccacacgaactacttatcaaacctaaaaagtactttttcatctgttcagaattaaatgtacttgacccttccactcagctaattagaattaatagttaactaaagtcaaattgctttgatttggtgatgatagtaacatatttaaaatatgatctttctgtcctttgaactagcagtttctcttctcaaatatatcctacaaagtaacacaagagttacacatgtaaaaaaatatatggcttacatgttttagaaattggaaatgctctaaatcagagtataaaccttcaaaaaagaaata

SEQ ID NO: 33965 - DNA, 1132 bp, Mus musculus
atttaataagaagcattttgcactctaggaagtatgtttgtgttgattttttaagaagtctaaatggatttattaatatctgacactttaagttaactgcattgatgatacgatatttttggaagcatacaattttaattgtgacgtctaaaacctcttttagtccattgaggatgtaaataaatatttcttcttatggaccagggatatgaaatcattttccttttgtagctaatgattgccttgagaaagacataatatgattttattaagagtctgcctttactccaattgttgaaggtgtgctgagtttaattgttaattttcctatatagtgctgatttcctgcatgtctgtactttgctgagtttctgtgttcctgcagcagtggtcagaacatgctgaaattcctttcatggtgttattttttatttgttctagttttgagataaatgagtgactctgtcataaaatgtccatttttgatttgttcttgaagaattagggtacaaaacaagtatcgtagtcatagtaacaactgttactgaacaggtcttctgtaggggctcctaagtatgagacaacatgcagtggtttctgaaatgactgagcgataagtaaattatatattctttttttaaaagatttattttatttatatgagtacactgtagctgtcttcagacacaccagaagagggcatcagatcttattacagatggttgtgagccaccatgtggttgctgggaattgaactcaggacctttggaagggcagtcagtgctcttaactgctgagctatctctctagccccaaattatatattcttatacagacccacagtccagagaaagtgaagctggctcagagttagcaccaacatttccctgaaaaaatgtgttaggtgtttaaaaatctcatcgtaaataaattattttatttttagtttaagtgaatttctcttaatttaaataagactaatatttttgtttgactgaagacccttgtactctctggtgtcagtttggtgtcacttgaaacaatgacaaccacgtcagcatgttactgcaatgtcagtgatggtttcaaaggagaaaatggatgtcatcttaggactgcttgtgtgtgtata

SEQ ID NO: 33966 - DNA, 1124 bp, Mus musculus
gctctgggcattggccctcttgtcaaaggtgtcagagcatggcttcctgtgaggggctttcccttgctcctgtgtgagaatctgtgcgttgtcttactggatgggggacctggatggagatgttaggggagatagcttagtcttgttctaaactctagacttgctaaaaagggttctcttgagtccaaatgcagtgccagagggtgagaagcagaattggccagtagtgaacagtggtattgtgggtgataagccctttctggtggccttaaatagcagtgctagtccttgagtgccacagggtcccctacctccgtcctggcagtgctgatgggtttgtttcagcatattttggttctcattctcatttagggaaaagggctgttgatgaagggattatcctcccaggcaccaggggcctcagcacagttccctgtgcttttaaacactgttgactttcattagttattctaaagggatttatattggagatacaactccctttggtttcatattatgaaatagctttgtactgtggaatgctaactctggaaagtctccctcataccagaaccaaacattcatttcttttatatatatatatatattatctccctggtactctccagggaggtggttattatcaagctgacccaaaggagtgcagtatgtgttctagttccttttctggtaccttgttcaacattcttttttcctgaagaacatccttttgtttatgaaaacgtgaatagcatcatgtaaaacaatcccttgctatcagaatgctccagtttggccttaattttgtaaaccttggagaggagtggagcgcggctgtgagaagagatgtaccatgtactctttctgtatcattaaagtgcagtttttatgcttctctctccttgatttcttcaggggaagggtcttggagttaggggaacacaggaactggttcttgacaacttctcaagtgcttaaatcagaaagcccctgagaaacgctagctacagttgtcttcctcaagcttccaggcccacggtgtgtctagggagtgtttcgggatctagtcattagactctgcccactctggtgctggagatggctcatggccagcagtctcgaag

SEQ ID NO: 33967 - DNA, 1725 bp, Mus musculus
ccgtccagcttttggaaccagtatacagcagcactgtccaacgggctggccatgaaggccaacgagatctctgtcattcagaacggcggcatccctccaattcctggaagcctgggcagtgggagcagctcacctatcagtgggctgactgggaacgtggaaaaactgggcaattcggaacccagtgctcctctggctggcctggagaaaatggcgagcagcgagaacggaaccaacttccgtttcacccgcttcgtggaggacagcaaagagatcgtcacaagctaaagctgccagagtgcttcctctcagaatgtcgcccgaggttgcctcctgcccctccccccgccctttaccttctggcccctgggactatgaactacactatgaagacattcttttgtatgttgttcaacctctagagttctaagaaagcttatttattagtgctataaccttgctttgcaaacagagtgcaggcattaactttggtcttctgtattttggactaaatactaatggactagagtgctcctagcttgctgtaacatttatggcaatcgcaagttgccctgctaggcggtcttaatccggcattaacttattttctatatccagtttaatatgaatctggtgttgatgcaatgcctccgtgatacgttagatctctaataaagtctgtatataaatgtacactttgatcctgctggaaaattttatcagcgaacacattgtctaatctttccaaacagatttaagggaaggactttaagtacaggctgaacatttggaaggcttagggtttgttgttgttgttgtttgtttgtttgtttgttttggttttggtttcattttgattctaaacttcaacctgctttttttttggttttgttttagagagttaaccatttccgttttgaactatttgtattgtgctttttacttgagtcgtcttcaatgttaatacgtttctgtacagtaataagcacgcagaattctttagaggaaaaaaaaaccacaagtgttgttttggtagttgaaactgagacgtagcattttggccttgtagggtatattcacagtagaaaacgtgtgctggaatttcacaatgctgctaacgatagcatcttgaacgaccttcagtggagaaatgtagatgctcttctatatacaataagaaatatcactttcattaaaatgtacatatgttccttacaagagcaaatgcctcttgatcaagagcaggtatagtgttggtttattttgtattaggtatggaaggaaaaaaatggactgttacatgcactttcttggaaagttgaaggggggggttccaatttctttaacatttaatacttactaacaacagagatactgtaattttactcaagtaatcaaatacattttttttgcaacagataaaacaacatattgtgtctgtgtttgtagagtgcatttctatttagccagggccctaaaggtagtttaacatttccctaggtagctgtaaattctgactgtgagctagtatctctaaataagaaaaaattgtaaaaggcataacagaattgggcatgcatgggcctgccttttgttttggtttgggttttttttttcatttggttttttgtttttattttgttgtttgtttttttgtttgcttgtttttgagatctggcgacctaactatttccactatatccatttcttgttttagagtgtata

SEQ ID NO: 33968 - DNA, 1632 bp, Mus musculus
gtgggaacaggttctctactaagggcaatctgaaagtccacttccagcgccacaaagagaagtacccccacatccagatgaacccctaccctgtaccggagcacttggacaatgtccccacgagcaccggcatcccctacggcatgtccatccctccagagaagccagttaccagctggctagacaccaagccagtcctgcccactctgaccacttccgtcggcctaccattgcctccaactctcccaagcctcacgcccttcatcaagacggaagagccagcccccatccctattagccattctgctgccagtccccaaggctcagtcaaaagtgactccggggcccctgatttggccacaagaaacccaagtggcgtccctgaggaagtggaagggtctgctgtgccaccctttggtggcaagggtgaagagagtaacatggcaagctccgccgtcccgacagcgggcaacagtactctgaactccccagtggctgacggtggtccaggagggaccaccttcaccaaccctctgttgcccctcatgtctgagcagttcaaggccaagtttccttttgggggactcttagattcggcccaggcctcagagacatccaagctgcagcaactggtagaaaacattgacaagaaggccacggatcccaatgagtgtatcatctgccaccgggttctcagctgtcagagcgccttgaaaatgcactaccggacacacactggggagaggcccttcaagtgtaagatctgcggccgggctttcaccacgaaagggaacctcaagacccactacagcgtccatcgggctatgcctccactcagagtccagcattcctgccccatctgtcagaagaagttcacaaacgcagtggtcctccagcagcatattcgtatgcacatgggaggccagatccccaacaccccagtccctgacaactaccctgagtccatggagtctgacacaggctcctttgatgagaaaaatttcgacgacttagacaacttctcagatgagaatatggaagagtgtcctgagggcagcatcccagacacacccaagtcagcggacgcttcccaagatagcctgtcatcttcgcctctgcccctcgagatgtcgagcatcgctgctctggaaaatcagatgaagatgatcaatgctggcctggcggagcagctgcaggccagcctgaagtctgtggagaacggatccatggaaggggatgtgctgaccaacgactcttcctcagtgggtggcgacatggagagccagagtgcaggcagcccagccatctcagagtctacctcttccatgcaggctctgtccccgtccaacagcacccaagaattccacaagtcacccggcatggaggaaaagccacagcgagtggggccaggcgagttcgccaatggtctatctcccaccccagtgaacggaggtgctttggacttgacttctagtcatgcagagaaaatcatcaaagaagattctctgggaatcctctttcctttcagagaccggggtaaatttaaaaacactgcttgcgacatttgtggcaagacctttgcttgtcagagtgccttggacattcactacagaagtcataccaaagagagac

SEQ ID NO: 33969 - DNA, 1153 bp, Mus musculus
tgactcatggcagaggtgtgatctggaggtttttttttttttttccatgttgggaacaatctaatggaggggacagatttgctaggctcaggactgtggccgctttgtggtttttctgtgtggtctgtaaatgcctttgatttcgacctgatgaaacggtcgagagcttagagtaaagctaagcctgccccagtgaattaaactgtctttgaacctctgaagcctgatgagttgatggctggtgccagctgtcagtctgtgtgaccccagcccccaccgggctccctgtagtcaggacaagcagaaggttccagttaaagttttttcactccgacgagtgtaaagcgggatatgtgttgaaaggagccaggatttggaaaaaggaagtccgcattaaaacctgtattctgccattagcaaagggattttgcctgagtgtttttcatctgctagaacagtctctgtggttctgtgtggactgaaggacttcatctgtgtacttacctgcccagcaagtgtgacatcaccaggctgtcaccccccatccccaccccaggggcaggccattggcatcgttaagtgaactgaaggcagaggaaggaagggggatctacttgtgcacaccacgaaggcttacatttggaagatctttaaaggcctgggttgttaaatgtttgggcctcaaagtggagctactgggaggtggtgggacctttaagaggtggggcctaggggaaaatgtacaggccagtggtgcatggtcttaaaggggcataagtcaggtctggcttgttccattctttctggctatgaagccggcagtttgctttgcacatgccccactatggcacctgacagaccagtgagcaagggtctagtgagaagacttagtggctaagagtagttactatttatgtcgagggaacctgagttcagttgccagagcccacactgaatagcatataactgccgctaactccagggaatccaacctttcctggtctcctaaggcacttgtatatgctccctctccctccttccccaaaccctaaaataaatctttttttttttttttaaagaagcccaaataaactctttcactagcaagtttattttcccaggtattgctatggtgagcggaagctgtcacatg

SEQ ID NO: 33970 - DNA, 1139 bp, Mus musculus
ctattcaggttcaagatagacaaaatgctgaaggtttgaacttcggtaaacctacctctctatgttcgttcaaagctgcttagtgttttcaaatccagtgtgggtgagacttaccatgcatcctttagtggaccaaaatctcctgaatttgaggttccatataggaacactgtcaacctggtttgtacataaccagaatcggttgcggtatacatgatgaactggttaattttttaattaaaatgttatatacatctctttatgggagagggggtatgtgatggtcagagaacaacttgcagaattcagttctgtcttttcaacatgtggattctggtggccaaagtagggcctcaagcactcttgccaactgagtcaacacggaagccaatattttaaagggtcttccccatgctaaccaggcactaccgagagctacatcttctacctaagcaatctcattctttaaatgagagaactcatgacctccagaatagatggttctcctagctgagatactgatggagctgggagaaaaaggtgccagaaaggttacaattacagctgtgcttactctaaaggatacttagtaacgagaacctcactgaaggagaattaagatgcgcagtcacgcccttggaactctcaactccctacattgcttatttgtattgtgttctattttgcgaacttaatttgagtcaaatttaaggccagtaccatttatctggcattgcaaaagttactccatatagatgaaaattttcagctacttgaaaaggaaaactttccttcccatgatctgatggaaaactcatggtctcttgaacacagctttctggtaattatgtatagctagtaattaagaaacatcaataattatcaacattactgtgctcacaatctgtgagtgccctcaaaaatgtgtagaatttattcccgtaataaaagcccccacgatccctatggctgtttttctatgtctccatcacagtaaggctgacactttgcaatgctttttaccaaacaagttccttttggtgttttttggttttgctttttttttttttttttaatttacttttttggtgttttgatgatatgtgaacttaaagttcaaatttaaaaaaaactcacta

SEQ ID NO: 33971 - DNA, 2438 bp, Mus musculus
tctcaaacacacaccattttggagggcagtgcctagataacctactcactgcatggaggtgctgggactgtgagacattttaccctggagtgtgacatatatatatatatattttttttccaagtaaagggatgtgcacttttacctgtaaatgaatagttgtgccccccacaggagcctgttttgttctgtacagaatattaataacctgtttgcaatgacttgtcacacacaaactactctgtgtacgttttcttgataaaggcttagtgaatacttactactaagtttaaaatacttttgttgttattttcctaggattctgatgcttcatgacatgccatcatgtagagcaataatgaacactggcctattttggactagccgacaaccctcagaaatgataccgtaataacctaccgcagggaagctgagcatactctatttggagtggacaactcaaattgtcacgggagtttcaaaatgacagacccaatgatggacttttttgatgatgctaatctctttggcgagactttagaaggcttgtcggatgatacatttgtacagcccggacctgtctcactggttgatgaactgaacttgggtgcagagtttgagcctttgcacatagactcactaaaccatgttcaaggtactccaacacaccagaagatggcagattttgaacagttaagtcagtttgactcgatgaagtttcatccagttaaccaatctttcggcagcccagttgaacacgtgttatctccacactctcaatttaattgctctccaattcatcccccaaaccagcccaatggcttgtttcaagatgtagcagatggcagtccaatgtggggtcaccagacagctactggcctcgctaatcaaaatggatccccctttcaccaaccaggacattcacactctctgcatcaaaacaaaagctttgtggcgcaccctgactttgccttatttcaggccagtgaacatcaaacacagtgttcttcccttcactcacaacaaagcagaagtaaccttaacccagggcaaaactctcttggccaggctaaaaattttctagacgctaatgtttccggcgcacacagagttaacgttaaccacctcgccactgccccctcctcacagcagactcttccagtgcagttttctccgactgcaaaccctcctgcacacttcctcaagtgcagcagtcaccaggaaggcaactataacagaccttctccaagtatgacttcctgctccgtgagtaactcgcaacagttcccttcacactattccttctccagtggtcacgtgtcaccaagcagtctcctgcagtcatctgcaggtctcgctcccggtcatacaaatcaggctttatctgattttgctggaagtaactccttttctcctcataggggaatgaagcaagaacccactcagcatctcctgaaccccactccatcactgaattcaaataattttcaaattttgcattcgtcacatcctcagggtaattatagcaactcaaaattatcgcccgtgcacatgaacttcccagatcctgttgacgcaggacctccagtgggtcatttcaatgaccacgcggaaactaatggtttctcatctttagaagagaatttacttcatcacgtagactctcatgcagaaccatttgcaggacttgaccctgaagacctcctgcaggagggtctcctcccccaatttgacgaatcaccatttggacaagataattcaaatcatgttttagatcatgacctggatcgccagttcacttcgcatcttgtatcgaggccttctgacatggctcaaactcagctgcaatatcaggctcggggctggccttccccactgtctaccaaccatcaacatttacatagcagaaatcatctatgtttacagcggcaggtatgtagccctctgtttttactttggcagtgcaagtgtgggtcagctactatgcagttcattttaaatgagacctttcaagagttcttaaagatcaaagttgtactgagcgtgcctatttcgacaggtttgtcttgctgttgactcttactgaaaagcaattctttttattttggagctgtgagatttaatatgtcttactgcttttgtgtttactttattataagactgtcttgttaaaattaaaccttagtatcaataagtaagtaggaaacaacagtttggagatattttagtatgactctgataggcatagaattgatgtacaagcccaaacagacttatcagtaacctaacatctccttgatccctgggtaaagtacacaggaggaaactcagaaaacaggtcctatggagctcacctctgtgggcttatcacctctgtgctcttggctttcagctgcctgaggcagggttgcaagtttaggttggtttgggtactttag

SEQ ID NO: 33972 - DNA, 1149 bp, Mus musculus
tctacagtggcacattttgcaggactacttatttatgtctttgcatgtctgtgtctctaatagacacacacccctggacggcagagaccatgctctgtttcttttgtatcccatcttctcacactgtcctgagataatggaagggatttaataaatgcttcctgaatattcgacattccttattctggccttttcactcttaaaatcagacacttacaaggcagtatcttcatttgaagctataaaaatctttagtgttcctttactggattatagtaaaataatttgagcttactctgcatttcaacaactttttatgtttttataaatgaaagttttttcattggatctttgcttatttatggatatttatcttttaaaactagtattctgaaaagcccgatgtgtgtatggataatatatttatttatttcagacgaaactgcattttagcagatgaaatgggtcttggcaaaaccattcagtcgattacattcctctacgaaatcctgctgacgggtataagaggacctttcctgattattgcaccgctttctaccattgcaaactgggaaagagaattccgaacatggactgatattaatgttgtcgtttatcacgggagcctgattagcagacagatgatacagcaatatgagatgtacttcagggactctcaggtgtgctgttactgattttgtttcctttttaaagactatggctgaatgcgactgtgttacatgtcaacaatttgcaattttttattcagattttaattacatacttgaggctcatttgtatttatattgtgctaagatttagtagctgaaaagcagcaactagagccagtttaacatttctagtttactatagcacagaatattgattataaaaatgtgtaagtttagtatagtctatggttcctaactaaatttatttatattaattaattaattaattaattaattaattaattaattaattaattaattttgagacagggtttctctatgtagccctggctgtcctggaactcactctgtttggcctcaaacttagaaatctacctgcctctgcctttcaagcgctgggattaaaggcgtgtgccaccactgcctggcctatttttattttttaacttctcttaaa

SEQ ID NO: 33973 - DNA, 1162 bp, Mus musculus
ggtgacaccacactgagcacctacactttttatgtaggtgctgggaattgagcagaggttctttctgaagcttacagaaacagccctctaccaaccaagttccccttccagcctcataggcagtgttattgaacagctatataatatatttctagtaatgaatgttttaagtgtctgtgtatgtaaaaatatcaatgaaaaatagcttataacccgttctatttttatgccataataaaaaaagtggacttaagccgggcgtggtggcgcacgcctttgatcccagcactcgggaggcagaggcaggcggatttctgagttcgaggccagcctggtctacaaagtgagctccaggacagccagggctatagagagaaaccctgtctcaaaaaaacaaaacaaaaaaaaaagtggacttaaggcattctcactgcattgtttggtaccttctaggggcgcatcatccgaggagcgtaccggttccaagccatcatcactacctttgaaatgattcttgggggctgtggagaacttaatgcaattgactggcgatgtgtgattattgatgaagcacacaggttaaaaaataaaaattgtaaactcctggagggtttgaaactcatgaatctggtaagtaacttaaagtatcattttgacttagttttctagctaggtagaaaaggacatggcgattcaaaactaatgctaaaatgttgttttgaatttttatagaactggtattttaaatgctatcttgctaattgagatattttgcttatttggccttaattagcatttgttgtaaagctgtaccactttctaagataagatttaattatttataaaattaaaagaagagggcctgagagatgctgcaacaggtaagaaagagcactctgctcttgcagaggagctgttcggttagcagctcccacatgggctcacagccatcaccaactctagttcgggggcctcctacctcctattgtagcctctgtagtactagagctgcatttggtacacatacactcaggcaaatgctcacacataaagtcaaaatcaatacaggagacctgtagatatgaaccattgaaaagaaaataaggccacaacatttcaaaccttaaattcctttataaaaagccatttctcatgctacatc

SEQ ID NO: 33974 - DNA, 1210 bp, Mus musculus
ttttaaatggttgctttgtataaggactgtagagacttgtacaagactccagcgtgtcctctgcagacactgctgtagtaactgagaggattcatgggggacactcacagcttcctgtgtagtcctgtcaaagttatcattaagtgacatcagcagcctagggatgtgagtggtgtctcattttgcagattttctattttgtttgtttttgcagcagtgtaaatcaaatcggtgtttctgtccacacaaatcagtgtgcaagtgttcgaccctcgtgcctcagtccccaggttccaaaatggggttttagcaatagaaatatgcacatctaggaatgcagacatttgtatctttatgttaccatgagtttcaaatgtagaaaatatttatgatgctgttgctttttaattttatagcaatacagggatgctgactttgccatatcttctttttcactatactcaacatttaaacttcctgcttttcatttaaatagatatttatatgagcgaattgatggtagagtcagaggaaatcttcgacaagcagccatagatcgatttagtaaacctgattcagatcgattcgttttcctcctgtgtacccgagctggtggtctgggcatcaacctaactgcagcagatacatgcattatttttgattctgattggaatcctcaaaatgacctccaggtaataaatttcttggttaacaaggaaggtaatttttttaaaaatccatgttactttttttttggtgatcctcatatttttatatagacagatcaatgtgtttctctaagaaacacctgtgtataatgaaattattttaattgtcatttaatgataataaaatacaccttttagtgttccttactaacttatgaaaatatgtaataattaaatacagtatttgtcttctttaaaatatggggtaggccatgtgtgagtgtgcatgcttcttaacccagctcttctgaggttgaagcagggagatttctgagcttgaggctggcttgatctatatagccaattccaggccagtcaaagccatggagtgagactttgcctcaaaataaaacaaaacaaaacaaaaaaaaccctaaatcccacagtaatataataaaataatacacgggggaaagtaaaatatgggcatgatcccctagctcagtgaaaggattccctctaagagtgatgtcctaggcttg

SEQ ID NO: 33975 - DNA, 1110 bp, Mus musculus
tcctttttgtttgtttctttgagacagggtctttctacacaactctggctgacctggaacttactaactagctcaggctgacctaaaacagagaaatctgcctgcctctgccttctgagtgctgagattaaagacatgagacatcacaccaggttaattctaccataatttcttaatgctcctgtagtattttagaaattatgcctttgtctcatgcagtttcctgctttaaaaaaaagataatatccttgtttattgcaagctttcaagttaacccacaatagtaacttgcttatttttgctcctaaactctagcccatgttggcattaaaaaccttttgccttaacaaatgatgttgtctttcaggtcactgtattggagcacggcttaagtacttgtacatatgccagattcagattctgtgaacagtaaatgaaaagagagaatcgcttatttacaaatgttttactttttcaatgtctaagtatttttacaacttctttctatatttcaggcaagttttgtagcatctgggaaccggacagatatttccttagatgatcccaacttctggcaaaaatgggctaaaaaagcagaactagatatagacaccatcagtggcagagtaagtatttatgaaggcgacatcaggctggttactgtgtgtagcagatgtacatatgagtttgcatttctgtcatttggaaagtcaaccaaacgttaaaagatgctgagaaaaatgcaccttaaaattattcaaacacaaatcatttaaaaagaaaaaaaagaaacatgggggaaatttgacaattctttcttacaaatttcaattactacatgtagaagatatgagggaaatgtaaagtcacccctaatccacgatgataataattatagcaggtaaatcctttaaggaatttaaaaattaatgggttgtttagaaaaaaaatgggaccggcgaaatggctcagtgtttgagaacactggctgctctcccaaaggtcctgagttcaattcccagtaagcacatagtggttcacaaccatctacaatgggattagactcctcctcctggcatcatgcaggtgtacatgcagacatagcactca

SEQ ID NO: 33976 - DNA, 1190 bp, Mus musculus
ggttttgagagttgtggttgatttcgttttctggaaagctgatcaagtgtggcgcatgtggtcaacctgaacagtgatggtcttttattctttgaagaaattcatataaaactctcaaggacataaagatgaccttagctgtcttaaggctaaaccattccctgttattaataaagcaaattctggagagcaagagaacaaatacatgtctcatatctagtgaaccaacagtaacggagggggtagcttacagcatcagaggacaccaaagtgagtattgtctctatttgtgaaattgacttaatttttataaagccatcttgaattgtgtttgagttgtaattgtcttagcactattacggttaatgtactaaagacccctgtgttacctacagagactccagaaagtctccagcaaccttctgcattcgaaacatctttcaaataatagctttttataacaaggtatttctgatttcaattgtacttttcatctttacaggcctctccgctcctgtgcccaggggccgaaaggggaagaaagtaaagactcagacaagctcctttgatatccagaaagcagagtggctgcggaaatataacccagagcagctcctgcaagacgagggctacaagaaacatgtaaagcaccactgcaacaagtaggtcgtggggggcagctttgagacactcatgttcctgcgtgtgccggtgctaaccgagtctagtgagagcacagtctaagcttttacctccatgtggtgtcttcacgtagtcatgaaatgtcttatgtagttctatcagcaataaaattaatctccagataaacttgtcccttcctgggcatttaataatgaccattgtaaagatcttttagtatcttctgtgtagcatcagtgatggcagtcacttgatcatacttaatcattattattaaaagactctgtatgagcaaggggtagtgcacacacctgttctctgtctgctggggaaggcaatggcaggagacgtcacccatgagttcatagtttcagaccagacaaagctgcatagcaaatcctctcaaacaagcagacagacaaaacacaccagaaagttaacaaaagtctatagataatcccccaccttgactggtttttccctttagtgacttaacatctttgtgtctcctgtagttggttggttggttg

SEQ ID NO: 33977 - DNA, 1147 bp, Mus musculus
gtgggtgatgggaaccaaacctaggtcttcagcaaggtcagcggtgctctcagttgttgaaccatctccagctctggtttcattgttgttgctgtggcatttttttttaagatttgattttttaatgatgtgtgttcacatgcgtccaatgcacaagtcattaaaaagagaatgttggatcacctggagctgaaattaaaggctgtggttagcagcgtaacatgggtcctgggaactgaacctgggtcttttacatgcgcaggaactctctgaaccactgggccctccctctatttttctttgtaacagatacattaaaaaatttgtgatattgtttgaccgtgtaatatttagtgactatttcaagacagcatatttagcatgtattacttaaatataatgttcctttaatcccagaatatcagtattgtgcatataaggaacccttgtgttttcacaacttttttctgtcctctgaatcattataactggcggtccttccaggttatgaaaagtacaacacgatcagagcagacccagctttgtgcttcttggaaagagtgggcaagcctgacgacaaggctgtcgctgctgagcagagagccaatgactacatggatgggtatgtgtgggtcacacttggctccatgggcttgctttccctgtctgtggggttcatctttgtctttagatttgtttactgtttgttttatgcaattttcctgcatgtatgtatagataacatttgcatgcctagtgctcctaaagtcagaaaagggctttggatctcctgggactggagttatagagagttgagaaccagttttgtgggtgtcacgaatcaaacctgggttccctacaagagcagcaagtgctctaatccactaaacttactttacaactcaaggtttatctgtgttggggggggatggggggtgttagcaagaccacgtgcattgagtgcataggacgactgcaggtgttattttcagctcttgccaaccttttttttttgggagagagaggccttttttcagggagtgggcaaatctggtaaatgaacaagctccaggaaccccccatctgtaccttcctaccattgggctcataagtgtgtaccaaatcgcactactttttctgcagtgct

SEQ ID NO: 33978 - DNA, 1156 bp, Mus musculus
gggggtgagatgtgtgtgcatcggagaacagcttgcgaaagcctcttttcatttttcaccatctgcatcctatagcagacttggtggcaaacagtgctttatctactgagccatcttgctggcacattgattattttcttgatcactaaagtctgtctttctgccctcctaaaattctttctatagcacatacaataatagcatttcatactgcaaatctgtttaaaaacactttatcattttctttaaggacagggtcatataattttgtattctgtgcatattttcttatttagtaaacatgcagaagccagttggcagtgactgaaggcacagacagtatatatcaattaagttatggatggataagtcaactagaattttaaaattatttcaaggatcaaatctggctttgatcctgtaagtcattcagtactataagcattttaaattatgttacagccattattttcaccattaataaatattttagtgatgtgtgcatgtattttttaatctcaatctgattcattatagatggacaaggagagaagaagctgacttttatcgagttgtgtctacatttggagtagtttttgacccagacagagggcagtttgattggacaaaattcagagctctggctaggctacacaagaaaactgataacagcttggagaagtatttgtgtgcattcatgtccatgtgccggagggtttgccgtcttccttccaaagaaggtatgtgtaaggtttcccctgtagaaatcaaagaaacaataataatacatttaagaaattctaactttttagaactgtaaataaattatactgatagactcctgtcccttggccctattgctgcagtgagataaagagtaaagacacccaccaaagattaagaaaacaacttgtttaattctagcatcaggaggcagaggcaggtgatctttgagttcaaggccagtttggtctacatagtaagtttcaggcccgtcagggctatggagaagaggccctgtctctaacaaaaaccaaaaagaaagtgaattgtactgtttcaagaaaacactactcccttgtagccatccactgcctctggctcttacagtctttcaagtctctaaatcgttacagcatgtaaccccaactcggag

SEQ ID NO: 33979 - DNA, 1707 bp, Mus musculus
aacctaagttaccttatgcgttatgaaatttgcataaggtaacaggttacaaagacattttgtttctaataaacagatttcatttgtttattgggtatcactagatgtatttacaagtaaggttagaaaagttcttaaaaacaaattcctatttatggcaatatacttctgaaatgatcatgttactcattttaaaatatagatattttgtctcatgattttagtaattttaaaaacaatttctacatttacggtcctagaaattatagtgatactgtgtagaggcttttaaagttatcgcgtgttaaatcttccataaagcatttttgagattaacattttggtccttgtttcaatatagaattggtcgatccaaatatttttattcaaccaatcacagaggaacgtgcttctagaactttatatcgcattgaacttctaagaaaagtacgggagcaggcccttcgtcacccacagttgtttgaacgcttgaagctttgccatccaaatccagacttacctatctggtgggagtgtggctctcatgatagggatttgctcattggtgctgccaaacatggggtcagccggaccgactaccacattctccgtgatcctgaactctcgtttatggcagctcagaggaactacaatcagagtaaggcggctcactcaaggacttctgccccacttttacagcaataccaagtagcactttctgcttctcctcttacctctttgcctagactgctaggtgctaaaggtactcttctagaggatatgaaagttaagagtgaaagcctcacagaagagccccagtcctctgaagaagaatctatgtcttctatggaaacaaggacacgagttaaatctgagcctgtaagtccaaagaacggtgttttatcacaggctactggagaccagaagtctggtgggaaaagtgaaacagacagacgcatggttgcagccagaacagagcccctaactccaaacccagcttctaagaaaccgagagtccacaaaagaggatcccagtccagctctgattctgactctgactctgcgcgctcatcgtgttcttccagatcctcttcctcctcctcctcctcctcctcctgctcacactctcggtcaggctctagctcttcgtcatcctcatcttgttcttcggcatcttcctcctcctcctcatcttcctcctcctcctcctcatcttcttcatcatcatcagaagaaagtgacagtgaagaagatgtccagaagcgaggtacatgcacacatttgttatctttatgaccgcttttcaagtgaaaatgtagagaacttgatttacataactgaagcatgcttaactttgtaagcttaaactttatgcttataaattgtcttagaaaagcataattgaggaggaaactggagttccttacataatcctgttctgtagattagttgaacaggggagtctgaagttttgcgtaacggcttgccttctttatgactgccttaaatttgctgctttccccagaacaagtttattatgagcaaataatgtttacagcaaccaccaggaaccttagattaaatagacaaacaagagtaccatactccatactgccgcctacagtctgtagaaggacgcacaggaagagcttacgcccctcagcagagtagcctcaggtggcttttttctggggtgcctttgcaaca

SEQ ID NO: 33980 - DNA, 1203 bp, Mus musculus
atgaggttgagaatttagaaatggacgagcctgttctctttctatattcctacgtgttacttttgtaccctgcatctgtaaaggcagctccactaatagagcaccgtgctaacatgcacagagcctcaggtttaaccaaccattgtggttcacatttatattccatttctataattcaagcaagtgggaggtcccttggactgtttagtgacttcaaggacagcctacaatgcgtaagacttcgttgaaggaataaaatattaaaatagtaaatatatctttgtggtataatgcttttgaacttcaccaaagggaatttgtacttaaataatgtacagaattataatacatatgagaatatataagcatactacacacactgttatacctggcttaaaccatcaaagctcttaggttatttggtctgcaaaggtctggcctaagtactaaagagtaccttgatgttccctgcttttctaggaccgggtaatgatcaaccgcctggacagtatttgtcagacagttctgaaagggaagtggccgtcagctagaagacattatgatgctaacacggtggcgtccttctataccaccaaactgctggatagccccggagcagctacagaacgcggcgagcccagcgtccccacacccccagccgttgctgtcagagaagagcacgagcagtcagcacagatgtcaaaggtgaagaagcatgtacgagaaaaggagtttacagtgaaaatcaaagacgtatgtgcatttttattgccctagggcctggttgcgattgcggtgtgcagcatgcttttctgcagtggctgcctgctctcactcttccttccttccttccttcctcccttccttcacatccttgtctcagggtactgcagtgcttccttcctgtagctaggctgttcagggtgagcatcccattaaagcgctcatcactaagtaggcctctctcctgagaatggttctgcacaaggtgtttcctgaagcgtgtgactatttctgttctggcattttaaaatatttatgtggtatatcaatgtacgtactttctcaaacacttaatgtgtcccattattaggaatgcttttttaatatgatctttgaagtttaattatttgttatcaaaaatatgggtgagctttagtgtggaagacagacatgtaacactggccctttaaggctaggaag

SEQ ID NO: 33981 - DNA, 1151 bp, Mus musculus
attttattttcactggcatcagtttggtcttctgtggattcattaaccattctgtgtaattttctacttactgaccctgcagttgaaaggctggggatataacttggtggctaaagcatttgccatgtgagcctgaagatcggcctcagggtgctcagtacttcataagggctgtaatcccagtgcttgttagccagcaacagggcatccttggggcaagctggcgagctagacgagccagatcaatgaggtctagattcagtgagagaccctgcctcattaaataaagtggagaagtggagagcaattgaggaagacacccaatgacaggcaatttctgtccttcaaatatacatgcagatgtttgtgcacacgagtgcactcatatctaccatacacacacacacacacacacacacacactcatacgctcccctgacccctgcaagaacatcccgtgtgagtgtttctattcgtgaagtatccgtctcccaaatcattcttcttaacgtgttagctctatggttaaagagctctctttcgcactaaaatatgaggacaaatggagaccagctgtgggctctcttgcccacccaacgtgagtttactgttctcatccttaacccgaaagcttctctagaagatacagtcagtataaatgaggtcgtgtgaagggttcagtggctttgcagctgaagattgtccagttgtcacctataagtaattctttgatgaataatactacacatagtgtacagtaactacatataaaatactgtatgttatatagcaatgtagtttatgtagctgttactattatgcttctttattataccagtgctttttatattaacaatataaatataagggctgaaggggtggatcagtggataagaatggatacagctcttgcagaggacctgggttcagttcctagcacccacttcaggcagccacagatgtctcacctctagccccaaggcttcagtgccctcctccgaactccacaagcacctgcacttatgtatacacatacacacatacataatttcaaattaataaaatcttaagcaatataacaacagtgatatgcatattatgtgataccaattataacgctagttttaaaactacataaaactatgttaaag

SEQ ID NO: 33982 - DNA, 1097 bp, Mus musculus
ttatagtacactttgataattataaatgtgaaatctggatctgccttccttcttgggcttgtcagaaattagttaccattaacatttctgagccttgtcattgtgtgtgagatgaagtgagaggagcaggatgtgacacctctgtgaggagttaaataaaacaggatgccgagtggccagtaaagagttgactacatgtgaggtaaggtgattcacaccagaatcccagaacacagatggagaaagcaggaggattgggatgggagccagtgggagccaccgagtgacagagatctagattaccagtccccaagtctttaaactgagaaacgggcatgtttttaatccaagaacttcttagtttgatgtataaaagaactaacttcaaatccatttagagaagttgtgttgtttaagttttcagccactgttttgcatttctaattgattaggtacttccattcagccaaccctcggtgccaacggagcgatactcgacagccagcctatagtgaagaaaaggcggggaaggaggaggaatgtagaaggtgctgacatcctctttttgaacagaaataagccacctaatcatgtaagtaaatctattgtaaagttatttaaccttaagcctgaaattcaatcttaataagtacacacttattgttttatatttttaataaaataaataataaggaaattagtcttccatactcttaaattggatcttaataatatttggcactggcagagagagttataaaaactttaacttaaaaaggcttggcaggggctggcgagatggctcagtggttaagagcacagactgctcttctgaaggtcccaggttcaaattccagcaaccacatggtggctcacaaccatccataacaaaatccgatgccctcttcaggagtatctgaggatagctacagtgtacttacatataattaattaattaatttttaaaaaagaggcttggcagaattttatacaatgctttcttcttcttcaaaaagaaagtgactgttgaatctggacatgagagagtacttgtgtgaccccggtatgcaggaggcagaggcacaaggatcactgcc

SEQ ID NO: 33983 - DNA, 1163 bp, Mus musculus
gagagtgtcatccctgaccacgaatctcatacccaaggagctacagcatgaactatggaggatgctgcttgttgcttcagtccttgcttactaacttacttggaggctcatgctcggccagctttttctatagttcagggtctcctggctagggagtagtcccacctacagtgggcaaggcacatctacgttaattagcaatcaagacggtccttccatggacatgccctttaagtcagtctgatctaggcagttcttcaataaagtttccaattctaggttgcatctgccaagttggcagttacaaataaccagaggacaaaagctaatgtgtttatttagtatttcggtagcccagttagattggagtgaccctttttaaatataattacgcatattgttgcagattgctcaaaaatacatattttaaagaaattctatatcagaaatcaaataaacaacttcatacttaatagtgttaacggtctaactacctttgtttgtttgcttacaggttggaggcgcatttgctcctcctttgaaagacttatgtagattcctgaaagaaaattcagaatatggagtggctcctgaatggggagatgttgttaaacagtctgtgagtatctcacaaatacgtcatgttagagagtaaaccatttgattctgccttagattaagctctcttgccaggataagaattccatgaacaccgacaatagctttcagttctcagtcttgatttttcagagtgtgtaattgatgataggatagcattcagaccaggaatgcttccctttttattgcaaacattgtttggatactgctacaaagaataatcaaataggtatgcaaagaaactcatataaaaatagtcaccatggaagggtctctgtagatagctcagactggctttgaactccaattctgcctcagctccctgtgcactggagttatactactttggtaactttctatatattggaattctgtacaactatttaaaaatgatgtcttagaaaattatctggaatcaagaggaaaaatgttggcaacacacaagtatcttcgtagttcagatcttgggctgttagagcctaactacataataaatattctaaatatttattatttctataggtagtcaaatggaaaaggcaagt

SEQ ID NO: 33984 - DNA, 1684 bp, Mus musculus
acaattagaacagacttagacattctaaggagaggtaaatcttagcattttcctcgtgtctcaatcatgctaaagtttgcaaggtggtaaatttgggaggagtaccccagttctttcctatgggaaaactgacttccagtatgtttcaacagagctgttgttgtcctggactaagcgattgtactgggtttcccaagacctttaccagtaaattatgtttctgtatgtaaaaacgtaacccattattagacaatgttatatgtatttaccaaattatgtaagttccattgggattgtattattaatttttgtattttctcaaaatagtactttgaattgatagttctttatgcaatgtcttagcaatagtcactgtaatgcccatccaggagcagtgggtagtaatccttcatcatgaaaatgatatactacatatttactgtgttccctttgcagtattgcacttttgtttaactagaacatacctgtgagatagccaaagtttttcagaccgttaccttggtttgcagtggagtgtttcaataccacccgcagcccactcttcctctaggcctgcccataggacctttattcctctttcccaattaaaagaaaatgaggttaaaaagaaaaccttagatcttgtcattaaaatctaatttatagcaaaatctatgagataaagtattttcctaattatggtctaataaatttggataacatcctagtgattctttctatatataagttagttaccgttttcaaagcataaggctaatattaactttaaacattctcttgggtttcaagacatgcctttgtagattgattgggggaaggtggtccaggaatcagctaagaaaaccatgcagatctggaaatacaaagttaagggttataggaagcaagtcaatgcagtcccacttactcaagctgcagctgaaaggctatcccagtacgtgttggtagttcctgagagagttatagctggtgttgccttgtggtctaccccttgtttcaggcctcatgactcagtcttagtccaagttttcttttggacatttgcaatatttaccagttgtgttttgtgtagtctaaatttgctttctgtagttgagcaaacgtcttaaaaagtcatttgtaatttattaaattactttctatgatgttctatagagcaaatggaagtttaattattttttattaaacatattctttgactacccatgatgtcagcctccctccgtacctgacactactttttcacttgagtcttaatataatttatctcactcaagttataaaggaaaccatagctataaatcttcaacagcactgcgtactttagaagaaatgcggatgttggtcttggtgtagtttttcactgggtatttgtcacctaggctggcctcaaactcggggctcagtgatacttaagggattgaagttttctatatttatatataattgccttttaaatgccaggtttttgttttcagttcattgatggttcactgatattgatgtctgcataaataggaaatagctcttttggagtgttgactattaaagcccatatagatatgccttatagataaagcagcctccaccttatgccaagcactgtgtttcctttcttccccttcggtccctaaaacttccaagacgactaaaaagacaagcc

SEQ ID NO: 33985 - DNA, 1124 bp, Mus musculus
ctgtataattttttaagtgttgttttttttgttttgttttgttttttaatttgaacgtaaggctcatttgcagaacagagttctgatgtttttcagatattcccccaagcttttatttttccaacagcctttagtcacattactaattcaattgataatttatatagttctttctctatgtgaggcaggatgttacagctcagtcggtcctcctgagcatgggttacaggttgaggaagcgtgtccctttctgtttgtcctggggatgttgcatatccatctctgacttcatctctcttcatcttttgaggcatatgtaaattagttacacatgcccaccatgtgctgagcagactaacatttctgtttccgtgtactgtatgttggcgagttggtgctgaccattgtctccatcttgtgattttatacaccacaggcctgtccgaggactgtcaccccaaggactctaaagcgtcctccgacccgccgtgtgtcattgagaagctgtgctccttacacgacggtctagtgttggaggccaaggggataaaggaacacttctggaaaccctatattaggaaactgtttgagaaaaaggttcgtaagtaatgacatacggacgttttctgggtaaagactcggtcgcacgtaacccaagaacctttcttttcatcgtagcttctcaaggggaaggaagaaaatcttactggcttcctggagcccggaaactttggagagagtttgtgagtacttacgctgcacacctgctaggatggtttggttgcttgcttgctttctggggttttttttttgtttttgtttgtttggttttggttttggtttttggttttttggttttttggttttgttttgttttttggtttttgtttttgttttgaggcagggtttctatttgtagccttggctattctggaatttgttctgtagaccaggctggcctccaactcagagattccccctgcctctgcctccccatgcccggcttgctctgatactttaacttagctgtgaggagacctcgcgctcagtgtttgtactgtttgtacgttggatggttttaatgctttatggtagaactcatagaagccatcacagttctggaa

SEQ ID NO: 33986 - DNA, 1928 bp, Mus musculus
gcctttgagaggcacaggcaggcccgcatttaaggctaagcctggtctaaagggcaagttccaggacagccagggctacacagagaaaccctaaaaattgtttcttaagttttattagaattaccttagttattgaaaaatgaatgctgtacatgtttagaaaactataaactttttaatcttttttgccctttaagcttttctccgtggaacccttctgtacatgatgaggccagagaaaagatgctgactcagaaggtaagtacatggccgcctttgacagggctgccctggaggccaccgtccatacagcttggggaaaccagtcatggctctcagcttgctcatcagtccttttttttttttttttttttaatgtctgtttttgattgtgcccagaagaagcctgatgaacagcacaataaaagtgttcatgttgctggcctgtcatgggtaaagcctggctcagtacaacctttcagtaaagaagagaaaacagtagcaacctaagagatggtggatctggtgcaccgtgcactttcctgctggactctggcctagttaaagctgactaatggcaaaggactgcctgaagagtaaacttcgtgaaccgtgactggctatcagtgttgtgtatgcgtaggttctaacagcaggttatggagacctctcattaagtagagttacttctgtcggaagtgtcagggtggatctagttcagtactccaaattattggggaccttgaggcttaagtatttttctgaatatgttagaggtaagttgtgtttacttaaactaacagaacagagagactgtaatgagtacaatgagtaccatgtaatagtttggagttggtagtttcagctgtacatatgttaggccatgaagaagggtgtagaggacagactccgagtgcagcactttcaagtagaagcctggcttcccagcttcagcctgctgacttgctgtaaacatctatctcagaagcattaggaacgtaggcagaaccaggatgcttcatcatagggttttttttttttaattttttttttaaggcaaattactgtatttttatggcaggaagaagaaaaaagtgttcaaacggtttctgatgaagtcaggtatttaaatggtgaatgactgatgtgttagtggagatgaaataaaccaataaatgattgattgtcatttatgcaggaaagtaatgctccttttcaatataactaaacagagactaatttataagtgctttattgaaaaatacacatattttcatataaaattacagtagcggtactaaggttttctaagtactctgcacagcactactctgtggtgggggggggagtgccaggcttgtaggtcctcagctgggtgctgtagagcagcatgaagttacctagtaacttggtttatcatgatccaatttacaattgaattttttccttaggattattaatccaacttaaaaaaacgacaataatgattaataaagatatgcgtagataatcaatagctgttaaataattttctaatttgtataaatggtactatgtactaataaaaacctcacttctccaacctatttttttaacttccaggaataccctcaaagatagtttctttgggataactacttccaaaaggaaggggtcaaaacttttcaaatactctcaattcaacttgacttaaaaatctttacttagctaaaagatccctatgtaatgccactaccacaaatggaagttttttacatgtggccagaacatgtagctatatcagcagtcttttaagaaaagcattaaaagaaattattagctgtttagcctaaggcttgtacctaccaaagttcacaccatagaaagtgccatcataaatatacagcaaaccctgggtcacaatgctatgcatcttacagccataaagt

SEQ ID NO: 33987 - DNA, 1126 bp, Mus musculus
cctcagaagatgccctacttgaaagaggagccctatttcggcatggggaagatggcggtgagctggcatcacgatgagaacctggtggacaggtcagccgtggcagtgtacagctatagctgcgaaggtacagtctgctctgggggaaagcatgctcgatggcagtgtggccagagcctctgaggctctgaggatgagtaagcacactcgtgtctgtgtgttgggtgtcctttcctttcctggccggtctcaccagtatatctgcagagcacccctctcccccatctaaatcctctctggctcattgttccatcgtgcgcagaatacttctgcatgtaagcaccgctgtcgttttgtcttcctgatgcccaggagagcagcagttgttggatccgtgcatctgtaaagctcagggtagactcttcagtcaccacgattagtttgccgagaaagagccagggaaacaggagtctgtcaagtcgtcctcagttctcacaggtgcacattcttaacttgccaaaatgctttattgggcctgacatcaccatctcgattgtcgttatttgtcaggtatggacttgttcttggcttcctgtcatttttataagaccctgcttggcagaagcagttaaatgcctcctgtaggcagacaggccagtctccttgcctcttctaaggttccgacgccttggagcagagagctggagcttgccgacttggctgaccttgccgtcttttcctgctctcgtttctgtgtgtctagggtcccaagagtgtctcagaccttttttattacctgattattagacaaagtaataaggtattagaacttcctgtgcaaaccgagagtgctaagtcctttgaaagaactcactagcacttttaaggtcagtgtttcctggcagttccagttgctttgtctgatttctgttgttgttacttgttttctgtttgcttgaatgactgtattggaaaaattatttaagaccaaaaaaaaaaatctgtctcatggtactctttaaatgttttcatttttctggtcttgaatttgtcctcaggataattagtatcttttctaaatttaccctgggctttcagtccaaaacaaagaatgagatgaatggtt

SEQ ID NO: 33988 - DNA, 1198 bp, Mus musculus
gtcaccagctgagaaccttaatggctgtgtaggatcctctataactaattacatattgtgtgcttatgtggctaagatgatcaccacttctcccatcccttgggtaagttctttatttccagtgtcaatgtcatggccttcttagcttttcctgagggtgtttaattactcattatgacttgccattgcacatagtgagtggatgctgcctatacttcaggatctgagtatttgttccacgtgcctaaaagatttagcctgacctggattgccatcctagcaggccctcaactctgagacttccattttcttggctttcagaatgctctggagatcccagggtgtgctgggagctgcttaggtcaagcttttctcgcctgcctctctcaccctctgacgattaagttgccaaaggagacttgagcggggaagccattgtccttgttggtctatcacaaggacattataaccgccaccttcttgttctgctccacaggtggagtttgagtggctgaggcagttctggtttcaaggcaatcgatacaaactttgcaccgattggtggtgtgagcccatgactcacctggaggggctgtggaagaagatggagagcatggtaagtgcgtgaggtctgagcacgtcctctggggcaccacactgtgctgatcctaagccgtctgatttccacaggcaaatgtatacgtcgtccaagtaaacgcccgtgctaggttataatgggagcagcctgcaattctgtttcaggaaacatttctgatattcttcacagagggcgccctgctagacatgagccgggacacagcgtgcggacaggttaatagcagcacccagcattcacttgtggttttatgttccagccaccattcaaagggttttccttatcaagattataaatccttgcaacaattgatgtggacagcatggtgagccctaacttataaatgtgaaagcttaggtatagagaagctagatactcatccagggccactaaatagatggctgagatgagaggccaggctgcagagcacacctgattttactcaccatagcctagaggtttagcaaagagagaaatgtggatgtccctatgtatcactatggctaaaataaaaccatgttgtggggcctaaaaaaaaaaaaagaaaagaaaagtcatggtctggcaagatggggcagagtt

SEQ ID NO: 33989 - DNA, 1170 bp, Mus musculus
agctggtactatcctagaccctggggcaacagtgatgagtaacccttgattagaaatgggttatgtaacacagaacaaccaatactcagaaagagattgagtcacgatttcatggagatccaggtcccagggagaaaagacggggatcctgcttaggtgctctcgagtgactcacagttaagtcgtcctctgaggattgcccttcctctgccacactgtgctggctgctcgtgggcaaataaactgggtgtccttgagaacaagtaagaaggaaagaaaatcatgtatggtgtaggtccttgaatagaatcttgcaagagattcctcattctcaattttgaatgtggggcaaagtaggttttttttctagagcaaattgtatgattatgtcatagtggttgtctgtgtagactctgaggtttgactcttggctccacttccataactctagggaaggtacaactgaaaatcataagtagacaagttacttaactccctgtgaacctcacttctccccctttgtaatctgcctagggataatggtggaacctgtttcatagggttgatttaagtaattataaaacacctaggacaagtacctgacacacacggagtattctgtaaaatcatccttatcataggtcaggtggtagtttgaatgcgagcagccctcacaggctcatgtgtttgaatgtctccttcccagttggtggattgttcaggaaggattagggggtgtggcttctagggggcgtggccttgttagagaaggtgtggtagatcaggacgtttcaaaagcccatgccaggctcagtctctatgccttcttctgaaggatcaaacgtcagctctgagttactgcaccagcactgtgtctgcctgcctgttgctatgcttcccgccgtgttgatcatggagtcaccctctgaaaccataaacaagtctccagttaaatgctctctcttattaattaatttccttggccaagttgtcttctcacagcaatagaacagtgcccggacggaccaaaagaacaaagtcaagaatgcactctttcacactgccctctcctttggcagagtgtccaaatgtgaagccccacactgataatggaggcccgttagtgctgagtgaggtgtagagaggaaacaacctgcgctagtccttctc

SEQ ID NO: 33990 - DNA, 1203 bp, Mus musculus
aaagtaaaggttatcaatgctttgtcacataggttaaaaggttccacatacacacacacacacaccacacacacacacacacacacacacacacacacacacacacacacacacaccatcagtaagaaagggagggatgggttaagttcactaagcctgcctgttctctgagaaatatcaagtcaaagtgatttttaaatccaaagttcctagacgtaagggtgacctcgaaggacaaaagccttggcttgggagtagaggtctatacaaataactggtgttcctcaggccactgccacagggaagcttcccggccaccagactcatacagctagaatcttaggccttggatgctagttacggtccttctcagagtgctgcagtaacacacagcctgtgctgtgaggttgagtaaactgtgtctctgccctccggatgctgtggtgtttgaagatgtttggcccagagagtggcactgttaggaggtgtggccttgttggagttaagtatgtcactgtaggggaagtcaatgagatccgcctcctaaccatatgggagccagtcttctcctagcagccttcagatgaagaggtagaactctgagctcctcctgcaccatgcctgcctgcacactgtcatgctcctgtcttgataatggactctgagcctctgaacctgtaagccagccccaattaaatgttgtctttatatgagttgccttggtcgtggtgtctgttcacagcagtaaaacccaaactaagacagaggcttaacatctgaagcaccgctaatcagttttcattagacccgataaacagtcaagtattctgcctgggttatgatctcatttgatcccagataataatagtgctaactaagcacagaggccaggctgtttctgagtgcttatgagtccactcttcagctgcaggtatttttattagccctaattttaagaagggaaactagagaccacagccacagagacattaaataacttccccagggcacaaggcttctaggcagaagagctaggattccaaagcttgccctttggacttctcattactgccatcagaaccatctcatagccttgtgacacagattgccgacccttgtgggaatgctgtggggactgatttctaaggcatttgagatggtaccaatgcccaatgctgtggtaagtgtaaggagaacaatgga

SEQ ID NO: 33991 - DNA, 1138 bp, Mus musculus
gtttctggggcagcctcagatgtcccaggggaagttgccatctgtcctttatattaacagaatcttctgtacagtctacctgacatgcttgtcccagagatagatgttgttaattaaaggacggcatttgtcctttatctgaaataaatctctcttgccggaagaactattctctgaatctcaggaagcaggtaggagcgttcgccccatgtcctagcctgactaaagtcctaggccatgtccctgagtggtcactacttttgacttgtaggttagaagcatattttttgttgttgtagttactgctttttttcttatttctctattagcttattacttaaaattattgctttttataggagcttatggagatgaacatgacacataccattaactagtgagtctgtctgtgtgtgtgtgtgtgtgtgtgtgtgtgtgtgtgtgtgtgtgtgtacacgcatctgtgttaggtacggggatggggcgctgtgtttgggtctcagacattctcccccacactggacctgcacacagtagctttgacagcactttttgcagcctctcttccttgcaggtgcacagcctctgttcgtaatatcccttccacccctaaggaaagaacgatacaaatgtctgtccccagtaaagagccagggctctcccacacatgaggtggacttcacagaaaagacagcatcttccttaacctgcctgatctttgtcttcagaaacaaagaaaatgcagccagggaaacaggactgtgatttggcatctaaagtgtgttggcctttgtggctctattaatcccagagactgccagagtccagctttgtagaaatgagaaggcagcatctgctaaggaatgagggtggctgagctgtgctaatggtgacaggaaggactttagagtcacctgtgtggtggaggacaacagtggtcactttgcccttactcctttggtggcttgtggtggttcctttgcatagctacgagacagtggctgacaaacaggctacagaaggaaggcttgcttccagctcgtgagggtttgagctcttctttttttttcttttttttttttttagatttatttatttattatatgtaagtacatagtagctgtcttcagatactttt

SEQ ID NO: 33992 - DNA, 1153 bp, Mus musculus
cctggcccctggaaagcagctgaagcagtgggcagctggtatatcttcaatcttgcataccaacatctttctctgattcacagatttcctttatccccagcacttcctctggtatgtgcatctctgacagtaagcgatatctcttcttggatttgggcgttttgaaactgtgggtcctgggtgagaagggggagggagaaggggatggctggttactggactatttccaaaaggacttctcccccttcccccatttctgtctcacccacctctgactcccaagatccactgacctctgtgtccatgaaggagtgacattggagtaattgtgagtggcactatgaactctttgactttttaaatgatacacaatctgagaggaaaaaacattaatgtctgtccagttgtaattccgtgactaggtccataggataagatgctgtggaaactctcagtgagaggagaaatgtctttgggaggttcctgatgactttcactcacaaagcatagctctttccggtgtacagtgcggcatgaggctttggagagaggcagccgagagtcacggagtacaactggatatgagccatcagaggcccattcctgacagtctgatgggtctcagagtgccagaccatacccataatttattttcctaaataactgtaaccgaaaagattttccacgcactaagaagggtatttgaaggtcggatgtaagtgagagcccaaagtgactcggagcctgtctactttcatcattgtgggcctgttggcgctctggtacgaattgagtcctctctggcatgccagtatttcatggaaagcacagttgtctttgctggtcaccacatgctctggcttgcaggagcccccaggccttcagtaaagtgttggatctgttctagaggcaagtgaattattctatgagacaaacttggggaacaaccccccccctttgaccctgtgcatgtggaaatttcaattgaacaggtttctgctagggacagcagcttggctttgggtggcagctgcatctcttaacagttcctatgttattgcatctggatttactgcctaattctcaaaacaagccatgaagtaggcagcagttacagtccctacttggacttcatgacctgcctcctatgtta

SEQ ID NO: 33993 - DNA, 2318 bp, Mus musculus
gtagactcctctcaacccagtggttataggacctgggttccaattcaaaacagctagagaacaaagcccacagattctgaagtgttgaaacgttactgtgttttagtctgacttggtgttaaattagagcacccctccctccccccaaatattcttcactcaccaccccccacacacacctggagcccttttgtctcccaaggcagcagtagagatgggctaagcctgtgacaagcctcacctgctctcctctttggctggccacctcaaagacccggaagtaggcctggccatagggtgacagaactagagacatccatcccagcttctcaccgtggcttctagtggttagaccatccaagatggcagccagtgtctcaccgcggctgcacagatataaattcagctcagttgtcattaaaactccattcttcagttgccctggcgcatgctgatgactgctgatttagacgacacatacagatgtttatgtgttccacatctgtgagcgagccttccttctcccagccttctgtagtggctaaaacatggaggaaaacagtgaaaggcagtcaccactgtcacctctttcctcctctgagagggaaggggccatgagccctgtgcactgcacacaggaagaggaaggagctacaaggagacagccaaaccctgtctttgcggggcttccctgatccagtgacagagaccagccctgggaccactgttctgtggagctagtgtttctcctagaattccccactcatagatactgacaggtcgtatgggggcttgaagcacccagttcccaaccccgtgatgtcagagcgtcagagagagcatggactccgatttcaaagtgccaggagtaagacccaccgcagcactcactccatgacctttgcatgtccttgggtctcagttttctcatctgtatgattttgggaggtacccaaaatgccaactcctaatgtgaaaatgacgtgatatgacagagctacagatctagagtaatttctagcataccgctgaatatccgatatgttccagtgtcgttacgtgagctgacctggaagaggccgtcttcctcccccccccccccccgggtctgcagtcctttgccgtcttgtgtctcgtggcccacatctttccctagtgacctgaggccttttggtggctgaaaggttgacaacagttagcccatgattctcttgtattggccgagacctgcaattggaaggacacaacatagttgtggtttttgctgcatccaggattccagttaaggtgccttcctgcctagaatccaccatagaagctgcactccaccagccccaagggcttcctggtgcagggacccaaggctctcagaccttgatttgttcccctttgtctctgagccaggacttcctcatcagtagagagtgaggtacattctcacggggtaaaatggaacaacctaagtaacggtataggtggcttcatatgtcacaggctggcccgtctccccatccccagccatctggctctgtggtttattaggccccgtgatatttctttgttctatttaattgggtgccagaattaaaaattgagagattccacataaaataaaaatgtctgcattctctttagaagccagaatacctgtgagcccctgggtctccataatcgcatggcggtggcttggcaatgcctgtgacctttgtgctctgctgtgaccctgttgctccctgtcaccattttgtaaacctgcgtccgtcccagcagcactttctagagctgcttgctcgcatccttggtagaaagcagtagcgttgagtgctcagtccctgctcctcccattggtctaagttcatggtctgcttgtattgctgtgctgtgtgcatttgttcatacacaataaagaattaaacgatgagaagcctaagagcgtccgtgcttttctccttacatgccagtgtggggctggccttgctgggtgggtgaaggtggttctcaaattgtccagttgtacttacccacattcctctgggcctttcatgactgacagcaggttgcagatcacttgagaaaagtgctctaaaagatgcattacactgggcgtaggagggactcacggccttcctctctccagactctagcagtgtatcttcctttctcggggactctatggagccctaggttcgatagatcctaccgccaatccctgtctgccagggtacagagtgaacgcttagggatttatactgtcatggccaggaaacccagactgagacaagatcacagtagatgcctgtgcatggaatggaagcaac

SEQ ID NO: 33994 - DNA, 1181 bp, Mus musculus
tagtgccttggaagtggagaaaaagttactcaagacagctttccagccggtgccaaggcggtaagagactccgaatttgggaagcatagtgggagacccttcgggaggaataagaaaaacacagagccagtggcgggagccctttgccccctgggaaggtagcaaagtagctggcaaactattgctaaaggacccaaaaaatccactcttctgtcacttcttgtggacccatagacacggttccattctcggctggagcacctcaggcctgtggtacagagctaggggaagtctggcccttacaagaggcctgtggcgcagaaggcctctgcgtaatgtccacttccttccaagcccggtcttgacttctgatctctttagctcagcttttagttaatactcccacagctaaacaccggctttataggggatcccctatctaagcagtctccccaactctaaagctcactgtctctgcttccgttctcttccaggccacagaaccatctggacgctgctctggtcttatcagctctctcctcgtcttaacttttcaaccatttttaaatcgttgtactaattgtaaaaaacaaaacaaaacaaaatcgctctgtatagtgacgagttgcaagcatgtctgtgtatgattaccttaaaagaaacactaaacaacaacaacaacaacaacaacaacaggaaaggacaaaagaaagaaagaaagccagtccccccaccttggccctcccccaagtcaccccacatttagattgtgaggttccttcgttgtgttgatttcggggggggggggagtggggttacggagagaacaagcctgtctgactctttttgtatatacgggaaaatgtacatacgtgtgaaccaaattgtacaagaaagtatctattttttggctaaataaatgagctgttgccacttttgactataaccggcaggtctgccacatggaccggtttgctgcatggttctttggtgtttttggtgtttcttcccccccacccccggccgttgtttaaagaatctacaggaaaagatgagctgggtctgaggacagcaatggcagaagtcgttcgggcttaggtagccaggcttagaagcctctccaagaaggggtgatgagagtcgctgggcgaccgagaaaaaagggcaaagaccaaggagaa

SEQ ID NO: 33995 - DNA, 1199 bp, Mus musculus
tgtcaactctcacaaagggctaaaaagcatgctttttcacagatgggacttgaagcagatgcccctttctctcgccctcataccacatgcagccatcattgggaaaaggcaagaggatgctgactggcctactcaaaagcaacagcactctcagcacaagggaaaaaccaatatgtgccacttctagaacttttagctctaccctggagttgtcctcccccaaacctccttcctattaagcaagtcttgatgcctgtcttatttctctcttgaattccacctcatgtccctgctttggcactcaggatatagcctattcctcgtggcagcccatgagttcggccatgccatggggctggaacactctcaggaccctggagctctgatggccccgatctacacctacaccaagaacttccgattatcccatgatgacatcaaggggatccaggagctctatggtaagccgcagcttgtgggactctgaggggagaggtgtcttcgaggatcccacagcctgggtgggaagacgcaggagtggaaaatgccagacctcatctagttagaatggccagggacatcatcaggggacatggctcgtgcctggtcctcaggctttagagtaatgctccaaagggcttctgagacagctctgtcctttctagactctagttatccatgcctctcttggttcccatttccatgtgctaggtatatgaactgaggctaagaaaggcgtttagcccaatatcaactaggtttcagcagccaggtagggtttaggatccagaagagggagctgcctacagggcagaattttctctggcgtgaaatgggtgttactagttcttgtaagatgctcatgtttcattttgccatagaaacataataactgcttcctgccaccaatgatggcctattgtctgcgctttcagtgaggttagaggctaaaaagcagccagtcaatttcttaaaaaaagaaatcaattatataatagtcctagtggttcctggaccaagcgcgtggtgaaagtgaaacctggatggggaagctcacggactctgaacttgggaaagaatcagagatgcagacattgatgggtgacattgcagtcccgctaaggctacatgccagctggaatgatgcaactgttcgcctccctagactccactgttgcgcagcctgaggagtacaaaag

SEQ ID NO: 33996 - DNA, 2368 bp, Mus musculus
ttcttcctcgcttcctctccttttatagttttgggttgagtacagggttttacacacactgagcaagcgccctgctgctgagctgcactgtacccgagccatgggcaaggctcttctcatcacaggatgggcttgagtgacagctttgtgaagatgcctgtggagaaggggaaactgtcttcccgtttcccatctttctctctcttgtggctttatttcttataggcggttcttaaacaaaagttctgaagatgatggggcctcagagagactcctcccttctgaaggcacatcctctgaccccgtgaccctgcgccgaaggatgctggcagccgctgctgagcggagacttcagaggcaacggacaacctagtgcttcctcaccttcctcagcctcctgcccagctctacctaccggaagaggcctgtcccagttctgcctgctgtgtggagacctgcgactgcattgctgctgcataaagcatgtggtctttagtgtgtggacagctgacaaatttaatcctttgtaatactttctttgtgacatttctcttccccttagaaacattgcacattttaactctaggcatggcctcttctggtgttgactggacttgttgggagtaggggacgagcaaaaagaagtgggcactggggcgctcgcctgcctgcagcagctagtttgaatttctgttttgatataaaccacagcagatgttgagtattttagcaccacagctggaaggaagcacggatcttggggagggtgcataacagcagtcagaaggtgcgcagcaggagcctgaccaccactatggcaaagtagcctacgattaaatgctgtgcttagggaggaggccagtcccacaggcgcctggacctctagaccagcaggacatggtgtagaaagaactggtttggtacctggagtagaaagaggaagctcagggctgcagaatgaggaggcccttttctgcccttaacattcaggaccaatctgagcccagtccccagctggcttcacttccgtcactctggtgctctcgcatcacagaagcttgcccccatggctgccgcctcttcctttcctttggttatgactttaattccttggtcaacccaattaggctatgctaaacatatgggtttgatccttggaaaaaggcatggggcctgcccagcaagggcaggggtgtttggaggacactgctgaagaaacacctttcgtatctttgtccctggagcccttgagttccctgcttttgttcctgtgggtctcattaaacggaaacagaggatgttgaataatccacatgcctcaagcagactcggtcccagatcggctcaaattctccacgtatttaaggatttgaaacatgcaatcataggatacatagttttatgtcccattggattaaggttttttttttttaatgtttcaaaacatagttttatggtagtccttttgggaaaaatccagtattatctaaaattattggcaaagttaaatgtattttacatacctggaagtttttagactgttgataagtaactgagaaaggataacaggcgcctaggtgaagataatttatttcaataaatctttcaaaagccttaccttgaactgctgttagttaaattcctgtgggtttttgttttgttttactttgttttgctgagagcgtagcaatttgtttttattgtaaagcaacaataataaaaaggaaaatctcttgtagtgtggtgtgggggcagtggagtcccacgctgctctgtgtgtgccgtttgggttggggtttataatgctgttcaactgggaggggcgtggtttataatgctgttcaactgggagggcgtggtcgctcctgtgttttacttggaggaggaagcactgagcttgtctttgacacctttccaggctgcacatgaaaataaaggggaagctaagtccactgttcttccatttcagatgtcggaaggtgggaaccgcttgcagtccgtttcggagggtctacaacattgtagaatattgaacagatgtaaatggaagtgccttaacatggcttaagatgtccaaggagagacgccccaagtctatgcttggtttgctccctctgtagatgggttgggtcaaagggaagctggtgatgaagtaatctgaagagtcaagggttctgggtgcagtagaaggcttcatcatttcttggggacactggacaagtgctaagtgaaggcaccagctccaagaggcttctgggtcattttggaactattctgtagtcctcttttccttattggccatatttaatttttgtcttcttggatccttaattttttctttaagctttggcacttttatgtagcagag

SEQ ID NO: 33997 - DNA, 1184 bp, Mus musculus
gacttagagttgtgtcagatagaagtgggtgtttgccatgtaggatggacctcatcattgcaaagggcattcctaggaggtgggcaggcatggctgctttattgctgtcagctggaaaaggctcagcacaagctgatctcctgggttaggaagatattcctcagaaactgggggtgataaacttgaccaatttactttccatcttgttttttagaaatctgctttttaattagactaagaagtatttctcttttgcagtctcttcttgtgaccgtgagaacagctcatgtgattttaaggtgagtagaaatgttggagaggtgaccgacagttgcttgttcagttggctttgagatgtaatagttttaaacatatgacagtgtaactgaactataccatatttaagttaaaggaaaatatataacaatgtgactaaactataccatgtttaagttaaatttacttgtagtagtcagctaacatgctgttctcttttctgtctatattgtagatatgtaattcacctctgggacctcaaccacgaagggacgtgggaaggaaagggaacctatgtgtattacaccgactttgtcatggagctcgctctcctgtccctggacctcatgcaccacatccacatgctggtgagtcccccacacccacatgctggtgagtcccccacacccacatgctggtgagtcccccacgcccacatgctggtgagtaccccacgcccacatgctggtgagtcccccacgcccacatgctggtgagtcccccatgcccacatgctggtgagtcccccacacccacatgctggtgagtcccccacacccacatgctggtgagtcccccacacccacatgctggtgagtcccccacgcccacatgctggtgagtcccccacacccacatgctggtgagtcccccatacccacatgctggtgagtcccccacacccacatgctggtgagtcccccacacccacatgctggtgagtcccccacacccacatgcttcgggtggtggtgcccagcgcaggaggtaagtgctgtggtaggacatgccattaaactgctgaccagtcaatagagcatcctcagagcatgggaaaggggccttccctgcagtgtctgtggctttcctactcaacacatgctctttagtggtaatgggaaggaagg

SEQ ID NO: 33998 - DNA, 1238 bp, Mus musculus
acctgactctgtccttcagcactgactggggttgcagacaagtgtgcttctccactggctttcttgggtgtgggcttccaaactcaggtcttcagtgcttgataaatactgtacccactgagccacctccgcagccctacttttatagtttttgattatttagaaagtttaatcttttctattatttattaagtcaggatacagaagtcttaaaaataatactgataaccttggtgaacatgtaaaatataatatacttttacttctttgtacttaaggatactaagcaactgcttttttgttttttgtttttgttttgttttgtttttgtttgtttgttttgtttttttgaaacagggtttctctgtgtagccctggctgtcctggaactcactttgtagaccaggctggcctcaaactcagaaatccgcctgcctctgcctcctgagtgctgggattaaaggcatgtgccaccaaagcaactgctttttaatggttaaaattttataactgtttcagattgcaagtttcagttcacaatcactttgtcttacctctactcattatgagataactgttttctttgccttctgtacagagtgctctgtaaccttgcttttgttctattaacatcaatgaagtccacttggtatgctgcgactcacctttacaaacttttttccttttagcatctcaaagacaagttttggaattttattttctacaagttcattttcatttttggagtgctgaatgtccagactgtggaggaagtggtgatgtggtgcctctggtttgctggacttgtcttcctgcatctgatggttcagctctgcaaagacagatttgaatacgtgagtttttagccagcctctttccttgctcattcacatgtgtgtgccaagtttaatgtgagacacagtgtgagaaagtcacagggttgcatgctaaggcctgctagctcagctgtcaccgcctgcagtggtaagatgcctgttttccagggagctcccttgcccccattccccaagccctatagccactcctagccttggcttaggtcagagtgtgaaggagccttgatgtataccctgtgtacatcctgagctcttctggagagttccccatttttcttctcttgccctgactggtggagcttttctttctcactggtatgtacttttcttcttggagtcaagactgagtgagctgcctctgcttccagtctggctgtaaga

SEQ ID NO: 33999 - DNA, 1223 bp, Mus musculus
ctaaattcctgtcctctgaagagcagccagcagtctgtgctcttaaggctgagcctggtccataaaatgttagtctagtggccattatctctcaagggcaccttacatggttcctgcatgatgagctgtcccaagctgtggctttcatcagctcagctctcctcttggcttatccatttaacttgctgttctgcaatccaagctggctacacgtttatgacagtgacttatttttgtgttctcagctccccaaacttaaaaagcttttactggtttagtgtttgggttgctggctgctggagaggattttcagttttctatgaaagaagcttagcttttgtagtttaagattagattttccaacacattccacttgttttctatctcttgcttgggttaaactggactcacttgagtttgcctctgtttaaatacaagctgtaattcatctggagccattaaattcactttactattaactcatataacacacatggctatgaggggggaaaaaaaacccaaccaaatatatcaagattaagccagttaagtgcactttgtattctagtgagggattaaggctagagctaagttggaagaaatgcaggcattatactgttccattgagagaagagcagcgtgttgagaaagcaaagctttggctagggatgctgctgttcagtgggaaagcgtttgcctaggaaggtttgggttcagtccatgtgtcctccaaacagagaagttggtaattatgttcatatatagtatacaagcaccatttatagttgtgactttgagaatttgaacctggtttgtttataggaatgtataaagaaactggagttttgggttatgtttttatatttgtaaagcaaaagtttgatcaaaatgatcattgttctttttaaaagttttatttcactgttatttcaataaaaatatttaaaactgaatgactaattgtttgggatattggtggagggttgctcaacttcgtagaccagtagtgatcccacaaagacaagtttccttgtctgtggtaaggtccattgtgtaagggaccactttggcatagtgatggtttggactatcgatcaatgttatccatctcccccccctccccccttgagataggctctctatgttactctgtagacaaggctgaccttgaattcagaggtctgcctgcctccatctcccagatgcttcgattaaaggtgtaa

SEQ ID NO: 34000 - DNA, 1458 bp, Mus musculus
cagggcaaaggtgctgtatcgtgtgcacatgaacatgtgcacagagcaaaggtgctgtatcgtgtgcacatgaacatgtgcacagggtaaaggtgctgtatcgtgtgcacgtgaacatgtgtgtgcacagggcaaaggtgctatatcgtgtgcacatgaacatgtgtgtgcacagggcaaaggtgctgtatcgtgtgcacatgaacatgtgcacagggcaaaggtgctgtatcgtgtgcacatgaacatgtgtgtgcacagagcaaaggtgctgtatcgtgtgcacatgaacatgtgcacagggcaaaggacatgtaagaactgtttatgccttcaaggaactttgtgattcataattaacctaatttacactcttaatgtgtctcagggtaagtactcagctgcacttctgcagtgggaccagtgaggtcaatgttcattgtagtatagaaatgtttaacatgtcggaaggggagagatggccaggtgaaggtggaaactataactaatactgtttttaataaaagttttctgtttttttaaatgcaggttcaattttatatacaactgaattcctgtatgcagaagtaaaagaagccgtctctatgagcacagcttacacgtgtagaagagtaactgtagaacaagttttggttttctcttgttccctaaattgccaccaccttcctgtttgaagagtaaaatgaatatgaccgagatagtggtggaaacatgtggcagtgttcattagcttttggttctactcatacttttttttgtacattaaagaaagtgaatttcttatttgtatttttttttaagtttctcattaaactctgaaaagtcttagagccgaggatccttttttccctgctttagactggggaatgttaaaacatgatcatggatgagataaggtgagattgtgggccctttgctccagtagtgttggaagcatatggtcctaggctgttacaggtgtttgtaatgaggactttcctttactctggggaactaaatttctctgattaagttcaaggtacagtgtgtaccaaactacactctgttacaaagaattcccaatatattacctgacgagtatattttataaaactctctaggccttacttcacaagtcaagacattaaacatttgggagtacattaaaaataggtaagctgaaaaccattggaattggtataaaaagaagtccatctagaactcattgcagtattttcatataatggcatagtgattgtttgcactgctgtggattgcttcttactgagtgagccatgacaaaattacatgagtttttaaactctcaaattatagagttacagttatgggaatctgaggtgttgtatacgtaatgataaacatgattttagtaagcagcaaagcttttcaaaagtattttagagtaggctgggtatggcggtacatacgtagaacccc

SEQ ID NO: 34001 - DNA, 1194 bp, Mus musculus
aagcagaatatggaatgaaccgagcagcagtcagcgcccgggtcggaggtggctgcgatcctccccacacctcttgctgccgcgcctccctacagcaccccattaccatggctgaacggtgtccggcagctccaggcctcagccacctgcttcctcaggatttcttcagtgacagcgtccgaaaactctgccgatacctgcttctttcccttcttcattggccgcgctgggccaggatccgccggccgcttcccgttcatcttctcacggtgcacagacccacgccaaggaagtcaggacgctacttccctccagaaactacagttcccgaaaaccctctttccttatttcaccagcattacccaatggaaaggcagtaaagcacagggaggcgggatctccacaaaaataaccaatgggagatcaacatattgcgtcacgccgccagcaattggtcaaatggtcgcagtggcctgcctcccaacttcctgcctccggagcgtattcacttccggcgtgtgttccgcgcctcttgctctcgactgttaatggcgggtggtggctgctgagcgggacgcagataaccgctgcccgccccgcggacgtctccccgggcccccgctttctgcacgtccccggcgtcggagctgttcagcatgtctgtggtgccgcccaatcgctcgcagacgggctggccccggggggtcaaccagttcggcaacaagtacatccagcagaccaagcccctcaccctggagcgcaccattaatctgtaagtgcggcgcggcctcggccgttgatgctctcccagtgcgcgctcctccctcacgccggatgcgggttgtcccttccgggatgcgcgctttctttcctagacctgtttctcgaccccgacttggcagttttcctattttaaaagcgaggttcgtttccccctttcccttcattcagccatggttagaacctgcgtttgctttgaattcataatgtgtgtatcctttcaatccgttgctggttgtttcatcgcacatgtatttgtgtttatttgaacaattctcagttttgtagggtgtacatttcttttacagtaacttttccagattaacctctgacatcctagtttttttttttccccctttaaatgttgggtagtgttccatccagtggccacattttattaattttcgcgctgtt

SEQ ID NO: 34002 - DNA, 3763 bp, Mus musculus
ccctgggttgcagaaaaaaatgttttcccccattgcaattctcttcgttctgtagtaactgccttggcgactttctaactttggtgattttttttttaatttatggtgtatatacaaaatttagcagggtcacttttttttggcttagagtttggtttggtttggtttggtttcttttgacagggttgtactatgtagcccaggctagctctgaagtactgattctgccacctcaacctcctaagtgctggaattgcaggcatgagccactgcaccagttcctgcatgtgcagtccgtggaattgagcatactgaagtgctccaaagcacccgtcactgccatctggaaaacacccagacctcataggaagtggaaatggttttctgtcttcccataggggagtgctactgcccttctttgatgactgttcgcctcatgagtgaatcgtgcagtgggtctcgcttcctgattggcttgtttcacttagcacagcgtcctcaaggcctatcagtgtttttcttcttcactcctaagtagttgtagaaacttgctgagcccgagagctgtgacacacggtgctcccactgtgggctgagctccaccctgactctgaggatagggtaccctcggggaggtagtgttgctcttttggaagaggtctgcctgaaacctaacatagctccaggaattccatagctgcttactgccctatgtatttcctctcgtctactgccttccagacctggcatcgtggcttctctgagtctagcctcccagtgactatgcgttcctaaatgctggaaggccgggtgtggaacttgctgcctttcccttccttttgaaagacccccgtgctaaaaggcagtgtcaggaggagaagttcaggaggagaagccctccttttgtctctggtctttcccctgaactgctccatggggctgtggcacagctcttcccattgtgggggtgtgcatgatggctgagagatgtcctcacaccaccccacaccacatctatttgctgctttcttggttcctgactatccttgcaggtttcagtgtggactttacttatcggtaggaaaaacgctggacctttaagtatcttattcacacttctctgacgtcctaaaagtccatccaaatgcattctgtcttttacattggctttcaatttgttttgtttacccagtcagtaaaacacactttaacattcatatcctagtagatacttacaagttttatatgttttggtattaatcataaaacaaagtaatttttaaataatgacatgagaatatccagacctaaactgaggggacatactttaatcccagcttttggaaggtagaggcaagaggattaagagttcaagactatcctcagccacacagcgagtttaaggccagcctgggcagcagtacaccttgcctcaaaaacaaagatggagccaggagtgggaagcacgcatctttattctagcactcaggaggcagaggcaggcagatgtgtgaattcaaggccagcctggtctacaaagagagtttcaggacagtcagagctatatagtgaaaccctgattcaaaaattaaaaacaaaagactctccagacctagtttgagagttgtcttcccacgccaggcagtgaccaatgacaggctgttgcccacgcatactgttgtagactccaccgcactttaatccagagtagtgctcaagttggactacgcatactttgttgctaacggttacttttgaagcttgccttttctgaactgctgcagactaaaggcaggcccactcccccacccatcccaccctcactccccaccccccattgaagtgcctgagtgggaagaactctgaagggtccctctgtctttgcagagcctcctggtctgcaagaacaatagaacctacaggttgcctttctgctctagtgagcagctgcgtttttcagttgccatgtgccgcattgttgatgtatgggtgagacagatggtgtatgacagtgagcccgtacgtctacagtggagctgaaagatgcctgaattccaaatcactcaaagtcaccgagaggctagggagaacaggcagctgtgcacacaactgtcactcacaggccaccaccttatgtgttcactcacatgacctgctcagagtgtgtgctgttaaagcgctaactcccatgtgcagacaacacaggtggaaagcagtgagaatgaagacaatcaataagtgtatgggcctgtgtgtgtgtgtgtgtgtgttagtattaacagaaaattcagaaaggttaaaaatgaaaataactcaaaatatttttgtacagctatacaatataaagttataagtcaaagtttaaaataaagttctattgcataagctaaggctattgaagatggagtatttttaacgtgtcgtccatgttggaaggcagaaaagcttccacttagtctgtccaagaatactgtcacgtttgcacaagtgatcttgcctcagtttgcaattgcttcattcttgatcctgattgcttgctgctttgggcatggggcaagagagtcaaatgtgggctctcaatacctcttgttggtaaaagctatgctgctttctgtgtgaccaatggcatgtctctcttaataatgagcctctaattctttcttgttttcttattgattggtgttttcgagaagggtctatgtataccctagctctctaattgctaagattctagagtaccacggtgtccagctgtgaacttccagttctcataactccttttcctaaaggtgatattccctccaaagataacaatacataaacaatgcatgttcattgttgggaatttaaaagtgtggaaaaacacataggtcagctgaaaccccttgccaccaccctttgacaactgtgtgctgccgtaagcgtgtcagcatggccaccctgccctgtattaggaagcatggctcctctctgccctctcttccctctctcctgttgggtaaatacaaggttgtaaggcactttgtcaggctgggctcagagggagccactaaggccgccgctgcagacaagaatgaaaacagttttcagtggctccttaagaataaaaaggagcagccagagatgcgtttggagatctgtattccagctaatgctaccccaactgatagactgcctttagatttgttttcccttaatataaatgtttacacatacatttgagtgataaaaaaaaatggatgtctgtattttttgttttccccacaaaataaaagtgtttgtgcatttctgctatggtggtaatttataaacaacaacaaggaagaccagtgccttttatttttaatgaaaaagtaggtactccattttaaatttcagtaacaatttcggggggaataaattcatacactaactttatgtacaaaaacaagttaaattctgaaatggtgatatattttaagatacaaatcagcaacaccactgatatcaatgaaggaggctttcagccggagtgctttgtccttagctgtatcagttagcatggtttcatccttagcagctggatgcccaggctgtgatcgggagccagccaggctccgtgtctagaccttttgcaggggcttccttcctctttccctgtctcctatgaaggagcagtgcccactcgcatgattctgaagagggtgttgatgttgttgcttcgaatcgcatcccgacaagcactgatcacctggttctttggctttccaactgtgtgagaaaa

SEQ ID NO: 34003 - DNA, 1420 bp, Mus musculus
gagctagacaggctttttggcccctcctttagtaattactttaagggtacgaccggctaccccttccgaatgaattctgaagcactcctgctcctttaaactagtccttgagatagtggctcgcctacccgggtgatttgcctcaccttcctaggagaacagcgttcaggtactcccgggtcccactcaaccgcgctcactgactgccttctacttttagatggatcctgctcctgcgctggcgcctgcaaatgcaaacaatgcaaatgtacttcctgcaagaaaagtaagttggatcttctctgccatttccccgtcactctcctggggtccctagcccgccgcgccgcgccttccctcccgggagcgttcaggtggtgtgcctctgacaaggtttctcgctcacgttcaactcttctctccccacaggctgctgctcctgctgccccgtgggctgtgcgaagtgctcccagggctgcatctgcaaagaggcttccgacaagtgcagctgctgtgcctgaaggggggcggaggggtccccacatctgtgtaaatagaccatgtagaagcctagccttttttgtacaaccctgactcgttctccacaactttttctataaagcatgtaactgacaataaaagccgttgacttgattaattcagcttgtctctgtgcattggttaagggctggcagaggcgttgagatgggactgcagcagctgaatttgagctagtcggattatatttctctggactttgaccgcctagaaagtggtcatgcagaagcatgcattggtcacagaaatgggccattcctactgggcgtgtgtgtgtgtgtgtgtgtgtgtgtgtgtgtgtgtgtgtgtgtgtgtgtattggggattaaaccgaaagcttcctgcttactaaacccaggtgctctaatgcgccacatccctacccctaattattttcggtttttaggcttaaagtatgaaatacctgtaaataaaaatgggagtgagtcagatatgacgtctcccacgagtaataaccccaacacttgagagcctgaggcagaaggaccactaactctgaagccagcttggtctcaaattttggtgacctttggttttgaggccagatcttaactgtgtaacctaagctgtccttgagcttctgccttagacttataaattctgggcttacagactaaaatccatttttaaaaattcagtaacatgggctggcaaggtggctcgggttaagagcgctggctgctcttccagaagtcatgaggtcaattcccagaaaccacatggtggttcacaaccttccataatgagatctgacgccctcttctggtgtgtctgaagtcagctacagtgtacttaaaataataaatcttagccgggcgtggtggcgcacacctttaatccc

SEQ ID NO: 34004 - DNA, 2211 bp, Mus musculus
tctaatgcagtccccacctaaaatgatctctctggagggagggtaccttggtttttaaaaccagcctggagtagagcagatgggttaaggtgagtgacccctcagccctggacattcttagatgagccccctcaggagtagagaataatgttgagatgagttctgttggctaaaataatcaaggctagtctttataaaactgtctcctcttctcctagcttcgatccagagagagacctgggcggagctggtcgctgctcaggaactccaggaaaggagaagctgaggttaccacgctgcgaatgggtttacggagatagctggctttccggggtgagttctcgtaaactccagagcagcgataggccgtaatatcggggaaagcactatagggacatgatgttccacacgtcacatgggtcgtcctatccgagccagtcgtgccaaaggggcggtcccgctgtgcacactggcgctccagggagctctgcactccgcccgaaaagtgcgctcggctctgccaaggacgcggggcgcgtgactatgcgtgggctggagcaaccgcctgctgggtgcaaaccctttgcgcccggactcgtccaacgactataaagagggcaggctgtcctctaagcgtcaccacgacttcaacgtcctgagtaccttctcctcacttactccgtagctccagcttcaccagatctcggaatggaccccaactgctcctgctccaccggtaagactcccgatccttggtctttagaataccaagttgggaccgcagagcggaatccccgagttgtagaggcttggcgggaataggcacctttagttggcgattcattccggttctttctagaatccgctcttgcaaaagccttcattagttacgagtattgtcgaacgggtcctttggcggggttggggctaggatttagacgcgcaaatgtccggttcctgatcacccagttagtggggacatctgggttgagtcccaggcattactaaacttactgtgaattgcttgaattaagaaagaggtgaaggacctttatgtcttgggactcaaagacataatccctgacttaacctgtgaggagaaaagtggggctaggctccctgcagctccgaggaggacttagtgaactgagccgggactcgtggtgttggccactgctgtaatgctgcctccctcatgctgtcttctttctcctccccaggcggctcctgcacttgcaccagctcctgcgcctgcaagaactgcaagtgcacctcctgcaagaagagtgagttgggacaccttgggtggcggctaaggctaggggcggggaactcctacaaaactggctctgagaaatgtcctttgcttcccggaggccattgtattgtctcggggacagaactatacagagaactatttaaaaaaaccgaggtcttctctgttggggacaggaagcagaggtcttcagccaggctgacctcttcctcctcctttctaggctgctgctcctgctgtcccgtgggctgctccaaatgtgcccagggctgtgtctgcaaaggcgccgcggacaagtgcacgtgctgtgcctgatgtgacgaacagcgctgccaccacgtgtaaatagtatcggaccaacccagcgtcttcctatacagttccaccctgtttactaaacccccgttttctaccgagtacgtgaataataaaagcctgtttgagtctaactctggttttcttggtgtggtttggcaataagaaactggggtgacttgatagtctggggatctggttttggaccccctcgtgcctttacctcccgcctctggccctcacagaggggtaatgtctttgggtaaagccaagctatcccataagcttcctcatggaaaacagctgtgtgcctggtcaggtcttgtgttaggggaagggagggagggagggtggtcctggaagacttgatgtcccatcctggaagcacagaaaatcttatcatttatattctctttggattctggtttcctctcacattgttgggtataaggaggtgggtatgaaaattaacatagggtgtctcgtatgctaggcagggactaacactgaactagattccagaggggctttcttggctgttttgacacaagttgcttaccttgtcctagaactcattctgcagtccagtctgaccttgagtttttgattctcctgcctca

SEQ ID NO: 34005 - DNA, 1102 bp, Mus musculus
tggtctagaagcaagcggcggtgccagggtttcaaacgtacccagccattgctccttggtaactctgttttggagaagtacagctgccaagcctctaaggggataggaacacaatgtcttcccagggcctgacaaccagtcatttaacgtgcagccttttctttttcaagtcctgtgtgaaaggtcatcctcaattaccctctaccctgtgcagaacagggtgattgtagacctctgtgagataagattacggtaaattgaatgcttttggcgtgggtatttttagaacggcttgcttagtttcagaaggttcggtacaccattgtgaaaaaacctggcaagttgttgagaacatgggctgtggagccaggctgcctagctagctagacccactcccccacttaggatgtcaagtagcctgtcttggggacatgtcttaggatgacatgtggccaagtcccatgtctcatcatggggagcacacggggctgccatgaacctgaatgtgtctagaacagtccctggcacatatcagggactcaggactctctccctctcatccagccatggtgtgtggcagtcagcaggcaatctataagtgtgctctaagttaaatgagcatgtatcggatactgtctgccagtcacatactaatcaggtccaaccccactcagcttccaagaggagaggaaatataaatataacagaccccctgatagaagtcttcaaggctctgtttcctccagaacaacccagtcctaaaagatgaggacaaggggctgtgaggtcaaagagatgcagacacatctagaattaacgagtgacaattactgggggaatttacggacagaagtgtggacccaggcaccagaatgtccaatttggcatcccacattttgactcagttgggagtttaaaggcttgaacaaaagtgacttgacactactggaaggtagctggcttatcttaagatgatcatgaagagccgggtgcatcctgccagtctgactgcaaagtctcataaatgactccaccttatcaactcatggtttgctaagaaattgtgcagtgaccactaactagggttactccaggatagtca

SEQ ID NO: 34006 - DNA, 1147 bp, Mus musculus
aatccttttagaatatgtttggtatgctaaatgataacagatacatcacccagagcagccattgtacattctagcctctctccacccctgcaaatgctctcaacacggaaatatcagaacagatagttttacacaggtgtttctgggtggtttcattctgggaaagaatagtaattattaggtgagatttcccaagacacagcaatatagcatcccatgttggataaatgtgtatattttggagaagcattccttcatgatgctcacaggtcctttactagtgtgcattagctcctcttgtttctgacaaggactgcagcttttcagtaacatcccagttcagagtcaaagttttgaggctcctgagaggtctttggggaagagagagaaaaggttagctgtcaaattagacctgactctctgaaggtaccttctcccagaagcacctgccagtctgcctgctgtgtctctctgcagagggatcggaggaaggaatgttgttcctcttgcagtgtttacttagcttggatgtcaggtgaaatgtgtttatgtattatttgtgtaatctgaaaagtaatgaagtgagaagggcccctgcttgatgcgcagttagttcagtctacagggtaaaatcctcagcaggactgatggcaggcacggctgccttctctagtgtgcaagaaatgttccaaagacattacgtgaccagttaggaaattccagtttcattagtgacatcgctggcagcagtacttaatcctagaaatagagacattcatttgatttagatctgaagacatttagaaagggtttttgttgttgttgttcactcttgaatttcttaccaaaattgattgtcctgttataaaagaccaatgaaattaaattaggattcttgaatgcctccaaaccttattaatacatttaccttgtagagtgtgtttctgaaattggcagtctctaaatattgtgccatactgagactaaatgtgcagccagccaaaacaatttaggtgacatgccacagcacaaagtgtgtgcatatgtgtttatgaggacgacatcccagtgttgggagccagcctgaggggtacctctcacttggctggacagtgggagcttactgctgagcaaaaagaattttcaa

SEQ ID NO: 34007 - DNA, 1139 bp, Mus musculus
tcagctttccttctactaccatgtgggtctcagagatttaactcaggttgtcaggcctggcggccacactgagttctcaggccgggcccagagatgctttctaggggtaatattccaactctgtagcaaacactgccctgacaaaggagaagacagctgtgccctccccgagtccgtgagccgtggcctgggaccattcagtcctctgacctggatttatcagagcctgcctgtgcttctatagtgtgccgtcttcccttttgttcctggcctctgtcctctactatcttgcgccatgtttttcaggtgtttgtaaggctgggctcgtggtcagctttaatgtgctggccacaggtggagacctagccttatggacgattaggcactccgaggaagggaaggctaacataggcctctactgcctcttgctggcttcagaatgacttctgatctctaaggaagtgagagtatctcgtgctggttacttttgtttccttctttcagatctatatctataacgagaagattgtgagtggacacctacagcctaacctggtggacctgtgtgcctctgtcgcagagctggatgacaaggtagtgcccagacctaacctgggtagaaacccacattccgtgttcaaatggcgtcagcgccttactgactaggctgcagtatgctaagagagactgttttaagagttagcatttttttcccaatgttttttataaattggagtgattgtttttgtggtggctttttaaaaatacatccaagggtatgggggacttttgggagagcattggaaatgtaaatgaggaaaatacataattaaaaaaaaatcctcaaaagttctggctgggattagtcagtggtcagaggtcctgagctctgtttggcttcttgaccattttctctcctcaggtatcagcatgctctttaaggatgcagagggcggagttggtgctatctccttgaacttaacttacgccttcctcaccctcttacttccctggcagctttctcctttaggaagagcagcagtgggtggataggggtgggtgcattagaaggtgctggagggaaggcagaaggaagggaaggccagtacaggagcagaaacactcatacacaggtttgt

SEQ ID NO: 34008 - DNA, 1251 bp, Mus musculus
agacggctttctgggctctggcaagtcagcctgacctaattggcaagctcagaacagaaagggatactgtatcaaaacccaccacccacccgaagagtggcatgagaggtcgacctctgccctctaccctctgctgcacacacatgtgcatgctgataaacgtcaacagcaagacatttagggaaggacctgcttgagggatgttggagggaatattgagccctagaatccccagtcttcctaatgaggtcttagacctgtagaaggccgatgggcgaaaggatgtagtgctagcaattagaagtcaggtgagagtggtgggtgagcagagaggccctgtgctcaggatgatggagagcttccagactgttatgggcatgcttgcacttcacctttcaggatctttgctgagtctttctctctctgtgtcttcagattgtctccagctacagaaaacaaactccgacttcactaccgcagagccctcaggaacaacacagacccctacaagagagctgtgtactgtattattgggagatgcgatatcaccgacaatcagagtgaagtagccgacaagactgaggactacctatggttaaaagtaggcacagtgtcctttggctgctcaagtccgccatgctcaacgctcgtaatgcatgaagtttgtgtagtactcaggacagggacagtggattttgtatcaaatccactttattttttttattgtgtaattcccaactaataactacacagtcagctttctttttcttctttccttccctcctcttcccccacttccctttccctttgctttgctagggacggaatttagggcatcagtcatgctctactaaaatacagcccagccccaagaaccacagtgtgtcatgtagccccagctcacagcatcaagcttagctgctgggcagctacagctctgcgtgtgggtgacggtgtagtctgtaccaatgtgcttgtttcctttgggcatttagttgaaccaggtgtgttttgatgatgacggcaccagctcaccacaagacaggctcactctctcacagttccagaagcagctgctagaagactatggtaagatcctggacagtcaccatctcctttgggggggtatatggcttaccattttcaatcaggtacagaccattatgcgttaagaaatatgcatcacttggatacttgagagactgaagcaggaatatcctgagttcaaggccaacctaggaaacagtaaaa

SEQ ID NO: 34009 - DNA, 1173 bp, Mus musculus
taactgaaggccccttctctgacgctggccaagggaagtgtttgaactatggaaggtcaattgcagatgtgctatagaattggagaggtacctcctgcagccaagggctcatccccagggcttgtcagcctgctaggctttatccggacctgacttcaggataggtgttcctctagaccctaatcattttctcgttgtgtctttgcctatagggaggtatggacccagaaatggaagaccccaaccgcctccccccagaccgcgaagtgctggaccctgagcacaccagcccctcgtttatgagcacagcatggctagtcttcaagactttctttgcctctcttcttccagaaggcccaccagccctagccaactgatggcccttgtgctctgtcgctggtggctttgacagctcggactggatcgtctggctccggctccttttcctcccctggcgtggactcgacagagtcattgaaaacccacaggatgacatgtgcttctgtgccaagcaaaagcacaaactaagacatgaagccgtggtacaaactgaacagggcccctcatgtcgttattctgaagagctttaatgtatactgtatgtagtttcataggcactgtaagcagaaggcccagggtcgcatgttctgcctgagcacctccccagatgtgtgtgcatgtgtgctgtacatggaagtcatagacgtgtgtgcatgtgtgctctacatggaagtcatagatgcagaaacggttctgctggttcgatttgattcctgttggaatgttcaaattacactaagtgtactactttatataatcagtgaattgctagacatgttagcaggacttttctaggagagacttatgtataattgctttttaaaatgcagtgctttcctttaaaccgagggtggcgacttggcagaggtaaaacctttgccgagttttctgttcaataaagttttgctatgaatgactgtagcagagactcccattgtcctggcaagcttgctgtgtcttttgtcactggagaatcaacagttgagctgctgattcttaagtaacccaaatgcttctttcctaaaggactgtttgtgccagcaagggacaaggctgctgcagaggctcttggtaaccagggctgtgcctctgtgtggcctcatttcccaccta

SEQ ID NO: 34010 - DNA, 1233 bp, Mus musculus
ctgcccgtcggctgctgtgtgcatcggcatcctccctggcttgggcgcctactctgggagcagtgactccgaatccagttcagacagtgaaggcaccatcaatgctacagggaagatcgtctcctccatcttccgaaccaacaccttcctcgaggcaccctagctcctgatattaccacagggagcatctcagagggttggatgccagttctgcctcggcatcacctccctcagaaaacttactcacctgcttcctgtgcacatgtgacattttaacctaactcagaaatgtgtctcagtccacttgtggctcaaactcggcttgatttctctttatactcctgtgcagatgaccaaacctgtcccattgatatgaggagtcggggttcaggcttgtctcagaaatgtcacggacagtgcaaggacaggcagcagctggcctgccagggtttggtgtaccttgttgctgtcttgtttatctccttacctagcagcacaggaagcaagggcagcgttagcttcatatgttgttgtagatgaatgggtttcttggttctaccatgttgtgtgtgggcatagagaaaggggctgaccagctggtgacatggagctgtcccctagaactaacccttcctgggtgttgtgtgacttaagtaaaaatctcaagcctcacccacaaggctgtgagccaacgacagcccttgagcagagactcttccatgtcctcccctctccatccagcctgaggaggtaggaaggagctgaccacgagaacatgaccatcctctgcccaccttctctctctgaaaaaatgttttgattttgtttttgaaataaaagatttagtttaagattctaaacgttagagaagcaaacttactgaatcatagccagaaactataactgctgatagctatgctaaagagatgagtaatgcctagcagtttctggaatcctcagactgcaaactagtgggacatgcctgcctgttatgcctgcactctactccaccgaagcactgctgtttgcacatacagttgtagcttctgactgcgaagctgcttttagccagtctgaggtgctgctcagtgcttttcctttctccagtgtgccttcccccccagccccctcaacacacacacaacagcgcctgggccatgagcagccaaaagcagcaggctctggcctgtttctgtctcatggaggatgaagggagggaagggggaggaggga

SEQ ID NO: 34011 - DNA, 1105 bp, Mus musculus
aaccatttgcaagggaactgtagaatgacagtaactcccataataaattctggcctactttgtgctatacccagtgtgtcccacagtggttgtggttgtgggtcacctctcaagggtactctgtggagtgggcaccctgtcccttcagcagtgtggaggcttctgttgtgctcgtcctttattggaagggtgcagtgggtgacacaggtgggtgggactattctacttgattgaaatggccagaatgccctttcaattttagtatttgccattttaaaaacaatgtctgagtcagtaatgtatgtatataattatttagaaaagggatgttcagtacactgagctgtggccccaagaaagcccaggagtctttattctttgcctcttgcctactgtcctagtttgcttctctgtctgtctggttcccaaccaaggcagcttggaggaggaaaaggtttgtcttctacttgcagttctaagtccattactgtaggaagtcagggcaggaactcaggaggagctgtggaggagcgctgcttactggctttgctttttgtttttaacagattagaagagctctttacatcttaaaagttgttagctttgtgatgattgttgggcgtattcttcaccactgcctcccctgcactgtagccgatgtctcccagacactgctcactttgccttttgagatatggagcacacttacctccagcagtttctcccttccctgctagagaggagcagacccccttagctgaaatctgtgtcttagacaaccaatggccttagcatctcagtagctctggattcagtgtcccttcctcattctcttgagtatctgcacacgtgtggtttggtttgtagaaggcagtccgcaaaaggaacgtccttcggtccgggcagtgacttccgacctctgagcttgggcatcactttgtacagcatcttctggtgcagatttgggttagtgttttatactctagcctgaattcttacaacttacttgactcccctcatcagtaagcagggagaacacccacatacaagttgttacagtgatcaaatgaggctggaaacattcagagggaggaaagaatggagc

SEQ ID NO: 34012 - DNA, 1175 bp, Mus musculus
tgggctgaacgtcaggtgggcctggctcttctgcttccactctttacactcgtgtcttgttgtcctagatctgccacctccctccttcatagacgggacttgactgctaaagcgccttgagtacctgagagtctccattagaatctgctttggaagcaagaacaggtaaatcaaggcagtgagatggcagctgaaagaaggtggcaaatcttatagctgtgaagcaggatgtgagctgagaacaggtgtggagcccagaaggcccatttgtctagagtgctgcgacagggaaatagcttccgtgtgacatgctgtggaacgcaatgtcagagtgatcctagaatctctcagtgactgtggatagcacagatgtgtgctgtctgataagccagaataaaccccacgtctccagtgccgaacataggtgtgcactatcacaccggtgtatgtggtgcagggatgctaggcaagcattgtaccagccgagctacatccctaccctgctcctaaggatttgaattgtagttctcctttgattttttttttttttttttttctgtagactgtaccattatggatggagaggacgatagtaaccttgtcatcaaaaagaggtttgtgtctgaggcagagctagatgagcggcgcaaaaggaggcaagaagaatgggagaaagtgcgaaaaccagaagacccaaaaggtacgtagatagacctagagttggacatcattcatttaacctttttctaaaaaacaataatttgtttttatatgtattggtgttttgcctgcatgtgtgtctgtatgagggtgtcagatgccctagaactggagttaaagacagttgtgggccaccatgtggttgctgggaattgaactcaaatcctctggaagagcagcaagtacccttaaccactgaaccagcgctccagcccctcatttaactctttaatcttcgcaaaaactctgccaagaaggtgataactgtcctcactagaggctcccagggtgaagtaagctatatgaattctccacagcagaaccagtactccgtatttaccctcctccccccaccatagcgcctgccaggagattctgctagttgcttgcttgctacaagtggaggggcagtttgaactgagatgctgctaataggtttgaactggctgcccatc

SEQ ID NO: 34013 - DNA, 1178 bp, Mus musculus
aagcagtcaactgtcaaaagaaaatgggctggcttatttctgctaccctataaagcgtatagcacagacatgtgattccttgagtgtatctctacaggtagggtctgattttagaagggtacggtggccagccagatgttaacgtagtctgccatcacataattcaactccataggaaaacagagcccattaatctgcatcacagcactagttacaagttccgtgcactaagctttcagttctaggatgatgatcactttgtaagttgggcacttttagaccttgcacaatctgctatgagacaccctgttttgtctccccagcctggaaaggaaatactgactccagtagaaacacagtactgcagtgtgtaacaggttaccctgccttgaagcataagatctttgttttttggctgttaaatgagtttgtaagccatggctctttttggagacagaagtctcactgtataataaaccaggttggcctcaaacttttcaatccttgaaacttgcttaagtttaaacagagtgatttttatttctaaaaaatccatattgaagaatgttgaatgtttctttttaaaaaaaaaaaagaatgttgggctgagtatgtagttcagcaatagagcatttacctagcttgtgagttactctaggtttgaccatcagcactgggggggggggggggagtatttggtttcatagttgaactcatttttcagataccttgaaacagctggacaaggaaagaaaagctcattttaatcagtcagtgtgtctgtctgtctcttaccctccacccctcacagcatctcacagtagccttgactgtcctagaattcgtcatgcagagagtgctgacctagaacttagagagatccttctgcctctgccctctgagtgcatgctggtactgaaggtgtgcgccaccacgcctggtgtatttaatcttcctagagttgaacataggaaggacaaaataggccttccatgtaaatcctctcagtcctgtgtcggtcctgatgcttagatccccctaatcctgggcttcttgtctgcttgtattttatctttatttattgtagcgaacaaaggggggaagtatagacttatgaaaatttggctaagcaataagaattaaaagtcagtgtaatttaaatcccataattctgtagt

SEQ ID NO: 34014 - DNA, 1510 bp, Mus musculus
acctgcggcactaggtcccaccttcgcacaaccggtgtgattgacatgagttcaccagaccagcaggctccgagaaacatgggctaatgatgacaggtgtatcctgcaaagaccctctgtgccacagccctttgttcatgtgaagtattgataagtcctggaaaacacgactgaccttgctggcccttgtccagaaactccttcccctagtccgctaccctcatgttccctgctccaggtgcttctgagtggctcctcaggcacaggcccgggttggccacctcacctgggggctgtcctccagcaacatggtagtgtagtgtgtcaacagtgtggagaccacactgttgtgagcccttcatcctgcaggctttagtgagtctatgttctcccagttttcacctgggtccccttcaggcctcagcctcaatggggcttttgtttgggcatgttgatctagggagttacagaccagctgtctgtcctggtttctgaatctcctgcgattacagcttgattggctgtggggatccaccgagagagctgccctctacccacaagtgaagaagaactcccgaccttacattagcaatccttttaccagtgagtgagtcctgctggtcttgatgtagccctactgttctctatgactctaagcattatttttaagaaacttatttttatagatgaaaactcaggctaacctagtgagtatgatcttggaatgcccatgatcaaccacttaaagatcaaagtattatatgctgtgtgcttcgtagctgtgagtgttgcgagtgcgaatgtgctttccgacgggttctccttgctgggcaccagaacaaagaggctgtgtgctagaagtggaccgcggctctgtcaggacagcatgcgaggtgtgcttgtgcatgcttgtgtgcagtccttcgtgtaggccagtgagctgggggggttattgggggtagggactctgctgtttgttttcatacaatctctcctgctaagttgatgctcccctgatccagctcagcctgggggtgggggtgggggcaggacacagatttctggtcctctgtcatctttggtggactgccaccaaacagaaagcatgtgtatcacatctctagaaagaagacgaaaacagttcaaaccctaatgcgtacttttgactttaacttttatagtaaacagactccgtgctgactttccatgtgaccattagactttaagggatataagctaagctccgtgtttttttctgtagctgtgtgtcatttagtacttttgtaaaatgagtaaaatttgaggtgtttggcaagaataatcacttgatgtgcattgtccattttaatgtatctactgacctccggttattgttgctttggtcttttgagatcaaaggccctctctgtaactgtcaactctcagtgaccttccccttcctgcccctcctataatcagggctgcagtcagatgctgaaagcactcagtaaggtttgctgctcagcctgcc

SEQ ID NO: 34015 - DNA, 1231 bp, Mus musculus
gtcacgaaataactgaaagcgagacggcgcggggatagggggcatctgacctgcatactattgtgtgtcaggcactgtgtgggcactgaagacacggccaaaacccggatcagaccgtgtcgctgcgggattcatctaagctagagtctgaaacaaaccagtaaccctgcaaatgggtcgctgaggttttgatcacctttaggcaaggggaccaggattttatgacgtcaaccgggtcagggtagcaaaggctaagcaccgttagctgccgcgaatatacggacctgattgccacgtaccataaagacacgaaggtggggatgcaaaaaaaaaaaaaaaaaaaaaaagcaaggatgctggcagatccgcaggaaacaaggatgaagggcacagtttctgcattcatttaaaagaaactgcaggtctggcgccttctgagttttctagcgagtggcgagtgccacctgccggtcattcgtagtattacatagggtgcttgctccgcccagtgcaaaaaatcccagaagctacttcattacgcatgcgcacattgagaggcttacaaagaggactgactaggcgctctgtttccagttgtcaggatggccgagcggtctaaggcgctgcgttcaggtcgcagtctcccctggaggcgtgggttcgaatcccacttctgacaagttgctcttttcttcataattcaatttatacataaagtgaattaggtaataattatcgactcttcataatatactcctcttcgtcgttttaaatgctattgtatactttttaaaactatcttcttactacctatttctttgatttgaaactgtaaaaagaattccaggagcgggggagggagagaatgattattcccactctggtgtctcaagcgcaggtctagttttcaaatttgcttttaatttttagagagaattactggagggggaaaaaaaaaaacaggaattctgtcagaagtgggattcgaacccacgcctccaggggagactgcgacctgaacgcagcgccttagaccgctcggccatcctgacatgagagttggtccttttcatgttcattttagttattggcactctgtaacaccaccgctgccacgccaccaccactaccctaccccaccatcaccccggtcgcacagacacatgcttgcttggcatctacagccagcgtttctcctgctttgtgcaatgcaatgtctacagtccagtct

SEQ ID NO: 34016 - DNA, 1216 bp, Mus musculus
ttatttgatataaacatttttgcattctgtttctatcggcctgcgttgtctaaaccaatggcttagacagttcctcactggtggtgacccctgaccataaaattagttttgttgctacttcataactgtaattttgctgctgttatggatcgtaatgtatgaattctgatatgcaggtggtcttaggcgacccctatgaaagggacatttgacctccaagacatcacaacccatgggtgagaacctctgatctaaatctccagcagagtgtcctatcatctgccccagtgtaaactcatggaaaatggtgtgtgtgtgtgtgtgtgtgtgtgtgtgtgtgtgtgtgtgtgtgtgtgtgaagagcttgggttctagatctgagtaaaggctatatcaaacatctagaacccaaggactccccaggaagtagcatggagtaagctgactcagcttttagaacttggaagcctaattgttcttcagctccactgaaacacactgcttgtgcataatacttacacacatatggatgtgcaaacatgctccatctcgccaagaatgaagggcagacggagctcagggatacagtggtgtgcatgagtttgtgctcagcacaacccctaaaaaaaaaagaactagccaaagctagcacaaagcctaaccaactccttgccccatcacctcctggccatgagtcactccacattgtgggaaaggaagcttgggctgcaggtctgagctgggtcatcaagaccagtcctagtagttcctggcctcactgaattacagtgctgtcttctctcccccaagaagtaggctatgaaagtcacaggtcagggctggggagacagttgagtagctaaagtatttgccacaccagcttgaggacttgggtttgattccccagaacctatgtaaaaaaacatgcatggtagtgtgtgtttgtaatcccacactggaggagcagaggtaggggctcactggccagtcaggagtgaccaatcactgagctccagatcccagggaagagactctgtctcaaaaaacaaggtgggtggttcctgaggaactatactacgattgatctctgctacccgcagactccttcgccctcctccattcctcagtagacctaagaatagctcagctgtgtccccccttcctaagtccctggtgcccactcctgcatgggtctctggcagatatcttcctggag

SEQ ID NO: 34017 - DNA, 1465 bp, Mus musculus
acagtggctatcagtttttattttggctgaccttgctgtgatctcctgtagcagaggctgcctgagctacctctcctccgtcccatgggcttccacataactcaggcaggccataaacctgcctcagcctcccaagtacgtcagtacagctgtgttaccaactctcgtggctggcgcccgtactgactgacgtttcatagaacaagagacccgtgggtgtacgcaggtgccctttccctttggcccttagcctctctgtgtgactgttgtttctccacagtgctacctgggtgacgctttccgctgtgccaactgcccctacctcgggatgccagccttcaagcctggcgagcaggtgctcctgagcaatagcaatctccaggatgcctaggagggacctcaagcccacacacctcctcctccagcaactcctgtcctcagctcctcccacggcctcctcccacctctggattcaggcgctctgaaaacactcacagggagaggcttgcagccgagcgagcgagcgaagctgctgtgggcagtggggtggggtgctgctgtgtcttgaaagaccaaggattgaggggacctgtctcttagtgttaggggaagagggtggatgcgcctaaggaactctgctcctggtgttacagtgctgtccctctccacccttgagtatttatgctgagtaagctccaggctccgctcagtgatgctgccacctgctggacttcctcaggatgtagttcttggagccatgggttagctgtcaaagggcctcaggggcaccaaagaagtcactcccccagttgtgatccatcttgtgtccctctgcctttctcacctcaccccgttttactgtagtgttgtatctgtgtcctgttgtcatttctgttaaatggtattaaacttttgtgtttttatgtctcccttttactgtgagtgtgtctttgtgtctgtgtgtggtagtgaagggttgtctgtcacccatccacattcagcttggactatgaaaattgtttttgaagaagtcatcgtcacacaggagtggggccagaactgcccactagctaggactaggatctgtcttcacctcctgtaggagccaggtggagaatgcaggttagggcaggctggaccagcagcaggaagtatcagagcaggaggccctcttcagtctccctcctgcctctgcccacatccctgttatccatcatgcctgctgttacctgtccttgttacttgatctgcttagctagcttctgctgctatgggtgtggtgaaaagccctttgagaagcagaatttctgttgaccccagtgacccttgccttgtgttacctcccctccaattacagcaaaccctgaaaacctctggtgtttctcttctgagtggaagaggctttgctaagtgaaagggttttacagatggacccacagtccctgctgattaaagttaattagac

SEQ ID NO: 34018 - DNA, 1156 bp, Mus musculus
tggttttgttttaaattatatttctttacttcttgtgtgtatgtatctagtgtgtgcacatgtatagaagtcatctgtccatgtgggtctcaggcattgaattcaggtgtcctgcttgctgtggcaaccttgggccttttctctgatgagccatctttatgtccccttttgttttggtttggttttctttaatttagagtcgttatagagccagggccagacaagactgccctgaaacttgtcctgctgactctaccttctaaatactagaattgcaggcatgtgccaccatgcccacagctttcagtgcctgttcctttgacatgaaaaaaaaataataacagtctattctttaaatacttactaagcaatgatgtgtagcaggcactgtgctagagatggtgacagtgaacacatgagagttcctcctcttggtctcggtccaataatatttttctttaaacttaaggatttgtttttattttgtgtgtgtgtttttgcccacatgtatgtatatgcaccatgtatgtacctgtgcctaaggaggccagagggggtgttgaatctcatgggacagatggccaaggtggttgtgagctgccaagtaggtgttaagatcagtgagcattctttttttttttcccttaagatttatttatttattttatgtatgtgagtacactgtagctgtcttcagacacatcagaggagggcactggatccctcacaacacatggttgggagccaccatgaggtggctaggaattgaactcaggacctctagaggagcagtgtgtgcccatgagagaacactttcaagtatgtgttcgtctaacctagtgtatttcacttatcagattgacacccagttccgtcagctttcctgtgaatgccttccttttgttctttacatctgaacacacttcttttatgtatacttgcaatgttttccttatctgttcacctgctaatgggcagaggagacaggatctatgccttgactgttgagagcagtatagcaaaaaacacgaatgtacaagcgtctttgtaaatgatgacttagcctccttaaagcacacaccaaggtgtgctatagctagacctgacagtagttctttttcagtttgttgtgaacctcaatactgatgtccacagt

SEQ ID NO: 34019 - DNA, 1645 bp, Mus musculus
tgacaccaaccaatatagctttggagggttaaacagaagctgaataaaactgaccttggtttatcctcagtatcttctcgaatgccccagctcttccctgttgtcatcaagaagcaattgctagagtagggtgaggcagggcagggcacacctgtattccatcactcattatgctaaggtggaaggataaaaagttccaggccagcttggccaaatggcaagctctccccaacccctaaagaagactgcctctgcctctgggcccccagtatgcttcagtctgtgtcctagctatacctgctgaacaccttgaacaccccagggtttcccattgtagtcttggagataaggcaggcctcaccactctctttaattctgttcctgtgttagctcaagaacctgacgggtctaaaccagcgtcggtgagagaagggaaccatgtgcctgggaggagcagcagtagatatgaagggctttgacaagatgggccacccattgaacaggatgttaatgagaacacactgaagaacttggagtcgtatgacagccacaaggctggaaatcacaatgcacttgctgccgttctgacctgggactgggccacttcttcagttcctaatgccaggcctggcctcctgatgccttttgcattgcagctgtgtgtttgaaaactgagactcacatccaaggtttcaaaccacaaaaccttggcatgactctgccatggtgtcacaggcatcttgatcatgtcttgaccatagaattgctctctaggagctgggcatggtgacctacgtctgtattctcagcactcaggagactgctacagcaggattgagagatcagaggcaggcttgtctttgtagagaattacaagcctgcttgagctacagagtgtgatcctgtcaaaatcccctgagaaatattcttaggggctcacaaccaaggtccggaggcaacacatagtgggagctcttccccagcacagggcagacagtgctcacaaacatttgccactggccattgtctctggatcccctcagaaagctgcctcccctaggcaggtgccttttggacagttgtgctgagcctggcatcacagacaccagcatgcacttcaggatcattagtgtatttagaatctgtaaaaataataaatatgtttgaaacaatttcttgttgttttgtctatgtgtggacgcctgacttgccagcaaggaagacgccacaacaggattcttctgcacacgtttattgggagagcttgatagagaaggcgaaagaccctgagccccagaactggcgctgcttgtataggcgtaggagtggcgtgtgtatacctgattggttgtgctttcagtacctcatttacattccccgggatgggctgtgacgtggcacgaaacccttatgcacatgcgcacattggttgtttacccgaacttaacagcggtagccagtgccatcttgtaatggcgtatgtggcttcccacatctatgtccatctagacaatgtcgagtatctaagtatcctcacacctacggggccaccatgacagccttgcatctttgggcacagtcaaatgagagtaatcccaggccatgcacttcttgtctgctcctagtctctgactacttgcaggca

SEQ ID NO: 34020 - DNA, 1166 bp, Mus musculus
ggagaccccgtgcccgctgagctgcaggtgcctcttgagtacatctcctttgtgggttgcagcatctccatcgtggcctcgctgctcaccatactgctgtacgctcagtccaggtaacgttttgtatgctcattgccttgccccactgctgatctgggtcttccctcttgccccagtgtctgcttccacgccccgggcaggtgggtgtgactctgaggaataggccgccagaagtaagccagactaacactgtggcagccattaggtcccttcccatttgcctcagtttccccatcgttgtgagccgggccatggtactatctgggtgatgtcctacccacaggaagcaaagcgattccaccacacgtatccacatgaacctgaatggctctgttctgctcctgaacgtcaccttccttctgagctcccagatgaccctgcccaccatgcccaggcccgtctgcaaggtgctggctgctgtcctacactacgcactgctcagcagccttacctggatggccatcgaaggcttcaacctctaccttttcctggggcgtgtctacaacgcctacattcgccgatacttgctcaagctctgcatgctgggctggggtaagggacacctatctcactggtctctggaacttccagggtacaaggtgctgaccccaagtcctcctgcctttcacgatgaccatttctaactccatctccatcaatgacattggctcccgcatcacctccacccccagcaccatcattgcttctgccgtcatggtcatgtctactacttcagctttcaacactgccattgccccaagtcccctgtccccactatcaccaccatcgtgtcccccctctgctacccatgactgctttactcccatttctacccaccccatctcaaccatccccatcaccttcctcaccttcactacatcccaccatcctctccgcaccatctttaccacatcagcaccatcacagacccctccatcactgcttcagcccatctccatttcctttcaagtttcccaaccaatgccacctcctgttagctccttaccacatctcaggtcaccattaccaccaccaccaccacctcggctgccactcagcctggcatctcattaacaccttagaggggagcctcttctgagacaaac

SEQ ID NO: 34021 - DNA, 1124 bp, Mus musculus
ctaaaatcttgtggttaggcatttcatcttgtcccctgtgaggcatgtgaaccgaggccaacaccaaccccctgatatgccacagtgtactgagtcattccgagtggctccagagccctgagtatatgactggacgccgccgcccccaccccctccaccccttggagcagagggactctgagaggggaacagagccagacgggatcttgccatctgataacccatgtgcctcactgcccacaggcttcctcatcttcctgtggtactggtccatgcggttccaggcccaaggcggcccctcccctctgaagaacaactcagacagcgccaaactccccatcagctccggcagcacctcctccagccgcatctaagccaccgccacacctcccctccgggaggacacatgcatggcgtccgctcacgatgtctgtggcccagtgctgtgcccacccagcctttgttggttagtggcatactagagaaggccctggtccttgaaggcgtagggctgttgctctggtaggtagatacctagcttgccttggggacgactctggtcctcaaagggctcagaagcacactgccattctgtttgtggggccgtttcagtctggagctaaggccttgtctttctggccacctctgggtccagctgttgctgctgggtgttgagacctgcagacccaagctggggttagatctcgaaggaggctgacacatccggcctgagacacagctaactgtcttgacttgctgctctgtctctgtggtcaccatgcagatcccgagggtggcactgggggtaaatgttctgggagaaggtttggaggcagagcaccttaggagctgagcatctcccccagcctttctgcaaaccctcctcttcattccccatccccaacccctcctctgtgttcccctaaccctccacctgaagcctggggtcctagaccaatgctgtgatttggggtggtagttcccagcagtttcctggtgccagctatcaacttctgtctgttgtgtgggctttggcctctgactcagggcaggtttctgtctgagccctctctccaagctgcctcacctttgctcgcacctcagagggacctccatctctcctg

SEQ ID NO: 34022 - DNA, 1177 bp, Mus musculus
ccttcccttgcctgccttgggcaagagtcagaaagctttactaaatccctggaaagggacagagggcctggccctagaggctcctagcatgtgctcctgacttgaggcccacactgtgtatataggagccctcaccttggtggggctcctctggtacctgattctacccaccttccacaaagcagtccagacatccccggtggaaaagggggcctggcccctcactgggtccaaagggggtggtggcagctgggccaatccctccccaagtgagacatctatcactttgatttcagcctgacagctggggctgcagtctccaggtaagtgggggtcagcggcctggggctgcccacctgctgcctgctgttggttcagggctctgccagggctcttgtacagagccagtcctgccttctgctgccctgtccatgtgcttctgctggcctcctgcatctgctaagggcaagcctcctgaggccagaggctgagcgctccttttctactttttctacagggaagttgaggccagtgcctgtgtgaagatgtgccacgctgccaggccctgtggcctggcgacctgctgtaacacccacctaccatgaatgcaggagatggaggctctcccgccctgcctctcctcagagatgagaaacatgttcagaaggaagcgagtctctgtgtggctctgggcacccaagcatggggcttctggaagggcagggatggcactctgcctggtggtaggcttgggagtctagccgttgctgggagggtgggctctctccccacctggcccttgggctggactgttctctactagttgagaagacttgaggaaccagctggggggttagggagagcaagagcatctctatctaccctcctgaggaggggagccctcacagggcatgtatataatgttctaggtgtatatagaagtcctcaccctgtcagaggtctgggctatatttatggctggcagaggccagtgtggaagggctgggttctgttcatctgcctgacaccaggcactctccctgcccactgattctcaacatgttcctctccccaaatcctatttaagaacttttggaagcttagccatttttacttattaaaatgaatgtctttttacacaagtgcaatctgaatcgtcagtactgggagaccctat

SEQ ID NO: 34023 - DNA, 1214 bp, Mus musculus
gacagtgagaggtgtggattgcagcacaggcctccgcaccacgggtgagagatgcacagtggccattctggtcaagccctccatcagtatctttggggcagcgctgacccaccctctgctctgcctgcagggaagctgaacctggtggacctggctggttcagagcgtgtgggcaagtcgggggctgagggcaaccgcctgcgagaggcacagcacatcaacaggtcactatccgccctgggggacgtcattgctgccctgcgttctcgacaaggccatgtgcccttccgcaattccaaactcacctacctgctgcaggactcactcagtggtgacagcaagacccttatggtggtacaggtgagggcctgaggttcagcaagagcctccccaggctgctggctccccctacccccacatagacccctaccaacatccccttttagtacacaagttcctccccatgttcactgcccacagtgggctcccctgaccagaaacaccctctggtggccatgctgctacctcctgtgctgtaccatgagctctctgtcccctaggtgtccccagtggagaagaacaccagcgagactctgtactccctcagatttgctgagagggttcgctctgtggagttgggccctgggtcccgccgcacagagctgggttcctggtcaagccaggagcacctggaggtactgggggatggatggggtgggggaggaggggagaggcttccatgagtgagactcaggctggtaccgagtagggaaagggcagacaggctggtgtagtgagagtagaagctgccacaaaggtgggtgaggccagagctcaggcgtgcttctgctttcttgagacggtctcactatgtagcgctgaccggcctagagcttgctttggagaccaggctagcctcaaactcaggagacctgactgctgagattaagggtgtatgcccgtgaccccttcagccatctttgtcttggagaccagcagttgcccatggtagatgcattttaaattgtagacaatgtttaattcctgtcccgtgacttctcagggcggcagggtcattagtcccctctgtagatgaacaaacactgtcagagaagggaagcagagtggttggagatgaatgagctggggcagccttggctcccacacccactggcatctctgctcacagtgggagccggcttgccagacaccac

SEQ ID NO: 34024 - DNA, 1147 bp, Mus musculus
agatggttctcatggatggagcattagctgggaggttgctgatgctagagctgtggggccccatatgccagcagcactggaacccgtggtccctgccccatgtctccccaggtgttccaggaggtgcaggccctcattacctcctgcatcgatggcttcaatgtctgtatctttgcttacggccagacaggtgccggcaagacatatacaatggaggtaggtgtttgcccagtgtgtgtgtgtgtgtgtgtgtgtgtgtgtgtgtgtgtgtgtgtgtgggcacttagggaacctagcttccttccatgaaatttgggtttccatagtgtatgctttgagtctcataaccacctcgtgctgctgttcttggcattggctcccagggaccaagtcttcacacgctaagttctccccaggagagtgctccattggctcccgtgtctcaggaggtagggcaggctgtcagaggccaggcctttatccttgcatagattccctgagctttcctgtgttctcctcgactctgctcaaggattcccaggatatggggatgaatgaggactggtatcagctcccagcaaggccctgggccatgggagagactggatacctgcacgactacagttgtgggaagctgggctctcagagaagggctttatccagggtgtgtgcccagagccagccttgtaaggctacttgagcagaagaattttgttttgctattgttttgagacatggtctccaatgtagccctggctgtcctagaactcgctgttagtcaggctgaccttgaactcagagatccacctgcctctgcctccagactgcttggattaaagatatatgttaacactcccagcccagagttgaagaatctgactacagagagaaatagaacattttagccctatggagtattgctttgttagtagttttctgactcactaggggctgcagtggactccccacataggactgggtgggaaggggcttgtcacttcctgctggtcaggccactgggcatcccctgttgtgactgtcccctaacacccctctccctaacccccataccctcagttctggttagcagggcagggcaggtgggctagaaaggggaaggctttatttagctctgtcttgggctgga

SEQ ID NO: 34025 - DNA, 1185 bp, Mus musculus
caaaggaggcatcatggtcattgtcctggtcagatagactcaatgtgtaccctcctagtcctgggagtgccatcctcaggtggggagctgtctgccaaggtgttacggcagatgacactgcaggggtgttgccctaagactgttgtgtgaaggcaggatgggctgcattgaggcttgttgtgaacaggctgctcacgtgttgatgactcctgacccacagagcctgcagggatagcacaaactttatttggggaaacttagaatcttttttttaaacgggtatggaaactgactatggtgggactgaagagtatgaattactgtcctctttctgtgagatgttgctctggcttccctgggtcccaggcagggctctttgtccacacctccttggtgaagacaccgctgggtcctgggaccagcgtgcttgccatcccagggcaggggtgtctcctcagcacagtccccttcacgagaggattctggttgtgtcatcagcaggccctgcgggacaaggggtgcgagagcaagagtcaggggacgaaagaagacgagctcccgaagaggcaggcgccggcccccaggcgggaccgggaggccccagaagctggtggtaccatgaatgtagaaaatacaggtaaaagaggtcagccccactgtgacacactctggctgagctagtgcaggagggagacctctgtcccacagctggaagtggctcagccagactggccacctgacatgaacttgagactctgtccagcctcttccagatccacggacaaccatgtgtctgtcccagggccacacccagtgataagagactttggccactggaggttgggttggatttcccttcttttttgtcttttcccagtacctacctaaagcagggcgcaagagcagcctcccagacgccaccgggtcccttcgccaccgggtccctttggcagaggcctggccgtgttctggtcagaggatccagaggtcagggatttgtttcccctccccccagactgagacacctaagcctgcagttccattatcctctgaccgctgtggcacctagagctagctggttttatttagaaggttctccgggctcctttgcaggttctgggttttcggcagtaagtactggccaatgaacacagggagagaacaccttacggagcctcaggacaa

SEQ ID NO: 34026 - DNA, 1119 bp, Mus musculus
tcagaattgcccagtgtactggactgcttttgtttgtggtgctctgggtctgactccccttaacatagctgtcatctccctgttgctggctgaaggaaatcgtggatgagtttgaagactctgagatgctgttacgtgtgctggccaaccaggtccgctgcaagtccgggaacaaattcttctccatgcctttgaagtgagccttgtcccgtgcctctccacaagccgactgagatggaggaacttgctgccatctgtgggatgccccagccaggagtcctaatcccacacttagtactgatctagtgggctgctcactctctcctggtccttaggttggtaggctgctactgtaatgtgctcatttccagaaatcaccagtagagggcagcccggacctctaattcttcctccactttcttaggaaagtcaaatgagcctggctggggagcccacccacgctcagtccccaccgaggtctctccactgcagtaatctatattgatgcccttggccgtcaaccacttttttagatccctgtgttctgacccacctgtgtcagactggggcttccgttgtctgtcagcctctctttaatctcctttatttatcacctcgtcccttcatcccgtcctgtgccaggagaggtcatttcagggccagggcacagggtgctaatttgtggtcagcagcagttttcttcattccttcctcccacttacccagccaggtgcctggggagagcccagcagatgcttcattttggcttggctatggctgctggccaggcctccaacacccatgacccctactttccccatcagctttcccagagatgcaaagaggcatcttccctccagccagagcacccctgcccctgttgctgagcatttttcaaagtgggggtgggaagtggggagagggccagggaggcattggagaatttattttccatcaagctcctaccagggcaaagagccaaacctttctagttgtcatggggatttctagtgatggatgaagaaatatttttttacagttttaaattatgttcaacaaataaaatctgcctttttaatgtggtgtcttattttaaactacttctactttaaaaggtga

SEQ ID NO: 34027 - DNA, 1123 bp, Mus musculus
tgcagtccttgtcccaactcttaatgacatggggcagacacacccactagggtaccagaggtccctgggcagtgtgtgtgattgtggatgctcagcaggtcacagaccaagcttatgggcttcctcccttccagattcctgtccccacacaacactactaggctcaggccagcagctcaccccacacagagtctgtggaacccccaaaggaatccactaaggcctgggaagtctgtcctaagggtgaaaggggccctcccttcctcttctcatcctggagtcagcaggaggcttctgtgggaaatggtactgtacagctgtggctctgtctcctctgcctccctaaagccttgagcagtaaagggctgccagccaggatcctctgggtcaccgccgctttccaagtggtggattcttatagcctggcactagaggtgacagatcggaggggcatgtcctgcagcactctagatgtcccctctgcagaacctgagagtcagcaaggggtggggcgtccacccccccactccccatcgtttagttctgtagataatcagcactgattaaatgtccagccagcgagcgtggctgcacttgtacgctcagacccaagcatgccgcaaggaagacctgcttggcagggtcggggccaagcgaggatgccgaggaataccctcctcccagtttggtaggacctttgggatggagtccaggaaggtcagggaagagtgggggggggggggcagtaggagtctggttgggctgaggtttactgggtttacttaacatttggtagtgataagaggagaggacagcccagcttcccaaatgactccacatctggcggtctggaagaaccagacaaggccgcccaatcgtcccacccacctggattggattttgggcagcctgagaggtggcttgaacaagaactcagggatgggtctggagagaattgtgtaacggggccactttacctccagaatcttccctccatgttcagagaataaaatgcactggaacctgctgccttgtctacaggggcagaaaatcccaccacagggcccaggatggcaggaactggggtgctgggggcctgggtgtggctggtgaactggggtgc

SEQ ID NO: 34028 - DNA, 1101 bp, Mus musculus
ccgctaaagctcaatgtggctctcattagggaggtcaaaagcaaagcttaactgtggggttttgaaagaaatagcacccaaaaaatctaatcaatagctacaaaagtccgaagattaaagatcaacaggtccatttggggagggaatatttaatattgaatgattgtttctgttttagtatctttgagcgtttagtgtgaagaaataggaaatcattctatggtctgagagcctgcaaactgtgtcatatgtcatagcagctgctgttgtcttgacaacaaataatataaacttgctccttccgggccatctgtcaccagttgtgacctgtctctggcctgtttattctccctggggtttggcattgggaatcaggctgtggaggctcaggatctggtcttaacagctatcctgagcttgagaacatggaactagtgtggccctcctctgggtgttgcaggtactagatgacaaaaacgttcgtcgaaggtttcgagcaagtaactaccagagtaccactcgagtcaagcccttcatctgtaccatgcccatgcggctggatgatggctggaaccagattcagttcaacttgtcagatttcacccggcgggcatatggcacgaactacatcgagaccctgagagtgcaggtactgcaccttccacacagggagtcccatactgggggctttaggacactctggttggctaactggctggcttatggcccatggagcagaacaatgtgaggcttctagccaaagtccccaaggtattgttcaggaggttttggcctcaaaaaaggtccagaaagtaatctgaggtctactcaaacgtaaggtaaattctacaagcaacctcccacccccagcaaaggtttttttagatttgtgtatgtgaatgttttgcctacaagtacatctgtgtaccatgttcgtgtctggtgctttagaaggccagaaaaagttattggataccaaaaaactctccacaggagttagggatggatgtgagctactgtgtgggtcctgggaactgaacctggatcctttacaaaagcaacaagtgctttgaccactgaagcaactctccagtcctttga

SEQ ID NO: 34029 - DNA, 1114 bp, Mus musculus
ggaataaactcaaggaacacacacacacacttcctttgaaacaaggtctctgtgtagcccaggctgcattgtaattcacagcagtctcctaccttagcttagatgagaagtgtacatcaacaggtgacgcttgggaatactgctctcaccctttttagtgacgtgtgtctgtgtgtgtgtgtgtgtctctctctgtgtgtgtgtgtctgtgtgtgtgtgtttgagacagggtctttctccatagccttggctgtgttgtaacttactagaccaggctagcctcgaactcacagtgatccaccagtctctgcctctggagtgctgggatcaaaggcatgcaccatcttgcccagctgacactagattattaatctttgaggacaaagaagctatgttgtagtaactttggagttttggcttctttgagaaacacagaaatattatgtggatgtgtgttcattttaatctcaggtctgggataggatgctgcttcagattgtccacagcagttgactgatttgtctagtgctctagcaggactgtgatttttgccagctgcagtttctgcaactgtgtaatgtttggaattctgagttcagaggatatataaatactaggaccctgaaaggtggactgttggtgggttgttggaaggtttgttgattgtggttttttaagtagtcatttgtgaagaagaagcaagaaataagatatcccgatggcgaagatcaaactggtcacaaggcactgatgctcctaatcagcaagtattagtctcctgataacatctcccctttccaacctctgactttattcagatcgattgatctccttctttctctcctatttagtgttagggagttgtagggtagaaaaagggggtgaagaagggtggaagaaagaagaacccacagagtagcagaagacagctacactatgtatgtatgtttgtgaatgagacacttattacttaacgctgttgttgatgtgctgtggggttgagtaatatactctgtatgaactttgctgttgacagagtagagagtaaatgttagatgaatctgaaacagggaggagtttattccaaacggcgggtacagggatactcccttat

SEQ ID NO: 34030 - DNA, 1796 bp, Mus musculus
ggtttgtacttgatcttaggctgacctttcccaaactgcagtgttagtggacctttcctgcctgtctcacatctcccttggtatatatgtaacatgtatgcccggcacagcttgctccagcctcctggagattttccctgggttttaaagagtgtgtatgagtagtggtgaggctaggaaatttacccatccagtatcctttttatattctttttaaactcatctcataattctcgtttgtttcattaccttattagaggtcaaaagtgcctatgacaaggacttaattatttcctaatgaaaagcaaaaaaaaaaaaaaagaccccacaaaaacctgtggggaacagggtagtgttgcactgtcatctcaggtatgcctgtgttgaagagtgcacctggtgtaataagaagccgctccaggcccaagttcctatcagtttctctccttggtatccacagggagtgcgaccgcaaggttgcctggactaaaagccatgctgagaatgagaagtgtgttggtgacagtttgtccttttcaggtgccagtcagctgacctgctcccgtccttgtaggtggctgggtagaagccaggcctggtggaccttaccctaatgtccatgcttcgggcacatgggttccctggttgaaagggagaaggtactctcagtccaactactgagagaaaggagctaggagtccctgaagcttagagaaggtggctggctgttgggagcaggtgaaaagatcctgtaaggacagtgttgtaaaggtgggccttaagagctcatacttctaaggatgaaactaggggacactaagttcctgttgcaaatgcctggagaggacactgcccctggctggggtcctgtggcccttgaaaggtagttgccaagcgcctcagggaaacaatctaggtctccaggagctaatgtgtcagcagagctacttgggggacaggaaggatagaaagagtttatatgtgcattgagataaatgtaggagccagttaactttctgttaacaccagttaagattcccagacaccacagggaagggagtttctaggtaagagctggggagaggtggttgcagaatgccagcccttctgaaagcaaaagcaagcaggtgtcttgagcacacaagaacctgaatttgtcagggagcttaataaattaaaactgaagtgggttctgtctttaaaaaataagcccaagggaggtggccaagagtgcttgcttttgctatggcggtcttggttgtagaacctggcaaggatggattatacagcagacgcatactttgtgtcaaccaatgtgctacaaatgtgacacttgaccctgaactgcatgtattggggatttttaaaagaaaaaacaaactttgaatcaataaattaacagttttttccacttggtggctcttcttgatgtaaatggtgaattggggacagaatcttgttatccagtggcaagtttggataatcttcaagaaccaaggagccttctgtttgcaggggaaaaaacactgcctgtgttgtggtctttttccaaaggaacactacaaacccagttcctccgtgtagccctggatgactgatgtggtgccgtgtcaaatcccattttcctaaataaagtttctgttgacaattcctggccttcccaactaggagacaaaccgttgcttcggaccttaacttgcattcaggggatggggatgggccataaacttggaacttcaaagacctgtggtggctgaggctgtcactctggtgtggagatttccttaggagtgaga

SEQ ID NO: 34031 - DNA, 1302 bp, Mus musculus
atgtgtgaaactacaccctgctttgagggagaaaaaaataaggaattatttcctgatcctgccttgatgcctggtttttgtgtgacctgagtcccacataaacgtgcatgtagaagaagaaaggcagattggcctcagtgctggtgctgatgtggggaacctgtgctttcttgcagacccggtggtgaaggagcagtcccagccttgtgctgagaacaccgtgctttccagtggtctcaccgcagcacgatgaagcctggggaatcgacggtaatgcggcactgatgcttgccaataaaaccaaccaaccaaacaaaaacttgaaggaaactacagtgtgataaaaagaaattctaatcattccttctaaaggcaaagaagagtaaagacctaaagtctgtcaaaagcaagaaactccccagtactagtctgcagggagctggctgtgcagtgtggcagagcgcatagttcaggatctgagggactctccctttggaatgcatgggagatgagaagctcggagttgttgtacacgtacctgcgtttaacaggataccactgttgaattaatccgttcggtcaacaagctctgaatatctgacttcctatctattccattgtggtctgattttctgtgagaattcaggctcaagttttagcaaaagtcagcagtctattctgacacaccagcctcatttacaaaaaaaaaaaaggattaaaacagtgacagtattttttttaagctcttttacaaattcatgtgttatgtatttttttatgacatgagctctccaggaaatgtacctcgttcctgcagtttgcttctaagtgtattcattgggaagcaaaccgccgttgctctcgccacgtcctctttggtgtcagaagatggcactgtaactctcgagatgccaagaacaggtcccaggctcgttagatgttccatgctgtgtgcatgacttggggctcacctttattgatttgcctaactattgaatcttgttgccttttttttttcctctctctctctctctttagctttttttccccctggccttgtaagaacctcacagtttctcagcacatctttgtgagggcgctacttcaatgctccactttaaaacaaagactatttttgttcactaccatagctatagctggaaagttagtcttcaggcaggtcaaagagggaggaaaacagttctattaggatttatttaggaaagacctcacgggtgtaaaaaggccgaccaccatcttccctcccctaaccctgtgacaaacaagtctggctgcagtcag

SEQ ID NO: 34032 - DNA, 1099 bp, Mus musculus
gacaaaatccagtttctttcccttttctaacaccagtattgatgttggttggttggttggttggttggttggttggttggttggttgggttagctggctggctgaagcaaggtctcacttgccgtgtagaccagagctggtcttcaactcacagagatctacctcctttagcctcctaaatgctaagactcctacttatcaatagaaaatggaaaataagccaggagtggacatggatatctctaatgacaacatcagggaggctgaggcaggaggatcattgagtttgaatccagcctggcaatcatgagatcccatggaagcagagagacaaaatcataatgttccaggggaaatgtttacttggttaaagcatggacttagtatttaacacgctggcttatctgtaagcatgttttacctgtgtgcatgcatttgtaccatgtatgtattgctgtctgcagagccagaataggggtcctttgaaactggagttagagatggttaagagccaccatgtggttgtcagaaattgaactcagaagctctggaagagcaatctgtgctcttaaaaccacagagccattctccaaagccctaaatatacctatttggatgacaaatcctggaaaactatgtttttaaataagaaatgtatagcttattttctgaagtaagttttacaataattattaaggcatactgaattttcaggtatagtgtagatttgtatggtttagagatttatttgtttgttcatttgtttgacatggtcttgctgcatagccctttctggcctcaacctgagtgctaggattatagatgtacaccaccatgcccagcttcagtcttcagtgcagtatgcaaaaggaaatacttggctggtggtcttcacacattgtcatatgaaaccatttgtttctaaagccaactctcttaaatctacctaagcatcgttgattgcttagtcaccaccaggctgtacttactcacagttgaaaagactgggccataagagtgatccaggaagattgaaccgactcccgctcagatgtagaagttttaaacagactctgtttgtccagtgattgagccgttt

SEQ ID NO: 34033 - DNA, 1125 bp, Mus musculus
ctagccctaagagatacacttggggccctccaactctggctgtcacagccagtgttagcttaataaccagttagagcagtgtgcagtgcttctgcctggagggagccatacatgtccttcagtgttgcctggagctcatgttaacagccgtgagtgatgggggagtgtgttccatatgtaagtagcatggaggcagaaacaaggttgagttctgatgatctggagagagtaaaagaccagggtaacttaaagggaaaaactcggaaacattccaagtgctccagaaatgacctcatctgcagttcttgaagtgtagtcttccatgggtacactcctactctatgtgatcaagtacctgttatagatacgtgctgtggcctcaccacaggcatgggcatgtccaagggcatctttcatggtctgtttcctcttgtctttcttatagctccgactgattgattggggtctggcagagttctatcatcctgctcaggagtacaatgttcgagtggcctcgaggtacttcaagggaccagagctccttgtggactatcaggtgagcgtgtcagtgaagctgctctgctctgcattaattttatattttcttagggattttcctggtttgctatgtagtcgatggattcatacaaaacccagttattattctactctataaagctttttctcaactacattaaattttttttcattatgtatgtataagcttacttgtaccacagcccacgtgtgagggttagaggggtttgttctctccaccatgttggttcttggcataaggattaggttgttggggttggcagccttggatacttagtctaccagctgagcctcttgctgccctttttttttttttaaggaaagaatgacttttagttataacttcagaaaggctaagaatggaacttgcctgataagtataagaccctagtgccttagaaatacgggccaatcttcaggagtcagatgagtactagaaactccatcagtacaaagagtttctagccatctttgactgatcgaccgtccttactgccttcagatgtatgattatagcttggacatgtggagcttgggctgcatgttagcgagcatgatattccgaaa

SEQ ID NO: 34034 - DNA, 1227 bp, Mus musculus
ggatctctgaatgatcagtaatgaaaggttccatgagtgtgttaccttgtggtcatgcttgacactgcagtctttttatttttttaatgccctattttatacatctttttttaaaaaatcaaatattgcctgtgattttttttttttccaacctggaattgtttggagaacatagcatagatttttggaaagtctcttgacatctccaaaattctcacttttcttgtttcttgtacgaaatgttttattcccctaacactactccaaattccctggagtagttctccaggtgtgctgtgtcggggttgggctcagcttgctgtgcagtagaatatgtgcacagctcaacaacagacctcacagcagtgtggctgtggttattgaaattgaagtatttcctgtcccagaactccttcctttccccatctctactgaaggtagaaatgttggactccttatctttgctattccaggtcaggcagtgaactcctgggtgtccataatgtaagcgcaaaatttgcaggggaaggccaatgtttagaatatcagaacacagtcagactaaattaacttctgctttctgaaatctgtttcagcaactctaccagatcctgactgactttgatatccggttttatatgtatgaactacttaaagtaagtggcgtttgttgatggtgctttccccctcaggcttgtatttttgagaggatgttaaaaaatacagagagaattcaagcagaatatttcttaatagagaacttagtgagacttaagttctgatgagaatcctgttgtgagacctcacagattttcaatcaaacttggaaatttggccaaacaaggagtgcagggccgttatacaaagttcacaacccctcgtgtatgtctcttattggcagttggagttttttttctttgccaggtaattaatcttagttttatgatttagttttagttttatcttagttcttagttttctctatgacaagtgacctcagactttttttttaaatgccttttcaattgcttataatttgatgagatggcctggtaacttttttttttttttttttttaagagtcagggctgcctgactgagacaagatagtctgggttgggctcattcatgtgcctgtgtgatgtgggctggggttgctggaatagttgaggtcctgccttccaagtaacagtaagagaatgggaacctcagcctgcagcctgccaa

SEQ ID NO: 34035 - DNA, 1146 bp, Mus musculus
actctgctctatgcttcgcaacctaccccctgttatgtatattgaatatagcataaaatttaagcaatgcaaccatttataagcgtgcagtttgtggcattaaatgaattgataatgctgttaggaccactataaccatctatctgcatagttttttttatcttgtaaaactaaaactatacccattaaatgatggttccccagtcttctattccccagctcctagcagccaccatttgttgtttgactgtcaggtatcgcataagtgaaatcataaatctggcttatgactggtgtatttgacttaacctgctgcctatatgcatacgatacagtttagtttttgctaggcaagcctgtaatgtcagcacttcagagttgagatagagggaaataccctaagttcaaggcaaatctaggcattagtgtaagaccctgtttcaaagaaaactaaaaaggaaagaataatttctttccttttggagaataaaagtaatgatgggctttggttttgggttttttgtttgttttgtttttcgagacagagtttctctgtatagccctggttggcctggaactcattctgtagaccagactggcttcgaactcagaaatctgcctgcctctgcctcccaagtgctgggattaaaggtgtgcgccaccatgcccggcagtaatgggcttttatatatccgttcatcagtagccaacactaagctgcttccatgtcgtcaccgtgtgacctgagctgctttgaagacgggcatacaaattcctctttgagcctatgctttgcagcttttgggtatcttcagaagtgcaattggtggcttatatggtaatttatctctctctataaatggcatctcttaagttgcccaggctggtcttgagctgatgatttgcctcagccttctgagtgcttcgattgtaggcctgtgccaccattcctgactgcttggcttctcctaagatgttttcacaggagctgatccattttataatgtccacagcaggatgtgaggagtcttctttgtatcctcagcagcatgttttctgttttaatgatgttttcttttttgagactaaatctcaccagctagctagcccaggctggccttagacatgtaaattttccttgtacag

SEQ ID NO: 34036 - DNA, 1167 bp, Mus musculus
aaccgactcaaaaaaaaaaaaaaccaacaaaacaagatatttaaaaattgttagacctgtgtcaccatgcctggtttatttcattattaaattttattcttttgctattatgtgcgtgtaggtacatacatgccacattagtgtggaggccagaggacggctttgtgatgctggttctacctttacatggattctggggattgaagtcaagctgtcataaagcttgtgtgacagtgctcactcactgagctgtcacctgtcccttggtattctttcttaccatgattaatgtgcactttttttttttttttttttttttggtttttcgagacagggtttctctgtatagtatagccctgggtgtcctggaactcactttgtagaccaggctggccttgaactcagaaatccacttgcctctgcctcctgagtgctgggattaaaggcgtgagtcaccatgcacagcaatttgcacctttttaaaataacaataaaaaaccttttattggggactggagagatggctcagcggttaagaacactaactgttcttccggaggtcctgagttcaattcccggtacctctcaaccttctgtagtgaatctgacaccctcttttggtgtatctaaagacagtgacactgtactcacagaaaataatgggttttttttaaagtctttatcataaaactcctcatcactgaaaatacctcgcagcaagcatcatttttaacagggtctaatattccactatgggaaggcaccctaattcttttatatgaccccttagcctggaggatataagttgttttatactcccaggcttgaaaaggatggtgttcatgacgagtttctttggaaggatggtgactaaatctgagaggggctgttaggaaactaactttgtgagttcagatgctgactgccttcttgaggtggtggtcttggtttcttcatctgcagaaaaggaagtcctcaagttcaaggccagcctggtctacagagtgagttccaggacagccaaagctacacagagaaaccctgtctcaaaaaaaaagaaagaaagaaagaaagaaagaaagaaagaaagaaagaaagaaagaaagaaagaaagaaagagctaaaaaagaaaagaaaagaaagaaaggaagaaaggaaggaaggaag

SEQ ID NO: 34037 - DNA, 1861 bp, Mus musculus
atgatgcccgcttacctgcccccaggtcccactgccatctctgcaccggctcatcttccctttagttttatttttgtgagagtgaaggggaggaaatggggttacttctcttttatttaaaaagaaatgaggggatccaccttgggacagcacagcacaacagtcttagatggtgtgaggggctcgccttacacactcctgtctcactcagtgtggcccctcccctctgcccagctggggcgtggccaggatagttagatacagtactgaagaaagcccagcccagcccctggatctggcagatgtgaggtttgaagatggtgggtagtgagctaaagctctgatgtgagtgggagtcagaccagtgggcagccttggaccttaagagtgtccctttcctgtaacccttgcatcaagcacacctattctaatagtagaagtgacagtcatgaggatggtagccacaagagggcgctctagacagacagccattttcctggtgctctctgggcaggacaggtggtgtaaggccagccaggctgaagaatatggagaaccctgacatgggggcaggaacccccataccctgccaccacagggccttgtcccaccctgaggcaaaggtcacctggtctcttgtccctgttggcagaggttaaaatgttgattgctgtgtatgctgtgtgtagcccctgagaacttcatgattacccatccctttggaagctggcaggtactgtaggtccctcttgtcccagatttcaccaagtatttgtcacagtgccctggtcaacttgggccagtgtgtcacagacaatacttgagaagtgagcttgttagaaagacacagatgggaagatacaatgacctctgcttgctggaggggctggagattgcctggcccttgggtgggaaatgggccatcctcaaacaaaggttccatgcctcctacagcccacaactatgcccgccatctcaccaagtaggcgctcacagcctggccattggtttcatctgctctcatccccagagaggagagaaagcactaagtgtgtatatggggagtggggatgatgtatgtggtattgtatgggtgttctgaggcaagaggacacccacatccatttatctgtggcacatgccgcccctttctgtaactgtaagccatttctagactgctctggagtccagtggagtgtttcctatccccggttcagttcactcacgtgcttccgtgaatactgaatgtgactgtttagaggtggtagaactaatcccttactgtagatagcactccaagtattggacatctttttgctgtgttcttaagatatctataaatacctatacattatatatatatatatatgtatgtatatcaggtcctccttcctgtatgtggtttcccattggtagttgtcttctctttggtcaagatgaacttttaatggagttcattattttcctctctgtacaaagttaagagcctaattttgtgtattctgtttggtggctgataaagagactttgagattacaaaatgcaaaacaaaaatccttgatatagaaagttaactgtgcagaaaaactaataaagaaattaagtctacgtgtgtcgtgtttcctatcacagggaaggctcaactgtttaggctgcctggctgccccagggcgctgatagttggaggatagtgcctgttagacacatttggttgggggagggttgagcaatctttctgtagcccaggctggtcttgaatactcagcaatcctacttcagcgtcatgggtgttagaattatgtaggccaccctgcttaattttttttttcctcttagggtgataagagattgaaccagggtg

SEQ ID NO: 34038 - DNA, 1310 bp, Mus musculus
tcatgtaggaaaaatttcacctattttcatatgctaaattctgagtgcattcagggaaaggggcaatgaaggcatagttgtgaatttgtttttaatgtattaactaactcttctatacccctttttagggttctcttggaacggttgattgtaaataggccacatccttggggtcttcttatcaccttcattgagctgattaaaaacccagcatttaagttctggaaccatgaatttgtacactgtgccccagagattgaaaagtgagttaaaatgttaattaccaagcagggagacagaaaagaatgtgtctaatttgggtctgtgagttaaaagggcagttatagctaattcagattaagagatctttaggcttaaagtttgttgtgaagttaattggtgcttgtctccacttcttaggttatttcagtctgttgcacagtgctgcatgggacagaagcaggctcagcaagtgatggaggggaccggtgccagttagatgaactgtgtatatcccttgcagatgcatcagccttggtccgctgaaccaagttcataaactgaagattcctcctgactttcctagccctttggttctcaggggtctgccccaccaactgctggggttgatctcctgtctatgtgggcaagttccaaagtttaaatgcattttttttttgactcttggccaaaatttagaagatgctgtgaatatcattttgaacttgtgtaaatatatgaaagagaaaacttttgtctgaaacttcttgggtttgtgtaaagtgtgtacgtatgtaaactaccttgtaacaggcagttgatggcatgctcttgtctcaagcatagcagcatgtcttccgacatccatgacattccaaagattagcaaatactgaattcatgcaatttttttttaaaacgtagctaaggaagcttacaaagccacataagttataagtgtagactagatagaccagggggttctgcttgcctctggaaaggtagttgacctgctttggtggtcctaagggagaacatacccaaagaggaacatctctggcctgcgattctgcttcaccttgtttaggctgtacagcctagttaaacaacaaaagtcaaaaagactactacagctgctgctttttataaggatcaggatcgtaaatgttccgtgaacagctaggcccgtgttatattttgtagcctttgtagtttctgggccttaatcagctttcatgtatgtgtgaagacggtaaacattaaagtcatgacatgcatatgagtccactgtgcctttctcagtagcagcag

SEQ ID NO: 34039 - DNA, 1155 bp, Mus musculus
tgttagagctcaacatgatgaaatgtggagagacgtccaggtttctatacctttagaaaagccagtggcctttattgagaatatagaagtttggtccagtaacaaatttaaaaaacaaaacaagacagaaaatctaatttcccttttgctggctgccagcatagaaatttgtgtctaaacagcatgtatcctttcctttattgtttgtagtgcttacagagttcagggtaaataagccactgctggtagtgcaggcctgactgagtgaggaggtaagaacatcacatggaacttgtaagttcaaagccagtttttggacagcttagtgagactttgtgcaaagttttggtttttttgtttgttttgtttttgttttcttaaaagcctgactataatattcaagtgttaagtactcagcatttgggagggcctaggttcaatccaagacacaggtaaaagtgacaagtggcttatctgtgtggttgatgggatgtaatctgtatgttctgtataggttctcggtatagtagtgggagttctcctacaggatcatgatgttcggcagagtgaatttcagcaacttccgtaccataggatttttatcatgctgctgttggagctcaatgcacccgagcatgtgttggaaaccattaatttccagactcttactgctttctggtgagtgttgtgtatagtagagatttctatttgttattttatacagggtctcatagctcaggtttgatctcaaaagttcctgtattgttgaggctggccttgaactcccaattcgagcgtccaagagttggaattgcaggcacacaccccaacacccaacttaatggttgatttttgtaggtgtcagaggttgtgctgggatcacaggcagtactttgctgaaatttcagggctgttggttaagtgaggtaaaagtcaggtagaactttgatgttttgatgtgtttcattgtaaagtctacatgtgtttactatatttcaatttgtggttctgaatttttttttttttcagcaatacattccacatcttgagacctactaaagctcctggctttgtatatgcttggctcgaattgatttcccatcggatctttattgcaagaatgctggcacatacgccacagcagaaggtgtggct

SEQ ID NO: 34040 - DNA, 1340 bp, Mus musculus
tgcctattttttttcaaacaatactattttgtttttgtttgcagttgtctttttattattgtttttacttatgtgtgtactccaactcacgttattgatttttcttttaatatttatttatctatctatctatttatttattgtatatgtgtatgaagagggcatttgatcccattacagatggttgtgagctaccatgtggttgctgggatttgaaatcagaacctttaaaagagcattcagtgctcttaaccgctgagccatctctccagctcccgcagttgtctttttaagacatctttgtatagaacacatagctaatatggttaatacggttaaaatgctgtttttttgggggggcctcgaaagacttgactgctcttgcagaggaccctgattcaaatcccagtattcacatggcagctcacaactgtctataactcccaagatctgacactctcacatagacatacatgcagacaaaacaccaatgcaaataaaaagagagattaagaaaaatgcccttttttaggtgcctaattgaatgtcgagatgaatataaatataatgtggaggctgtggaattgttaattcgaaatcatttggttaacatgcagcagtatgatcttcatcttgctcaggtatggaagaaatttaacttgattgaattaaaggattcaggaagtgcttttgttttttaattattactctcttgaatttgctgtgttgccagtcgatggagaatggcttgaactatatggccgtggcgtttgctatgcaactggtaaaaattctgctggtggatgaaaggagtgttgcccatattactgaggcagatctgttccataccattgaaaccctcatgagaattaatgctcattccagaggcaatgctccagaagggtaagaatgaagtgctctgctctcctgtacactcagcagtctcttaagagcttcagaaattagatacacactagcataactcgtgactttgtgactttcttaacctataacataattttaggttgggccaatattgtccttaaagtatgaactcgtaatccactgctgccttcctgattcaggagagctgcacatacagtgactgctgagtggcagcagaagtcaccgtgaacactggctctgttaggctgggataaacctcagggagtgaagtgctttcagggtccttgggaagcccaagtcctcagccgccagtgtactgatacaaacttgtaatgccagtgctaagttaggcacaggtggcatagcctaatcagctatggtgaggtcctggtgagagacttcctcagaaaacaaagtggatgaatcctgctgaa

SEQ ID NO: 34041 - DNA, 1099 bp, Mus musculus
gtagctgtacagatggttgcgagccaccatgttgtttctggaatttgaactcaggaccttcagaagagcagtcgggttttttaaccactgaaccatctctccagcctgtgtgcaaatgttaaaatcaagaaattaaatgctagtatcctcatctaattcttttaaacttcaagttgttgcttcaagttgttggagtaatgctcttttagaatcatacatttcatgtagtggttctttgaaataaccccctgaatttcctcatttgttctgggattcacccagggccttggatgtggtaactgaatgctctgctgctgagctacactcagatttttatagtacttccacttactccagagtatggatatgattttgtgtatgcattcatgaagtgtgtatgtgtgcatgtgtggtagacaaaagactgttctcacttttcacctttttttgaaacccagtctcttcatttttcactcctgtgtgccccaggctagctgtcctgtgcgcttccatgaatactccttcatccattttccaacttactgttagaacaataggattacaggcacatgccatcacacccatccttactttcttctagagatgtgaactcaggtctgcatggttgcagggtaagcccttgacccactgagctatctttccaggccagtagcaggtttttgataggaaaagcacatggccatgtgtggcagcacatgccttaatccagtcagtactcagaaggccgaagcaggcagatctctgagttacactctagtctggactacaaagctggatccaggacagccagggctacacagagaaagaaaccctgtttcggaggaagagaaaaggggaagcacagaagtgatgtgtttttattttccagttatggtttaaaatttggtggaagtattgtatttgaaccttgacacacgttaagttgcagaaggctttctggatggtacacgtgcagtcttttccattgttgatattatgctctctgatcacttagttgtgttggtgatggccaggccttttcaacaggtctgtcctggctgtgaattacccccacataataatactaagactgaagaac

SEQ ID NO: 34042 - DNA, 1155 bp, Mus musculus
tgcatgcatgtataagccacatgtgtgcctgaggcagcagatctggaaatggagttatgactattgtgaagctacacagtgggggtgctgggaaccatagcccagggactctgcaagagcagcgagtgcttttcaccagccagccgtctgctgatactgccttcctaacggataatttagctataactttaacttagaaagtcatatgtctataagcaagtactatttgtttaatgagcttgttaaaattgaaggggattaaacagataaaaacagatcacaggttatactgacttcttttcttcctaggttctgtttcctggggctttgttagttttatgtgaactctgtggtttctgtagcattgaaggagtaccagagtcagatgtgacttgtgccttgtttcctccttccagatccctttatttcaagctcatcctcagctgaagcagtgtgtgcggcaagcaattgaaagagctgtccaggagcttgtccatcctgtggtggatcgctcaattaagattgctatgactacgtgcgaacagatagtcagaaaggactttgccctggattctgaggagtctcgaatgagaatagcagctcatcacatgatgcggaacttgacagctggaatggctatgattacttgcagggaacctttactgatgagcatatccaccaacctcaaaaacagctttgcctcagccctgcgtgtaagcagactgttttgtgtactataaaatgtattactggtctgtaagagcttgggcctgtgctgtgtgtgtgtgtgtgtgtgtgtgtgtgtgtgtgtgtgtgtgtgtgtgtgtgtgtgtgtgtgagagagagagagagaatttgaatgaatgtgaatgaatgaatgagaatgagttagggcaaactccttagcactgaaggatacttccagcctctggcgtcttttagattctaagttgtgttaaggcaaagtgttgcgtttgcttcttttttatgtagttctgtgctcagtgttacttgtcagatactcagcagtacccaagagaagaggactttttttttttttttttttagtttggagccagcatctcaaacatagatgaatttagattacagcagttggactaatagtttataatatatagttactttacttttatc

SEQ ID NO: 34043 - DNA, 1142 bp, Mus musculus
gctcacacaataccaaaagatcagagctttattcttgtgcacatagagctagttgaacaatcttccttagttggtcctagattattacacattaagttaggtgaagaggctgagtggatcagctttccactccgttttgtgtttttctggaatgggttgtatctaagaatggggcttttgtcactgtcatgtttatttacttgttggaataatacagagtaaaggtttgatttaggctgccttaatatcatagctcttctttaggtttttagaccaccaaacccctggacaatggcaattatgaatgtattggctgagctgcatcaggagcatgacttaaaggtaaaagagctgcctctctcagaggattctgggccttcagatgatttaatgtaaagatagaccagtacagggggtaggcagtggtcattgcaccagtggattgaattgtaggatatattatggacagagctcaaattttctcttattctaattaaatactggaatcatgcagttaaacctgaagtttgagattgaggtgctctgtaagaaccttgcattagacatcaatgagctcaaacctggaaacctgctgaaagataaagatcgtctgaagaacttagatgagcaactctctgctccaaagaaagatgtcaagcagcccgaagagcttcctgccatcacaacaacaagtaagtgcacaagttcatcagatccttctcagatgacaccactcctcataagccacctagcaaccaccccacactgtgagccatctgattatcaagtgtgagcagcatctaaggataggcttactagatcgtctcactatctcttaagataattttaagcaattatgagtagatgagttgttcttatatcatagcctggctagcttatcttgcaaaacatttaagtatcacagtacttgaatgacataatagtatacattatttcttaaaatccagggtttgccagatcagtcatgcctacaaggacaatcttatctgcatcaagacaagaggtttagaggtacagggctctaatcttaagaaactaaaggcaagaggattgtgcatttgaggacaacttaagctacatgagtttgaaccagcctgggaccctgtttaaaaatcattcca

SEQ ID NO: 34044 - DNA, 1299 bp, Mus musculus
aggggcggttttcaaactcagaatatcagaatgttagtttggtaactgtcacttttacttgcccaatcatcttactggaccaagaatctaatcatttagacataaccctatgtaagtatagtccctctttaaaataggtttttctgtgataaggaacaatactcagtatttttgtggcatggcatcttgttgacttgtgtctatgcatgtgtgagttgtgtctatgcatgtgtgagtgcgtgtgtgaccacttctttcttatctttggagactaggtacaagttctcaggtctctatccttgtttttaataaatggtcttacagaaaaactcattctgctggttgaatgtcaagatatctcgatttcagtcctatttgaaatagctttttgttctgggatcctatgtggtataaggccaaactcttatacttgttccataaagttcaactattttatttctaatctaccatttatttttaaatatgaagctttgtaaagaaacagtgcaaaccggatggagatggggtctttcatttctgagtaacttggggctggcttaggaactagcactatatttaaacctatgtatgggaaatttccccattcttggttacgctgtagtgcaaaaagaattcctggctccttgtagcacagctgactgatgccattttgctgttgctttatggagttaagggacatgactgtacagcttgcgttatcttttctaggaaggagttctgtagtctttggaatttcctacgtactctgaggcaaacaacaaccattcatttgtttgctttctctgtcatgctgggattcagattcagggtcttagacatggtagatcagtattccacctcgtgagctctttaaaacctgtttcaaaggtagtatcgacagtttgctaatgcatgcagtaagataccaatgggatacacgggataggtctgctttgggtaggtgctcagaattgatttcttttagagaggccagggaaactctcaaatacgaaattgagaatttcttttatatgcttattcacttatttataaattctgtattatcgcaggtgctgctgacttctgataaagctgcggccaatttctcagatcgttctttgctgaagaacttgggacattggttaggaatgatcacattagctaaaaataaacccatcttacacacagtgagttttaagatggatatatgttttgaacttggctataagaaatgttttaattgtcactgggattttatgtctttgaccatgtttgaattcttatttctgtgctcgtggt

SEQ ID NO: 34045 - DNA, 1068 bp, Mus musculus
aagtaggtctttttgctttccgaggatctgttggtataaatatgtagtagagaatttgtacattattttattggaagcataaagatcagcatttctccctatatttcccagagagcactatgcaatataataattcagtaatgggtttaatggtcttaccagtgtagtcataccatgtttatttttcatgctaatggaaatctataatctttttaaaatgttttatttattgtctttatatcttattgtctagtttgtatgtctgtgtgctatgatgtgtatggaggtcagaggtgataagcagtcctctccttctgacgtgcaggtcccagggattgaacgtaggctgggttatgaggcaacacttgccagcacttctgttttctaggattttccaatgaaacacctcggcttctttaacagtgcatattattacttctagccttctataaatacaacaaatatcgatacattgcttgtggccacagatcaaactgagaggattgtggagcccccagaaaatattcaagagaaaattgcttttattttcaacaatctctcccagtcaaatatgacacagaaggtaagcatgatgtaatgacatgaaatgccctctccttctccttgatgaatggcgggattggttttttgttttgttttgaatccagtaagtcaggaagctgccgtgagcatcaggagtctgagactagctttttctgtcacagtggtaacagaccctttctaaaattaaaagcccacaaactcagtcgaaaaggtatgattttagctgggtgtggtggcacatgacttcaaaaatttttttaaagattatttttataggaattaaacagtatccttagttacagtattgttttgcagtgagttgtagccttttgaaatagtgttatgctctcctgagaagggaagtgttattttttttccttctttgctttgagacaaggactcattaactagcctggaccagcctggagctcactgttaacccggatggcctctagattctgtctgcctcccaagtgctggggttaaaagtacataccaccatgc

SEQ ID NO: 34046 - DNA, 1092 bp, Mus musculus
tatgcccccccccccccaaagttaaaaccatattagtctttctagctttctgggggaattgaaagactatgacttaacaattaactgatagccttttcctccccaacagccgacttgtctcaggtgtggccagaggcaaatcagcactttagtaaagaaattgatgatgaagcaaacagttatttccagcgaatatataatcacccaccacatccaaccatgtctgttgatgaggtgagtgtctaggatccctaatttcttgtgtctttatagactcgaaataaggagactttgaaggtttttagaaagtctcttaaaatgttgtaatcttttgaaattttaatgtttgtgttaagctcttttttgtattggtaaatgcttttcgtagcaagtcttataaggcatataaggaaaattctcggtaaagttacttgtatgtatgtatgtattgtgtttatcttgcttttctaggtattagaaatgctacagagatttaaagactctacaataaaaagggaacgagaagtatttaactgtatgctgaggaacttgtttgaagaataccggtttttccctcagtaccctgataaagaattacatataacagcttgcttgtttggtggcataattgaaaaaggactggtcacttacatggcattgggtctggccctgcgatatgttcttgaagccttacggaagccttttggatccaaaatgtattattttggtattgctgcactagatagatttaaaaataggtgagtagttacactgacacttctttctctcttgttccccaacctgcagtgagatttggtattttcccttttcagccttctttggtaatatcttttttgtggagcagtagtgtatattacacacaatgcatacatttcaacattaaatatatactgacctatacaactaagtccactgtttgggcaaagtaaactggttttctgtttatttttatttgtttgtttgttttaagcagagatattgactttgtttaatttgaattacataattttaagttacttttaaaattttgattggctctctcccagtctggcctggaaatcccaattctcc

SEQ ID NO: 34047 - DNA, 1228 bp, Mus musculus
aaatagagtactcccttaaaaaactgaccaagcaaagagtagattttttttttaatagacatgtttttaggacaggaattagaaagtagtacaaagaaatggctattactggactttgcacgtttctctttaggccctgtcgatgctgctgaacggcactccatttgcttttgtcattgaccttgctgcactcgcttcacggcgggaatacctcaaacttgacaagtggctaacagataagataagagagcatggggtaagcagtgtgcaggaaatgttcatttctttccaaaactggtatctaaactgtcttagaaaaaaaataatataaaaaggatgttagggaattaaactcatgacctggtacatgctaggcaatatccccaccctcaaaagtaccccttttaagatgatatctaaaatgttggtctttgtagatggtagttaattgtgtttagaaagtttttaaaatagatgtaaaatacactgaagtcttttctttttttaggagccttttatacaagcatgtatgacttttttaaagagaaggtgcccttctattttgggtggacttgccccagagaaagatcagcccaaaagtgctcaacttcccgctgaaactctggcaacaatgttggcttgtctgcaggcttgtgcagggtaagaagaatatgcttggggctacttggaaattgcgttattaccgagacactcaggaggtagacactgatggatcattatgaattttgaggccagtttattttagtcttgattgaattcatgacctgccaggtatgtggaaaggcactgtcttaatcaagacaaccaatcaaaaattatgtctaatcaccattggtccaaaagtgacattgtgagaccaagggcaggtggccacccaaggagagtagtgagacctagtcttgaaagaaaagaaaatcttatggtttttaatcccagggcattacagtgttaacagtgtgttgtagcaccactcttgaatgagaatgttggctttctttgacctatcttctttaaaaaagccatgttatatgggtttatttatagattaattcttctgtgaaattacataaatgacttcttattgctataccatcctgtcttaattaaatcacccttttgataaacactgaaattgcagctaattaggtgccttccaactttttttttttaagttccttgaatttttatgagactttcgaggtcattt

SEQ ID NO: 34048 - DNA, 1147 bp, Mus musculus
ttgatagaactttatcatatgaagtatgtcttattaatatatttatttaggatatttagcttttgtgaaatctcatttgttttttcattccattcataaaaatcttggtagtaaagaaccaatgattattcaaattacttattggttgttagtttcatttcttttaaaattaatctataggcatagcagcatgcccccttccaacatacccaatgcattctgaaaccaaggactttacacatttaggcaagtgttttcctcccttgctgtagcccctgaagcatgtagttttaaaaatccacagcagccacttaagaatattctctaataccaaggcttggtagaaatgtgatgtgggtagttaaattctgtagtggatgtcacctcgtctggagtgaatttgaaggctagagatatagctcattatcaaagtgcttttaaggacatggatttagtgcccagtattcagggaaaacaagggatttttaaagatatagttaatattgtcagtgatctcaagcatttcctcttcgtttttcttaggaaaagcttggatttgattgaatctctgctgaggcttgcagaggttgggcagtatgagcaagtgaaacaactcttcagcttccctatcaaacactgtccagacatgttggtattggccttacttcaaatcaacacttcctggcacaccctacgccatgaactcatctctactttgatgccaattttccttggaaaccatcctaactctgccattattttgcactatgcatggcatgggcaggtaagacaaataagcagttcttcatttcagttattgacagtcttaaatcttggagtttcctgtttctagtgatggtgtagcagttaaagactgcttgctgctctttcagaggacctgggctcagttcccagcatccacgcagcagctaacaaccatccataacacaagttctcgggcagccagcatcctcttctgacctccagtggtattaggcatacacatgatgcccaaaacatctaacaatcacataagataaatttaaaaccgaaaaatatcagtgttctaatagaccgatttattatcatcaaacatgtttttaatcttagatcctattgtcatttctatgtagatattaaaatttag

SEQ ID NO: 34049 - DNA, 1158 bp, Mus musculus
tgttttgtttttcaagacagggtttctctgtgtagccctgactgtcctagaactcactctgtagaccaggctggccttgaactcagaagtccgcctgcctctgcctcccgagtgctgggattaaaggcgtgcgccaccactccctggtggtggcggttatctttttatgtagttcttgacctcacagagacctgcctcctgagtgtcctgccacacccagccctaaactgcttggttttgagaatgagcttgcagaattgggattgaagagattttagaggaaataacaggagagatttccatttatgtgttgctgaacattgcacccaaggcctcgggtatcatatggagtatgatgtgctgcattcttagcctcgagattgttgtttttagttgcttaatagttgcattctctctctctctctccagattttccccaagagcgctgtcctgtggtgcttgcaccacttttataccctgaaaaacgggacattctaatggacaggattttgcctgattctggaggggtagctaaaaccatgatggagagctcgctagctgacttcatgcaggaagtgggctatggcttttgtgcaaggttggtaggaagacataccagattctaaaatttaggaaccatggtcttggtttagtcactgggatagtcctattttatcatcatgcacatactttactattttaaattaaatttctagaagtaacatgaaaaggatgggtacattttcaagggttttcaagtattgagtaaagagattcacttctatatgcgctatttgttttgatgttggtaagagaactcagctgagaaaggtgttgtgtttcatctttggaacacatttgatgggaggagagagtagacttgagccaagttgtcctgatatccacacaaaacagtatgcatgcttatgtgtatgctccagtgcgcgcgcacaggctgtaattttaaaaatgaagttaattaatactaaaaatggaagttacttttttataaagttttatttattattataaataagtacactgtagctgttttctgtcacaccagaagagggtgtcagatctcattatgggtggttgtttttaagctaatgattcatgtttctagttgcataaaagtaaaacaaaacattaaatttc

SEQ ID NO: 34050 - DNA, 1208 bp, Mus musculus
tggagttcttccttggctttcaattagccatttaaattcctacaagatgcaacctgaagtataactgtgggattgtacagttgtgtgggagtcaagtgaggcagtggagtcttgggaatgagtgtatcctgtgggaaggcactaaagggaggggagtttgctcacaccctcaggctgagtcggaagcagtctcagacacagccctgactcggtgtactcctggtgctctgcagttgttagatgatattgataaaatagagatctcaaacgtttccgattgttttactatttactaaatttaaactcttggaagatttgtctttggaagatttagagatggcatttttatcttcactggtcaagacatcataattatttttaaaagtgtccttaacattttaaatgaaagttatttaacctttcccccacaactgaattctggaattttgtatttatacaggtgccatgtttcagaacagagtaagacacttggtaaagaagaactgaagacatttacagataacagagatagcctaattacaaagaaagcattaacctgcctctgaggtgactaaaggggaataatggtgattttgcgccgggctcggccgcctgcttccgccccaaccagcaatgaatcttgactcgctctcgctggccttgtctcaaatcagctacctggtggacaatttaaccaagaaaaactaccgagccagccagcaggaaatacagcatgtgagtactccttcagagtgtaacagcagtgaggcaaaacaaagagccggctgataccaagttggcaatttatgttactaggttgtgtgacaggtcatgacttctgcttctttgtgttattttgctttagaactgtacataaaagaccttatatcagtctatgggtacgttcacagcttttaatttttctattgaacaaatatgaagccaagtatgcatttaattctagcacttggaaggcagaggcaggtgaatctctgtgcatttgatgccagtctggtcagcatactgagttcttggccagcgagccaaggctccataaagaaaaatctgtctgagaaacaaacattaatagcaaaaaactcagtaaagaaacatgatctcactgggttcagtctagttccacctttttcctcttcagcattaagagggaatggctcagtggataaagtacttgtgttcaagcgtgaaga

SEQ ID NO: 34051 - DNA, 2042 bp, Mus musculus
tccttgggaagcctggctcgccttgcctccagaagtaagatgactgattatcttggctgctacagatatgagcctgaagaattaggggaaaaaaatgactgaagcattctcttgtcctctgccctacagctggtgggcactggtcagttacggagtccttctggtcacattgggagccttcatcttcggccagaccacagccaatgccatttttgtggatctcttggcctgaactctgcttccccagaaacatgaggaccgagcatcgctcagagctgtggagctgcccaagtcccacgtcccattccagccagtgagatgacatgtggactcctttccccatggacagtcatgagacaatcagccgcagatctgtggacggctcccgcccagctgccttgcatcctgaccccacgttctcatggatggaggtcccatatcacaggagcttcttcccctttgctcggatctccacttcaagcctttgggacttgaggatggagagggtcagtgggtctcagaagagagagtctattctgacttccctctggaaaaagaacaacaacaaaaaaatgcatctgcagagggctggcgtcctccgcggagcgtggcaggactgtgctcagtacctcggggttttgtgcctgcccatgtctctcagaagccagtgacaacttctcctgggacctggcaacttccaaaggagctgctgacatcatataaatgtccaaattcccctcttggtcccctatgagtctctggtagcttcgcaagtctttgggctccctactgtgactttgtccaaacaaagtggtccatgttgggtttgcttctgctgtgttcccggacatcaccaagtctaatgtttacaaagccagcctggcttcggagctaggggctgccatgccacggtgctctgagcactcctccgttagctctttatgcatgggcagagggtctgttgtctttttcagattccagataagcccgtcttttcagaggtttagggtaggatcttttagaccatccttccaggcagggatgctcaaggtccgggtgaagttctgcctcactcctccaagcctgtcctctctcttctcccgctaaacccagccccagaacccagaaggagttagactggggaccctggatgtttcccttcctgtttccatctttacccatccccacatggccatccctctcccccaaccctatctcttctctttcttcatttgtgggttttgttatttggtgggggggggggggggtgtggcgccagaccctgtcacaccagcttgcctggctccacacgtctgtcaagcctggcctccatgcctgggaatcctgctgaatcatacccaccccaggtgaggtcagcatagacacttctctcttgactgccttagcttcgaacctacccctgctcacttttgtaagtcccaagtacagaattggtctttataaatctattctgtctaaaacacttatcctaggagtgaaagggacccttcccagcagactaccccctgcccccaacacaggtcagtcctgttgaggcaggaggcttagcatccagacttgctgaattgttgttctcccatccatccctggtacttctggtcccgctacactgttttcccctagccccccaacccccataagcctccaagtgctgcctttcacagtgaccaatcacagagctgggcatggcttagagacgtgctagctgggacagttggctagaaccaggcttcagcttgtcctcaggacccccttcctccgtcccctttgccctctgtatccagtttcttgctggttcttttctactcaagcacacttggagacgtgaggatgattaataaagggacttacactgctaaactgtgtctcctttatcttctgctttggacagagtctaggccataaatgtgtaggtgatactctgactatccacaaccaggaatggcaccagtgggctctctcaccagagcaggagtcttcaggaggctctggacgctctttttctgttccctctcctgaat

SEQ ID NO: 34052 - DNA, 1193 bp, Mus musculus
cctcttctggtatgtctgaagacagctacagtgtacttatataaatataataaataaataaatcttaaaaaaaaaaacaagagggagagggagggagggaactggaggatggctcaatgcttacaaatgcttgctgttcaatcctaaagaccagggttcagatccagcacccatgtaacaaaccaggcatcctgcaaactcctgtaactccagcttcaagagatcttctgtattcttctggcctccacacatgcacctatacagtgcatgtaacactcacacaggcgcgtgcgcgcacacacacacacacacaaataggaaggttttggtacttggaagtataatttaatagcaaaccctgtgcttgtcatgtgtgaagacctgggttcaataccctagtattgcttccccaaattatgggggtttaatgtacatttatgcaatgggtaacctgaattacttatataattcatgtagtagtgaaaggctttagaagaaaaagtgggagtcccacgcccctaattgggcatatccctaatctcggtacttggaagcctgagacgagaatacttgtagagtacgaggccagcctgagctacatgagttcaagctagcctaggctatatagtgaaaccttttctcaaacaaaacgttggggtgagtttcttctcttacagcccctctccgcttacccttctcctaagacatctctgttttccctgtgggctgtaatctaaactggttttgtgcttgtatgtatcttgactacacagagctatgcagtgtagacagacataggggtttgcgtgtgattttgttgtttgaggtaggaaggttgccgggagtttaaagccagcctggacttcagagggagaccttggcttaaacatttaccacatataagtcatcggatgagggaaaagcacattgcttctatatatgtatgtttccctgaataatagttgagggaaagggggtgggttcatattttaagaaaaattattccagagctgggaatgtagttcaatgggctagtgcttgcctacaacatacaagaccctgggttcaatccctaccatgacagaaaggggagagagatagaggaagaggagagagagagaaacatatctctttttttcgttttttcgaaacagggtttctctctgtagccctggctgtcctggaactcactc

SEQ ID NO: 34053 - DNA, 1953 bp, Mus musculus
cctctgcaagagcagtcagtgctcttaacctctgagccatctctccagcccccaggagtcggttttctccttctaccatctaagttttgataataaacttgggtcatcgggcgtgataacaagcaccttgacttgctgagccatctcacacaccccagttcctactttaaaactttaaaatagctttttattctcttactcttaaaaaaataaaaatccacacactaaattctatcttaaagtgaaaaaataaaaaatttaagaagttggctattgggtgccctgtcaaagctggaatataatatcctcaccagaagtggttgtctagctcttttctttctgcaggtagagcggctgaccaaggagttctcggtctacatgacaaaggatggccgaatctccgtggcaggggtcacctctggcaatgtgggctaccttgcccatgccattcaccaggtcaccaagtaattcccaggtgcaaaggaacagagaccactttcccgacagcctttgcgctcgtgagcgtcacgtgcagggtgagggagggtgggtggtggtgaatagatccggtttccaaccacggtgcataactcagcgactgaactcgctcctcggaagagaggtagggcagaggcttcctcggctggtatctggaacttcgtcggctctaaaccaaactccctcatccttttgtctccagcttttctgaaagtttacacacgcaagaaaaatcacagcaccaaacacctgtcagccatggcactggaataggtcagacgctttacctaaagcctcaggtggtatcaggggctcccccgtggaccccagtagagcctcccctaatagaggctataagagaaaaataactagttctgtcattaacagttgtcctcaagttcgtcctcttggtgtggagcaaactgtgtcagcagaccacattacagaaattatgctttacaaaaaccaacaggtctgttgccacttcaacagggacagtagaagatgtagtgtcgtgtccgcctgccccttgtcattgctgttctagagcctagagtctcatcccgttctactgcaaacatccgcctcagcctatggggggagttacataagaatggagagcataggttttctgctcctgcatagcctcctctctcatcaaagagccgtggagagagagagaccctgcccttgatttcagagtcctcttcagtcattgattgattggctcctactgggatggggcctctgcccagctggacctcttcatccatcctggctgcacagcctgtctcttcacatgagtcagacgtgcagggtaggatcagaaggagatactctggggtttgtgtgctgccagcccggctcagactccgcccttgggaaagataaccaccatctgctctaatcatgtagacgtactgccgcctggtttctctgttacaataaaattactatagacccagccactgtctgcttttctacttactgagaggaaggggtaagagtggatatatatattccagaagtctgaagtcacggccagctgactgtaaaccaaattgtatcaactaccggaagtgcatcttgctcttcatcctgcctttcagctggttctgggccataagtgtaattcctcagacatcaggagactggagttatctcccaaaggagcctatggaaggatagaggggtagacgtgactccagctgtctagcggaattgaattcatagctaaataaaaggtgacaggaaccagatctaggacaatcatgggctaccagcccccatcctcggtgtggaagattagtaagggagaggctggcactgtgacatcaatatgctaggctggagccatccgttttagtaaaatcctaatttgggagaggtgagctatgattcgggactttattccaagacctgaggatgttacctttgcccacccactcccatctt

SEQ ID NO: 34054 - DNA, 1198 bp, Mus musculus
tatggtttcagagggtaagtccctgacagcagagtgactccgtggtgaagaatacctgagagctcacaactcaatctgcaagtgagaggcagagaaacacacttcctccaacaaggccacgcctcctaacccttcccaaacagttccaccagctgggatggagtagtcgaacatatgagcctgtggacattctcatccaaaccactttactaataatccacatataaggaaacctcaaaataaatacaattttatttcacaaaaatgatattaaaatataaactagtaaaagttatttctgttctatgatacaaaatgtcaactattccacttatccttaaacagtaacttcatatggaatattaggcttgccaagtggccagtcccggctgagcaggaagaccatgaaggcccaggagttcataggcagcccaaatagcaacgtggcctctgacatttacttcagaaaccgtttattgtcatttcagtaggacgagggcagaagaaaaaactaagacttatgttttcttgtctaggcagaggcccagattgctgcaaaaaatttggacaaagaatacctgcccattgggggactggctgaattctgtaaggcttctgcagaactggccctgggcgagaacaatgaagtgttgaaaagcggccgggtaagccagcgggtcgggcttgagcttgatacgagaaatgttaactcagttaatatgtgtgtaatggtgaccacgcttactgataggaagtttaacgatatcgattatcttgaagatttgacagaatttgaccgataaccttggccctgcttggtggtggtgttgatgactttcgtgttttttataccgcattttgttacaaatgcctccctgggcctataattagtccccacaatcatgtgttaagcttccagcttagacgggagaagcagccatgagtatgggggcagggctggtatggctgtcctctgctgccctgtcccagggcatggacagagaggccgtgatcctaaaataaagacactgactgtgggttactttctttttgtaagaaaaagggaagatgtggcttaatggacatactttcaaatttatttttctgcctaagatttaaaagcatgaagtattaatatctcactagtggaatactagcctcgaatgtgtaaaagccctaggttcagtcctcagcacta

SEQ ID NO: 34055 - DNA, 1196 bp, Mus musculus
agcttaaaagtctaatttattggttaaacacaaggaaacactagtagccataacttaatagaccagatcaccttaaataaaatactcttataaaaacttatagtaatgtgatatctctctcttctttctgcatgtgttaatattttattacagtatgctgaatgtactcatttaatgaagcacttaaaatttctctttggcataattaaatgccagtatcactattctttcaatttgtgtccagtattaagtaaataaaatctccttaaacacaagcatcatgttactaggacaaggttttttaacgaccaagtagctaatggacaggttgtatgtatccacactctagaaacttggaacaaagaaaaaaatccataatctgattgagacagaggagatagtgtgagatttcaccacaatttcaaaacagcaagaagtttaaacttaagaattattcgggcatcgcgcgagggacgccgccacctcctcccacatagcagccctgtcctcccgctcagtcgcgcaggttgaacccaccaaagcgatggttatggagaagcctagtcccctgctggtcaggcgggagtttgtgcgacagtactacaccctgctgaaccaggccctggacatgctgcacagattttatggaaagaactcttcctatgcccacgggggcttggattccaacgggaagccagcagatgcagtctacgggaagaaggaaatccacaggaaagtgatgtcacaaaacttcaccaactgccacaccaagatctgccacgtggatgctcacgcaactctgaatgacggggtggttgtccaagtgatggggctactgtccaacaacaaccaggctctgcggaggttcatgcagacctttgtccttgctcctgagggctctgctgccaacaaattctatgttcacaacgacatcttcagataccaagatgaggtcttcggtggctttgtcacagagcctcaaaaggaatccgaggaagaagtagaagaacctgaagaaagacagcagacaccagaggtggtgcctgatgattctggaactttctatgatcagactgtcagcaatgacttggaggagcatttagaggagcctgtagtggaaccagaaccggagccagagccggagccagagccggaacctgtgtccaacattcaagaggacaagcctgaggctgcat

SEQ ID NO: 34056 - DNA, 1826 bp, Mus musculus
aaaataccagcatctgcaccattctcattaattaacaattcttgaggtaattttgtgtaaaataaaatgaaataaatgatatcatatcactgtatttctaaaataacacccaaaggcacttattttattattttggttctatgtcgtgctttgtttgtttggttggttggttaattggttgtttttttccagacaggatttctctgtgtagccctgtctctcctaacactctctctgtagatcaggcttaccttgaatttacagtttgccttccgggcattcacacacacacacacacacacacacacacacacacacacacacacactcacacactcacacagtctctcagctgatgttatactttaaaaaattcactttagaggcctctgcggcgcggtcctcggagcggcgcggttctcggagccacgcgtctgtcttcctccgtggtcatggcggactacctgattagcggaggcacctcttacgtgccggacgacgggctcacagcgcagcagctcttcaactgcggggacggcctcacctacaatgattttctcattcttcctgggtatatcgacttcactgcagatcaggtggacttgacgtctgctctaactaagaagattacactaaagaccccattggtttcctcacccatggacactgtcacagaggctggaatggccatcgcgatggcgcttacaggaggtattggttttatccaccacaactgcacacctgaattccaggccaatgaagttcggaaagtgaagaaatacgaacagggattcatcactgaccccgtggtccttagccccaaggatcgtgtacgcgatgtttttgaggccaaagccaggcatggcttctgtggtatccccatcacagatacaggccggatggggagtcgattggtgggcatcatctcctcaagggacattgatttcctcaaggaggaagagcatgaccggttcttggaagagatcatgactaagagggaagatttggtggtcgcccctgccggcgtcactctgaaagaggcaaatgagattctgcagcgaagtaaaaagggaaagttgcccattgtgaatgaaaatgatgagctggtagccatcattgcccggacagacctaaagaagaatcgtgattaccccctggcctccaaagatgccaagaagcaactgctgtgtggggcagccattggcactcatgaggatgacaagtataggctggacttactggcccttgctggtgtggatgtagtggttttggactcttcccagggaaactccatcttccaaatcaatatgatcaaatacatcaaggagaagtaccccagtctgcaggtcattggaggcaatgtagtcactgctgcgcaagccaagaacctcatagatgcaggtgtagatgctttgcgagtcggcatgggaagtggttccatctgcatcacccaggaagtgttggcctgtgggcggccccaagccacagcagtgtacaaggtctctgagtatgcccgtcgctttggtgttcctgttattgctgatggaggaatccaaaatgtgggtcatattgccaaagctttggcttttggggcttccacagtcatgatgggctccctcctggctgccaccactgaggcccctggcgagtacttcttctcagatgggatccggctgaagaaataccgaggtatgggttctcttgatgccatggacaaacatctcagcagccagaaccgatacttcagtgaagctgacaaaatcaaagtggcccaaggagtttcaggggcagtgcaggacaaggggtctatccacaagttcgttcct

SEQ ID NO: 34057 - DNA, 1208 bp, Mus musculus
ttatgtttgcttaaatagcaaaaatcaacactaaatgtctaaaggaatttgtaatttgagacctagtatttttacacaataaacctgctaaaacaggctttaaaagacagcaaaataagccatatgtagtggtgttaagactgtaatcccagcactcaggaagctgagacaggagaattgccgggagtacaaagtcaaccggagctaaataatatcagccaccaggactacataacgaaagattgccacagaggaaaggaaggaagaaaaagccagcaatcaaccatcatgtgtttctgtagaatcagatgtaataggaaacatagtttcagattgcttctgacaaagtctgtgccacattcctcacagcaggtgttactctttaagaccatgatagtggagtaagggaaagagtgagatgtagcgctctggatgcttaaaaagtaagtgcttggatttaaccctaaagtggtttgaaattgggaagaagtgtgacaggatacagttgggctaattatgcaatatttcatctgtttaattttctaactctgtattgttcctaaagacggatgaatgagtctctgtggtgttgcctgctcattgtgcatacccttggtagacatttctcatagtgtgtacttaaaaagtgcctgacattgatttgtgttgatttctaagtccatgtaataaatgatacatgttttctaaaaaaaaaaaaaaaaatggacacattttaaaattaggtatatgacaaatctagactttctagacgtgatatttgtatgtgaaagggagggaagaccattactttagaagtttataaccaccctttcagtttttaacttatatgaatatgggtggttagaaaaattttgtactatagagtaaaatagaaaaatgcattatttagaaaataaaatatctagcctcagcttggaaagtaatgtaactactaatacatgtaattttcatagtttaattgattaattaattgtaggaagcaggtgctgctgcaggccccgtgaaacccacttgtttactgccttgcccgagcatgcacagtgaggctgcatgcgtgggctgtctgccaggctggactgttcctcgtgatctggacttgtcagcctatctgtgaatgacctgagctcatgcctgaagtgtgtgtgaattctgattggatgaggtgggtggagctagatgaggtcagt

SEQ ID NO: 34058 - DNA, 1148 bp, Mus musculus
tgaaatccataaaaactgaatgtatttctatacctttattttataataattttaattcatcaatgcatgcctctctaggatggcaaatggagacagaatatattctgtttctaaaaccaggttagtaggcagaagaggcagtcctagtagcttcaggatagctttatgccctgattgcagcagccccacagaacagcagagaccaccaggagttcaagtcacatgcaaatacaaagattctttattcaagcttgagctcagaccctccaacctcttcaactgcagtggatgggtgtagaagacccacaaactgctaaagctttgcctttttatcatagtttcagcatggtcagggaccttacaacttagcagttacaggattggttaaagtttgagaaattagctgggaggtggtggcacacgcctttaatcccagcactgggaaggcagaggcagccggatttctgagttcgaggccagcctggtctacaaagttagttccaggacagccagggctatacagagaaaccctgtctcaagaaaaccaaaaaaaaaaaaaaaaaaaaaaaaaaaaaaaaaaaaaatttttttttttttgagaaattacatcctggtgcattcctgttgactagcagtgatttttagcttgttatatacaattgtggctaacttgagcaatctattttgagatacctgggacattaggtattttccccctaagagctgattggctgtcactaagggtagactagcttttattaggaattgagattgttgctagggggtctcttggttcctgaaacaaggtgttgttgttgttttgttttttgtttgttttgttttgttttgttttgtttttcagtttctgagttcagcctgagaacaagttcacataagatggagtctgaatacaaaatggtgttcataagtgttaggctgggcccttcagatagtccaacagtccttacaagcttcaaatccagttgcaccttattttttgtaagtagtcactcttcctatgggatatcaatgtagataaatcccttttgccattctttgttactcagagggaaattgctggctatcagcttgaaggaagaatctactgttaggagctgaggtagccatggattttagaagatagctct

SEQ ID NO: 34059 - DNA, 1798 bp, Mus musculus
gtggacagccatgctaggttcttgtttgcaagcacaaaatagcaataataatagtgtctgagtttggtgccggcccagagtggttgtaccagcttgcaatcccaccagcaatggaggagtgttcctttctccccatcctcaccagcatcaatgtcccctgagtttttgatcttagccattctgacttgtgtgagggggaatatcagggttgttttgatttgcattttctgatgactaaagatgttggctgctctctcgccaggcgtcctcgttggagtgacatcgtctttaaaccccgcgtggcaatccctgacgcaccgccgtgatgcccagggaagacagggcgacctggaagtccaactacttcctcaagatcatccaacttttggatgattacccaaaatgcttcattgtgggagcagacaacgtgggctccaagcagatgcagcagatccgcatgtccctccgagggaaggccgtggtgctgatgggcaagaacaccatgatgcgcaaggccatcaggggccacctggagaacaacccagctctggagaaactgctgcctcacatccgggggaacgtgggcttcgtgttcaccaaggaggacctcactgagattcgggacatgctgttggccaataaggtgccagctgctgctcgggctggtgccatcgccccgtgtgaggtcactgtgccagctcagaacactggtctggggcccgagaagacctccttcttccaggctttgggcatcaccacgaaaatctccagtggcaccattgaaattctgagtgatgtgcagctgataaagactggagacaaggtgagagccagcgaggccacactgctgaacatgctgaacatctcccccttctccttcggcctgatcatccagcaggtgtttgacaacggcagcatttataacccggaagtgctcgacatcacagagcaggccctgcactctcgctttctggagggtgtccgcaacgtggccagtgtgtgtctgcagatcgggtacccgactgttgcctcggtgccacactccatcatcaatgggtacaagcgcgtcctggcattgtctgtggagactgagtacaccttcccacttgctgaaaaggtcaaggccttcctggctgatccatctgcatttgcggctgctgcccctgcagctgctgccaccactgctgcccctgcggctgctgcagcccctgccaaagctgaagcaaaggaagagtcggaggaatcagatgaggatatgggattcggtctcttcgactaatccgtcaaagcaaccaagtcagcctgcttaatttgagaaagatggaaataaaggcttacttctcttaaaaaaaaaaaaaaaaaaaaaaaaaaaaaaaaaaaaaaagatgttggccatttctttaggtgcttctcagccatttagtattcctcagttgggaattcttatttagctctgtaccccatttttaatagggttatttagttttctggagtgtaacttcttgaattctttgtatatattagatattagccctgtatcagatttaggattggtaaagatcttttcccaatctgttcattgcctttttgtcttattgacagtatcctttgccttagagaagccttgcaattttatgaggtcccgtttgttgattctctattacagcacaagccattggtgttctgtccaggaattttcctctgtgcccatatgtttgaggctcttctccaccttttctctataagtttcagtgtatctggttttatggaggtacttgatccacttggacttgagctt

SEQ ID NO: 34060 - DNA, 2534 bp, Mus musculus
gtgccgcttgcttaggtttggagcattgtacgtgagccttcaccgtctccatttcctgaggagatggcttcactttcttgggtggagaaaacatggcaagacatgcagttgttggggacatgtggtgtgttcgtggagacatggggttgacaccctctggcacttggtagtcttgatggatattaacttgtcttcggagaaagtgtattttggccctgttgatctcgactgaatgccaggtaccagtcttctctaccttccctgccaaaggctcagagggtaagactgcagtcaagaaaacctaaagatatgtattggctcctagaaagggcaaacacagtgaggtagtgaattcttttcagagaagttctgcttaaggagatagccatgtaatgcagattgcttttgtctacagacaaagcaagaatgcagtaagctgcctacatccttcttagcaatatgctaaaacagcagtgtgggcagagcctgggcatagcagagccagcaaggatggactaccctctgagcactctctgagaacttctcactgagagggaccctagggcccttctaggactcttggcaggaagacttacgggcagacctggtatgccttgtcctccaccctggctggatgcttctggagagaatttcatgattcagttgaaaacatttctttttctttcaagtttcctttatctttgaagtttttctattggttcagtcagtcttagaagaaatgaaggcctaactctcttgtccctgcatgtatgtgaattcttgctgtgaatgagtcttggctagccttgtttgtgaccttgtggatttgcatgtactgtttggaggagatctcttgcctatctaagaggtggcctgaggattcgtccccgcccatgtcagagtctctgtgggtcagtcggaggagcgtggagacttgtgtccatccttgtagtgatggaggtggtgccagtgatgacagcatctgtgttcagagcacacaaaagtcccatgcttagtgtgctcctgccgaactgtctttttctgaagatgtcctctacatagcaatagtgacattaaacaggtaacagcaggggttgggggggtggggcgcatacactttctatgtagagaattgttgactgatcctcatgagctgaaaaaaaaaaaagctgcttctagtgtgtgaggtttccgggtaccttttagttcctcataaagttgcagactctgaggtgcctcttgctgtctgcttttgtcagcaccagccccatagtagggctagctaggcacagagtctagtttggtggacacatgaaatttgcatgaccgaggcctgggggtggtgggggaggctccagcggcagcagtgggttggcatagatagcgtttgatatgttcataacccctgctgacctggaagcgtgtccttaacctccccctcttcagaagagtgaggtctttcgtgctcctgaaaggactagagcaggtgacaggctgcctcaggtgatgctgacgtagcagaccccttttctgggcttcgttagcttttctgactccttaaaacctattgtttctctcttctcagcagacatctttaaaataaccagttctgtctggttgagaaaatttggaatgtctgacctatcaatgtttatgtagacatcgtctctgaaagacaatagcatcagtgttagatctagaattttcttccaaaagataatgttctatttgatttcatgctggtcagtatagcattggatataagttcttaggctttgggactccccccccactccattctagtttcctcctaagagtaaaggggtggagggacccaagcccattgagttcaaagccatctcacagaatcaaatttagaccataggttcttgaacagtgtattgtgtcattagtttacctcatctccctctttattctgatactctaagtcaagtgagcctttggttagtggttagtatcacttggactgtggcgagctagcagaacttgtttggctgtgattatggtaagaacgtgtctgaagccacttcaggggtaaaaggtttgttttctttcataattgcatctggtacccagcaggaagtacctggcccctccttgttcgtcagaatagctacccaaggaatctgcctggagaaaggtcagtgaaggaagactcgtggtcaccccagcccagggcagggcagggcgggcctgcccgatgctgccggacgactcatggtcaccccagcccagggcagggcagggcgggcctgcccgatgctgccggacgctgccttcctccactaaccgggcgttgcttcagttctttcagaactgatttagcaagttccagaaccctgtcccctttccatggcactgaagggtacagtgattcagggcttaaagaattggctaggtcaaggggcagagagggcaagagcaaggcgtattgtaacccaggcctacctgttccaactctttcataacttgtttatgaaaaacaattgttttcattcatatataacttattt

SEQ ID NO: 34061 - DNA, 1114 bp, Mus musculus
atatatatacacacacacacacacacacacacacacacacacacatatatatgtgtatatatgtgatttataaaatttctcccactctggagccaagccacctgtgatttcaaggccagcctggtctacagagcaaattctgagacagctaaggctacacagagaaaaaagccaaaaagccaaaaaaaaaaaaaaagtctgtagttttatcgtttgccctgtggatttctttgtgtagaagcttcgctttaatatagtgctaattctctatgttaacgtgtgtttgctgaactctttggtggcatatcaaagaaccattagcaagtcccgtatcgcgaagcttctgccgcccctcctcctaaggcttgcccctcagcacttctgcattcttgcctattttgtttactggttgaaaccaattatgaggaaaagaatgttgactgttgcctctctgcttgtgataagtttttgcttcgtgtgtttagaggctctgttagtagttgtatgcacgtttgggattgctctgttgggccttttgtgtaatgtaaattcccttttcttcatggcagctttcagggtgaggttttctttgtctgacgttaagagtcactgcagctttctgaggactctcgtctgtataaatgctaacatctggtctgtttattgttgtaaacaccacagtttcgtagttcccttttgctttccgcagaaaccgtgtcatagggagctaaaattctgtacttacctatcaggcatattttaaagaagaaggttatgaattactgggtgtttttatttgtatttattgtgggtgttttttttttttttagatttatttattttattatatgtaagtaccatagctgtcttcagacacttcagaagaaggcatcagatctcattacggatggttgtgagccaccatgtggttgctgggaattgaactcaggaccttcagaagagcagttagtgctcttaaccactgagccatctcgccagccccttgttttttgttttttgagacaggtttactaagtagccctgactggcctagaactcgtgtgtagaccaggctggcctcaggcttatggctttctgtctgtctctgcctccc

SEQ ID NO: 34062 - DNA, 1962 bp, Mus musculus
ataagaccaggatttttctgattcggcacatgctgtcagtttttgggggtaggggagatgaactttaaaacaatacatatacttctttggcttgtccgagtgtgagatgcacatttaggaggctccatgtcaggccccttcttagggatgtcccttggactcttgggctgcgattctcttgtgggaagcaagtgcagctggccttgtagagtggagaaaggaggcccactttctatcagggtggagcaaaggagactaggaaggcattgttcagatggatggttagtttgaccagttgcgtgttagcaaattcacttgttcttgggaagcaggttaagtagctgacagtccaggaaagagaaaggttccggagggacgagagaagtgctggtggggaagccgaaggttgagggaggtggaggaaggaagcgagtgagcgggcaggcagtgttagtaagtacaagctcggtagaaaccagatagcaacagttaagacctaacaattagaaacatttccaaactaagcactaaacagaatgggagctgggcttgttctaaatgatctttaagttatgggaaatgtgttttatgtagggtgctgagtaaggtgggctgactcagggctggtgaagaccacagctgcccccgggacccacatgcttgacccaggccatgtcccttgtccttggagagatgtcgggctctatgcagatgtaacctggggcaggcagtcgctgtgcgttatgttcaaagtcagcagatacaaaactagatattttaaatagttcctgttttgtgttgtttaattatttttttaactaccacaggctggccaactaatagaaaaagggtgattgatttctcattttgtaccatgttggcaatgttctagggaaagtgtgggggaagtatttaatgtcgttacactctggttatttggcttgtgccaggtcctgccttagagcctgtggtaaccctccctgatacagaaaggttctttctgtagctccctggtcggatcattgctgtcagaccgacaggtgggtgctttccatggagagtggaagtggtaggcttgtgctttccatgaaacgtagcacttcttctcttaaggaggtgcaagtcttctgtgtcttccatcaggggcatgttcatgaacactgtcatgtcacaccaccatgctgaagataacttctgtggatttgaaatggcactttgagtttctgtgtgacacagcacatgtaaatgcaagcactaccatgactttaatgtataaaatctttgttatccaaaccaaggggaaaaccacagttcacttccgtggagtttactctttttttatatgaatgtttgttactgtgtctcggcatagtgttcctaatgttgttacatacatgccagatttgactaaccactaatgtagttgcgtaagttaacatctagttacatgacaaggctgctcaactgtcgagtggctttgtaaaggtctgaacactgttaaggggaaagctgagtgcttgcttgcctctctaacaacaaaaagatgtgtcttgtgccggttgtactattgaaatatattttttccttttttaattcagttttttttgttgttgttattttggttttgttttgttttgttttttaaacatgcattgtggcttcaaatgaccaggttgtccaggcgatgacagcaaactggctggagtggaaaccatgatggagggtcaactgatctccgtagcagccagggcaaagtgaatgacctcagaaactaggaattcttgcaaagacactgcctaatagtgtgattttgaaaccttgatacaaaagttaaagtgtatcactggaacgggtaggcactttttgtgttgatgtcaagtgtgctctaaccaactgaggaaatgctgaggtcggagtgggagggaggcttggagaccattgtgttattcctttgatacttgg

SEQ ID NO: 34063 - DNA, 1193 bp, Mus musculus
tgtgtagcactggctatcctggaactctttctatagaccaggctagccttgaactcaaagatctgtctgcctctgcctcctgactgttgagattaaaactgcccagatctgataatatattctttttgtttgtttgtttgcctgtttgttttcaagacagagtttctctgtgtagccctggctgttctggaactcactctgtagaccaggctggccttgaactcagaaatctacctgcctctgcctcccaagagctaggattaaaggcgtgcaccaccactgcccagcctgataatatattcttatgaagcgaggttttataaatttttgtgatttaaaaagtaagaaccacataaaatttcaatgtggaaaaggaaatgagtatgataatatctagctttattacaaaattaagaagttgtgctgtcacaggtgctgttctatttgctgtaaagaaacaccaggaccaaggtaaccattatgaaagaaaggatttaattgaggacttgtccatgatcattatggcaggaagcatggcggtctgcaagcatggtgctgaagcaatagctgagaactttacatccttatccacgggaagcaggcagagagaaagagtcagacatacagagacaaagagagacaaaaacaaaagactgtgcctagcttgaccttttgaaaccacaaatcccactgtcagtgatacacctcctccagcaaggctacacttcctaatccttcccaaacagctctactaactgaagaccaggcattcaaacatatgaacctatggggagtcttctcatttaaaccactatatgtgtcatcactaatacatgtacactatgtctgacatttcttgattcactggtctatctgaatataagatacaggaatggaggaagagagaagagactagggagatagctaaattgctaaagtacttgcttagcaagcatgtagaacttatttccatctcagcagccatgtaaaaagctgacacatagttggggttttgttgttgttgttgttgtttaatttaactttattttttacttattcactttacatcctgttcactgtctcccgccgggtcacccctcccactatctttcattcttccccccaccccttctcttctgagctgctgtcgtccccccccccccccgggtatcccctcgccctggcacttcaag

SEQ ID NO: 34064 - DNA, 1140 bp, Mus musculus
gctgtcactaagttaaaatccctagacctgagtaagacttactgaacttcaatttgtgatagattttagtttagcagattctgatattttcaaatgttggtttatgtttgttctgtagttttataccttactgttttaaactggattaagtaagagataacgatcagtttgaattactttttcccctgagacctggcgcctatgcagccctggcagtcttagcactcactacgtaatacagagcattcacaaacacagagatctgcctgcctttgcctcctgagttaaaggtgtgcactattgtgcccagcccacatatttattttaatggaaatgtatatattatatatatatatatatatatatatacacacacacacacttttttttaggagtatctaactatcaagttgaagaagatatagggaagttgaagtcctgtcttactggcttccttcaggaatatgggctgtctgtaatggtgaaagacgattatgtccatgaattgtgagtattctttagagcatataaagataatactcactgggagagactgtgatgagactaataaaactgtaaacccccatcctttctgtagttgccggtacggagctgctgagccacacaccattgctgcgttcctgggaggtgagttttgtagatgaaatgacttatttgttatcatacagttactatttgttgtaattagtgtaattagtgctttgccctccacactgctctccttgcccgccagctcccgtgccatcagagcgagcgactctggagtctttagtccttctgaagaccttcttccgatcatgagcctcacttagctctctgggtacaaggacacataggccttcctcctcttcctccccttcctcctccccctcgaatcctcctgccccatcagttctaggaaacaaaggctaacttgactaaaaggccctacgtcccttcttttcctgagacatgccctaggtctttgcacctcagggcccagtgaaaacctgccatttctttcataaaactccctttatcactttgctctagtttagttagacactgtaactgtaccatagattggaccttataaacatcagaaatgtatttcttacgggtttcaaagattcagatgcc

SEQ ID NO: 34065 - DNA, 1195 bp, Mus musculus
ttcagttgtcacaaccttcctgaagtctttactgtttccaggcagcaattctgcatttcttcgagtggtaagatgtcgatctttagctgaagagtatggcttggatacagtcaacaaagatgaaattagtaagtataacaaccagatgctaagttaaaagatactaataaaatgtgtataatagtgctgaataaatggtgctataaaaataatgtgaatatttcatagattacctgaatgattttaatttacatatattattcagaaataaatacataaaaatgtgtttagattactgactgcattgtgtgctatatagaactaacattatcatgtttctaccttggtagagactccagctaggagtctataagaccccttgtgttacaccttaatgtatttatttcttatttataattttatactttattttaataaaatatttaatattttttgctaatattattttgtatcctgaaacttgagtatgaattcagccttttgttgcttgtgtatgttatctagttttactgattttttttttttcctttcagtttctagcatggacaatccggataatgagatagtcctgtacctgatgttgcgggctgttgatcgatttcataaacagcatggcagatacccaggtaagaacagcagttgatttaccagatacaaagaagatcttttggcttttttgttgttttaagacaggatcttacttattagcttgggctggccttgaatttgtgatcttcctcaatcagtctccaaagtattgaatttacaggcatgagccatcagattcactcattaaagtcttaaataaatgcttgacttgatgccaggtgtagtggcacttgcttttaatcccagcactagaggcagagctgggccaagtctacagagtgagttccaggacagccagggctatgtagagagaatatgtctcaaaaaagaccaaccaaccacacaggaaaacccacttgacctgaattttagtattctgtggatattagaggaactattatttgatttttttttaaaaaagattgtttgtgtattttatatacatatttttatatacatacatacatacatacatacatacatacatacatacacacacacacacacacacacacatgccagaggagggactctgatcctattacatggtcgtgagccaccatgt

SEQ ID NO: 34066 - DNA, 2981 bp, Mus musculus
gtgattttttttttttttttttttttttttttgtcctgtgtgtgctggtcagctcttctgtgtagcaggcagaataaagactaaaattggcttaggctcacgtagcccatgtcctttataagactgttaaattgtgtcatcccgtgcttttaaaggataaatttaatcatgagtctaagaataaagaacttcaggatctcctgagacccagttgcagattttacagatgcgattattcagaactctgttatgcccaaagtctaggcgctagtgtcttgttttttgttgttgttgttgttgttttttagttagggaagcctaggtttacaaagcaatcttcagaatcttcagggcacttttctatatgtgtgtgtgtgtgtgtgtgtgtgtgtgtgtgtgtgtgtgtgtgtgtcggaaatgaccttgacaacattttgtactgtttgcgttttttaacgctggttaagtttattttaaaactgaaccctccagctctcaaggaggactgccagaagcacgtttgggacctgggtgaggaagagaggagctaggccctgggccagctgaatttaattgtgcagctattgttcgcctccgttgagcctcacctctgaaccttcgaggcatccgtcctgggaggtgatttctgtctaatccctaactcctgacacttttgctgagtaagccgttcccccctcccccacctcccccaggcttagccacaggctactcataattttaggttccttttgattatagccccaactcttgtttccccgtgacacaaccctacctctgctattctgtctgcctagcctcatcccgacgttactggaaaatcttccccgttctatcatccagaggttggaagaaagaaggtgatatggttgggtggcagttgacgacatgtaggcaggacttcttcagtggtttgtggagttcagcctagatctagagaagtgaaagtaaggctttctctctgcatcttggaagggaggagggaggcttatcagatgggccacgcgcccctgcctgttgaattgccgtcactccgcctcggggaccatatttagtgtgagaggtaaaagctaaaaatcatctggccatagtcttcatgggtcactggtgtttgaaaacgaatccgcacgaatccggtttagaggataagttttctcctctgtcaggtggctgtggcattgaacttcaggaaatgtgtccctaaacacatgtggttctttttgggcagttttaatttcctgcccttgtcagcacttcagccatcgtcggcaaggctcttgtttccactgtatcatccacacactaggtttggcccccttggctttgcaggtagacattttgttgagtttagatggggctagcaaaatgactcagtgggtaaaggctgccagtctcaaaaccctgagttccatccaggggacccccgtgatgaaaggcttgagttgaaagttgacctccgaccttcatgtgtgcaccgtggcatgtgaactcacacaaaataaataagaaaaaaaaaaaaaaaatcagagccgggcagtgttggtgcttgcctttagtgccagcattcgggaagctgaggcaggtagatctctgagttcgagaccagcctggtctagagagttccaggacagctgggactacacagagaaaccctgtcttgacccccacccccaccaaaaacaaaatcaggattgcttttgtatatttcctagtgtatctgtttagtgatttttttttttaaacaaaaagacaagaaacagaactcttgggtccttttgttctgaacctgatctcttagatttttactcaaaagtaaaatgtaggcagtccccctgaggagcagcccctctgcccccacacttgggtgggtttactctctgtggctcctttctgagaggaccacgcttatgctctcaggtgtggcctaccttctgagtgcctctttttcttaaccttcatctttacgcctatcctacataataacccccaactctgccgcctcaaaataaagtagaaaatgaaaattttgggtgtggtggcgcaggctttaattgtagcacttgcgtgaccgagggaagaacaccagaagttcaaagagatacgtgagacccttgtacaaaaaaatagtgtgtccccagctaggcactaaggctacacagagagaccttgcctcaggaaacaaaacaaaacaaaaaaacccataacccctaaacatgagtcattattagtctagatttatggcttgttatttgaatggaagacactattgaacatttttttttctttgctctttgctttcggtactagctaaagccaggagtatccttggagccttaactggtgttcggtgtctgagctctgttttggaggctggcacgggtcataaaaggttctgaatccagtaactaatcctggagttgataggacacagacctcccttctgtgtctcctcactgtctaatagatgtccctgctctccagctgaaatattgagagagcagaaagggcaatttatagtctctctttctctctccctctgaactcagcccctctgtgcctgctccagtgcgtgttgtcttctggtcccttgccagtgtcttgctggctacgggtcttggcagcggctcccttgaagcaagtgagcctaagctttgggccactgaaattaggaaggagatccatggtccctgtcacttcttccaaagcgcttctcctccctctcatatcgagattccagttattagacttttacattttaaataatgagactgaccgtttagtattgcagatgtaatttttgaaagaagtatgtcttggtgcttaaagtgacgcttatgatttggggtaagagacagatggcaatgatatcatttagatctttgttttatgtgtaaacagtgccgtgctgttgatttccaaagttaataaagctgtaggaaagactagttttgaatgtatattag

SEQ ID NO: 34067 - DNA, 1203 bp, Mus musculus
ttgatttgttaattttctttggtctagaattagatttaataatctacctttttttcttatcattcctatatcccttttttttccttttcatcctttctctccccttttattccttctctccctacataagaaatccctgacgctaacctcctataccttatttcctccctaatcaagaccatttagcagtttgcaacatacttcccttttaatggtgacaaacccatcaaacaaccaaaacccatccaacctgcctttggggattgtagctagaaactgttctttcctaaaacggggttggcatagtaggtgacagacagttgggctgaaggtgtcactgctgtgtccaaattgcttattcttagaacaagcagcctcaagaccctcaaagaaggaaatattgtacaagctagcaaatgagaagttgatcagatctcctcatacttttcttctgacacctaaatttcaggacccaagtttacttagctattgaaagggggggtgcagttaaaagaagtgtgaggttaggatcttactctgtggtcacactagtgcacataaagctttaggtttgctccctagtaacaaaatcagttctctctccgcccctccccttcctctgttctctcctctctgcccatttactgaacgaaacagtacttaaaccatcttatgttctgcactacaaagatctggggctttgtctatgaaggaagattagcagttcttaccactatattgaatgttgttttgctttgcaaacccctttgagaatcaaatggaagcaataatattctctagggaaaaaaatcttctgtggattcacaagtaaatgattacctagaattttacaaagtgtttggtcttactgaaatgtatctatataaattcaaaccttcttctgggttttctgaaagctaatccctaaatttagaagacagaggcaggtagatctctgagtttgaagccagcctaatctatttacaagttccaggccagccagagctacatgtgagaccccgtctcagtaaaacaaaatgaatctcttatctaggtatggtagtagacctgaagtcactgaactccagaggctgagacaggaaacttgattttgaggttagcctggccactagcaagtagtgagtaccaggcctgttaggcctgtatagttagaccttgtctgaaaaagattaaaggcagtgt

SEQ ID NO: 34068 - DNA, 1189 bp, Mus musculus
agagtaacaaaagaataggatttgcccaactctcatgagaagagaggaaagggaagctacttgaggagtaatgcagagaaaaaagaaaaaggacagttttgccaggacaattatagagagaaaacaagctagacacagatgaagacaggagccagaaggtcaggacatactgccaaaagttagtatgaagccaaggagagcaattcaggagaagctgagagaagccagtttgaatcagtcagcttgaagagaagtttgagcaggaagagctaagttgaactagccagccagagatcagaaagatctgcaaataggtgagattattcagcagcaaaagcagcaaatctcaggctagaagcttctaggactagcctagttaatagacaggcagtaagcctccgagacaacagttgtaacaggagaaaaaagttacacacacaaacacacatatgtatatgtttatatatatcctaaggaaaacttcatgtctggtttttactggttctcaccagtcttttttatgttttttaggtatacttgaaggctcccatgattctgaatggagtgtgtgttatatggaagggctggattgatctccacagattggatggtatgggttgcctggagtttgatgaggagcgagcccaggtagggtgatttcagtctttgctgggaatatagtccctaaacttgtctttggggaactactttgactcgtctttagagtagtatgtatagggctcgtgagatgatttaacaggtaaaagtcacctgagggcctgagattgattcccaggacccacactgatctccgtacacatgctgtgtaactggtgtgcacccatacacatgtatacacccataaaataataaacaaaatgtagtgaacacccccctccctaccacctttcaaattttatttttattttatgtctattggcgttttgcctgcatgtaagtctgagggtgtcagaaatcctggaacttgggttacagacaggtgtgagtttccaggtgggtgctaggaattgaacctaggtcctctggaaggcaaccagtgctcttaactgctgagccatttctccagccctttaaaatatttttaaagagtagtagtaggattagttttgctccgatgaagcaccatgaccaaaacttgggaaggaaagggcccatctccactaccatc

SEQ ID NO: 34069 - DNA, 1170 bp, Mus musculus
gtaagggagcatttaaggttaggagtcattgtgatcacattgtgctttagctatacacacacacacggatcgcaggggcagctctgaggtgccagaacagaatggaacaggggcggtgtttgggggacttaaaataatcgagtttacagctctttgggttccaagttagaaaagtgtttatagaaatgaagattccaaaaatataagcagcaaataggtagagtgctactttagtttacagaggtaagaagggttacaaagatggttcagattcctgttagaatgaggaggcacatgtcggtaatcccagtgctggagaagttaaggcaggaggattatgtttcagaccagccaaggctataacgagaccctcactccaaaataaaagtacctctgaaattagtgcgggatggaggggattgattaatactgatattttaagaattactcttcggttggattctttccaaaaaatccccaaattcaattttttttttttacataaatcaaaataattatttcatgtaccctgacagcaggaagatgcattagcacaacaggcctttgaagaggctcgaagaagaactcgagaatttgaggatagagacaggtctcaccgggaggaaatggaggtgagagtttcacagctgctggcagtaactggttagtactttccccaaactctcaggctgtgtttttgatgtttgtgcataatgtttttaattggtttaactttgtcttttattttttaaaattgtatattcttgcttgaattgattttatgcaattgtctataaaatgtaattattctaatttaaaggttgcatttattctcatttattggtcttcacaaaaaaagtcttactatatatacaaaataaggtatatttttcttttaattcattgattgaaatatctttgttccacctcttcctacctccactttctaagtactaggatacaggtgtgagccatcacacacctacatataaaatgtgtctcttgttaatatagagcatgatcaaaacatgtaaacattgctaaaatgctgaagagatggctcagcattaaaggccaggcttataaccagtaatataaaacattacaaaaaaatccttaaaggcaagtactattttctacttctttatgaatatttaccttgatgttgaa

SEQ ID NO: 34070 - DNA, 2171 bp, Mus musculus
tggcattattttagttgtatcgaaagtatatactttcttcattttaacttaaaagctcatgtcatttagaaacaagataagaaattaaaatttgtatcagggttgcttaacattcttttatactttcagacgagttggttatacagctttcctccttagataagggttcttggtttttgtttgttttctctacatcatttcgtgtttttgtattctgcaccattttacaaatgaagatgtgtttgcagttattttttccagctataaacctagaatagagctgtctgccacagcctcctaaaacaaacgtttacagttgttaaagccacagtatcctttcaaatgctgatagtcaccctatcccctttagacaaaaattcacattagtattaaattttgtctcagaccctgtttcaaggtatatcttgtaatcatgagtttgggtagagatgctcttcacaggtgagaatgctctacagaaatgcccaaagaagccacagactggcttctgttttattcagggattttttttttaatcagtcagaaaaaggatactggaacttgttgtatgtaacagcatattaaactggaggcagtgataaatcagctacacaggtaaattgtgttaaaataatgtttaagatagctgctttcatgtgtattttgtattttgtattgcatgcttttgtagaaacaaaattgggtgatgaagatgagtcttagaaaatgttcatctgggcagaagatgcatttctcccattgattccgggcaaaacattcacagatatagatgatggtattttacaaaaggactattaatagtgccttttgagatgaatcaatgtaacgatatttttaaaacaggcttagtgtcaaattgcaattttttaaatataaaactggaaaaagtgctaagtcattggcacatgcttacaatactttccgtggtcgtattcattaaatgttactacatttctgaatttttgcaaaaatgtattttatcataaaatggcattattttagaaaattttaaaaactgacatggtcaattcagaaaagtctgaataaggtcattgcatttaaaaagcatataaagatacttgattgtggaagtgtgtctttcattgtatataggtcttataattcataaacaagtaccctgtatctcaaaataaaaatatttgttatatatttgaagtcgtgcatgataaggattgtgtttgaattattataaacaataatgtgttacagaagctgatgctgaccttgtgttactgagcactatgaatgaatttgcttggtatttggtgttgtacagctcacatgtttacactctcagtgccctgatgcctctcgggagttacctttttaaagtgatcctttcttttttaaaataacatctcggtggtacattttctctgttgcttctcgccaagagcttccagtccggcagtcagtaagatcacatggtgttaatgtggccgtccctctgtaaatagcaaatgttccttactggttctgcactgcttctgtctgtcttaatgctggcgttaagatcataaactccttttcttcggtagtgcaggctttgaaaattaagttattgatgcaatttcatatttttcataatctgtatttaaaatgacatcattgcatcattttttaaagattcatctccattaaaacttgccttaagcttccagattgctttgccgttagctttactgtatatttgtatgttttatttactttcacattaaaattctgtgtactgaaaacaaagtcatgactctttattgatatgtgatgatttctgtcttactagcttcaagtctttgatcctttataacagtttttttaaggacagcaacaacagtgccatctagtggtcatatcttctaactcctttaaatcaatgtacagtaacttcccattacatgatgtggttttcaaaaagtctgaagttgagtgtggatataggaagtaggggcaggaggatcaagagttcaaggtcattcttggcgagttcaaggccatcctgggctgttctcaataaccaaaataggctagagagatgactctgaagttaagagctttagttattgctgaaggttatagtaggaacaggagtgtgattcccagcacacagaatagtcggctcacactcacct

SEQ ID NO: 34071 - DNA, 1198 bp, Mus musculus
cactcaaggcactcacggcttctacctgacacttctggcttgtgggaaataaatggatgctaggtgccttctgtgcccctgcccagtacatctgtgtgtactgttagcatttataggcagggtcttatggtctggtgcatgtgtgtaacctaggccagcctcaaactcaaaacaatcctcatctctcagcctcctccttctgcgattacaagtatgagtctctgtgtccgaccagaaacttttatcgcttatagcaatagttagtagtctttttagacctgaaagccatgtgcttttctgttgggcttcagtgtctgagttgggccttcctcccagtgaatgttgtgaaagatcccaagctaggactttgggcaggtaacatgggcttctgccttttctgggatgctgagtagagatgtaagagtggttaggcctcccgagaaacgggtttatctttgtctgtcttctttctagttaccaccgctgtgagttcaagatcccactggccataaagaaaggtgagtcgagagtcccctcaggttaaagggacatgcagttacctgcctgtatgaagaaagtagagggggactgtagagatggctcagcggttaagagccgactgctcttctgaaggtcatgagttcaaatcccagcaaccacatggtggctcacaaccatctgtaatgagagctgatgccctcttctagggtatctgaagacagctacagtgtacttacatataataataaataagaaaaaaaagaaaggaagaaagaggagaagccagccaagtgtagtgcttgggctggcagtgtccttgctcactgtcttctccctagagccttagagccttatctcctctgggatgatcctttgttctcctgtgactggcactattggctagtggacagaggagtttcctgtctgcagattaacacccagtgtgccttacacatcctttgtgcccatggccaactagtgtagctcacaccaagattggcctccctttgcctttctacgttcttccaaacaacctgcctttgctccctgtgtactccagccatagcacaaagagtggctattctggattctgcctgtggctggacctacaggccagctcaacccagcctgcaccatcttctctttccagaaaatgcaggtggtcagactgaaatatgcacaacctacagcaaggtaa

SEQ ID NO: 34072 - DNA, 2291 bp, Mus musculus
cagtaagcagtacagcagggagcgggcacctcagagcaagtgtggccacacttgggtgtgctgatccttgaaccccatgtgcatgagaggccctgggcaccccactggtttgagagaagccttgggaaccccccgccttaatctggatgccatacttcagcaggctttcgtagttgtagagactagatatgatacgcgggtttataaaagccatgtgtcctgtgaacaacaggcaggccttgagcagaagtaagccccactgacaggaggttggtgattgaggaaatgcagggcccgggcctgtgtgaagtgcgctgtgtgtgcaccctctagcccacccagtccttccctcgtgatctgctgttctcttcttacaccaggtcatgcagaacaaccacattgcctcagtgaccctgtatggcccccccaggcctggtgcccacctgagaacagcagagctgccctaaggacatcactgttttccctgtccatggaactgtgcgtcacatccagctcagtgggtctctgtgccaccctgtgtgtttgcttggacaccttggcagtgttgaagggccctgggactcagaagggtttggaagtaggatttgggctgagtcctctgccgtgggacggaggacccagatactctgtcctaagcctgctgttgccaggagagaacacagtgtgcaaaaagaagcacaaacttagagccatgatgagggctctcataactaacatgtaataaaggacacgtcagcccctgccctgctcacatagggaagacaggactctttctctagctaagaaaatattcccaggatgagaacaggctcctgcttttggcccgacattgccacgtggcccctaaggtgagcagagcaggtagcatgtcggtagtacttggttgcaatatttgcactccatccactttagtgacttgatgagctggctgtggctggtgtggcccactgcccttccctgcttctcctgtgagtgctccttgccgtgcccaggtggcacctaagtggatgaaatcgtttcctaccaggtatgtaccaggcctggttcccactgctgctctgggagccagcctttaaggtcacctgtgtctcttggtccaacctggctgacagggctgcatgtctccatcttgtttgcctcttttatttaatgccaaagtgttagccaaagacaccttcctccttttgttacattacagcattctgttatgcactgtgggccagctccttgccctagttctgggcactggcctggcctggcctggctacttggtttgaggcctagaggctcaaggaacactaggctgcttggtttcttacatgggtcttgctaatgggaagtagcatatatgtgctttaaaatagtaatccttttgaaaagaattgagaagagaaacatataattttatcccatttttaatattttggtctagcaacttgtgatacatagatgacaattttgtgagtttttcaaatgtgtgtacagatttttgtaaataatgacttttgtaattaactcatgtacagcctcatcttgtatagttcatgatgaatgtgcaggggacctgccccagctgtctgtatggttcctgggcctacagccaggcctgtgtggcactcccatgactgatttgacaggtgtcttcccatttggaccttcgtctggccagagaccctgcacatcccactgtcagggtagccaggactcttcccatcctcgtgatcagaggagacttcctcgtcccccttccaataaagcacctatgcccacagtgacagcgtgccatgtgctgccactgggctgtttgtactaaaatgtgagctgttgatttccttgaagctggagttgaagaatatgagcaatcttatagtggaggaatcttaggactccttccgggagggggatgggtcacccttcagaagtacactggcatggttttgtgtgtgtgtgtatagtgggcaagacggtgacacatgatggccccgccccacatgctacaggcaaacctcgacctgaagggcttagttagctctaacaccagacctcaaagggaacagataagatatggccactgggaatccaatgagagaaggaaggaagctagtaactatacgaaaatgcctgccaggtccacgagggctgaggcctggctatgggtatatccacttgtgtttgtttcatcccagccctagctctctcagtgagtgatctggagaaaagtcatgtacaccataaacccacatggaaaacccctttgggttctttcatgt

SEQ ID NO: 34073 - DNA, 2235 bp, Mus musculus
acgtttgcgcgctcggtgggtctcaagtggcgcagggtggggcgctcgctgcagcgtaactgtcgggcactgagagatcctgccctcgactcgctggcctacgagtatgagcgtgatgggctatacgagcaggccttccagctgctgcgccgtttcatgcaagccgagggccgccgtgccacactgcagcgcctggtggaggcgctggaggagaacgaactcactagtctagcagaggatctgttgggccaggcggagccggatggcggcctggcctaagtctagtactgtggggaagggcggccaaccagcagttcagtgtttgaaacccacgggtggctgttggggtatttttttaccgctgatgttgctactgctgaccactttccatctactggacttggagagcatacgcacgccccacctagctgagctgctggagtgcaactaactgcccctccccccgccccccaggagccaggcaagcagcgcaggggtaaatcactgatgatcatacaaaaagaggacttgctgcaaagaccctctaagtacccggaccttctgaaacctagctcaaggtgctacaaaaactgtcgggagcaggatgcacgattttccccgcccttggcatatactcatcgtgggaccgaagcaccttgtctgcagcgataataaaatgtaactcttttacagacttgcggagatgctgaggtctagacctggttggggttagtcaccttcagtggaatagtgagccaggtagagtagggagtggagagacaggcagggttcgggtagggccttgaggaaggtgagaggaaggggttgctacctgtcctgttagtgaaggataaccgggggtttggtgaaccatcatatacattaggtttggtttttgtttttgtgtgtgtgtgatctaagtatgtgcttaaaacatctaccgtgtacctgaattagaaaattaaaatttcagccaggtggtggtgcacgcctttaatcctatttagcactggaggcagagtcaggtggatctctgtttgttacaggccagcctggtctacagagtgtgcctttaatgctatctagcattggaggcagagtcaggtggatctgtttgttacaggccagcctagtctacagagtgtgctccaagacagccaagctctcctccacccccaccccccaccccttttctgttgagatcttcacccttgtttccacggagactgacacctataagattcagactttttacataccatgcggtattcaggatgttgaggcaggaggattgcttcaatttggaagtcagcatgagctacatattgagacacccccacccccacacaaaaacaaaagcaaacagacaatctgggtttccccacttcccctgccccaggatttccaacttacattgttactaaattcaaccttcaaagtttatttgaggtggggggcttggccaatgaacttacttctgtatcacacatactcagaaaccctagttttctgattgatttttgtggcagtgcggatataaccaaggccctgaggaaaggtctaccactgagctacatcctggctcttgcttttttgtttttttgaggcaatctcactgtgtagctcaggctggctttgaactcatgactctccatccagatgcttctgactcccgagtgctgggactatagatgtgtgcaccaaatgtgctagaaagtcatctaccgacctggtggtggcggtggcggcacatctatgatcccagcacttacttggcaggtggttccctatgaggccagcctgagctaattagtgagtcccaggttagcctggctagggttctgcttcaggcccttgtacccacatgaacacacacacaattaaaaaatcttcaggggttggagagatgtttctttctttttttttttctttctttttcttctgtcttttaagacagggtttctctgtgtagctctggctgtcctggacctcactttgtagaccaggttggcctcaaactcagaaatccgcctgcctctgccccccccccgccccccccccccccgagtgctgggattaaaggcacgcacgccaccacgcccggctttttcttctgttttgttttgtttttcgagacagggtttttctgtgcagtcctggctgtcctggaactcactctgtagaccagaccggccttgaactcagaaatctgcctgcttctgcctcccaagtgct

SEQ ID NO: 34074 - DNA, 1099 bp, Mus musculus
ggcatcggttcccattacaaatggtcgtgagccatcatgtggatgctgagaattcaggacctctgaagagcagtcagtgctcttatctgctgagggaaggattcctaaggggacagtgagaaaccagttccctccatcttgtctgttctattaacctcacttctccaactccgcgaactccaaggcggctatttcccctatttgcccagtactagtgaatttacatatcgattactctgccatctccagctctaccgcacttgtgctgacaggcctggtggatagtaccccgacacacaccagtacagttccaaatcttctcctaccccttgggatgggatcacatccatgggatagaagggtaggaaagtgaactagatgtttcatgaatcacgagctacttcttagacgtccttgcttgttttatacctcggtagctgaagagttacatcgtgatgtttttgccttactttttactaaagacatttatgggctggggtggggctcagtggctgagaactaccgtacacctggctcagggttcaatcccaagtacggaagtcactggagccctgccctgtagaacttcctggtgttcttgctcttggttcctgagggctgaggttacagataggatgccatcacctcaagttctctccttttcttttttggctttttgagccaggatcttactctgtagaccaggctgccccctcaaactcagagatttgactgcctctgcctcccgaatactgggattaaaggaatatttcatttacaatccacctcctctgctttttttttttttcctttttgagacagggtttgtctgtgtagccctggctgtcctggaactcactctgtagaccaggctagcctcaaactcagaaacccaccttcctctgcctcccaagtgctgggattaaagaaggtgtgtgccaccaccgcccagcgactctttctttctttctttctttctttctttctttctttctttctttctttccttccttccttccttccttccttccttcctttctctctctctctctctctctctctctctctctctctctctctctctctttctttctttcat

SEQ ID NO: 34075 - DNA, 2288 bp, Mus musculus
gccaggcactttgattagctctgaggctcagtttgcttcctataggtctcctatgaagacgtggaacaactgcggccctacggggtgctagacaataccagagtgccccacttcatgaaggacttggaacgttaccggcagcagctggaacacatcatgaccaccaaccggctggatgaagcggagctgggccgcctgctgcctgactgatgttgactaagggttatagacagacgctcttgacagaggtcacagatcggaatatgaagttctttatggttccatagcctaggtgtttcttgggggcatttgggaggccaggagcatcgtgggcagatgagaagcaacgttagaaggtttttgtccttgctacccttcctggggcctgtgaactgcagcagcatgtcacataaactcctgagcaggggagatgggagggcgatgagatgggagctgagtgtgaatagaaatgtgggttggtttgggaatagaaacttgttcctgcatgagatggctttgggtgtctggtaccactccttcccttccccctacctggccgattggtgctccttctacactcatacctctacctctcactggggccagcaggagttgggaacccctctgaggtgatttgcctgagcatggggttccggctgtcactcaggctcagagacccagctgggctgggctttgcctttcagcattctgtctgtctcactggtcatgcattgttccatagtcgccctcatggggtcatttcatgcctccaggcggggcccggaagtagtagtagtagtagtagtagtagtagtagtagtagtagtagtagttccatgtaggggcaggatcctttggaaaagtaccgtatgttcctagaccccttccttccttccttccttccttccttctttccttccttccttccttccttccttccttccttccttccttccctctccctctctccctcttccttccttccttcctccctctctccctcttccttccttccttccttccttccttccttccttccttcctccctccctccctctccctctctctctctctcttccttccttccttccttccttccttccttccttccttcttttctttcaaagacttatttattttatgtatacgagtacactgtagctgtcttcagacacactagaagagggcatcagattccattacagatggttgtgagccgccatgtggttgctgggagtagaactcaggacctctgggaaagcagtcagtgctcttaaccactgagccatctctccagccccctagaccccctttcttatcactcacacagacacactgtgtcttgtgtcttgtgagtccagcacctggtcccaccctcagtccccatgttagtcttggttgtgcctgtctttaaccacagcctcacagctggtctctggcagtggttaggacaggcgggagcaaccacaatcaaacctacagggcaggccctagggtttgttatcccacgttcaggccaggattagtacagagctggttaaggctttcatttcacttcagattcagcggtgggagagtgagctagtactgtcctaaccctggcttttcagttaatgtttccatctgtgaagcttggaaacacagctgggaagtttgtattcatttacttagtagatatgtgcagagctccttgtgtatgtctgtgactggttagaccccacgcccctcactgagctcccagttcagaggaaagccagacaattaaacagcagttacaatgatgtgtgtggcttctgtctactcaagtttcctctcaggtcctccctgcaagactgtgagcgccaagacttctctccatgtgtggatggacatcccccttcacttgcttggtacaccaagccgagtgatttccatggattagaagtgttgcccactcggcctcccaaatggcccctgaggggaataaagtgggtgagggagggtcagatttgggggcctgcatctgagatctccagaattacagcttgggctctttgggaagtggaatgtttttgaggggatgggggtattttcacacaagcctgctcaggtcagtgggattcagacccacgctcaccctcagttcttgagcaaagagccagacttgtggagagtcaggaacagactgaccctcctgagtttattcatttggcagtaggtgtctcggtgcatcgatggggtcaagctctggcaggtttccaggtcttatccagcacaaataggattggacagctaaggattctggcctt

SEQ ID NO: 34076 - DNA, 1661 bp, Mus musculus
tcttctctttcagttctggatctccccaaagagctgtcagaaatcttcgaccccacgagaggtaggcggtgttcctccttttgattggatgcagggcataaggagcatagtttgagttctgggttcccttctaagggtatctgctgggtatcccagaaaaagggtgaggttcctaatgggcctgtgtgggggtctcattcctgggctttggtgggtggaggcgcaagagccagaatctgaatgaattgtgttcattcccagagtgcatgagctccgagctgctggaagaactgatgtcttcagaaggtgggtagcccaggaagataagggtagctgtgagcaagggggtgggtgactgctgggggtcttggcctaagacctcagcctaatgctttctgcagtgtttgcccccctcctccgactttctccacctcccggagaccacgattacatctacaacctggacgagagtgaaggtgtctgtgatctctttgatgttcctgttctcaaactctgactgacagggacatgtcctgtgcagctgcaacccagactgtctgggcctggagccaactagggactgccccccacccccaccctaaccccaagagcccaactcttggcttactcagccttttctggtcgctcagttcgggctgtgctctcctgtcttgcactggcacttgtgactgtgctagcatagctgggcagagagcttagccctctctacatggagccttccccagccaggctcagctgcccctcagtggcacctctgccttgttcctaccagtcactatgaaggaggttcagagagagggtggtgctgggtggttgcctaccatcacctttcctttcccacctgctcaccctgcagcctctggacatctcggatgctccctgagagtcctgggatctctgggcagtcatggtggagggggttaataaggaattgctgtgtctagctaggagtctgggagggttggtacctaagaatggctccagctcctgcccacccacccccatctcccttcacttccacttattcacttaccctcatttagagccattgcagagatttagaaagatttacagtaacgaatgaattcctatataaagattatttttatacttttttcaacaaaaggaaatgtaatatttgtacagcattcaagtgaataaagacatgcctaaggctatctctgatctggttctttggggcccctacctgggacgctggattgttgctgagactgggtgggtcaccttactggaatgggaggtgtggctgctgtgtaggaagcctgctgccacagcctctacctgctgcaccttggtgtggggcggggccaggcaggcctctacggggcggagcagggcagggcaggcggggtcttaccctcctacccctgagattaacccggaactaacaggctcctttgggaaggcctcggagcccgatcaggagtgggaacctgggctgtgagtgcaggctacaagtcctagaccctagaccgggtgcactctcggcgggaggtggcacattagtgccaagtgccagcggccaccgcggctggactatggcgcccccgcggaatgtggtgaagattgctgttcagatgtctgacgccatcccacagcttatccagctagaccaggtc

SEQ ID NO: 34077 - DNA, 1661 bp, Mus musculus; identical to SEQ ID NO: 34076

SEQ ID NO: 34078 - DNA, 1133 bp, Mus musculus
ataacagttagcgtggtacggtgtgttcagtgccatatcaatgaaagtgtgaaacccagacaaggacaccaagacgagaccatgcagtggcatcagggcaggcctgagagataggatgggaacacaagttactctttctagaacgggcattaaggtatggaaattccacataactggattaagttttttgtgtgggatgtggtaggagaagagtcaagaatgtggtcaagatggcaaggtggcagatgtgccaggcagcagagagagcttgggctttcttccagttactgctgtggggccgtaaagaaatggtaagacagggctggagagatggctcagcagttaagagcactaactacacttccagaggttctgagttcaattcccagcaaccacatggtggctcacaaccatctgtaatgggagccgatgccctctgtgtctgaagagaggacagtgtattcacatacataaaataataaatatttgaaaaaagaaaaggtaagacaggcaaggacagtgtgaaacagttcttagaactccatactccagaatgggttagagggtaagatggaggttggggaggcagcccagccaggagggcaacacaaacatctgtggtatttgaaagcaatagcttgtgttaatttttatttaattagttttgatttagttatagtgaagttaagggtttttttgtttttttttttgttttttttttttttgtctcattagctatttgtgttctttatccacttaactggtagggtcttagtaatttgcttgtatgaaccttttatatatgaaaaataaactctttagctgggcagtgatggtgcatgcctttagtcccagcagtcaggaagcagaggaaggcagatctctgagttcaaggccagcctggtctgcagagtaagttcctggatagccagggctgcacagaaaaaaaatcctgtcacaaacaaacaaacaaacaaacaaacaaacagaagaacaaaacaaaagatttattctctatatattggttaaaatacattcctatttgctctttcattttatttgtagatagcagtgtttacatatgaggtacaatattaagcttctgtgttcgttcatcattggttacttaaaga

SEQ ID NO: 34079 - DNA, 1103 bp, Mus musculus
catcactagatttgggcagccagccttctttgagtatgtatgggcttactccagtgggaggatggcgtaggtctgggtctcccctgctgacaactcacccagtctccctccttagctcccgaggactcagaggtctcatcccagtgcccatcagccagtggctctagtgattctgacagcagctgtgtgtcagggcagaccatgggcagaggccttgaggatttgtcctgtgtgagtgccatcttttgccttatgcccatcagtccttcccaaaactaccctgggctatagctgccttttctttaggggagttggaaatgggtgggtcagagccattccccagaggactccatgtccacccctagaaccagagaggcaaaacattgactttgcttaacttggcaccataggtttgagtccggcctgaagatgaacagcactcagtaactccaaggaataccaggcctttgaatgtgctataatcagagcaccctcatacccaataggaatatccttgttgattatcctttctgatgtctgtagccatcaaccgacagccctagggcctctccaagggcatctggctgcagagactagttacacaccttgggtcccaggacccttctgtcccctctccaactacctccccaattgtgagttaaggacatgatagggcagaggggagtatttctagactgcaggctggtagagtagtgtggagctctcggaagtcatgaaggacacaagtggattcccagcggctgttcctcaacccttgggtaacactaatctctccaaacacagggcctagcctggccctatagcccccttattcttgaattccttggcaaacccatcgccaacctcttgtttttggggcccccttggtcattttgacttgatgcttttggttagagttgtctactggtttcactggcagtgacactctgttttctcagagaagaaatctaggcatttttcttgttatttacttttttatttgtttataataaaaaataagtgatttgcaccgttgactgggcatatgcattctgggggtttccacagaaaatgagccttgggcaactggtctgtgttggtcg

SEQ ID NO: 34080 - DNA, 2064 bp, Mus musculus
cctaaacctggctacagagaggggtgggactatgtgttctcaagcagagagtgggtcagatagctgggttttctcacgcagctagaatgcaccaagctactgctccttggatgattaactgttgaaattagtagatgttcggtagaggggaagttggcatagaatgagctggcccatccctaccatgaaaggttttgagaggggagatcagctgactgggtttctaaccagtctcccagcactgcaatcctggctctaagcaagcactgtcctctctacaggcctacttggagtccttctacaagttctgtactctgttgggtgggaccacagctgatgccatgtgtcctatcctagaggtgagtgcctccccacctctctgccttttgttcccattgagccttactagggggaactctgccaactgactagcgtggtctccctcatcttccctctctcctcacctatgcactggccctgcagtttgaagcagaccgccgcgctttcatcatcaccatcaactctttcggcacagagctgtccaaggaggaccgtgccaagctcttcccgcactgtggccggctctaccctgagggcttggctcagctggcgcgggctgatgactatgaacaggtcaagaatgtagctgattactacccggtgagtgccctagctgacaagattaggtggccatgtgggcagcccagcacccagcactcatacctgtgctcttcctcttcccggccaggaatacaaactgctttttgagggtgcaggtagcaatcctggagacaagaccctggaggaccggttttttgaacatgaggtaagaacagggtcttgtagagccgaccccgtatagggaaggttgtgacttaggccacagcgcctgttcatcacacctgtgtctgtccacaggtgaagctaaacaagctggccttcctgaaccagttccattttggtgtcttttatgcctttgtgaagcttaaggaacaggaatgtcgcaacatcgtatggattgctgagtgcattgcccagcgccatcgcgccaagatcgacaactacatccccatcttttagcattctaacttaaggttcccaagtgcactgtgtgtgtgtctgtgtgctgtggtgaagcccagggctcacttgtctgacctggtgaggtgtagcattgtcctgggattgtttgcccagcttccatgaccccttctgggactactcttaggcctaaaaaggggttaggcacctctcccctgatcaagaatggaccaagattccctccagagcagagaggcccccagccctatgtttacagccactgacatgtctaagaaacttgtatgactttcatgtccctccttagcctaaggacccctgggacagtgtccataggtcatccccagaacctgtgggaagagtagagaatatgtattcttggggtattgggaaagcagctttgtagccttctccctccgctctgcccctctgagacaataaaattgccctctttaaaaaccctgctgtctgtctgctccctcctttgtgtccttatacctttcctcggctctcaactttgttcattactataccttgatgagtctctcctgcagtcagcagccacagggccagggaagtccctggaggatggctctttctgctgggagctcaggtaggaagataggctggggtgggggttgttagagaataattatatcttggctctagaagtcccacacttccctaactgcttcactaagccctgtaactccctgaaattagccattaccttcatctcagtatgaagaaactcagacctagggacaagatttgcctgaggtcagcagatacgtaccacggagtgtctggggaacatcctcagctcccctgatgagtcccaagatctcccaagaaatacccaatctctgtcatatcgccataccctgtcacccaggcaaccaggcagtcacctcctccaaacactatctctcccattctagtagaaataaaatgtatctttattttaaaatgccaacaaccaggcaggtacaacatacagcttcc

SEQ ID NO: 34081 - DNA, 1101 bp, Mus musculus
ttgggtcatgtattccagatcttgagccagccctattcttctttcttcttccttctttcttcttctttcttcttctttctttttatttcttctttcttctttcttccttcttccttcttcctttttccttcttccttcttccttcttcttccttcttccttttctttcttctttcttctctttcttctctttcttctttcttctttctcctttcttctttcttctttcttctttcttctttcttctttcttctttcttccttcttccttcttccttcttccttcttctttcttccttcttccttcttccttcttccttcttccttcttccttcttccttcttccttcttccttcttccttcttccttcttccttcttccttcttcttcttcttcttcttcttcttcttcttcttcttcttcttcttctttttggtttttcaagacagtgtttctctgtatagccctggctgtcctggaactcactctgtagaccaggctggcctcaaactcggaaatccgcctgcctctgtctcctgagtgctgggattaaaggcgtgggccaccacacctggcccgccctattcttctaactccaataaatagtagagttgtgctggtgtgtttgcattctcacctacaggtggtaacatggaggacatgctatcagcctggaggaaggatttctatggaccatgaaaagcaggatcagggaattatttggagagctaaatagggcagctcgatccatggctggagtggtggagactattgggctgagagtgttcattaggaagctttgtatggcaccctttctgatgaaaaaagatggtgtatagtacgttgtgctgatatctttctgtatactattacttcaatttaatgtttgtgtgggttccctgagagtgggagtgggcgcacaatgcatatgctggtcaggagccaagagcctggatatacagatgtactataaaatactcaaggccaagttgcaggacaagatttaaactcacatttttatggctccaaagctcagatttttctcattttgagccaggcaagattgtaggtacatacctgtaatcctagcacttatagacaat

SEQ ID NO: 34082 - DNA, 1195 bp, Mus musculus
ccatgatctgctgcataggaccctgaggcttccaggtcacatgtggcagctcattcattttctccacccactaaatttcaaactatgttccacatggccagacctggtgggaacagagagtaggaaggtcttcccgtcattgccaagacagtttgcttctcacgtctttatagtggcttccatcatgtggatctaacttttgtttcattttgttagagagagaaaatgagaatgtgtgtctctgtgtgtgtctctctgtgtgagtgtgtgtaggagtgtctatgcatgtatgttgaggtattcatggagtgcagaggagtcaggtcccccagcagctggagttatagtaacatccacatgatgtggatgctggaaacctaacttttctgtaagatcagcaatgtttttaactgtcgagccattgaatctaccttttaaattatgaaggagctgggcgtggtggtgcacacctttaatcccagcacttgggaggcagaggcaggaggatttctgagtttgaggccatcctagtctacaaagtgaattccaggacagccaaggctatacagagagaccctgtctcgaaacaaaacaacaacaacaaaccaacaaaaaaaatgaaggtccctaagcacgaaagcactgccctgccagagtccagccaggaccacagtgctgaccacatttagcctagcatctgactgctgccccacaaaggtctcactctccttgagtggctatgtaactgggggtaagcttgagctagggtgagagaagggtactgaacaggaccagtctggatagttactgctgcatgttgctgtcttcttgcctggtctaagtctgttggctctgcaagacatatatatggtgtgaatcaactctgcccctggcctgggctattctctgcaggttccatgagctatagggagtggagtttcttactgaaggtaacatgtcttcatattcttgaatgatgcttgatcctttgagcctattcataaagctgaggtcaaagcaatattgatttatttattaattataattattaattattaatattttaattaataatgattaattattaattattaattttttctgagacaaggtttctctgtgtaaccctggtgtcctggaactaacacactctgtagaccaggctggcctcaaactcacagagatctgcctgcct

SEQ ID NO: 34083 - DNA, 1237 bp, Mus musculus
ggagtctgggttatttttaaaaaattgtttaaagggaactcgttagggaggatccagtggggttccaaggggggataatggcggatatgatcaagacatattgcatatgtgtatggaattctcaaaaaagaaaaattctactaaaaaacaaaaggctgggttggccagatggctcagaggttaggagttttttgtttttatttttgtttttgccaacttgacacaaactagagttacctgagaaaagaaacctcagttaagaaaatgccttcaggggctggagagaaggctcagtggttaagagcactgactgctcttctagaggttctgagttcaaatcccagcaaccacaaggtggctcaccaccatctgtattgggatctggtgtcttcttctggctggcaggcagaacactatttacataagtcttaaaaaaaaaaaaaaccaccacagcaacaaaacaccatcaacaacaatgaaacaaaacaaaaggcttattttgcttacagttttaaggctgaagaagtcatgtggcaaaccacagtcctggcaagagtccagtggcacctctccaataggcagcagagagagagagagagagagagagagagagagagagagagagagagagagctgggtggagccaggctcttgctccttttataagaaccctttggcaagagcttacagggttttcctcagtgacccaagggctaactaggtccttttctttcttcttccttcttcttcttcctcctcttcttctttttttttttttggtttccaagatagggtttctctgtatagccctggctgtcctggaactcactttgtagaccaggcagtgaccaggctggccttgaactcagaaatctgcttgcctctgcctcccttcttgatgacaagaaatccaagccacatttaggggcacactggaaggcgaaggggactggattaaaggtgtgggccaccacaaccggctcttttattttatttttttaaagatttatttattttatgtatatgagcacactgtagctgtcttcaaccagaagagggcattggatcccattacagatggttttgagccaccatgtggttgctgggaattgaactcaggacctctggaagagcagtcagtgctcttaaccactcagccatctctcctgcccccaactaggttctccttaaaggttctaccacctctcagtactgccctttgggggttagcctttaa

SEQ ID NO: 34084 - DNA, 1249 bp, Mus musculus
ggacctgggggcccaggattaggaggccgcggcggcttccgcggaggattcggcagcggtcttaggggccgtggtcgtggcggaggccgtggccgtggtcgaggccgcggggctcgtggaggtaaagctgaagacaaggagtggatccccgtcaccaagctgggccgcctggttaaggacatgaagatcaagtccttggaggagatctacctgttctccctgcccattaaggagtctgagatcattgatttcttcctgggtgcgtccctaaaggatgaggttctgaaaatcatgccagtgcagaagcagactcgggctggccagcggaccaggttcaaggctttcgtcgctattggggactacaatggtcacgttggtcttggtgttaagtgctccaaggaggttgccactgccatccgaggggccatcatcttggccaagctttccatcgtccctgtgcggagaggctactggaggaacaagattggcaagccccacactgttccatgcaaggtgacaggccactgtggctctgtgctggtgcttctcatccctgcccccagaggcactggcattgtctctgctcctgtgcccaagaagctcctgatgatggccggtatagacgactgctacacttcagccagaggctgcactgccaccctgggcaactttgctaaggccacctttgatgccatctccaagacttacagctacctgacccccgacctctggaaagagactgtcttcaccaagtctccttatcaggaattcacagatcatcttgtgaaaacccacaccagagtctctgttcagaggacccaggctccagctgtggctaccacataagggtttttatatgagaaaaataaaagaattaagtctgctgataaaaaaaaaaaaaagaaaaaaaaaaaaaagaaaagcgtcctcctccaagggagttgcccacatgaaaaactaggtagagctttccatcaggagggcctccgtgtccctgtgcaggttgaagttaacacagacttcagaactccctgggttcaggatttccatgtgcacctacccacatattttaattgcgaatcaaaaggtcccactctttccctatcataaatatggatttacgtgtgggagggagactttcaagatgaaaactggcctcctctgatggtctgctgtgctgcactgagtcctggaactggagccacttggccttctgacatgaagggtttgtgtgtgtgtgtgtgtgtgt

SEQ ID NO: 34085 - DNA, 1148 bp, Mus musculus
gacacagctagacttggttcacaaaaccacagactccgccccttctgagttgcccagcatcacacatactacgacaagctctgcatatagtgctgtaagccttgtcaacagtgttccaagcctaacttccaccactataggttctgcccacacaaccacgccctctcccctcacctccacaggctctgttcccaatgcaacagactcaacccaggctaccccaagccctactcacagtaccccaagccctacccatactactatacgcctcacccacaccactgtaagccctacacatagctccccgagccccatacacactaccccgagccccacccataccactgtaagtcccacctgcactactccaagctccggccacagtaccactagtcccactcaagaagccaagatgtcaactcataccaccggtgctgtgggcccggtccagaccactacaagtcccatttccacaactgaaagcccctccccttctacagacgtggctataatctccagctcctctgcagaatccaccggcccaggcactgaacctctgccctgtagtcacccagcctcccctccctacactaaagcagaccccacagcttcctgcacctcttaccagagtcttgcttcctctggttcaaaacccctcacaagccctgccccggattccccagaacaaatccctaagagcccaagttcctctccctcatctagtgcccctgaaccccaacattcagaacataacctggccgcagttgctcaagccccagtccctgaggcaacgggaggagctggggacagaaggcttgaagaagctcttgggaccctaatgtctgcccttgatgactatcgtggtcagttccctgagctgcagggcctggagcaggaggtgactcggctggagagtctgctcatggtaaggaggctagactgggctgggctgaggccgcacagggacagctgccaaccagtgccagtagctctgaccctctttacaatcccagcagagacaaggcctgactcgaagccgggcttccagtcttagcatcactgtggagcatgccctggagagcttcagcttcctcaatgatgatgaagatgaagacaacgatggtcccggggacaggtgaggcagccag

SEQ ID NO: 34086 - DNA, 1200 bp, Mus musculus
ccgtcaagaccccgactctcccggaggccccggccactgggctctcattcctggaacagattttaccgattcagatttgagagtcgcacccgatccctcctccatttacgacttcctaggttccagtcccaagccctgcgtcctttacagcccacgtttcatagaccatcccgcctgcaatcctactggcgcccatctcgggcccaccagtccctttggtcctagcagaggtagcaaaaagtagaccgactataaagacccatatttctcattgctggttatggcctcgttctcccctaagtcccctgtgaacttacctcgtgtctgtgtcttcctgttgttcttccattctgggtgggagaagcttaataaaaataaaatctgatgaccagaaggtgatgtgtgctcttaggtggggcgttgattccatttttttctctcaggcacacaagcagcccagaggttgtggcagaggacagactagactcatcaaatggccagtctctaagcacagggtgttcagccctggatgctaccttggtccagcacctgtaccactgcagccgcctcctgctggtgaggggataatgtcctccccacccccagccacttaccccaaggagccctgaactccaatccaaccctcgaaacctctcagttctatactgcaatgccccagggtcctggcatttggtgcctattggatgtaatacctcctatactcttcctgctttggcctctcccaatgcatgctgggacctgtactctcctgacccccatcctccccaaccctcgccatgaagcctaaactacttggcaacccttgtcctctagaaactgggcacatttggacccctgcgctgccaggaggcctgggccctggaacggctgctgcgggaagcgcgtgtattccaggaagtgtgtgaacgcagcaagctatgggggaactctgccacatctgcccaggaaggtaaaggccgtgtgggcctgggctttgatgtacgtctggacccgcctgctccccctgcctggttcgctcggttgctgatacttcttcccgtccttcacagtggtacagttctccgcctctcggcccggcttcctgaccttttgggaccagtgtacagagggactcagccccttcatctgctctgtggagcgggtgctcctcaccttctgcagccagtacggtgcccgtct

SEQ ID NO: 34087 - DNA, 1115 bp, Mus musculus
gcccttcgcagcttggagggaaaatgagcgagctaaggaaatcagggcaactaggcggagacccgatcgcccagaagccgccagcctccgcccagggaagccccaccccaatgggaaccaggccgcctccgcgccgccggcagagcccacgcgcgacccggcgagggcgcgggagggcgcgtgcggcgtgacgccgcgcctcgcggcgcatccccgtgacgccatcgcgccggcttttgaaagttggcgcccggggccgcctcccatgctgccctgcgccaacccctcccctcacctttcctcccccgccctcgtcgccgccggccggccccccccacccgactcttcccttatcagcacccgcggccccggcagcgccgacgcaggcgcactgcaccgcgccgccgccattttgtgtccgagcctgtggagcgattaaaccgtgcgcggagctgcttctttggcggcagcggcgaccagcagcagccggtgcgggcgcgcggagccggccggggacgccaggtggccggagcggtggagcggcggcggagcgggcgccgcggggggtgtggcgcgaaggtaaagggggcccggggtggaggaggtttcgcgggccgcctctaggtgtcacgatggggccgctccggtcggcgctggctgcagcccggcgccagcgccagcgccgccgccggggggtgtttgtctccctctaccgtccctgctgcggcgcggccgccgccattgcccggcgccgccgccagggcctggccaaccccctccacgcccgcccgcccgcccgctaagcttccctcctcccaacatggtaggcctctggcggcggtggcgacagaggcctgcgcgctcggcgactccattttccttcctttgtctctaccctcgaggccggcttttggcccggctgatcttcgggccacggcccgccctctgcccctcccgcgacggataccccttaccgagtctggaccctctgaggctcggttgccgccgcttgcttcgcctaggggttctgaaccctcggccggccgcttagccaggtcccggaaccgtgtgggtgtcgggtcccgaccgacgcgcctcagactccccatcttcaa

SEQ ID NO: 34088 - DNA, 1105 bp, Mus musculus
aaataagatgacttgagtaggctgagagtaaaaaggcatttccttgcgtggattgaaatctgtatttcatcctatccctaattaatctgactcggctctctctgttgattagccaagtcaacactaaccagctattctgaaactcccccaagtttctgtgtgactacaggcactgagctcaaacccttccccagccccaaccccagccccccatacacccatgtgcacggggcccagccttcttactggtgcttcctcgctcctttcctctttctgtttcctcccccatccctgatgactacagatgctgtgcatctttcctgaatggatgggaggaacatgttgagtacagttagcagaattttgagactttatggattccttaaagtttgtttttgttcagttaaagagaactttgagtctgaactttgttcttttagtagtgtgaaacaaggtttcttccttttgtcagaacacaatggcaagacatgcagataactgtgctggtccagatggcgtagagggggaaaatggaggggagacaaagaagagcaaacgaggaagaaaaagaaagatgcgatctaaaaaagaagactcctctgacagtggtaagtgggtcattgttgatttggttagaggtgacacatcagagacccagttttcagtaaatctgtgtaaggtagtagaggcaagaaggcccctctcctttatgcttggaatctttctaaagccaggtgctactcacggagggggaagccggaagagcaaagcagagttcccatgccagactctccttagcaagtgcaaggctagccttggcatctgaaatgtcagatgagcccccgaagttagaagtgatgacataagcatgaggttgcagagctgtgtagtttgctgcagtgctccctgctgctgtagactctgcattgtcttctctttccctgctacctaccatgcccttcattatgttcatgttctctctctgaagaaactactgacagcctctactagatctgtactgttctttcttctgacttcaccgctggtttcactcataggtcttacagataacgtagcactagaacactggaggcaatctggactc

SEQ ID NO: 34089 - DNA, 1117 bp, Mus musculus
gctgtctgtatggtttgaaactcagcttttttgtttgttggttggttttgttttttaatacaagatttctctgtgtagtccttaagctctgagatccacctgtctctgactcttgaatgctagaattaaagcattaattctatcaccatgtggcattcttattcttagactcagtatacttttatatgagtactcagtattcttacactaagcagctcacatgaaatgtggaagtaggtatttttctttttgatacaggctctctcttcttagccatggctgtcctgtaactcatgttagccttgaacacacagtgatctgcctgcctctgccccccaactgctctacccccccccccccccccccccgtgcccaacctttccttaagggaatataaaacagtgttttcagaacatttaactctctgcttgctttctcttttaccactcactctgcttgacccactacctgtgctttgatttcttgagaagaaaatgctgagccggatctcgatgacaatgaggaggaggaggagcctgctgtagaaattgaacctgagccagagcctcagccccagcctccgcctccacctcagcctgtggccccggcccccccacctgccaagaagagaagggggcgacctcctggaagaaccaaccagcccaaacagaaccagcgtaagttgcctgccctggctcagtgagcatctcatgtgaggaagcagactgtgtttgtgaagatgggcactgagctttgagaacaagtgaaggtcaccacacaggcacagatgctcaggaagccctgttttgtttgtttggtttggtttggttttttggttttttggttttttaaggaagtttttttgtttttgttttgttttttgattttggttttttgtttttttactgagaaacatctgaggcagtctctaaaagcctgttacaaatgaaaaagtctagaggagaagggtactaatgtcctgcaagatgggtgtgctgttattttgggagcgattataaaacaaccaaggtcacagtcacatggcagagctgacatggttataagtagaaaagagccaggctttcagggaatgaagggctgaagcaacgaatagact

SEQ ID NO: 34090 - DNA, 2145 bp, Mus musculus
gttttgtttctgctgacttgggcatcactgctgaggctttcttgttgctgcatcccattcattgtcagcatcgggaacaatgcctgtgctcgctgggggctttaatgtacgtaccctttgttttgttcctgcccttctttgccagcaacagccatcattcaggtcgaagatcagaatacaggtgcaattgagaacattatagttgaagtcaaaaaggagccagatgccgagcctgcggagggggaagaagaggaggctcaggcagccaccacagacgcccccaacggagacctcacgcctgagatgatcctcagcatgatggaccggtgatgctggggccttgctcggcaccaggactattgggctgtgtttaaacggcccaaatcttaatttttctcttttttttctttggctttgggaacggcataattttacaccattttaccaaacatactgagaacgaaaacttcaaggatgatgttagaaaaatgtgatttaactagaacttgtttgatgttagcaaatcatggaatgttctaagtctctgagggtttactgtgaagtgttgaggacagtgttgatgcctaactagttttcttagatggaaacagagacattgagccctctctcttgatcgtaaaccactccagaacggccacgggtttcccagagttctatggtcttcccaagagaatttttaattgtaaatgcagacttgggaaggacttggacttttaacctggttttgcttttgcttttcctgactccctttgctcagagtcagttgcacaccagtaggatggcatgctacgatcagtttctgtcctgaaagctttgcctctttcttggcaaagtttctggtatggtcaagcttgtaaataaccttttttacattttaatcttttccattaattaagaggttgaaaagaagtacagtgtaagaaaacccagcattttaattatttgcaaattaaggtgccacagacacagacttagtggtatgtaaatgttgactcggatcacaatcatgtagcagagggcactgggcctgttgcctgccagtcatggacacccatgtgaaaaatcctgatttccagctcatggagccagcgtttgaaccttgaacaaataaatttcatttatgattttctcatcaacattttctttgctctgtttgtagctgaatgttacatttttttaaaaatctctgttcaagccagaagagttgattatgagtggccacagcaaccctggcaagctgggccaaaaaatttcagtaggtcagtaatttaaacttcacatctggaaaaaaaattattaataatgtgaaacaaaccaacttaaaaagtgattcttgcacatgaattgtcacatattatatgtgttttttaaagagcctcagtctgactgatttcaaacactttttttctcctgtgtattgcttttaagagagccatcagttagctatcagaatctaggttgatgcatttttgtacttagctgtactgtgtgatatttttcattattttaggatgccaacatgagacctgtaataaaatatgtaatggggttgaaggctggggaggaggatctactgctgtacagctaataaatcataacggattaacaggcattctgaagactccgtcttttgggactcctatttgtccaggtcccatgggggcctgtgcacagctgtcttctgcaacagacaggagagagatggtcctagcaggtgatgggctgtggaatgcagcccacttcaagttgtgtcccacaagggtgtgggagtagggaagtgcgtggctatgtagcccctgcttccgtgatagacctgaagtcttgctgctcttgtacagcaagtgtcaccagagatgctgatgggagagagcctgtgctcttgagatctgcttaaggaaggcttagggtccatctctgttcttagccaggcccaggggagtagagagaagcttggttcaaccttggagagataaagagcattggtaatggtaaaagggcctgagagcaagctcaggtagtaattcttgttccttagctgtgtgcatatgtaacagaaagtccctttaacagaacagctagctttcacctgcatcgtcagcatgggtattcaaattaccttaaaac

SEQ ID NO: 34091 - DNA, 1129 bp, Mus musculus
caaaatgaaaatgacagcacggacaacttaataaatgtttgttccctcattctgccttcggattggtcgagtcctttttgggacgctcgaaccatagcgtaatgacgtaagaacagagaaagccctctctgcctccgtctccgtttcctaggaaacgtagactccacgtttctcggtgtcgcgtcccccttgacgtcatggtttgggtgggagggcggggcgagtgctaccgccaggggcggggcggctcgggccagcgggccgggctgtgcacctgcgcctcggcgggctgctgtggggcactgtcccccgcccgccaggccctgcaatggccaggccgcagaggactccggcgcgcagtcccgatagcatcgtcgaggtgaagagcaaagtaagggcttctctggtctcggctctagccactgcgctagggctcctaattccctttctctcccttattagttccttggctctccatcacctctttctgtcctccatcctccgtcctattctgcttttctgtctgcctcccctcatcgcatcctccctcccactacggacttccagagtccctctgtggcctgggtatgtggagagcaagggaaagaccttggacagtgtcccttgtactggagctgaggtttaagcctaaggctgcagctgttccagcaacctttccctctcctgacagcctcagtgctgtggtgagaaaggggcttgggatgtcctgacactccgttccctttccctcccgcctccagtttgacgccgagttccgacgctttgcactaccccgcacttcggtgagaggctttcaggagttctcgcgattgctgtgtgtggtacaccagatccctggcctggacgtcctgcttggctatacggatgctcacggtgacttgctgcccctcaccaacgatgacagtttgcaccgggccctggccagcgggcccccacctctgcgcctcttggttcagaaacggggtgaggatggggtacagtgggcagctttcttgggttagggtgataggacaggtatatcagggtagatcatacccagggcccccaggctttatgttctgtagcctctgcccttggtctgacctccaagtagcaggaaaacagttga

SEQ ID NO: 34092 - DNA, 3089 bp, Mus musculus
ccaactcattaaaaaagaatcatctcttgtcacttcaatcaagtgatttgtttattttaggctccccttttgttgagcctcaggttcagctgctgcccaggaaatatgggttttggggaaggctgtttggtgggcaaggtcagactaagctgttttgcagcatcccaagaggtgtgggtctctaggccccctataggtaaacaaaagaactgcaggttcagggattcagggaagtgaggtgggccaggggcacacagcaaagcaagggaacacagggtccgtagccagcatgctgtctaccactctaccctgcctctcactgcctgccttgcccctctctcccatctcaatgcctgccttcccttgttaagatggccaaataattcattactctcagttgattgcctggaaactacctgccttcatcccaagagctgctgtgtgccaggctgccaagaggaagccattcccaagacagaggcccttaaggacagggctcttttcttcctgccagagtcttcaccatcactgcccaaccctgatgggattgatgctttctgtggagaagttggtacctcatggagactgattcttggatcactggtcccagagtggatggaacccttgacttcctgatccggatttccctacagcttaaggaaggctgctccctacagcgtggccccagcgactcttaggaaggggggactccatgggccttacatatgtcccaccagctgtttcacaggatcctcacagctggcgggacaacagcaacaacaaaacccactatcccagggctgagatgctgccaggacatgagtaggccatctgtggaggggactgtctaccaaggaagaggagggtctatacagaggacacctaggagggccaggattttacctgcttcacagggtgagtgaaaagcctaggcaacctctgcaaagattagggtcaactgtggcaaagccacaagtgagtttccagtctccaagtgcatctgggcaggggaagcttttgttctgctggtggacacagaaatcaatggcagagctcgagatgttctgtgcccaccagtcctcacaaggcccacagctggacaaaattgaattagaccatctgtcagtgaggaagtagggccttgactgagatcctccaaaattttgctttagggtctaatcctacaggctactatgttttcctggttcctgtcagggccttagtttacagctcctcaggaggtcttgtcctatgtaaaggaaatttcatcctgtccaaggctgggacacccaagctccaagctcaggttggaaatatcaggctgttaacaatggatgggccttacatttggaaatgaaaaccagaggcatttgcagagcagtggaacttagagaacctctccaccagtcctctccttttacagtgaaagaaacaggtccaggaaattaagtgatttgaccaaagccacacagcaaatagtggcagaaccaggactaactactcctgtgggttagacaagtcctgtcgtgacctaaagcaaaatggcaaatgagctttgtaaggggttaggttggcgtgagttcagcagtgcctgagcagctggcacctttcgtggtgtgacgggtagggatgggtgctgagacgtggattgcggagtggctgagagggccttggacggcttgggactgctgtgtgctgcacgggattgtatgtccacctggctcacactcagtacccatggccacctccccatttaattctgtgccttatctcactgtttcagctgagtccaagttgtttactctgttcctctccagagaggctttctgtcctagttggacagctcactttggggacataagcctttgttccacaagctgtggggagggccaaaatcaagctgctggagccagtaattagtccagtcctgctgccagaggagacctgtatgcacccccaattccactagcccatttccaggaatctggagtgaggagcagttcctggaagcaacttagcaaagagctggacctgaccctggtgtgcaaaaggaggacctggccgggttgggtttgtccagtcctgaggtagcagcatttcctagctcactttccctaggaggcacagatggcagctccttgcagagcaagggccaagttggcggatgactcagagtccctctcccccaatcccttcctctgagggtctgtggctaggtgcagactgggtgcagaacatcacaaactaaagaagtaaggactgcctggctacccagcaccttcccagtccttaagcacaaagatgaggcagaggactgttggggctgaacgttcctttggttgctcacaactcaggtatgcatgtcattcggcagctggacagcaaagccctacttcaccaccaatcacaggcatttggacctgtggccagatggtggcttctggctgtcccagtgcccacctctttgcatcggttccctccattatcaactacagctgaaactggcatcctccacagtgtgcacactggctctgcctttgtccttgcaagttgatattcggcattagcatgaaacttgtggtgtgagagggttgacagaattccaacacaaacatcctagtaaattgtacttgagatgaaaagattcctgttgtattttgacagaattatttttattaaaatacacatccatgagcaattgtgtctgttgttcagaatcttactggagttggggttgggaggccctacctcttggtacctcggggacttttgaaatgtcaactttcaactttacaagactccaaaagggacagggacttgagctgttctcgattgaaattgttctcagacatggaaaaaacaaactcaacttcagaaatgtgggctattgctgggcgtgatggcgcatgcctttgatcccagcactcgggaggcagaggcaggcgtatttctgagttcgaggccagcctggtctacagagtgagttccaggacagccagggctacacagagaaaccctgtctcaaaaacaaaaacaaaaaaaaaaaacaaaaaaaaaaaaacaaaaaacaaaacaaaaaaagaaatgtg

SEQ ID NO: 34093 - DNA, 1111 bp, Mus musculus
tttctctgcagcaagtggagaattatcctccagcacacatgactcactcccagctgaacagccacccccgtcacctggagttgcagtgtaagaaaccccagttgttgggaagagggtgccctgaagtgggcattgtgcgctttcaagtcctcatagctatacggatgattgtcaagcacagcagctccagcctgtctgccgtcctggtgcctgacccaagatgtgtagaagagcttaggtgagggggaagctcctaggccagtatctaatcataggtggcttcctggaggacatttgtcggcttgggacaggcagtggtggattcctaaggggagagactgtccagtttgagacctgagggttgtttgtttgtttgtttttgtttttgttttatttttcgagacaattatatactctgtatactcagaaatccgcctgcctctgcctcccgagtgctgagattaaaggcatttgccaccacgcccggcgagacctgaggtttaacaagcttgagcaggtgccaacataaatgttgaggcttgactagagcattggatctatattggaggatcagggtcacagggaagggccaagctgtttctggttgtagttgtcagtcaacagcctcctctttctccttctcctcctcctgtttttgttttttggtgttttgttttgttttgttttgagacagggtttctctgtgtagccttggctgtcctggaactcactctgtagaccaggctggcctcgaactcagattcacctgcccctgattcctcagtgctggaattaaaggtgttgtaaccccaccccaccccggtgacccgactcatccccgttggatttccagttcaagttaattaatttgcaacggtcacagtttcagcagagccagcaggacttgtcttcacataggggcctccccaaactgcagttcaatcacctgtctgctcctgtcctcagcctatcttcagagcccctggagtctgtgacagctaagtgcccatccaggacccaaactgcaggtcctaggcgccgccaagacccccacaaggctggactgagcccctatgtgaagttcttcagcttctgtactaagatgcccgtg

SEQ ID NO: 34094 - DNA, 1354 bp, Mus musculus
tcgagtttgcagctgctgaaggggcagccgccgctgccgccgcctcagagctagaggctgctacggctgggctggaggccgctgagtgcactctgggccctcagctggtggtggtaggggaagagggcttccctgacactggctctgaccactcgtactccttgtcctcgggtaccacggaggaggagctcctgcgcaagctgaacgagcagcgggacatcttggccctgatggaagtgaagatgaaggagatgaagggtagcatccgccatctgcgtctcaccgaggccaagctccgtgaagaacttcgagagaaggatcgtctgcttgccatggctgtcatccgtaagaagcacggcatgtgaatggttccccccagaaacctgcagaattcgtgactccttccagcccaaggaatcctcaggcaaatgttgtactccccagtattcctgttgacagtgccgaggtttaggacagcgggactccagttggtcagttggcaccttctttcgtctcctcgtgaagtaagagttggggacttcagaatctggtgacaccagcagttatgactttgtctctcactccccagtttatgttgcagattctggttatacacaggcttcagaaccactgaacttggaacttaccctggagggggtgcagatggaactcttaagggactgtgggtttgaggaaaccacttcttcaggttggccagcaatcagagacagctttgctgtgtgtagtgataagagatctcagtaacatcgtttctcctttccatgctacccggttcaggtgcagtctgtgattctgatggggactagctgatctgtgcctctgtctcttaggacctctctacccagaaggtcatttatgagagggctctgggtgacttgctgatggagatccagctcaccagggacttaggtttatctcgttatgtttgctactggttacaaattctattttctgtacaattagactgaagttttcactgtttggcaaaacaaattaaacaaaaaagtaaggtttttatttgggtttcgactttttttttttaattaaagctaagtgtccttgaaatgtggggatatagataggtattggcctatttgaaagaacaggctagcccagaaagtagagatgctttaaacaactggacccggtttctccataaagcacatagatcttcataaagtcccttgttcaggtcactccgaagagtttggaagctgcacgaaaggccttggtttgtccatcattgtttctctggattgttgtgtatgtgtacatacatcaatgtgtgtaggaagggggtgcctgccagaggttctatacagccctttctttt

SEQ ID NO: 34095 - DNA, 1103 bp, Mus musculus
gctctgtctgataccacctgtggcctctgctctgtagatttgggtctagtagcagggtagatattctgtagcagctagaaaggccttagcaaatatggcttcccatatttataccctctgggttgaagtcctaaatgtaggggcctgctctatacccaaaataagtgacatgcagatgcccacattccccaagcaaagcgagagatgctgtgctgcctgcttgggatatcagagccaggcgccattaggtggagtataaattccacactggaaggaagcagtgtgaaggagtgctctaactctcccctcaagacctgtgcagggcatttacacaccatcttcctactttccacataccccatacactcttcaaatcccaggaaatcttaactagtatggcagtttctgccctgtttcttagtctgggcacaggtcttgctcagtaccgatatagcttttcatccttgagacctctggatagtataaagctactaaaatagcaactgcaagctagaaccaagcccaggatttggggtttaggattggctaggcacacctgaacatgcccttctccctgctctcctgcattgtgaggggagagtaaagatttccacatactccacaggttgcctggttagaccagcatagtcctggacgctacacagaaggttccagtgggattgatctctagctgctgtgtattgggggaagtaggggtgggagagaggtagatgccagctgcctcttaatccaccctgtataaaatctgcaatacagcttcttccatgtacctgtgcctgaaatgtctgcaataaagaggtgtttgtaaactatggtctctttattcctaacgtgaagttaccgtgtgggacaaggggttactggggacagttggtaacaatgacagttttgggggtagaaactatctcccttgcccttgcatctcctggggctaatgacctcgaagatgtcttggtcttgcttactcctaagcgggggaacagacccttaccagttcaccttatttaaggtctgaaaagttactacctgagtggtaaagttggctttgttgtaccattatccagttcatcagaatggcctag

SEQ ID NO: 34096 - DNA, 1220 bp, Mus musculus
gagatgcagatgtagtcagattctagggcacagtagaggtttcaggcttccctgacatctcccagggttgggggagctggtgaggagaagcagactcggtaggcgctgtggtgatagtaggaggcaggcaaggacagggctcctgctgctgctgcccggggctgggtgctggctcacaatcctctgcttctcttattccagctgccaacaatggctcagcaatggtccgtgtgatcagtgtcagcacttcggagcggaccctgctcaaaggtttcacaggcagtgtggctgatcttgcttttgcacacctcaactctccacagctcgcctgcctggatgaggctggcaatctttttgtgtggcgcttggctcttgttaagggtaaaattcagtatccattcccaggccaggggactaaaacggcagagttgggtctagggccggggctgggctgctaagggttacatcatcatcatctatctattgagccttaactccctactcagagaagagattttagtccatatccggcagccagagggtacagcgctgaaccacttccgaaggatcatctggtgccctttcatccccgaggagagtgaggactgttgtgaggagagcagcccgacagtggccctgctgcatgaggatcgggtgagagcactggctctggagaaggaaggctcagagctgcctgctgaaagtgcacatggactaaatccctccctgttccctaggctgaggtgtgggacttggatatgcttcgctccagccacaacacctggcctgtggatgtcagccaaatcaagcaaggctttattgtggtgaaaggccatagcacggtaggtctgcaatgggtctcttctctgccttgcccctcatccgtgctcttcagctactccccatttccacagctgcccagggggctttaccagtatgctgctcgtggggatgttgaagacaaattggctgtcacttgtacagttcattcctaatctagctctgctctgcgagtctggttttctctgtagtgcctgccctccacagtcagcacacaggagcgtgaggccactgttggtcagctcagttcgctaccatcttcatttaggaagggctcattcttacctctggtcaggaggcaaagcaaagctttttgggttctttgcagtgcctaagtgaaggagccctctcccctgatgggactgtcctggctaccgcaa

SEQ ID NO: 34097 - DNA, 1099 bp, Mus musculus
cattgccatctctcgtgagctgtggccctactttccaactgcatctctctttcctgctacattatggccgtcactgcagatcccagtgacttgtttttgcgccccttagcccctgttacttaagcctttgtctttgcccttctcaggtatccactgctgcctctgcactgtccttggatttgcaggaagtggagccattagggctaccccaggcctccccaagtcgaacccgttctcctgatgtgatctcctcagcatccactgccctgtcccaggacattcctgaaatcgcatctgaggccctgtcccgtggctttggctcctctgttcctgagggcctcattgagccagacagcatggcctcagctgcctcagcactacacctactctctcctcggcccaggcaaggccctgagcttggctctcagctgggtctggatggaggccctggagatggggataggcatagtaccccttccctgctggaagcagccctgacccaggaagttgcaacccctgacagtcaagtctggcctacggcacctgacattactcgtgagacctgtagcacactgacagaaaggtgagaagcttagaaggggaaaattatgcttggggtgggagggacattaggattagccactcctgagccagtgtatttccttagccccaggaatggcctccaggaaaagcacaaaagtctggctttccacaggccaccttatcacttgctgcagcaacgtgacagtcaggacacaagtgctgagcaaaggtgagcgccacctgggtctatgtgctcctctgtgaaggagagccattagtagggggacagcaggtgagcaggctcttccccttccacagtgaccatgatgatgaggttgccagccttgcctctgcctcaggaggttttggcagcaaaattcctactccacggctgccttccaaggattggaagacgaagggatcccctcggacgtcacctaagctcaagagaaaaagcaagaaggatgatgggtaggaggataggaggcttctgggaccagggccaggggtggtctcctaagctgcctgatgtgacctgcaatgcttttttgcctat

SEQ ID NO: 34098 - DNA, 1862 bp, Mus musculus
ggctgagccaccagctatgacatggacacactagtgtctcatctggacactttctgccatgtcacctgggcctaataccttctctatagctagacctcatgcccagcagtatgtagggtatgtctggacccagctcctctctgtacctttagtagcccctacctcctatcacaggcctggcctgttaggatggaatggtggcaggactgagtctccactgatctctttaatttttgccactttcttggaccaagcggggctactgtgttgggtagaagggtcctatggctcaggactctttacccattccttttataacccccttccctccacagagctttgtctagctcccacatcctctgccatgccaatccttaagattatgctccagtgggaggtctggcttgtgccgtagctaactcgcctcattagtcctttagtcctttagctccagttagtctccagcaaccctctctcccccagccaagatctgtctgtcttcatggtgccaccggggacaccttctagtccccagacttgccaggacctctggctgtagagactgtggcatggcccttgacctcaggctccagcctctctatgagaggaatcctgtctgtcaccctccgtgcctttgcagagcccactgtcgcctgtctctccaccaggaggacgccatttcattccccagctgcctccttcccaacagtgaggggttaagggagctccgtgctgctacctgggggtggatgtgcctgaggaaggtcctcctcagaacctcctcatcaacctttgttctgtcctttgctgtactgccctttgctgcttccttctggagctgcctggccctcctttatagctccattgcgccacctcgtgtctggtctgggtataggtggccaggggagggggtggtgacggatgcacaaccttgcaaacccacagccctctaaacggactaggaaagaaaggcgttgctgaattgggggagagtcctgggctgctcaactcctcttctgctcagtttctccaaacctcaccctggaacttagccgtactgtgttacctgcctctgaaccctgggtgccttgggtgctgaccttgctgtaagagctggccttgccctatttgccctgtgcccgtttcttttcatagcattaactttccaggctggccccaccgagtctcaggctgggaggtagggtagggttacaggggcagctttcccaagggactgagccacaacagtccctatagctgtcgtgggctctctaccactgttaggctggaatgcaacctccctccatctgtagctgctctcagtgggtaggaaggggccaggcagagcctagcttgggccttggctagattaagagcctgtcagcaggaagagtctagctccactcagctcctctcaggaggcagccttgggcgaggcgctcttttctacatatgccacctccactgggaaactaaaccaaagagaccactctgtgccaagtcaactgtgccttctatatgctctcttcacacacccctccccctgggtaggaggcagtggagagccaaagcctcagagttcccccacctaccagttccccaggaatccctgggggtgtgaaccaatggggatttattttttctcttgcccaaagtaggtctggttgtgaggataagacagagggagtttagtgtccgggcctttgataggtccaccaggccttcatgccatggaccatggatggagactgcagttatttatttgtgtactctgtaaatgtatcttctgtatccaataaacaggctgccctccctcagggaaggctgccattttttctgaccacgctgactgtgccatggga

SEQ ID NO: 34099 - DNA, 1177 bp, Mus musculus
acaggctggcagtcagcggtgcccctcctccctagacactgtgcgctgcaccacagctgcccacctggccctgctggtgccaaagaacatagctttctaccccagcaaccacgagcgctacctggatggccatatcgacgtgtggtggatcgtgcatgatggaggcatgcttatgctgctgccctttctgctgcgccagcataaggtatgccagctggctgggtgtgggcaagggcagctgggctctcgggaagcccggcatgacccagctgctcacacgaccctcggccacaggtttggaagaagtgccggatgcgcattttcaccgtggcccagatggatgacaacagcatccagatgaagaaggatctggccatcttcctgtatcacctccgcctggaagctgaagtggaggtggtagagatggtgagctgtctttggcctgctctgtccccgaggaaccccccttgcattcccccccaccaatcatgcatcctgatactcatccccctccccccaccagcacaacagtgacatctctgcctatacctatgagcggacactgatgatggagcagcggtctcagatgctgcggcagatgaggttgaccaaaactgagcgggatcgagaggtaaatggccatcttggcttgggcttgggtaagggccacatcatgcctttgtctggtggatataacaatgaatgattcaggactaggcttggtggcccatatctataatcccagtactcagtaggcggaggcaggtggattcctttgagttcaaggctagcctagtctacagagtgagttccaggccagccaaaggacctgtctcaaaaaaacaagacaaaaccaaacaaacaaaaaggtaggcatggtggtccgtgcctataattccattgcttaggagcctgaagcaagaggccagcctgtctttaacaaagaactgcatctgtttgcctgaatcagaaaggtcttagaggcaggatagtcctattgggccaagcaggcccccattttcccagggtaccaaggatatctcctctggttgtcctcaggcccagctggtaaaggacaggcactcggctcttaggctggagagcctctactccgacgaggaggaagagtctgtggcaggggccgacaagatccagatgacgtggaccagagacaagt

SEQ ID NO: 34100 - DNA, 1192 bp, Mus musculus
ttttgtttgttttgttttgttttgagacagggtttctctgtatagccctggctgtcctggaactcactctgtagaccaggctggcctccaactcagaaatccacctgcctctgcctcccaagtgctaggattaaaaaccactgcctggctggaaaggtttttttttttgttttgttttgttttttaaagatttatttatttatttgttatatgtaagtacaccatagctgtcttcagacccaccagaagagggtatcagatctcattacgggtggttgtgagccaccatatggttgctgggatttgaacttcggacctttggaagagcagtcgggtgctcttacccactgagccatctcaccagccccctggaaaggttttttaaagcaggttactctatgctagaatataacccctttatggaatagtctcctatttataggttcttctttttcaacattgtattttgtttggttggggtttgtttgtttgcttgtttccggtcttttgtgataaatgatgtcactacgtagccctggctagcctaaaactatgtagcccaggctggctctgaacttgaagcgatcctgcttctgcctccaaagtgctgggattacaggctcgtgctgctgcagcagcctttttaaaattttatttattttttcctctccttgccactattgccatgaacagtctggaacacccttgatgttccctttaggggaatccaagaggtggagttacaacatacaagaaattgaccccattggcgattttcagtgtctatcaggatttaacagcagtgatggatcggtcttgtctccgtattcttaccactttggggcccaggactgactgccagttttctagaagtgcgtgattctaatagaaagaagcaaagactcaggcaggctcatgctgagcctcagggacaagaaaacagtcaggacagattctgcgctggtctattaaagagaaaagcaggctgcgcttttgggtggtcgcggaggtttgttacaagggagatctcactgaagagttagtcttgacctgtgtgcactctctccattatagctggtggctcgtacttcatgatttcccgctctttgggaccagaattcggaggtgctgtgggcctgtgcttctacctggggacgacatttgcagcagccatgtatatcctaggggccat

SEQ ID NO: 34101 - DNA, 1157 bp, Mus musculus
atgaagttctaaaaaaataacgcctgtagtgcccgtttctaggtgaatacgtggttttcctaaaatggtcagagtgatagttgttaggacccctcacattctgattcctgatgggtgtgtggtgtgaacagacaattgcttcataatcctttctacatggttaaggaaatgccagctcctgggagccttagctctcttgttgctatactgttgccatactgtggtcaggccatcctcttcaatggtaagaccttctgtgtgcttttccttagggaggaatgggagccgctctgctgtcagaccctgacaagatcgagaaggtgagtgactgtagggtcctccaatgtgctgtgacttagagttctctaaaatgtctctcccccttagtccagttttactgaagtctgcctagattctctatttggggtccagagaaaatgtctttaaatttatttattcttttgtgttatgggtggtttgcctgcctacgtgtttgcaccaagtatacacaatggctgaagagatcattggatacctgggagatggaattacaggcggatgtgagctacccgctgtgggtgctgggaaccgaatcccaaccctctgcgtagatcattttcttgcatatcagaatctctccagccctgacctggaaattaaaaaaaaattttttttttgatatgcagcgagatttaggaactcttcagttagccttcagggctctagagttctgtaacagtctatagatagggtcatgtcacctaagagccacagggcctgaaaactcctgaatattgctactttcccttctggaatcatctgagagcagagggcagatgactctgggtcagagcaagttccggagtctgtgtgtagatgggtagccctttcctagggggctggacgagagtggcagggtatccctgcatatggatcgtgtgggtagtgtataccacaggtcacttcccatcccttgctccccaacctttctttttgatatggggtcttgctatataattctgtctagcctggcacttgctatgtagtctagattggccttggacaatgaacaatcctcctgcctcagcctcttgagtgctgagattctagttttgtgccataatgccctttgagagcagcccaggccaggattactt

SEQ ID NO: 34102 - DNA, 1559 bp, Mus musculus
ttttgtgtgtatgcaagagagtacacagaaatataccttctataaaaaacattcattattctcagattataatttttggaaatgtagaagtaaagaaaaagaaggtcgcataattacatatttccttatgtaacatatattcatatctgcaaaaaatgaataaatgtatttttaaaaagtcaacctttgttgttgttgagctatggtttgaccaaatagtgaaagctggcttaaaactcactatgtaggcattgaactcttagtaatccttctgcctgcgtgttgttaacatttaacagacaagaatcactgtgcccagctcttttgtgaagctaatgacatgcattttgatgtccaaatgtttttcctcaggattgtttctactgtttcatctaataatttatacacttgaattttctaatttcttcttttattgacctttttggttgtgatttttttcttttctttttttttcatagatcttgaaccagatgattgtgcatccatttacatctttaatgtagatccacctccatctactttaaactcatcccttggcttaccacatcatggactgctgcagtctcactcttctgttttgtcaccatcatttcagctccaaggttacaaaaattatgaaggaactggtgatatttctgaatctaaatatagtccattaggtggtcctaaaccctttgagtgcccaagtattcaaatcacatccatttctcctaactgtcatcaaggaacagatgctcatgaagatgacctacatataaatgacccagaaagggaatatttggaaaggccttctagagatcatctctatcttccacttgagccatcctaccgggaatcttccctcagtcctagtcctgccagcagcatttcttctaggagctggttctcagatgcatcttcttgtgaatctctctcccacatttatgatgatgtggactcagagttgaatgaagctgctgcacgattcactcttggttcacctctgacttctccaggtggctctccaggaggttgccctggagaagagtcctggcatcaacagtatggatctggacactccttgtcacctaggcaatctccttgccactctcctagatctagtatcactgatgagaattggctgagccccagaccagcctcaggaccctcatcaaggcccacttctccctgtggtaaacgacggcactccagtgctgaagtatgttatgctggttccctttcaccccatcactcgcctgttccatcccctggtcactctcctagaggaagtgtaacagaagatacctggctcactgctcctgtccacactggatcaggcctcagccctgcaccgtttccatttcagtactgtgtagagactgacatccctttgaaaacaaggaagacttctgaagatcaagctgccatactaccaggaaaattagagatctgttcagatgatcaagggaacttatccccttcccgggagacatcagtagatgatggccttggatctcagtatcctttaaagaaagattcatctggtgaccaatttcttt

SEQ ID NO: 34103 - DNA, 1119 bp, Mus musculus
gttaaattaaaaaaacaaaatattaagtaaatgtatgggagccaatgcattagttagaaacattaatttctctttttcagatttttttgcatttgtactctaaaataatttcatttcaactcaatataactctgtttctaaacattttagcttttttaataagaattattaccaatgttttgatttttttaaagatttatttattatttattttatatataagtacactgtagctgtcttcagacacaccaggagagagggagtcagatgccattacagatggttgtaagccaccatgtggttgctgggatttgaactcagaaccttcggaagagcagtcagtgctcttaaccgctgagccatctctccagccccctagtgttttgatttttaaaagcctaaattaattaattccaatgtttattttatagtatggacatatcttgaatgtgtgaaatattttaaaataatattttgtttttcttaactactaaaaacagctcagcgatctgctcaagaactccctcatattgagaagtacagtatcaacagttgctctgtcaatggaggccacgaaatgattgtgactggatctaattttcttccagaatccaaaataatttttcttgaaaaaggacaaggtaaataatataaaatacaaattaactcagtataagtgattaaagaaggaaataaattaagtagatatttcagttatattaatcaccaaatagtcttcataaaattataggcatcctgtaagcaactgggttttattgaaaacttacagttactaaattcacatgtatgtgttaaattctctttaatggcatattaaaagtaattcacccagcatttctactacatgatgttcactcaggaaacctgggacatatgtccacacagaggccgagacacagatgcctatggcagcgttgttcataacagctccaaaggaaagaacaaaatccttactgactgatgagcagacaaaagcaatatgctgtgtccacagtaccctagtttcttctctcttgctttgataaaatacccagacatttaggtaacaaaaggagtttggtttatagttccaggtttcagctctgtgggaagtaaagg

SEQ ID NO: 34104 - DNA, 1104 bp, Mus musculus
aagggaggcctatgactatataacaccctgttctgctgtggaggacatttcagagcactgctaatttgaccatttcctaaggaacattttgttgtcattactgttttgttttggcagctgcagatactgctggtgttttttacttgtgttgtgctggcacagacaaattcaggtgttgggagttaagagttgtgagctgctaaactgggccagatgctatgacctacataatctgttggtactggtagtaaagactgttgactttttgggcttttagttcatttcattctttgaagggaagaaaatggctagacatagtatcacacacctttcaggaagaggctggtagatatctgaattcaaggccagcctggtctacaaagtgaaaccccgtctcaataaatttaatacaaggagctgggcatggttgtacacacctttagctctagcattcaagagtcaggaggatctctgagttcaggccagcttagagagagttctaagacatggagggatgcatagagaacctgtctcaaaataccaaaaacaaagaagaaaatggtacagtagggaactaaatatctcttttaccatctgaaaatggcagaaacatgtaaagcatcgtatataattgatgaactatgatacaaataagtgaatgaacacatacattcaaatgaagtgaaaattgaagttgcttctggatatgatggcacctgcttgtaatcccaggagggagggagagaaggggtaaagagaagagacgagggagagagagttttgaatacatatgtataggcagagagagagagagagagagagagagagagagagagagagagaggatatgaatttagttcttcactctccaccttattattttaagataagtctttcaagctaggcagacagctaacaagcctcagagatcatcctatgactcagatcagcttgcttctgcctctcaagtcagaaatagtttttttttctttttctttgactttttttttaattttatgtacattggtattgtgcctgcctgtatgtcaatgtgacatacatccaagggatgccagattccctggaactggagttacagtcagt

SEQ ID NO: 34105 - DNA, 3141 bp, Mus musculus
ccattacttttaaagtccaaactgaagttaggtggggaaaagggagttcttgagccccttgaggagtgatgcttccatcttagtgccagtctgctctgcagcaagccatcggaaggaagtgtcttaagagaagaaaagaaaacctcatacgatattcctttgaagttgctaatactcttctttttcttttttagtgaacgagattattgggagagacatgtcccagatttctgtttcccaagccacggaggtgatgagagacactcctctcccgggtccggcgtctccagatctgatgacctctcacagtgctcagtgagccttttgcccaccacggactgctcagcctgcttctctcccggaacttaaggtccagccagacttcaggatctgttgcaggagttggactcactgtgggaaaagcagcgttccctctccttaagccacaggcagattgtgtaaaacaggaacagcagcggctgtttcagctgtgggaaacgagctttgcttttatatatatatatatatatatatatatatatttaaataggatacttttatatgatgggtgctttgagtgtgaatgcagcaggctctatctcagaggtgctgctcttgcaggtgacctggttgcatagctaggattagtaatttgtactgctttctggtcatttgaagagccctttagttttgatgatatttttaaaatagaactttttgataaaaaaaaaaaaccttccagatgcagacaaaaaaaattatcctaagcccacacttacacctcagaaacttagcatgcatcctgaaatgaagcctttcatagactcatagggaataaagccaaatgtagctcttactctttataaaataaagtgttaggtaaattgagaagaccattccatcattgaagtgttgggatatgaatacattccagagcatagccttttgtaattttaggtagttatcagtttctccactagctccatgttctagctttttcctccccacaggaccttgggtaaaatggtcatttgtaaggtgaatttcaaagggagggttttagcttaggtagttattttctacctaacttttcaagtaggagcctctgcctttagtcagtagtctttgaagcaagtatcctgatagtttaaggctttgcaattttaactccttgaggccaggccagaagtgttaggagctaagtatgaatgaactgtgtaataagagaggcagagaaaatgcaggactccagttgagaaggcttaatctcctgtttacagcccacaatgattctgtcccatggtgtcctggctatatgacctaaaaaccagcctttcctccacaaggctttgagacacatccagagatgaggtggtatcagacctgtccttccacaccaaagacatggtggtgctgctgctgctgcttctgctggtgaagtctgtgtccaaggcaggggccagcagaaactccagcctgctgtctaccaaaggactgttcccagaccctgtctttacccttcccttttaaagtccctgaattttacagtctgctttcaaatgaaatattgtactttaattcattcaggaagcaaattgagtgcctataagtgagacactgtgctgcactggctgaagacttaatgctgttactctaggtagttggatcccttgatggtggggactgtctttactaaagctacatcaggcctactaagcaggagctggcctgttgcctaccacccctagtaagcagggtaggagcaacagattcaagatgagagaagtatgtgtttgtttttaacatgatgctagttagagaacagtcttatcagcaaattactctggccactcttggagctagatattttccaaattttctctgaaggtgagttttatatcaataagtatgaatagagatttactttaggggtcccatggttggtagcccacagcttcttctaaagggcattggcctctcaggtgaacttgcagagacttggccaaatttgcttcctctttcccctggggcagttgcctcatatggggtcattacaagaccccttgggggtgctgctttgctgccttcaagaataaaagcctctatgatccagagttgctatgcaccaaattttgatgccttttaaataccttgatgcctatagcattagaaatgctttcctatttaaaacaggttagattttaaaatagagctttgtattgtgtaatggttttatatattagctttgtataagctttcatgtaagagtcatattttttggctttgtagataaagacttaaatttttgtgcaaaatagtggtggtaaagcacacatcattggactatgcaagttgatttctaggagcagcactgagcagctggccattgctagcacacaccctttccctcacctgtactagagcttggcttgaggaaggaatgaaggagcagccttctgtttactagaaaaatgtttgggttcacacgtggtgctgctgccctgggtacagcccaccaacacccagggccagccagtatcaccagacctctgctggacctagtcaagaagcccagttaacatgtagagcatgggctcaagatgaaaccttgtgtttatagaacggatgtttaggtgaagaaattggttcttggttatgtttacagcacttgggattgtgttttcttgtacattttgtattttaaaaatcttttataggagtgcagtgctcctatacaaagggaagatgagccagcagtccaggctcctcctcagttacagtgctgacataataaacagtgacagatcaacagtctccttgaaatctgagtttttctccacctggggctggtgtggagccctctgggccaaaggctctgtggctttttaaaagtccgcttgaccaggaacctgagttctgcaccctttaatcagtgcaaaggacatgccatggtgtttgctggcttttggacaactggtcttccaagtgttgcaagaaaaagttggcaaagtcccctttaacctgagtttacatgtgttacctgccctctggtattctctgaggatattgcagcagcacagtcgttacaaaacataacttggggttttgtttatggtagagggctatacagccttggctaga

SEQ ID NO: 34106 - DNA, 1929 bp, Mus musculus
tgcttctggaaccttgatgtcctccgccaggcagggctgctggatggctggaccacggagcttttcttggcctctgactctttcacggtctacaagcttggcagagtttgtgaccatcattcaagtcccaggaggcatctgcctcggaggaatgctatttctcaacctttcttctgtagaatggccatgaagaaggaagaagtgagtgtggacatttgaaggagactgctgctgctgctgctgctgaattgtgacctcacgctggctctggaggctggcttgtttggcccctcaccccagtccctaacttggaccgtgcaatcctcttagctctctggtctttctactctagctcactgggccctaaccttcccttttgagggatgttagttactgagctgatgtcctgccatgaaagattccacagagatccccgggtgaccttcccacgcactggcctcaggttgcccactacactggccacaggtggctagagctgctggcttccctgtgacctcgctggtggacattctgagtgtggggtctcctggaggcagtcgggtaagcccctgcaggcaggccagttgctcgtattgtctccgtgatccctccaggctgggttctttacagtctgctcctacctctcatttagcagcatcctagttctggactggacagcagaggacctctcaattcttgggggccatgtcctaagattcctgatgtcccagcttgtgacggaggtcccggtactgaagctggctctgttggttctgggacctgtagtttaaggggaggggatggggcttctttgaaggttcctagaaagaaagtgagctcaagggaacagccacggttgcttagagcttcccatgagtcaccttcttgagaactctaccatcatggtgcaccccgctgtggggtatttctactatccacttgggctggcacagggttgagaggtggtagagttcctgcccaacactaccaccaggcagctgaatgggttttggtttgcaggaaaacagtccagagctttgaaaaggctcctaagagagctaggaacttagagtcccagcttgggggtggggggggattgtttgtttgccccagggatgccacatggtctctgtgtgacagcagggatggggaatctgggactgccttagggacagtgtacctgactatgggcttgggtacagcttttaagttggggtctcaaaaccacttagaagctggaccacactgccttcccatatcgtttctgatgctggacttcccttgttaagcacattcctatcatctgtccctcacctgagtgttgggacccccccacttggggccctgagcaaactgtacctcgattttggcaataaaagtattctggatgttgtaaggtgccttgtcctgctctgagcacgagaggagggaaccatggtgtctgaaggtgctgtagaggtgggcgcttggtctgtaactttactggggcctcagcattacccctccgccttcgctttacccttttgtcctcttctctggaatcgatagaattgatttctccactgggaccaagaaacagacccagaagccaggcatggtggtgcacgcctttaatcccagcactcgggaggcagaggcaggtggatttctgagttcgaggccagcctgatctacaaaatgagttccaggacagccagagctatacagagaaaccctgtcttgaaaaccctgcccgcccccccccccaaaaaaaagaaacagacccaaaattgtgtctcttggagttgggctcctgtcttcatcctgcttctccccagtcagcagtgtaatgcctagcttctccagtgcttgtctgtatgcaccaggccttttgccctctacactttgaatttaaagttcattttaggaggtcaccttttccagattcag

SEQ ID NO: 34107 - DNA, 1101 bp, Mus musculus
tcattttcctctgccccaagacaagggcttcttacgtaacaagttagtatgtagtataagttagtcttgagcatagaccctcttgcctcagcttccctgaaggccttttttttttctttttttaaatcctgtgttgatacatgagggtgaaaagacaggtgggtaaattatctattttttagtttaagcaggtcttagcttgtcttagaaagctcgtttctgaaaccctatctactaggattctttcatataagaagacaagtagttacccctctctcaagagtgagtatggatccattttgctcatctccctttcaaaagctccaggccactgtgatggttccggaggcagttcccccatgtgtatgccaggtagctgggcttcaggcctaacgaactctaagtcaacagtgtaactcccattgtggttggtatgttgagggcctccctgtcagccatcagaaaggaaacagaatcctaccttgttaagcacagtgcttgcaacaagcgggagcactaactataggcagagccggagatgttgccttgaaggttactgagccactgaaaaccagagctaatctggtaaagctatttcagctctgacagactgctggatgtggcgtctcctggtgtggctggaaggaatgatcctcgttcctcttccccacctctctgtccctccacagtgcaccatgacacttatctacctcgtggtgaaggacgtcttcctgctcatcaactacttcagcttcagctactggttcttcgtgggcttgtctgttgttggacagctctaccttcgctggaaagagcctgactggcctcgacctctcaaggtcagcaccccctcctctccctcctcctcctcctctttcttcttcttccttggaactaaccatgtggccaaggagagcttaacacgcacatttcatgcatacatactagcaggagggaggggtcctcttctcttttaaagatttatttatttttatgtgtattggtgttctgcctgcatgtctgtgcaaggatggcagatgagctgctgtgggtggtgggaattgaacttgagtcctctggaagagccatctctccagcccc

SEQ ID NO: 34108 - DNA, 2122 bp, Mus musculus
gcatcacagatattctttcagccttctgctattgagatcgtaactgcagcgagtgtgtttgctaagtcctgtgcttcttatcttcatacagctactgtcaccagagtcacccagaagctttgcttttgcgtcttgactgagctagatgtaactgaagagaaaaatgttgagaggaaaactgactagaagccagagatgacattccctgaagcccaaaaggctgtggtcgcagccaccaaagaccagttccctaaaccttctgaattaaaggagcctcttggcccacattctgtaagggggctcagggccaatgctctctcattggtaagctatgggaagataccaattaggccagcctgaagatggggacttcagtgggaggggaggttgggcagggcattgatttagttttacttctgatgagtagatgcagccctgaaggaatattagactgacagctctggctcttgattcacagctctttgtagtttaaaccaggagtctacagtggggctccttcatgggaagttttcctctgaccctctgaccaagtccagctacttgatttttagaggtctgaaatgctaccatttcttcctatggctcaaaattcttccttgaggagagcgttgtgttcccctttttgtttgttgggtggcatgaacagcaaggtgctgtgtaactgacatgggatcaatgtgtgcctccttcctgaattccacaagaggaacaacactccctccctccccggaacttcaggctcaagcagacagtgagcttaatgggaagcagactgttgaggatctaggcatgaaagtcctctaactcgtggatccgaatgttgctgtgtctttgggatcttattgtgtatagagtgtccctctccttgaggaggggctgcctgtctgactttgcttaggtcacattagcagtatggtcaggattctcaggcaaggaggtgagcttctggcttttcaaggaattcgactgggccacttgattgtgcccttcctagctgaatccatggtgctgtggagcccttgaaacaagggctgagagaaaaacctcactactccagctgagtggagcgtctctactacctggacaagccacaactgtcaccaaatttcaactcctgtatgtcattatttattgatatttaatccaggataccagttgtaacaaaccattagtgatcatttctctataggatgcaataagtgaattgtgtttttatcttagctggcctggttgcacacatctgtaatctgaacttggtatggtgaggcataaggagtttgaatttgaggctaatttaggctacataatttccaggtagccactctggaaagatcagacaagatcttgtctcacaatatacctgttatactttaatatacagataagtcacatgttattatcatctggctcagatccagcaaggacagatgagcaacttcatgagtcataatactgctattttgaaggacaatcctttgttttattaagactgtagatctttgttctacttgacataaaataaatctttggatttttggtatgaactgcaagaggcctggaatgttctacataaggtgttatgcaaaattcaggtagataacctgatttatcagttgtcactggactcctggattcaagtcaaatagtttgttatctttaagagcctgtgcaagattggctatgtatggactcacaaaagcccactctgctggaagtggtcactaattttctgaaagcaccaagctttgtttacatgcttgggtcatgggacagtatacccgcttgccttctcttgtccaagggctgggcaggtgagattgaagtctcagaaaatgcttggtacttgtgcatctgtcttctccctatgaagatcgatgaagactgtgggagaaaacagcttccaccccagcctcgctcctggtaaacggtagaaactaattctggtgatcggactaggctgccagttaaagccaaagcaataggcgtgaatctctgtgagcagtgtgtctacacaagattgtagaactcttttgatgcccttagacattgccaccttggacacagaagaacctgctatgctgtcttggcatccttcaaggac

SEQ ID NO: 34109 - DNA, 1107 bp, Mus musculus
aagtgtccgtgcattacactagcacttggaagattaagacaagattgcaacttacatttaactccctcccccacaaatgctggttgtggtggctcatgcctttaattccagcactagggaggcagaggtaggtggatcccttctgaggcagcctcatctacacagagactgtatcatcccctccccaaacaaaaaccgttgaagtttctcagttgccctaatcatatttcaagtgctcagaagccacacaggtgtaccgtggatacacagaacatgctgtgggaagttttattggacaatactacatctagggctaaggcagctgagatgctgagttctggtgacagtgtcctattgatgacagttggccttccatgtacgggccctgcatttactaatctacattttggggcaatgtgcctattctaaatatggaaagatttactctcattctccaaagagttgtggtataataatttagtgtttacattagatttttataatctgaagaggcatagactttgtagacataccgtgtcatcttatgtaagggacttggacacatggtggtttttggcagccctagaaccatataacaagggtgatgtatgtaatgccttgggtgagtgctataaacagttgacatggcccataatgtttaaagttaattttgaaacatgtagttcaccaacctctcctttttctatgaggaaaacacctaaaataatcagatctaaaaaagaactgcttgcttctgtgtaaaaagttaagtttttattaaagatcatcacattcatacatactgttccttggtaccactgccaaaggtgatagcagtctttataaccattatcagagtctaaagggggcgggggggggggggggggaaagacatgaccgccctgaggcgggggagtcactgttgtccttgcagagatcatctccatcactgggagcgggctctccctcctcccaccagcttctttagccctgagcatataagtaaaatgacagaaaaaccaccagggatggaggttttacatcattttattttccagagtgtaagatcactttttaaaaatagaatgcccaggctgtttagtctaa

SEQ ID NO: 34110 - DNA, 1684 bp, Mus musculus
cagagcagtgagctctagacagatcttgaaacaatacgggaaggagaggatttttaaaaaaaagaaaaaaggtggggctcagcagttaggaacactgactgcttttccagaggtcctgagttcaattcctagcaaccacatggtggctcacaaccatctgtaatgggatccaatgccctcctctggtgtgtctgaagacagtgacagtgtatagtgtacttacctaaaagaaatttaaaaaaaaaaaaaaaaaaaaaagcctctaacccctgatcatttggctgctaagcctgataacccaagtttgattctcctaatacccacataacgggagaactgactctaagttctttatcgtaaattttctttatgagcaagtattttataatggaaaatacaatcttttatctccctgaaggctctgatgaatacaacagcctcagcgaggaggaaagaagctgcgagcgactgatgtggagcaaataccctttggatgtacaaaaggagtttgactatgacagcccccatggtctggattcagattgatggtttgctggtatttgtgagattcttccatgggcctttaaggctctgactacagagtcatcatcttaggattcctaactgaacatgtggaaagaaaagcctttaccccagcacagtgaggacttccttgtaagtgataagtgacgccaaacacgctgggtcatgtctgtaattccagcattggagagtttgggagccaagaagagcactgagaatacaaggccagcctttagactaaacagcctgggcattctatttttaaaaagtgatcttacactctggaaaataaaatgatgtaaaacctccatccctggtggtttttctgtcattttacttatatgctcagggctaaagaagctggtgggaggagggagagcccgctcccagtgatggagatgatctctgcaaggacaacagtgactcccccgcctcagggcggtcatgtctttcccccccccccccccccgccccctttagactctgataatggttataaagactgctatcacctttggcagtggtaccaaggaacagtatgtatgaatgtgatgatctttaataaaaacttaactttttacacagaagcaagcagttcttttttagatctgattattttaggtgttttcctcatagaaaaaggagaggttggtgaactacatgtttcaaaattaactttaaacattatgggccatgtcaactgtttatagcactcacccaaggcattacatacatcacccttgttatatggttctagggctgccaaaaaccaccatgtgtccaagtcccttacataagatgacacggtatgtctacaaagtctatgcctcttcagattataaaaatctaatgtaaacactaaattattataccacaactctttggagaatgagagtaaatctttccatatttagaataggcacattgccccaaaatgtagattagtaaatgcagggcccgtacatggaaggccaactgtcatcaataggacactgtcaccagaactcagcatctcagctgccttagccctagatgtagtattgtccaataaaacttcccacagcatgttctgtgtatccacggtacacctgtgtggcttctgagcacttgaaatatgattagggcaactgagaaacttcaa

SEQ ID NO: 34111 - DNA, 1194 bp, Mus musculus
aataaactgtttctgtgttctttaaagaaaccaaaattccagacttgtcactacaaagggaacttgcggcaagtgttcttcctctgagctagattcctaatgtggtattttccttttcttaatcttcacaaatactatgaattagatacttttatcgccattttgttttttttttcagaaagtttttattagcaagcattggctattcaaagtaatagtttttattagattttgtatgtctatactcactcctgttgaacctttaaaaaaaaaagccttatttattttatgtatgtaagtacactgtagctgtacagatggagctcactctgtagaccaggctggcctcaaagtcagaaatccgcctgcctctgcctcctgagtgctgggattaaaggcggctgtctctaccttttctaatgggaaaaccagagccttcatgtggttgttgggaattgaattttaggacttctgatcactcaaccctgctcactccattcagcccacttgcttcggtcagcccagctccggcccaaagatttatttattattatacataagtacactgtagctgtcttcagatgggccagaagagggcatcagatctcattacaggtaattgtgagccaccatgtggttgctgggatttgaacttaggaccttcaagaagagcagtcagtgctcttacccactgagccatttcgcttgcccccctgttgaaactttcttaatgaaccctgattctttttcttttattgctatgctctttgagtgtgtgtgttcccattaatttacttgaggttgcttatagaagtatgggtgaggaggctttagctgtgttacctggcatttatttctatgcctgtatttggttttttttttttgttgttgttatgcctgattttttttttttcttgagactatgtagaccaggctggcgttgaactcaacagagatctgcctgctgcctaaagtactgagattaaaagcttgcaccaggggggctggtgagatggctcagcaggtaagagcacccgattgttcttccaaaggtcctgagttcaaatcccagcaaccacatggtggctcacaaccatccgtaatgagatctgactccctcttctggtgtgtctgaagacagctacagtgtacttacatataataaataaataaatcttaaaaaaaaaaaaaaaa

SEQ ID NO: 34112 - DNA, 1142 bp, Mus musculus
ctcggtaaaggtgaggttgagagaagttgctgcatcccagtgagagaggagatggagatggagatggagcgtaagaggatcagccgaggagactgaggagagccaacaggaaagttaggatggaaagaaaagagaagctcagggaagggaggaacgcaggaaagggtcgggctgctcagaagccctgaatgctgatgcccatcagcaacagcagtgggcaggtgtgacgtgggggagctcctttggggagtggactggagagatggatggttctacacatttacacagtgggcagcgcaactcgctccatccgcactctgggcattctcatacacgtatgattaaaaagaaactattttgccaggcaatggtgacacatgcctttaattccagcagttggaaggcagaggcaggaggatttctgagttcagggccaggctggtctacagagtgagttccaggacagccagggctacacagagaaaccctgtctcggaaaaaaaaaaagagagagaaaaaagaaaaaaatctaaaatattttttgagatttcatctattattggcttttttttttttttgagacagaagaaggtgtcagaacctccggctagtagagttagacagttgtgagccacagtgttggtgctcagaatcaaaccctgatcctctggaagtgcagccaatcctcttaactgctgagccatctctagcacctaaaatcttttttaaaaagtaggtagggcagatgggggcacagctcagttggtaaaggggttataggtccttagttcggtttttagaatgccctgcattttgttttgttttgttttgtttttttgagatggagtctctttagcactggctgtcacgagatacacaatgttgaccagactggccttgacctgagggagccactttgttcagcttacccagtcctggattaaaggcttgtgacaccacatcctgcatgacccacattccttaaatgtattgatatgtgtgtagatgtgtatgtatgtatgtatgtgcctgatgtccaccaaggccagaagaggtcatcagatttcccggaaccagaattacagatgcttgtaaaccaccatttgtgtgctgggaatcaaacccaggtcctgtgcaagagc

SEQ ID NO: 34113 - DNA, 1196 bp, Mus musculus
tgtgacattcagctgaaccaggtgtcgcctgctgacttcactgtcctcagtgatgtgctgccaatgttcaggtactgcagaccctccctgggtggctgttctttgagacatttgatcggatgtcttcttttatggaacagaaacctagctgagtcctttccacatcagtaccattgttgggcaggtctctgtggaagcttaacagaggagtgtgtgtgagttaaattatgcttaagttcccaaatattcttccacagcgtggacttcagcaagcaagtcagcagctcggcagcgtgccatagcaggcagtttgtacctttggcgtctggccaagcacaggtggttctgtcctggtgggacattgaaatggaccctgagggcaagatcaagtgcaccatggcacccttttgggcacagacagatccgcaggagcttcaggtaagaggcaggagctgagcacattccatgtaagtcagggaacttttgtttctttttacccctagatcactgtatcagtcaaaggcaaagaagaaattgtcttttgggaagacagacatgcacacatgcaaggactagggaccgggaatgtactcagtgatcgagcactttcatagcatgcgcgattccctgcgctacatagtgagcacagctgactatgtagcagtgatgaaaaacggtggcctgctctccaagatgagtctgaacatactgagatatttgcatctctcaattactacaaagaaaaatgataagaaataaaatcagcacagcctgccagtgtgtcgtaaggtcgacctctcctctctggatggctgacaccagtggccgcagtgagcaacaaagtcttagtgaattagttccttcattctccttgtcctggcatagttgcacacctcctcaccttctgctgtggtccagggggctcagtcaactgggagtggagaactacaacctcactgcctctgattcagaatccaccttctccagctcagggtaaatgagccgaggaatatgaactagaaaatggaaatactagtcaacatgtaaattttcacctttaaactgctatgcaataaaacaacataaatgaactcaaatgaaatactatattttacctattagtaaataaaaatcagaaagtttggtgacacagtccaacttggatggaagtgacagatgttagggccctgggtact

SEQ ID NO: 34114 - DNA, 1099 bp, Mus musculus
gatagttggctctgggctgctgggttggaagcattgctgtcacagcttggtgaaagctggctctctgctcctcatttcagtggcgggaccactggatgcagtgtgtgtacttcctgccgcaggaggagcctgttgtgcagggctcaccccggtgcctggtagcccaccatgatgactactgtgtgtggtacagccttcagagaaccaggtatgcctgcttgttgttggggtggaggactagctctcagagactgcattgatgtaaactgtctatggacagaccttgcagagatttgaatgggcagatttatagcagaacaaaatgaaataagtaagggccggtaagatggtcctgtgggtgaaggggcttgtagccaaatctgaatccccagaatccatagtgccggaggagaagctgttccaaaagttgtcctctgacttctacagttgtgttacggtactccccagccccacacacaaaataaaaaatatttacaaagcaaaagtctgtggcagggtatatcagtgtgtttgtgtttgtgtagaaactgctatagattgataagatctattcaaaacaaatctagaaaaataaagactcacagggctctgtaacctgtactgtgctggtgtccagactcacctagggtctcggagagacctgtgcatgtatctcccagggtctaggctgagttctggtgttattccctgtgctgtgtcctcgtgatctctggtttccagtttggaatttttttttttaagatttatttatttattttatgtgtatgagtatattgtagctgtcttcagatgcattggaagagggcatcagatcccattatagatggttgtgagtcaccacgttgttgggaatgatggttgctgggaattgaacttaggacctctggaagagcagtcagtgctcttaactgctgagccatctctccagcccctccagtgtggagtatttatcacttatgtttggcttttcatctccctgctcagccctgatgagaacgacagcgcctaccaagtgcgacctgtgtgtgactgtcaggctcacttgctctggaaccggcctcggtttggagaaatcaat

SEQ ID NO: 34115 - DNA, 1291 bp, Mus musculus
gccctcggtcagtcagctatgttgtggagtttcaccccctcactggagacatcaccatggagtttaggcttgcagacaccttgagctgatctcttattgagaaataaaatggccagcaggctgcagactctgaatggcttgtggctcaatggggaagcaaggccgaggaacttacctccttgtgtgcacctacttgacatctgcacagcatcaggtgtggcaggcagcataggctggcgagtgactgaagagttgtgaattagcagggagaacagtttgtgacactgaggatctagaaagccctgaggcagtactgcttcctgttctgcctggagaactgaggggcagctttcattaggaccaatgcaggactgccagcttagctggacctacctggcctatctgctttcaaggaagttccaggtctcccagggaaaatggcctcccagggagttccctggggcgtcgtgaccctgttagggtctggtttgagaggactatgataccccaagcagctttaccaagccacattcgtaaacatttgggtcttgtgtcctcagtgcacactagcaggtggattgctaagccctgagacccaaatgccaggctgtggttcacaaggccgtcatccagcagttcctgtgggacagcactgggaagaaaactaggagagtagccgcctcctgtctctctgtctgtctgatggacggacggcccctgctctgatggcctaatcttgctgaagcagaaagtgcagattcccagtcggccacagccttgtcccacctctgcccacccatgcatgcacttgctaatgaccactcagttctgaaacaatccgggagggaccgagtagtagaaccaaggtggcagacctgggctgtgcgctcagtcatttcccaaagtccctaggctgggatcagctctggaagtcagcaggctctccccagtttgtcctgaaaataaggctagaacaagacgccgagcttgagcctcctcacgggtttattttctcctcagtctccgtcttcctttcagcaccataaagggaaaatccacctcttttcgactttttttttaaatcaggcatagagattgttttttcttctagggaagaattgtctggatatatacttgataatgttttaccaaaaccttgggtgtcttaccatataaaacccctagtgtcccataggatacaatacagaaaaaaaatacagaaattaaaaaagtttcttctttgtcttttaaaacagtatttctaaatctgagcaagttaatacaatagtta

SEQ ID NO: 34116 - DNA, 1192 bp, Mus musculus
ataaatctttaaaaaacaaaaacaaaagaattttaaaaataattacgtttatgtgtctaggaagaaaaatgtcgatgtggagatgtggagatgtggaggtgggggtgggtatagaggctcggcaggtgtactgatttgtcaaaacccaggtcgctggcaagggtctccatccaatcaatgctgaccgctgctctctgcttccctagaacctgaaggctgccaacactgaccctactgccccgccctacgactccctgctggtttttgactacgagggcagcggctctgatgccgcctccctgagctccctcaccacctccgcctccgaccaggatcaggactacaactaccttaacgagtggggaagtcgattcaagaaactggcggacatgtatggtggcggtgaggatgactaggctgtccctgccaagctgtccaggcaagaactacagacgggtcacagcagcatctcaagggagcctggctcccgctccagccaggactctgaagtttgcccagaagtggcctgcgtggcacgctgcatctgaccagaaggctggactgtgagcctttccgatggaaggatgtgactctgacgacaacactgatccccacctcagccatggctgagcccctctcagagcgggaatgtctaaaggtctcccgcctgccacacagcactcagctctgccctctcagggcttgaacttgctccgatgccctcggtgactttccccacttggaatggctccctctctttagaaagaggcccctaactaaggccctgtttttctttaatgcagttttcaaaaagaggctggggtgggtggggcagggtgcggacatcagtgtcccctcaggccctccagaagagaagcctacagggcactggccctggtacatttctctgacatttcttgaggcctcacattggggaggggtcactgccttttttttttttttaatactgagtatatctaagttgtctcgtatttttttattttccctgttatgtgctgtagatggagagtgatgacaatcgtgtaaatgtactagaatttttttattaaaatgaacttttttttttcccagaggtgctaggggagtggatttaaaaagactttttaacctagttctcagaagtgtttggcttggtgggttttagattttttacaagatttgcagacgccct

SEQ ID NO: 34117 - DNA, 1478 bp, Mus musculus
aaaactgaaaactggctaggcctgatggcacatgcctttaattcgagcagaggcaagcagatctctgagagtttaataagccatcctggtcttgaactctagcaagttccagggcagccagggttagttagtgataccctgtcttaaaacaaaacaaaacaagatcccaacaaaacacacacacacaaaagataaataaatgtaattaattaaaaccccaaagaaccttttccgggctggtgagatggctcagtgggtaagagcacccgactgctcttccgaaggtccacagttcaaatcccagcaaccacatggtggctcacagccatctgtaacaagatctgacgccctcttctggagtgtctgaagacagctacagtgtacttacatataatcaataaatagatctttaaaaaaaaaaaaaaagcccaaagaaccttttcctcagctgccgccaaggtgctcggtccttccgaggaagctaaggccgcgttggggtgaggccctcacttcatccggcgactagcaccgtgccggcagtctacagcatggcttctgtctccgagctcgcttgcatctactccgccctcatcctgcacggcgacgaggtgacggtcacggaggataagatcaatgccctcattaaagcagctggtgtcagcgtcgaacctttctggcctggcttgtttgccaaggctctggccaatgtcaacattgggagcctcatctgcaatgtaggggctggtgggcccgctccagcagctggagctgcgcctgctggtggtgctgctctgtccactgccgctgccccagctgaggagaagaaagtggaggcaaagaaggaagagtccgaggagtctgaagatgacatgggcttcggtctttttgactaaactgcttttgttaagttggccaataaagagctgaacctgtaaaaaaaaaacaaaaaaaacaaaaaaaaaaaaaaaacaaagaacaagccaggcgtggtggtgcacacctttaatcacagcacagcactcaggaggcagagacaggcagatttctgatttcgaggccaacctggtctacaaagtgagttccaggacacccagagctacacagagaaaccctgtctctaaaaaaaaaaaaacaaaaaacaaaaaaaaaaccaaaacaaacaaaaaaacccaaaacaaaccaagacaaaaaaaaaaaaaaacccaaagaacagaacactcacataataaataactgtaataaataatctaaataaaagcaataacaaactataaacatgaacacagaacaagattcaagggtgcccttctccagtctgaaggtggcacctccatcacccaggactctcctctcattctctgctagtgtctgagaagtcatggaatccttccaagcagccctgaatccatttctgttcttgccccttgcaatagtttgtatatgcttgggccagggagtgacactatgagaaggtgtgt

SEQ ID NO: 34118 - DNA, 1221 bp, Mus musculus
tcggagaaatagctcagtcagtaaaggccaatggcggcaatgcaatcccaagaccctcttggtggaagaagagaattgactcttgaaggctgtcgtcttatctccacaatcggtctgtggcacgtgcgtttgcgagcacaggatcgcgctctcgcccgcgcacgcacccctccccccatgttaaaatgtcatttaaaatccctaagcaaacaaactcatccaaccaaagaaaataaaaacataagaaacaaaacggaaacctagatgatgaataaagtcctttgtaactccatgtctccgtgggtcagagcacagctaggctaggattcgaacgaccgtggaataggaagctgggaagtcttctaaggccggccccatgccaccaactacagacaggggtggaggaagttgagggccctgcagttccttggctgccacctgcaggtgcgtccccagccaatcagcggcgccgggggcggtgcctgcgggctcacctggcggccgcagcctctgcgctgctcactggtgtgggagccgcggcgcactactgagttcccaagaacttctgctagactcctgcccggcctaacccggccctgcccgaccgcacccgagctcagtgtttgctcggcgtctgccgggtccgccatgggagcccggtgccgcagcttttccgcgctcctgctcctgctgcaggtatgtggagggtcctgactcgtgccccatgatccgcttcgctgtgtttttctgccggctgtggtcccgcttcccttcttccaagaaagttgggatccggagggccagatcgccctgggcgctgcgcggtgcggggctgagtgcggtggagtgggagggaggtccaggcgggcgcggagtggtcgcctctggcgcaggttcccaggtgggggcgcgccacgctgccggctcccgggtccccgggttgagcagggtccctgtttgagacagaggaggcgtggagcaggatgggggcctgcctgtagaaggtggggtgctgaagtagcgcggacgatccgagataagggaagggattttagtattataaaagcacctgtcctgttagggagggaccgtagattggggtacccgagaggagtctgcgggtgtgcgttgagaccgttcgcggtcgaaggaaagtggtgtccggaagagtcaaggcgtctccagtgagatgcaaatggagctaggagaggaaggtggact

SEQ ID NO: 34119 - DNA, 1173 bp, Mus musculus
ccagctgactctgacattccttgctggtgagttcctgctcatttcagttctagccctggagcagcagtcagtattaaagcaaacacttattctgtgtgtcacagtgccaaggggaactatcactattctgatagtatgttaacttacttgtgggttttgtttattactgtttgtttccgagacagaaatctgccttccaagtgctgggtgcaatcttaccagagccttaccccatagcttctaggtatgcactatatagttcattgtcttgaaacctgatgtagcttcctcaaaagtcactatggaaatggactgacacaagccaccggccagtgggagaatggggtttgaagcttagcgactgtaagttcatcatgtaatgtaggagggggaagtgtggtgttagtaatacctatagtcttagttcttgtggagttgaggcaggaaaatcccttgagcctaagtgaagatgaggtaacatagcaggaccctgtgtctgtgtgtgtgtgtgtgtgtgtgtgtgtgtgtgtgtgtgtgtgtgtgtgtgactgactgagatagtctcaatatatgtagccttgtctgccctggaactcttctcatggccttgaactcctagagatctttttgcctctgtttctgcttctgccttccatgtgctgggactaaaggcatatgccaccatgccaggtcccaggtccctgtctcttttaaaaaataaagcagaaagaaacaccatacttggggctggagagatggctcagcggttaagagcactgactgttcttatgaaggtcctgagttcaaatcccaacaaccacatgatggcttacaaccatctgtaacgaaatctgatgctctcttctggagtgtctgaagacacactacagtgtacttacatataataaataaataaataaataaataaataaataaatattaaaaaaaaagaaacaccacacttaaactgatgccttacaagaacttcgtacgtgttttgtacctgttactgtgcagctgtggtcgggacaagggttatcagagagagatctatctggtagagtttgagctctagatgtcagtggatgtggcatgtcacgggcttcggctttgtgccttcctactttgcagctgggtgtaattttctgcattcacctggtgtttcttgcagca

SEQ ID NO: 34120 - DNA, 1297 bp, Mus musculus
actcagacatgatgtagacaaaacagcagtgcacataaaaaaaataaaaaataaataaatatatctttttaaattggcatcctgcctgcatgtatgactctacaccagtagagatcatcagaggtcatggtggttatgagtcaccatgtggatgctaggaatagaacaaaggacctgtagaagagcaggcaatggtagtaacctctgagccacctctccagccatatatatatatatatatatatatatatatatatatatatatatatataattttttttaaatgtcaacttgttcttggggagaaatttcttacctagatgatacttgttctgataataactatagggagcaaagctcacttctgagacttggttgcaatgtgaacttagggaggagggagataatctgtaggtgccaaatatagaaaaatctcaggaaaatattagactgaaatagccagagggaaaatgaccccaactgaaatttgtgtattatgtgataaatgggctggctggctggtggttgtctctagctttgagacttcatcatgagttcattaagcagcaacacacaatgtggaaaattctcacatgaaggtgtcatagtagaaagagtggaggctagatggagccattctagccagactcgccaccctggatcttcttccaagtaaccctcacttgactctcttgcagctctattctcatgccgtgtcatcaaatggggaagcggtggaggatcccatggagatagtgatcacagtgacagatcagaatgacaacaggccagagtttacccagccggtctttgagggattcgttgcagaaggcgctgttccaggtaaattagtctcaaggaactgagtacccagaaagacatttgggttctttagaccttgaaggatgggattagagatcgtgtcactgaagttccgacctgctctttgaaagccaccctgagggatgaggtggaggcatgagggagcaaatataaaattctacctgtagaaacatatatgagcttggtggtgcatgtatataactccagctctaagggatgtgatgccctcttctggcctttaagggcatctactactactactactactactactactatctacaagtgtacatactactactactactactactactactactaagggatgtgatgccctcttctggcctttaagggcatctactactactactactactactactactatctacaagtgtacatactactactactactactaataataataataataataataatagaagga

SEQ ID NO: 34121 - DNA, 2646 bp, Mus musculus
gtatgtactcgctatgtagatcaggctggtcttgaagtatgtagcagaggaggactttaaattcctgattcccccaacttcagaattaacatttaacaatagcagtttgtcatctgtccttcgaggattttctgggctgaactgtaacctacgtgttttagtatgacgactctcgttgctcttaccctctgtccagcctggccttgggactttgccttctgtgctggtgtgtgtgtgtgtgtgtgtgtgtgtgtgtgtaccttgaaggggttaactactccttggttagtttttcatgtttggggtgttgcttgcctctgatgcatactgataagtacggtgctcttccttttagaacctgaaggcagccgacagcgaccccacggcacccccttacgactctctgttggtgttcgattacgagggcagtggttctgaagccgctagcctgagctcactgaactcctctgagtcggatcaggaccaggactacgattatctgaacgagtggggcaaccgattcaagaagctggcggacatgtacggcggtggtgaggacgactaggggactagcaagtctcccccgtgtggcaccatgggagatgcagaataattatatcagtggtctttcagctccttccctgagtgtgtagaagagagactgatctgagaagtgtgcagattgcatagtggtctcactctccctactggactgtctgtgttaggatggttttcactgattgttgaaatctttttttattttttatttttacagtgctgagatataaactgtgcctttttttgtttgtttgtttctgtttttgttcttttgagctatgatctgccccagacacaacagccccaagcccctcacacctcactaattttttacattgtgtacttgccctcaattaccatgtttgctgtattctaatagtcactcatgttcctgaattctgttgccctgcccaggtgatattctaggatgcagaaatgcctgggcccttttatggtgagagacaggtatcttggtgtgggtgcaactgcgctggatagtgtgtgtgttcccaagatctttcgtggtattccctctccacctccagagaactcatttacagtggcattccttgttcggctatgtgtctggggcagaacaaaaaaaagggaccactatgcatgctgcacacgtctcagattcttaggtacacacctgattcttaggtgcatgccatagtgggatatgttgctttgatcagaacctgcagggaggttttcgggcaccacttaagtttcttggcgtttctttcaaaccaaaactaaagaatggttgttctctgagagagactggagtgccaccaccaaagacagaggagagaaaaggagagaaaccaaacttggggacagcaacatcagcgaacccggctagttggcacaccgatggtgagggtacacaggcggtgagacctatcccacaagatttctggaagactaggcttatctcaaccaatgttttctggctggaatctttgtccatgtattcctgaagcccaggaaatgcacccctccaatgcctgctcttgatggtagctacagaaaatgctggccgatttaaacccaagttgcccagttctgagtagaaaactgagactatgctgtgtgtggcggcgcgcacctttaagcccagcactcaggaggcagaggcagtcagatctccctgagttcgaggccaacctggtatatatagtatagtaagcgaattctaggacagccagggctacacagagaaaccctgtctctgcaaaccaaaagagaaaactgagaatattacaaattgtgcattttctcaggaagcaggaagagaacattctaacgggaaaaaggagacaagacctttgagagttttcattcaaaatgcaaatctcagctttttgataaccactggaaagaattttattgaaagttctgtacttacctaactttggaagaaaatgatgaccacaatcaactgtgagaactgttgatttctctgtagtttaatcatgtaatgttgctagagtgacctttgtatgtagtttgagtgtatgtgtgtgggtgctgataattttgtattttgtggggggtggaaaaggtaagccattgaaaccgttctctaagatgcatttttatgaattttattaaagagttttgttaaactgttgtgaggctcacttgatttgactctgccaggattcctagaccaaaggacagaggtgaactcagatcatgggagcttccagctgatgtgtcttctccatgctttgggggtcctgcatggggaggaaatgcttccacggggtcactgctcagagccccatccatgtgatgtgtggtgggagcaataagtaccaaggccactggggcatgggggacctgcgagcttcaaggctgtcggcagacattttccaacagtaatggaggcagcgattctgtgcagaggaagactggcctcccccgagcgacgtttgtcagtgcctttccgctgccccctccctgctccgtgatagtacagattgaacctaggacctttcgtgtgctaggtgagtgttctgcctttgagaaacacccccagcttctttgtgctttgtactctttcataaattataacga

SEQ ID NO: 34122 - DNA, 1133 bp, Mus musculus
acaggggtgcacatacaaatgagtcaatgtcgttttaacagttagagaaagtccatagcattttgcctgcatgtatgtctgtgcaccacatgcatgcagtgcctgagaaggccagaagagggcatcagatcccaggaattggcattaggaatggttggtagccaccaagtgattgttggaacaaccttggttctctgcgaaagcagcaagttctcttttccactgagccttatctctagccctaattttagattttggtgacaaagttatgctatagagcaacagagcacagaatggctttgcgctgaagacaaaagtgctctgtcttagaactcatttttcctgaacaagagtaacatcagtagcgtcagaggttctgtgaatatcacatgtaagtggcatgtcatacagtggtgacactcatcttctggttctacctgcactatattactaataaaaccttgctttattagtgtcttctattcagaaaagtaatgagtggggttaattttatttattttccaagagattccagagagtgacatggtgccaggagctattttggtgactgaagaggaacttagtcggtgtgttgaagatgtgtttaaggttagtaattcaggtcgctgatgctgctagttaatgttcatacttgacggccttttgtttttggaggctctggactttgaacacaggccttctgctggcaagcactgtaccactgaactgtgtctgtagctttgcctcataaccagtacttccaggatttgaatgaataggggctagatggctcagcgggtgagagcacagaggacctgggtccgttctcagcacccacatcaggtgcctctcaactgcctccctccagtcccgggggatctcatgcctctgggctactcaggcacctgtacctgcacacacccacatatgcaggtgtgcacacaaatacacataattaaagaaggaaagaagatagtgggtctgactagctggccctggaggtagacgcctgtaatccctatgctcaggaggatcattgtaaagccaaagccagcctgtttgctatagtgagttctagcttctagggcttcacagtgagtactggctgtcaccatctcctttcccttccctac

SEQ ID NO: 34123 - DNA, 1187 bp, Mus musculus
tccatcctttcctgggtcactatgaagacactgtgtaaactggagtccctagaaaggtccctgacaaattataagctcaataactcagagcagtcattagtatggctgctaatggtgaagaaagacactcagccctgtagttaagactaaatgtccagcctaaaaataaaaataaaatctttttaaaaagtaaaaaaaaaattaagttctcatagcaccgttccatcctcatcaaagactgacgggggagcatgggcctaccccagccccttctagtgagtggggtggcttctagagccaagggttaagctacccctgggtgacctccagggcactgtactctgaaatttgtaagatgcatgcttccctgtcgagtgtcagcagccagtggccgggcagcattgggatcaagtggaacctgacggtcatcgtgtcttccccccccccccccccccccccgcatagcttgctagcttcatggaataagatgacaagctcattcattcataactgcttcatctaccaggtcactttgccaagagatcttgttatggattctggtgaagctggaaaggaagaaggcaatcgccagcctgaaaggattttcggggttggacaaaaccgtgcccactctccaccctcagtgtcagtttagagccgctacgcacggtggcatcgtgattaccgccaaagaggccattaggtgagcttaccaacccccgattgtcacgcctgacagaagtttttatacgacactgttctgtgagtcagccgctaaggggcgctgatggaaaggaaaccagaaacaggcagccaaggcgcttgctatttataatctttaaagaaaccagagccttaaatgatcctctgggtgttattccaagatgccagctaatagtaggtgtggtttgctggcgcctcccggctctacaccgcagcaagcccagctactgcccagtgttcgccagtgactcagagcacagggcagcacatgttcaccgcagctcccgagcagtcagtccagtctgtctctgactcaaagagcaggatgcatgtgtgccttattacgattattactgtatttgtcttgtctgtgtctgtgcattgcttgcatgcctgatggagcagagggtatccagtccctgggaactgtgtggatattgggaatcaaacccagatcctccact

SEQ ID NO: 34124 - DNA, 1131 bp, Mus musculus
gcatatgtacacatgcatggggaagccagaagttctctagctgaacctgaagccccctgatttgactaatctgattggttagctcaccccagggattctctgtctgtcgcttaagtgctgacatgacaggtggctgccatatccacccagattttatgtgggatctggggttcaaactctggtcctcgcgcttgcatggcgaacgagtgtcttacctcccgagcaatttccttagcctgcactgtaggactttaaggacagttttgttgttcagtaatgaatgtgataaatacatgaatgatattctttagcaaactcttatagccagacaatttatccagctatgatagatctgcttagatgccctcgaagtcacttcccttgaacattctgcatttcaggggttcaagtgatccctctcagtgtcaaaagaatctttggctgcagtggtgttttcgggagaatgatggtattgaattcagggccccttgcatgctacagaggcacactaccagccaggcagtggcgcacacctttaatcccagcacttagaaggcagaggcacgtggatctctgagttcgaggccagcctggtctacagagcaagttccaggacagccagagctatacacagagaaaccctgtctcaaaaaatcaaaaacaaacaaacaaagcaaaggcatactaccactgagcttcacgcttaggcccaaaatgcctttggataaaacaattataacaaactgaaaggaaggaaggaaggagggagggagggagggagggagggagggagggaggaaggaaggaaggaaggaaggaaggaaggaaggaaggaaggaaggaaggagagaaacccataccctgagccaggcataggaggtgaaagtgtgctgtgtgtaaggaagggaatgtaggcactgacatgcccagacaaaccatacccttcccaccccctctcttttttcatttctttcaaagcaccaaagggagtgaaggcaaaaggtggggggggggggcagtggagtataaaaagatgacaagatttttacagagtttcaaactgagcagaagtacaagccttgacttgctaggcaccaacctttgtcttaggctccaatttctacctcaagt

SEQ ID NO: 34125 - DNA, 1238 bp, Mus musculus
aagagctatggcaaaggtaggaagcacaactgtgctttgggctgaagtccacagaacgattccactcatcaaaccctagaatggtaaaatccggaggatccctggtggtcccttgctgctgtgccaattccagccatgacttatagggatctagcctgtactgcagatgtccatagctcatagattacagaatgtccatggcaatacctgagagccctggctaggattagcaaatccagagatctgggttcccagtcaccatcttccacttacaatcctaatagagacagccttggcctgcagtgttacaggtaggtttaagtgtgggctgctgagatgacttagagtcaagatgccttaccaccaaggctgatggcctgagttaataccgaggatgaaggtgagagaaaggacagaattgactcctacacttgtcctttgatacacacacacacaagaatgtaaaaataaataaataaatctttgtatccatcccatcacaggatatctaggttatttgtctccccatcctaaataatgagttctttctttctgttttgaaccccagggattgcccttctttcagatgtgtaccctgaagaaatcttggttgatctgttggccaaatatgacagtgggaaagacaagcacactcctgagaccagaatgaaggttggcgaggtcctgatgcgagttgtcagagcactgggtgagttttgtttgtttactccatttctctgacactgagcagtgtagtactgctctgtctatgtactgaaggctcgttctagcagacgaggggatcagaggggatgatgactgtttagggattcaacacatgctcagccaaacctatgtgaagagctctttccccatggctgcttagtttccctctcccagagctgtgctttgctggggtccgtgtgagtggggtgggctctcggaatgcaggctagctgacctgagatacactgttcaggcagtactcaagcaggccgacctccacatcacaacctgctgtctcagccgctagagcgctgggagtatgggtgcccccagcttggaggccaatgtataatggacctgaaaagagactttacacccgagagcagcaagcacaccagggtgagatccaagcaggccgggaatggagaactggcgaggactgtctgccgtgtatgtatggtcgcaaccaatttcccaaccagtcctttaagcaagttgtcagaggtgtggtg

SEQ ID NO: 34126 - DNA, 1099 bp, Mus musculus
tggtgcacgcctttaattgtagcaccaaggggcagaggcaggtggatctctgagttccaggctagcctggtctgcagagcagccaaggccacacagagaaaccctgtctcaaaacaatacaatgcaatacaatacaagagaaaagaaaaagaaaggtttgctgttttctgtcttagttaagatccacagggctgggatgtagctcagcggtctagcacctgcccagcactcagcacaggaaaagccctagactcaatcaccaaccactcaagaaacaacttaggctaggcttagtgtcagatatttaaaatccagcatttaggaagcaaggccggtggatcatgagtttaaggatagcctgggctacagagcaagagcctacctcaagcacaacacaacttgtgaagcttttggcaaatatatcatggtccccgtgttgttcttgttgctgttttttttttccttttggggccaggggttgatttacatgttctagtctgcactaaactatgtccctactcaatatcactattcatataaattgctaataactgggaagatggggtgaggggaatatcgggactctatattaaaatcttctataagcctaaaattaattaacaataaaagtcggtttaaaggctggacacatggctcagtagttaagatcatgcgctgttcttgcatagggcccaagtttcatttccagtacccatattagtcagcaccctgcttcctgtaactccagcttcagccagtaggatatatatctgacctcaggcacacacagatacacatctacacacaaataaataataaaatatatttaatattaagttacagctttgtaaggagaaatctaagctcagtgtgttggtttaccctcgtaatcccaaaacttggaagctagaagcaggagggacaggggttaaagttcattgtctgctacagaacaggagctcctgggccgcatgcattcaatgaagcggatctctgagactctagctgtggagtgtagcttacttggaaacctcatacttcgtggttaaaggccctgattttgacccctaaggcccaaaaagaaaaaattctgttagtt

SEQ ID NO: 34127 - DNA, 1166 bp, Mus musculus
tctgtcacatgaacagagaaaacaaatgagaaacccaaggagatatacatatgtatagtatgtatgtatgtatgtatgtatgtatgtatatagtgtgtgtatatatgaagtatgtatgtgtgtagtatgtatgcatgtagtatgaatgtatgtatgtccatatatatacatgttgtatgtatgtacgtagtaaacaagatcctggtgcaaattctggtttttgtgaaaatccctagacctctgtaaccctcttttcacgtctgttggatctgtctgacacagaagtgcccaagggaggtggctcggcatgtatgagcccctctgactctcaaggttgtcatctaagagcagtgatgatggtggtcaccagtggccattacagtgctgtgctgggcttctgctgccatcgtcaccactgcacaacctgctaaactctctggcccacttattggttattttgctctagggttgtatttttcttgttttagtttcttttgtgattagattctttttattccttcatttctttttttgtggcagaatctcctgtagcccaagctagcctcgaacttgccgtgtatccaaggatgaccttgaactcctgatctctgccttcacctctcatgctgggatggcaggtgtgcactgtcatgtttagtttatatggtgctgggcatagaatcccaggctgttggctcacgtgctagccaggtactggacccactgagctacatccccagtcctttctttatttcccctcacccctgccaaggctaatcaaactcaagatctaacaaatactagggaagcattcggccactgagatgtcataatcccaaccccttacagtgactagggaagcactccaccactgagatatcatagtcccaactccttgcagtgactttaaaaaaatctactaaagataattttatagactgatcagattatatccatatggaaggatatgtaattaacttgatatctataattttacaattaagtttattgtagctgatgcataagaacacaaaagcacatgtactaatggaatgacttgtactgttttatacattcataaaaacacttttggctcagaccaagtacagtatcatgcatggatgtgtacaataactttaggtacctcacatttcattgtgccaggc

SEQ ID NO: 34128 - DNA, 1997 bp, Mus musculus
gaaggcaggggaaaccaagcagccaaagcagtggtcacacacctcccagcaggtgtctccaccgcctccttggtgcagacctgaggtctgctataacctgaaggtagctatacggtgctggcaccacttgggtgttcagggctacctttctagagcgtccatttggtcactctgcatctggcccaaagcttgtgcagtgagaagggtgaaccccatctaactacacccttcatcgtcccagcctttagaggaggcctgtgtataactgtggagcattttcttccggctggagaagccgccccacccccctggtcccaccttgatatcctgtcatagggagatgattctgcctgtgatgagggacaggcagagctatcatctgggtgtgcagctgtggggaggggaaggaagcattgctgcttaaactacacaatacgagagaataaaagaataaaattaccttggctggaatgatcagccaatgtgaatgctgtcaccgagctggttgacttttgcagaagaagagtaagccctgtctgtcctctggggccttttttctttttattgctcctctgtttttacttgagctgccattcagtcttctgcacctctcagggtgatgctgtgacagtggagtggtctgagaaaggcaggcagggcttatgtggcacaggagtggcctgccaccagctcactgaaacaacttcagatttagcactgtgttcatccgctcttggatttatgtattttggtattttcattgcaaaagacaagaaagggttaaaagaagaagaagaaggaagaggaggaggaggagactggggagatatggagataccttagtccctgaagtacttatgcaaacttgaggacctgcgctccatcctctgcatccaggtaaaaacactgcttgaggtggcatgtgcctgcaggcctaaggagcaggggagggtgcagggacaggtgcatcctggaggctcacaggctagccagtctagttaattagtctgtgagctctcagccaccaagagaccccacccccatccctttctctctctctctaaaaaaaaaaaaaaaaaagggcagcgcctcctgggaaacagcacccaacgttgacctttggcctacacacacacagacacacacacacacacacacttacatgctcgtacagtgtctgttcaactcatgagcccacatgaacatacgcatacatgaacatatatacacaggcacagtgtgtgtgcaacttcgtccacatggaacggaaaggaaaaggaagcaactggctgcttccgataagcccgctctgtagcctacgcctttataagatgaatgcggtgttcatcgatccccagcatcacagagataagtataggactctatctcgggactttatctatctccactttctggggtatcctgatctaaaggaagcagaactgtgacagtgcaggagactatggagtgacattcaggtgttctcgcctgttgggagcaagccagattacacagccttctcagcttagccttcccagtaggcatcgccagaaaggtgccaatcactgatacaaaccacaggcagtgtgtcaagcaaaggatcaaacaaggctgccgtccgtggcagcacgtacctctgatcccagcactcatgaggcagagacaggtggacttctgagttcgaggccagcctgacctacagagtgagttccaggacagccagggctacacagagcttgaatgttttgaaggaatatttctattcagctagggtagcagtattagtttatattttttaaatcaagagtgcctataaagtcagggttggagctgcttaagcgagtgttacttagcctttagaatacatccaacccaaggctggagagatggctcagcagtagagtacacactgatcttgccgaggacccaaacttggttcccagcccacatgagatactcacaatggcccgtggctctggctccagccgattgacacc

SEQ ID NO: 34129 - DNA, 1205 bp, Mus musculus
gcctctcacatatggctctcatcctgcttgctatttcaatctcttcagagccgcgcatgtcgcttagttgttgttttctggtggggagagcagcagttacctcttcattttcatgggtaaattcccatgtgaccatggtagagaatagacgcttacaaggctttcaaggctgttccctacatgcatggacgtaacaacagcctctggccacactgttcatcgtccaggactggtcaggacttcggcagctggttagttagcatctgtaactttctcgacaatcattcccaaaggaaagctttctggagttgcccaaatgaaccttcagatccatgttggtcatctttgagagcatccattctcagtggcttctccaaggaattctacggctagaatagtagatgcacctccatttgctgcttcagtccagaaaccaaagtaggagctggaaccggtccaacagtcttcagtcctcttacagccctcactggctgccgatttccttgtttctcttgaggaacgaggagaagcttttacactcttttgaagtcaagaccagattgctttggcattgaagcgtgggctcgtgactaagcctttgactttgtgggctacttacaatttccctgaacatttgttctctgagggaccagctaaccctcagaagcaactgggttggagagcagtgtacataggtgcttcctacaaaagaatgaagtgcactccaaaccaccaatgggccatcccttgtatttcccttcctcgtatgaacaaaaggggttttccaggtgtagctaacagttgccacagcacacaaacctcaagttgctaggaaaactgctggctggtgtgaggcccaactcatggtggctgaggagcagcagccgtttgtgacaggcagttgctctggggccttctgttaagaagtgaactatttgagcactacagtggagacaatccagtcaacttcggggctcagactaagggcttgtttttcttcagcttttacttgaaggttacaggacaatggactctggatgaaaactggttgtctaccgtcagctctctgccttgcactgtggtcaactctcctcagattaaagatgcaggtacagtagtgagcttacaacatttgacctcgactggatttcctaatttattttataagcagcaaaactaaactgggtctacagctatatccctgt

SEQ ID NO: 34130 - DNA, 1557 bp, Mus musculus
gccccatgggggtaaatgctggagtctttccaagggggacaggatcaggaggactgaacccaaatgccttctctcagtcttctggcacattggcctcaaatccaggcacctttcagaggtctgctggcctccagggctcaaatcaagcagttttcccaagagcctctgggccactaggccccaacccagctaactttccaagggccactggcctgcagggtccaagtccagctgccttcccaaggtctgctggtccattaggcccaggtcaagttgctttccccaggtcagctgcggggcacctgggctcttctccagcaggccctgtgggtatcaacccagctccttttgcaagaccaacggggaccctgggccttaacccagcttcctttccaaggatgaatggccctgtaggtaagactttggtcccatttcctagggtaggcagcctccctggctcaaatccagctgctttccccaggccagggggtccaatggctgcaatgtacccaaatggaatgttacccccttaaataccatttttcttccagggccacttttgttatttaagcactgtggttctgagctggggctgtctcttagataaaagagtagatatggaagtacagtctgaagaacatagctggggctcgagttcaaatgaaccttctttttcctctgcttttttcttgactaaaggcaaaatgttatttgtgagccatggactatggcagatggggtgatcctggcctcaaggaaaaggctctctggccttccggaagcctctgtgcttttgtcccacagctttctgccccttgtttcttactagttccttgaactgttctcgtggacttttcctcagggatacattggcctgcaggtcctagttccccactcaccgctggagaattggctcgcttgctgtctagtgacgctgcattggtgagcgggccatgcttcggtaactctgacccggctccctggacctagtcatgttctactgccagacctttccctgggggcttgaacacagaatgggaggtggacacccacgccacagacccaccacatttctgcttgactgggcctgcggctcctttcttctgggacttagaggtggacagatttaagcttcctccgatcagccagctccctcctcactggtcctcccaatcaaagaacctcaaaacttaaactgcgatggatgggaagtgggggggctggggggggggtggagggatgaaagggaaatcactgtgctgtgttcagcttgatgtgaaggatggttggttttcctccattgtatcttttcttactgtttctttaataaatgggtgagagggctgctgctgtcgctccattttgttctgtttactctctgcttgttttttttaaaatgacaacaaccctgtttattacctgccgtccaacatgcttgtatttgaggatacaagctttggttagccttcactcattcttccgattctattttgtagaataatttgaggagtgtgagattctgacgtctacaatagaaaataagccatcttgcatgtg

SEQ ID NO: 34131 - DNA, 1226 bp, Mus musculus
actgtcctcgggtttgttgctccaggttagccagtctgtagagctagctgcttgctgtccccaccttctggagtagcagaggaatggagccgttgggaatctgctagagtcctaaaagtagaaatgctgtttacgtggggctgcaaagaatgaaagggcacaagggtggattgccaatgtggttttttaacagtgatagagccagaccaggggctggaggtgccagcattgctgcaagagcagctttaaaaggcccctgaaaggaacggccttgccctcaaccttaggcatctccttctgttctgccaaagggaatccctgtgctgatcgtgggccatcatatcctgtatgggaaaaccatccacctggagaaaccttttgcagtccttgtcaaacacactcctgggaagcaggactgtgatgagcccggtcgagggactggcacccagtacttggtgacagcactcatcaaaaacaagatccttttcaaaactcgccccaagcctattatcaccaacgtccccaagaaagtatgaaagaaccccggattttccctagagagcgaccaactccttggactcgtgctccattgccacctcgaggacggctggacggagggcctgttatgaacgcaggccacccaatgggtgtgaactcagatcctttccttatggcagcaggttctcttggtggaaacctggctccatttccaaggaatgcagctccttttcagaatccatcaggctctttggcgtcaaacccagcacactttgctgctggtgctcgcgacccaggcatgacttctttcccaagagggatgaatcccactggcacaggtgcagtttccttcccaaggccaggaggcctgttgggaccaggaccaggaccaggtttaaaccctagaacaggggctcttccaggcccagggcctatgtctaaccccagattaggagggcttcctggacctggtcctatggccaacccaagggcaggcggacttctgggagcaagtcctgaccctagaagtggtggccccatggtccctggatgtggacccaacatgagggcaggtgttttgtcctctgggactggtcctcccaatcctaggccagttggcctgggtcctggaccaagtccaaatctgagatcaagctttttaggtacaaacccggcccctaggtcgggtatgtttccaggcccaggcctgggtcccaacccacgagcat

SEQ ID NO: 34132 - DNA, 1134 bp, Mus musculus
agtcttggttccactgcaacccttcaggctttggagttttcctttgcctcctgtctcagaaagccactgcggttgcagatgctagtgctgtatgtttagtgtcttcatgggcactggagagtggagctcaggtgttcatactcgcatgtctgagccatcttcctggatccaggacgtagagtattatcttcttccccatgtttagaatatgatgttcacagatgtgaattctttattgctttttttaggccactttttttttgcagcttacacatcatacacagtatcagtcaacaaaagcttatttgaaagaacttggtctgtgcagccttggccttttacaatctttatgaattataatcaaagttagactgtcaaatgctgaattgcttacttcccaatctaaaatattagctattctcaataggagtctaaagtcttgcatgagttatatttagtcatcacactagtgagtcatcatctaggtgtcagcgacctagtcatttagtgacctgagcgtgatcatacagtagctttccaccttacaagctggaaccggaactcagccttttgaatttggattgattcactttggagatgctctggcagcaggactcagtgcttttgatccagtgtatgagattaaaacagagggattggaaattcaaagatggacctggtctcaaaagttaagttctgcaaagggtcttataagcacaaagatctttgccttttctcggtagggccacagcctctttgggtacagagactcactagctcacagatctagtgttggtgcccttgtgctgatgtgaacagcacttacacatgttcctggctgcacgctctcctgattcctcttcattcttgctgatacctggttctgtcctttaggaagggaaaattaagtagtgacttttaagtaactagatgggctagtttcttgtctttgctctctatactctagttgagtgtgtaccacatatgaatacatgatttttatttgtatatgacccagtagcctcaaatgcaaaataggaataaatggttatcattagagttgctgtgttggttgagataccatgtacacatgtgcatagcatgtagtccatagtaaacatttaaaatatgtta

SEQ ID NO: 34133 - DNA, 1140 bp, Mus musculus
gagctggttgtcaggatgggatgagataatccagtaagcagtccaaagagtatggagatgaaatcttttggtattggtaacactgtgctgctttctaatcaaggcaaatcttagtcctagaaactggtcgattcttagtgttagcatgaagtgagactgaagactcagaaattgatgccacacagaattttcattgtaacatttttgttatttgttactattaccagaatttggcttcttaaacagcattggaaattcacacaagtgcttcagatattggaatctttgcattgatttagcagatgaatagcccgaaaactgagaaatcttgacatttgatactagcagcctaatattatgtttaaattttttttctacttggaaacatgttctcagattgtaggtgttctgcttgtacgaggcttcacctctttttaagtttccctcacacccacctttgttgttggagacagggtcttcctgagttgtcctgcctcagcctgaagggcagggattacagatgcatagcaccacacctggcttttgagaccctttgaataaaatgtatgctaattgggacacgtggtcatactcctgttacctctgtcggttgtgctctcaaatcaatatgtaagctagccccatggacagttttctggtgacctcaaggagcaagaacaggagtaatagatgctacaggaaatctcaagccctgagatacacacacacacacacacacacacacacacacacacacacacacagagagatcacataggtataatcatatggatatacaggtgtctctaagctagactgacacatttccttttatatccgtgtaagtcacctaatttgatttagcataaaacattttacagggttgatggggtacagcaacagaatggccaggctgtaagccacacagttactgtttccaaggcattgctaggtgtttgccaggatcaatagaaataactcaggcaaggcttcctgcagctgtatataaagatgtatgttttcagttgaacctgcatgggtaggtttgcaagtgctaccccaaatcagaggtcaggtgtctgcttttcttagttcattgtgaattcttattctgatagtctgtccaggaagcagagaatt

SEQ ID NO: 34134 - DNA, 1212 bp, Mus musculus
gagctattactctgttttaagacagagaaactgtctcaaaaaacaagcaataaaaaataaatattagatactttgtatccaactggacactagcccaacttttttatgcatggggactgccacagcctgctcccacctcccaccctcttcaggtgtcctacctctgcttcctgaggactgagattagagttatataagccaccacacctgctgagtcaatcttgaatctcctcattctcaaatattatttgatcgtctgctacattagttctagtctaaaagagagaaatgtataacatgtaatgttaagtaactaatatttgaagctgaaagaaagaaagtgtctaatagacacagccgtttgatagtgacaagctactagttatttgtggggaaatacttttgagtgccagtgactgaggcattcatagcaagttgggaagatatgctgctttgtggttttgaactcacggcaggttgtgaaatgatggtacttctgtagtttttcccaggtcatgagtctcggggtaccgaagccctgtgttgggcaggaggacagcggctctttagtgctggactgaacggagaaatccttgagtatgacctacaggcactaaacatcaagtacactttggatgcctttggaggacccatctggagtatgaccgccagccccagtggctctcaacttttggtcagtaagctagtattgataatacaaaatacagtagtcttgatggtcagtcccttccccgtctcacaagctgttttggtttgttttgattttaggcaagtgatagctttagagaagaaacgcttgtgcatgggggtattagttctgtataaaggctcatttagtctgttttctactcgtctctaatcaggttggttgtgaagatggctccgtgaaactatttgaagtcaccccagaaaaaatccagtttgcaagaaattttgatcggcaaaaaagtaaggcttgttttgggttcgggcaatgaacagcttcaacaagaggttgtctgtttgtgtcaccaaagggacaggatattttcctgtggctataggatatgctgtgtagattttctctgagcacaaggggagttctagaaggcatcccattaggtatcccattaggtagcatagttgtgaaattcaaagtagaaagctagtgttcctgtgaaaatgagtgtattgtttatcacctgcatttta

SEQ ID NO: 34135 - DNA, 1202 bp, Mus musculus
ggcaagtgttctgtctctccagccccactgttagtgacatccggcaagtgttctgcgcccttcctgtccttctgtttattttcttgttgtttctattagtctccttggcttttctcagtagaggagactttcttcccatgccatgtgtgctgtttgcgcctgtcaccatagtggggctcttgagtatggccttccctgcagagaggtatcttggtggcctatctggggacttgtgaagtcataagcttatacttttttttttcttgagtgacttgaaatcaatcagttgggtttttgggggggggtcggtgggggggtcctagagatcaaccaaccctgagcgttccatgttctgccactgagctgcactctcagactcccccattctgtccccgtgagtcctgtaagtacaggcccagctgtcagtgttctgaggaggagaaatctggtgttgtcggcattcaagttagcagtttcactggaccgttttccttccagacacctctgtcccagcctcagttcccaacgctttttatgtaagaaagtcttctctggagatagagtttagttaatatccggcagcttactcaggagattgctacctcgaggtccagcagcctctagatgaccttttgaccagtccctcctgtgggtgtcaagaataagtcaagtggcttcttggctttccttaaggctaacctgcatcttggtttcaaggtcctgcttggttgccaccctgagtctttgacactgtcttcttttctccctgtcctataaacagagtgtggggagagttcagggtgtgatgtgtacatgcagtacatgatgtgtacatgcagggtgtgatgtgtacatgcagggtgtgatgtgtacatgcagtgtgccagcttttaagtgaacagggatccttccatgccagtgccccagaaggaatgccagtccttttgctctctctttctccctcccttttttcctccctcctgcgaacttcaccccttccttttcaggatcccattttggaattttaaaacagttcgacccagctaccattttactccctaactatatgttcaggcatctaactccatgtatgcttgcctgtgcagttttgaaaaactaaaactaaacgtgtgcctttcttacttttcagggagcataattcgtaagatggttttagataggcaacacctgggagtgactaa

SEQ ID NO: 34136 - DNA, 1170 bp, Mus musculus
gtaagaacaagccatacccaaagtctcgtttctgccgtggtgtccctgatgctaagatccgaatctttgatttgggatggaagaaagcgaaagttgatgaattcccactttgtggccatatggtgtcagatgaatatgagcaactctcttctgaagcactggaggctgcccgtatttgtgccaacaaatacatggtaaagagttgtggcaaggatggctttcatatccgagtgaggctccaccctttccatgtcatccgtatcaacatgatgttgtcttgtgctgggtccaacaggctccagacagggatgagtggtgccgttgggaagccccagggcacagtggccagggttcacattggccaggtcatcacgtctatccgagccaagttgcagaataaggaacatgtgattgaggctctgcgcagagccaagttcaagttccctggccaccagaagattcacatctcaaagaagtggggctttaccaagtttaatgcagatgaatttgaagacatggttgttgagaagtggctcattcctgatggctgtggtgtcaaatatatccccaaccgtggtcctctggacaagtggagagccctgcattcctgaaggcttcaatagttctctcctataccctaccaaattgttcaataataaatctcacatcaagttcaaaaaaaaaaagaatgtggcagccagaggccacctcttgagagttggttctccttccaccatgtgtgtctcagggattgggttcataattgagtttgtcagccagcaactttaccctctgaaccaccttgccagccctttaaaagtaatagtaccggctggccttgaatttgccagaccgctgattatggccttgaacctgtcttaacctcccagtgctagggttacaagcacaggaatgtgcctcgccacctagtggtgcctatggggtttctattagtgttgttggggatgttggttggtgcactaagtacactccctgagagatcaggtgttagaggagtggttccctggctagtggtgctgataggaagggatcatgagagtggcaagttcttctatacgttgttgtgatgaagtaggtcacagggccatacctaagacatacttgcctttctccctctgtctctgcttcttggtgaccatgaggtgagca

SEQ ID NO: 34137 - DNA, 1153 bp, Mus musculus
gtacatgaaagaaagaaaggaaaggagagagagaattacagtgacaactcatgtttcttctccacagactatggacctgcattcttgtccaaagccgattgtatttgtattgcacacgttcttatccgccaaagtcactcgcatgggactgcttgtgtgagcagcaagagtgaagaaagagctttgactgtcacaagaagtatttccacctcaaaagatgaaaagaaagaaaaagcaacaacaaagaagcacaaacagaagcccttgctcctgcctccatcacagtgccttcctgaggacctgcagaccactgctggaccacaacagggttttaggaagggccgacctttcccacacagccttggtcagaaattctagaactgttataagctccaaatgaaagctattgatttaccgtcttatttcataatgtgatctcaagtaatcaggtttcttttccctgttatgaagtctggcactttgggtttctctttggacataaacagatagccaaaaggggctcttcttttctttgtgtaggaatcatttgggtatagccttgagctcttcctgggatgactgtcgctctccggtgctagtgtgcagctgccgtccctcaggcacatcccacacaggtccttgcaccacagtgaccccgccctgtcccaccctccccacctctatctggcaccagctctgccacccataagtgctgcctttaggactcagaacttgcacagtctggttgcctttgccttcactccccttttttgtggtgtccaagttgaaaagcaagttggaaatgctgcccggaaagaggagtgttgctttctttagtttatattgagtttatatttggtaggagccaggggatggtctacagtttattttgaaagatcctcatcttacgctaagccatttcttattgcttaccaaatgtgcctttgggtagggtcagtggagctttattagtgactgtgggatgaccgggtctcactgctgttcctgggatcccagctggctttcaggagttgtccttgaggtcagttccttagtggcatcttttggtggtggttttgtgggtcacgttagctttgtagcacagatgccgttttgagtgacacagagcacgggggctaggagaggtcctggc

SEQ ID NO: 34138 - DNA, 1147 bp, Mus musculus
cacagctcccgaatctgaacaaaaaggaaatattaatatctgatatcttctagaggttttctaacctctctgaaaacatgtctagaaacagctctcatgttctagatttctctggagtgctacacagggatatggctcttcaaatggggtagagggtgaaagggaagaaaacataagtatttgtgcagagcctgagctgccttgattggcagggtagccagaggaaagagcagacgccaagcagaggtgtcaccctgctgtcctccgctgtcagtgagtcaggcctcctgctctgcagtcagactaacagtacccagaggctggggagaaagtcttaaccctgagataggttccatccctgatacatcttcaactcaaaagaaaaagaagaaatgtcccagctctgagtgcagaaagcagagctatagcagtaagagagctctggctcctgccccactgagctgcgggtgtgaaaggcggagacaccagggagactgacaggagcctctgccccctgttccttagaagagctgtaagtgggtaagctgtgctcttcttctggctgaggcctgtggcccacagggtttttaatactgtcatttgaggcttataaaatgaaggcttatgggtgattttgttgtcattaggagcaccaagagcaaggtcctaagctgcttgttccagaagctgtagcagccccaacccccgcaggtggtcagttaggaattttaaaccacaagtggaatgctttttgtgagtgtgggacaccttgatacaaacctatattatcaattttgtactcaaaagccaaaatatagcaaactattttcaaatgataactaaaaatgggcatctttgataattcacctctttttatagaatcagctatattgtctttaatttttcatcttgaacattattggggatgttgtgggctcctgggtgtgagtgggcaggaaactgtggagcgcctcctgttggatgggccacttcctaggcatctgtgcattccacacagtcccaggtcatcctgcagatgagagctctcctccccataagaaagaggactaaaggaagctcatgttaccaacaagccttgcctagaaattggtatcaaatattttatataaagaaatgcttgtgtgta

SEQ ID NO: 34139 - DNA, 1210 bp, Mus musculus
tttcctaacttattctcctggacagaacggtagcaaagttttgttcagctgaataaatgcactcagctaataaaccaaaatttattctttcaaaataagaaattatctgttatcaccaaaaaataaaattaaaataaacaaattaagctatgtggaatctgaacacgattaccccactccccagaaaggttttactatgagtggttttgatgaacaaaaatgtgtggggaaaattactgatttcttaaactcttgtaagaaacgcaagagtcttctagtttaatttaaatgcatgtggctttgtttgttttcaaaaccttggaagaacctacccatgtgtttaatgcaaatcactgtcaaagctgctagccttccttaaaagccctggctgctggaagaggtgagcagtcctgaagtgttcggaagagtgggagactccgtcactctctcttcttttgtatcttttcttggacacctactcagaccgtattttattattcccactggttcatgctattgattgtacacgatacttaaatgtgcaaatattctgcttccatccccacgtggctgctggcagctctcggtgccaagaatggactggctccttagaatgctgggctcagtgggtaagagggctgctgctgtcatgaggactgccgagcagatctcagcacccaagtccagggggctgaaggaatgaagaaatggaaggagggagggagggagggagggagggagggagggagggagggagggagggaaggaaggaaggaaggaaggaaggaaggaaggaaggaaggaaggaaggaaggaaggaaggaaactaactcctaatctctaatgagaagatcaaatacaaggttacttagatcttaaaagcacattgctctggacaaattttaatgtgtactactacagtggtagtctgagtttactttggaagctattccaggtttgtcaggcaccaggactacacagtaagattctgtctcagaacaacaaaatcctagtacttgggagctacaggcaaagaatccaagattagctgtactcaatccaaggccagctggactacatctgatcctgcctcagtacaatagaaaaaaattgaggtcatatacactttagttgaatccatgcccttgttttaattacttagtaatctagaatgattttgactctacacacaattcttacaagtcgatac

SEQ ID NO: 34140 - DNA, 1276 bp, Mus musculus
gaagccagaggaagcttcagagcccctgggactgacgtcagagagggttacaagacactatgctggggccaggaactaaaacccaggtcctctgcaggcgcagccagtgctcctaagcactgcacatcttcccagccacggcacgtgacgtacagtccagctcttgagaggtctgggaggcaagggagatggggagttgaaagtcatcctcagctatgtagagtttgagatcagcctggggtcatgcaggaaactcagctcaaaaaaagtttgtgtgaatttaatataatacataaatatgactgttgcaaattactctttgcccaattagttagatacatatgtttaaatctaccatattgtgagacacattggcttaagtgcttagtcttatcagggaggcagaggcagatctcaaggccagccaggtttacagtgagttctaggctagccaaggctacacagtgagaccctgtctttttttttttctaaagcaagcacaaacaaaagctatgcagttaaaccctataatagatgttcccttactccatgataggactgggatcccgggttagacttctcacctcagccttgcgctgactttgcctccatatccttgtgacagtgctcatcccagttaatgctctaccctcagggcctcgtggctctgtcacccttccgaagccacagaggactgtagatacccaaaagattctctgggaatgtaaacatttgaaactttcgggctagttcatggtgtatccctacatttcacccaacaggcattttgtggtagaagcttctgcatcaagccgactgagtgatcaggggcctacaagatgtctcagcaggcagaggcactcacagccagggttacaacctgaactcagtgttggaagcagagaactgtctcccaacagttaccctctgaccagcctcaggccagagcccccccccacacacacacacacacacgtgtgtggcagggagtcacttggtagtggatccaattaacttagaatcttttattgcccaggcacaccacgtcctctctttattaactagtctgtttctcttttcttttatgtatgtagttgttttacctgcatggatgtgtgctacatctgttcagtgcttgtagaggtcagaagaagggtccagatacctggaacaggagttacaggtggttctgggctgccgtgtgggtgctggcagagcagcctgtgttcttgcttgttacgccatctttccagccaccacttagcatttgtcccag

SEQ ID NO: 34141 - DNA, 1669 bp, Mus musculus
gaaggcatattcaggctctgcccgtggcaacatgagaagatcacctaaacatgttaaggaagttggagttttcattatatatcattttttaatgaaaacttagactttagtttgtgaagggaaatattataggtccctcaataagataaatcacaaagtgaaaatttaatctttatcgccaacagtagattaataggggaaaaagcctttttcttttttctttttcatttttatatgtgtgaatacactgtcactgtcttcagacacaccagaagagtgcatcaggtcatgttatagatgtttgtgagccaccatgtggttgctgggaattgaactcaggacctctggaagaacagtcagtgctcttaaccactgagccatttctccagcccttttattcttttaaatagacagcaaagtttatttttgaacattgctgacctattcatttccagactggagggtagttttgtgtttttatttttctgttttttgaaacagagtgtctgtgctatcctggaatagctttatagaccaggctggcctcaaactctctagagatctatctgcctctgcctgggatcaaagatgtgtgtcaccaccactggttgcatcttattttcttaaggtccttatacacatcatagctggaccgtttctccattaacaagcaaccacattgcattaaaaattagcaagagtccaggtgtggcaaggtcactcagtggttggagctcttggctgctcttttagaggctcgattttaatttccaacacccacatgtcggctcacagtcctctataattgtcctatgggattcaatgtccttttctggtgtgcagctatacatgcagacaaagcactcatatacacacactacataaataagtcctgaaaattagcatttttctgcttactcaagaacccgttggcgttcaaactcagtggaaagagacctagagaaagtgagccagggttggctgaattttccagtagtgacgcctctttcaatccttcttgctttttattacctgtgaggtcagcttttcaaacttgtttaatccctccctgaaagtactctctgagctggggatggcgggaagaggagttgcatggctctctccccttgttggcaaatgtattggagtcactgggtcacgccttgcgtgtcttgttctctaaacctgccctttgcagtcaggtgctaataactgcgtttttatcaaaaccagcagatattattgctgcacacctagtcctataggaccaaagaagggctttccttctgtggagtcctcggttaacagtgggtattttcacatctttttgctggtgttttctgaatcagtgggattggggagagagaaaagctgaggtctgcggaatcacggcctcccaaatcctcacttagcaccccaggcactgggttcagctctcctccctcggttgggatgccacccgtattgtcagtcgcctggtgaggtaagttgcagtccccggagccccaataatccctcttcctagtgccagatctgaagtcttacaaagcataacctattttttttcttctgtgtaccctctgctaatccccacgtgtatgtattctttcttgcactactcatttttgttaagtgtaaagacttagaaagctagctcaagtaaggctgg

SEQ ID NO: 34142 - DNA, 2201 bp, Mus musculus
ctggaaaggatgaagtttcagtcagcagctcggagactgacttcttggctcctttcacagttctcaaagatacagctgtttcaatatagtttttgttttgttttgtttccttataaatgaatgtctgttctttcaattccagggttttggggtggcagcaaagtctacccaagactgccgaaaagtggaccccatggcaattgtggtgttccaccaagcagacattggggagtacgtacgccatgaagagacactgacttaggacggtcattccaagaacattttgctgtgtgagaggacttagctttgtttcctgtgtgcggccatcagattaaatctggacaacactgagatacgcaacttgggttcttatcaacagaaatggcgtgaaaacagggtctctggccctctagagtcaaaagcaggtggatcacaagtataaggccagctcaggctacttggagagttcaaggctagcctgggctacatagtgagccttgtctcaaaaatctaaaacagacaaaccagaacctgagagtgttttgtgtgagtaaatagagtgtttctgttttgtgtctgcgtcgtctttgtttggatcagaagacttgctctgagtgatggtttctaagttacttcactgaggacaggagccatcttactgttatctgtgataacactgttttccaggctcatgatagcacagtggactttctattgtgtgttaatgttaaaggtagaaacggccatatgagcctctggttttacatatggaatttaataaattttaatggttttatatttgttatttcatatgtgtgagtgttttgttggcatgtacgtatgtgcactgcttatgtgcctggtgcctaaggaagtcaaggtgatttcagacctggaactagagttactggttgtgagccaccgtataggtgccagaaattaaactcaggtcctctgcagggacagcagtggtcttaaccactaagctatcctaataaatttaataggtgcattttggctatttttcttggtgttaagtggggtatagcgtggaagcgtctgtattcaagcctcagttctgccccttgccagctgtggtggtggacaagttctctgcttagagaggcttcattttcttcctttgttaaaagaaaaaacccatgaccctgccgtatggtggtgcatatctttagttacagcacgggggcttgagggtgaggcaaaggcagatggagctctataggttcaaggccagcctggtctacataaggagatcctggccagtcttaaacccaaaacccacaaaactgaaaaaacacctccagtcatcagtgtaacagtgatattcagaattaaaaatagcagttgtaggggctggtgagatggctcagtgggtaagagcacccgactgctcttccaaaggtccggagttcaaaccccagcaaccacatggtggctcacaaccatccgtaacaagatctgactccctcttctggagtgtctgaagacagctacagtgtacttacttacatataataaataaataaaaaatagcagttgtaaagcatcctgcatgggatagagttatcctgtctcaaaacaggaaattgttcgtgcgtgtctgtgtgagtatatcctgcttgggtagcggtatcctcagagggcagaaaacacttgggattccttggagcctgaggtaaggacagttgtgagctggccattgttggtgttgggaaccaaacttcagtcctctaaaagagaatgttctttctgaactgctgagccatcttccctgtctgtgttaaaatgattttgttacttttttttttttttaattgaaacaagttctgactatgtatctctgcttagaatgtacccaggctggcctcaaactcaaggatccattgattctgaagtgctgagattaaatgggtatactaccataccaggctcaattcccccacctcccttttttttttgtttttgtttgttttttttgtttgttttgtttttgtttgttcttttgagacagggtttctctgtagccctgactgtcctggaactcattctgtagaccaggctggcctcaaactcagagatctgtttgcctccaaaatactggccttaaaaaatgtgccccaccatgcctaacttcagaacaatttctttttctttttttttgagacagggtttctctgtat

SEQ ID NO: 34143 - DNA, 1159 bp, Mus musculus
cccactggggatactgactatcctgtgtgtgctttctcagcagacagcctcagaaccctccagccaccatcgggatcaggactctgaaggcagctttcaaagctctgtctactgcacaagactcagaggccgcttttgcaaaactggaccagaaagatctggtacttgctaatctggcatccccatcatcaccagcccacaaacacaagagacccaggaaagatgaacatgaaagcgcagctcctgctgagggtgagggaggctcagaccggcagcccaggaacagtcccatgacaataagcagattgctgttggaggaggacagccagagtactgagcccagcccaggcctcaactcctcccacaaggccatgtcagcatccaagcccagagctctcaaccaaccccacccgggggagaagaagcccaagtatgaagaccttctttgtaggagtttgggggctggttggcgggcctggttgggcctggttttacttccatgaatgacgtaatcttcagctaagctactctccaccaaggcttgctcagactgctaggatgagactggagcagggagtgacaatgtgacagtccctgccagctcctgaggctgctgtaggctgcagggcactgccctagggcatgagtaagcaggaaagggttctgagccgtctgcctgttggtctgagtgcctcaaggacgaaatatcagccttacttgtacaatttgtctgaagttgggcctcattatacttgatatttatgaaagaccagtgagcacttagctttatacctttgagcatttgagacccagcaaattcagcaaagatctcccaatcttccatgttctgctagctgctgtaggacagtggttagaatatgttaattaagtttatcaccatcatgactcccagcctgggttttgagtcccgctgccctttgtaccctgtgtggaccccactccaggcactggtttgcttgtgctctcagaacatactgtttgtttctcccgctgtgcacctcctctcagtcccccatggcctgccacccccctcccccatttggtgcttccaaggggagaggaacctaggtgtgtgcacttctatactagcttacggagtctgcagtgctcgctctgtgccatggtggtagccctatcg

SEQ ID NO: 34144 - DNA, 1423 bp, Mus musculus
agaatcctgctcccgccgcatatttgcggcagagttgaggagttggtcacaccaaaacctgttttatcgtctctgttcataatgactcaaaaaccgtgacctaccaaatgttcttgagtggataaatgaataaactgtaatatatcccaaacaatacagtagtgctccgcagcaagaaaatggaaccctggcagcacaggactcaatgatctcgcattgtgcggcctgaaagaagcatccagaacacagctgatgctagggcgccgcctgctggcgaatgtctgtgacctcagctctgggaggctgaggcaggagaatttgagttttatgtgatgataaaacctaaaaaagcgcttcttcttcttcggaaaacaccaaatggcggatgacgccggtgtagcgggagggcccggaggacccgggggcccaggattaggaggccgcagcggcttccgcacaggattcggcagcggtcttaggggccgcggtcgtggccgaggccgtggccgtggtcgaggctgcggggctcgtggaggtaaagctgaagacaaggagtggatccccgtcaccaagctgggctgcctggttaaggacatgaagatcaagtccttggaggagatctacctgttctccttgcccattaaggagtctgagatcattgacttcttcctgggtgcgtccctaaaggatgaggttctgaaaatcatgccagtgcagaagcagactcgggctggccagcggaccaggttcaaggctttcgtcgctattggggactacaatggtcacgttggtcttggtgttaagtgctccaaggaggttgccactgccatccgaggggtcatcatcttggccaagctttccatcgtccctgtgcggagaggctactgggggaacaagattggcaagccccacacttttccatgcaaggtgacaggccgctgtggctctgtgctggtgcgtctcatccctgcccccagaggcactggcattgtctctgctcctgtgcccaagaagctcctgatgatggccggtatagatgactgctacacttcagccagaggctgcactgccaccctgggcaactttgctaaggccacctttgatgccatctccaagacttacagctacctgacccctgacctctggaaagagactgtcttcaccaagtttccttatcaggaattcactgatcatcttgtggaaacccacaccagagtctctgttcagagaacccaggctccagctgtggctaccacataagggtttttatacaagaaaaataaaagaattaagtctgctttaaaaaaaaaaaaaaactaaaaaagcaagaaatagtgccacttatacactaaaagacacaaaatagcaaaaagaagggtttgggaagtgagcattgaggatattagttttgtattcttgcaga

SEQ ID NO: 34145 - DNA, 1195 bp, Mus musculus
gatacataaagaacttgtatgcatgtatgtttgtatatatgtccaaacctgtgcacctccctcttccctgagacaatagtctcattctgtagcccatgcactgaggttacagtgtgagctatcacactgagctaaagtgcttttgttggttgtcttggttggttggttagttgttgctgtggttgtttgaaactattgaggccctggcctggaacttactagatagaccttgaacccagagatccacctgctatgattcaaggctaccatgtttggctaataataattcatttagggattggtcaagtttttaagtttagggtgtgtgtgtgtgtgtgtgtgtgtgtgcgcgcgcgattgtacattcatgttttgattacacatatgtctatgtgagggtatcagatcccctggaactggagttacagatggttgtgtgctgccatgtgggtgctgggaactgaatccaggtcctctggaagagtaactagtactttaacccttcagccctgagattatttcatttttatgtgtatcagtgttttgccttatgagccgtgtgcatgcctggtttccaccaaggtgagaagatcattagagcctctggacctggagttatagctgtgagctacccaccatgtgggtgctgtgaattgaacctgagttctctgcaaaatcagcacgtgttcttaaccactgagctatcttctagccctaggatttagcaacattttaaacagtgaaactttattatcttgttttgctataggatattctatagcctatgctctttgttgagctgataagtagctgagagatggcccttgaaccaccagtcctcctccttccacttcccatacggctaagccatgttttgttgttttactgtgggggctggaaaggaggctcggtgcttatgagcagttgctgctctagcagaggttctgagttcagctgccgctatagctccagtcatagatgatccaacaacatccttttttttggtctccacagggcacatacatatatgtaggaaaacacacacacacagagacacaattaaaagttaaaacatctttaattaaaaatctaagccagggggctggtgaaatggcttagtggttaagagcactgattgctcttctgaaggtcctgagttcaaatcccagcaaccacatggtggctcacaaccgta

SEQ ID NO: 34146 - DNA, 1158 bp, Mus musculus
tattccagtctttggaatgctgagtgactggtgctttgaaacagttaaaggtgaaatagatgcctaggaatagcatggaggggctggcagtaattactgtcatattagaagacagtagctttgcctgaaggaaggtagcgaatgcaggctctatgtagtgtcatcagtccccagggatcccctgaaatcttgaatttgactcatcacttatcattcttgtttttccaaggatgataaaaacaacaacaaagcaaaaaccaaacactccctacacccacagtccacttgttacctaggtggtaggtagacatatatacagaaggcattctgtgttccctcagtgttcatgtgggttgacctagagaagacttgaaataaggtgagaaaaaggtcagaccctggccctatgcaggcaaggtggcagggtgactcaatcagtgttttttttttttttttttcttcatttgtttattcattttgtgtgtggtcataggcctgtgtgcctacttgtgtgcatttacgcacctatgagaacagagtgagtgctcccaatctccctatgcctaaggtatcatgctctgatctcagtcacacagaagacaactgtggtcctgttcctaagagtttatagtctaatgggaaagaaagacattcaatcaaaaccacaattgtaggttctagatggctcagctggtagagcatttgttcaagtctgactccctgggacctgcataagggggaaggtgaacctcctccacagtgttgttcttggcatgtgctttggcatgtgtgaggtctggtgaccttgccagcttacaccctttggcatcaggctagtttcctaggcaacacccctgtcttcccaggttcactcttatccccaagccaaaggcatcatttcctcctgtgacccactagttctgttatctttctctgccttgccatactttgatctttgtatttggctttagtgatagtctgtgtttggctagagattgctctttatcgtccagcctagttctgcagcttcctcaagctaatgactctcattccattttccaagtcaggtgggcttcaggagagctccattgtcacatttttactgcatcggtatggaatttccatccacagagaacttgaatcattttttcccagcta

SEQ ID NO: 34147 - DNA, 1109 bp, Mus musculus
ttcaattcaagaggctgcttgcttggcagcgtgtgccttctgttgccctgaaatccagggtgtgtatataattaactcttctatactgctcgctcgctctgttaagttactaaggagatggaatgactctttaaacgtttgtgaccactgacggttggttttccctctccctcctcttacctcactcagtcttgaatcctcttgtgacattaaggtaaaatttgagctaatatgatcttaattgaacatttctagagaacgccaccctgagtccaagctttcacaggcgaccttgaacctagtggccctcaccagtttcccaaggcgatcatgaacgcactcatatgttaaagcaagagaaagacactggtcagttacggtctctagaactctatcagttgtttcttgttggttttcttattgttgatacaggaggcacaacgtttgtgcggaatccactgcagtgtttcagaaattctgttccttgcaccagtgttcttttcctgggcttgcactaattctgtttagaatctctggagtcgagctagctttgcagtttgtttgtttttttttttagataatttatttaattttattttctgtacattggtgtgaacgggagctacagacagttgagggctgccatgaaggtgcagagaaaggaaccctggtcctctggaagagtagccagtgctcttaaccagtgagccacttgttcagcctcctgggtttgcactttaaagagcacaggtgataggaaggaaggcaggcagcacaccctgtgctgaccgacgtgcctgtctgcctgccactgcagataaaacccggggacactgaatttgctcctgtgcaagcattgctgccttctgtaagccaagcaattagagactgatcagctgaaataaaatgattggccctggattttccccccctgcaagaagtatagaaaagcctcctcggagcaccaagtagcatggtgacttagatgtggaaatgtagtatagccccatccaggttagggagggacggagagctgtgctttcaagcctgtttttctccagttacttgttccccagggacccgtctccattaggatccttctggctgtt

SEQ ID NO: 34148 - DNA, 1115 bp, Mus musculus
ttcatttttgtgggatagagttctcatcttctccttcccttcccttctctgcaccacttctccccctcaggcagcctctgccttcttcccagagaaagtcagtgttccagacctgggtctgctgtgtctgctgaggatgacctcgaacttcagccctcctgccttcccttctggagctctgggttataggcataggccaccgtgcccagtcttcatttccctcttcttttagaaacagcttttcatgttccagctaataagtggtaatggtcaccattgtttcacagtagactgataatatcccagttgatggcagcacatagtacaatataaaatttttgaagatttttaatttgtcgatctgacaagtttatttttctctgtagctttggctggcttagaactaagatcagccagcctctgcctcccaagtgctgaggtagaaggtgtgccatgacacctgctttagtcggtaataactaattagaattaaaaataattctactctttgggatatgctgatgccatatggtcagactgttgtcttcaaaaataaaaaaataataaaaagagacttggtaggtggggtaagagagtcagtacttgaagaccaccttagctataccatggtctacatgagaacctgcttcagaaaaataaaaaacagttctttgctgtacctgtcttaactacctaacttcctggagtttgcaatggtcaatagtaactgccgctgatcaagacttctctctggtaatgtgattttccagacagctatggtctttgggaattaagcataaaatgtcctggccagtctctcttgaaaaacaaaatgctgttctctgagcagtgtcaggcattaatgtctcaccaagttctagaaacaaagtgagcgtgagaagccgggcagtgctctcccacacttcccagctggaattgctcgctcacatgtttcggtccaaatagggatgctcacctcgggagggagggcttttcctcgagacacaatctcatgcagccaggctggcctcaagctcaccacttcatgaatgctgaccttttggttctcctttcaccacctccgaagctctggggtcacttgtgtgggcagccat

SEQ ID NO: 34149 - DNA, 4146 bp, Mus musculus
ttccctccttggaacctgccagttgttttctttccccttggagccaagatggttgaccagatatctatcctccttcagtgtacgaccagagtctttcatccgccagagcctgacgcccaaagcacctgctcactctgtgtccttgccagggtttctctcattggttcccactccttcctttcatttcaaaagttgatgccaatgacttagagttcctatgttgtagtgacatggcctttggggacagtacatgatttctcataatttgaattcatagtagatatagttaagggaacagcagtcaggttatgaatcttttcccatttttctttttaagtaaatttatttttttaattctgatttaattttgtcattcatcataagggatttaattcatgaagttgtgtgtatcttatttcaaacacagctgccagatgatcttatttatgattgttagaagtaaggggccagcaagatggctcagtggataaaagcaattgccgcgaagcctgatgacctgtgtctgagtcactgcactcacaggatagaaagaaccgattcccaaaagttgtcctctgacttccacatgtgtgctatggtctttgcacacacacgcacacacacacaccccagatgttatttttaaaaatgaagtacagcaacagtggctatctacccctgccccctccagacagtgtagctgatggctcctcctgtctctaagtcccgcctcttttcccaaaatacttcacaaagtgtgcatccctttgatttcttaggaatctaagagctgaagaaggactgacttcagagtaatctcttttacaaagagaaccaaacactacttacaggagagcagtttaaaaagggaccaacatgcgctctctggtctgacactggtttctaaccatcttccaccctggctgtctttaccagtgaaagatgtgtgtgtgtgcttaccttctatacacttctctccggtccgtggggcttcacaaaggcctttctgctgtttttctttaccgattagcaaatttctgattccttgtcttaaagtacaagactcaagtttgaacttatgtttatctcagtaaaataacttagatgtaaatgtcattgtccggcatgccccttcagattgggagaccatgccaagagacttcggttttcatctgggttttacctccatggcgccaacttttggttttgtcctactttctattgagggtaatgataaatctggaagctttctttcctcttggatatgaatttcactggaaagtaggcagtcatttaaaattccttctctcgttggtccaggcattttcctggcacctctgactgtattctctctccctgtggcagtgcctgacagtacccagctgtttcttagtttctatgatctttcttcacatctttgttcattaccagtcagcttctgggctggtgtcacatccagcaggaaaccatgggattccagcaggaccagagatgttgggaagtgtcctcctgcctcccttccagcttgccaggggcttgacaggacaggaaactgcacagtaaaccagtctgcccgtgtaaactattttttaaaaagttcagtccaggactcgtatcctgtgatttagcagttgaatgaattcagaattcatcaaaataacattaaccttttccttacacacttgaatatgatattttagagtgatttctaggtgacttttatgtcagagatgaagacttaatcaaccattcgtctttagaaacgtctgtaatattgtgtcatagattgacagcgtaattagtctgtaacaaaagcggcatgcggcgcgcatctccaggtaaaggcagggaaggttgtgtgcagggagcccgggacctgcatgctgggatagcgaagtcacatggagtatgctgggtagaagggaagaacaaaggaacattgagtgcaggacaggagcgtcccagctaactccaaacttgatgggacacctagtgaaaaacatctggcttgtaggaaatgttaaagaactgcattttcggctgggcatggtggtgcacaccattaatcccgatgtaggagagacagaggctgcagaatctctgagttgaggccagtctggtccacatagtaagttccaggacagtcaggctacatagagagaccatgtcacaaccactccaccaaataaaagaactgtattcttaagtagaatcggtgttttgatatttctacagtaaacatcaataccaaaagccgttttttctatttcacatttgtgtctttcccagcttcttatagctgagctttttctcccgagagccagaaggaaaagattttcatacttttgtctttgcgatccatgaaatccgtcaatacccagggcttcttttgaactactgataatgtaatgtcattttatattatataaaaaggatgcttttttttttttaaatctttaatcccagcacttgggaggcagaagcagacagttctcttgggttgtaggtcagcctggtctacagagcaagctccaagccagccaaagctacataatgagattctgttcaggtctacttgttgtaatcctgttgcctacataaacagctaggggaaaggtaggttttaggtgatcgtttgtcaaggctttccgtaaacggcaaagcaacacaacatgtgcacaggtgtacttttaaaagtctaaacttgtcaaagaagcctggacatttgagggtcatgaaaaaacattaagaccaagaggaggcagttcctatccactgacagcacctcctgacctgtgggcgtgggcaggtttgattgtttattcttgaggtgaccagctgctgccacatatacaggtaatggcaggtgaacatgagagatttgtgctacccagataaaatgtgttaacacccattctctaaaagtttctacccagccctgggagctggttttcatcactgagtgatgtacagaaagcaatagcacacagtgtatggacttacttaagcagagacaagtctgtccagagctgtcacttgagctggctggctcttccagcagttgccatcggggctcacggtgtagggtttgtgctcattaagtgctgatggcaagcagtggaaagtgatttacaagcaaggtgtgtcatcacatgcagcactcatgcttctgtctccagtgatgcccgtccggctgaagtcgacctgagatgactgaagcaaggatcgtaaatgttcattgcctcctaccccaagggaagtggactcagacatgtcttgtctcaacgagaaaccgaagggttgaagctgtgagattcagttgccaaatatcccaaaagtaacggggagctccgtcacatttggccagctttgggatttgtgggagtggtctaggagggaggctgaagaagcaggggtgtgccagtcacctgccttacacccagtgtcctactcatgaatggcaggggccactccttgcccacgcctgcctcgtctaatcagctgcttgggcagacgctcctttcggttatttggcttgtcttttcctgcaccctcaactgagtggctaatactacattccttttgtgaattcaacgatggggtttgtttacctatttggtttcagcttattttgaacaaagatctttgtctctttctactggaatgtgcacacagtgaatgtttgttagaactacacaataaagatactgttttccttttcttgtcctgactacggttgctttttttttttttttttttttataagacttttgtttttaaggaaagggtactgtgctgcttaggtgttgtggatgaagacagttggggtgcacaatgttcttcggtgcctctgctaacatttcgtataacctaagatagggtgcgcggtggctccctagggttctttgttggaagtggatttctcatttgatagttgagagatatagccatcctggtttggccctgttaggggatatgaagtgggaagcagaaaacagcttggagttctctttctaccagtaaagaaaagccaacatgaggtaatgttttattgtccgcagtgctgggcttcagttgattgttttccttggaactagctaaactgttggggaaatttatacacagaggttgaggttctagtgactg

SEQ ID NO: 34150 - DNA, 1148 bp, Mus musculus
aaaatctatcaattataacaaaagtaaaataacgctatttgggcattttttcaaaaattatatttctaggctttatattgcttaaagcatttatattctaaaacttaaccaaattccaattattcttttggggaaagcaatcagttcacaaatcacattttcattgggactgctagccagcctaggtgaaaacacgtctagtgtacttactcttggattatacactgcagatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccggtaacacagttcagcagcatccatcaaccccgaagaggcacacagttttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagctggaaatgggttggtatccacattttttaaagttctatcaccattatgcaaaacaaaaaagtaaatcattcccaaattttcttaattctcagctcaagtttgcatataaagtaaaaaaatgctaattttatccttgaagtacatgatattttaacttaaaataatcaaattttactagaaaaataatataaaatagcagtagattatagcaaaggaattttatgcatatggttaggcatagaggaaaagataatctgttttgaaataacttaaacttcaaatgaacttatattttaaaagtatttttaaaatatctttacctgcagaagtaaggagcaatataataatgctatagctaaaacacctta

SEQ ID NO: 34151 - DNA, 1227 bp, Mus musculus
tccccacgctgcagtgactgtttacatgtcagtcagctcagtgctttacagttgaagtggtcacttacatgatggttcccacagccttgggctccacagggtcatagcattgatttaaaaggaagagttaactgtgttgcatctacagagagcaaaattacacactccagaacttgcatttgtagcattagttgtagagttttgggtgtccttaccacccgtgggatgcctgcttctcactaccacctacatctggacacgtgcttatgtctcatttatctttggcatgtgggaagtgtcaatgcagcgttagcccatcatgtatgcagcttctatatgttgacatgctttggtttcctgttcaattcttttactttctaagcttttaaaaattagccagttcatggttgttgcctttttccttacttttcctttcagtttttctccccctatcctccacatgtgttgaactgtgtggagcttggtgttggtttagtttatatggccagatcctgctttgggactcttcctttgttatttgactgtggttcttgtcatctgtttcttctctttgtccttctccctctgccctggcccttcctttccctctctgagaggcattggattacgttttcagtagtacaggcttcttgccaatatgaagggaactttccagaaagagacctactctggtcatttaattttgaaaacagttttcaatcgttcaagttttggatggtttatatctaatgtgtgtttcatttttttggaaagctatattttatatttaggaaatggtatactattttgctatttgtactaagtgagtacattggcataaatatagaaatttatatatatatatatatatacatatataaactattcttttttgccacacatttttgtggtaaatttgtgagtttgtctgatgttctaccacaacgtggcgtctgataacagtgaggggggtttgttatgtctttcttgagtatttaagcaccttttgaagcaaatggcctgtttatctgtagccattccatcaggcagttcctcgatgttattagggagctgaagggcgactgactgtgtgtttgctggatcttcactcagtgagatgttaaagcgcaaggaaattcatttgaggcagtgtgtcaaatggtgtttgacaagaatgagccactctgtctttgttcactatatatttaatattttattattgttgtt

SEQ ID NO: 34152 - DNA, 1207 bp, Mus musculus
ttatttataaagacactaaaaaaaaaccatgtttgtaattttaataacatttccccatcttttaatatccagagctactttataaattctctaaaccaaaagtatttcctcaagatctcctttctccccccagttcctatagggaaaaatcacccaacatagttcgggttacaagaagggtcagccacacaattcagtgcttcagttttaaaagtaaaacagacagacactagagtgttgtccagagcatcatagaaagcagacctagcagatttaggaaaaacagaagtcaaagtttaataccacatttacttctgagttttctgaattactttgtgagatcatgtagaagactcaggaaatctgtttcttcaccaagatcaagttagaatgtttgacactgccatgctggggatgacgtggcagcaggaagcctggctcgtgtggtggcttctggtcgttctggactagcagcttatccttataaaatgctgattggcaatgccaagtcaccgggaccaatttctgttttataatgtttaagtttagaacagaacatcacctgaactgtagtgctttgagaggatggaggtggaaacccccattttcagtctcatcacttctgtggttatttatacaagggctgtgctgtgctaccatattcctgctcgaatatgatggagtttgtttattttctcgcattgttaaatgttccttgcccctaaaggtccatgttaagaacaatgttctgaatatatgatttggttacaaaaagtatgtcttcttattgaagagttagctcagtggttgatatttgtgctaagatgcagcttcccagttactgttacaagttacagctgccaatgggaagactcaataagccagcaaaggccttgaaaatcatgatttattaaatttatatctggcagaaggacctaaataaactgtgaactacattgtattcctttgttacatttggctcttgctttcagcaattcacagaaatgcttggagctctctctctctctctctctctctctctctctctctctctctctctctctctctctgtctctcccctcccttcctctctccctttccctctccctctctgtccccctccctctctccctccctctacatcctttccttcctctctccctttccctctccctttccctctctctctccctctctccctccctct

SEQ ID NO: 34153 - DNA, 4360 bp, Mus musculus
agaaattgtgcatctgtcccttcagaattaaagggacaattccttttgaccttttgagtgtttgtttttattttttcagcaaggttgcagtatcctgcccaagtcctgggcctgctggtatgaagcaccttaccgggaccccttttttaaaccagtataaatgcttgttttgggaaaatgaaatctgtcagcaaataagaaccaaaactgaataattctttttttttaattattattatttttgtattttttctgtacattgacactgtcttcagacaccagaggagggcattggatcccattacaaatggttttgagccagcaagtggttgctgggaattgaactcaggacctctgggaaagcaatcagttctcttaaccactgtgccatctcttcggctcctgaataattcttaaattcagcagagttatacttactcacaggggttagcctgagaatttttcattttcctagtaaaattttttgttatccctatttcctgattgttaattagttgaaagttatgggagaacttgtggctttactttgcatctctagcacaggctctatctctaaccaaaatgaccactttatatctgggtcctttgggttacctggaggggctcagtgaaagagaaaaactaattcaatagacatacgagaaaaataacccaggccttgaggagtggctcagaggtagagagtttatgtagcatgcgcaaggccctgaatttggtccccagcaccaccaaaagggagagagagatcttgggtacacgtgctagcaagaggattagcactcacccattcatcacacatactgagagctttcccattctgcctacttttgtcactagagctaaactgaaggtgacattcatgatgcaggagattgactctcttcagtatatgtaaattatcccaataccctaattactttctaactgtctgtctattttcatgccatgctaagcctcatattaataaagttctgtttttactgctcttgctcttcaggcaattttttacattaatattttatatgtagattaaatgttatggaaaagtgcctttttaccatgccagtgcccccttctttagtatatgtgctgccaaagcaagcaccgtgcccccttcttaaaaacttcaccttccactattgccaaaattctgtgaacaactggttttatcaggtcccaacttgtactttttccatgtgaccattattttctccatttcttggtcaccataggagataaccttgtcagttcctttgacttaaaaataatagagaaagtgctttggcagaattgcttgggaaagtaagtgcacactgttcaggcttgtgtgaatctaatttcctcatcccaacaaattatagatggctatcacctgaataagaacaaaaataaacatttggctgtctgtgagacttcatgcacaaaaatgtgtgttaaatgttataaaggcactactcaacagcctcttctcagatcctaattagctgggggtgggggggaacagtcactaaaacttaggttttgtaaggcctggaggtaacattgggtttttttccttaattaaatgtgacaaagtagtttatttcttatctatctgaacttcagttaattgactttagaaaacttaatgtcagaaaaaacttagaagtcatttgagtggggggggggggagagctaaagtaatgttttagtctcagatacagttgggttgagtgtcctggttttgtccattttgtttctgatccaactctttatggtggtgcttgaagaaagagacatcagcatcaaattcaggacagtagtaacttaaactccacaacaaaggtgtgttccccatgcaagtatgattgtaactgttggtggactgaagatagcatagttatgcagtatttgtaatactctattgtgcactttaatcattccaaaaaaagccaagaatacatcttaactattcagaatactgcatatttattttggatatatggcttggtgtgttaggttcctgcttaattaaagtaacttacaataagtttgaaattactattttctaaaggacttaagaccttgaaatgtagctgtagggaaatgactatattttgcagaccattttagaaatagtaaaatttgactggctgatgagtatgtcggagagctacttagaaccattccccttccttcgtgtcccttatataagaatgctatagtgtatagtttctacccctgtggtttatgcaaaccagtatggtcctctgcccagcagctagctgatgcagtatgagcagggaactagttaaaggtgcacattcttgggcagtagcccaggcatactgaattagatctgaagtggggcccagcagtctgtctaacccaagtccccagtgagtccagtgcatccttagtttcagagccactctaacggatgagttctatctagtgaaagccagagaatttcttcccacttttaagagataattatttcttctttgtgtatattcagccttacctggttatctgtgatcatttctcaacaataataatttattctcagtactgcctaagaaatgcatgtgttttatgtatatacagtgtagttattgataattcatttaacttagtttggcatttccctaccactgactaaaaagtttacattaactgactgatttcaatatataggtgcaatgttctgtatttctttaattgttgtgacacttacttagctaaaataattgatgggtgctacagtctcctgtttatgcataacatgggtacattgtgggcagtgtaatacaagctttctctttgttgcctcttaatttaccagcaggccatggttttgctcttggctagaccagctctcagaacagaattgccattccataccatttttcttgtatctgagatctcagatagatggctagccaggccaacatagcaccttatttaatttcttctcttaatagattcttttcaagtagcttacttggcatttgaacagtgcagtcaagtgatggttctccttggaactcacacttcaggtgaagtacttaacaaaatgataagacagtgcattttataatttgggtatcccctttctcagttgtgtgcatcttaataaatacaagctaagcaggtttatttttttcctttagaattcagcacttccatcatccttccactgtttacaaatcgctgatgagttaactcatgatagagagattcacttttcagaataaaactaactgaatacttgctttctgagaatcactgcttctgtaccacactagcagtgctaagtggcttactctacaaactggtgctggaaagtaagtaggcaagctgttgggatgctgtagagaccccctcccttccccttctgtcactggatacagagcattctacacaatttatttaaccaaggtttgtaacacctcctttaaagatcctgcattcaacccatgtcacccctacctgctctctcacattggtccttccctttcccaggaacccaccccagcagtaataatatgcatggtttgtaggggtggcctattgttactattttagctagtgagcctcaggaaagcttacactcacacataaccccagacgcttgcaagtgagttgagaatcaaacttctgtgacctggctggagttagagttcagcgacagagcctttgtacacacaaggcccaaggtaggtgtaatccctggtaccaaagagagacagacagacagacagagctgtcctgtatcgaagtgatcacaatttcactcattagagaccttctgcagtgcaattgaactaaccccttctctctaatgaatgtatctgttcaccttgttccctctaaggataagctccaagtgattgctgctttcctggcaacttgactgagtttcactctcttcttttacttcctgttttaatgagtaacttggaatatttcattaacatgttctcaagtgatttagctgccattctgccattttgagttttgtttaattttatctgcttgagcacactgatcaaccactgacctgccttcttgcattgtcctgcagtgacgtaagagtgacattgtgtatacggcttcatagttggaatttcagagcactgacaccagatattctcagtttgttctctgggggaatttcatttgcatctatgtttttagctatctgtgataacttgttaaatattaaaaagatattttgcttctattggaacatttgtatactcgcaattatatttctgtaaacagctgcagtcaaaaataaaacattgaaagttttcattttgcagtgggtggcaatcttttttcctcagactttgtg

SEQ ID NO: 34154 - DNA, 1177 bp, Mus musculus
tcatctgcctgctagttgtctctgagtaactattgaaagatcttaagatggaggtccagttcctgactggaccaaactgaggagagctagtgttcattgtaggtagatacttacctgactggaagctatgagtatacccagactcagggcagctaggtctggggtgtgtgcaggatgtttcttgttttgttcatcctctgtgtagtagcttgaccccagttttttctatgccccatcagtagaacaagggaacacaaatcaataatgtaaagatgttgtagctaatgtctcatataaaatgttttgagagactatgggcttcccacctgcacaacatgcagagcattgccattcagcacacccaccccactctgctttttatttcacaagacattagaaagggcagggaagccctgccgcgaagccagggtgggtgaatcggaggccgccgatttaaagaatcctaacttgtgcatttgactcaatctgtccatgttgcattttgtatccaacagtggagaacacacaactgaccctgaacctgcagacagagaacaaaggcagtgttgtctcgggaggagagctgacaattttcctggatgggccaactgttgatctgggaagtgtgcctaatggcagtgcagtgacagacggtgagttgccgccctgctccccaggctgtgccaggataggctgtgccaggatagggcgggtgggcagccatgctaggggcttggttctctgctaggcatcttggttagagactctttagcggccctgccttagtgttagccctgcctcctcttagtctcccagatgaaaacatgacatggttctcaaggaccaagataaatgtcacagctctgtgtgtgattgtttgaactgaagcagagaaaagcatctcttcacccaatatgggccttggaaattaacccctctaacaaacgtgcttctagttaaatcccctggggagcttgcgtgtactcttttgagatggagttggctgggtagggattgtggaaacaagaaccagcaaagcaggacagtgcctcctgctctgtcccacctgagggttgggagtcttgctagtttgttccattcgatctagtctgaaattagtcacttctggatctagcaggaaattatttcatggagtctaaggtctgaactgggttgc

SEQ ID NO: 34155 - DNA, 1170 bp, Mus musculus
ggcatctccaggatgtactactttggggctagatctcaatgcagacagctgctcctggcagtaatttaagaggttctgtcaactcccctagagtatcagtgagctcctggtacattccagagccaagaggctccctctcctagcaggaacattggttataaaagcctatggattcttgactttagctaggaaatcctcatgcacacagatgacttggctggctctctggcccccagtgcaaggttactggcacctcagagattagcaggtcaagcatgagagcagaacttgggatcccgacgtgaacggggagagcgcatcaagctaagcggagctaagtctgcgctccgcctacaacgctggagcctggactctgcattcccgctcctgcctacagcactggagcctggagtctggacctgggtggttttagctgtgcacaggcggtcagtgcagctccatcaactgcacttccttctggagccatcttgctaaatgacagtcgccatggggagagctgtggaaactggaagatagtccacaggggtgaagtgtgtgagcatgtgaggtgagacaggcgaggaggcctgctctggtcagtgctgtttgtgtgacgtcagaaaagcagacatgctccgcgagtgagggagaacagttttggctgggcgtggcagcacttgcctgtacttgctgcacagtgagactggggtaggaagggcgaatgcaagagttggaagatgaccctgtgacgagaacacagtgtctggggttctgggttgaggtctcagggctgtagcaggggcttcttcctccagaatggagtggagtggaaaagcaaggccagaagagagaccttgcaatgctgagcctgctggtcttcatttgccgtgaggtctcaggcgctgatatactcctccaaggagcccccatggctgtccctaactacggtttcagggggacacatcctggacagccttaacatgtgacagatgtgacaaatgtttacaagtctgttggcccctaaactctggtgccgctatgttcacaaacggctcccattccacgacaaagctgttctttgaaggctgccggtgggtacgtaggcctccacactgtagctacaagcaaagcaaaatggacggcggctcagaccactgcacagatcttcct

SEQ ID NO: 34156 - DNA, 1198 bp, Mus musculus
tctaatgctgatgtataacccccaccccactcaggttctttaggcctcttggtctagtccattaaaccttacctgggtgtctgaggtccagcagttaaaaggcatgatgtcccgggctccatctttggttttaggctgctgactgactggcgattcacccgaggcgtggaagagcagaccaaagctttcctggatggcttcaatgaggttgcccctctggagtggttgagatattttgatgagaaagagctggaggtgggtgccaaagattgggagtccttgacctcagtgcttctagggtgccccagctccacgatacatacctacagaactcgcacaccaagtcccacattttggcaagctaaatgcagcaggatgggaactgttacctgggtcctcagcccaaatttccctatgcttagaggtcagggcccttaaatgtcctggcacaatagcaggttgagaaagtttgggagtctgatggtgagagaggcagctcttcatgggcacaaggcggtgccgtggggagggcgtgatgtgggcttgctgacgcgtcccttcctgcagctcatgctctgcggcatgcaggagatagacatgagcgactggcagaagaacgccatctatcggcactacaccaagagcagcaagcagatccagtggttctggcaggtgcgtctggggtcccagctcccctgctaggcttggggcaagagtcttgcaggtatggttatcagttacccacaggacatgagacctatctagaccccaaactcaaggcccttcatctttgacacattcctctcctccccagcttggagaagtctggaataaacctctggacaaaatagaggtggttgtgacgatattgtcaccagcttgtgtgacagaggttgtcagtagttggtctggacctgattgctgggagccaaggggtcctgtgtccaggaagttcagctgcagttggctgtctggtctcctccagtcagatggggtgagaaaaaggtctaggaaaatgcagtgagctcaccatccttttgaatgacctggttcctttttttacagctgttaacaaggagagcatgcatggaaaacagctacagatatcctgtggggcgtgtgtgtgtgtgtatgtgtgtgtgtgtgtgtaggtaaaagttttgtaggtaaaacttttgagaagaagctgggcagtggt

SEQ ID NO: 34157 - DNA, 2300 bp, Mus musculus
gggggatttgctgagctcatcggtgcgtttccttctgcccttctggggccctccctgggggagggacagcatggggcaagtgcagctggagctgggagggaaagagctgtggcacttggttactttgggaaagaccatctgtgttgacacaaagtacacgttgccttgaatgacagggagcaatggcccgcagaagttctgcatcgacagagttggcaaggaaacctggctgcccaggagccatacgtggtgagtttgccgggagctggcaggctggagctgtaggctggtgggggcagggcaccagagccctggcctcctcccggggctactcctctctctctgtcacagcttcaaccgtctggacctgcctccctataagagctacgagcagctgaaagagaagctgctgtacgccatcgaggagactgaggggttcggacaggagtagctgaggctgctgtctcacaccctctagcacatgtagtcctgagtccttcctgccggagatgccaccggttgcacagccctcaagaggcccctttggatagtggccctgcacgagactgtgccttgatcatttcggtgactgaagagtctgaccccagaggccttggggaccctttcttctctctgatgatggcagtctggaataaagcactgtcacctttgactctattacctgttgcaaagccagagggctgcccttctctgcaaaactgccccttccactaggactgagtctgggtgtgtgtgagagtgtgagggaacatgccctgccttagagggctgccactgaagctgggcctcatatgttccatgaggagctaggcctcgtggaatggctggctgactaaacccagaaagccaaggctctgccagtggaagagacttcacttttgtagaccttccctgaagtccatggaacagacctaagggaacaactgagcatcaaaaccggctttgctttacttcctggcaggctgcagccaaggggactgagcagcaggcacccaatgccaccagctcgtctcttcctagcaagcaaagggttaaagaagccaccacctgggtgtcagtgggaaggagacagcagagctcaggctttgccctttgacagaaacctaaagacacatccacatccatgcatagggctgttgcttgttgtgttgtaggcatgctcttctcaccttctgtcaaggacctggtgccctgggtggtggagggctcagccctcttgattcagtagcttcccaagcagctgctcctctcaggagcctgcttaacacttgcgccagctcagaggcctgcctctatggtccagtgcatccccgctgtgctcagatgctgacgagactcctttgctagactcccctagttagggcctctgcagcttatggtggcttaaaatggagagagcatcttgcctggccgagtgtttgtgctatgtgagcatgaggctttatttgactgtggaagaagacactaagagccagcagaagggcctgagctgcctcattagcctggcttcatttggggagctcctgacagtgtcccgagtaggtgcccagcccctcttgggtaccagagtggttatagcgacacactcctcatccaggcttcccaagatacactagctctgggacaccccaggcatgctctcaaactagtcatggggccttctgaggacagttccatcctacctttgtccttccctggtacagcctgtgaccctggcacactgcacatgctgatctgagtggctctgctcactgtcgcacaccccttcctctcccatgcagtcacctcaggactcccgacatacatcacaaaggctgcttcatggctgggtgtgggaccagatgccagcaaggatggaagcatcaggctcacaggtgtgtgtgtgtgtgtgcacgcgttcgcacatgcgtgagtgtgtagcagaagtgtgtacagagaggcccgtgctagctagcaccaagttggttgacagattgttttgtgatgcttgccctgcctcggtattgccagtttcttgtgcaataaagaatcagcagccatgggtggtgtcagtgtagctgtttatacacattctgttgcaggaagagtcttccattcccacaggtcctctagaatctccagaccaagagaatctccacaacaatagtgctccagccttgctgcctttgcgagtttgagtaccagtaaccaaggtagcctgacttctggaatagatggtagtccttctagctgaggcgagtgacctctggtcacggtgtcatactctctctacaccggtt

SEQ ID NO: 34158 - DNA, 1452 bp, Mus musculus
tgcctttcttatgggctgttgcagagacatcaaggacactacagtggggactctctcccagcggatcacaaaccaggtccatggcttgaagggactgaactccaagctcctggatatcaggagctacctggagaaggtagccagcggcaagctgcccatcaaccaccagatcatataccagctgcaggacgtcttcaacctgctgccggacgccagcctgcaggagtttgtcaaggccttctacctgaagaccaatgaccagatggtggtggtgtacctggcctcgctgatccgctctgtggtcgccttgcataacctcatcaacaacaagattgccaaccgggatgccgagaagaaggagggacaggaaaaggaggagagcaagaaggagagaaaagacgacaaagagaaggagaagagcgacgcagcgaagaaagaagagaaaaaggagaaaaagtaaatggtgtagcttttttaattagtaaattaaaatcttataaccataactccgtgtgccactaggagggtcctttgtcacattcagtgcttgtggacaagcgctctgccctggtcacccttgctgtggcattgtggagatgagtggacaaaaggacggatctcagccctacgatacagcttcagttgcatgagttgggggtgtggtggctcaggtgtccgacttcatgaggagaacaacctagccttgggcactcttccttttatccttgaaagggattttttttcctatcttacaagatccatgggatctgttggttgtaattttcataattgctaaatggaattcatggatcccatacaatgccgcccaacacttgagcttggacccttgtgaacttttgagaccacaccaccttttggacctgtaactagcattcttagggcttggggtccaaggccatgtattgtttaccttcaaagatacaattaaatggcttggtttttatgtctgtgtcctagtggtttgtgttattttaagaagcaagggaaatgatcttcagttgttgctgcagggagtcctgagaacacggggcagtaggttaacagttagctaggaatgggatgctgagagatgggccagccccagtgagtgtggacaggaattggacataggctaatcacccagctctcaattcccttttgctttgttttgggcttttttggtttttgttttgttttgtttttgagacaaagtttcactgtgtagccctggttatcctcccaagttatcctccaccaccataactcagcttgtcaggtccttccttgaacacctgctacatccttgagaattctcaagtgtacccttgggttaaaatgttgacaaattttaaagtgctataacaaaaagtcaactaaatcttggtcaaatgaatgggattaagcctcaaagagatcagaaggataaatgacccatagattaccaaagggcca

SEQ ID NO: 34159 - DNA, 1128 bp, Mus musculus
aaactctcagctactggtgttaatatcatggaaagacctgtcacatcaggctttgttctgatacttttaggtctcaggtccgaaaagagggaacctgcaactaaaacacagaattcatcactgggccttacaaaggccccacccactcacttcctaaacttcacttttctggcccttatcatcctaatccacggccagctctagagtccgtcatctacttacctttctggttcctcacccactgctttattctcccatttgatgattgattgattgattgattgattgactgattgattgattttatgtatgtgagtacactgtcactgtcttcagtcacaccagaagagggcatcagattccattacagatggttgtgagccaccatgtggttgctgggaattgaactcaggacctctggaaagagcagtcagtgctcttatccactgagccatctctccagcctttattctcccatttgatgcctcttagatactgtgatctctgagaccttatttaggtgtttcaagacactgtaccataaaccacacacctggttctaattcaagccccaaggctaaggctctggacaagaagtgatcttttttttttaaatatgtatttcatgtatgtgtgtgtttgtatgtctctgtgtctgtatgtgagtatctgtgcatacgtgcaggtgcctatgtatattagaagggagtagagatcacctgaagctagagctacaggcagttttgatccactccatgtgggttctagaagccaaacttgagtctcctataagagcagtattatgcagctcttcaccactgagccatctctcaatctttactttactttaagacagggtcttactatgtagcacggacaggcatgaaacttgctgtgttgaccaggctgccctcaaacttgtaacagttctcttgtctacaccacctccaggctgggattataggtgtgtgccatcgcatttagcaaaaggtaatcttaaaatgtatgaaagggggctggacctgatggttcaatcgttaagagcactggcagttcttccagaggaccggggttcaattcccagcacccacagggcagctcacgactctctgtaactatagttctaag

SEQ ID NO: 34160 - DNA, 1194 bp, Mus musculus
tgtctaacatgcaactttaattcagaaagaaaaattggaatgactaaaaccaaaaaagccaaatttctccaaaattaaaaacaccaagccacaaacccaagagccatcaaagatgacaagcagaaacctcctcaaaaaacaatgaacaaaacactttcttgtccagctgttagaaaataacagtgtcttaaagagatattatctgtagagaaagtttaaaaaagatcagtgtaacaatttataatttaaaaccaaaaaaaaaaaaaaaagaacctggaatcttcacaggcctggtggctttggctaattataaactgagacaggaaggtcatgagttcaaggccagtgtgggctccagagtgagctcctgtttcaaaaagagaaaaattagttgtaaacttcatctcaccgactcatgatgttgtggttcggtatttccagagagcatttttccagatagaggataaatattaaggaaactgctcccatcctctggtggggttttgtttgtttatagttcctgaatcttttttttttttttttgaactatcactatgtagcctaggctagccttgaactcacaatctcccccttgccttagtctcacagacactgggactacagacatggaacaacaggcttgggtgtcttggctaacattaccatcttatggtgcagaaggagagacaaacattcattaagcactccccacccaggagactttactttgtacctgacagaatgggtaattgttttttaaaaacacagtcttaaatttcaacatatttttaaactaactccatgaagattttcattcttacattctctaccttttgttttgtagaaacagatattaagataagcacttgtagggccaactctaccctcagcaaagtagcaccactgatcctccccacctaccgagttttacagattgtaatctccaacacgttatctcgctttctgcaatttcgtgagtactttgtctttccctccacagattttcaattattcacaataaagtctttgacatatgcccacattgaatcggccttcatgcttatgattcatgtggtggtttgaataagaattgttcccataggcacaggtacttgagtgctttatcattgaggaagtggcaatacttgagaaggattaggaggtgtggccttgctggaggaggtgtggccttgc

SEQ ID NO: 34161 - DNA, 1189 bp, Mus musculus
aaatcagatcaagttagcagtgaagatttactatctcctgaccttagcatcgtcaatgtccccctatctgttttaagagaggtagctagatgttacctaataggacgaagtctatccaaatgccctgctccctctagcatgttaagagcccaggcggctactttattgtcaggacttccctggcacattctttcagccctctcctccaggaaatacagcagttgctaccctaccaccagatggcatacttcatctgcaggatagccgctctcattggctgaaccacaagccagcacaagccactgccccctgatgttgaagggatggtaatacaaaagatggcgcttcctttcttacttccatctcccaaaacaaaagtcaagcccccaatcgtgagcgtctgcctcaaaaaaccactttgtgttgggactacaaggaccctgaatgcatagaccaaccttaagtataccaccaacaagctcattttgaaagtgcacccccactccctcaatgggcttgccatttttttagcaagcacaaaattggcttctatctgcactaagtatgggcaggggctgtaactcagttgggagaatgctcgcctcacatacacaaagctgcgattctgtgccccagcctcgtaagccaggcatggtggttcatgcccctagagccctagggcatcagatgttcaaggtcatgttcagatacacagcaagtttaaggccaccctgggctataggagaccctgactcaagatttttcttaaaagaagaaatagaagctgttacacaggagctgttgacaaagatttggcaacagggtaattaaggcaggatgccaagcttcaagacttggcccataaatttctccttgactactaaataaatgtcttattttcagagtctggagtaaaacccaaatatttgaatatgaagtatgtcatggtttgtatatgcttggcccatggagtggcaatatttggagatgtagccttgttggagtaggtgtgtcactctgggagtgggatttaatacctagtccttgttgcctggaagtcagtattctgctagcagccttcagacaacattcagaaatctcagcccctcctgcaccatgcctgcctggatgctgccatgctccctccttaatgataatggactgaacctctgaacctataagccagtct

SEQ ID NO: 34162 - DNA, 1134 bp, Mus musculus
gtagcttccaaagacagacccgacatattcagcagactggagattcctggctgccagctcagttcttttatgaggtgtctagagtcagctccccagagaggaggaggctaagatgaggtcacctggtcctgcaggtcagcaggggaggttctgccctggggctgtgtgcccagtccttggataatgcggtattttcgctttaatgcatctgaaatgtggattatactattaattactgcaggacaaaacaggattagtgcagctgctccgctctcctctctgcacttttacacttcccctttgctagggaccagccaaaagggcagttggttttcctgtggtctctcttttgtcttagccgcagggggtgctgaacctctggggctcagaagacagagaatgtgagcgaggccgccaggcttgcaggggccaggggtggggtggtttccttccctatagctggggcttttttttttttttttctatgttctgagggtgtctggagggtggcctggcctctgtaggaagagttgttacagtctctgagctgtcaggtttctgcagctggagtcgtggtgccacagagtgttgttctgtgtgtggaagcccacaggcatccagtgggttgagactttcttatgtagtgagaacttagagaaaggagacttgtgggatggctcacgggggtaggggtggggtgaggggggagagcttggtccatctcaatccatactcacacacacacacacacacacacacacacacacaccacacagacacatatacagagacacagacatacacacacagacatacacagatacacagacagacacacacagatacacagacagacacagatacacatccagacagacacagagacaaatagacacacacacagattcatatatacagacacacagagagacacagagccacacagacacacacacatatagacacagagacagacacacagacacacactttctttttatttttaaaaagtgtaatgggaaggccttgacttaggctgcttgtctctagccagtgtgtgagggtggagactagcggcctgcaatgaggtaatgccctttgtattttgagaagctctaaatccccaagcttggc

SEQ ID NO: 34163 - DNA, 1149 bp, Mus musculus
tacccactgactgcaggcgaaactttttaaggagatgcgtcaatagcactgtcctgaaaaatgcaggctcacaccccaccccaaacagacctgtcagatacacatcatctctggggaccctgaattaaagtttgagatgctgtttcacgacatcttcaccagacgaccagcctgtctgtttctgtattgccagggcaggaaggctgcatgtgtcctcctgcctgggtccctagcagatgcagagaagaaggaatagactgggaagggggtgggggtgcgctgacgtgaagcaatctcttcatcctgcccagtctggcagctcatgggcctcggggcatccactactctcccacccagcgagcttgctctgtttatcagccagtcaataagaaaaaggtagttcttacttaaggaggcagaagtcaactcggcaggtcgatcagcgctctgtctgtaaacatggtttcccgtaaaatcaatgctcttcagttacagagggcggcctgggaaccaagtgggtccccacactttcacaggaagccctgccactcagcattcacaaacctctcctcagccccctaagccctcccctccagccctgaccccatcccacagacactccagtctggctcacccggaactctcaacccttcctgcaggccaattcttggtcccctggctactcccgcaggttccctttaaatggcctcaataactacactccaatgctacttgtttaggaattcagttcagattttataaaagcacatctttccgatgacaaaattcaagggtagacacggaagcgatccatcaggcgtttgtgcgcacgcactgttgctcccttctttgctctgcggagcatttaaatctgccattgaaaagtactcagtgcacaggaattccggcaccttaggaatcccccaatacaaaggggggggggtattgtgtgagaatatcaaggttccctgttttaaggcccactgcagttttggaaatatcaatctcttttaaaaagattgctttgcaaggatagaatgctactaccaggtctgccacactcgcctgggcaactatctccctctttaaagtgagagggtgtttgttgtaaggaaagttcagttttattccatgaaggaggcagggggg

SEQ ID NO: 34164 - DNA, 2399 bp, Mus musculus
ccccccatgcccccccccagtgcaattgatctgctacagatggcttcatgtaagttatctgtattggggggggggtgggcgggtcattccatgacctcactgggtactggaaagatgctaagcctcttccactgtggctccctgcccagcctgtctcaaagccctgatggcatggagtgaaaattccagtggatcgaactgtagagtgacagacagtgtgaagtctaaggggcttatccctgaccgcttccctgtttcccactcaacgcatggacccggctgtgtcgtccatggtgcctcttgccctctctgtaccgcaccgtgcaggggccatgttccccagtctgccctctgccctgcaagctttgtgtcgtgggtgtggacagaagctttcttagagcaccccacgcggggactttagcctcagccctcctaacctctttcctttctctctctctttcccctctctccctcctccccaccccccctcgcctccgcccttcaggtccgatccgtactgggtgcaatgaaagctccaagcaggccttaccatggaaggctgtgactcgcccgtcgtctcggggaaggacaatgggtgcgggatccctcagcaccggcaatggactgaactcaacagcgcccacctccccgacaaacccagtagcatggagcagcccacaggcgagagccatgggcccctggacagcctgagggcccccttcaatgagcgcctggcggacagcagcacctccgctgggccgcccgccgagcccgccagcaaggaggtcagctgcaacgagtgctcagcctccttttccagcctccagacctacatggagcatcactgccctggcacgcatcccccgccggccctgcgagaggagagcgccagcgacaccagcgaggagggcgaggaggagagcgatgtggagaacctggccggggagatcgtctaccagccagacggctccgcgtacattgttgagagcctgagccagctggcccagagcggggccgcgtgtggcagcagcagcggcagcggggctgtcccctcgctcttcctgaactctctcccaggggtgggggggaaacaaggggacccttcgtgtgctgcacccgtgtacccgcagatcatcaacactttccacatagcctcatccttcgggaaatggtttgaaggctcagacccggccttcccgaatacctcagccctggcggggctcagccctgtcctgcacagcttccgcgtttttgacgtgcgacacaaaagcaacaaggattacctgaacagcgatggttctgccaaaagctcctgcgtatccaaagatgttcccaacaatgtggacctgtccaaattcgatggctttgtgctctacggcaagaggaaacccattttgatgtgtttcctgtgcaaactctcctttgggtatgtgcgttcatttgtgacccacgcggtgcacgaccatcgaatgaccctgagcgaagaggagcggaaacttcttagcaataagaacatctccgctatcatccaagggattggcaaagacaaggaaccccttgtaagttttctggaaccaaaaaacaaaaactttcaacaccctttagtttccacagctaacctcataggccccggacacagtttttatggtaaatttagtggcattcgcatggaaggggaggaggccctcccagccgtagccgctgctggccctgagcagccccaggctggtctcttgacccccagcaccctcttgaaccttggcgggcttaccagctcggtcctgaagacccccattacctcagtccccctggggcctctggcttctagtcctaccaaatcctcagagggcaaggactctggggcagctgaaggagataagcaagaatcggggggtcatcaggactgcttctccgagaaagtagagccagccgaggaagaggaggcagaagaggaggaagaggaggaggaagaggcggaggaggaggaggaagaggaggaggaagaagaggaagaggaagaggagggctgcaaaggactctttccaaatgacctggaggaggagctggaggacaggccctccgaggagtctggggcccccgcaggtggtagcagcaaaaaggaccttgctctctcaaaccaaagcatttctaactcccccttaatgcctaatgtgctccagaccctgtcgaggggcccagcttctactacttctaactctgcttctaactttgttgtctttgatggtgcgaacaggaggagtcgtttaagctttaacagtgagggcgtcagggccaacgtggcagagggcaggaggctggacttcgctgacgaaagtgccaataaagacagtgccacagcaccagaaccaaatgaaagcacagagggcgatgatgggggc

SEQ ID NO: 34165 - DNA, 1099 bp, Mus musculus
gaggaatgccacggagccattcctgaaggtgtcttcagatagcatataacagggccctggctgttcagagcgactcctcattctcaggacagaggttgtcggagggagggaggaaaagagggagggaggaagagagggagggagaaggggcgggacgggaagcatgaaggcagtgctttctctgcagtgggaagattgattggaacagaaatgttggaggctgtgtctcctgcaggtttcctgggcgaggctaggggtgtccttgctgatcgaaatcatggatggacctgacttgggtggcctgagctgcctggaagtcagctggtccacagctgggctgctggcatcggggcctggctacagaaggccttgttatcttcgggtctcgaccccttgttagtcctgtgtgagcctggaacgatgatggtacccgtctggtctagcagtggttttgccttgtcggggtcgtccgtggtgtctgcggcaccaaggtcctgactgtcttgtccctgggccctctttctgtctccctgctaagctctccatggcgacttgagtattagggcaccctctgggtgtgatccatctccgcctcctgctttctgtgtctctccccagggctgttcttcatgaaacccaaggcttcttaataccatctctcacctgtcttcatctctgacatctccctgcatccgactcctcagcttagaatgtagcctggaaagaactctaaatggccccagctcctagcaaccaccccctctgccccaatttcttcccttcccttgaactggcatagcaacctacctgagctcctggctttgtagcttatcgtgctggaatgaggtgagcgtggtgcgcggatggagaccttacagagtgggcttggcgcggatggagaccttacagaggcttctttagccacgcctttaccctctcattctcctcagagattcagtcttatcctgactctcgggcagcacccctcacaggattctgcagcgtgtgtcgaaaggctcatcaggatgcagcctccttaaaccctgctggcccggattgctcccttcccaaagctgctgtatcccctccgtactgtctt

SEQ ID NO: 34166 - DNA, 1192 bp, Mus musculus
agatctgaagacttccttggaacacataagaccagagagctttgtgccatactctgctgttttctctggccctttccttaatcaagaatgtagactgggattttggaggtctaggtttttgggtttactggggggagctatgtcttctagtcacttgtttaaggttcttttgagagaaggatgctggcacccctcctggatatctggaaagaatgtttccaccacacctgtctgccttgtgtgaggacaaatttaatatatttcaaaagaaaaaaaatctagccccaggcagctttttttttttcctgtttgtttctttagggggagggataaaaaactgaaaagcagcaacagcagcagcagcaagctgtggtctgaccagccagcagaagagagattatctctaaaggatatgaaaggtttaatcattttaattttgtttttattaaagttcatcataacttcttcccctcccccagcatgccctggtagaacaaaaggaggtaatataaatatacaggaacatccccccccccccccaagtatttggctaataaaagagctcctttgggtggtaccctgaggagaggaagcagcttcatggctaaggaccgtaggctgaccggggcaggctggacacagccctagcttgtctgaccagtgtccagtccacctctagcagtcatgggaggatcatagcttctgtctactggaagcaaaacctctaggtgttggctcactttctcttgatttttaaaggaagtccagcttctcaaaacacctgttgctgaagacattgaaatttctgcccctcgccagcctctcccacctctgttgttctggtgaaatatttaaacccggatcaacatgctttagacagcaatgctgggacaaaggcagtcttcagtttttaggcagacagacagacagacagcatgaagctttcagacacacacaaaaaattctggcttatcttcccactgtgacagaaaaattaagctgattttcaacgttaactcagctgtcagtgatcactggatgcagatgaactggccacactggttctgagaagagtcccttcctcccgtgctgcctcggaacccccacacagggcatttcctcacctgagaacaatagagttgccttgaacattctgttcttgccacttgaggtaacttggatggtttagata

SEQ ID NO: 34167 - DNA, 1207 bp, Mus musculus
gaaggcggagcaaggcggtgaaagcctggagaagctggagtgtgactcctgcggcaagctcttctccaacatcttgattctgaagagccaccaggagcacgtgcatcagaactacttccccttcaaacagctggagaggtttgccaagcaatacagagagcactatgataaactgtaccccctgaggccccagaccccggagccacccccaccccctcctccgcctcccccgcctccgcttcctaccgcacctccccagccagcttccgcgccagccatccccgcgtcggctccacccatcacttcgcccaccatcgcccccgcccaaccctccgtgcctctcacccagctctccatgccaatggagctgcccatcttctcgccactgatgatgcagacaatgccactgcagactctgccagctcagctgccccctcagctcggccccgtggagccgctgcctgccgatctggcccagctctaccaacaccagctcaaccccaccttgctccagcaacagaacaagaggcctcgcaccaggatcacggatgaccagctccgagtgctcaggcagtacttcgacattaacaactcccccagtgaggagcagatcaaagagatggcggacaagtcgggcctgccccagaaagtgatcaagcactggttcagaaacactctattcaaggagcggcaacggaacaaggactccccgtacaacttcagcaaccctcccatcaccagtctggaggaactcaagatcgactcccggcccccttcccccgaaccccagaagcaggagtactgggggagcaagcggtcctcgagaacaaggtttaccgactaccagctccgagtcctgcaagacttctttgatgccaatgcttacccaaaggatgatgaatttgagcagctttctaacttactgaaccttccaacccgtgtcatagtggtgtggtttcagaacgcccgacagaaagccaggaagaattacgagaatcagggggagggcaaagacggagagcggcgcgagcttaccaacgatcgctacattcggacgagcaacttgaattaccagtgcaaaaagtgcagcctcgtgtttcagcgcatctttgacctcatcaaacaccagaagaagctgtgctacaaggatgaggatgaggaggggcaggatgacagccaaaacgaggactccatggatgccatggag

SEQ ID NO: 34168 - DNA, 1107 bp, Mus musculus
ccgattcctcaggcatttctcttccgatgtctgcctttcctctttgttgttgacttggctgaacggtgtgttgttgttgttgtttttttaagttaattataaacgaagttgagtagcaaataagccagtagcttgccctctcaaaaaaaaattaatgaaaaaacaaaaatagcccacacaagtgccttctgctgcaacagatgcccacatcacccttggcatgggcaacggacaaacagtttgggtggttgatgattttctctgactgtcgctgtatctgttgtttgttttccttgtttctttttgatttttcaagatgtccaggaccccggcctctgcttggaacggaatggtgtcatggcggagacaacggcctttgtcttgctgggtgtgaaaacatccgccgtgctggctcttccactgcggcagaatcaagtttaaatgaaaaaagtgattaaagtcagctttgtgcttctttggtgtggaagaccccaaaaccccaagtagccgattcccagggtccaaggaagggctcatagttggagcagcctgggctgtaatcctggcacttgcgccttgcgttgctgcttgctgttcgctcctgggggtctggataatctcccttggctttaccgcactgtctggcccgcatacagggcccggtaacatatacccgctgctgctatcacacgaaactgtggcgttgcccctgaatggatggcaccgtgccaactcttctgccatccgcccttgcagcttttttttcttttctcccgccctccccttcttctcctcctcccgtcgacttgacgttaattaacacacgggttaattgattttaaaagccgaagaattacagttaacttttcccacagggtacagacgccagccgcttggcacactctgccttccgcactggtgcagggggggcagggaaagcccgcagcaaaactagcaactgctgagggaacgttgtctgcttattggagtagagcgatagaagtcagcgtggcactgcctcatcctgtacagtatatggagccattatagattttgtcaaataatcaaacacaaccccgtctttcctcttcccaactagacaacccc

SEQ ID NO: 34169 - DNA, 1174 bp, Mus musculus
tggcgaagatttagtggcatgaggtaaatggggcactgtagcgccataggtagacagagagccgtgtctgaggtccgagccatgtagccttttcctgattgcttctgccatttgcactggaggctatggtctgcttaagcctgacgccagcctcaaggatttgagtccttgtctctgaagcaaggagcccagggataccagctctaattttaagggcctcagcaatcaggctcaccctgaggttggctttgctgagtccagtgctgcagctcagacaggatgaagctgtgtgtcgtctgggggctgctgacctatggcgcccttgttccctctgctgtgttcagaccccgcaggaagattacgtggaggccgcggtgaagcagtccttgcaggtacacctgtctggggcccctggggacatcctgatcttcatgccaggccaagaggacattgaggtgcgtgcttcagtcaccactgggttggatgggaaccctccacctgagggttaggggctctggggtctcatgactccttctgtgccgcaggtgacatctgaccagatcgtggagcacctggaggagctggagaacgcgcctgcgctggcggtactgcccatctactcccagctgccgtctgacctgcaggccaagatcttccagaaggtgcactgcttcgctatgcctgtctcttggtgtccctcaaaggcgcaagaggggggatatttctttcctagaagaacaggtgtgaactgggcttttcttgcctgttcagtctctccctccccaaaacttacctttccttctgatgtcctgattggccctaggctccagatggtgtccggaagtgcatcgtcgctaccaacattgctgagacgtctctgactgttgatggcatcatgtttgtcatcgactctggctactgcaagttaaaggtgaggggcgatgcaggaggcgaggggtgatgcaggaggctggattccaaagcttcacccaaagtgaactcagcatagagacactcagtgcatgagagtggtggaggtgttaggccaacattcagtgagcactgacctttccagcctatccttgtggtagcttgatggtatagatatttaagcagttctgtagtggtcccagagctggtgtggatggagagacctctgaggctttcttgagtc

SEQ ID NO: 34170 - DNA, 1201 bp, Mus musculus
gaccgcaagagagacagaggtaacgtgcctggcacccctcctggggtccgttagcatcgaaccagcaagcctttctcttcctgtcacaaggacttttacagtaatagtcattaattggacaacttggtttgtatagtgtgtgccccggtggttttgaccctttgagactaggattaggaagaagtttaaggaacgatacctctcttgtaggacagcaactttgcttgagtgtgtggatcttgttttattgtgaaaattggtgataaaggaaatgatgggtgatccattgaagaagccagtatttacactagctctgatgagggtagaggacagtgttatgggacaagtgaggcggggtccagcactggcctcgcttagaatcagatctgctatacacagaactctccatgctgggcatctaactgtccactgaggtgtgagtgtgtgagtctcagcccatggattatgggcgagtcagtggggaggcctgcgctttctgcccagtgctggggtgtgtggtggtgttagtgaatggtgttaagcctatgcgactcttacagcagatgagcgggacagaagtaggcacagcagcagatcagaccgagacggaggctccgagcgcagcagcagaagaaatgaacctgagagtcctcgacatcggcccaaaggtattctcatctgtcctctgctggtagggctcaggtgcagaaaggcagagtaagaggtagtccgctttgttcccaggccgtgagtcaagttctaatcccaagatgtggtggatcaagaaggatttgttgaaagggaactattggttttaagatcaaagagagaaattgattctttcagtgttgttttaaacagtgaaagccagactattatgttcggtctctttaaatatttatttgtcgcagtgtcttatctgtaacaagtaagtacaaggttgtgaacaggggatcagatcaactctgatcaaaaggctcacctgctgaggacacttgctgccaagccttctgatctgagttggtttaccaggatccacacgatggaaggagaaccaactcttgagaattgtcatctgacctctgcatgcacgcacacagacacacacagttagataaatagaggtaattaagaatcagttgggaaagtaggtgtagtggcttatgcctataatcccagtacattggaagctgaggcagga

SEQ ID NO: 34171 - DNA, 1125 bp, Mus musculus
aagtggatataacatgaatatatttgatttgagaatctgatttctcagcttttctcaggaaaaacaggaaaacaataggatcgtgattcaaatcccggttcactgaaaacatctgtctaaacaggaaagcttggggtaatgagtgtatagaaggaatcataaaacctgcctgcctgccatctgggaagcctctctggacatcagagtcttccagtaaaagttaagaaaaactggcttttggctggaatagctgtggtaggttttgtgcaaggtttctatatgtaaccttgtgaggtgttctttttaacaaatggtcatacacacacacacacacacacacacacacacacacacacagacttcggcttgttcattgttgctactagccctttaaccagtgactcacccccttgtgaagctacaaccataacagtatagcaaatagctgttgcatcctttctcgggaagaaaaccaccgactaacctatgtaatcagaagcctttgagtcatgggtgtgttggctagttttatggcaacctttgacagacattgtagttctctgagaggagagaaccccaatcgagaaatggctgcataatattgggctgtaggcaaacctatactgtagtgctttcataactagtggttgacgtgggagggcccagtttgtgggtggtgccacctgggcaggtggcctgggttctacaagaaagcagactgagcagagctgtgaggagcaagctggtaagcagcattccaccagggcctctgcaccagctcctgcctccctccctaagataacgggccatcaaagtgagcaactgtccaagtgttgccagttccatcaatttcctggtcacacaaccctttcaatgctaggagccaaatagtcataaaattcatagttgaagttttcccctcactttatttaattttgcataaagttatagtaacggtactggatgactgtgtgtgtgtgtgtgtgtgtgtgtgtgtgtgtgtgaagttctttgccctttctgtaacatgggcagacagggttgtgtgcgggtgagggaagagtgaaccttagaggtttgttaactgtaaacagaactaatgcaatgctttctggcatgcctttg

SEQ ID NO: 34172 - DNA, 2073 bp, Mus musculus
gcctccttatccactcgcttccacctccctagtgctggcatttaccaccgtgtgcagttgtatgcagtgctggggatcaaactaagctttgtgtatgctgggcaaatactctgagctacacccctggcctctcctgcattttaattcattaatttatttatttagccctctgccaaaagggattgtggggtgtttggtactggttttgtcacagaaggctgagtcattcctctgccacttgtaagattgtgctctttgacctgatttaattaggacccaagccagaagctcctgcaaagcccccttccagacctgtggataattacaacacctttgtactgccagagttgccatcggtgccagacacacttccaactgcatctgctggagccagcacctcagcatcagaagacatagactttgatgatctttcccggagatttgaggaactgaaaaagaaaacataggtctcttaaaccaggcagcatccacattctggaagttgatagtgaacagttctccgtgtaacagtgactctccatgaaattccgtttcctctgttaaccgtcactgagcactcttcctcggggctctctgctgctctaccaattgtgttgctttccacttcttcagtgattcttcagtgatcctgagagactaacagctggagactctagctggagcagttggctcctattggctgtgtttgcctgtctgtcttcctgtcacgtggatccttggttctttcccggccattccattcccagggagtgagaagtattgtgggtagagttgccaaagatggctggaccatggaagagagtaccctatgatgggtttcaaccttgactcgtaaatacttccctctgcatgggggtgatcgtagagagaatcaaggctaccatgtgttttctcatgagtcagaagatggctcaggaagccactgtcacggttcctggaggctgggccctctcattgacatgtacactactcctcgctgcagggcactgttccacctggatccagttgcaaagtttggaaaagttctcttagttttactggattctcagggagccctctgtggccttttcctttattttgagtgctgtttcctttttaggaaagaacagcactgtggaaatttgcttttccccatagcatgttaggaaggaagtacaggtcgttacctaagctagcgtgggcttccagttgccttaatagaagtactcaagtctcttgggtagagatctggaagcctgcaggagaggaggggtacttgttttcattggaaaacttttatgattaagggactctttacaaactggcatcttaagttttagtgccatgtcgctgtagtctgctgctttcctgggtggatgaacctctttattatggtaacttctgtgctgctttgcccctagccaaggctctccttccccaagaggttagctttggcattggaagatgagatttttgcttacctgtagtatttctgtacatacctgtttccagcaacttcagtgtcaatgtttttgatttatttgtgtcttatagctctagctgctaataaagatcccatgtcctgctttctctagtgttggtcaaatgagtgaatttggattttagtggacaatagttacccaggtgacccacgttagtgtacaaggcagatccagccttcactttcctctcaccactgcaggtgtcaggggctgttggcagctcatttccatcctttgattggaggtcagatggcatcaatgaatttgctctgctgctccatttagtaagctgcaggtgtgctcaccctttgggcatgagtggtggcattctgttacctgttggttggcagtgtagtggtgctgtgttcttagggtatcatccttaatactctgctgatacccaccagcaagaatatggagacaagtggactttgattctccactaacacaaagtgtgataatagagtgaaaggtaagctatgctgggcagtgatgaaagcaatgagagttcatcttaagacaccaaggtcgccgggggcgtggtggtgcacacctttaatcccagcactcg

SEQ ID NO: 34173 - DNA, 1657 bp, Mus musculus
ctgctttctgtcagaatcaaccaccgaccttgtgctgcattggagatcacatcctttccctgtgttgcccccatttctctgctgcttctctggcttgtttcctacagcgggggcctgtgggattgagtcttgaggaattctctcagatgagagccataggagatggcctcatctcctgactgtttcatgaacaactcattcctaggtgttatttgcatgtgtgggtttctcacaaggctccctcccttcctcagaaggttcatcacggaatttcctgacatgcactgtagatgctacaaacatgtctacccagggtaccactgagctacgtcttcctcatggggcagacgtgattggctcacagttgaagtcaaatcactgcttgggctgcttgtagcggaatccttggaaaacagttgttgagggccttgacagatcgggccagcgctgacctctgtgctctgcttcctttctttatccctgtttgtaaacacggcgcctcccttaatgtggcaccatgcagatgtgacttgatttggctgagagctacctttcctgaagtatgcaccctagaaaagaattgtgtgctaatgcttgtcagagctgtggcagtacttaactctgaggatgtaggagacgtgactggcttttagagtgagcatttcagtggttagctatcagcttttgaagtctgggcagttgacaaagaccagcctggtcctagttaatggtagaatactcccaaaacttggagaaagaactgctctctgaagctatcagaaatacctatgccagtatagaaggggaacttggtgaaggatggtgctcatccttatgatgatggataagggggaggggtttgggtcctcacactgagagcttatacccagttggagcccaagaagagctagactgaccctgtaaacttagggttccatttggtcttaacactatgggctttgtttgctctgtgctgctgtgccactgctgttgtctgctcattgtcctgcctgttgctcattatagcccctgtccttcatgtgtctggccatgtagactctcaggcatcctgtccatttttaacctgtgttctgccagtatgactgtgtagctcagtcatattgaacagggaggtggggatgctgttgatgggctgttaaatcggaaaggatgtggcttcagtgccctcaggaacccttaggctccaaaaatttgcctgcctttgagagaacaacaaacaggtcttttctctctcctttatggtacttctcagaacaagagaaactgagttagggcttgagtcagcatcccagtgcttttgtctagcttggttctggggttgagaaagtgaagtttggctgcaatagctcctcaagttgggtttcattttatttttaccagtgggtatcataggcattttaagagaacagaatggtagcataatttaaccctgcactgagcaggaacattgaagagttgggtggtcgcactggtgttagctgaagatgggaaagactcaagccattggggtaaagataaccagattgatccaattggccatgggagcttaggccatagtcttggaagtgagcaggacaaagaccatgttttagagatgtgataacttcctaggactaagtttactaaactacactga

SEQ ID NO: 34174 - DNA, 1154 bp, Mus musculus
gtgagtgcagtcaacatactctagagttggagctatctgatgtgtgcgttgggaaccaagctgatgtccttaacttacaatgcctgagccataggaatgcaaaccaatgtaccaatgtacaaatgcacagtgctcttccctctctgctcaccttttctttctttcttttttttgttttttgtttttttttttgtagttggagtgcctcaagctaatcgcctcacaaaaattcacagacaaacgcattggctatttaggagcaatgctattattagatgaaagacaagatgtgcatcttctcatgaccaactgtatcaagaagtaagtcttgcatgccccttctcctccccctcataacaactgttctggtcttttcagggtatctggtgggagtaagagtagctacttaatgattttatacttattgtccagaatatattttgagtgacttttgattgtggttaatagtttaaagatactaagcaaaagaaaaccaaagcattgctgtgcatctttgggcacagtacataattaacaattagataagtatttgctattcttagaaaagagaagaaagccttggtgaaatctggattttcatattttatctttctagtatgttggataccatgaataatgaaatattgcctttattagtaccaatctatattctgagtatggggctgaaattttagtagtatggaattgtactcaattcctaagaaaatattagatttatttcattattttgtgtgtgtatgtgatctcctgtatgtgaggggagcatggccagtgtgtgtgtgtgtggtgtgtgtgtgtgtaaagacagccttgtggagttggtcttcgccttccactgttatatgattttcagggattgaatgcaggtcatgaggctcgtgtggtgtgtgctttacttactaagccatctcactagccctgaaaatgtttgcgacagggtcttgctagtgttcctcaggccagcctggatcgctggagcacgacttggtcacttaagtctccagtgtcctcactgatgcagtagttgttgtatttactcacgtgtggaataaccaaggaacacctgctgtgtggagaagcgagagactctaggagggagttagctgttttctctagtgcccttcctacagtag

SEQ ID NO: 34175 - DNA, 2625 bp, Mus musculus
aagagtgccgagtgttttttagaaaagaccccaatattaccaaatctttatgttgaattgttggaatgaggtgaaggtgattgtctgtggtacacgttgaatgtactatgtatgttcaggtattcaggcatcatgtccagtttactgcaggagaaagtaaaagtgggcccccttgcttgtaaagcgtttgcagttgttactgtattatgcagtaagacgacactttggcttcagttttaactcttgatacaaatctccctttctccctgctccatttcaccacgcctttacttaaattcttcagtgtcttgtcaaacctagctctgtatcagatgctagactattcctaacattgacaaactggagttgaactaaaggctccaaaagggaaagtttctggtcttaatagtcctgtaagagcaagatttactgaaatttacttgactgggtaaatggacatctgagttacaaacaggatatttctcctgtgttcagcaaaacaggtgtggacaagtgcagactttagacagccgctctgcctgatcagtgggagccgttaggatttcctgcagacggatttcattggatgcatagttaatgctgtgaaacgtgataggattaatgctgtattggtggatttcttgaatagaattttgtcttaacattccttttttgtgtggaggctttattttctccatttgtagctaaccagctcaggttttttggttgctttttgttgttgttgttgttgaactgagttgaatctgaagaaatctgctcaagaccaagtgctagccgatggagctggaaagatctcctctgtggacaaagcctcagcccgggtgatgagtttggaggtagcatttacaatcatccatggctttatcgagaaggaaaaaaaaaatcatggccttaacacaaagggtgctgtgtagatatggagttcatttgggagacgacctgaacaccatactgacggactagcagccagatgcctgcctaggatgctgacggttgtgaagactgtcccctgtgattggatctttgaaagcttcagcgtgccttcttagtttctaggagcattagttctcttctcactcggccttgcagcttaaaggaggaatctcttcgtttctgtgactacgcgcgcacatttcagtcattcctttcccacacgtgacccttcaagaggaaacagatttggatgtatatgacaacctcggagcctttgtgaagagagtgatttctgtgacttttgaataaagccaaggtgataagcagtgagccccacttattgacagttttatacgcacttgtacctcattagcatcgccttcctcgaggagtagtttttatgtcatccttctttcccatcccagagtcaccctaagggagagttcctctaagtaatctcagacaactgtacacgcttctcccacaatgctttggtgctgttaccttgagatggtttagggagtcatggaggttttctgctgtgtatgttatcatctgttaaacttcgaggtgttttggttttttttttggttgttgttttttggttttttcatttaaagcaacattcctcagtgtaacagtacaggtattccttgcttggttcctggtgtggctcttaacctttgtttgtttccctcacatatgaaaacagacttttaaaactgtccagcactaatagtttgaaattttccatctcccatatgacaccttgcttttcatttctgcgcccttttagagaatgttggaagttagggaataccgcttttgtggttcaactttattttcttctacattggaatatatttcggccgtgaaaacttggggaaggaggagtttgaatgtgtatttttcttttcctactgaatgtattttaactacagagccctaaactgagagagaacaacaacaacaacaaaaaatgcatattcacaaactttgtggttgggagggcatttgtcagtctgggtgtgggggaagggagaactgcacaggaagttctgaagtttaaaatacttctgaccagctttggctcgggagggtggggctgtttgtggaactgaaagtgaaaacccttttcaagcaatagcagagagtgggtcccatggacaaggttccagtcccagaacctggaactcttaaacagaagaaaaagctgaagcggcttgaagcagcttgagcagttgcttcttgctcctggcttcaagacagagcattggagactttctccccttaaagacctgcatttgcgctttgtgtgttttgtttttattttatttgggggacctcatgggaaagggcttctgcactccttcctttgtgaaccccactgtgttcttgtatcatcgtccttctccttttactatgttgtaagttacggttttcattaggccccatcacatcttctttactgtaaaattattaaaaggctgtttccaagtggggcagctaatgaagttctaattattgcagacatatttttgagatgtaaaacactttaaagtgaaatgataagtctcttggaggcgagtgaggaataacatggatgtaaacatttacatgggatgcattcggattctgctgtgtgtattgtcttttggttgaaacaaatta

SEQ ID NO: 34176 - DNA, 1156 bp, Mus musculus
cagagcccggcttttgatacccagtactgcatcatcttgggattctcaacagacctggatggccatggtaggcaggggtacactgtaccttgatggggagaatgacttctttgttccccacagggagattagccccttgtgggtcacacctcacttcaaatgtttctgtctcatagtaaggcaggttctttacacggtctagctcagtgctgaagcctggacccaagacagaggggaaaagaaaaatgtttttcgtgagcaaggaaaacagcacatagaagctgctatgccctctgcaataggctgaccaaggtatggcagaacagcctagaaacccctttagctgagtgcagaagctgcagggatgtcaggggggtaggcgcctgtcacgggccctggaaagatgggacatgcgagtggctcctggtacctgtttcgtgaaggacctgtttctctgcgtggaaggacacagggaagtggctggtgttggtgatcttgacgatgtgggttctgacgtcaccaagtacaatgtagccgaagtccaggatgtactctggcagctggactctgaaacagtcagggggatgtcctagtcactggtcactttcaagcccagaaggccgctcttcacgaaggaagagagtgtatgttctcttctgggtgcaacttttgtgtgtgtgtgtgtgtgtgtgtgtgtgtgtttggtggaggacagctaaggaccactagataaagactagacactccgtgcatccttcacaagtccacatgtgtgttttggtcattatccagtgacatgttcagtatgagatggggcctgcctactggctgtggtgttctggctttaagagccagagttgcctgactggcttgacgctagggagtgactgctaatgtgaggcacgtggcttccagtcccaggggatcaatcaggatctcaggagacacaaagaactgcttgctccaacacactccagaacaaaggcaacaccgatgcaagagggcctcacttggtgagttttcggcaactccgctgactgaagtagatgtcctcggtgttattggagatgcttctctggtgttccagggcatagtcttggactatgagtcgctctacttccatctggacatgagcacttatctgaagcgagaggga

SEQ ID NO: 34177 - DNA, 1098 bp, Mus musculus
catttgttggacatctgatatttccacttgttctacgagctttgagtgcacaatatcacttaataccaatcaatcctaagggatactgtcaccccatcttacagctaggaagaccaaggcctggggagtcccatcacagtatagtagtctcagaagcaagtgaaacaaccacagatgtcatggtctcagtcaaccttccaccaccttagcacagtcacattgccctttcaaattaaactgcacctcaaaggatcctgttacccctgaacactctctctctctctctctctctctctctctctctctctctctctctctctctctctctccctctctctctctctctctctctctctctctctccttataatcacatgcccattcctgttcatctccaggtataagtcatccttgttccctggcaacatggagacactgacgatcctgaatgattctccaatggtggtagaggcatacttctgtttccagcatgacataaaagcaagcacctactttctagagccggtcaacatgactctgaaacccaatgaaaagcaggtacaatcaaaggcatggggggggggggggcgggggaggattctatcaggggcaaggagagtcaagccctgacatccccatgtaaatggaccttcctttataactctctcaccaggcactaaacgtatgggcctaccctactgcagttggtatctttgaagacagcattgtctgctgcatcaaagagaacccagagccagccatctttaagttaagctgccaaggaattcgcccagaaattgaggtggagcccaggcagttacattttgaccgactcttgcttcataggtaagagttccagataactcagggacaggaggggagatttgagagcatttaggtctgaggttatcagctggtcttgagttactttagattttctgggcttgctgttgtctgtctgactgtctgtttggtgtacatcactgggaacggaactcaactcagagccttgtgcatgctaggcaagtaactctgccactcagctgccatgcctcccccagcccatagtttgtcttttcattaaatcaagaaaagaaa

SEQ ID NO: 34178 - DNA, 1193 bp, Mus musculus
gttagttagttagttagttagttagttaattaaaagggctccagtggctcctacagcagaactatccttagtatctccttgtaaaccaagttccaggttgtgccttgtgccatctgggcctgtgggttggctgtgtagtgaggtagcagctgagagaactggtgctgggcagaatggccacctggacctggatgagggtgagacctctgctctgtgccacatctgtatccacgtgtagaaagggcagtgtagcagtgacacctgtgtacatggaaaagcattttcacacaaagactgcctgatgtcaagaacataccagctgtcctttgtttatggccactgagaaagaaatggaggacgcggcagagaaaatgcccacagtggcagaaggcaggagttaagaagactggtcttcaggcaggagccagagctgccctcatttcctctccttgctcaccagccttgtcctctgtgtgctgcctctgtcttcaacaccaaggcactccctcagcccaggcccagggtatctcccatctctccctgcctcaggcccctactttgtgacctgcatccatctgtattctgagggatatctttatataagagataaggtactaccttatctgggacagtaacgcaaacctagctgaatcagacacctatgcagcctctgaaagtatagccaccaaaaccaagtacctcacaaactccctgagcacactccggatccattttacccctaggcccctgtgctggctgctttatgtcaacttgacattttgcaagtaggaacctcgcttgagaaaatgccccctgccaggttggcaagcctgtggtgcattttcctgactggtgattgatgtgggagggcccagctcaccgggggcagtgccactcatgagctggtacttctaggtggtataagaagcagattaaaccaggaacaagccagtaagtggttctcctccatggcctccacatcccagcctctgggtaggttcctgctttcagttcctgccctgaattccctggttagtaactacaagctgtaggaaaaaattaaccgtttcctgcctgcgctgtttatggtcatggcagtagaaactccagctgagacagcctctcagcatggagctccacaggcaggctgaattccacaccagcaagtatcctttccttcattccagtctcct

SEQ ID NO: 34179 - DNA, 1160 bp, Mus musculus
atctcctggacactctgagctttggtgtgcgcctcactacacacaaaggcattttcccatccaccctccgttagcaaagccctaatccactctttctctctagctcatcctatttatagctcacgtgctggcacgtgcagcgccaactggggaatctgttactctgcaagcccccagccctcattataaggaagcagctgagcctggggaaggtaggcttaacccagcagcaggttcagggacgtcaggctgaggggctgctaggtacgtcagtcaaatggatgggtaggaggaaattggggcataaaaatggctaaaattctctgagagaagggccccaggcctggctgcctgtggaggagcaactgcttagctcgtaggcagctgtgtctccgcctagcagtgcttggtccaggtgcttccagtgctttcgcagctcggctgaggaagggatctgggctagtgtgttctagagcaggcccaggattcctgacccctgacttctgccctgctgcagatctacgcctgcaactgctggacgtgaagaacaacccatacctgatcaaggccctgtacggcctgctcatgctgttgccccagagcagtgccttccagctgctctctcaccggctccagtgtgtgcccaaccctgagctgctgcagactgagtgagtgctgggcctcaggcactgccctccaggcccgttccatgggagatccagggccctactttacctctctgtcgtttaaccttgttcactccacaagttctttctcttatcttcaaatccacagcagatcccaaaatggaggttctgggagtgtttaaagggcagaaatatataggcatgttttcccaagcaggctgggggagcttagagagaccaggcctaagtgtgagatcttttccccagcagaagtccctggagagaggagctctagggatgacaagtaagtcgggagcccagacagccagatagagcccagagttgggcacctcacaggcttagatgccttgctattccattctatgagatgctcaaacttggccctctgagagctcccacatcatcaggacctgcccaccatcattccaaaggattaggaaacaagaatatacctgctctactccaccaggaacctgctctcaggaagagcat

SEQ ID NO: 34180 - DNA, 1124 bp, Mus musculus
gtagactcaggttcccaaagctgcatctgggagtagttgtgccctgctcctagcctgaaattcaacaggccacagcagtgccttcaggcttaaagccattggtttttctcacttggccaacctcactggggaaggtgccatcgtgggagctctagacagagcagccaagtgtaccaggccctgggctgcctgctcgaggagtggtagagctgtatgtagctacccatctcatacctgagctggggctggacacaggcaagtttctgtcatgtcacagcgggagggaaccttatactcggggacgtgacatgtctcctgtggcaacctcttacagactaggatggaggtttgtgtgtaaggtcagatgtctaggccaggtctgctatcctatttcctctgcttcagtcagcctcttcacccacccagaggccccagggagtccgctcagccgagttggtcacagccttcatgaaaccctttgccagggctctaagccagtgaggcagaatggagtgtggggaacagaataaggacagttaggaatgggactggaccctgggtggcaagctaaacccagctgatgagaggctacaggattggtccgtcaattggaaggagtgtaggtgggtcagcatgtcctgtggtaagacaagctcttctctgggagcaggtagtgatcacaggccttgggacccaaggcctgccaagttataggtccaacagagagacttcaccgatcccagctgtctgcagtctcagccataccacagagaaaaggctgggctaccgcctcccccttctccccagaccctgttccaggccccagctgccttcctggctggctgctggccctggctctcaccctaaagggagccactggtaaacaggaagtgctcccccatgcaacgctccgggcgccatcaacagcccacaggccgacagacatccaagcagcgggttggctgttcccaccagctgcaggaaagggggtggacatgggaccctaagcactatgggtctggctgctgggaagatgtcttgggcagggacccacaggtgcccagagactgaaccccaccagcacctaccatgatgcagacactgactctgacttctgtccatct

SEQ ID NO: 34181 - DNA, 1145 bp, Mus musculus
atccctgaactgcttggatggagctatcactgctgcccgccagattctggcctcgcaagccagaggctcctcactggtgtgcaccccctgagccccagtgacagaggggcctttcctagtcatgtgcagtaaggctaagggtgcttgccacaccccgcaggactggaccaaggctggtccccacgaacaaccctcagccaccaccctgcagcggaggaaggatcgtgtggaacacctccgagacactgagccaggccctactggtggaggcactgtgggctccagtggagaggaggtgccacgaacccggatgtctcctgccaccatagcagccaaagtaagtggaccgctccctggctattccccacccccgtcttcactccagggtcaatgccaggcctcccagcagctggccttcggggcctactccgtccacccttatggaactatctagagtcccagaagagggtagacatggagagtgaggctttttagcccaccattttccctatcctcagcatggtgaggaggtatcccctgctgccagcgacctagccatggtgctgacccgcggactgagcctggaacaccagaagagcagccgagactcgctgcagtattccagtggctacagcacacagaccaccacaccttcctgctccgaggacaccatcccctcccaaggtgggcctggagggagggatgccacaggctgggtgtgtttgctaggccttcacagccccgggacccgccccaccacggcagcggggaggagggccataactaagagacttacttccctctctgtctcccttgagtaggtatggggttcagggacaaacttggccctgggctcaccaccccctgtgtgtctccaggctcagactacgactgctactctgtgaatggggatgcagacagtgaaggcccccctgagttcgacaaatcatctaccattcctcgaaacagcaacatagcccagaactaccgccgcctgatccagaccaagcgcccagcctccaccgccgggctgcccacggcagggctgcccacagccatggggctgccctccggtgcacctcccggtgtggccaccatccgccgcacaccctctaccaagcccactgtgcgccgcgccctctcca

SEQ ID NO: 34182 - DNA, 2370 bp, Mus musculus
gtggccggtgcccacgccctgggtgagggccagttccccttccctaccgccctgtcagccactccttcggaggaaacgcccactccaccccctgctgccaccagtgaccccccggccgaagacatgctggtggccattcgtcgcggggtccggctgcgcaggaccgtcaccaacgacaggtcggcgccccgcatcttatgatggtgccgcccacccctccccgtctgggcctggcacaaggaggtgaccggatctgtgagcagcggccagccactctgagtggcggcccagccagaagacagaaagcaaagcgtcaggagtgaggcacagccactttacggaaagacaaccaggctggatcccagcatctcgcgggaagcgacttccctcacacacctcgccaggacagagcctgttttatactttccttacctactcaaacctcctcttccttcctccaggccctgctacatccaaaccccagagcccataaccaagggctgggcctgctacatggggccctacctggcctggggtccacaactctcttcctctggcccggctgtcctccggggccatatgcccagctctttccttgaatgctggctccctcttctccctgcctggaccctgtcccatttcctcttgcctttgccctgcctctcccaggctcctctctttggggcacagggtggtcacggaggggccaggtacccaatcagctgaggatctttgtgtgactgggtttagggacagtcaggcattgggaagccaggcttgctcatgggaaagagccctggagggagggaacgtaggggccttgtctcaggggaccctccagttccctgtgaagagtaactagtggggtgaggcaaggcagacagggaatgagtccagaggtaccaggtgttttggatgccctgttcttgtctggacactttggagcttttactctaggggcgccttcgggttacagtgtcacctgttgctggagataagggctggagcattagatggtgtgggggttattttatgactgtaataaaatggagctgaccctagacaaagaactatgtggggcaagctggtggtacagggtgtacgtctgagtgcctgagagaggggtgtgggagccctcagtgggctcgaggccagagaagggtagaatcactccccccaaaccgggggaagctgctcttctcgccagtgtctgaagtgtcggtagaataaggctggtgagggtaggccagggactctggccagtctgttgagatctgagcaagctgcaggcccggcttggagcaagtattagaaggttggtttgactttctgttgccagaggcaacaccatcccaagaaagtctatgcctacaggcctagctggggctggcagcagggaccagaggaagagtgggtcctgcctccctgtcagcccaagtctgagcaagactaagcacgtaagtgtaagccagaggagagattcgggaggtagagcaggcagcagactccaaggtagcattctgcccgacccccacagggagtccagagagcgtaccttggtcttgaaggaatggagttggggctgacctgggcccaaggtcatgggtgctccagtgcagggcagcccagtaggtctggtaaagcagggattcctgtatgtggatggagttaccacagggctccccgaggctgcttagcgagttatctccagggtctgagacctggcccaccaaactcagttgtcaccagagccccgagtatagagtccaggaaaacaaatggccagatgtggaaccctgaggcatattttggctgcatcttccccaaaagagctgtcaaggctgatggaaagggatgcaggatgtcaagtgggcagatgtggtccctatacccagggtgtggttgggtcctagagaagggggtccaagaggatgggctcactgccatctgaggactccaggccctgatgggaagggaggccagggacttcccaggaagaggatggggtggcatgcccacccccagttttagccttcccctcccccccagggctgtacatattccatccccttgtctgacccacaagtatcctcctccaccaaccaccacttcctctagtgctcacctctctcataggcccgccctcgggatccgagccaaccatcctgcatcacagactggtttgggggcttcttcacgtacattttattttattttatttcatttcatttgtacagcaaaacattcttttcaaatgtgtcttttgactgaagtaacttttctggtgctgttaacttgtattttttttttttaatttattttgccgcccctccttgttcctactcaccctcccctaacccccagccccag

SEQ ID NO: 34183 - DNA, 1810 bp, Mus musculus
cagagtcccttgtctataccactttatctggaggaattggcatccttgtccctttcacgtctcacgaggtcgagtcaccacattgcccttacctcatctttcctcacattgtttcttggtgttgaatctgcttcagatggcaagcctttgcttacagttaggaggttctagaacttgtttaaagtaacagttaaggtgcctagaaaacagaatcctgcgttcttttaggaaggtcttttatactatggtatagatacagggttgtattatgaccccaaagcatcagagtagcagtccacaaactcagaatgatggtctagatagctgtctggtgggacaattgcccagcaagaatgggtggcttggagttgggcacgatgccacgtacccataatcccaatactaagtgggctgtgtcaaggggatttcaagtttaaggccagactgggctgtgtaatggagaccccagctcttaaaaactagatgccttatctgtactctgttctggaaatcacttctttcttagagatagaatgtctttcttccattaggaccatgacttcttccagcatgttgaaatgcacctgcggtctgagcatccccctctttgtggacgggaccacctgagctttcgttcttactatttccctgttaaggtaagttggaaaaaggaatcctgtgcccattcacaggccttctctgttggcctttgtttctgagattcagatagttctcaagggacctggtgattcatctgtgacatttacataacctgtctttaaagatgaaaacagggttgggttttattcagtgaatcaatctctctctctctctctctctctctccctctctctctctctctctctcccccctcacacacaccagcccttagtggggtgtcaccttagacccctttttctttggacatcttaactttgttctcttccctctcttccatgtcttagaatgtgattgatggagacctttgtgagcagttcaactccatggaacccaacaagcagaagaacgtctctgaggagctggaccgaaccccacctgaagtgtccaagaagcttgaggacattaggacccgctatgccttctgaacccgtctttatctggggccttgccagagagcccctcttttgttcccattgccagtgtctggcttttgccacacagcagaagtgatgtggtatttaagactgcattgttaaagccagtagctctgcaccctcaactctcccctttgaatgactggttccctacagttgacactgaagtctgctccttgaacatagtgtgtggccctgagcttcggtgtggaacacagttttccttattcccaaagccacccctgcattgtgtaatttctggctcttgtctacttttgtacacattcttaattttcattgttttcctgtaaatacagttttgtacaatgttgctttgagagatgaagggaggcaagcaaaggtgcagccaggctgattgcagtgtggctcagttctgccctcggaaccctcctgaatatataaaactagtttttaaggtgtcctgcgtgtgtagtttttgttgttttgttttatagtcttttcctgggagtgataattctggagaaaggcttgaggcctaattagaacaataactggatcttttacttctttgctcttgtgtggacatcatggctctagtgttttcttagtgtgtcttggttctttgctgtggagatagaacatgagttcactgaccatgtaaatgtaaccccactattcatggatattaaagagggtgttttccctttccctca

SEQ ID NO: 34184 - DNA, 1168 bp, Mus musculus
cagccttgaatcagtcatcccttggaaccgtgttcctttagggaaaatgaggcttagaggtaccatagtcagtacatcccagcctttaattgtttgttttctttgttttgttttttgcggaggtctgcttttaaattataaaaagtacttaacttaaatgatttgggggggatggggaggtgagatggggtttcttgacccctggctgtcctggaactagctctccaaacagaccggcctcaaactcagagattttcctgcctctgtttcttgagtgttggcttaaaagacatgcacaatccccacctggcttaaatgaaatatttcttaatgtacaggaaatgtatgtataatgagaagtgggttttgccagtagatgcttagtaactaggagagaatgagtgaattcctgattgttgggcgctgtgacctgttttatgttgttttcgccaccaagtcatatctttgtcttctactaaagtagccaaaggaaaatctaacataaaagttcccatcataaaaaggaggctttacctgttccatcttttccactagaacggtgtactgctgaggactgtcctagaccctgttactggggacctgtctgacacccgcactaggtatctggggtcccgtcctgtgaaactcttccgggtccggatgcaaggccaggaggctgtaagtagtcaaaagacatttggatgttggtaccactgtgaacttctgactaattcactttgtaggttgatgttcgtttcacttacataggaaattctgggttctttggagttttctaagagatggtccatgagatggcactgggcattatgaggttataggaagcttgaatattgatctttgagtctatttaggcctagctatctgagatggaaaaggattatagtgatctcatgagtctacctaataggaatgagagcctattcttcgcagttcagagttaacactgccactgccgtgctagttcttaaacgttaccttattcacatctacagctgtccaaccttggaatagagtctctaatttatacccaagggaaagtcggtccagaggaatgtgattgataaagcttgctttttctttttctttttacttatttttttcctttctttatacaataagccgtgtactgcctgtttgggctcccttt

SEQ ID NO: 34185 - DNA, 1179 bp, Mus musculus
gggatgtttaaggatgttgatctgtggctactatgtgtttcttcctcaaaagacttgaatcccttttgtagtgttttagattctatctatgttgttcatgttttgcttgcatgtttgtatcaggaagtatccaagccaacatgtagatcctgggagagcaacaagttctttaaaccactggagccttgccttcagtttaaaatcctaagactggtgattaaaaaggaattttacttattatagggcctaatatgactttcttactttgaccattatccactttgacagaaataaacaagagctccccaaaacttactctgagatttagatttaataagcatctactgtctcagttttcttttggggtttccattttcctcaacaaagatcctccttcaatcctagcagatttctgtgagtatgtgttttccagaattgtctcttacagcaatttttcctccccacttctgttccttaggactgtttacagcctctgagtatgcaggctctcccagcccagcctgagtctctatgtattgtggaaatgggtgggactgagaaacaagatgagctgggtgagagaggctctattggcttcctgtacctgaacattggactacaggtaagatgtccaggggctcacattggtgtaaggccttctttggtatctatcagcctgttctttatccagtctaagcattttctttgcctgtagttctagatagtcgccttgggaaactcatcatctagtgctgtcagagactgatttttctcaacacttagaacatgttaggcaggcctggaaatagcacacacaaagcgtcttcatagctggtaaaaagtgctttgtgataggtgttttggtttggaattaaatgagtcttcagtagtgacctatagttcccatagtattctagtcttttaaagtgaattcctcccagttcataattgaccatgttagctctagtgtgtagaagcctgggtgtttttgtagccaaaggagatgagttttatcatggtacaaaaagcaggaatctagtgtaaactagcatcggtgctctcacggtgctatgtgccttacttcctgaatcaggacctgcaaagacttaagttagatggcagacttgtgctttttcagttttagtttcatactttaaaatgcttgagcatgagacacac

SEQ ID NO: 34186 - DNA, 1223 bp, Mus musculus
ggaaactcagttccaatctccagcacatcataagccaggcatggtggcacacctatgtatagttctagtgctaaggaaagtagagtcagaagttcaaagtcatctttggctgtatattgagtttgagtccagcctgggctacataataccccatcagtcagtcagcaattggcacaaatagatttgctctagtttttcacacagttacttaaggttttcttatatgttttattattattattttatttttatcgtctcttttccaaatacctgaaggaaatactagtcttcagacatttatactcagcgtgtttgggcatttacttgtaggttgctaggacagccaatcgtcttttgaacattctgttttgtgtgtgcatgtgtgtagtgactgcacatagaagtgttgtgaaaggtttctaaaactgttgtgtctcaactgcctttctaatgctagtaaatttgaatttttcctaacagctcctctgttttcttttttccagatgagtttgatgcctacatcattgtgtctttcgtgaatgccacacttgtgctatctatcggagagactgtggaagaagtgactgactctggcttcttgggcaccactccaaccttgtcctgctccttgttaggagatgatgcactggtgcaggtgagcgtgcacctcctcagcgtgccttggccgtccgtcctttgcccatcctttgcccatccttctcttgttttgtggtgtgcttgaattcatgtttcttcattctcaccttccagaaaacctgaggggagggtctaatgtcttatcaacataaaaaggggtactgagaattcatccctttcaggctttgaataactcggcagttaggaaaatttgaagcctaacatttcctccctgttggtcattccctatcactgcttttctcatctttatcattaacatgtgggcttgggacctttctcaactgaggtggcaaagcatgaacatttcaaaaacaagcagtgcctcatttgtgtggtcccagtgtgccagtgtgagggccattctgggtgacaatcagattgctagttagatgttcttctttgactgacttctaggtgtatccagatggcatccgacacatacgagcagataaaagagttaatgagtggaagactcccggcaagaaaacgattgtgaagtgtgcagtgaaccagcgacaagtggtgatcgccctgactgggggaga

SEQ ID NO: 34187 - DNA, 1405 bp, Mus musculus
tctacagtatatttggaaaccccaaatgataatgacttgagtttattcactctttctataatatgtagttaagtagtactgtgcattaagctgtctactctgtctctgggccatttaacagtacttaacaaatctatcttagagcagttttatattaacagaaaaagtttaaagataataaatacggaggttgtgtctaatgtactactgactgtccttaaggaatatcagagtagggctggagagatgactcagcagttaagagtaccggctgctcttccaaaagtcccaagtttaattcccagcaatcacatggtggctcccaaccatcttcagtgggatctgttgttgccctcttctggtgtgtctgaagacagctatggtggattcactcatatacataaaataatgaatatcaacgtgtagttaaacaacaaaaagcacttgtaaggtggttgtcagcccaggggtagagcagtatgctccctaacatgtgtaaaaagatgtgcttttgtcttacggaatttagagaaagcaatggtgttctactgtagctctgtcatttccaatggtgttttttgtttgtttgtttgtttgttttttaatttttaaggatataggcattcgaaaaatgtataggtttggctataaaacctgtatccttctgtgtgttccaggactttttcctgaagtctctcatggggacttcagtctgaattttaggttctttttcaataagtggtccagttccttttctatattgtagagtatgaggcctttgcctttggggtattactacctcacttagcctggaagtcatgctcactggatctgtggcttgcctcctcttctgttaggtgtcggaaatggctgtttctgagctccctggtaaccccaatgctgtctggacagtccgtcggcacattgaaggtaagtgtcccttttcttatagtcaagatggggcctgggagccattgccaagaaacttagaaactgcattcctactatgtctgtattgtttcatctagtgccatatgccaggaacttctggcacaacaccacattttttgaggtttctcctgatcagggtaccctggtttactgctgctttttctgaaagtggatagagagggtataaattgactgttagttgcataaacatttcagaattcttgagctgcctgtgtgatctataaatctctgctttcatctgtgtatgttctaagcgaaagttgttgtttcctcattgcacttgaactatgttttcattgtgctaaaaaatcacaatgaaagtcaagattataaaccctgtcagtcagtcagttctgcttactcatcagaaaagcctagattgagtggagtcagtttaagagtgtgaagaaaagaagttgtgaaggaggtggag

SEQ ID NO: 34188 - DNA, 1085 bp, Mus musculus
ttgtgctatttatggattgtatacaggggaagtgtggtgggtgtcaggcatcaatgtcaggtcttcctcaatgtctcctcaccttattttctgaaatagactcttacaggaacctgaaatgtactgattctgtgttggctggctagccagtaagctccagggatctgggattgtcttcccatctctgggattagtatgagtacggctgcatcctggtttatacgtgggtattggggctctgagtgtaggtccccatgctggtgtgtcaagcactcttccaactgagctatccccagcccatactctgctctacctgccatttgttctccctttgaagtttatatagctaactgctgtcacattgtttccaagcatactgaaatctgtgttcaaattgtttctgtataacctgtgccaaagaaaacctcttgctttttcccagttacttgtatcaaattgcccatctcggagatgatgatgaagaacctgagttttcgtctgccatgcctctagaagaaggagacacattcttctttcagccgagaccactcaaaaatctcgtgctggtggatgaactggacagcctctctcctattctgttttgccaggtgtggctttattcaaccacctctgtactatgccagcctactgttactaaatctgaaatgtaatgatttaaagttttcctcaaactgagatgcagtctgaaaacaacttacctgtgaaatcatcactgtggaaacctggtagttacagaagttcagggactaaaacctgtcagtttatgaggagtgtttattttgaagcaagtcagtcttactctgtatagctcaaatctagtcttgaactcactctcctcctgcctgagctttctgactgctgggattagaggtgtaagctgccacgtgtggctgagtggtgaggtttgagttcaagactcctgatgcattacctaagagttgttggctcactgcatcatatgcatgtatgtggatatgtaactaatcatattctattaacaatggggctgataggtttttgaaagtactggttaggtagagtaaatgactcttggaaaatctgaa

SEQ ID NO: 34189 - DNA, 1182 bp, Mus musculus
accaagcaacaggaaattgttgtttcccgtgggaagattttggagttactacgcccagaccctaacactggcaaagtacataccctcctcactgttgaagtatttggtgttatccggtcacttatggcgtttaggctaacaggtggcaccaaagactacattgtagttggcagtgactcaggccggattgttatcttggaataccagccatcaaagaatatgtttgagaaaattcaccaagaaacttttggcaaaagcggatgtcgccgtattgttcctggccagttcttagctgtggatcccaaaggaagagctgttatgattagtgagtgtcttcctttactttctttgctctgagtgctcagtgtggtgtgacatgctgtgatcttggcgatgtgctagttatcacttactcgccagcatttggcattacatttatatttactaagttgaaacgaagtcatatggtaaactatttatttgaaagaatttattttatctgcagcgaaggctacagtgaagtgatctcagttgtgtagtttggttgctttcttcagcctgaagtgatgattcacaatcatgtctcttctctgaagaattcatggagattctgtgtatctgatcaggcctctagagggcaagccacctttgaccagggacagaaccactgggaccaattcaaagaggagttaacagactgggtattttctcatctcttaaagtccagggcaccttaaaaatttcttaaaagttagaggggtattaagatatttgttaggggggattataatgatttttgttgtctgctaacagtagagggcagtgtatttgtacagttagtggtgactgttaatgattttttttcttttggttttgttaccatttatttgtgaaattaaaaatgaacgataagtaaaaactgccatacaattttttttgttttgttctctttttttctttcttagtttatctcatcttcaatagatgattaatgatcttatttaaaagaataaatatttaggtttctgtcttttcatgaaatctgctactttatctcctttaacaacaggtgcaattgagaagcagaaattggtatatatcttgaacagagacgctgcagcccgacttaccatttcctctcccctggaggcccacaaagcgaacactctggtgtatcacgtg

SEQ ID NO: 34190 - DNA, 1180 bp, Mus musculus
gcccgcagactggtgcgacagaccgagaagtgcgctgaagctttccgccaaggtgagcttgtttatcggttcagaggtaactcttgcctcaggccagacacaaccccacacattaggtccttggggatctccttgtgttttctccttgtggagccctatctcagtatagaacttgtctcatgggaatagccctctgatcctagttaccaggaaacaggaggaagaggctctgccctgactgagttgcagggaagtgggggctgcttaagccccaatgatgaggctatagaacactggctgggcaccatgctggctgctccgtgctgtgcccgcaaccttgtgcagttgaagtcatgccttttgacactcccttccttccctctgcaaaagttaccaccggagaatctggcccaggcaaaccatcccctctcctaaccccaggaaacctgcctctgctgggacagtacctgacctcatactgggagcagaagaagcttatggccccaggctgcgagccgctggccgtgcagcgaatgatggatgtcctggccccgtatgcgtatggccaaagcctggcaggggcaggtggtgggggctttctctatctattgaccaaggaaccccggcagaaagagactctggaagctgtcctggccaaggctgaggtatgtgctggtataatggttggaagttggttggagtgaaataacccaactgtggcccaccaaatcatggtcctcctggccccgtatcagtccaaaaggcctgggaatgtttaagctctcaacaccttctgtcccacccagggccttggcaactacagtgtccacctggtggaagtggatcctcagggcctgagcctgcagctgctgggacacgacacccgtctttgtggggccgggccctctgaagtgggcaccacctagagctgcagctgcgcgtcccttcagtggggctcactttgttatcccttacctacctcttcaagtctgctgctaaggaaggaagcaagacttggacagaagaggcagtgtttgcaaacagtactgtgcttcatggtgggcagtggctgagacttggcctctatctcatctggattaagggaggtcttagtcacagtgtctcatgtgcactctacaaattccatggcccagtgtaggcctcctagggccctgcaaag

SEQ ID NO: 34191 - DNA, 1224 bp, Mus musculus
tgaagatggtcgtgaacacctgattctcttgcctctgccgcaggggttctagggtcactggtgtgcaccctgatgccgagctgtgcacttgatcttgtggacattctttaaattcatcttcatttctgaaatgctttcatctgcccagtccttggcatatagtaggtgctcaggaaagttgaagcagagattttgttgttggtttgtttgtttgttttttctccagatagggtttctccgtgtagccctggctgtcctagaacttgttctgtagaccaggctggcctcgaactgggagaaccatgtgcttctgcctgctggattaaaggtgtgagccaccactttccagctttgtttttatttttattttttaaaaagtaattaagcttttttcaagggtggttttcacgtgagtcttgattttgtctttatatgcgagggaactcctgggaactgggcctgactttgtagatcctccttttcttggcgggtaccgggcgtgcggtcccgcttcctgtaatgtacggaggtagaagaaagggctctggccctctcggcgttatgtcttcggtgcttgcggcctcctgttctcgggttctatcctcagacgccggaacacttaaaaaaaaaaaaaagtaattaattggagatggtgcatgtagggcggtgtgtgtgtgtgtgtgtgtgtgtgtgtgtgtgtgtgtgtgttgacccatgtgtggaggtcagaggagaactttcgggagttagtttttcccttctactacatgggttctggaaatcatagttaggtggtcaggtttggttgcaagcccctttgtccaccaagccttcttgcctgtctttgctttcatttctgaaatggtatcttaccatgtagccctggttggccgtatcgtgtagtccgatgcagcttggaactttcagtgatcctcctgtatctatctcctgattgctggggttacaggtttgtaccactgcgcctggccaagtagggaggctcaggattaaaggtctagggttggattctttgtactttgcagatcttgaaatcacctggagagttggttaagacacatacctgttccatgttgtcagaggtttttgtttttgttttgtttttttttgattcagttggtctgaatttgtatctctcatcagctcctcagggctaacattttgaaagacaccatcttgagccattatagttgcctggttagctaa

SEQ ID NO: 34192 - DNA, 1556 bp, Mus musculus
gttgctaatgcttgggctgcaggccttgttgcccactggctggctccctctgttttgaccaatcctcaaccttgaataaatgagaggaaaaggcagttcatagaggtcaggagagacattgctatagctcacctgcctctcatagaaccagtagagacactctgttctccattcacccccactcaacaaccacccaccccccaccccaccccacccccgcttccctggtgtaatgccttggttatgtctttattcttcagattggcagaaaaaatggaagtcagcaaatctcagactcgagggtcatagacaatcccattgaagatggaggtgtctttcctcctgtacatctagtctgtgcctggctccattgtttgttccaatccatgggacttcatgccacgtaacaacttagaaaggaagttatgaccaagcaaaaactctgaattatgctatgagcagacttatgggttacttcatacattgtatgaataaggtttataaatcagtggtaacacgtcattcttagaaactttaattatgagaaattttgctaatcatgatttgttatttgtatttttctgcttactagactaatatatgctcattaaaaatgtgtataagaatgtttgtgtacacttgaggcaccatagctaccagcctactcggcatgtccctctctcttccacaagtgtgaacacttcacactagtttgtaagctgatggttcacttgtatgcccatctccctctggaaagtagctgtcaccctcatgtgtagccaccctggcccaggtttcctcagtggtaggtgttgagggtttctagcatgttgttacctacagtgacagtgactggctcagtccctgtcttggaccacagggggtagaattcttgggtcagagttggaacatttgaagtcataattcaccaactctgtagtattctcctactttttttgttgtttgagataagttctcactgtgtagccctaattgtctttgaactcggaaatctgcctgcctctgcctcctaaatgcttggattaaatgggtttatattatcaaattttaaaaaattatgtatagtgtttgtactggctgtatgcatgctaaaagagggcattagatttcattacagatggctatgaatccatgtggttgctgagaattgaactcaggactctgggtcagagcagcccatgcttttaacctctgagccatctctgcagcctttatattatcagtttttaaaactttgccaatctaggagctggagagaagactcaatagtcaggagcacttgctgcccttataaaggacctttgtttgagtcccagtgcccacatcatgtcaggtcattcacaactgcctggtacttcctttgcttcagaggaagctggtacctctgctgtccttgggcacctggcagtcatgtatactccactcccagagatgtaagttactttcaatcccagtgctctggtgacaagatcagtagttcctgaatatccggagttatattaagagaacatggctcaaaaacagaattaaaacca

SEQ ID NO: 34193 - DNA, 1167 bp, Mus musculus
ctgggactcaaacaaaggtcctttataagggcagcaagtgctcctgactattgagtcttctctccagctcctagattggcaaagttttaaaaactgataatataaaggctgcagagatggctcagaggttaaaagcatgggctgctctgacccagagtcctgagttcaattctcagcaaccacatggattcatagccatctgtaatgaaatctaatgccctcttttagcatgcatacagccagtacaaacactatacataattttttaaaatttgataatataaacccatttaatccaagcatttaggaggcagaggcaggcagatttccgagttcaaagacaattagggctacacagtgagaacttatctcaaacaacaaaaaaagtaggagaatactacagagttggtgaattatgacttcaaatgttccaactctgacccaagaattctaccccctgtggtccaagacagggactgagccagtcactgtcactgtaggtaacaacatgctagaaaccctcaacacctaccactgaggaaacctgggccagggtggctacacatgagggtgacagctactttccagagggagatgggcatacaagtgaaccatcagcttacaaactagtgtgaagtgttcacacttgtggaagagagagggacatgccgagtaggctggtagctatggtgcctcaagtgtacacaaacattcttatacacatttttaatgagcatatattagtctagtaagcagaaaaatacaaataacaaatcatgattagcaaaatttctcataattaaagtttctaagaatgacgtgttaccactgatttataaaccttattcatacaatgtatgaagtaacccataagtctgctcatagcataattcagagtttttgcttggtcataacttcctttctaagttgttacgtggcatgaagtcccatggattggaacaaacaatggagccaggcacagactagatgtacaggaggaaagacacctccatcttcaatgggattgtctatgaccctcgagtctgagatttgctgacttccattttttctgccaatctgaagaataaagacataaccaaggcattacaccagggaagcgggggtggggtggggtggggggtgggtggttgttgagtgggggtgaat

SEQ ID NO: 34194 - DNA, 2226 bp, Mus musculus
aaatgtatgtgaacacacttgggccagagattgatgttgggtatcttgctgtgccgtttcctgcctctcactgaactcacatcttacctttggttagactggctgccgagcaagctggggatccagatcccactccccatttccatacactagggttgcagacacacgccaccatgctcagcctgggttgttgtatacttacagatctggcatgcaaaagactgaaccagtggaactccttgggttggtgaatactgactaggtagtgactgtttttaacaagcacgtcagaggctacctttattacccaattgagaataccaaagggttttgttttgaaaattagctgtgtatgagcacctacatatgccagaagagtttacttctcagattccttcatcttttaaacatttaatattttaaaatttactatttttatcttatttagtatgaaatttttattgtatatgtttcacagtatatgttttgcctacattagaggccagaagagggcagccaataagatcccatagaaatagaattacaaacaattgtgagctgccacatgggtgctgagaatctaaccaacttcttttttttcttttttctttttggttttttcgagacagggtttctctgtatagccctgggtgtcctggaactcactttgtagaccaggctggtatcgaactcagaaatccacctgcctctgcctccccagtgctgggattaaaggcgtgcaccaccatgcctggctacagctagtgctctttaactactgagccatctctagtccttttgtctttctttctttctttttttcccacccacccaccccccattctttctttctttttttattgcatatatctctatgtgtgcatgagtacaaattgcacagaggctagagtataacttgcgggagtcagttcccctattctatctctggattccatttgacagatcaaacttggatcactaggcttggtagcagatggttttactcatagacatattgctagtcttccctcccccaacccccttttaaagtctcactccgtagctcaggctgacctggaactcactgtagcccaggatagtatgctcaaggcaattattttattacagctttctgagtattgtggttacaggtttgagacatcatgccctgctatcagcttttctgtgaaagctgagcatagtaggaaatactgcgatcccagcactcaaggcagaggcagaggtaaagtggtcaggaatgcaaggtgaccctcagcaacatagtgagttcaagtcaaactgggttatgtcaactctttcctttaacaacaacaacaacaacaaaatttaaagccacctggcctgacagatggctctttgggtaaaaaccattgctgtgcaagctgacaaccttagttcaatcttagaacaactcttgaaaatgtaacttccacatgagcacgggacacagcaggtgaaacctgtactcacagatacatcatgcacatctgcacagtaataatagttaaatactctgtgaatataggggtagtagagaacttataagtgtaatactaattgatatttgttaagtagttacttgaaaactagttgccaggactgcatctcagttgctatagtgttggccccgcatgcaggaagccctgagtacagtccctataatgcgtgaagtgtgctggcacacttgggagtatgccaagtcagggtgtgaggtctaccaagtttcagaacagtctcggcttcatagagagacctcatctctcagaaagaaaaacagtttcacaaaatatagatgatcagaattaaggataactttggatacctgagacactggcaaaaaaaaaaacctctgaaaattccatttttctaaagaaattctacattgcaacagtataacaagcagtgtttatttggggcctggagaggtggcactgactgctcttccagaggtcctgagttcaattctcagcaaccacatggtggctcacagccatctgtaactagatctgataccctcttctggtgtttctggagatagcaaaagtgtactcgtatacataaaaataaatcctttaaaaaaaaagcagtgtttattttagaaatttcctttataacttatttcatggtatgaatttatcacttttgctgcatccatggaacacttgtcatccagatctgtctgaacacataggtgggcctgctgaa

SEQ ID NO: 34195 - DNA, 5582 bp, Mus musculus
ttgcgtgtcctcggtagttcatggtgagatgtcctcccgtcttctctttccccctcagataagaagatagaaagactggacacagatgatttggacgagattgagaaaatcgccaactgaggcgctcgcttctccatgggctggcgccaccctcagcgctccctgcctgggagtctagtgctttcatggcataggcctgacgggcccctcagagaccacgggctgagtagagactacctacctcattcggaattacgtttggacttgacaaatttgtgcaaatgatgagggatggtagaaatgtgtttacacaactttggaagattaggcatgaatacacagaaatttaccttttcaagtcccatcttttttttttggacagtattttcccatcacactgatctagataatatgcctaggattcctcatgacaaaccttagctgtttgtgacttggagtttgcaggccagcctcgtggaagtgacagcacagaacagagagcacgtagaggcagagtcctcagggaggaggaggatataagccagtcgtgtgtcaggaagatggcacaaggcactggagttggcctgtggactgctgcttaggacttggttggtgtgtaatggctaagctgtgtgttacctgacccctgctgacattctttccaggaaaagatttgccatgttggaccaaaatgcctttggggcctctccttaagctttgtggctcaggaacatgggcaaatctagttattggtgagttcttggctcatacttcagcaagacctgtggagaagttgtcctggaggattagtggtgcctctggcttccggtaacacctggatcatgggtacttgaaccatagtttttacatctgtaacatcacttggactgttagtagtcccaggcaaataacagggtactgaggtttgggttctaagtgagtactgtagcttaaagtttctgatgggctggcagccttgatcagagcaggctaggcatggtcagcagttgccaaaattccttgctttgtttgcagttcctgaaagattagtcctgtcagagctggggagtgactgcagatattgggcaacgtggctctaaagggattctgatggtctgtgttcacagtgagtgtgatgagggacaggacggaccacagccgtttgtctgtccacaatgagtaatcaacaagtacttgctgctttctcccttagcatccatcattaggacagtaaaagcacacaataaacagagaacttctcacactggctaggccatagatactacagagtgacagcaatgtggagggattgagaagcatcctcttcagttctttgacttggacatggggtgagtcttctctctagggcttgttttgttagttttgttgcatgtatgtgttgtgctgggactcaaagccttgcgttctgctacctaagcacggttactctgaactattatttccagccatgatagaggcttgttgtggtgagaagtatagacctgtgttcccatatcttaaggccagttccgtcccctgggaaaggagagtgccatggctaccacctggtggtggttcaatgtcacagagaaatcaacaggtgcttgttctccactctccagtgggtatttgaatagaattctctgtgggctcctggccaactttgatctattttaggagtcttaaaaggaaagaataaactttttctcccaaaatactgtggatcaaacttgaaataagtgaaaacaagaactgtagttagagaagtgtatgactcttccctgagtctgagaaggagactgggcaaggcgagcagcagcccctccagtggcttctggtgggagtgtagatcaacactcctaacctagtgtcctgcacctcggagaatactggatgggtttcatggtgtctgtgaagttatatacattagtttaaggtttaaaaacttcttaggaagactcccaaaagattttccaccttttaaaaaggtgagtcctacattgtgaatggctctggcatgtcactagtgtcatgtggaccatactctttcccagcccacactcactcctgccaccatctatcccccaggggcagattagcactgtctggagccttaagaatgtattgagcttacagagccttgatcccagggatttgactgttatgtatctatggagtgagaaactgagctcttggacgaaggagctcagggaaagaaagaagggagaagctcagggaaagacatatttttgtgtaatgaaaagttttgtgatgctcattatccacaaacatatttatattggaattttattccttgacctcaaacttaagtttctgcctcagtttcctgggtgctagaattgtaggtgtgtactatcatgccagactgtggtatttttgttctgagtatcatttattggttatatgcatgcataagatctgataagttgttgagacatagtcttttagggatttggggtttttgtttttttgagacagggtttctttgtgtatccctggctgtcctggaatttgctctatagtagatcaggctggctttgaactccaagatccacctgcctttagctcctgagtgctgggattaaaggtgtgcactaccacaccccgcacgatatagtttttgctggtgttaattatgaattgttcatgttactaagacagtaatgcttataagaagcaagtagtatcttgtggttggtgatatattaagtaaagttaataccaccttcagctagtattagtctatgtcaggtggtactgttcgaacgtgagcaacgagggcatctccatagaaccaggattctgctcacttgccaggcattcacaaacacacatgcatacgcacacacacaaatacacacaccattccactttagtaaaacaggatgatttaggtcacagcatgtaaggtcagtctgtgggtgcatcctccaggagtgatggtatataccagtcagtccctgcattagcaacggtgatagtccatacctgtagtccctgcataccaagagcgatagtccatacctgtagtccctgcataccaagagtgatagtccatacctgtaaccccagcgttagcaaagctgaggccagagggatttgagttgaaagtaaacccaggcctacataggtcctgtttcaaaaaacaaacaaataaaacaaaacaaaaaacaatctcaacatggtagttcatgcctataatcttggcatttgtgatataaaagcaggaagttcaggagttcaaagctaacctaggcaataagaggctgggtcagggcatagcacctggagatagatctttcctatttcttacagaatcagtgtccgagactggtatagagttccagaggccagagaatgttgaataaaggagtggggtttgtgtgtgaggaagcaggctcgtgacaagatttgcaaggaaaggactcatcctcaggtacaaagagaagttgaggctagcctggcctacagcaagccctgtctcagaaaggaaaagagtagaaagtattgggtacagtggtccttttttataattgcagcactcaggaggctgagacagtattgctgagttcaaagccagcctgggttacttagaaacaggccagccttagctgtgttagtcaagatgacaagggtgacagagatcccctgggaacacagctcaggtggccctgtgtgggaaagtcagggttcacaggataaaatgctgctgctgctgctgctgttcagtttttattgtgcttggtgtagggtctcactgtttaacacagactggcctggaaatcaaagcaattctacctcagcctcctgagtgctgggattctaagcaggagccactatgacctggcaactaaattttgactgtctcacagtccagtgtcctgctgtgacggagtagccagggctgagtagtctgaggacaggtgagcctgcaggcctggagggagacatcaacatgagagcattagcagcaggatgagggattctgaaatcagcgtagcaaaattggctttctgttgttggaggagggaactggactgcctgcctcctctgcccacaccactcgaggtaatgctgaaggcttcatggactctcaagtttctcttgatcctcttttagagacactagactcatagaaattcattgcaagtttacatggctttgcttctgtgcttgagagtaaatatcctgtgctttgttgcgtggctgttatggtgtcttctataaaggaccctggtgcacggaattaactcaagaaacgtatgctgaggcacatacactgcttttcttacccttagctgagatagggctttcccagaacagcttggaaccctagtgtgaagatgcagacccatgcttttcttggcctccagactgtcttggctttagaatccgatggggcaggggagtggctgttcttgtcgtagtttcagtcatgaagtggggaatgactagaaggtggaggaaggtgtggtggcacacagctgtaatcttaacacttgcagggctgatggttgaaactttagagtactgttagggctacagaggtctagactgtgtagtgagatcatgtctcttcaaaatgaaaagattaggtcaagctttaccgtgatgcctgacatgcctgctgtccaaatgaaccatgtctcccctctgccttagctccagttaatggacagagggacgagggtgagagagcagatctttgtctttttgagcggctagcttttgccaacgtaagaaatagctttccctacaagactgctgttgctcagtatgtttttcccattccaattcttcaacttaagaacagcctactgagtgtaagttattgtaatattccctgagggcatgcctctcctgcttttttgtttgtttatttgtttgtttctttcttttggtttgggttttgtatgtgtgtatgtgtttagttcattttgctatctgacagcagtagctgctaagtatgcgtagaaattatcaagatatggctagtgagatgactggttattgcagtccagttcctaaaggtaggagaaaactagctagcctcagggagttgtccttagacctcagtagtggggcaatggtgcatagtcacacacaaattttattttttaagacttgctcgtctttttaaataaatatatttttaaaaatgtgtatgggtattttgtctgcattaactttgtccagtgtctttgagtttccattgctgtgaagaaacaattgaccaaagcaactcatttaattggggctggctcatagtttcaggggttcagtccattatcatcatggtgtgaagcatggcagcatccaggcagacacagtgctggagttgatgagagttctgcatcttgatctgaaggcagcctgtaaaagattgtcttctacaggcagccaggaggagggtctcatccgcactgggtggagcctgagcacgggaggcctcaaagcccacctacacagtggcacacctcctaacagaactactccctaaaccaagtattcaaacatgggtctatggggccaaagcttattcaaagcaccacacacagtgt

SEQ ID NO: 34196 - DNA, 1068 bp, Mus musculus
aacaacaaaaaccaaaccaaaccaaaaacaaaaacaaaaaaagaaaaagaaaacttatttggtagttgtgtagttaggattctattgctgtgatgagacactatgaccatggcaactcttctgaaggaaaacatttacttggggctggcttattatagtttagatgttcagaccattattattgtgacatgaagcatggcagcatgcaggcagtcatggagagggggctgataagaattctacatccaggtcagcacgcaacaggaagagaaagagagacacagagagattgagacagacagacagacagagagacacactgggtctgggttgagcttcttagatttcagagcctactcccagtgatacatttcctccaccaaggccataccttctaataatgccactccctgtgggactatgggagctattttcattcagaccacaatgatagtgatatttctaaacattttctttttcatgcagcccacagaacttaattgcccagtctcagtctggtacgggtaaaacagctgcctttgttttggctgtgctcagccaagtagagcctgcaaacaagtttgcccaggtaaggactttaggaatcagggtttgctactaacatacagcctaaaggggtcatagttcctggactaaaaactgtgggtaaaccaggcagtggtggcgcacgcctttaatcccagcactctggaggcagaggcgggtggatttctgaatttgaggccaccctggtctacagagtgagttccaggactgcacagagaaaccctgtctcaaacaaacaaggggctggcgagatggctcagtggttaagagcagtgactgctcttccgaaggtccggagttcaaatcccagcaaccacatggtggctcacaaccatctgtaacgaaatctgatgccctcttctggagtgtctgaggacagctacagtgtacttacatataaatctcatgtaaataaatcttaacaaacaaacaaaccaaaagctgtgggtagtcaaggtatttacacttgtaatcccaataaagggtaggcagaagcaggag

SEQ ID NO: 34197 - DNA, 1144 bp, Mus musculus
cttgttaactgtcaactattagggctttgccaatagaacccaaaatgtctgcctcctgaagccaatagtcaaccctgtcacgtgacactccatgtcctagctttcttgagcattgcatcagccgagcccaggagccttcccagaaaccggcttgttagctcattcgcgctccgaatgattggcatgccagtggaccaatcatatcagaggatgacaaggcgtagcgggtcacttttcatcagagcgctctgattggatggtgaggtacggctctggcaccggttgtggcgggtgagtatagcttcttgtgcgcatctgagggagcaggtaactgccggcgagtggcggtgggctccgggcaaggaaggacctggggacccggaccctcgggaaaaaaagcaagtgagccccgagagctctacgagaagagccggcgcttggagggggaggggcagctgcagcgggctgccgggcggtcccgcccctggcctgggtcaggacccggtctccgcaggagccggatctcgagagtagcttttgctattccctcggagcactgagagtggtgtggtttctggtggacttgcagaggaccaagaccttgggaagatcgcggttgctcttcagtcgccacccagagctaagggtttgtctcctctaattttaatctcttagggggttagggaaccaggcctgaagagcagggtgactaagataaatggagtctctctaagaggcatcttcattcattctttattaggttctcacaccttaccccagactggcctgaactcaactctgtaacccgggctggccttgaactcgcggcagttctcctgcctcagcatttcaagtgctggaattacaggcgtgagccagcactccagactcgcttctttctgttgctgttttgagacagggtttcactatgtagaccaggctggtctcgactcacagagatcttcaagagtggtgggaccaaaggcgtgtgctacgaccctcggcccgattcgattcttaaaaacagaatagttgataccttcaggttcacccgaacaaatatattcagcaattttttcaaacagtctaagtttcctggtgtgctttggagtatgttagtgcagagcatgctatttacagatta

SEQ ID NO: 34198 - DNA, 1106 bp, Mus musculus
ttttttttttccacgaaatgttttgcctctttttgattggggggtgggggtggggtcttggcatgtgagtgtaatgcccacagaggacaagagagggcgctggaacccctgggaaatgataggtatttgtgagtagccagaaaatggatacccaggtcctctgcaagaatgacaagtgtgctctaacctctgagctatctctctagttctggttatttccctttattggagtgaagtgtttgcagagaaagattaaagaactcactcacagtgctcagattaggaaacagaagtttaccaggagaccctttatccttcagttctaaaagccttacttacctccattcacacctgttcctctcagcagcgccctgggagggcttggcgggaaggaaagggtctgtctatgtcgttctgacacagttcctttgtgtgtactgcacaggtgacaccgcttggctcctctatgatacttatggattcccagtggacctcactggattgattgctgaagagaagggcctggtggtagatatgaatggctttgaggaagagaggagactggcccaggtaaggagtgtgaggagtgactcgtaagcacctgtcttcccttctcactctctcaccccatccttgggaccacttctctttctgaagaagaaacaacccctatttctcttaccaccaaccacaaaaaggaaagaaagaaagaatatgcggaatgagatgaagggcagcaccaggcaactggattcccttcctttaaggtctcccccactcccagagcagtgacgcacggctggaggcatctttcctggatggtttacaaatgtgttaaagcatttttagttttcacaactaggggctgatgtttcccgttatcttattggtagagcctcaagatgccactcagtgtcctggcatgaaagaagacagcccccaaagcaaaggctggtctagccccaaatgccaggagtataaagattaaagacattattcttagttttttcttggccacagtttttgccaaggctcagttctctcttcatctagactgacataattaaggctttttttctctcctgttttgacagctgaagtcacag

SEQ ID NO: 34199 - DNA, 2092 bp, Mus musculus
tgtgctagttcttttataaagtctaatgggctggttttcaaaatacaaatagacaactaggacctgaatattgaaaaatagaatttagcaaaaagcaactaagaatatgtgattggagccatgtatggtgttgtgtgattttaatctcaacacgtaggatgcagaggcaggtggatctctgtgagttggaagttatccttctatacagagaattccaagccatcaagggctacttgccatgaccctgtctccaaaagaaatcaaaacaaaaaaaaaaacccaaaaaacaaaaaagactacgtgagctgggctggggctgggagctctgtggaggagtgcttgggtaacgtgtgagggtctagattcaatctttagtctcagcacagacatgggactgtatatcaccagtcactgacctgtctccccctatctctgcatctgttgatcagtgtttgagtgtacagtggctaccgtgcttgctctgcgtcgggaaaagatgtttgtggacgaggtggtcactggccaggagtgtggagtggtgctggacaagacctgtttctatgcggagcaaggagggcagatctacgatgaaggctacttggtgaaggtcgacgacagcagtgaggacgtaagtaaggccaagctctctcctgttagccgtggaaggcaagcaggggctgggcgccttctctttcaccttcacattctgagccttggggacagatgtttttattttattctttggttggtatttcttctgtagccaagagggctgcttcttatacctgttgctgtctcaggtcttaggtcctaagggatctttgcagccagggtgcagaggctaacccttacttcctatgcttccgtatgcataaggacaaggactctgtctcacttgctgagtggtatcctttgttgggcttttgaggcagagtcttacacttacagcccaggtcagtcttgaactcccagtaagcctgcctcagcccttcctgtgttgggagtagaggtagggcttcaccatgcctggcagagatcattcttgaaggacaaacattctgagaaaacttagcttctagtgtggccactgctggctgttgggtctcctttagcaacggattcctgcagataggataggatccatttcatgggacttttaagatggcgcttgctgaggaagcagctcacttttagagcactccctggagttcgtccccacactgtataaacctgggagtgggctgtgagcatgtgacccctgcgcctgagagagaagacactgttaagaggcgcgtccaccctaggctgcccagtccatcacagggccgtgtgtgcatcatctgaccgtaggggtgtatacgcgcatgaagagagaattgatagatttggaaattttacttacttgttggtggctatccttgaccctgcagaaaaccgagtttacagtgaagaacgctcaggtccgaggcgggtacgtgctgcacataggaacgatatatggtaacctgaaagtgggggatcaagtccggctgtttattgatgaggtaagttgcatatgttggtccacatttgatgtatatttacttacttagtgagacaatctcttgagcactttgtagttaaagctgccttagggtcatcctgttgtcctagtctcccagatgctagagtcatgtgcctggacccccctggcccagctccccatttgatcttagttttaattatttttaataattttttaaattcatttttggcttcttttcaagacagaggctatctgtagagccatggctttcctgtaattcactttgtagaccaggctggcttcgaactcctagagatctgcctgcctctgcctctgcctctgagtactgggattacaggcgagcaccaccatgcccgcctgtttttaatatctggtctctgtgcacatgtgaaagcacacatgtggaggctcaggccaacctgaaaggagtcagctcttaccaagtgggtcccaggtattgaactcagattgtcaagtttggtggcaagcgcctttgcccactgagaccttttgttggcacctcgtaagtgacactgttagcaaagt

SEQ ID NO: 34200 - DNA, 1335 bp, Mus musculus
tctgtctatcatttgtcgcctcctgcggcacctttacccctcgggctttcttttggtgaaagacttcactcctggctaatgcctggctttgctctctgtcctcactttggcagtagccatagctgctctcctgtgccagctatagtgttagtctgtggtagcatcacacatgatacaaatggatgttgggggcgcctgccattcccccctcaatcccattctgactaccattttcccctcctatctcctagaatgcagccaaccggggactgaaagccagcgagtgggtccagcaggtttcaggcctgatggatggtaaaggcggtggcaaggacatgtccgcccaggccacaggcaagaacgtgggctgccttcaggaagcactgcagctggctacctcctttgcccagctccgtctgggagatgtgaagaactgatgggagggaagccctctcgggaaagcaactcgccatcaaccagacatgtccgaaggcgggaattcagccaggagctctcctcccgccacgaagacattggagtcatgggacctctcagcagccctgtccgtcctgatccagcggtaatgggaacacgcctggagctgtcctgtgattcattgcccccctccattactgctctgagcccattcatgtcagcaccatctgtctaaaatcactacccaggaatgctttttaacgtcatgatcacatctagatgaggtcactctgccagcctgaggctttaggtctgcagaggaaggaagccttttctctgcagaaaataaaaaggaccatgtgcaatacttggtgatgtcatgcgctctgcttcttgtcctgaggtgagccctggctcctgtatatctgttacggttccagcctgtttctggttgatggtatcaccgaatagactcccagactcctgaaagttcaggaaattcaatagaagggtggaggaaaataattctgagttgcttccagtggagaaccactgttcttagtctcttaggacaacctccaccatgcctgtccacatgcctgtttgaggctgctgatatgaggtcagacaactgatataggcagtatgaacatgtaggtgtgtcctactaactgccccacccctactgctttaacctaaagtaggttcaagaccctggcccagccctaaaatgcaatttgtatgaatctacaaacagcagggtctggaagcagagatactgtctgcttatgacagttcctcagagtgttagaaatatctagttgtacaaagagagataccgtccatttattaaacaagtgttgaagcagccagaggactaattgcacgagtaaacaaaaa

SEQ ID NO: 34201 - DNA, 1238 bp, Mus musculus
gggctgtggtcgagctctgaaaagtgaaaaggtgccaggcacttaagggcggtctcaccccttttcatacggagggatgaattatctatgcagacagttgcatgaatggctggtgcgaatacacaaaacattaggtcctgcctgggatgaggctggtgagcacgttgagttggagtctagtctaaacaaagaaacaattccctagtgctgcagtcttacgtgcccagctctaaggcgactccgtgggctaagtgaaggataggatgcccatctgcccttacagcctgcagggtccccacaattgggaagagatttccggccacctctgcttcctggcttctggcggtctgggtgggcggttgaggacactcagggctgcttcggattccggccggtaggaagatgaaaaagccggcaggcgcaggaggtcaaagcggagagggcacgcatttctcctcaacaacttaggtcagatacgaacgatgttgtatccatccagagctccaggtgcaggatttcaggaataacgatgcttcgtgagctagaccctcagagactgaactcagccaggaaaggccacttttacagtaaggcattggtggttcagtggtagaattctcgcctgccacgcgggaggcccgggttcggttcccggccaatgcatatatctcttttcttaatggctttctcaagtagtcagaaaagaacacaaagaactaaaaaacttcaacggacagaataacacttgtgtgtctgcagcctcgactagaagagggagcccctccctgcattgaatcgagtgcattgatcatcatcccccctcccccgcccctccccgtccttggcttttcctttttcctccaagaggcgcaatctcttgctaacagtaccagggctaacagctgcagtctatctaaaatcttgagttcccccacacagaaagtaatggaagaagaaaattaaagaagttcaaagaaaatttaagaaagaagagagaaaaggagagagagaaattaaaagaaagtaagagagaaacccaaaacacaccattttgtaggtgtctctataggcaaaaaccaaactgcctcccagagctccactttggaaggaaccagtggggaccatgttaacaacacacaaggtcgatggcttctgtgccttttagcagagaagtctagtgtccttggctccaggaattgaattcaagttgtcaatcttggtggcaggcacgctaaccc

SEQ ID NO: 34202 - DNA, 4106 bp, Mus musculus
tgacaacagatttcatcaaccgaggagaatatgaaattgacattgcaggacatcggtttcaggccaaggccaagctctaccctgtcacctcttttttcactcacaagcgtagaaaggacgatgtggagctgagcgactttcatgggaagtaacgcaagacactcccttcccacattcttgccatgaggagcatcgttctcagagccgagtttccctccgtcctggtctcctcactgaaggtacctttgtccttgcctaggttcaatttgacctaaactttttccttgaaaacctttcttgtcttcccattttctcccatttgctgttacccctcctaataatccaggctcttctcatccctccagcaggctcacatacccacaatggcgggcagaacccacttgtggagtggtattagggtgacagactgattttaaattcagtgttaggcaagttggtattatttaagtcttagggtaaatatccatttcccttcggcttagattcttaccaagtaacctcctagtttcggtagatgattttgtgtctgatgcagccctgggaataacttgtgtcttaaccaggcagataattctgttccactgtgctgaggttgccacctgatacctcgtaaccatctacctcaccaataagagcgattgtgtggacactgtctgctctgtggaagggggaatagttacctggcacccagtatcctccaactttgtccttacatgtttgtgccagggcaccctacctgcattttcttcattttctgctatcttttatcatgatgttggtttttagctgagtaaacaggtatgccagtatttgaaaggaaagacaaaccatgctgccttttctgttgcttttcccagtaggagcagtgtgaactcagatgctgagttcctactattagaggaggagtgctgcttttcttttagctaatcatattttggctatcccttattgatttcttcagatgacttctagactcatctgtgccttgtgtagcctgcctacaacctcaacatccattcttagccttttagaagaggaagaggggatcaggcgggttgttttggatgattaagtaaaccatgctggtcatactgcatttcagagccccaggctttgtgtccctagcatgaacaaagccagacagatgaccactgagaactgtaagtacagtgcaggccagagactgcttcccatcctttctttccaggctccccaccaaatgcaccacacatttcagtggcactgttgtttttgtgaaaattggagctagcctcaaatttgtgatcctcttgcttattagtctcttgagtactgagatttcgggtgtggtgacagtttttttgaagttgaaacttggatgtcatggctgttctatataccatcaacactgattttgtttgctctcatatacaaactgtcccagtcttggagaacttttaattctctcagcactcaagatgaagaggcaggcagggtctttgtgagttcaaggccagcctggtccacagaatagagtgagttccaagagagccagggctacacagagaatcctgtttcataaaaccagaaagtggggggagggagtgaaggagagggcgagggcgagctcaggcaagagagctagctggccataacacatgccagcctttaattcagttaaagtaattctcagtacccgggaagcattggttttgctaaactgatatcaatagaaatcctttcatttctttagagcagctcaaatttctagtgtcttctttgacatttctgtagaactttatccactcagacttttctttcttccttccttccttaacacatttcttgctgttttttccagctaggccattcctacttggctttcaagattttaaatgattaaaaggacacacaattagaatttgatgtgaggggaattagtattttgggaaaaatacctatttaatgagatgagaggaactgtttctccactagagagctgagcagggcagcagtagcagtaagctcctgaggagacagaacaggctcttaactgacctatgggggtggaatacagatgcacagctccaggtattgtgtgccctctctctctctgatagatatggctgttggctgtaacattccacagtctgtgtaatgaacgtttatttggtattgaatacaaaatacatttttgaactatgcattacttgtaaaaaaaaaaaaaagtagcaatcagcaggtttgctctttaaatatggaagttagtacttaagttccaaatcagaaaaacttccaaaccaatatagtttacaattgggtataccaccatcacagtatattattcagaaacaaatgtcatcaagagtattttcagcagttttttattttcttctgcacttgttaatcactagctaattaactattaagttggagggaaacagcagcttcctagtaagttttcagctagaagttctggccgatgctgccatcagcagagcttacacaccgtgcttgtcttgctgcagttttttctatgcttgatggcacaagtaccttagatagtcgagggggctgcttacctagaatatctgatccaccagtgtggtagagctgggcttctcaggagtagatgcaagttgttagcagaaatggtagctctagagcaacccctgaccctttcacaggtctcctaaataattggaaagcacagatatttacattatgattcataatagtaacaaaatcacagttactaagtagcagtgaccctacattggggtcactgcaaatgtgaggaactgtattaaagggtcactgcatcaggaaggttgagaaccactgctctagaggcgtgaatgaaaatctaggacgactaaggaggaacaatcactgtacctcctgagctgtgtgacacttccagttcagggacagtgaggctatcttggcttgccttgtataacacactggggagccggttagctttaagggattgtaaacacttcagttttaggtgacagattctctggaataatgttaccacatctacttcctagaagtgagggggttccatgttctcttctttgattatagaagcaattaaatctctttgaacaaggtaacaaagtatatagaaaacctagaattggaagttttctgtgatactccatgaaggctcttttctcttagccagatgcaaagcctatttctcagcactaccacagttatttgaaatatgctcaagcttgtaacagagttcccttccatgacataggtactgaacttgcaaaaaggaacaaagaggaatggcttgaatagtcttaattgtgagactacctcactgcatttctagttcttctgtgggttcctacagatcatattagtcctgcacacaggatcatttagcacaattgtaaaccctagcttcagtctggtcaccaagagcccatttatgcagccgtggactatatagccacttcagcttggcacttgttgtggaagtacattagctctggcctgtctcctctatattgtgttcaagaaaagtaaccaaacatgaaaaacaaatttgtagatttcagtattaactgatctgttttgggatgtgggtgacagctttgattttcaggttaccttatgaacacatttgctagcatgggaaaagttcttcactgtccttggagagaactgtatgccttacagtattggtactagccctggagacagacctggatgagcagttccatcatcctgtttgcaggggtgaactacaaatttcatctttgtatcttttggttaacttcttggctaaggtaacagatttatatttaggacaatgaagtcacttttccattttctgcatcccaacacccccagctcacatgttgataagcagcatagtatcaacacagtacactttccttctactggaggatgctcctcctgcccttacgtctgtaggcacacagcttgaggagcagtaggtgagcgggtgaggatgatgcctgagttcggctgtggctgagctgtgggcggcttggcagcacctccctttcttttggcctccaaggtgctgatctgtaagcccccatgttcgtcagcatggg

SEQ ID NO: 34203 - DNA, 4661 bp, Mus musculus
agtgaattccaggcagccagaactacataaagagactccatctcaaaaaaccaaagtattttttaaaattaaaaatatttctaatttaaactaaagaaaaaaagatagttgaactagtaggtgtccaagggacaagttagacatggccctgctacccacccagcttaccctcagaggatcatattgctgtctcctttcaggtggctccagcagatggcttctctgatcttgccatgcaagtgatgacatctccctcaaagaactacatcctgtctgtgatcagcgggagcatctgcatactcttcctgattggcctgatgtgtggacggatcaccaagagagtgacacgagagctgaaggacaggtagaggcgcaggcctgaccaccaaggagccaccgcccgggcccgcctgtacagccgtcctgtatagtgtaccctctcactgcgccctctaacggtggcactgacacccacagtagagcagcatcaggtgcccactgcatcttcccatccagacttggccatgtcctcggtgtcctcctcctcctcctcctcccagctgcccttgcagcgtcggcagctggctgctttggtggtagcttttgttggcgaaggtttacctgcctgtagacaattctgtcatacctacagaactgctggtacttccagaccgactcacctgacctgcaactcaaatttttaaaaaaaaaaaacaaaaaaacaaaagacaaaaaaattttaaaaaggaaaaagtgtatatagtagaacttctccttcagtcttgactcaaacagtaggattattctttcatgtaaatgcagcaggtgtcagcaggacttggaggagcgatgcatatcccgtgcctgatcattgacatgtctgtttcctctcccagaagcaactttggcccacatcaaggcagggacttcagcaagtagtggggacactaagcagcctgctctagggcctgtttgcttctactgcagtgtgatgccttctaccctctaccccagacgagccactgcgacccacagtctcatagcaacaggcatttctgtgtcgcccacttcagtgcagatgtgagcctctctgtgtcagtggaagcggactagggagggagcagagtctgaagcaggcctgggtgcacagccagcaggggcccagccatcctcttcctccaagatgggatagagctgcctcatcttgatgaaccctcataaatgtggggttccctggaagttctctacctcgacaagaagtagttactaagttggggtgtagggcttctaagatgagggtgggggtggcagggcaggaaggaacaggtgtaggacttgcttcacttagtttgctgaacaatagtacaggccagaagagatggcttctgaagatttagcgtgatctcgggtgcgtggctggcattgaagcctgactttctgtgcatgccaggcagacttcctgactgacaggcagacttcctgaccaacaagctcctttgtgcctctaaatgaagggatgtggaaagtgattgcattaaaagatggaggattttcttcgttcttttttccctcctttctgttcatttgctgcgtgtacccactccagtaggcactggctcagtgttacattttggtgatctgacaaccttccatagtctgagctttacaggagcaggatccccagccatcttccctcactcctccagtgtgaagatgacagggccggagcataggagggaggagcccaggcactgcagttcccctttggcgagtttgggccatggtgtcacagtggctgtacagagggtggcatgtacagtaggagatatatttatataatatatattttattaacctgttagatgtccacagagtattataaatcatgtgcctagaactgtccacacagacccaggccccctcggtgccgccctgctcctgcctcccatatgcacctacagctgctgccgcactggagccatgtgtcttcctgagatgcgttctgtgcaggctctgtcagttgctccaaatcactctgtgtctcacctgactgacattcatttgaatactgtggttttcttttctgctgccttttctggtggcagtgagttccagggctagctgtgtatcccctgcatagggtaatagaagtcaccaggggaaaatttgcaaagcttcctgggcccctacttactgcttctagagtcttcctgattctcagcagctgtcctgggattcttgagtttgatgagacttaaaactcctgctctgtaagcaacctcctccactgctagctggctgagccaatctaaaggtccctccctccctcccccgagagtctccgtgtcacattgatgttccacagttagacgggggtagaatcatagctctgatcctgtggctcccttccggtatgtgcttagcatatgatgtgtgtctcagcactgctgcttctgcactgacaggaatccacactgcctgcagcagatttggaggtttggtgggtttggtgaatttgattcttaaactatttgccattagacatggtcagaatagaaaaaaaaaatagctactagtgttttaaattgcttagtacaaggaagtgaccatattccttggagtagttcttatgacttgatggtcctaggcctggtcttaagcaggtttttctaggctatgtctaaggggcccagtgctgtctattctgtagctcattgggcttagtagggtgggctctgtgccctcataagtcagtcatgggtataaattagatagacatgaacttgccaagaaccccaacctggccgggcagtggtggcacatgcctttaatcccaggacttgggaggcagaggtaggcgaattactgagttcaagaccagcctggtctacagagtgagttccaggacagccagggttacagagaaaccctgtcttgaaaaaaaaaaaaacaaaacaaaacaaaacaaaacacagacctacagtgcgagccaaagtctgagcctcacccttcactgtcctgctttcattgcctaagaatagcagttagggggtgtaggccaaggctcaggcactgctaagtcactgtgggctagcttgccagctcatgccagtgtcttggggaccactggtggtaggtacatttccctttggtatttcaaaaagccggggcctgggccagggacagggcatctgtggaccaggtcagaaatctgtcaatgagccaagaaccagacaaactaaacttcttttctgatggggctgcttctagtgaagggactccaggagcaagacatttcttttaacccggtccctggacttgactgttgtcgctgctcttgggggtattttagcagtctgaccctgggaaagccttaactctctgcattcccagagaacttctggccaccatttccagtcctggttctgtggatcaagccagcttgctgagccatgcatccttaataggcaagggcactccagagccactgatgaggtgacatctagtgatcaggtgataacaaaagagttcagtacaggtaccatgactaccacctcctgttcttagataggagcatgcagtccactgtcccagacgagttggcagaaagttatccaactttttatgtcttcctgttgaaatcagctgatggaagatgctctgcttctcagacactaggacgagggtggagttgtgtgattagtatcctcggccttcctagagagcatccactcttgtgcatcagtgtgacttccagaacccccgcctcccttagaggctatggtaccgtttctggactttctggaaagaaacctcccttccattcttttttccctaccccaaaacaaaacaagctttttccacttgcccccagttcagtatctcagaagtcaactggcccagtctggtatcctgcagcctaacacagggccagagaaccaaaagaaggtgtggctttttgaatcccatgcttcttggaagtttgtgtttcttcttgtgagtgtgaaaattcaacacagctccgaacacccccttgagttttttgctctttgggcacacttagtagttctgaagagtgtgaccttcagggcccaggtctcctgacccatctctgccccacttggcttcagttcccaaggggctgtacctgacctctcgcctccccttccctccaggtagctttggtttgccatctgtttagctccacttctccctggcctctccactacggaggcctggatcacctgttatagtaaccaagtctaaagccaaatttcccttcttgctacccagacctcaaacaacagtgagttgtaaagcaaccaagattaaacctcagggtgacacactcccctgagcagacagtgagactgctgtggcggcttagaggctgcttgtcacccagaacacaaagatacggttgtctgtgcagacaggtggtgacaaggggttttctctgacatcttcacctgggcactgagcaccaggcactggagagcttccaaggtgaggaggtgcgcagacagaccgtgtctctatgtcacgtttcaccttctcccagctcacactgacatgagaacctcagagcgtggggtccttacaggaacaggtcccaggtcacttggcagcacggtcgtggccgagcgcttcctgatggctac

SEQ ID NO: 34204 - DNA, 1195 bp, Mus musculus
ctgtcctgccactcgaactatagaccaggctggcctcgaacttgatggagatcctcctgcatgttttctaagtgctaggattaaaggcctgtgtcaccactgcctgccctaggtgtttattttatatgatgtgtttacctttttattgttgttattgatatgacagtgatctcaaattttagagaaatagactgaagtatttactgagctatgcttcaaatatcagcagaagacactgagttaaaacacatttagttgcaggatcaccaaagctctggagaacagaagtggcctgtacactattctctactcttgcatatgttggaatgttttcatactaaataaaaataaagctgctacataggtcttacatatgcagagtttgaagtccaaaatggctttaaactggtagaagaaataattactgacaagatcagttaatttgtgtgattctcaatcatgtcaccctggggaatgcgtattgaaatgattttagaagcctgtcgtcaaaacacttcttcattacaatctacctctttaatgaccaggattctctcatgtctgatggagcatttatacacagagaagatggtggaagactgtgaacaccggctcttagagctacagtattttatctctcgggattggaagtgagtattttaaaaatagtggaaggcactgcctcattctgttcccttgtgtggtcaatatcaaaagaatgggtgtgtgtatggggaagaagttaatagtttatcagtgtgtacatatgcatgctatgtgtctgtttgcctcagcgagcagttgagagtcagagaacaactttatagagtctgttctcttgcctccactcttaaataggttctgagaatcaaactagggtcaccaggcttaaaccataaagtgctttatccactgaaccatctcagcagtccacatgaggtttaaacccagggctttatactgtagagtgtacactcctctactaagctgtgtccccacaccccacttttatagtttatgataataagtaacaaattaacacattctttttaaattcttggatagctaactatctccaaccctcagaaaacctattcttactgctcctagagcagtatctaaaagcagagtcaacccactaccagcctgtaccaagcatccctgttcaccactactttggatgctggactcaaaa

SEQ ID NO: 34205 - DNA, 1216 bp, Mus musculus
ttagtatatttgaaccctccaaaaacctatgtgatgtcctagcaacagttagctactaatttactgcctgatttcactttcccagtgatttactccttactctttccatactagagtcagatttttttattatcattttattttcatttattatttttcatatatgaatgttttgcctgcatatatgtagatacactgtgtgtgtgtcagcagaagttggagagggcttcatagagcacccttggaactgtcattgtagatggctgtgagccaccatgtaagtgatgagaatggagcctgggtcctctgaagagatgcaagagctcttaactgctgagtcatatctccagaccttagagccagattcaaaacaaacgtacagataggtgttttggtaaaaagtgcaacttgcttggttctgagtttctgcttttcagagatagctgagccacagtaagtctcagggtagacttaaggtttcgttccttatcctctttcctcagtgtagagaagcactaactacacgccagaagctcattgcccaggattataaagtcagttactcattagccaaatcctgtaagagtgacttgaaaaaataccggtgcaatgtggaaaaccttcctcggtcccgggaagccaggctctcctaccttctgatgtgcctggagtcagcagtgcacagaggtgatgttctttttccttttctcctttcactccttcttcagttcacattccaaagcttcttgtacctgtaattagtagttttcttctgcattttttgaaccttttgatttttagaatgactactggaacagtctttagaagaatgggagaacattaatgtcacatgagtttttggtcagagtgatgtgacttcaaatcctgggtctattactaaagtaactgggtaactttttttgtttggacttgaggactgagtggggtggttgctgctttttatgttctccctgttcacatttatagctccaagacatggggagccatcatgaattttggaagaatagtcttttccacaaactttagctgtatagggcaataacgattgttctcagtttatttactgccccgatagctttcgtattgctatgtagcatgaatgtgaccatgagttcaatcccctgcatcagaaaaaggacttgctttggcagaacatttgtattatggttgataagatctatagtgcacaaccctg

SEQ ID NO: 34206 - DNA, 1099 bp, Mus musculus
taacattcatcgaattgtcgcctgcttctctaggtaagaaatacaggtcagacacaaaatgaggctctcagataccggaatacattcggttttgaagttcatctacacacaacaaagtttttaacccttcctcctccacccaccgtgagtcaccgaactggcgaaatattccaccggccatcttagttgtgtcagtccaaattcacttctcttttttctcttccgtgtcaacaatcgagagatttataccacggtgcccctacgcaggttttctcagcagctccaacagttcctccgggaaggctatccactttcccgccagccgggtccagggcgtgggcccttccttcgcagcgcaacctccgctgcttttcactccgccgcggactcccgagtctaccgcccgctggggaggagccacgccagcccacgcccgcggctccgccccctcatttaaatacacgtcgccggcgggtgcgtcgagctcgccgcgaacccaagatggcggtgtgtggacgtgtacgggggatgttccgcttgtcggcggcgttgccgctgctgctgctcgcggcagcaggggcccagaatggtcacggtcagggccagggtccggggaccaactttgggcccttcccagggcaaggtggaggcggcagcccggccggccaacagccgcctcagcagcctcagttatcgcagcagcagcagcagccgccgcctcagcagcagcagcagcaacagcagcagtcgcttttcgcggcgggcgggctcccggcccggcggggcggagcggggcccggtgggactggcggaggctggaagctggcggaggaagagtcctgccgggaggacgtgacccgtgtgtgccccaaacacacctggagcaacaacctggcggtgctcgagtgcctgcaggacgtgagggaggtgaggaggtgggacgagcctggggaggagggccgagcctggtgcgggccggagggtgtcgccggcctggaagccgcggatgccgggctgcagcagcagcttccctctgctcttttccttcagggctgtgctcgcgcctctctctttcctgcccctcactcccgggtgcgtt

SEQ ID NO: 34207 - DNA, 1923 bp, Mus musculus
atcaaatgagtacccttgggaatcttgcctggaaatttttttacttaaattctatacagtcctctcaacttgctatttagaatatgagtatgcaccaagcattttggggttgtgataaccaaccaaccaacctaaattgtcttgtcagttaggctaattggcttaaaagtggtacatgaaaggtctgccttgcttcttggatgcaaaagatacaggagagagtcttccactaagcataaagggcaccattaatatcttgtgtggaatttgacctatttccaagtctgaatgctcataacctttcagtgacttgatttctcccatacccctgcactgctgtctgcccccagtgtctggtacttctgtgagatatgctttgtggcaacaagttacatcccaggtatccatgcctactagaatgttgataagtccaatggtggaattggctgactagctagccatatgtaaaggcatagctttaagctttgtgcagtaagttcattgcattgtgagaggtgaggaaagggaagaggtgtttgggcaattgttaaagacttgaaattttctagttagcttgagatactcaggagcctggcttttactcgaactcaccccccaaagtcaatgctgaaggatagataattcccaagtaaaaacttcccctcctgttctacttttttctgaaaatgaagtggttattctcaggaagttaatagtggctagagatctgtaggtgacagaaaggaagacactcagaaacttccattcttgtggtcccaaattgtccagcatttagaggtatgctcaggttatatttgtctgctttgccttaggctactccactaagccactgcccctaagacaccttgtctcaaggcataggcaacatgtctgattctctcagatgttctttgatgaagcactatcttttttaaataaaagttctttcatgcctatcaaactcagctattttggggacctgtactgccagcaagggattattaagggaaaattgttaattttcccagaattccaagttgtggctttatctgcttaatgaaacctatttgaagatgtgtaatttgttttgtttttaaaacttaaagtaagctttaaaaatgtcagcttccagacagttgaggtaatacatgcctttggtcccagcacgctgaaggcagaaactggtagatccctatgagttcaaggccaccctcactacaaagtaggttttggacagccaaaagctataacacggagaaaaaggggggggggggggcaaaagaaaaatgttagcttccacagcgtagaggaaagtcgccttctctccctttcttcccccaggtgcttttgatagagtgatgcttaagagtagctgcctgggcctggagcttcgatttcaggataggattcaaattaaatagaattcaactaactaaagcagatggccacaataaaagctgtgcgtgtcaggttagtctggggcagggttaggatatgacttgccttgaaggacatttaaggctgactggggatttgctaccacagaagctaagctaaataccaagccttgccgtggcaatttgcatttccacaataaatttggattggggtgggggagtgccaggacctcaacctggttaaggtttttgctctaccactgagctgtattagaagcccaaatctgtgatttggaagcagattcacagtatggaccgattgaccaaagacaaccttattgcaagaaacttcatctctaaacctgggctctagtcttagcaccagcaagatctgttttgttttaaaatcttgtcatagggcattgggatttctgaatatctgctgtcctgtgtgtgtttcaatgttttaatgttaacaaaataaagaatttgtaaggtgtcttcccagtgtcttccgcctgtttac

SEQ ID NO: 34208 - DNA, 1231 bp, Mus musculus
ggaagtgggaagagagagcactcacacaaagaaggagaagtgacttgggagagaccacagtgtctgtgttatatgggaaaaagcctctgggggaggggaaggcaagcccctgggctgcaagttcagagtggagggtgggaacatgctgggagaaccaggtagggactgagggatgctaagagaacctgggggccaggtctactttgatgtgttaaatgtgcaactcagccacttgtcctgggtttgaatcccggctctgttgaaagtaggtgcagaatattatatgtatttcctttttatttctcttacagacctggctcgttgctttttagagggtgcaggaggatacttatctttctgtttgacttctgttgagttgggaatgtggcccaggtcctctggtcatgaggtctggaacagcccaagtgttgtatttggaatgtatgtcatgatttcctttttttgccttcagatgtcctctggtatccctgtcatatttacccaaagctgcagtggctgcatttccttatggtggggtgctggctggaacattggagaatgcctccttctgggagctaaaatcagacttttctcataagcctcatgtgctgtccttggagccagggggctttgtagactttcagacagagagcagcacccgacactgtcttgtgacttacagacctggtgagttctgaaagttcttatgggcctgctattttgggggtggggggtggggggtggggaggaggtacaggtaagaagaaaccaggtggctttggtcagcttctctaaggctgacaggctgtgctgcagttcttggtactacagtgaagatggtggctcccatttctttcacagagagtgcctccctaccctgtatatttgacagctttcctgccatgtgtttctggaagtgaattaagcactctagaatctgctgtatctaacaacagtgacaggatgaggtggtctacccttgagtccatctcatcaccttagtccacttcaccctcacttcacctaagaaaagtccccagctgcaaacagcccgatatcagatcagtgttttagttactccatatttaagtccaacaaagttaagatggacagcatggttttgtggaactatctaggcagctcaactctactgcctccaaatccatggatagaactccgagcagctattgatttacaggtttgttttgttcccacttaaagaaaagaatcg

SEQ ID NO: 34209 - DNA, 1554 bp, Mus musculus
gttgcagtttcagacacaccagaagagggcatgggatcccattacagatggttgcgagccaccgtgtggttgctgggaattgaactcaggatttctggaagagcagtcagtgctcttaactgctgagccatctccccagccccagtagatacgtttttgcgttacgtggttgaccagggagaaagaaaatgcatgaggatgagagagaaggaagaaatgactgatctgccagagcctgacagggtcctgagaggagtcggtatccttacccagccagactcagtctgcttttattagaactaatgtctcctcttgctttgcccctgtccacccatttgcagagtttggtgtgtactgcagtcactgtcggagcgaggtccgtggcacccagtgcgccatctgcaaaggcttcaccttccagtgtgccatctgccatgtggccgtgcggggttcatccaacttctgcctgacctgtgggcatggtggccacacgagccacatgatggagtggtttcggacccaggaggtatgtcccacggggtgtggctgccactgcctgctggagagcaccttctgaacttaaaggacagtggcacttccggaaatcccagaggactccataagtgctggagaaggctctctgctgctgctggtggaaagtcctagaaccagggccatcctcgtgatttaggatggagagtatcctctcacagactgtcacagcatccgctcgtgatcctgtgtgttcccttctccttggctgccgggcacggatggtgctggaagaagggagggggacgcacagagctgaccctcctgtactgtctgttgagtccacagtggatgttttcatgaggaaaagcacctgtttccagagccatcagagctagcatcagccttcaagattctgtccttgaaccaggaatggaccctccagatgccagtacaaaggcacacagcagctgcaaaacagactcctgagccagaagacgctggctcttagtgccatccacaagtgagctatggtatctgtgacttagaagttggcaccttgatgatggccttataaaatacaatactaaagtgtaatatatgatggacatatattcagcattctttttcttggtacagggctggaactcagcgccttgcacatactggtgagcagccataccactgagttacattccagccccataagaaacttaagatgtatatgttttctgtttctcttcatctgctttcctttaactaatagaagtttgtacttgtgtgtgtgtgtgtgtgtgtgtgtgtgtgtgtgtgtgtgtgtgtgtgagtgagtgagtgagtgagagagagagagagagagagagagagagggagagagagaggatgaataaggaaagtgaccgtcttagtgactcattttgcattgtacttctggttgaagggaactgttttggaccggactagaattagtctcatgacttgtaaaggaaatgccatttgactttgatcatctgacagaggaaacggaatctgacattaaggttctctctagccgcaagagtc

SEQ ID NO: 34210 - DNA, 1193 bp, Mus musculus
caaccggtgagggtcagttttctctttccactaaatgggctctagggatcaaatcatgattgtcaggcttggcagtaactatcagccaccactgaacgacctgtactcagaccactcacatactcagacctgtgggtgtgtagttttcgactaattaagcatttctgtgctgctctgtaggatagccatatactaagttatccctgcagccggccatgcatcgcatgctcctgtggctacttctgtcttgtctcagttaacactgcctggctccagcccactctgacatgtccttcccttatgtgagcggccccaactggataaaaggatagtagttctggagtatggacatagttcttcttcaagaaattggggcctgtaggagactggaggcttaccccataataacaggtcaaggctcccctgccccacccctccccctttgaagaatcaagaggtgtggataattatgatgaacaattcataggtgtttcagctaacctacttcacttacttgtctggaacccaggtggcccacatttagtaggtcccaagacatattgattagtatgggaagtcgattcagtggacacttagagcattggttgaaacgcctggatttaggcgtagacagattcctgaaagagtgattatacagaactcaggagtggaaacgtgagtggtgtggctcctgaccacttacgggcattcacagaaactgcagttctaggttgcagtgttaagtaagtctgtgcatctgcatctgtgtctcctcgctgtaccttactcacttcagactggatagcagagctcagcattagctaataagacaagaaagactgacggctgtgagactaaatccacagcaagtaattaactaggagtagcttgcctagggccatattgaggcagaacacacagtaccttagttttctgatgtcaaactgcaagccccttttagttgctccttatgcctcccctgttgataactgtgtggctcccttgcttaatcaagtgtctttggtgacctcttttaacttttggaaataaaataggacattgctccgataactggttgtctttttgaagatgccagatggggcgacactctgtgactttttgtttcccacgacatttctcattcctcacagccacttcctgaggcagctctgggagctgaaacatgcgcccat

SEQ ID NO: 34211 - DNA, 1229 bp, Mus musculus
gagttatccaagcatttggcttagcctcatatttcatttgctgtgttccatagaggctgtgtgtaatagacatcatatgatatttgacaaaattttccccagatgagtttgagctttccataatttttttttaaagataggttctaagctgggcagtggtgccacacatttaatcctggcactcagaaggcagaggcaggtggatctctgagttcgaggccagcctgctctacagagtgagtttgaggacagccagggctacacagaaagaccctgtctcgtaaacttaaaacaaaacaaaaaaaggataggttcttcctgtgtagccatggctatcctggcctgtaatttgagatgtcgaccaggctagcctcaaaggtgtggcaattctcttgcctctgctttctcagtgctggcattacaggcccgagccaccatgcctggtgtctatcatgtagcttgatttagttaggaacagttccagctttggtttggtttcggctgattccacatggagtaagcccagcttccccttcctggctgcagcctttcagcaacgggctagtgaccgtgatggttccccagctgcggagggagaacagcctgctcctgtggaacgcgtctgacttgaacgctccagttcacacctttgtgggtcatgatgacgtggtgctggagttccagtggaggaggcagaaggaaggtgagtgagtagggagggctgtgctctgattttctcctgagctctgctggacatctctgccagtcatgttgtcatagtgaactagcagaccagggctggctctagggactggaatggaaggcaggcagggagggagggctgtgttgaattagagatgaataaacagagtgtgcaacattttccctctccctagttctgttctccaacttccattgtgtctctcttgcttggaagagatccgctccaggaagaggttgaagaggtggtttttattttggtttgtttttttaatcatttcaagggccaaagactttagaatcttccagagccaagccataacaatagcaatttttaaaaaaagatttatttattaatttattttatgtatgtatacgagtacactgtagctatctttagacacaccagaagagggcatcagatcccattacagatggctgtgaggcaccatgtggttgctgggaattgaactcaggacctctggaagagcagtcactgctcttaactg

SEQ ID NO: 34212 - DNA, 1184 bp, Mus musculus
gggagtggagaactgactcctgaaagttgtcctctcactgccgcaggggcaccatagcatgcgctctgctatcctcagcacacaaacaaatgaatgtaaaagttataaattttaaaattgttttagggttagagatgtagctaatgggagtgcttgcctagcatgcttgatgttttcattgggttgtttgtattttacgtattgcgtatgtaatccacctgtctttaccttagcactgggattactaagcatgagctacaatggctgttaagaaagcaaaaaaggcctagaggtccaaggtttgatttccagcacctgccatagcacatgtgtggtcagatgacaacttttaggggtcagctctgtcctttcatggtgagatctggggaactaactcaggtctttgggtttgccccacgaacactgtcaatatttggtttttgagtttaatgaagtgtttttctgctcttggtgggcttagcttgggggtgggtagtaggaccgtggaaatccagtggccttcagagtcactttggtctcacaatcacaaaggacggtgaccgaggccactagcagggcaagcaagccgagatcccctgatagtaacagcttccacagcaggtaggagtctcagaaatgactcgctggctggctttctgctcttttatgtgttgggtctcattgctttagcctgtatattgtatataaattagctgttgatttgggatgagtctgggaacacaggcacacacacacactagtgcacttttgtatgatatgagtgtgggtatctgtgtgtgtgtgtgtgtgtgtgtgtgtgtgtgtgtgtgtgtgtgtgtgtatatatgcatggagagagagaccagtgtcagctttgggctttagtccttaggaaccattcattcacctgtctgtctttacgtccttggcgctgggattataagcatgtactacgattaaaaaaaaaaagggaccagaggattcaggtttgatttccaacaccatatgacagctcacaaatgtctatagcttccagagcgtccaataacttctggcttccttcagtactgggcacacatgtagtacacagacatacaaataggcaaatacacataaaataaaataataataaaaaatgtgtgtgtgtgtgtgtgtgtgtgtgtgagagagagagagagagagag

SEQ ID NO: 34213 - DNA, 1176 bp, Mus musculus
ggtaagatttcttaagtctgtctcttaatagaaacttcattatccttgttctattgtcaggttctctgatagagttatgaacttacaactgagttccaatatctcacactctccagatatgaaggcttagtgttctccccaccatcttactcccacccagtcacgggagtagggagtcccactgagtgatgggaatacaagaaaagttagagtcatcctttgggtgtctttaaagtgtacgtggcaggctcttgttaacattataggtaatatttgtatatatttacttatttttagtatatagaaccacctgtgctttttgcaagactctgggcctattgaatgctcctggcatcctgcagttcacctcatactgcctctgaattcccaaatggcttttattggggtgggtgtaccagtctgactgtgagctgcctgtgctgttcagcagaggtgagcattcatttgtgtcagtgttagaacaggccgtggaattttctggggcatccttttctcttgttcttggctgcaaggagagacgctgctgtttcgctgctgtctcggctgtggagccttggagttaggtctgagcagcttttgctcttgtgtaagattccaaaggtggggctttcagtgtttgactgactgcgggcctggaaactggtacagtgttagtacttgggttttcaaggtgctttggtgactcctcacaagcagagagctgtcattaaagaaataagtcaaagctgtgggcttgtgctgtgttccaaagtagaatactgagggcttccagttttaggtcctctgctgagtaactttgaccttggacaagacacagcacttttctctaggctcatctttgttattttaaaaatagatgtggtaatcctccgcggtggcagcttgtaacggttgttctctaaaccccaggagaggatattctgcaattgcgcttggcttccgtgcttctgtgtccctgtgccttcctcatggctgtgaccctcgaatactgagctccttaggacagaaatgctagctcttactttcttcacatagatagctcctttgaaccctttaggactcaacagagatttttttcctcagtgggcactcttaacatctgactttcttttttttttttttttttttttttgcatgttttataagcatttatct

SEQ ID NO: 34214 - DNA, 1199 bp, Mus musculus
ctgataactgacacttaacagctgcgtagtagatgcagcatgactgtactggacagagtgattcctctctcaagcaggatggagcgagatttcatcgtactgctcagaaagttatgcagtttaacatgtatgatttgggccctggtgagatgctctagaggttaagagagcccttgctgctcttgcagagaaccaaacatcagttcccagcacccatatcaagcctgtaaccccagcttcaagtgacccagcacactctgctggcctctgcaggcacatcttaagactgtcccttcttcccatctctgaagaaaccattctagcgtaaatgaagttaatcctggcttagtggaatttagagcttttagtacatatctcttgtctcaggatttctattgctgtgataaaaacaccaggatcaaaagcaacctggaagaaaaggagctgtaaattccacaccacactccatcactaaggaaagtctgggcaggaacctgatggcaggagctgatggccaaggccttgaagtaatgctgctttctggcttatgtctcgtggtttgctcagcctgctttcttataacactcaggaccaccagctgcaggggaggtgtctcccacagtgggctggggcctcctacatcaattattaatcaagacagtacagacttgcctgactagtcttgtggaggcatttctcaagtgtgattccctcttaaataactctagcttgtgtcaagttgacttaaacctagccagtatatatccattctattttcctacctgtgcctccatcactaacttatatgacttaggtgatatcgtcttggggtagaacagggccctgtctcttctgaagaacttggtatcctttttaggctgctgttctgtgcatagggcaagtcctgtcctcagactgtaaggtcttctctgatagactctgggcttgatgacagacactgatttctccctctgtgagagaggcttctctttgttctgtaggaacccagaaaacattcttaagtacagtgctcccccagccacccactcacacttcaaactcaaaagctcagaaagcaacaagctgaaggaggaactctgtctggagctccctgtctgactaaaggatgttcacccagtagacaggagattaccagaggctcctttcttggggtctgagtgattaactcacagggaaag

SEQ ID NO: 34215 - DNA, 1195 bp, Mus musculus
aattgcccaggccgtgtttaccaatatagggtgtgaactaaggcggcattatttctcgtttcctccaagtcctgtgacaacgttgaatgctttgctaactctcgtttactttctccttgtaagatgttttctctccttgtgtgctagtgcagacctttaatcccaacattgaggaggcagaggccctgagtttgaggcctgcctgggctacagagtgaaaccctgtctcaaaacaaacagaaaacccatccttttacggtgtagtttcattcctggctgaacagaatcatccttttgtggacagaagggaagtggtttggatagagtgagagcatcctgagtagtcacctgaacaccagcctggctcaccggctggtttgcccaaacctgacttaccctggggttggagccatgccgggaggcctctcctgccaggttgtactaacactgtttttgtctttatccaggtacattgagcggaaagcttttctggatcgagtggaccacaggcagtttgaaattgagcgagatctcaggctgagcaaaatgaaaccttgacattctgggaaggattcctagcagctgaatcctattgacaatgtgagctcctctgagtgtctgtgaaatacttccagtgttcctcatcatgtttccagcaagtccctttttctacgttgcagtttgtttaatgtatgttaatttcacctggcttcattcattttcctttttaaaatttgtcttttaaataaacaaacagaaccctctgtgaggttggtgagagtaagggtgccgtgctccttccctgtgctctgcctctaaggctgaaggccagcaggcccagccaccacatctcagacctgtctgtgatggtcacaagcctctttaaagtcagcctttcctggagactcctcgggggcttcctggggtggcagctaacactgagtctctgggcatttgttctcaatgcattcagctcctctcttgtgtgagattcgtaaggtggggacattgggataaattaacgctaagtggctttttgtcttttcctattcccctttctccttaaaaaaacagtctacttcagatatattttctacctcagtagttcttcaggttttggtcaagggacattctttccagtaatgctgcacacacctagaatcccagtgcaaatggaagactggcaaagaactgc

SEQ ID NO: 34216 - DNA, 1212 bp, Mus musculus
gttaactgcaccttgaccctatgccggatgctgtgttggctgtttgcatggacagttcctcgccatccatgagtaagcattcagtgtaggttgagaaatcaaggcacatgcacttgaacagctagccttgagtcattggggcagagctggaattcgagcttgtgcctgtgtgtgatttcagagccttacctgaagccctccattttcctccctccctgcaagcagggacctgccacccagtacaagggggtctgaaggggtgagggctcctgtcagcggtgcagctaagcaggcatggatgttaggcaggaaaggcgtattaggataatgccctgtctatagttgctacacagcaaagaacataccctaggtataagcatggtttctgttgagacaaatggcttcaacctgggaccctcatgtacacatcaacaacagcacacacggccagtgcagaaaccagagttctcatagtcccttttcttccacaggataaaaagagcaagtggtatgagcagcctcttagggaaaattggagccaaaaaacagaagatgagcacccttgagaaatccaaactggactgggagagcttcaaggaagaagaggggattggtgaagaactggccatccataaccgagggaaagaagggtaagaagggggtctgtcctccgcagcctcagagctctgcagcggcttgtttcaaactgtttaagcaaatagggcttcccgtgcttcagttactggtgaagctctgctctaagcggaggcagatcccatccctgagcagcagtgttcccaggacggttagtgaattacagcttcagtgaactgtaagttgcctggtttattcacaagacggggtctggctcaccgtgattggcttgttctaatctgaatcacttggccgtcagataatgtggtctagttcaagtgccaggacactgtcacattatcatgaatggtgtggtgctagtttgttccattgtgttactgtagtcctgtgcgtggtaggactgtttgctgcatgcagcctgtatgacacataagaggccattgctataccatttcccatccactccagaatacagaggatattccataagccaaaaatgatcattcctgttagtgtttattttgttttgttttccctgtggggtttttgagaaaggatctcactctataacctagtctagcctcacaatcatggcaa

SEQ ID NO: 34217 - DNA, 1161 bp, Mus musculus
ctcttgctcatgcgggcccaaacctcagagttcttcatcctctctgccccactttgcacccagtccaataagttcttttaattttgtcattttaaaaatcattttatttatttacattccagatattgccccccttcccagtccccctcccactgttcttcatcccattccccatcctctttgcctctgagaaggtgcctccctcagccccaggcaccccccttccctggggcctcaagtctctacatgattaggtacatcttctccaattgaggccagaccaggcagtcctccgatatatatgtgttggggcccttggaccagcccatgtatgctctttggttggtgggttagtctctgggagctcccagggatccaggttagttgatactgttgccatatatatccctatagggttgccatcctcttcagtgctttcaatccttctcctaactcttccataggggtccccgacctcagtccaatggttggctgtatctgcatctgtctcagtcagctgctggtagggccttctcagaggacagccatgttaggctctgatctgcaagcacaacatagcatcagtaacagtgtcaggctttgatgccctcctcccccacaaggagatggatcccaatttgtcccagtcactagacagcctttcctttgctttctgctccatttttgtccctgcgtttcttttagtcaggaacaattctgggtcagaaattttgacagtgggttagtagctccgtctttccacttgggccctgtctagtggaggtagtctcttcaggttccctctccccactgttggggattcggctaaggtcacctccattgagccctgggagtctctcacatcccaggtctccccacctcacccccagaagctgcatattccagtcattctcctggccctctggccttctctcctgtttccacccccatccctttccactccccctctccatccccacccaggctctctctaagtgagaccgaagcatcctcatctgggctttcttcctcctcgaacgtcttacggtctgtggattgtaccgtgggtattctgtactttttggctaatagccactgctcagtgagtatgtaccatacatgtccttttgggtctgggttagctcactcaagatgatacat

SEQ ID NO: 34218 - DNA, 1159 bp, Mus musculus
ccctgagttaactatgtagaccaggctagtgccaaacttatcaaaatctatctatctcttcctcttgagtgttgggattaaaggtgtgggttaccatacctggcaaacaggaaagttttattttttacatttctcccattaaaaatccaccagatttcctattaaactgtgtaggtaaatttccatctctagcctggctctgaataatggtgttaaagtggtgtacattgtaagtgagggtacacttacctagcagaattgatgacaacggtatattcaagtcatttatttatgtgagaaatggttccagggagacccagagagtggggtgaaaggaagagaggcctctctcagatactgctaactaactgccttttttgttacatatcagtggtattgattgtcctgaagactggctaagcagactctttctaaacaaatctgggctgactggatatcatcagcataggacagtctctttaaattgaagaggattcctcccaaacctgagctgtacagtcctggcatagccaagggtcaacatggaggctctgctgacaaaagggctgagaagggtgactacaggaggagggagccatcctcaggctgcacggaagagctcctggggtagagggcagctggggaaaggtgctgtcactggcagctattctagtgactttcttacacagggggaaaatgagctctgactgtgaaagctatagtggaatatactagagtatagaatatctaagtgtctgagtaaaagcgcaggagtatgggacatttaaaatctcaagtggcccttcagggcagtctgcttgtttttctgacctgtgtcagaaaactgcttggaatgccaaaggaagtcatctgctttggtgattgaaagtagacggtttttatccttgaaaacttgagaatctgcaacagatcccacatgtatggaaggtcttttcgagggaagaattttcaggagtcatctaatatataagagaaaagtaatacagtaaaatgtttgcttcccccaacccctttgggaatggcttcagtttatagaaactgttttccttttctctaaacagatttcagcaacacaggaaaaccagagcagacgagtaaaacatcctgtcgcacgtccttcagtaacaaatatggacag

SEQ ID NO: 34219 - DNA, 2186 bp, Mus musculus
tctggttaaatagtagccaggaggggctggcaagatcattcagcatgaaaggtagttctcagggtccacgtgttagatggtgagaaccaactcctgccgtcgcctctgctctctacatgctgttcacgtcacacataaataaaatttctttttaaatatccaagactctctgtgggcacttgcacccatatgcacataacttcctgtcctccacgtacacatgattttaaaatttgataaaacagccaagcagatcaatttgcccagtaatggcatcaggggaaactgcagggatggctccaaaaataattggctctttccttttgaccaccacttgtcaaaactgtagtgacgatcagatttggtgggcaactaaaatgcaaataaatggctcttcctatcccccagcaaaaagagcaaatctttcttccaaggaaagatttccattttcagtctgagagactttgaatttggaaaacatccttcagctggagaaactggaatattgtaccgggccttgtgggcgcggatggcatcactggaaggatgtgggatgtaattttacacactaagcacataggtgaataggtggttggctgttcccctaaacaataactcgtgaacgtattcatccatgaatatttgtgtttctaatcaagacacacaagttcgggtgtttttgtttctgtatgtttcaacggctctaaaaacaaacacttgaacttgaaatgtatcttcaaattacttagtgttttatctatcccaatatgtgtgaagcattctttttttgggggtgtgtgtgtgtggtttttctggtttttttttttttttttttttttttttggagacaggtttctctgtgtgaaaactttggctgtcctggacccactttgtggatcaggctggcctcgaactcacacagaagatccacctgcctctgcctcccaagtgctgagactaaacacatgcaccaccaagccgagctgtgtgaagtattcttttgtggataaatgtacatagagtctatagactgagctctgtggcttgaaatgttttcaggaagaaaccatttgaatgataaagagtgtgttccacttggacgctgtttctgctgtctctcttgctcttcttgtttcaaactcgagttgtttgccacagtttattttgaacacatcaccttgaggaatttcctcccagtaaggactttcttggaccatgattcctgcatctgagtctcccttctcatcctaagttctgagatagagaggcaacctccaaccaaaagctgatttcttgatgccttagtgggattttgaggttaaaattaagttcctgtgtaaaagcgtaatgcttatgagcaagatgcttctctgggctgcacacttcctttgcagcaagatttcacttaggaaatgcaggaagtggcgagccagcagttcatgcaagtaatagtgtccatccttcctgcgtcctttaggtttttaaattgtatgttggcttttgattccaatgtcttttatgactgccctggtttcctgtaagttattgtgacagccgggacatgccaaccttccctgaggaactctttcctggaatgtgaagccctggtgccattaatggtccacgcgcagaaggttttgtgaacttgtatttctttcttgtgtactgtgtagggctggttatgaccaaaatcagtttaactttttatattaggttattgcacttaactgctatagtcaaaatgatcaaatctttgtacattagagatttatttaaatattatttttctactgacatttctaatgctagtataaatgtttattatcaataaagaattactttaaattctttgcgttgggaaccttgatttgtttgtttgtttttagatttcatttgatgcaatgtcttgctatgtatccttggctagcctccatctcttcatgaagcccaggctggccttgaatttgtggcagtcttcctttctctgcctctgaggtaccaggattgcaggcgtgccaccacactcggctctgcagttgctttttcttttttctcccgactcccaccccccacccccccacctagtactacaatactactgttaccaccaccacctcttccttctcctcctcttcctcttcatcctccttttccttctcttcctcctcttttttttttttgtttgt

SEQ ID NO: 34220 - DNA, 1191 bp, Mus musculus
tccaaactttgtctctgtaacgccttccatgggtgattgttgagcgtggtggcgcacgcctttaatcccagcattcgggaggcagaaccaggtggatttctgagtttgaggccagcctggtctacaaagtgagttccaggacagccagggctatacacagaaaccctatctcggaaaaaaaaaatttctgggactgactggatgacaaaggaaatctttttagcagctgtctttaatctcttttaaaagaacctcggggaaaacttttaaagtctccctccctggtcagtactgaacagaagggaaaatatctgttctgtctgtccaggctctattgtctggcatctgtcacccagggactttttatctatctatctatctacctatctattttttatggactattttttgtttgtttttgtttgttgttttttgttgttttttttttttttttttgagacagggtttctccctatagccctggctgtcctggaactggactattggtttaaagggtgacataattgtaaatctcgaaagagaaagaaatggaactttgtcttttccttcgggctcagtccagggaacattttctccttccccggggttgcttagagcagccatgatgagaagagcagggacttctcgttgggggatgagttctacctccctctgtgcggtttgcttagatggcacggggtcccccaattgcctcacacaggggccaacctcaacagcgacagcgagcaggagccaagcaacaaaagaagcaagcactcctgctcctgaggtgggactggtggaggtttgggacgaatttctctgggtgatctggcagagccaaaaggtttgggtccccaacaggagaggacaaaggacttaagctgggttgggggagggtctcacactggacaatacaggtaaacaaaactgacagaaacacatagaaacacacacacacatacacacacatacacacgaaaggaaggaaggaagaaaaaacggtggctaccataccttcatacataaacagagggatccagtgacatttcgcatggcatggatccagccacatacctgttctttcgagtccaaacagccacatacctgttctttcgagtcgccttaaaggaactcactttgtagaccacttagctccacaggtggcagaccaggcaactttctaatttc

SEQ ID NO: 34221 - DNA, 2579 bp, Mus musculus
cccaagtaggaacagatgtgggcctcacaagataggaaattgctgcagcccaacacaaatgactgccgttcccacagcaaagaaaaatcaatttcctgtgcctatttctttctaagcaattcttctgaggcagaattaaccatatttatatcttaataatctctggtcatccattttatctgaagagtatttgaaatattctttctatttcccatctgacctgagctccggggtaacggcgtcttacgtgtagctgttgcctccttccgggtaacggcgtcttacgtgtgtagtctccttagcgccttgtacttaccagccagggttctgggagatgatcaagttcgcctggatccagtatgtcagcatcctgctgatcttcctctgggtgtttgaaagaatcaaaatcttcgtgtttcagaaccaagtagtgacctctatccctgtagccgtgccccagggagagatacggaaagagcacttatcctgagaagataccccgtcaggagcccgagggaccgcggctacctcattcctgtcttctgagacctgccatcttacaacatttctgcgaagagcccaccggacactttcaggcctgcatgtttcacttcagagacaacggtttttccagggctggactgcacaaaatccacgccttcaaagcaccgagggaacccacaaacactagtttgtggaaaggtctcagggtggccggaggctgtgattttcgttttgttttgttttgtttctggttttgctttgctttgctttgctttggccttgaatttcagggagacaattactgtgagttcatacatctttgaaagagccccacctccggtcaagcgaagagtcttttgagctgggacgccctgcgcactcctatctcctatcataagctagccgctttcttagcctccccaggggctctcacaagaaacacgcaagccccgagtacattctactcctaggtatctacacagtgcccattcagaactttgatttccagaactgaagcctcttaactggagaccgaaagggggcaggccaggacctaaatacaagcggctcagaaccgcgtgcttgctggcgggtaacttaagggcaggaggaccagacacctgccctcaggctaataggtgggggtctgtcatcagctcagctgaacggccctctgttcctggtgcggctggctctgtgccctgtttcttgccctctgtctgtgcccctgggatggcggctggagtcagaagcgcctgcttcattcagtccgtccgcctaccccctccctgcaccaggggaggatggtgggcttctaacaactggttctttctccctggctctcacccaacagcctggccactcctccttgatggccttccccctttctgaaaggatgtgggtgacagaggggttgttgttggcattggcttccactgcctgacaaccgcagggtttatttggaggctgagctgaaaactcagttgttttgcagttcccttgattaaggaacagagtacttaacagaggggaggctctgggggaaggcatgaggagggtgaggaaagaggctgagcagagcatctaagccagcctggccattaaaggagtgacaagaagcctagccagatagccctgtaatctatagaggtatgtatctacaaagacatctactctgcatccaaaactgttatttggccccgttccttcccctagcaagtgtgctctcctaaaaaactctgccacatcattagccctgccctgaaaggacttccctaccccatcccccatgcctccaggtctaaccacaaacactcctcaccacgtgcctcagtttaccttggagacatccttctgtcaggctgagcaaagtaagaattttgaaaataaagctattttgagtattcagggagaaaaactctctggtactagtttctccgacttaacacagctgattatgtgcctgagtggggtttttttttttttctgaagatatacatgaaaaaaatggtctctgatttcaatttcaaaaaggttatgagatgtggctcagttggaagagcgcttgcctggcacacttggagccctgtgttccatccccagctacacataaacctttatggtggtgcaagcctataaccccggtgcattgtgggtggaggcaggagcagagaaattcaggatcatccttgagttagagcccagccggggacacttgagaccctatctcaataaaataaggaaatggggttggggcatgatcagaagtatattgtatggaaaaaagatagcaagacacagaaagatgaccaaagatactttgcattaaattaaactatcctgtgcaaaaattgtactgagaactcaatgatgttttataactttctaattaaaatattccaaaagaacgtttcccttggcttctgaacggcagggaccctgggtgtgtgtggggtggtgacggtggagaatagggagagaagagcttccccgtggttctgactgactgactttaatagccgtcctctgccagtgccctgcctaaagacgctggcgcttttgttaggtctttggca

SEQ ID NO: 34222 - DNA, 1146 bp, Mus musculus
ggctgtcctggaactcagtctgtagaccaggctggccttgaactcacaaatccgcctatctctgcctcccaggtgctgggattaaaggcgagcgccaccacgcccggcttaaaaagttaaacttttgaagtaccttataacccaacatttaatagataactaaaatctacccatatatataaaatttatatgtgcatgcatgtgcgtgtgaagtgtgtagtatatgcacacatatgcatacaggtgtgcacgtgcacagtgaccagaggaagatgctgggtgtcctgctgtatcactctctaccttactcccctgagacagggtgtttgtttagttttttaagatttatttattttattttatgtaatttagtacactatcgctgttgctgtcttcagatctcattacagatggttgtgagccaccatatgcttgctgggacttgaactcaggacctctggaaaagcagtgctcttaacggctgagccatctctccagcctctgagacagggattctttctgaacctagataaaggcagtggtcagaaaaccctgagatcctctgaacttgtggcccttctgtcccagcttcattaatagctgtcattacaggcacataccactgtgccttgctggacaccttcacatggtatgtattttagtatcatcgtcgtcgtcgtcattattattgtttttagacagtcctatatagcccccgactgccttggacttctggttctctgcctctacttcctgtatgctgtattctctgcctctacttcctgtatgccgggattcaaagcactgaccaccacacttggtttaaatggtgctaaggattgaacccagagcttcatgcatgcttatcaaataccctagcatctaatcaaaatctctagcccgctggttatcattttttcaaagagtagatttttatgatatgtaaaatgtgtctccacaggagagtagtgtgtgatacaagcaatggtagtaaaaattcctgttgacttactatgtcttatctatgttcccctatctacttgtacacacaagaagttctttattgtcaagtagcatatttaaagtcctttctacagtatttggcctgtgacaaacagcaaatattagctactaattttgaaaaca

SEQ ID NO: 34223 - DNA, 1816 bp, Mus musculus
ttgataccaggactcaattctcactcattttttttttttttttctctttcaagcctaactatgggacagctttacgagaaggaaaaagatgaagatggattcttgtatgtggcctacagcggagagaacacttttggcttctgaggcccttgctgggctaggtgcgcccttcctgcttgtgtctcttgtaaataactggctgttctcagttactctgccagagcctccacacagacctactagtgcatttgtaactggatttatttcttaatatattggaaggttttgtttccttagattagtaaattatcatacagagttttattttcagttttctttttgtgcactgtcctcatggctatttgctccagggaacctgtcctctgggaatcatatttaatgaagatatttccgtaatgaagggaggtaggtgtggtggtaaagggaaaaggaggggctgatgcatagttctggattatgttgaaagtgttagatggctaagtattaaaagcacccagattaaatccttagcaatcagaacacttgcttcactagattttgccaactgcaaatcatgttggactgagctaatctattcttctttctgagactattaaggtaaataattaacaataaagcctccttataaaggcatcacggtgtgaccatgtccgtcattcacctccacgagtcaggagtggctcctgcctgtcaggcttggagaagggcttgcaggggagagagaggcctagcctaggatgggaagtgctggttgatatcaaaaggggattggtttttcagtggtcaatacagtcaacaggttcagatttcaggactgtaaaaaggtgtatactgcaaagtctcgcttttaccactttttctgatctctgctgcttatggaaaattgtatgggtttcttctcagtatttgagtagcaaaattttaagtatgaatatactttttaaaaattatttattggtgttttgcctgcacgtgtgtctgtgtgggtgcggtctggatttggagctagacagttgtgaactgctatgtgggtgctgggaattgaacccaggtcctgtggaaaagcagccagtactagtaattgaagagctatctctctagctccatgtatacatttttttgtttacatatgtaaggcatgtgtgtatgttagtaaagcagagggggttgaagagatggctcagcagttaagggcaatgggtcctgagcttaattcccagcaaccacatggtggctcacaaccgtatataatgtgatctgatgccctttccctgtgtgcaggtgtatatgcagatagggcattcatacagataaaaataaatctttctttaaaaaaataaaacatgtacttacacactggattttgttttgagacagggtttcactgtatagttcaggctgggctccaacttgttatctgccttggtttggctttcattaagtctttacttacattctagcctgatatacacacgtcctttatatgtgctgtgttcttttgagacagggtctctctatgtagtcctagctgtcctagagcttgtaatgaatcaggctggccttgaactcagatcctcccgagtgctggagtcaaaggtaggcaccaccatgcctggtacaaacccttgttctttaaggttctcgccagtccctttaatctctcatgacaatagatgcttgttaggacacaaaagcatcttcaagaaagtggctttacatcttccacagatggactgtgtttggtgactggtgactgtagccttacatcagtcatcaggataaggaaaccaataga

SEQ ID NO: 34224 - DNA, 1188 bp, Mus musculus
gaattctgggaacttttcagagagtatataaatgctagggcctcaagaggcaaggttggtggtcggtggtcatctagggggttggttgcagtttgctagttgtgctcaaagaagaaacaaaagaaaaaaaattagattcaaagatctctctccccatctattcttctttccctcctatccagtgataacatttaggcgaggcgacatacgtctttagtcccagtgctcaaggaggcagaggcatttggaccttcgtgagcttcgaggccagcctagtttacgtagtgagttccaggacagccagtatacatctgagaccctgtcttaaaaagcatacaaacagagcttggagagatggctcatcagttaagagcactgaatgcttttccagaggtcctggattcaattcccagcaaccacaggtggcttgtaaccatctgtaatgggatctaatgccttcttctggtgtgactgaggacagcgacagagttctcatatacataaaataaataaataaatctttaagaaagtaagcaaacaaaaaagcattgtgcatttaaacaagcagtactgttctctgttagaaaggacttgaagttacattaagttcaaggctaacctggctatgtgagatccagtctcaaaaaaaaaaaaagactagttagtgttcagatacatgctacagcatccatgtgagtgagccattaagtatcaagctaagtgaagtaacacacacgtttgactccgttgctgtgaaataaccacaaaaggcgagtcgttcctggcactggaaagggcatggagtgtggtgttggctgctaatagttgtaaagtttctgagatctgaagttcccatctgtgcactggatttgcgtcatgtgagcacctggcttgttcagaagaggaaaaatacaacttttatagtgtagggttattttagtttgggttgtttgaaggatttcctagaaagcctgtgtgaacaaggtgtagtttaagtttctcaaaatgagagtaaaattttagatttctgacccccaccgatgggcattaacttcgtttgtagctatgcctcagaccggtaggatgggatcttttaagccataaaattcttgctggggatgggggtgcgttgctcagttggtaaactgcttgctggcaggcataagtaaggctctctggttgatcctc

SEQ ID NO: 34225 - DNA, 1194 bp, Mus musculus
gggtcacttgtaaaacaaaaaaatacatgtggctcatttacaccaaaagcatcccttgtgcttgcagaggccagaagagatgtcagatcccctaaaacaagctacacatggctatgagccaccatgtatctgctgggaaccacatctcggccctctgcaagaacaagtgctcttaatggctgagccatctctagcaccgggaactcaattttacgttcttttggcatgggaccctagcaggttctgtgtccttgtctggatgcgtacttctagattttgtaacatcaggcaacagcaaaagtaggatagtggggagaaaaatccatagtgccctgttattgaaaggcggggtcttactacatagtctggttgtcctggaacttaaccatatggagaccaggctggccttgaagtcgggtcgcagaggtctgcctgcccccgcctcctgagttccactgagcccggctcctggtgcttctgaacctcggcagatgctctgctcttctcaggaagtgcttctctttcctcttctctaggaagtacttctgtttcctgccatgaagccagaggacaagaaggaaactgcagcgaccactgaaaccccagagagcacagaggccagcccctctgtctagaaggcacatgcaactatggtgtctgcatctcagcagatctggtctgagggagcgattcctgtgtggcgccgtccatctggccactgcagtccaacctccacaagagagaagaactaaagaagttctttttattcctcgttaccaaataaatcatttctctctttacccatgcagtgttactttttctcccccgggctgctggtctgatgagtggtctaattagagctctgtcattgtattctttttaagatttatttttattatcaattgtgtgtgtgtgtgtgtgtgtgtgtgtgtgcatttagagtgcaggtgccctgaggccagagatgttgggtcccttagagccagagttacaggcactgtaagctgcccagcacggaggctgaaaaacgaaggtcagccccatgggagcagggtgtgctcttaactcctaagccaacttctcggccccacctgcagtcagaatctctaataaatgtatattaatgtctgtctattcagtatgagccattgtgctgaaatactggaaacaaccagagaacaaaagtcaagtcac

SEQ ID NO: 34226 - DNA, 1236 bp, Mus musculus
gagtctcaaatccccaagcagatttaagaagacagagactgtctttttaaaaattactgtacattatttgtataaaataatgagggctgcctggctcccttaacttttgtgacaagatctcactgttcaggcttggttggcctagagttagttatttaaaccaggctatcctacagctcttggcaatcctttgtctcagccctcctagtaatttgaactacagatatgtaccatcacattctacttaaaatgggtttcatcctgaggtctctggaaatcattttccagcaagttcatcagaaattgtcctgggcacctctggtgccccttctgaaagttagagtctgttcatatggacactgagattgcctagaactgtgggttgagccctttttggtctcatatcagacatgtacattatgattcataacatcaaaataacagttatgaagaaacgctggaaccgttttgtggttgggtcacggcattaggaagggtgaggaccgctgactagatcccagactagatgatttggatccttttgaacatttcactcttattttctctaggccaaggctgccggtgatgacgaggccatgttcatagacgagaacttctgtactgccctggaatacgggctgcctcccacagcgggctggggcatgggcattgatcggctcaccatgtttctcaccgattccaacaatatcaaggtatgtacgcaggggccgcccagctcctgcttccccagactccactgtgctggggacagcgtagaggacctgggaaagaaagcagaggctcaagaggttccactttacgggaggagactggcgagcgtgtggctctgcgggattttagtctttcctgcttgagacaggagggggtactaatggtttgcttttcttcagtgtccagggaaacgctgagccctcactacatggtttgccttaaatcagtccgttctgtgaggtgtgaagacgggttttactggtgttgttacttgttgtgagacaggatctcatgtagcctgggctctcttggaaggccatcagtagtttatagtgactttgatataactcatattcctgcctctacctccagaacacagggattatgttggtggaggcctaggaggaaattcacttttggtttgttttgttttggtttgttttttttttgtttgtttgtttttccacatagggtttctctttgtagccctggctgctctggaac

SEQ ID NO: 34227 - DNA, 1105 bp, Mus musculus
agactatcatgacctcatggagatcacagagaagatgctgtcaggtgagtcctgctgccttcagctcatactcgggtggaagacggccgtgctgcctgtagaggagaacttctgttctccgtccttgagagggctgctttcttcccagggatggtgaagagcattacaggcagttacaagatcacctaccacccagatgggccggaaggccaagcctacgaggtcgacttcaccccacccttccgaagaatcagcatggtagaagagcttgagaaagccctaggtgtgaagctgccagaaaccagtctctttgaaactgaaggtaacatacaatactccaccatgtggcctgccttcttggtcagctccagatttatttgggttaaagctaaaatgtcccacctgttgtatttatagacattttacacagtgatgttccctgtcctaactcacacatttctgtcacagaaactcggaaaattcttgatgatatttgtgttgcaaaagctgttgaatgccccccacctcggaccacagccaggctccttgataaggcaagagaccatacttgtgctcgtccagtgcttaccagcaccctgatccctagggcatggatcccccgggagactcctcccctgcagcttcgcagggaagccttacagaggaacgggagaattcaaactctgaattggattgggaaatgtagctcggtgatagagtactcacttagcaaaccaaggccagggaaggggtggctcaatccccatccccagatcccatttgcctaactgggccgccttgtccagccgcagtgggagaggatgcacctagccctgcagagacagacgtgatgtgccaaggttggggtgatcccaggggacttccaccctctcagaggagaggaggaggggcactgcggaggagaccaggagtggggacacagtgatcaggatgaaaagtgaataaaataaattaatgagggaaaaagaaatataagcaaaagggagctttgaaatgtaatatttctcttctgccaaatagtgcatattatgttactcaaaactctgtcctttgaaaaagctacaaggtgaactcatctgtatga

SEQ ID NO: 34228 - DNA, 1224 bp, Mus musculus
acaatgaaagtctgtccttccttaaagtacagtaaacataaaggaaaccctccagcagttgtccccaaagcaggggctctgcgggaaggtttcctgagtgagacaggggtctggctctgcgggaagatttcctgaggaaggcaggggtctggctctgcgggaaggtttcctgaggaaggcaggggtctgtattctgagggaaggtttcctgaggaaggcaggggtctgtattcatttgtagagctatgcattcagttacctttcctttcacccaggaattacaaatcagaggaggaatttgttcatatcaataacaaactgcgccggggagacataattggagttgagggcaatcccgggaaaaccaagaagggcgagctgagcatcatcccccaggagatcacgctgctgtccccctgcttgcacatgctgcctcatcttcactttggcctcaaagacaaggtaagccccacagctgatctcggatgcgcgcctcctcctgtagccatcacagaaagcaccggtttctaaccgctcgctgcttttgctttaggaaacacggtatcgtcaaagatacttggacttgatcctgaacgactttgtgaggcagaaatttatcgtccgctctaagatcatcacatacataagaagtttcttggatgagctgggcttcctagaggtgacgagggcgaaggggtctttacctggaacggcgccgttttggctgtgcttgtctctcacggtcccgtctttcctttacacagcataccctgccagggtccgtcatgcccgagcagtgtctcttctacctgtttagtgctcatggggcaggctttctaaagaatgcaccatccctgtgctaatgatgccactttcagtgacgctggagggtctgtagcattaaaaatctctttagaagccaggtagcgtggcaccctttagtccaagcacttaggaggtataggcaggcaggtatatgcacacatggatactctaaatgcacatgtattctctctacatatggagtgcacatgtaaatgtttcggcagagttttattttttggtttaaatacaaattgtagtcatgctatgtgcactcttaataaacctgctcttttttatgtgtacattgcgtgctggtgcatgtgtctgtgtgcatgtgcaaaggatggggaggatgcccagcgtcttctataactcttagcctctttcttctttacgaca

SEQ ID NO: 34229 - DNA, 1620 bp, Mus musculus
aaaaataacatgcgtgtactcatcacctaggtaaacttgccaactttattgatcatattaaatatcttaagcaagtagttcaagacccattactcagcaagtcagggggaggggaggggaggataatgatgtcctcccaaaaggtctctgtcgctgcacagctgagggaaggatcttctcggtcacttcacagccagcctacatcactacttttgggtttctcggggctcttgagcacggctttccccggttttgtccgatttggtttgacttttagtaatgacagtttctcttcctcattggggtcaaggaagtggagtccagcctagaaactactggaaattgcagttccttggaaagaaaatatctctcatggtaaattcactagaagagcattcttgttttaattatagaaaatttctaaccattctaaagtagagaaaatagtgtgaccaaggaccctgaccctgcttcaacgggtgttcaatctttgtccttgtatctgtctccacctccccttcctgcacacccagcccgtcactacatggccaaacaggggaggtggcatcttgccagacctgttcactcagattccaaaacaatgaatgtgaccttcaagagcaagacccacagtttccctgggcacctgaaacacctgcctggtgcttggcactcagtgacctttccttttccttttccttttccttttcctttttttttttcttcttttttgtgggtgaatattgaaatcattttaacagaatttgtcttaaattggagtcacatgtcgggtgtcagttttcaaagaatagaaatcagacaagttgcattttatgacccacgcggtacagtgccgcagagatgtaaacatttagcttcaacctttcaaattcctcagtttaagtaatcagggacttcattggcccgggaggaaggcagaagacgaatcaggtcacatttcttcgccactgactggccataggggggatgctctgcagccccagtggccttctggtaggggcttgcggttttcagcagatgctgttccacatctgcaatctccatgctaggtcatcacaggagacagactgcacgagcgtggaccaggggtggccagtggtgtgttactaacaggcagagagagaagaattgaatccaaaacctgaccaaatctaggtatatccatgcagattgtagattttttttaaaaataagaggtggagaaatttaaatttcagttgataaaattgtttatcaaaattgttcataagaggtgggccctaggagttttgtttttattattgaatatcaagattgaaacgagaaaggcggggatgtacctggcaagggcagctctagaatggcctgaggtaagcacactgataattatgaagaggggccttggatttgtgggaggggagcaaagtggaggccttcgtgatgtattattttatttatctcttagaaaattggtagtgatacgtaatttacaatgtaagaggtcaaggggaaactgagcagcagcccgagggaccaatgctaacacccagattttaagttatgccagtacctggagcccccgtataatgggaaatgtgcactggagtattcaggactagt

SEQ ID NO: 34230 - DNA, 1111 bp, Mus musculus
gtgtgtgtatgtgtgtgtgtgtatgtgtgtgtgtgtatgtgtgtgtatgtgtgtgtgtgtgtatgtccgtgtgtatatatatatgctcagattattttctagctctgtgtgtgtgtgtgtgtatgtgtgtgtgtgtgtatgtgtgtgtatgtatgtgtgtgtgtgtatgtgtgtgtgtatgtatgtccgtgtgtatatatatatgctcagattattttctagctctgtgtgtgtgtgtgtatgtgtgtgtgtgtgtgtgtgtgtgtatgtgtgtgcatgtatgtgtgtgtgtgtgtatgtctgtgtgtgtatatatatatgctcagattattttctagctgttctcaccaggaagataagaaggagggcctaggatagactgctacaattgctggatttgtaagttctggaaacacccatcacagagtagaatatgggggcctcattaaaccaagggtctagtcatggttggtagtgaagcatctggcggtggcctgaactctcttggactgggccttcttcatctttgaaatagctgtctcggttgggacggctttctcacatcttgccgttggccttctctgtcagcagggctctgctgtgcatctaaagtaagatagtttctctatcttgtcactaaagccactaacactccaatgcacagtctcgccctctgaaaatatctcctgacctgtcccagtcccctggggcacagagccacctctggttgagcaccgctcagtctcgtcagtgctgtctactgtccactgacatgtcccttcgtgacccacacattgccaccagcgttgtttctaatgtggactttttcttctcaccacagggttcgagactgccaagtcctttgccctccatggcgcgcatgtgatcctggcctgtaggaacctgagcagagccagcgaggccgtgtcccgcatcctggaggagtgggtaagcgctctgctgctttgtttcctatctgtcaaatccaaacgtaccccgggctgagtgcacagaggtttcaacgctgcatgtatagttcgctgctcttggaataacatctttgctttctgagtcatcttcacgctgtttactgtgtgaaggggagggtgag

SEQ ID NO: 34231 - DNA, 1163 bp, Mus musculus
gcctgcctgcctgcctgcctgcctgcctatctacctacatgcatcagtattttgactgtgaatgtctgtgtgagggtgtcagatcccctggaactagagctataggcaggtgtgagttgccatgtgggtgctgggaactgaacctgagtcctctggaggagcagtcagtgctcttaaccaccgtatgtgcctatctgtgtgtgtgtgtgtgtgtgtgtgtgtgtgtgtgtgtgtgtgcatgtggatgcacttgtttatatgtgtgagtgcaggtgcacgcgtgccatggtacgtacgtagaggtcagaagacagtcgtgggtattggagcttgcctttcacttgttggagaaggagtatcttatttgccacaatgtgagcctgggtagctggctcaggagcttctgtctctaatgctcagtggaattctggaactgcccatgcttccatatctgctctcttgtgggttctcagtatcccccctcagaacttcatggcagcagggaaagccctttaacccccgagccatctctggttctcttgtaggggagagtgaccttgaacttctgccccctgctttgccctctcatgcatttagatcactgccttgcatcatctcatctagtttttcgggcactaggattgaacctaggccttccttcatacaagccggcaagcactctctcagcggagccacacactcctcgtcttgacgaggcttgttaaagaactcagcctgatactgtactctgagtcagtgtctcatgatgggaaacgtgtcagtaacaagagggtacctgtggttacctaggaaggaacttccctagctctttgtaatccgatgtcattgataactgggtcaaaggagactgcatcttcctttccgccccctcccttccttgttaagtgctatgtagtgtatttaccggtctgcctaagttgcccatttgacctttcttgtcacaggcccaggaaagactctttatcagttaataaattattcatcccctcgtagacataattggttgctaaaatattccgagttttctctgtcttcagaatgtctgaaaaattgtgcctggtccttctcctccaacttttccatctcatttctcattctgaaaattctgcgttgacttactcttgactgtatccaccattctt

SEQ ID NO: 34232 - DNA, 1149 bp, Mus musculus
cttctggtgtgaagaagaggctgtccctccaattatgcctcatccttctgtcttctttcccttcccgagacagagctacttacctttcttctgttcagtgcatctgaagattgcccatgttgaattataaggtgttgggacatggctgaaatcacaagccttcaatcataacaaagaattctgcaccttagtcataactacaacatgaattaggttagttgttgaaatgtttttttgtttgtttggttggtttttgtttttgtttttttgtttttttttttgatcaaatttttgtttggggaacatattggtcacaagacatagttcaacttctaacatttgaaacatgcagccttattgggaaagaaatttcactgagctcaaaatacaagaaggttgaatgttataccttgtctgtagtagtgccctgtcctgttctccatctctgtagtatatcctgttttaaaaaggacccaaactatcagtatgtgtgccattcattggactgcccctgttttgtcctgagcacatttattgcatttctcactgaattgctgaaatacatcagatgatccaggaacaagcatctcaacttgagcaattctaagtgatgttgagagtgccagtagaaggaaggtggcaggtgggatggctgtgccagaaaactgcttgccctgtaatctcgagggaagcagagtttggatcccccagttttcctataaaatctggggctgatggcgtgcgtttgtaacttctgtgctaatggtagtagtgaggtcgtggggcatagataggtcctcagaactttgagccagccagtctagcagaatcaccgagctccaggtttatcaagagaacctgtctcagaaagtgagatggagagtgactgacggagactctgtatgttaacttttggcctttacatgcctgtccccatcccccagtagtgtcagggaaaaaaaaagaaagaagtagaacacatgccaacacatgtacaagttgtccatcgtgcacagaagtgtttcaaattgtgctaagaggcagtagaggggcctggggaaatctgcttgtgtgcatgctcatgtgcacgcatgctgggtcttgaggccagagaaacctaaaggggggcggccgctaaagtttggagtc

SEQ ID NO: 34233 - DNA, 1162 bp, Mus musculus
cattggcctaacgtaattttggtaactctgtctgcttctgccttgggtagaaataattcacatttcactctccattttctttaatgggctaaacagtcagtctgtaatacctgtattttatgagacataattctggatattgtttctttagcatttgggtaagacaaacctgagagagaccagccatttacctcaagcaattgtaaagttatttgtaaaatgatatgctgtctttctttccttctttctctcttttttttcaaaccagttactttataaagttacattccctggcaaatgttaacacaacttctctgtgtgtgggctaaataaatattgggcaacactgaccgagcacagcctttgggtaaataattctctctccacacatctccctcccagtttataatgaggagttttctttctggccccaccaaatgccgcattccattttaaatgagacgcaaacctataggtgaatgagaagtttgaggaggcttattgaagaggtgtgaatgggcgggattacattctcttgcctccctctctgccagctgactagtctcccatctctaggacacatatgtcctagagacccgtgacaggagagatgtaaggcagacacttctcagaatgcccaggaggactgagagtctcagagcagtccacccctctgtgcaatcacaggagacatacttaggtttgaacttgaagaacactgactctgggccaatctgtactgtacagtctgatttcctgtgttgatcacgccccagcaagggccttgttttggctctgcacattgtggagggattctcagatggttgggatgtctcctgcactgggtattggtctctgccctctccttttccgtctgtagtgtgcaggtgtctacacccagtgacactacagagtcctcaaggtaacgagccgacagtggtcatcttcatttccttgcctgttactgtgacagaaatactctgacagggtcaacccagtggactgtgggtttgttggacttggagtttgagggacaatcggttcctcgtggcagggaagctgaggtagcaagcagccagtctgggtagggcttctcagcttagttcatgtaatcatgataattttccacaggcatacccaaaggcccatctcctatgtgact

SEQ ID NO: 34234 - DNA, 1152 bp, Mus musculus
tgtatgtgtgtgtgtgtgtgtgtgtgtgtgtgtgtgtgtgtgtttgtgttgcacatttaattcacatttgcaaattggtttctgtttttaactgaagtcactttctcagcagaaccgaagtgatgatgtcacttgtcatctcaatagtatttgatctgaaacattaaaatcgtcaagttcattttattactgagcacttttgaggaatgtaggtacatttattagttcatagaaggaccctcagattaaagtcatgttggcttgaacattttcttttgcctgtcttgaggcctctgatgttcgagatgctatgctttaagttttcttttcaagaatttttgcctaacgtgtatgttggaatagtgtggcagtttctctctggagtgggagggcaggatttcttaggtcttctgccactgagatgctgtctttctcctaagcacaggtgtgtccaattcattgtcctcgggctgcatgcgcccctggacagcctagaatgccaccctacacaaaattgtaaagtacgtcaaacaacatgaattttgtcattgttgttattgtctgtttgacagttagattgcatggttctctcgagcttgagctttgtaggtgacagtgtggcctagcccagcataaacaggtgggtcatgcctacagagtagtgcctagagtggaggtccctgacaaagactgggattcctaaggacagtttatttaaccatgatacctgctgtgctcagatccccgacctgggctgtgtgtttatatcctccgtgtgggactgatggcagagcaagatgtgtgtgtgtgtgtgtgtgtgtgtgtgtgtgtgtgtgtgtgtggtcctgacggcactaggaagttcatgctattactcagcttcaagtatggggatctctgtgtctggttctcagctctccagtcttctagagaggcctggtggcgattcggagcttccagggagggtgggataggaaacactttgtgaaaatttagtaggtccagaactgagaagaggggcgctgacaatgaacagacttcagcccttgggctaaagcagattgtttggttcttgttcttgttttttctcttcctcctcctcctcttcttcttccacctctttctccttctcttcttcctcttcttcttcct

SEQ ID NO: 34235 - DNA, 1173 bp, Mus musculus
agtgacccaggtaatagtgttccatatgtaggctggtgttaacgccctctttgtacatgatgctaggagtctccgttccctactgggacagcatcatctttgctcacatcaccggactaagcacctcaggaaagatcttggacaggcaaacccatggcttcccccatccacagtgttctcccggtagctcaccccatgctctgggtctttcgagatgtttctggggctagaaagaaatcccggtgtgattgtcaactgcttgatgaattggtctcaccagtgatccgcaaagaaagggccactttctaagcgacactacagggagagccttcctgctcacatgcttccgatacctgttctcaggtctgtccctagaagcagagctccacgctgctcccctgtgttctgggtggacttgccttcctaaggggaaggaagacagaggccacagagcagaattcccgacaagaatgtggcttccactgaaggttggcttcagtctgaccccaacaggagctcctggagggccaagtgatgctacccaaattggccctgcctgagacaaggctttaactgacggcagtccgtgattggagaacatctgccagggaaggcgggctatgtgggagaagtccctggggaatagggggaggtggcagattagaagcatgtgatcataattcatcaatagctggtgtctcctgggctgggtagctctgctcagagaaagggtctggggcaagaaggcggtactacagcagagtgctcaccttcagatggcagtactacagagtgctcaccttcatccagaagctcctctcaaacaagtcctccatgcagagaggaacagagcattcatgaaatgctctgaagtcaggtcttgcacccatgcattctacaggatcccccttctttgaccccagcacaggtgtgcaagctgacatcaggctcttcccgctgaaatcttctcaggctcactttctgcagtctgacctgtttcctcccgtggtgatcctcaagttaagttttgtttagtgaaacgcaaggctattcaggatgctgggctaacatcttcccgttgtaattgagtaaatatattatacacagctgggtaggtggtttccgtgctggcctggctgctatggtttcaagatggacaccatcttctttaaa

SEQ ID NO: 34236 - DNA, 1136 bp, Mus musculus
taaagtccttagtttatgttaaagttcacctcctgtgttgtacttactgtgagattaacccatacatgaagtcatcactccactcccatgcgtacagcagtttctccacttcaaaactctcttttggaagtgtgcttaaaactaggctaagcttcagagatggcagtcaggacaatgtctgctatatcagtgagaggaacagagttcagttcccagaacccacattttaaaaacaaacaaacaaacaaacaaacaacaacaacaaaagccaggtgtcctgtcttgtggctaataatcccagttctgcggaggcagagacaggccaaccagcccacctatgccaggcagtgagttccaggctagtgaaataatgtctctcaatacatcaagatagatgggcaactaaggaaacccaggggcacatgtgcaccccacaaagtgtacatgtatttgctcatgctcttgtgtgcatctacacacacacacacacacacacacacacacacagacactcacaactatctacttatgtcaccctctgccctggccatgctcaggggactaagaatatcttggcttgaccaccccagtgctaagaatgaggcagccccgggcatccgggttgctctagtaattgcagcaattgaatctgggagtcattgagcgacagtgtttcccttgcttcatattgctggtgtaaggactacagcctccatgcctcagcagtagctggggtaggcatctcctccttttccagcaggtcctctctctcctccctcttatcttttgttgggaacaactgttttttcttgagatgcctcacagagtattgcggcggataactcagcagccacgtagatcacaacagcattttcttccttggcttcattatgagcatttgttgttgttgttgttgttgttgttttcttcttgttttacttgtttgctctgcttcaaggcaaacctctctgactggcttcagagttgccatggagctgaggatgcgcctggagtactcacatgcctgcctccacctccctgtgctgggattacagaagtggcccaccacacccggttcattccgttctttttaacatcacgcacagctgttcttattaaaagtgacagaccccgag

SEQ ID NO: 34237 - DNA, 1748 bp, Mus musculus
ttcctggcggatggatgatgggaggctaacaaaacacagaagtgactttttgtaaaatagaagaatcagccatccagtggcttagactgtctacccacagtgtggccacgagaacatatgagaattaatcagagggtacctgggttctcggttccacatgaccagccccagctctagtcagcccagccatgcgttctttcctaataaatttttcattctagaatattccatcttttccgctcttatccactctgctctccccggaagcattccaggtctctcagattagaacaagggttttgtcacatgatgtcataaaaaaaaaaaaaaagaaattcaggaagtacccggagcccctcaaaagcacaggctccactctgactaaagggccagggtccaaacagttctagttcccaacctttccacagctgtgacctcagaagagagtccctgtgtgctttcatttgatattcaaacatggcaacactgtacgtcattgtaaaggaaagaatgctgtgtgcttatgcaggagggtcagtagtgggctctttgccgctagtctccctgaggtggggaaggattgcagttcagagtgtgtaagaaatggtgaggccaggtctcacagcctcagcgtatccagggtagctagggtcagagccaaaagcccccaggcacttggctccaagccacagcaatggattccctcagaaaagcatgtttggaaggaagattattcattttgagatctggagagctctagaactgttagggaatattctagagttaggcgactctagaaataccagctcccctctgtcctaactcatgagcaagtttcctaccttcattaagactctcgtgaaataccaggacttgtgcccaccttatggacttatggactgcactgaggaaatgaagggcagcaagcatttatagatacttgataaccatcactgccctgttgtgagaatctggccttgtgaaggtttcatgtcagctgcatatggaaactcgctgtgttatcttcggtccacatcactgtgattaacctagatggcatggtggcaaactctgttccatggcagagtaagcgtgggacagctgtttcttctatggtggaaacagaacttgactggaagtagggatgggctgtaatcccttccccagggctccaaaacctaccatcaagtgccacaagccagggatggactgttgagacacctcacagccaagccacaacacttgatgggcagttgctgtgccttttctccatacatcacagcttcaactcagttttgtgggtgtgtgattgataaatacaaccccgtctctttttggtataaacacatacggtgaatggtttgccctgatgaacatatttgctgactcccttggttattgatgtgtgtgtgtgtgtgtgtgtgtgtgtgtgtgtgtgtgtgtgtgcgcgtgtgtatgtgtatgttatacatatgtatatgtttgttttgtgtatgtatatgtgtatacatgtatatatatccatgtttgtttattatgtgtatgtgcgtgcatgtttgtctatatgtgtttgtgtattgtgttgtatgtctatgttggtatatatacagatacatgtatacacacagatatatgtatctgtgtgtgtacatgtatgtatgtgtatgtgtgagtatgtatatgtgtgtgtgtgtgtgtgtgtgtattcatgttaagaacttaaaatctattctcacccatttccactt

SEQ ID NO: 34238 - DNA, 1167 bp, Mus musculus
agtatcgacgcttggctcctgtgtgggccttgtgtcactgatcccccatgttgattctcagcagctataataaaagacggagctaatgaaattagcgtgtttgagatctcaccgttaacccgataagggtttgcgaagatgttcaaaagaaaacaactacagcatccttccttgcttcgggaggattatgttctccagtaagctttcttcctctctctccttttgttccaaggcccaggaaaaagctggcaggactcttctgcttgcaagggatacacccattctcctgggctccctgattcgaagtcactggtgcaggatacctgggcgtgtctccttttccctcccttcaccagggcagggagaggttcccttgggttcatctttggcccccaggatgatggaggcctttttagatccaaagccaaaacaaacaaacaaaacccatcagaaactgaactccagctctacctgaccactgcaggtttcccacgtgtaattgaattgttaattcattgtagcagagggtcccctgagagttgtggctgattaagaagttctgggagacaataccatcaccttgcctttactaggactgactgtaccaagcatctttccagcatctgactgcttctcaggtctccaaggtagatgggagaggggggtggagtgtgtttatctccatttggttaagatgggagtcagatggagcagaaagggctgtgcatggaccttgaacctgaaggaggctccaggttctgactggatcccgggaggcctttctgtgtgccgtgaaacagagaagacattgggcacctggaggttgtcagaggtgaaggcgaggctcaaacctgggccacctggcacaacttgaactgttcatttgctccaaattgtgccaccacagtggcctttcatgatggtccagatcacagacaacagttgtcaaggatgctgtgtatttcaggaaggagttgaagctttgtgggggcagagtgccctttcatccctaattgcaagggatgtctcagaggaccaaccacaccccttccttttgatgatgacctttcaacaggatttgctttggggagtgcttatctctctgcccatttgcgagtgagtctttagtgtgtttaacttcgagttttggggagctgtgtaaagcag

SEQ ID NO: 34239 - DNA, 1193 bp, Mus musculus
gaaaatgtttttcttgcaccgtaacattcatgcagtaccaactgctggcagcctccccggcatgtaaggaaatattgttgtaaggcttttatgttccatacttcaatcagcccggagccagcagcatccccacagaaggaccctctgcaggccatttgcagcattttgctacaattaaactcctctggttttagccctcaggcaatttagtacctttttacatatgcacattatgaacttttgaccaggttctcgcagtcatatattagagctctgctcttggaagcgggcttaacaagttcctctgagtattgggcttggagtcagttgtggaaaaggtaattgaagcagcttgcagtgagggccattcaggatctcagagatgatcctaaatctctctctctctctctctctctctctctctctctctctctctctctctctcttctcttgctctctcctctccccctctcacccttccttgtttcctctggaagctggtagcaagagctttcaaagtccgtgattgatcttttattcagtagctaacgagggctgtgattctattagcgtgctacaaggcaggagaacagtgatttaatgaagtgtctagtgagccggccatagatttatcctgttgtcgctaatttgcggcgcagtggcaagcataaaggaaacggtgctcacagccactattaggcaggtatttcccttagtaaattgttgtaaggtcaggtacagttatctgagccaaagcaatgcctcccctcttcagtgtctgcagatgacagccgccgtgctgagcgctcactgaagtggaactgggagatcagaggtccgtctctaagtcgcccttagcggaggcaggagcagatgaactgccaagaaggagtaatagagtcataattggtgattagaactgggaaaggtgtgataacatcttaatacaaactggcgtgtgttatagttactgtcagttgttgtaaactcgccccgccacccaggactagttctgttccccttgattagctctgagaaatgaggcagagggcactggaaggaccatactgatggcatcccggccagctgtgactgcttccttgggtcttgtccccaaccccagggtttttcttggctacctatgcctgtccccacccaggatgctaccacagtatcctttgcctaccaccttg

SEQ ID NO: 34240 - DNA, 1239 bp, Mus musculus
ttcctgcccttccccgggactgtcctctgttcagatgcctgtgtcctggtttgccaagaatacactccggtaaacacagtgaatgtccctggtattaccaaatccaggtaaaaataagacaggtggtgtggatttgcccatgtaacctgagaatcggtttttgtcttttatttcaagacctgtctcccattatcacggaggatggaaagtctgcttaaattataagctagctaattgcttcctcagttgaagacctaaatgagttttaaagcgaaatgcatatctccaagggctaagtagccagcacacaataggcaattgagatagcaaagactaatttagaaaagtctttgctctctccctccccgctccagtaccatgcctctacttctccctcctctttccttccattgtccctccatccctttttcttcatctccctcccctttttttctcttctgtccctccgccccctttcattcaccctccctccttcccttttccctttcttccttctcagccccatttccctactttgactcctgtttcctctcctctcctgcccctcccctccctctgtttccttcttcacttgcttccttcttctttctctcccccctcccccaccgacccccttccatttaaccatttggaatgcagcagagttgtatctgtgggtttctgctcctaattaaataaatcatttatgcatttaacacaatcttgagttactaggtgatcatctgaggcactcagaagtctaagagcccttgaaagccatatccaagcatagatattccatagcacgtcttacaatctaaatattgcttttagtgtaatcgaagcagctagagcagtcccagcagttgatggactatttttcaaattgatttcaaaaatgtatttaaggggatgatcttctagtctagattacctattgatttttaatatgaaaagctcattatgtaagcagtaactgcatataaaaacctcgcaaacctttgcataaatcctttaattgaatttccagagcctgtggttctccttttttttttaattaaatctatttctttttttaagtgttactgtgtaatttgcatgctgtgaagaggccctgtcccagataaagtgccattgatccttattaaacctcacctctgggcttgcttaaaactaactggaaaaattaaagggttcatgccgcactgcacttacagcgcctctgatgggattatggga

SEQ ID NO: 34241 - DNA, 1127 bp, Mus musculus
attgacattccagaccaataggagaccccacctgaaacaataagtgaaaggtgccagaggaaagacacccaggattgtcctctgacctccaccaccaaaaatatgcatgcacacacatacacacgcgctatcataaaagatcaaatatgaagtaagccattagaacgtcgtccatagttctgctacgtggctgcttcccagttgaaagtggagtatacttcactttgggttttatttccagttaagacattccatcagtcaagggccctgggcttgtgcctccctgcctgggaggaccttgagtggcctggtctccgcagatcgtctggaatcccagggcaaacaggccccttcagaaagagtcagcatcagcagttacacgcctccctctccatctgcaatgggattttgtgctcgttaccaggagatcaatagtgaaagctgattctgttaggctttcggcggcgggggtcattaatctccttcagcctcagtttccctatctgtgaagtgagtctaactgggatgataatgaagagttaggtcaagtgaggttggcagccagacacctaccaccagctggaacacaagaacatatgtttcctctacaacccaggtcagccgaggtcctcctgtttagaataatgaactgccatgtctggagtcttctctctcttctcttggtcgaatattcaagtagaaactgtgctttgttcgcccgctgacctgcacttcagtgccagtgacaactgggagaaaacaagagggtgacaagcgattgtctttcctatgcatgggtgtgcagatgcatgcatgtaatgtcatgtgcatgtgtgtgtggatgcatgcatgtcatgtgcatgtgtgtgtggatgcatgcatgtcatgtgcatgtgtgtgtgcacggatgcatgtgctatcatatatatgtacatgcatgtatgtgtatatgtaggcccttgggtgtcattcagtttttgaaagaggatcattgccccggagctcatgaaataggtgagattggctggccatcaatccacagggatctgcctgtctctgacacctcagtgctaggattgcaggtccatagcaccatacccagcttttattttatgtgggtcctgagg

SEQ ID NO: 34242 - DNA, 1099 bp, Mus musculus
gaagtctcgctcctgtgctcctaaaatttcatattaacctgagaaagagaagaagaaaaaaatgaaagggaatctttcactctttttttattttactctgtccagtcctcagaggtgggcgctcagaatctccccagtcctacccacctactggaataccctgtgaccggcaagggaccgtgtgtctcactgccacacctgtccagttccagcaatgtcacgttcaccagctggctcctgttagaaggttgaagctgattaattataacttaccagaggcctgttctacagtaagactcgggccctgtctgttctgtaccactgtggaacacacaggagaagcaagattcttctaacgaagacaaggtgatctcagatgaagaggtcagcccagatagcattgcttgctacctgtccacccaaccatgagcaaatgtgtaggctggaccagcccgtgttctgatagaagagaacactagcgatttctctgtgtgctgctctgtttaaaggaacaagtaacggtaataatatctgaatataaattaattttgaaaggattggggaggtggctcagcaggtaaattgtttgctgaataagcatgagaacctgaggtcagatctccagaacccacttaagaaggctgagcacttggctccagctgaggaaacctaggtagagatagagacagatcctagggtccctggcagccaactgagctgaaatggcgcatactgaatcaaaggggtaggggaaggcatgtatagagagtagtagaggaagacatctaatgttgactctgtggggaattggtgtgaacatcacgtgcacacgcatacatatacacactacaaatgcacacaaatataaaaccgtactgaagaaaaagcaaagacgggagaggtggctcagcatcaagagtgctcattgctcttcttttaaatgacccacgtttgctttccagctcccgtagtaggcagcacataaccacctgtaactctagctccaagaactctgacatgctcctctggcctctgcaggcagctacatacccatcgcgcgcatgcacgcacacacgcacactctcgagtgcacacacac

SEQ ID NO: 34243 - DNA, 1207 bp, Mus musculus
cctcctaagaggacagaaccccgaattgcatgtgtagcaggaaagctgctgctatccagtgtagtgcgcacatgatctgttcttcttgcagggtgactttaaggcaggtctgcacttgaacctctctcctcctggagtgtttggcacaaaacagcttaagcatacagcagaacacaccctgggtggatgctttagagacccctacgctttataggaatgggaggctccgtgcaactagatgattctgaatcagctcgctcttctttgaagctgatgccaggtgcgtctcttagatttgatccgtgtcccttaatcagttttaactatctccaattacatccgtttcagcctcgtagtgtctctgaagacaaccttttaaagcaatatgtgtgatgacatttggtctttatgatggcttggtgtgaagacttgtttgtctagcggttctcagttgggtgatttggctttcgcttaatatttggcagtgtctggagcgaaaagggactaggggcagaagctccagccatcacccattggatggagatcaaggctaggtttgatactactgtatacaggacatccctgtacccctaaacgtcagcaccgtctaggttacggagctctgtacgtccagtgtgggaaggttcaaggtgtgtatgtcctgggacaagttgacagggcttataacatggcgctagctctccttcaacctcatttactgtgggtaattaggagaaattaaacagaagactgctgtcacccggtgcctatctgcaaagcatccaaggtgctaattagagtgttttgttgccagtaaaaacaagagtcagagtccatgattgattcatgattattttaaaattaatgccgctattatcatacaaagccgcggtaagtgggggtaggagaccctgtaccgggggatgctaagtcaacattgcagtaaacacacagtaaacccatttgtctcgggcttaatactttgttgtttcttctaagcacttcttagacgcccatgggctttttaacattctttgaaagttgtaatttattaatttttttttaatttggcttgcaagagtgaactttagtgacggctctgaagagagtgaaaagaaagagctgtttgtgtatcagcagctctggagcttggactctaaaagtcaacccagcagggaaacttggagttcctagactctgggctttc

SEQ ID NO: 34244 - DNA, 1136 bp, Mus musculus
ggccttaggtaatccaaaaggcaggtgtatgcccagtttttggtttttggtttttattttttataaaagactcagcaatactttgtgagtaaatggttcctacatcaaccttctaaactggcatgatgtcaaatgataattcagggaaggcatttctacaggaagcagagataataagccccgagtgcttttgttttctgcctttgtttcttaatgcagggaaaaccttcagcctcccagttaaaaacccagatgaggggctgggagtcgtcacagtctgacccctgaggacattagtccaattttgttctgtaaccagaacaagtagcaaaatgagacaggacaaaagaaacaagagataacatttacttctcggtttaagggtgtgcatgtgtgcatacctgcatgtgtgtgtgtgtgtgtgtgtgtgtgtgtgtgtgtgtgtgtgtagtgggtagaatagggggttgtgggaatgctttttttcttaccgatgtcatagctctccatccagtgtccccagggttcctcggggacacaggctgatttccattgtgtcatctggtacaagtgtccctgattgccactagagggcgtcacaacagctacaaagtgctttaatctgaggtgtcctatgtcactggctctcagcctctcagctgcctattggctagacttgactggtgtctccagggactctgatgtaagacctctctatggtcacaggggggaagaaaacaagacgtcacatcctgcacctttactacagggttgcacctcaggtccgggagagactggcatataggttgatatgacaaagtggatgacaaggccaaaggacagtagcttggccactgcagctttaacctgcactataaacagaagcccagataaccccataggaacattgtgttggctgcaaagcatgcatctaccaagtgctatggtgaacacttcaaatcccaaatggcatgcaatataagaatctcaacccagcactgctccctgaattaagggatctcaaatgtcctacttcctcgagtccgtgggtccccagaccttacctgccatgctctgtggattgtaaaggaccatatccccttagcataccctcatgatctgtcgatgggtgttga

SEQ ID NO: 34245 - DNA, 1140 bp, Mus musculus
catgagaggggaaaagaaaaaaaaaacgtatacatgtaaaataaaataaataaaagctggaaagaagaggaggaagggaaggttaagatggaggaaaaagcaagtccctgccctagagatgtcacaatcgtcagcattcattgtacaccgaatgcacatttaaactattctcctgcgagggagaaaagcaggaattcagtgctcttatctctgcacagagctcttgagtgagacaggagtcagaggaagtgggtcctttacccttgaaatatttgttcttgtgagtcttttccttggagcatcttctaaatgtttgggaaaaaaatgtgtgttttctaatatcctagtctccacgcccagacagctgctgggccccgtggctcaacaacaggagcaggcagagccagggccagagctagcatgggtccctccctgcccggtacaggcaacgctggcttcaaagcgcaagttggtctctcagggtaattctgatgacctcagtcctgctttatggagccattgtagaactcaggctgcccagtgtcagatcaggggccactatgatgtcttccaataaatgtcctcctaatggctctctactcagaagagatttatctgtttcctgcagcagaatctcttgttacgaaatagactgcagattgcaggctgtgtggcaatgtgtactgggaaggagctcctaggagaggctgcaagtgtcagaggtgtacatcctccctcccaagatggtgctacctgaatgacggcatgataattcgatgtgggagcataggggaagggcttgggacctgcatccctagaggtaggattggtaatccagaggctctgagttgagtgcttttgacatgcagaagcaagagtcaagggcaaagctgcctttgaaaggctatttttgaggcgtctactgcagatgcacttgagcttccttagagcaaaaccagttagtactgcatgcctagcgggcaaatgcgtgaggctccttcacatcacggctgtgtgacattgctaaaggttcccagcctgcttgtctgcttgttctctgaacgttgcccgagcttccacattcacagaagcccacagtagcatatccctccctctgtggtcgcaggattcagctaaaac

SEQ ID NO: 34246 - DNA, 1126 bp, Mus musculus
tggaggtagttctcatctctggtttgcagggagtcagggaaccaatataaggggggaagatgaggagggagacacagagactccttgtcttgtgtttctgcctttgttaccactagagttggaaaggaggcctggcttacatggcccgggccaggtatgtgccaggaagtacatgtgcctgctggtataaggatctgactgtaatagtccggggttggttgtttggtttgtttcttccttccttccttccttctcctctctctctctctctctctctctctctctctctctctctctctctctttctttctttctctcttccttccttcctttcttctttctttctttctttctttctttctttctttcttcctttcttccttccttccttccttccttccttccttccttccttccttccttccttctttccttcctttctatttgggtgtacaagcatgtataggtgcatgtgtgcatatgtacacatggaggtcagagaccaaccttaggtgtccctcctccctttggccttccaccagtgcatcaattaggttaggctgtctgctcagcaagctccaggaatcctgtagtctctgatttccccagagctcagatcataaacacacgaccccatttcctgctttgtgtgagggatctgggaactgagttcaggtcttcacgcttatgggacacatgttttacagcactctccatcctgcctttttgtgatttcaaggcagggcctcgtgtatccaggctggtcccaaacttgctacaggagtagcatgaccttgaacacctgatcttcctgcctcttccttctgggtgcaggattacaggtatgggtgttcacacccatatacgtgtactgaggattggactcaggtttatgtgaatgctaagcaagcatctgaatgtagcagtaaattcccagtagcgctcatctggccccagcgggcttagactctgcatctcaccggcattccacactgcccatcctgattcttttggaattccctttattggatttttattgtaattttaaaagatttattcattgttataaatgagtgcacactgtctgcactcgggcccatgagccaccgtgtacgtatagaggtca

SEQ ID NO: 34247 - DNA, 1167 bp, Mus musculus
acacccacacagagacactcagacatacacccgcacacatgagcacacacccacacagagacactcagacatacacccgcacacatgagcacacacccacacagagacactcagacatacacccggtgagaaataagaccaatgtttaaaggacgaaaagaaccttaccttagcctcttcccatctccatcgaattctttgtcgcttgtatgaggaatgcattgatgacagttatcctttcctttctcctggtatttgtatatgcatatacccatgtgtgtgtgtgtgtgcatgcgcacacacatacacatgcatgcatgaacatacacataggcatacatgcacatacacacataaccacacatgcactcacatacacacatatatacacatgcatgcatagacacacacacacacacacacacacacatgcacatacactcatttaccatttcctttgcaattagtataactatgccttagactgatgacttaaaatcaacacaaagccatacctcatagacctagaagctgaaaagccgtctgcccgcttctggtctgtagatgctcattcgcgccgtgtcctcacagagtggggggaaagagaaccctctcagagtagtgtatgaaggtgctcttccccatccccatccccaaaggctctaccctcatgaactcattaccttccaaagcccttcctcttaataccttcatctgtgcagagttaagactttagcataggacccatgggtgaaggagaggcagacctcagtgagattagtggacatgatccaagttgaactaaaactggagtgggtggcaggaccgtgacaaacttttctaacgtatacacagccaaacgattaccactgtactgttctctaagtagactgatcagtcccaattagaatggtggtcacagggttggaagtagaactcagctggtaaaggattagcctagcatacacaactctgtccagtcctcaaccctacaggaagccaatgcggtggcccatgcctcaagcctataagcccagccttataaggtggaggcaggggagtaagatatttaaggtcaccttcaactatattgaattatattgggagttagagggccaggtgagactgcctctgtggccttctctactgttgaatctgtgtatattc

SEQ ID NO: 34248 - DNA, 1156 bp, Mus musculus
tccctcccttccccacactctggcaatcttcttcataatgggggtttgtctccttggcagttttctgaacggtagccccagctgcaacccagaggtctacagtgaccccgtgctaatcatggaacaatctcttgctaatcttggaaccgccgaggaggaacaagaagaaaagatgagagcccgactcagagaaaaagagataatgactgggtggctactggggcctgaagaaagacgaagaattggaagaagaaaagaaataagcaacttcaggggggaatcttggggagattctgtgccaaataattaaataaatgattaaaagacataaatacagaaaggaaagtgggtgactggtaaatggacctccttttcctcttcctcttctgtcgattttgaacccagcccctcatacatgtcagacaagcactttaacactgagctacaccacagcacctattttattttgatgtgggattctaacgtgacttctaacagccttagtcaacacgagtgttctgacagtcacaactctaggcttacgaactttcccaggatggttcatagctatccttcagcagagctgggtccattcccttcaagaaaggaaggagagaaatggctgtaagcctttcttcgtggtcagactccagaaagccaatgttcctttcttcctttagactgggcgctagccacctcacatcatcagcctcattttctgtcttaacccttgcctgttcagagtgcactcctgacaagctgccgtgtatccttggagagaggcataatggacacttggctccaggacctgcgaagagggactcaacggacagccacaactctaggcttacgaactttcccaggatggttcatagctatccttcagcagagctgggtccattcccttcacgaaaggaaggggagaaagggctgtaagcctttcttcttggccaatgcttccagaagcttctccaaactgttgtagctagcttttctgctccttggagagaatgttctgaccaaaagcaacatggcgggaggaggggagtcctttcatcttataactcccagttcacaatctcagacagaagtcaaggtaggaacttaagtcaagaacttggaggcaggatggaaggaggcctacttccttactggc

SEQ ID NO: 34249 - DNA, 1238 bp, Mus musculus
ggcagtgagagataagggctcaatgtgtgtattcagaaaggaggcaaagctacccagagcagtagggagtaagacagcatgttcccggggtactgtggtttcccttgctgtaagggaaaccccaccttacagacaggaagcctcatctagtgttacatggggcactagaaagtcagatgtgacacttaagtacatctgctgccaaaaccgtagctcttttcatggaacccctggtttagagacaaacagatcccagacttgctggaatctggctcgggagcccccagaattaaatgtgtatgaccttttcagtgtagaccccatccccaccccaagttctgtgcctgtaggatggaagcctgcctgtacctgtagtctgtccctcaggaagcccaaggaggaatgacactgaacttgaatgctaaaatcttaagccctgtcccagggaccacctccttctacgcctgataggaagaatgtggtacagtcagccttgacatggtcaacatcaagatcattaatattattatcttcttccctctgtcatgacaagcactggctatcacatgagagagagagagagagagagaaagagagagagagagagagagagagagagagagcactctggtgttagcttttctatatggcctcagtgaagcccagtttagatgccttggaagccaggtcacagaggaaaacaccttgtgtcacacagggctcaaaggtagctgtggcaatgcagaggaaaccctgacctaattgtactggtaatataattctgtaactcacccagccactgcaaaggtgggtggacagttccccgtccctacttccccctgcacaccaccctgaggtcctaggagagaagtctgcactcgagctgcaattttaaggtgcctcgaacaggtccctgctattaagagtcggtggttccatgtcaatagaagatagatattaaatgaaatccatgttgctgttgatacaatcagccgctctccagctcagatgaaagcttcgataacacagaatgcaagaggagggagctaagggttgttgacttcctactacacatcactggctccactagacacctcagaaacctcagcacgaaataccttgtcaccaaacctgatatatcaatatgcttaagcatcagacactgagagctgatgattacaatagaggcatccagttggggcatagtctctgctcctgttctttggaataaacaggct

SEQ ID NO: 34250 - DNA, 1301 bp, Mus musculus
tcggggtaccactgcagggtacaggctgtgctttctgagcaggggtctcctctaacacctttccttacctttggattttagaatgactcctaaaggagaaaaaaaatcatccatacaagtttctctctctctctctctctctctctctctctctctgtgtgtgtgtgtgtgtgtgtgtgtgtgtgtgtgtgtttgtttgttgtcttttcaagtctaaaatccctcttaagggattttcccaaagggaaaggcagaaaaacccaaaactcaatgagagaggagtgtaaaatatccacagggctcttcccagatagagaagggctcctttttaaattagaagccttggaggacaaagcctctaattgttatacttgtgatgtcagggctatcaatattagggcctttttcattaataaagtggcaggaataggaaccccctccaacgcctcccccccttatctctgagcactacttcatcaaggcaggctcaatcgaaaggaaagagaccatagaactcaggggtgtgctctctgctggccagacacagaagaaagggagcctctatcccccctccatgaagatgccaggctctgggttaacccgagcaagaggtacttaaaaaaagccccgaaaatctcaggcgactccgagaatgcctcaatttgtgtatggattaacacacggcggcgataggccctgagtagcaaaagaggaacactaattacctgacagcgttcccctccactcggcctgggtcattgaaattaatttctgctttcaggtttggcagcaagcagctgcaagatctcagctcaacactcaaatgagcggggagctgaaatggtttctccgcacaggcggagtcagaggagtgggctaccaaatagatcttgatcacagacaccgaggagaggattagtttgctctttcatcaagtgcctgaagtccttgggaagcgcggatgggcgggaggagaagagaaaagcagcctcagtgtatctgagagctaacaccagactgctctgccagatggggtgtgagaactcatggtagatcgcctgtcccccagataagccgtaatttctctccattctcaacaaaaagttgaatgaatggtgggccagcacgcgcttgcgggcacacacacaattacaagtcaggataatgtgatttgtgaacatccatcctgcagcatcctgtgttgtcaagatggtatttatttcctatttcaaggttgaggaagtctatgagggagggaacaaagaggtgaaagggcctgcgtttgggcttcaaggaggata

SEQ ID NO: 34251 - DNA, 1748 bp, Mus musculus
gtgagcagattgttaaaacagtttcagatctgggctggaaggatgccagagtctatccttcaagccctatcggaggagtgaggagaagccctggctttctccttgcttctcactgagaacttggatgcctgcacatcagggatctacctcttgtttgtcctaaggccagccccctgcctcccttcttctcaccagcgcaggtgttcagcttgagggcgtgggtgaggagtccagcgggcaacacccccaagccacaaaaacaaaagcccctctgctgtcagagtggttggggagtcagggccagctgcatcccaccaaagtgggttccacggaactgttctcctaactgtctgttgttctaagccttggttctctcatctataggatgggccctgcccttagccatcaccgcaaagaggtaaatgttgtataaaggaaatagtaactggatgccagaaacagatggtagctgtaaccaattgtattcctgtcattcattttcttctacgaggaccagctggcactggcctggctgggactgacttaaaggaatgtggagagccgggtgatgataagtccggtatcctgaagaagcttgagagcaagacccctggtaacttagaatgcatttgcaagccaggtatagcacatatggccacagaccctgtaacaaggaagccctaataaaccaggcatagtagcactaatggctttaatctcagcaccgtaacaaaacttccactttccctgagcctacaagaagagacattcccacctgctgatggtgctacccaccttcaatcccagctcttgtgaggcaaaaacaggtggatctctgtgagttcgaggccagcctggtctacagagtgagttccaggatagccagggctacacaggataaccctgtctggaaaacttaaaaattgattaattaactaattaaatttgattaaaataaggagagacactccccaacacataaacggccagatttattcggcagaactctcatcagagcccaacgcagagtttgtctgtcatcctctttctgcctgtctgtctgtggcattaacaattcctctaataagcttcttacctaaggatgatccacttcagagttctccttgaagcccaaaccccaggacttttcacctctcagcagctcgcctgccttcctccccagctccctagacacagccatttctccatctgtttggagtccccagggaccccactgggtagtaggattagtcagacattttagttgtcttctgaccaaatttcccccagccaaagcaccctgactctgcaggactatggctggaccacacccccaccccaatttgtagagatcagccaatgctctggattaccatggagataacgcacacgtgcatgtggctccagggcttttatgtgtgttggcgtgtgtgtgtgtgtgtgtgtgtgtgtgtgtgtgtgtgtgtgtgagtcatgtagcatctaataagttcctcacagaattacatacacagtgtaaaaaaaaatgcatcgtgtctagtttcttttcttaccagatttggactcctctgtaataagagctaataggttagcaagtattctttttatgcatacagctgtttatatagcattgtgcagttcctaacatactaatgacctcagtaaattatttgatcacatccagcatctgatttgactgacaccctcttttctttttagacattcattctttttaagtgtgtgtaggt

SEQ ID NO: 34252 - DNA, 1670 bp, Mus musculus
attccatgtggctgcatacgttaaatagcttacaaagctatagagcgctgcctttcttgtctcagaacttttcatcataaagttggctcggcctcctcagcctgtatcttaggggaacaagtaaattaaacaagtaattatatccataatgtttttagaagttagaagatttaaatatatgaatctcatctgagcgtgcagccttttgtctgcggtgtttcctgccaaaagatgtcttgacaggaaataaacattaaaataatctttaatcccttgtctggtctattgccattaacaattgatgcactttaattttgcgggattttaactacaaaatggaatggctaagtagtgataattgggtttggaattatacggccatttatatcaacagagatgcaagaggcagggaggggaggtgattaattatttactatttcctggctgtggttcccattatagaattttctgatacgttctgccgtgaacaattatcaccaagtaagaataaacaaagctgtgattcgaagcttagaacttagaccccaccaaggtgacgtggcttgatttccgcagtccctctggacttcgtgtgatccttccctcccccctctgcccccatatttatgtgtaagcttgctcatgtttctgcgtgttgcttggttttcttctcctttttctcttgggtttattggtaagggctgcagcatagcttaggacactcccatcgcgccccaccccacccccaagttctggggttgtaagtgtgagccacaatgtccacccgagtctttgtgtgtcttagactccaacaggcacactctgaggtatgaatgaccgcttgtcaagttaggacaggaagttggggctccagcatcgattcttcctcctcaaccatttcccagcataactgagaaacgagagcagcacgcggcggtacttgtcacaagcatccctgcacatctgtgatgttcactggagtgatgccatcagaagggagcatttctagtagtagtggttctgggtgggggaaatgtgtgcatcttttgaggacttgagcgatagctcagcagttaagagctcttgctgcttcttcagagatctgggctggctcagtccccagctcggctctcacatcacgcaactcaaaaccacctctaactccatctccaggggattgaacaccctcttctgacctctggggatacctgcacacatgtgcacataccctcacacagacacagacagacacacagaaacatatacacacacacaaaattaaaaatataatatttttaaaatagccaacattgaaataatctgtttagcacgagttgccaacttatctaaaatgtcacagcagtctcctttctgcccttcccacggagaaatgcctgtgacgtcccaggacttagcaccaactacaaaggagattgaaatgacaggcaggtctagtaaatcgggaatctgcagtctgtttttaaaatttatgtagttctcatgtatttgggggttctgacgctgtcactttgtaaccgttaagcctgatccccaagtcttgccgttgccacccctgtctatattgcacattgattttctgtgtgacattatctgcttaatacaaagtgggatagagcagctgtttgtccggatttgtcccgttccttatc

SEQ ID NO: 34253 - DNA, 1126 bp, Mus musculus
cctccctccctcttccccaccccccccccattttgcctcattaagaaggtcactgtccttcactttgcttaggcagagttctgagctgtggcttccctaggacgacctacctgcccaatagccacaaagcctgttagctttgtgaaccctggaatcagaggagacctggtgcctggtgaactggctgcgtgatagtgaactcaagaactccgctccagtttcatctgactccaaggtgtaaacaaccttgcattactttcctgggctgatgggaaagttggactaagagaaggcggtggacctggtctgtctaatagataaggtagccaatggcccggggccactatttacatttaaattaagatttaaatcaggcttggtctactgtaactagtgactactagtacactaacctagtgtactagtacagtacactaacctagtacactaggtagtacttgggggctgttggatttctgtggaactccctaccaggcagaggaggaactgtctcagcttaggtacactagttcttaattacatcacttctgtgtaaggaaacaacaaggggcacccaggcactcaaaccagaaccttttaaccaggaccccccacccccaccccagccaaactctggttggtgccaccagagtgttcctttgtttacagtaaaggaaggaaactggatcaggctgagaaaggttctctgcccggtggagtctctatggacaggcgggatctcgggggtgggagggggtgcagaaagcccaatctcagaggagtccatgtcgcaggtgttaaacctgattagccaagccgactccccgttaattccctgaagtggacaggacagttccctctgctcagcacaaaccttagcgtccgtcctgagtcagccagttccaccctggtggcctcagcaggctgccctttaagatggagcctgttctctgcctagaacagagagagagagagagagagaatccattggtcaactggtccaaaccaaatgcccccagaccccagcctgcctgccgctttgcattctcctgctctgagtccagggttggaggtattcgtacctagctggttcccaaatattgccgaagctctctgagttcttggg

SEQ ID NO: 34254 - DNA, 1107 bp, Mus musculus
ctctgcctctctctctctctctctctctctctctctgtgtgtgtgtgtgtgtgtgtgtgtgtgtgtgtgtgtgtgtgtctttctctcagtctctgtttttctgactctctgtctttctctctctctgggcctgtctctgtctctctcttatttctggaacagtttccctggaagagtcttacagaggtttgttttatttttttttctagctagttttatcccatgacaagatgaaagaggaaatccttctggtgggcctggagatgcttggcagagtctcacttgatctttgtttcaatcctctgggaaagagccgtggtgggttctcagttaggaaagaagaagacccatgtgccaggatgaaagtgcgcttgaacttgacttttgcagtcgtctgaaggtccctgcatagatccttctcttttgattgtcacaatgaatggaagagaaatgggtgtctgtcgtctgaggggttcttaatccttcaggttctgattaagaactctctatggtggcgatggctaattctgtgagtctgacgggacctagagtcagggaatagacaagtctctgggtatgacttccagggattttctagattaagttaatttgaagtgggaagatcgaaacaggggtagtgccaaccgatgggatgggtcctggactgaatacaaaaggaaaatattacctaaacaccaacattaatctctctctgcttcctgactggttgccctgtatctggtctcttcttcaagctcctgcctcaactgcccactcattctgggctttgttttccaactgtgagtcaaattgtacctcccttccttcagttgattctgttaaatgatttatcacaacaataagtaattaacatagagtggaagaaacctaggtgctcttggaagtttccaaagccaggatagcctgcttaagggttatttaacattgtctttgtgatatgaggagaacacttgaatctcatgttccttaaactatggttttaatcttcccagggaactggtggtacacacctttaatcccaaccttcagcagagaggcagagaggcagagaggcagagaggcagagaggcagagaggcagagagag

SEQ ID NO: 34255 - DNA, 1101 bp, Mus musculus
cagtcagggctacacagagaaaccctgtctcaaaaaaccaaaagagagagagagagagagaggcgaggagggttttgttttcttttttctttttttcttttcttttttttcttaacttaaaaaaaaatgtggtacagtcatttaccatttgagccacttactggtggatgctttggtggcaaaggggacagccagtgctgtagtatgaacatcacgtgacacagggcatccaatggtgaacttggtcctgaagttaccagccaccggtctcaactcgcaagatgcctttcagcctatggtaggaaggagcagtctgaggcttgtgtatttatgttgaagcacaggcagctgtttctttgggggcaattagctgacctctttgagcctctatgtctgtctatcttggacccatcatttccctcctttgcatcggatgatctgaacctggagtcagtgggtaccacacagggcaactcgtcacagccccatctctctctgttgtaaccctctgtgatggttaaatgctagctgaccacccatctctctctctctctctctctctctctctctctcgtgagtctgcactttcctatccttgattttacgtgtatgtgcccctgagtgcagtacctgaagagaccagaagagatctcttggaaatgacgtacaggcagttgtgagctacttcactgggtgtcgggagccaaccatgagttttctcaaagagcagtacagtgctcttaactgccgggccgttgctcccgtcccggcttgaccttctgtaaccatgactcaggatgtatgcagcacctgcaaaggctgacaggttctggggggtccctcagcaactcattggagacccatgggccgatgcgagaggagcagcccaactccttagtatctgtcgccactctcagaacttctaatccatagaagccatgtgaggtttccatccattgggagatgcgcacaagtggttaaaattagtcatgcattcttggtccgctgctgcaggaagggtgtcttcgcccgtgagagcgattatgacatgttaaaacggggtaatggtaagcagacagtccgaggggctgcagggcaagc

SEQ ID NO: 34256 - DNA, 1142 bp, Mus musculus
agttctcattggccaggttgggcacttttatgggaatctcccctcccattcgtcagggctggtccatgagtggctgtggtcccactgcacagatgaggaaagtgagtcctggaggacttatattccctgccatgcagagaggaaaggggggagggggctttttaagagttcaaattaaaaacattaaaacctttaaaaatcccatagctttttacattgagttacccatgttaacaacagtgtggggatggggaccgagatattcaacatttaggtttggagttgatagcccgttagatcagcgtggagcgtttggtgtttatttattgcttcccccacccttactgttagggatatataaactaggtaaatatttattttagtagagaaaaataaaagtgaagaatgtgcatgtggaaaatagcggagcatgaatcaggcgagaggaaatgttttcgggtctcgttgagaaatagctaaggagggaaaattacagatcttaaaatagacgcaatatattatacagctgtgaaaacgggccaactagattgcctgcattaaagccgtattggatgttcaaatctcgagttacctggaatgcgactgtacttcctatatttaactaggctttttataaactcttcctttaacacctcaagctcacaaacatatcccacgtggttatttggtatcaaatttgactttctccactctgagagtcctcagtaggaaatctagaagtcagtcttccagaagggttctactgttgtcctctccttacatctccgcatcagtagtaaatagtctgcgatgaaccaaaagctggagaaaaataggccggcatacagaaagaacttctaagtccttttcgctctaacctgacgttcgagcaaatgtaacagaaaacattggcgaacttggcccctggagtatctttacatcggaagtcccacctccacctggaagtcccacctccatccagaagtcccacctccatccggaagtcccatgtcttgttctgttatctccattgctgccttgccttcccctgtctgcagtcagtggataggtacttagtgaattttcagatagtaggcatccagtgtgactgcagacagcctgagatcaatgtgtctgttagg

SEQ ID NO: 34257 - DNA, 1116 bp, Mus musculus
gcctttcttcttgaatgctgtacccttgggacattttttttcttttatccagacaattagtgtttattaaggaagacgctcatgttctgacccaccgaccagagatgaacaaagccttcagaagttctagttgtatccctcagcaccggtgactgcactggtatagttagctatgggtttccttctgtttacctgtgcacagtttttctttctttgttttacgtatgtgtgggtgtgtgtgcatgggaaggtctgttgctgtacacggttgatgctgttaatcatccttgatcatctttcgaccttattaattgagacaaggtctttctagcaaacctagaattcatatatgggctggtctttttactgcggccattggcatacagattcagatttgtgtttgcgtgtctgctttaaccgctgagcagtacagccaatggttctttgtcgtggttggttaggaaaacaagaggaggtgttctcatgatcaactgggcttctggccctggcgagctgcttgggagggtctacaggccttcagttaaagagtcgaggagtcaaggtcaggagctctatttactcagcagagggctgataactcgcttacagtacttgccccatgggtgttcctcatctgctggagaggtggtgtcatgcctaggtacagggcttgctcttaccacatgatgatgaagactacattgggcgacatagtctagattctaggtctgggtaaagcaggcttagttgctctcccttgggtcatgtcctattttgggaccataggggctttcaatgctaattatcttaagtctgtgtgatgatacagaatgggtagaaatattcattaggtaatacctaccaggacagccatagtgctcgtacactgttcaacatccccacattagttggtcagtcatcttgctctgagatgcccaggtgtctctctctctctaccttccacgggaattcccagtcaactcaccacctgaaaagttaatacttttttttaccggggaagggaactttccaaagacatgaccagagctccttcagattgggctacaacataccttgtaaatgtgtccatgccattcttgtaaaaggacactctta

SEQ ID NO: 34258 - DNA, 1138 bp, Mus musculus
tgaaggtgctcattcagtgctgtcacgtttacttgcaaccccatggtccttaggaacctgtcctcatcctcatctcatccccatggtccttaggaacccgtcctcattttcgtctgctttctatgttttcaggtacttaacagtataccatgccctgaaactactatgtagaaaattctggaactaagcagtttataagttctgaaagcacacttccttctgtaaaatgataaaaatctcacgctgtcctgcttagacaccttgaatgaccatggtgtgatggtgattacacagggccgtgctctctgcagttccgggcacccattgcgtttcttggaatgttcctctgtagatgagggagggtgtctattgcatagctagtatccttccattttctccagcacaaactgtgtatgtattaaatatgagtaacatccttcttggtccccatgataacccatgctccactttgttcttcagtgaagcttccccttctaggactctcatacaattggagtctgacagtacgctctaggctggcttgcttcactcagcacatgccttccagatctgtccctgttgtaacacatggcaagattccctttctaacattgctttgtcttttggtagtttcatacatgagtacagtatgtttagatcatatctcccttctaccccccacttgtgagtctcttccctccccctgttagaatgttggctagcttgatcctgtgcaagtcttatgttggcagccatagctgctgagagtttgtggatgcgacgaccctgtcatttctaggagacagtatttagcagcagtcctccatgacttctgattgttacagtctttcctccccattatccctgatatacccatagccttgtgggagacaggctcaagttccttcatatttttttaacggtaatattccattatacaaaagccagtttagtttattgaagatgcttggacactttgggctagggtgggcagagctcttaggaactcctttatacaactatctgtttaaatatcgccctcagtccctttgaaaatttatctaggagcgaaatggctgggccttagaatggctccacattcaaccttttaacacttgtcaagactgtgctcttacat

SEQ ID NO: 34259 - DNA, 1198 bp, Mus musculus
attccctaggcagagggtcctaaacgatatgagtggagcaatcgagctgagcagaagcaagcaatcatgccttctctctctgttctcaactgtgcatgtgaccaactgctccaagctccttcctaggacttcccagataggatggactgtaacccaagggtggaagcgaagaactgaactgtggcctgttaaacatgctcagcaagccacactatgtttgttttccccctttaaaataatgatttgttaaaaataacgaacatgagactattccacaaacaacaattcccagcatcaatgaatggaaaaacataccgggcagttccaaaatgcaaattctagaaccaggggaggggctaggcacttggaagcacaaggccccgagttcagtcctcagaaaacatgtggaaaaagccaggtctccctgtgtagtcactgcatggcaaaggggaagatcggcaactccctgaggtcactggccagcgggtttgcactgctgtgtaagtgccaggcaatgagacatccgatcacagaggtaaaaagaaggtagagagagtgtgggaataacactcaaggctctcctctggtgtctacatgcttacacacacacacacacacacacacacacacatgcacgaacatgtacacacgcatgtgacatgcgcacatatctatgcacaggcccctcctagctggaagtattaagttcttcacagccaagcaaaaattgatcttactggcttccattgcatcgctttctcatttatctcccgacttaatatttgtttaatatgagtgttaggaaaatacccacaatcccgctgccactctccccagccgggacataaatcagagcttgcaattccaccaatgcctcgctgctcttctccgggcctcccgcaggcaactgcagtcagacttccaaaaggccgtttctcccttcctccctttgggggccagagacatgattaacttgcaattatggtgccttcctcattaaagacaagttgtagcaagagaggaaaaataaaaacccagggactgacaggacaagctatgtttccctagcaccttggctgtgtgggcgcctctcatccctctgcccttcaggttagtaaaatcacgaccagttgttgaagctatgagctatcaataaaagttaatgtaccacaggaaatgggaagagggaacaaaatca

SEQ ID NO: 34260 - DNA, 1129 bp, Mus musculus
tggcaggaagtgggagaggggtgaactggagcccgatgcatggattaaaggattgttgtctttatgaaggtccagggtgcatgccggaggggccacatggcaggcacagtctttgatgttcactgggcctcagtaccatggctcctgtgacctctgcctctggaccaaagccagtctgcatcactggctcagccctaaattgagactgaccatggacaagttgtagggaaacagctctgagcaggttacacagtgcaatggttctgcccttatttcaggttgccttcctcaattaacataacacaagcctctgatattaataagttggttattaatttcaccaagaggaaaataaccaacagccttttaaaggaggggatatcaaagagatgccaggttgagagacagtgtagtgaattagcatggtgggtgaatgcagaagtacggtacagcacggacctggcagccatggcctcgacctcttgacctctctttgcctccatttcctggctataaatgaaagtgagaggcagcaggatggctcagtgggtagtgatgcttgtggccaaagctgatgatctgaatttgatggccggaacccacatgttaaaaggaaagcactgactatggaaagttatcctctgaccacacacacacacccaacaaacacacacacacacacccaacactcacacacacccaacacacacacacccaacactcacacacacccaacacacacacacccaacactcacacacacccaacacacacacacacacactgattaagtaaataaatgttaaaaaaaaagcaactttggataacccaagtggtaagtaaaaagcaaaacaaacaaacaacaacaaaacaaaaaccacaacaaaaagaaaaagaaaggaaaggaaaacatgtgtgcaaacgagcacatgatgtctggcaaagtatccagtaaatgctcattttctgtactttgtccttttccatactgcacatttgctcggacccgttactggaggctgtgtacacaccgtccccagttgatgtctagtctgccctcccattggtggtcaccccatcgtctctacttactgtagacacaggggcccttcaaaggacagccgtcttc

SEQ ID NO: 34261 - DNA, 1135 bp, Mus musculus
attcaaggataaagatactcctgcctcccccgcctccaacacatatacttctttctcctattttttttaaagatatatttatttattttatgcatatgagtacactgaagctgtcttcagacacaccagaagagggcatcagatcccattacagatggttgtgagccaccatgtggttggtgggaattgaactcaggacctctggaagagcagtcagtattcttaaccactgagccatctctccagcccttctttctccttttgaagtcatgttttcaaccatattctccagactgccctgtagtcctttcctgtctcctggatctcgctccttttctcttccttctagtaactatcagtctctttccccaaggctggccacttggcactgcacttgattcactgagatgctttcccgaactcagtccccagcactctgtactagcacttagtattagcactcagtccccagcagtcagtcccagcaagcactcagtccccagcactcagtccccagaactttccctatctttcctccgaacaggatcactatcccagtatccttccttccacactggccccggccctctttgaatttgactctcaggttgatgacgcctgcctctgacactgatgacacccgtgctgtgcctcttgctttttatttctcacttcggaaactgctaaactacacatcaatgttgattgaaacctagattggcagactacaattgttgtctgttttagacaggaaaaaaaaaaccctttattcttttattgctacaatgtcagaattgagtatttgtcacagacactggctcacaatcacagaaatcatttgcaaagagctccttatagatgacacttgccaggtatggtggtgcacatttataatccctcagagaggctgaggcaggaggattatgagtttcagacccgtctcggttacctagaaagatgttgtcaaggagaaatgatagggagaaggggacagagaggaagacaaggggggaggggagggggagggaggaagggagggaaagaaagaaggggaagtaagaagggaaaggaaaggcatgggagggagaagagaacagaggagaagggggaaaagaaaaggagggagagaaggagg

SEQ ID NO: 34262 - DNA, 1165 bp, Mus musculus
cagggcaagaagggcacagatcacagtgaccaagagaaagagacacggaaggcggaatccaagagtagcagatggtcagtttccaccatccctttccacgaagcgtggacaaactgtcttccttgtattggtatgtggctgcactctggagtgtggccactcgtgaaaggtcaccaaaacccaaggtccagcgtcctcgtcacctgaatcctcatcactgaggcatggttgcttggctgacgaatgattggctagttgatccagggttaacctgagcctccaggacaggtgataccacatgataaaacgttcttaccctaaacctaattttttggtatttctgcaatggcctgtctcaccctaagaccttagggatgaattgctaccaccaccaccaccaccaccaccaccaccatcaccaagaaagcttaaaaccaggtcattccttagggtttcctaaatgttatcatcagtttatgtgcacctttaataggacatatatatttaaatatatacatttaaatctctgcctctgtctctccttctcccatgtgtgtgtgtttgtgtgtgtgtgtgtgtgtgtgtgtgtgtgtgtgtgtgtgtgtcgggacagcacatgcatgccagagcctgcacatagagatcagatgaccttgggtatcagtcatcactctttactttgggaaagagtggcttgtttttcatggcatattgggatcctcccagctctgtcacccagctcacagcaacagagccaggattagagacgcgccccaccgcatccagctttcacccccagtttaagatccaacctgaggtcctcactcttaggcttcccactggtgcagcttgtcaggtcagagcatctcttttaagaccgctgtatcacaggattttgcagctgtcatgtggacacaggtcttaatatatatacaaagcatctctggtggccatgacatcccctgggctctcagtgttcgttgtataaaagtaagaacagcgttcaacctctgtaagatgtgccctgtccaccaaggccattttaggccccaccatcaaggcttatccctgttgccactaggtggcagcaaccaggattgggaaaacaacccctcaactgttcagaaggtaaaaggggggcctgaagggcaggtaccttttctcc

SEQ ID NO: 34263 - DNA, 1138 bp, Mus musculus
ctgaagagcatctggttggtaccaagaagcagccttcctttgtggcttctgactctgcacctccttgaattcctacattgagtcccctcaatgataagctgtgatcagggcatgtagccaaataaactctttccccattgcgatggtttgggtcagaattttatcacacggcagaaaacaacttaggatattaaaccattgggacaaacaacagtatggggaaaacaatgagagagaagagtgaaggagaaacactcaccgaggaactctggaaaattctgtgctaccactgaggtaaccaccctacacatctttattgaatactctctgttcatggatcagagatgaaaccgtacctagaactttgagccagaaatagacacggagctagacacagaatgctatgctgatctgaaagcctccagttcagtagctgcgcatgattgactggccttgtgttttaagggcaaaagggagacgccaaaggccatcttctcaggatcttcaagctcgggagacctacagtcatgaagacagaggtgttgaggtaactagatagacccggatgtagaatctgcagacgtggccttactggtggatcttggctggaatacagagagacaggggtttgggtttaaccagttggacaacatacagaaaagaatttatagaagagcaagctctgagatgaaggttgaaggtacttccagctggcattgctcgtaggtctggaccacagccttttagacattcagggggtcaggggagaccttcctctaagctgcatagaaagtaacagcatggaaacttgtccgaaggtgtctgggtgtacacacccagatgtttcttaactgaccactcgatgacccagcccaggtgcccgtgtgggtaatttttccagtctggtatttttttttttttttcatatagactgggactatgcctgggtaagatcacgctgtgtaagggagttcttctgcacctcaccctccaaatgtgcaaaccaacaacaaccacagatagatcccagatgccgtttccctgctctcgacatccttgaagtgggccttgctggcaggcacacctgccaaagaaaacgccgccctcaaaatgctcctggtgtggttctcactaggtg

SEQ ID NO: 34264 - DNA, 1132 bp, Mus musculus
ggatagatgaatggatgggtaggtggatgaatggatgaatagttggagattttaatggatggatgatcagatgaagaaatacatagatagatgaatagattagattgatggatagtgggctagttgaatggatgggtggccagatgggttcaaggtttgatgagtggctgcctgcctggataaatgatgcataggaaagataaatgttgaaattttatatttgactttctacagtcatattctaacagcttgccaaaaaatgacatagtcgcccaaatgtccacagtcccatatgtccttaggaggcaccagtcaactaccaaaccccagcagttggaaataggggcagacaacatacagacctgagctcactaaattccgtttctaaaagcaaaggtacacaatgcaccgagagaagggttgtggtggtgccaggacacaatgcacacagagctgcataacgtcccaataatcattgtgtttccacagtcgaaaaacaactgagaattgagaggcaaaggttgtattgggttttcccgaatataaagggagacgttacagttgtgatcaaccggaggagtttgggtggttcaaactgcttgtaactctagctccgtgggatcagacattctccttgggcttctgaagtcacctgcacacacctggcatgcacatatatttatttaaaaaaattaaatcagagcaaggttattttctattttttttaagagtagttgttaagttcagcgtacccaaatataactggcttgccttcccatcttctgctctttgatctcctgattcagagtggagcctttgtggccacctaggcccctgtaccaatgcatcctgaccatccaaaaagcctgctgtttacatctaggtgatcctgagtgctatgtaccctatgggcatgacacacatgcaaccacaagtctcttccgtgttgtatgatgtcaccaatcacatcctatatcgtcagataaaataactattctaaaaaaacctggttctcaggctgcagacacagctaaacaatagaacatttacctagtataaacgaggcttcattttgttgtgttttcctatgagaaggagttaaatccctcatgtagctgaggatgatttcgag

SEQ ID NO: 34265 - DNA, 1151 bp, Mus musculus
atttttcccaggccacagaagctatttgcaccccaagcaacacacctcgctcagctaaccgaggttgcctggctcttagccctccatcttctaccatggattatttagctccattgttccttagcttacctcatccctcacaaggtgaaagaaattccatttggtcccttttcagactgccggactggctgacagaaaacactcagtcccagtcacttctagagaatctgcttccttattgaaatggtccttttaatgtcatctttaatttaatcagatagtgtcatcaaaataacatttactccattactgcaaattccctgcgttattaactagtataactagaccaaaaaaaaaaaaaaaaaaaaaaaaaaagggaaaaaaaaagatggtacaaacccccatggaaatatagactaactgtaaaaatggctacagctcatagacattctatatttaatttgcagtctcaaagcactctctatggagaggttttatggttctgaaataattttaaaacacactttactacaattcatagcaggtagggttccccccccccccccactctggaagtcatggcatcttgtagttccctgagtaactggaacagtggcctgtgttaacctagtaatgctcttgtctttcattaagcgtggtggtggcggtccattcccacaccaaggatttctcagttttcctttggcacctccccccaaacccaaatataaagctcgcgatgtcagctggtgtcatcaggatccagttatttagataaaaaataccaactcatcaatggcccttgggaaagcttgattagaccattgtggtcatggttagggtagggtttacaagctagaaagggctatgtaattacgaagatctccttctggtctggggtggtggtggtgatggtagtggtagttgtggtgtgtgtttgtgtgtgtgtgttagagataagtgggtagctggggtttgctggtcactagcctagttctagattcagtgagtccccgatgaatgaataaggctgaaggtgacagagcaggacacccaagatgacttctacatgtgcttgtgagcatgtacgcaggctcacatgcccgtgttcagtcacatgcacatataccacacccacatcacacatgtga

SEQ ID NO: 34266 - DNA, 1196 bp, Mus musculus
cctggctgctcatttctaagctttaacatctgtactggagaagagaagatgagtttctggattaatgtcataccaaaaccaaataataataataataacaataacaacaaacaacaaaacaataataatgaacaggtaacatttggtcttgcctacattagatctctctattagaaattctatttaaaatgtttgtttggtttttttttttccctcctcttgggaccagtcttgttgggtcccctccatgcttggttccagtggaactaaagggcagcaagctggctgagccatctaagatgtacggtcacctccacccctgcctaggacctctgtacaaccaacacctaagcgcttggctgacagctgccgtccttttctgtttgccttattgctttgcgtctagcatgtcagctcactagagaaatgtcatctgactagggacagtcaagagtcacctaagtctcaagtcaacaaggccactatccgtgctgcttctccatgcggctctgggaagctgatctgtctactttggtccctaaagtgttgactctgttccctttgtgtctagtatttgtttgaacacgccgcttccaactatatgtgtgtgtgtgtgtgtaagaactagagatctgggggaaatggcagcaggggtgtgtgtggcgtgtgtttgtcgggagtgaggggatggtacttgtccggaaggctcagaaatctctgtgacctcccttggagaaggagacttccttgcagtgtctcccgaagaccccaggttccaacagaagacattgattcgcctggttagttatgacctcagaacttcttgtggctcccttctttctgatccagctcccaagcaaagccaaaggcagaacgaatgtgggcagagactggcttaaggaagcctggcccttgctctggtcctccagattgctctcactaaagccttgctgtgttcctttcttagagaagctttcagccctcttcttataggacactgtgaaaagtaggcacagatcctctctaagcatgggggagactctttgcatttaaaaaacaaaaacaaacaaacaaacaaaaatcccaaaagaattcatgtcattgtggagtattcataaaacaaaagagagaacagatagacgtgaaacaaactattcacattcccagccacaccctctgtgcgtcgttcatttgtc

SEQ ID NO: 34267 - DNA, 1152 bp, Mus musculus
ctccaaagggctggacacatggccttatccatagttcgtatgtgtgtgtgtgtgtgtgtgtgtggttgtatgtgtgtgcaagtgtatgtgtgtgtatgtgcatgtgttgtatgtgtggttttgtgtgtgtgtgtgtgtttgagtgtagtaaaacccatcccttatctcactgtagtggcacaatacctgacgaaagcagcttacgggagggacagtctcttttgtttcacaggttaggggtacagtccatgaaagatgaggaagccacagtggcagaaacagtcagaaaacagagtgaccaaggctggttcttagctggctttctccttttagttctgagcaaggactcccagtctgtggaatgatgctacccactgcttctaggtgattctagacctaggttgataatattaacatcatacttaccttaaaaggttttctctccctgctggtttcccggagccttcctcttgaatgcaggcatgccgaaatgttttagacatggaagattctgcagtaaaaaggaccatgtttccttgagaccttccccatgagcaaagactgtgtggatgctggccttgaacttggcaggtgctggtactcttgtagctccctcgttctttgtgcagtgttctttgaggtgacagcagcccactacggccccccatggttttcagtttcagggtgcatcttgctggcacctttatcacctccctgctgttccatttccctacttctcaaaagacctcctccctaaaaatgaagggtgatctccctcctcctcctccccataagctagtgctcagtaggggctgactccatagtgtacccttgtgctggccgctatttgcctttatgaggcttgctattctgctattcctgatgctgctaggagttctgattcctagcccatgaacctttgaccaaagattttcctctatctgggagggcgatgctctggaaccttaagccatctggaagaccatcagatgaagggtgtaggaagcaagaggtgcacaagtaggtggctcgagcagagggactgaccctaatgatttatggaacataaggggtacacggagggatggagagagagagagagagagagagagagagagagagagagagagaataaactccatgctctctggc

SEQ ID NO: 34268 - DNA, 1177 bp, Mus musculus
ggtacaataaaataccaagttaagagtattaattcctcaccagccggatgggtcccagctgtgcacacgcgtgtggggcgtgagggtgtacgctcagcgggtgcaggtgctgacggcgctgttccacctcggagcacgcgggccgggaacacagctgtttctcaaatcctccgccactcgctgcaaaccctctatgaagttgtgctacctctgggtacaattaaaagctatatacacatttcaccaggtagtgttagaaatttaggctgagccaaaaaacggaaagggagaaggtgggagggagaaagaaatgactcccttgttaaggctggcattaacctccttaccctgcctattgaagcaataaagcttccaaatgcctcatggtctccagtgttaggagaggagagttggggtgtggaaaaggtgttagagaggagccttcctgtcttcttcctgttccttcctgcttccttcccttcttcccttccatttcccctttcttccttcttgccttcccccctttctccctcccttccttccttttttctttcttctttctcccttcttcctctctccttctagttctccctcccctccacctctttttctctctttcttttctttctccctttctacattctttctcttcttttcccacttcccctccctccctgtctcttattcctcccagtctctctctttcctacacccccttctttcccactctccttaccaattccttgcttaaatttccccgtctttgcttctgcctcagcacccaggcctgtccgtatggaaacatctaggcctaggctaaggaagatagaattagaagaggccaagtcgacatgtggaaggcctggatctggcagctgttttggagaaaggggccacaatacctcagccacttttatccttaccttgggaaactgattggctttacagcctgggctagcttcctttccatggcgggccccatgcagtaagtctcctggaacccagccacagaaatggcagctgaggctccagggggcagggacaatgactgtgttctgtggcctcaacatccacatagccactgctttcaatgcaggaaccaagggccactctgatcttcctttgtcttcgttaacacacagaaaaatctgaactttccaaaaaggacctcttccca

SEQ ID NO: 34269 - DNA, 1126 bp, Mus musculus
ttgaagtcctctttgttagcttcgatcatgttgtttcttctcagtaaagcatcatccaaaactcacatgaaaaccagcactgagctatgatggaaggaccataggtttctgagttatgactcttgatgggacttgatccccatttctcttctgattctttgtgactatgaagttaatcccatgatccttctgggactctggtcatgtaagtgtgtatgaatatatattgtctctagatatatgtatatacccatatatgtgctcttttattatgctttattatgttttattatgagagacagtctcagtacatagttccagctgatcttcatcttactaggtggctcagaccgtccttagattcatgcctctgcctcccaagtattgggattacagctctatggaacaggctccacccacaagtcacactttgttgtagatgtgtgtctagtcatttgtagaggacatctccgggaggctagcatctggtaggtctcttataattggaggactcactcatgagattgcttgccttgtgtgtgcaatagggagagtcttctgccctcactgcccctcaagctaggtggatttttctcttgttgacaaagagtatttggtagggaaagcaggttaaaaataaagacagcccttccctgccctttgtgtccccttcctggtgacagcaagaaaccatcaacaccaacaagtttccacgttccttttacagcaaaagggactttttatataaccaaatgtggtgtcttagtgactttttgataatgtacagttttttgtgaatttaaatttatttttttctatatttttaggaccaatctcatttttaataaggtttaaaaaaaaggaaaaaaagtctagagaaaaaaaaataccttgtttttgccatgtgatgttccacaggtgcggctgtagaaaagtgcttgtcattgaataaaaaccacatttgataaaagaaaaaaaaaaaaaaaaaaaaaaaaaacacttcccatccaaatgtgaggatcagagttcagacaaataggactcccataaaagtaagcaagcaggtggctctgtgtcgtagtaaggcttggaaggggtcaaagagcatctctggggcaaacttgct

SEQ ID NO: 34270 - DNA, 1199 bp, Mus musculus
atagtcatacattattaagaaatcaagtcaatttttttttctctagaagtcattacgtttgaattctaatttgaaaatgtattgaatttgtgaataagccttaccattaggttcaataatccttctgacctttcaaaactacacgtgtagttcaagatccccccccccataaattctcactgtgtggcagttgatggagttcggaaaagagccttaagcttgttgcaaaaataataatataattaattaattaaaagggtaatacgggttgtttcctccaagtaagccatgttggtgggctcagtgcagtctgtaagtcgctcatggctaatctgaagagagtggtgggaggagctgatggcggcagggaccaggtggattcctcggcgaatgtctttggccataagactggaccgagggtaggttttcttgagccacttgtattctagtagtatggttgagggatggtgccagggagggctgctaactcaccatttgttctaaacaaatgacatttcctgctcctgaccctgctggggaccccagggtagctaaagtccgtgctctctgagagatgttaacaaagtttacataagagtcttgctgtgtagacaatctggagtcagtttctgttccatcatcggcatcgccatatgtccttggtgtttctgtgaggaagtgtgtgtcaagccatactagggtgaagtgtgctggatgaaggtactgtagctacagagagggagcagcaggtgacctggttcgtccagggctgtttcgatggcgaaaaaaatcacagagggtagagttaagtctcaaaaatcaagttataatatcttttggtaggtggcactccagccatcactggctgattctccttaccaacccttgaagtaggattttgcatttagggctatgtggcttagcatgcggtccatctctaggaagtgtccaaagtcactttctcagcctttgggattaagattggcatgtgtcagtcaggagacctgatgtctagagtgaagcttcagccttacgtctctgggtttgcctcaccctccttaccccgacatcttgtctgatgtgggagcttaccgactccaggatattcagagggtgttgagtgctccatctagtctttaacttaccattgtgccattagtcccagcttgaagttattttctaatgtctacgttagctag

SEQ ID NO: 34271 - DNA, 1843 bp, Mus musculus
tcagaagggttcaggaagaaaagagtttaagtccctattctccaccagcctgtgccaccttggccatggggagcctgagagtacagtcaccttggctgtatttggtcacaggaaaaagaaattggagcatgtggccccctggagtccctatagaacactgtaggagctgtgggctgactggggtgtagagaattaaggagcctgagcctcttgtcccttctctgctgggatgagctccatgtacacttaaccccacgcccttaagacatctcctgttctttacatgtctgagtaactctttcagatcgctgcctcctctataggaaacacctcccccaaacctttctgattagcttctgatcaagccagttttgtccatagggaagcaagttgtcaggattctctctagaaatagcacgggatgtttagaaatccctgtgatcagcagtcatctttgactcctgagcatacaaccagatatgctttctctcttggccatttgatgggcgccacacttccgaacatactgaggatctgtgatgactgaggtagacactgaccatttctgaggtgggatttacaccccttgtttttaaagactgtgttccgtctgttggaaggaggtagatctgccacatggacacaaggcatttagtcaacctcctgggctggccaaaccacaggagttggcattttcaggctggctgtttgggtagtgtggagttggaatccaggtgacccacatatagcagattgagctgggatggaaaattcagtggttgtgtccaggttacccccaaagctttattgaggtcaggtgctggctctctcatctttttactttgtaccccattgtcctctctcctcccatgaggtccttttgcttgacctgttactctccttgttccttttcctaccaccctttcctagggcccaagtaaatcttttgaggaattttagatgtctttgcaggcctggtgtatgtgtccctattgaacttggaagggcagctatgagtgagaggtagaggcttcctcttctaagtcaaggttccctctagcaagccatttgagactctcctctgtttaccacaaccttggtggtggcaactcccatatgacccggctggggttaagtgctcagatcccaggcgacttttgaagagttatggttaagatggccagaccacctcagcactgggaagccaccacctaatgtgggtgttcttgggtgaccctttactgggcagaagtaaagtccgagggaaacacatatgcagagaaaggcggggactgggggaaaatggggaaatgacgtaaaatcttactctgtggcataaatcaaactgggaaatatcctctcggaagcgggaaaagatgatttccctgagtgaagttcaacctgaggacgggaaaataatgacaggagacactgggcaaggcatatttaaatctccgaatccctcttttacaaatagccttgactgaacgctgagtcctatccctcactactaactgctggtttccaaaatcctcttaaaaggtttgttaaaaaacaaaattctctctctctctctctctctctctctctctctctctctctctctctctctagtttggaatttagtcctatccccactctttttcaatctaatttctgttgaagttttttttttttgtaaaaaaataaaaattaaaaatagagacatccaccaatcttcctatggggacgtttagaaggagggcttgcttctcttctgtgtttctttattaagatactgagatctgttgtatgtatgagccaagatgccctcactaatatacacagtatttaagactccaca

SEQ ID NO: 34272 - DNA, 1107 bp, Mus musculus
tatagaactatgatgttctgcttatcttcctttaaggtctacaagttttcagtgtctaggatgcccatagaattcacggttaaggtcatggtttttgagttcagagggggaggtaacgaggactgagaactaggctgacgtcaggcgtggactaggccagcaggtgtgtaccatcccattcatcctctccccgccctgtcccccagaatctgccagctctgtgcttctgtgagtagggcatgtggcctgtagttggcctctacctgcttctgatgaccaggaattgtgccgtggctcctgggagaattggggggagccacagaccagcaaataccagccattagtgaaagaagttcttctctctctttctccagggacttcgtgaaggcctttatccagtttaagaaacccatcgtggtagccattaatgggccagcattgggcctgggagcctccatcctgcccctctgtgacatcgtatgggccagtgagaaggcctggtttcagacaccatacgctaccatccgactcacgcctgctggctgttcctcctacaccttcccccagatcctgggtgtggcgctggtaagcctcctgcttcctccataacttcttgcttggtctgagaggcatgtgtctgggtcttagcagggcccttttcccagagttggagtacagcagtgccctatgagtgaagcccaggtatccattagacccaacgaatctgctctggcatcctctgttgtcccagaaccgctgtgactgaaggcaggctgatctcaaccagactgaaaggtcttcaagctgtgggtgtcgaatggagtagctgagctgagccgacactgatgctgccgagttactgtttacctactgtgctgcaggcgccatgcacacagaggcccccttattcctcattacactctggtaaagctgtgcctttgggagagatgagcgctgaaaccaacagccgcagttatcagaggtctcgcacagtggtggcaggacaggtctagtcacagtagtgccggcaggacatagagagcattcacggtgtgtaggggccacacacaaccccatgaggacgatggtggtggttaccagtgaaca

SEQ ID NO: 34273 - DNA, 1209 bp, Mus musculus
aggtggcctgtcatttattgctcacctggagagaattctagactggcagatcctgaatcttgtggataatacacagcagactgtgaacttggtcatgtctacatgctaaagcatgctgaccatgggccacctatgacccctgcaagggtctagggagataaaacaagagaaaattttaactgagacaactagaggcttatatagctcaccaacgctgtgcagaggaccactttcccatgctttttaaggggttcaaccagcaaataacctaaagttggctaacagaagttcatagagacagatcaagttcacaccaggctcccaggacttccatgttgatccttccgctttcactgagggtggtgtgggaaggttttggttcagtgaagtttctttccccggggatggacgtgtgcttccattcaggggaagtctctcagacattcaaagctctgcgaactcacctctgcctgcagatcatgaaggaagtccggcgagccctgtgcaacgcggccacagatgacagcaagctactgctgctcagtgccgtgggcagtgtgttctgcagcggactagactattcctacctgatcggccggctgtccagcgaccggagaaaggagagcactcgaatcgcagaagctatcaggtgagtccgacctctctctgaatgaacgctttggggagcctgccaacggtgaccaaatttagccagttaaaagtacaggctgcccagctgtaaacgtacatcaaacaatgtgcgattttatttttagtgtgagtatatcctcggcaccatttaggacaccaggacatacttacattttaaaattaccgttgatttatctgaagtttgactctttttgatgccagggatcaaacccagggtcttgtacatgttggacaaataaatgttctaccgttcagctccgtttccatctctgaactgtggacacgagctggccagccgacgttttgtctgtggccccatggcaggctttgctctccataggttgcatttcatgcccgcctcccctttttgttttttgtttttttaaaaagacatacctatttttcccattatggcctgcattggcaatgcctgtgatactttctgattccaccttctgcctggtagtatggtctttgattatgtagccatttctgtgtcctggacctgatgtgactcaattactagggagagagtga

SEQ ID NO: 34274 - DNA, 1098 bp, Mus musculus
tcaggtcatcaggtgtggcagtgagcaccttgacctgctgagtcatcatattggcctgcatttatgttgttgttttttttttttttaaataaacttttactgtacttttaaagtcattccaagtaaaggaagaaacacatgttcttagtgtggcacagctaattccttgaactgtatttttctttttctcctcccccttcttttttttttttttttttttttttttacaaaaaaccttaaaactaattcatatatgttataaaatattccaagtacatgtctccctcttctccacctcaaaccttatttagaggtcatttctgttactattttttatggttgtttctggactcttttctaggtatattattcattattttatgtaatttattaacatatatgtaatagttaagtagctattcaaatgttggttgattgagccatgaaaagaaataacattttctgcttattacttattgattggcaatcatcagccatccaccatccatctgtatctgtttgtatgtctgtgtttgtctgtctgtctatcaatctcacccatcatcttctgtctatgtattatctccctccctccctccctcctcccctccctccctccctccctccctccctccctccctccctccctccctccctccctccctatctatcatctatttactctgttagcttcagctgtcagcttgacacaaacctagaatcatctgagaagagggacctccaaccgaagatctgcctggctctggttggcccatggctatgcctgtgggacatttttcttaattgctaattggtgtaggaggacccagccccactgtgggtagtaccatcccttggcaggtgggcctaggctgtatataaaacttagttaagcaacatacaggaaccatgccagcaagcagcttggtcctccatggtctctgcttcagttcctgacttctggtttctccttaagttcctgccttgcctgcctttgatgatggactcttgacatgtaagccagataaacctgtttcttccccaaggtgctgttggccagcattttattacagcaactaggaagtaaaccgggactca

SEQ ID NO: 34275 - DNA, 1116 bp, Mus musculus
aatgaattcgtttccactctgaatttctaggttggatgttggcagccagactggcagatgtttagcggggactctgaggtctgtctgcccatctgtagccggacctcagacagcttggggcccctttggaaaatgatccttgggtcccacgtcttctcaccctcttcgtcttgcatccccaggttgaaaggattgtggacaagaggaagaacaagaaggggaaatgggaatatcttatccgatggaaaggctacggcagcacggaggacacgtgggaaccggagcatcacctcctgcactgtgaggagtttatcgacgagttcaacgggctccacttgtccaaggataagagggtgaagtcagggaagcaggccggagcctccaagctcctccgcgacgcccgcggcctgccagtggaaagactctcccatcggcctctggaacccgggaagagcaaaccatcttcccacaagcggaagcgcgtcaactctcccctgtccaggcccaagaaggggtcttcgggtaaggctccagacagggccaccaagactgtgtcctataggactacccccagtggcttacagatcatgcccctgaagaaggctcagaacggcctggagaacggagatgccggctctgagaaggacgagtcacactttggaaacgggtcccatcagccggatctggagttgaacgaccagcttggagagcaggaggccagtgactgcgacgggacccactccgcgctggtggagaatggagttggtctgtggcttttctttctctcagggttgggttggtcttggctggtggccagcttgtggtgttgttgttgttgttgttgttgttgtaggcaggatcttatgtggtccaggttggcctcaaactcaccaagtattctaggatggctttgacccccctgtctcctgcctctgtctcctgggtgctgggattgcatgcaggcactgttagatcctgtctcaggtaaaggtggaacacggggcatgctgggtaaggactctactcaccaagccagccatgtcttcagccctttggtctgacttttctttcaacctagggaaatatctaagttgctacccaccttctgtctttaac

SEQ ID NO: 34276 - DNA, 1121 bp, Mus musculus
gacctggggaaaactgaagctctgagaagtcacaggactccctaaggccgagatagactcccgctctcacctcggggttcccagttcacatcctgggctctcaaccacagggcagggacagtctctcttgccaaatgttctgtctgcaaggcccagtaagagtcgagtttgttgtgagtgttttgtgcacactggctagatgagtaccattctctgcatagggggcccctgggaacctcagcagtccttgcccagttccctgggcacatgaagtcttcagtctagaactcactttccttcctatagctctgatcttgttgccaggaacagctctgtccagtttttcaggttcttccccctcaaggatctctgcattgtcccctgccctcaagtcctgaccacttggtagccttgtttctgtaaaccccaggccatctcttactctcctctgtagccttcgtagaggctggcgttctgtcttcaacacaggtgaggttgccgactccctcttacctgggcagacttcctgttgccctctgaaccatgtgtggttctggattcttcctgatgcgaactgtgtgtctttggggctatatcacttaccacttgctgggttgccctgggtgtcaggttacactctccaggctgttcttccatccttctgatgtcgccttttccctgtgtgtcctagtgctagctccccatcctggtcttcacaagccttgtgggaaatctgccctacaaatcgtagtctacgagtcaggggatttcttgtttgtgatgggggtcttcccaccagtccacacccacacgtgctgcacgttgcacatttgttattaagcatctgctcatgtccacctttgccgtgtccaagctaacgggactcccgagcgtttcttgtcttcttgacagtggagacccaggaacgcatgtggtttcatttccaggttgtccatagggaaattttctctctttatggcccgcaaagaggtaaggaaacctgtaggtgccaccacaatgggcccccagtctctcctcaatgcccttctctgtggtagggtatcccagggagtgtctggttccacaatcatgaggaaatttgtgctttctaaccttgttga

SEQ ID NO: 34277 - DNA, 1104 bp, Mus musculus
atggtgtattataattattattattattattttaaaaccattagactgtatggtctatggtttatccttgaaatgaggctcctcctccaatgattggagaatcatctcggtgtttgggaaaggcacaggttttagacgttagttggttatttcttctgcaacctcgagcaagtctttttttttttttaagatttatttatttattatatgtgtgtacactgtagctgtcttcagatactccagaagagggcatcagattttttgtaacggatggttgtgagccaccatgtggttgctgggatttgaactcatgacctttggaagagcagtcggtgctcttaactgctgagccatctcaccagccctcgagcaagtcttaaaaccccgacctccccatatataggagaggcgacccactttgatgcacgttctgaggtttgcagatagaaaacctgtcattcagtttcaccgttgacacttttgttggtgttggtcattgacttgataaagtgctctcaaaaggacgaggcttgggaactgggctgaggtcctgggctcaggcccagcactgtttctttcttccttggaccttgctgtaatatgcggtcttattttatatctctgattagctgagcaacctccaggaactcttactgtctccaccccggccaagtctcagaataataagatcagtaatgtagggtttgggttttagctattttctttcctttccgcatccattcacttcctatggaggtttggcctgttgctgtgtatcatagtgcggacctctgtaccagaaggtctatgcctacatgaattctcatgtttactagcctttgttgtgtaaactgtgttccttgatttaagactattaagtaaaactgttaaataaaattggctataaccaattgctggagggatcagaagtaggtaggttttgatttacctgattgggggtggagaggagagaggagagaggaggaggaggaggagtaagggaagggggaggaggaggggaggaagccgtcatgaggggagatgggccatgagcacatagccaggagaaacagctagtatctgggctacaccactagacaggta

SEQ ID NO: 34278 - DNA, 1105 bp, Mus musculus
tgtgcatgcttttacctacactgtgccatgctggtcattattgtgactcctaggcaatatctctttgtaggacagctagttgcttccctcttttggaagtgttcctggtgctttctgctaccataggagctagacctcagagagaatgcattcaggtattccagctcaggggcctctgggccctctgtctgaagtacttggtctcttcagcaataggaacttactttctacctctggggccaaccaagggcatatcaatagcctgtaatgttttgggagtctcttggacaaccccaaccaacaactcaaaagagggcttatatgcactgtcttggcatttttgttagactgtctttggctcttagagtgagcattgtgaacccagatgagaagatttcatttaaacaaaataggtatatttatacatagacttacgggtattctagttgttttttttttttaaggtagttcggtaacagtatgatttcttataactctttcagacacccttcctcttattttatcctccttctcttctttctctttattcatctctctcccctatcctatttggaacccccacttttccaaccagattatttgtaccctgctaattctccctctctctagtgtccccctcctctacgttatagagagggagcaatagcccctcatcatttcctagtttctagagtcaccccagcatatgtactcttatctgaagattttaagtttggagcctccaggagccaaagagagcatacagtgtttgctcttctgggtctgggttacctcactcagtatgatcatttgcctgcagatcccatgatttcctcccccacccccttacagctgagtagtacccacgtgcgtgtggcagacacacaccacattttcatatccattgcttggcttaaggacatttaggttgtatccatttcctagctgttgtgaatagagcagccataaacatgacagagtacatatcctggaataggatgctgagtcttttgggtgtatgtatgccgaagagtgacatatctgggtcctatggtagatttacttttagcgttttgggaattcaaacactgatttccacagtgac

SEQ ID NO: 34279 - DNA, 1163 bp, Mus musculus
tccacatcttttggaagccttgaaatccttagctccagccggtaagtggtcagtttatgtcacgggccagccagatatcaccagtggctgttgcttctcgggagatggccatctggttccctgtaagccggttccctctgagccctccctcctctccagtctgcttcccctccagcccttttccccttttcgtgtctgtgcctattagggggtaggagaaggtgcccataactctttctgaccgtagccgtgtttagactgagtgtccccgtggtcattcttatgtttcgttttcttgttttcaggaattgcagatgcaccactttctcccctgctcacctgcataccgagcaagaaaatgaattattttaaaattagagataaatgaatacatatggcttggcttccgctgcacatgcaggtccagttataaccgaccagcttctgtgtacagtcttgtgtcttagaagccaatccttggcgtcggacattcggtgtttttaatgaacgattgggactgcatctgtccttcatccgtgcatgccctctctcttcccgtctattaagtgcagcagctgtgggcatttgacaagtgataaatatgtgcacgcacacgcaggaggctgcaggttggcctcaaccctggcacgcacagaagtggagcatgggttgactctgtaggcacctcctgtccttcctcccgctgctgcttctcctcagaagtccgtccctgtgggatctctgttacacacccttgatcacagaagaaccaagaagctacccaaccccaaactaggagagtcagagggaagctggaggctactacgcaaggctgcatatctaacggcctctttgtgtaaaacaacttctctattatacatattcctaatatacatatgcttctcgtgatcttttatccatggcacactgaaactgagcatcactgatctgtgaataaagatactgacaaacgcattatcagttcctttggatgaatatacaaatagtcgtgaaaggactaagtaatacttatacagtaatgtgtacaggctgtgggtcatccgatatggaaccattttaagttttagcttggtcagacatgtcaggcgcttccctcgtccctcagtgatctgagtatttgggctttgtgctgacaagttctc

SEQ ID NO: 34280 - DNA, 1083 bp, Mus musculus
aagccagagttaagcagctccaatccacccttcactctagctccaagggtacccatttcagcccgtcaccatgtacacataacacagagacacgtgcacgcacatcttaaaattgaatttatttttactttcttactgtttccagagacccacctagtaaaaaaaggaaaatggaaagctacctgcaaaaccaaaagttgtccagtaaaaccactgaaccactgagcgaccaagcagccccgcgccaagatgctgctgaaccggatgctccggaggtcaagcctgcagcatccctcgaagactcctgtagcgcccacaccaaaaagcagagcgtcgcgacgcctccccggtgtccccagaagttgctgttaccaaagcccaaggtggctctggttaaactcccagtcatgcagttttcccccgtgcctgtctttgtgcctacagcggagtcctcggcccagcctgtggtgttaggtgtggatcacagttctgcagccggtactgtgcacttagtacctctgtcggtaggagccctgatcctcagcctggactcagaggcctgctctctgaaggagagcctacctctctcaaaaattatcagtcctgttgttgagccaatgaatacaggtgttcaagtgaacttgggtaaaagcctgtgtagtcctttacaagaggtagggagtgtgtgtcagaggaccagcatttcctcaagcaacgtgcagacagatctgacctatgcctcagccaacttgataccctctgctcagtggctcggccctgattcctctgtgtcatcgtgttctcagactgacctgtcgtttgattctcaagtgtcccttcctgttagtgtccacacccagacgttggtgcccagctctaaggtcacttcatccatagctgctcagacagatgcatttatagacgcctgtttccagcctggtggggtctccagggaaacccagaccagcaggatgcagaaccgcacaaacgactcagtgccagtgggccacactggcttgtgtggggacatttttgaaagcgtgcatgcgtcatacagtgtgcctactgacaccatcatgagta

SEQ ID NO: 34281 - DNA, 2980 bp, Mus musculus
ctgctcggcacctgcctgctctggagagcaaggtccagttgagcagcacagaaacacaaaccatgagttctggcttcgagcccctggggaacttgttcctcaccagcaacgaaactcagacagcaatggatgacttccttctagccgatctggcctggaatacgatggagtcccagttcagctccgtggaaacccagacatgcgcagagctgcacgctgtctccagcttctgaaggtgcagccaggcatccccgctccttgtgcgtttagaacatgggctcaaggacagcggcaccgactggggatgtagtcagtggggcagctgtttagattctcttcagttcttggtgttttgtactcgtgaccacaagattggtgtgcaaatgtgagtgtattataaagtgtaagtgttgatctgaaatgtcgcctatgtttgctcctgtgtagctattctatctttttttaaaaaaaaatgcatttgacactgtaaaacttagaactgtttagctaatgccaagcttagcaggtggtagggggcaagctttgtggctgctttaactgagtatagcacacttaaatggcatctccacgtaaagggcacctcaaatgctcagacaatgtttgtgtggccgctaactcctgagatgccaccaccttgccttgtcatgtccctctgactcggaagcaccaagggaagccacacctgtctttagcttttatgacagttttgagtctcttctgtcccttccctgctgagctgtgactgccgccagcttcgtgtgccatccttctcccaatgtgaggttactggccagtgtgagaacagcaagcactcggtgtcaatggcaggcttagtacgaggaaggtatccagctgtggagatgcctgcgcactgtggacaccctcagttctgttcatctcaggctcatcccgcttcgtggacgagctctcctctgctccctccagagtgttgatcaaatctgtgggattgccatgtgccagacggcagccagctgtgagcacacagtagctagagggtagttcctggttgaccccagagcttctagctgtctgtaaattggggttcctatgactccacactctttgtgctcagtgaatttactagaactcagggatactgtttctgtgaagggtaggctgggtgcaaaggggcagaggacttccacaccttctctaggcacacctcctaccaagaatctgcctgttagcctcgtaggaacctccaaactcagtcttgtggggttaatggctgctttgttgtgtgggtagagagttgcttaaaccattagcaatcaacttaaccttgagtgtcaccctatctggtgggttgggaggtagggatgaagctgaaaataccccaacctttcgatcattaattattccttggtctctcctgtgacttgtccccatcctaatgctacccagatgctaccagctaccaatgacctcatagcaagcaaaagcaaaacattttttctgaagactttggggtgggggcaagttgtgatatacattacatcacctcccccacaaacatccttcctgctccacagtagaccatggggcctgcccgactgcttcccataatggacttagagaccctctaagaattaaaaaggaaggcatgggtgggggaaaggctttcctgcccagcccccgccagtatgctgcacttgttatcttgataggagaagcagggcccacaatgtctttccttccacccacccccatctcctccctgaaagaagctcttaggtctggcaagcatagtatgtgtaccctgagactagcaactgtagaatagacccatctaaagtacgctgatctagattatgttgtgatgcattctttaaagaggaaaaatctggagagcaattgcttcaacggttaagaatactctcactctgaggggagagcgaggtcaagcctgcctggggggctctgtgctaagtagatcatggattcatagctggtgcccaactctgaggcaaattcagaatcagcccagcctggggacctttccagtctagcctggatggaaaagccctgttcttttggcatacgtttgtgctgccaaaagctgaaccttcaaaatgaaacctaagggggctggtgatgactcattaaataagttggtattgctgctgtcctgtcccattcacccgatgcagaggactcgggaatgggctaataacacacccggcaggtgaatgcaacccaggagctaaacagtggttgtggccacagtcgcctgtgaatgtgagtttcagaacagacacaaagccttaacttagattttctgttgttttggactcgtccactgccttaacgctcaagcatctatttaagccctccggctgaaggagaagtgcatgtctgctcgtggctctttgtaaatataagtgcagcaatctatggctttttaagtttttgtgtctgtggcgatgtgtcttaatagttacaagataaagaatggagcatgtaattgtccttcatgtgcaagaactgtccccacaaaaatcttaagtcacctgaactcccctaaggttggttgtttgtgaacataaatttggtgattaaagagaagctagaattctacctttctgtgtgaatcttgtccacacttaggatgcaagtttgttgttcttgtgtatttcagaagatagtaatgaaatggttgtgcccagttaccttcacgaaaagacagtgacacttttccctgaatagataacccaagggatgaagaggtggcatggtggttcagataccttgctgccctttcaaaggacccaagtttgattgccagcacccgtatcacacccagcggtaactgggtgttcaggttcaaatgttcaaggcatttgctgccttctgaacttgggagggcaccctaagacacgtgcatacataacattcataaataaagtataagcccagcatagtggtacctgcctcacag

SEQ ID NO: 34282 - DNA, 1590 bp, Mus musculus
gagttcaaggccaagcctggtctacaaagtgaattccaggacagctgtttctatatagggatatttgagtgtgggggtctttagtggtcagaggaggacactgaattccctggagctagagttataggttgtaagtcacctgataccaatgctcaaaaccaaacttgggtcccgtgctacagcggtatgctctcttaaaaacggagccatccttactccagcccactaaagtcttagagctaaatttattgaagaaagaatggatttatgttaggataacaacatcacttaaatgagggcactgtattaattttgaatgaatttgactttaaaaggcaatgtgaactgaggttctgttttgggtacaggttggctgatcaagatgacactgagtgacccttcagagatggatgaattgatgagtgaagaagcatatgagaaatatgtgaagtccattgaggagtgaccatggcacccctctactcccagatcaaactggatgtgacgtgctccagcatgcttgtcttaaactagtggagaatagaggacttgaaataacttagcaatactgatggaaagaaactgttcttgacagtgctacttaagagccacccccaacttcctaaaggatgcagataaacacagtgtacaggtttttgataattgccatactaagtatttagactaggggttaagccctggtgtttagaattctgaggatcgtctgctgtgaaacgtggttatgaggctggttttggtgacggaccaccttctaatcccagcacgcaacaggcagatgttagttagttcaaggtcggtctacacaacaagttctagaccagccacagctacatggcgagaccctacctactgggtataagactttcataattcaagataatagtggtgtatcttagataattttgttacttgcccatatccaccactggatttgggtcagagattagtgtcttctcattgggaatgcaaggaagtgttgtacagtgtcagaggcaggagagtactgtctttgtttcaccatgtgctgtgttgactgttgttttcccaccgtgaagcaccggctttgcaacactgcgaaacaaataaaacattcatcctctttgttgattgtgatttttatttggatattaatgttttacttagtgactgctagttttagaagggttgattttaattataggatgttccagtgtctggtgctaggtataccactgaggtgtactgtgcctaaccatgtgaaatgattaaagagaaaaaaaaatagaagtctggtgtggtggtgcacgcctttaattcaggaggcagaggcaggcggatttctgagttccaggacagtcagggctacacagagaaaccctgtcttgaaaaaccaaaaaaaggaaaggaaaaaagaaaagaaaaaaaaaaagaaattaggccaggggctagaggggtcagtggttaggagggcttgctgttcctgcttcttgcagacaacctgggggttgtttccagcacccatgtggtagctcaaaaccatccctaactccagttccaggggatctgatgccttctatttctgaaggaatc

SEQ ID NO: 34283 - DNA, 1106 bp, Mus musculus
tacctgcctcttcctctctgagtgctgggatttaggtgtgccgcccccccccccccccccagtctgtttctgctctgaggtctgctctcactgcgaagctggagagacccctgtgtagctgaggatgacaacttcagatccttccacagtgctgcgactggactgccgagcaccaccaaacccagctgtgcaatggtagagactgaactcagagctaccacagtgataggcaagcacccatcccccaaagccacatccccaggtctcaaactgtgtttttcgaggattaggaagaaagtaattatttacctaatctgctttcttcagtgaggtcaagggttaacggagaattgtaatctgtgcctaagcctaggtagcattcctgggctaaaaggacaatatggactttaagggcaagtggacctgggtgtgctgagctcagaatgctgctggctcaaactgaagctgcaaagttgaggcagagcagcgacactgtcagcggtgtggccgaggatagcgcaaagggtcagagatctgtgactgtccgcccctggtcagatgctgtgttgaggtgatgattgttggtcataaggtaatcagggggttctagacttgtaagagaatggcagttgagagccacagccacatagctgtgcatcatctttgacccaaatcccttttcctttattttttttagcagggttgggaattgaagccaaggctttggccctttcttcaaggacaggcttaaagaattgcagaattttaagaacttggccaagttataattgtttataggaagcctgtttcagtccatagaactaagttgcagttaccttagagaactctacctaaagactcacattacccttttttaggttaaatcttttggttttcatatctttgttgttgttgttttgtttcttgagacagggtttctctgcagccctggctgtcctggaacttactctgtagaccaggctggccttgaactcagaaatccacctgcctctgcctcccaagtgctgggattaaaggcgtgcgccaccacgcccagcttggttttcatatcttaaaaggtttatgctacacgtgttttgcttgca

SEQ ID NO: 34284 - DNA, 1191 bp, Mus musculus
ctcccatcctttggcttgtatgggaagtactccactccactgtcactggcccgaggctctctgttggctgtcttgggtgattcttactgtcttctgcattcagggtggatgccaccaccccttcacttacatggaacctgtttcttcaagcttccgttctatgttctgtctccttttcttgccattttaatctctgctgagtccctgtcctgctggaaaccatgcctgaccctcacatgtgctcagtgagaagcagagtggctgtccaacagtcccttctgacagtgtctggcctccacttcttagctaaggcttggagagacagctctcctggtgtaagtcccctgttgccttcactctgcaattaaacgtgcatttcatggctccactgaacctgttttttgaagagctgtgacacgtaatctccagatgcagtataaactaagacatttctctgccttggcctgtttatcactgcccatcactttcttgacattctgtctctccttgctccagtgacaccttttgtttcccccacagttgactttctggctttcctccttcctgtccctggactgtggtcaggcatacagttctgactttactctgcacttcccccacaacagcactaactgtgccaagacacttgctgccctctcctctgtcccaagcccgaaggtcacttacctagcacctggccaccttcacccgtggtggtcacactgttccttccaagtcagctgtccctccttcccttttgtgtgtggggtaagggtgggacacacctgtgtgtatgcacacaccctagaacagtgggcaggtatcttcatctgttgttgtctacataccttttgagacaagatctctgccctcaaaccctgggcttacagacacactccatgtgagtggctcaggatttgaactcaggtcttcctgccataagaacaaatactcttacccactgagccgcctccccagacccttatttgccttcagtttttttttttaagatttatttattattatatctaagatgcaccagaagaggggatcagatctcattatggatggttgtgagccaccatgtggttgctgggatttgaactcaggaccttcggaagaacagtcagtgctcttaaccgctgagccatctctccagccccagttttgttgttgttggtggtgtggttg

SEQ ID NO: 34285 - DNA, 2117 bp, Mus musculus
tgtctgatctgacacagttggcaacttaggcgcctgaggctgcctgctgttaaggttctccagaggtgctgttgtttcttgggagtttttccttttactggctcctccctccgctctctccccttcagtcctggtagaccagatgtcagaatgaagcagatgtgttccaggttcaaggccgaggttgaccctgagaccttgaatcatgttctgcttaaaatcatgactggtgtgacttgtctctcacacaggggactctccttcacttaatccctgcatatcggttctccacaccaccagtaacagagcctcagtgcccctgcctctggtctcccctggtccccaagtcagggtaaagttgctgagagacctctgccattggagaccctctcccgggagttagctctcatggaagtggccacagttggacctggcctacttaaatggaaggcttgggtagtcaatagtagttagaagaaccctgtgatctcctcagagccggaccctctcctcagccctgtgattccctcacaggcctcatgcttagactaactagagaacgtcatgcagtagacagtaaatttgtgtggtgatgcctttcacagttggcccagagactagaaaatggcaaagcttttccttaggtggccgtatatggcagcatctgagcccagctgagctcacaataggagcgcccaagagaacatatctccccttcctgctttggcccctgacccatgctgtcagttgttctaggaacaggtcccgtggccaggagcatgggctctggagttgaagaacccagggctgcagacttctgatctgtcttctggtctcagggctcagttcagtttgtctctggaggaagggcagtgtgggttttggcctctgtgggctctaaagaaagggtgactgggtcctgggccgctgtgttacccatcagtagcaatggcacagttatttctttggtcatgtctactgtccatgcagacagtgctgtgagacgctgagccagtagggtactggttgggaactgcgcattcctggctcctgtcattgcctggcccagtgtctgccacctccttaaaaagcatccaacatctgtttgtgctgagaaagtcctttcccttctggacacacaccacacaccccacctctcatctccgacattgggatatcagaaacacaccccaccccaccccagacctgtgctgaaatgttcaagagtggcagacaagccaggcatggtggtgcactcctttaaacccagcaagtgggtgatagaggcgggtggagctctgtgagtttagagccagtctggtctacatagcaagcaccaggacaactagaactctatagagaaaccctgtctccctcctttcagagcgtgcctgacggagtcctctaaggatctttaaagtccttaaccaaggaggaacttttcgctttcgccagaatatcaagtttgtcatctaggttgaccaagtaaacctggtgttttctgggctgctggccgaggcttagctttaagcctttaacttggatggtggatgtgggaaccgctactctttctgtgtgtccgaggcttccagcctggaggttctcggcagtgtgcagcatgaggcctgagcatcctggagccgtcctagcaggtgcccagaccctgtaggggccttgaggctctggttccgtggtagggcatagaaaggagcatttcaggccagtgggcagaactacagagtttcattagcttataaatcttgtgcattttcttcttgatttttttttttttttgagacaaggtcttaagagccttctgcctctgctcccaccaggtcgaatgacgttagggtgacagggtgcgtcccgcagttctggctgatggtgtctgccagcactaccaggggcccactgtgctcaggacagactgtgtggtgctctgggaactgtttatttagtcaaaaggagtcattccatgggtcctgtgaggtagttctgggtcctatctaggctttgccttatgccctccactgctcgtcatcacgttagtcccttgacactggccactggccaccagccaccatggcagacccttcccagggtgcctcatggtccgg

SEQ ID NO: 34286 - DNA, 1123 bp, Mus musculus
cctggcagtgagagggacacctgccagccagtcccagcagcttccgggtcagcacccagcatagccaaacacatctctagcctggagcaactggagactagaacaggagccttccaccttccctgaggccaccacaggctctctcagagtcaggggccagcaccaggccacacatactacctcagcatctagcatctgtcacagcattgtgtggtcacagattgtccatcaagattgtgctcagagcctggtcgcctcacagaggctggctgacaccctccctctgcactggccccgcaaaccgctatgggattccttcctgcatcccatggcgtgctccagcgagcaagccaggcttctgtctcctcctgccttgtttagctctgacttaaatacacctcgaacccccaaactgtgagtagagtcagaaatgggagtagcttgtttgcagtgagaaagggaccgctttttcatattttcatcacaaggggtcttgcttcaagagaacccctaaaaactgtgtatatgatgctgatgaccagggtgatgaggactgttgtgatacctagaataattcacagaacttgactgcaggctttgtgtaaacaacagtaatcaagagtgtagggctggaaaggtagctcagcacccccacgggggctcgcagctgctgctaactccaggggatctgatcctctccttctgacctcctcaagcagcgcacacaaacataagcaggtaaataataatttggagactggtacccatggcaaaaagtatcctcaaacttaaaaaagttaactaagccttcactctgtctgtcacataacaacttcttctagatgacaccttagagttcagcttcatcatttagaggccatggaaatcctaggggctgaagaactgtatgttgcgaactattccaagtgggtcttcacggagaaagaagtcaggcacggtggtgaatgcctttaatcctagcactcggaagggagaaccaggcagacctcttaagtccaggctagcatggtctacagagcaagttctaggacagacagggccacacagagaaaccctgtctcaaaaaaaaaaaaaaaaaaaaaaaaaagaaagaaagaaagaa

SEQ ID NO: 34287 - DNA, 1177 bp, Mus musculus
gcaggcaagggaagggccagaggacttctgggtaatcttgactagtaaaggaagtacaggcaattcaggagagtggtcagcacacagaacagaacaccgatgctgttagctgctgttgtttcctttttttttaaataattttttaaagattgattattgttttttgtgtttgagtgtttcaccacaaagcattcctggtgcccaaggaggtgtggagctgctgtgtcagtgtcaggaatcaaacctgggtctcctgcaagacagacaagctctcctaaccaccgagccaactctcccagccctggggtgttagcttttgcagggactgggtgtggaaggtcaggccacttcctctgtagccttgacatcaatcaggcacagctcttggtttcagtttaaaggaacaaaagaaagatgctgaaagtatccgatagtgaggcggcctctggcctttctctgcacttccacttttggtgtctgggcagctccagaggtccctcagggtgggttctcacacaccctagactactagccagagtagtctctgagttccaggcacctagctggggaggtttcagaagccccacccgaacggttttatatttcctctcacggccagcacagaggacaaaagagcaggcttccgggagtgtccacggacagcaggccacctggtggtcaggtagaccctggttctgtgaagttggcttgcgcagccggtgaatgggggtgggggggggccgaagctgaaaaatgttaattttctgaaccagaaaagacttagcccctttgctagtctgttcccatggtttgtaagtaaacacagttcctcacttccgggtgtcagttctgccaagttgttgtttgagtcagctcagatgataaccaagggaacgtagtcatcggtagagacgtgtacctctgtgcatgtgtgcgtgcccctttacacatataagcacctgctcacatgtgtgtgtgtgcacacgtgtacatttgtacatccctgcacacacatgtacacactcttacacataaaggttatgctcacacatggtgtacacctggcacataggtgtgcagacacgtttaatacatatgtatagatagacacatacacatgcgcaagactatacgaacatatgtacgctcatacttaatgaaggatgcaggtatgtgt

SEQ ID NO: 34288 - DNA, 1151 bp, Mus musculus
ctcctttcttctttttgaaatagcctccccccacccccacccccacccccgaaattaagctagcaacttgggtgtggtggctcagagttggtggttccctgctttggtgtggggatcagtcctaggccaccgaaatatttatttcctattaggagacccgggcttggcgactggtgttaatgtggggtgattcttggtctcataggacttggggtctgtggagggattggcctgcctcggtgtgagacagggacgtggtgagctagtgaaaaagtctcattaagttggctgtatttaaaaaatgaggagagttcccttaaaagagattctgggtttctattatttttgaataatagtgataaataaaagccagactttgtgtgccacgtgtggggcctgctctcctttgttccttgaatctagcagctctgggtagcagtggggagggtgaggctccagcttgcccatctgctcctgtcctcaccctcactgtggtcccaggtcctggtcactctacaccagcctctgtctccaggatttgggcctttaatcaggatgccctgagaatacattccagcctcacctctgctcgtttcttctctttctctgttctttccccatccccatccagatgatacctgaggatcccacgtggaattttgaggttgctccttacattcagaccagagtcctgttgctgaaagatcttggaatcagggtgccaggcttcccacgtgatcactaagacacctgtctcatcttgtgctagcatatgcaagacactgggtgatttgaggcagagccttctgtgcctacccatgaaggctctcatgggaatctgggtactttctcttcaggacttcccctcatctgttccctgatcctgtcagcataccctctctgctgcccttctgggtgttagaaggccaactaggctgccttgcccataggcagttcaggagaggagggaatggctgctgtctgtgtctgtttctgggacactgtggtgggtggttgtgtttctgggggtggcccagcttcagcgtgagtcattttaggatctctctctgacgtcattccacttgaggaagctttgatgacgttgaaggggagggctctcctcccttctgggggacatgtggcttcaagga

SEQ ID NO: 34289 - DNA, 1953 bp, Mus musculus
agaaaacaacccagaaatgtgatatgatgttttcattttaatctcaggtgtgaggataatgggcctgcccggatgcagctgactatgatttgcacagtcctcgagcaggggtgtggtttggccagcggcagatagcatctgcaattgtgtgatgtttggagttctggaaacttttcagagggtctgtaaatgctagggtcctgagagacggggttggtggttattggttgttgggggggggttggctggttgttggtttttgttggttatggtttattaagtagccatgcaaagaagaacagaaaggaggaggaggagaaggagtagtagtaggaggaggaggaagagaaggaggaggaggaagaggaggaggaagaggaggaggaggaggaggaggaggaggaggaggaggaagaagaagaagaagaagaagaagaagaagaagaagaagaagaagaagaagaagaagaaataataattagatattttgtggcaaagatcaaacttgccccaaggaactccgatgcctctaataagcaggaagtagtctaacaataacatcgccccctttctgaccccctattcagggatctctttcctttcctctctatccctttttttcccctcctttctagtgttaggaggttggaaaaaaaggggtgaagaaaagtggaagaaagaagaacctgtaaggtaacaaaaggacgcctacagagcaatccatggggagcaagccagtaagcagtcctcttccatggcctctgcatcagctcctgcctccaggttcctatgctgtttgagttcctgtcttgatttcccttcagtgatgaacaatgaggtagaagcataggccagattaaccctttcctccccaagttggtttgatcacagcgttttatcacaacagtagtaattccaacaaagacaatgatttagcacataggtcaaaaaaatgtaacagtgtcatctacctggatggagaatgttccagaatcttccatgctagctgcctcctggctctctaaagagtttcccgaggaaaggaaaagggttagtttggtggggtgtctccaacaccccactccttgtagcccagatcaagtttagtttcagatatgtctttatcattctcgtgtgtcccgagcctagtgctggggactcagatcagggcccgtcagtggtttccatacgaccgatgcgtgctgagaattgagcagatgtgagaaccgggatcctgtcccagaatttgcctctgttgacctagtggctgagaaagcagccacgtgcgtagctgctctggcctcagagcgagggggccccttcctccacactcaggactgtggagtgtgggtgaccccttccctctgggaggaagggatacactgcttgtaggaggtaggacattaggaaagaggactttggaggcagcgcagtgtgtaggttgtgcccgtaccgctgacatgatgtcaggagccacacatgcttagggccacctagatagccaggactactctgatatgcaggactgtaaggcttcaagcaagccaggtctcctgtctgaacgttgggttcctcctccatagaacgggtccccgtaagctgtctgtctttaaatgataaggcctcatggctagtgcctggcccttgctcatgggagatactcaccaagagtcacctgtggttgttctcgacagggttattatcatcccacagggcatggacttccctggtccagtagggacttctggcttgtgcaaagggcaggaggccggtaaggccctgggaggctgggcagtgtggtgaatgggagagaggaggccaaggggtgcagaagttcggataagtcctggcgcacactccagagtggagaaaaacaaaacagcccggtctgcggtgaccactccatttcctgcaaagaaggaagttgcagatttcctccctggtgtccaggga

SEQ ID NO: 34290 - DNA, 1151 bp, Mus musculus
tgatggtttctattcggaggtccctttatgcagaggtaaagcctgcagggtctggtagcatcttccaggcaaagccaggtaccacccatttaaggcaagtctttctatgggatgctctacgtcttgagtatgtttcatagaccttggcctggcctagcttccctgaggtatagttctctgcagatgacctaccccagactgtgtgagcccaggctgggctgctgctgttccaggcctcccagaattgtgagctgacgtcttgagctgtttagcttggccaggtgggctcctagcaagctctttcccgagggaccctgagcctagctggtagcttccagaagggactgtgggactctctcattgctccctcaggacctgacgacacagtgctctctgagaagccccgatcataagtcatcctgctgctgacatctggctagggtagctccgagagcgtattgggtccttggcatctgagagcctgttaatctacaaccccacgggacttgggagctcaggatgccagccttctggatttccacagaagactgcccagtgccctgacccatgtgaaactaccaggcttggaccctggaaactccttccatatagggcatcactggtccctcagctgctgttgcctggcagccatatggatgacttcctttgcctgcccggcatcctgctctgctccaggggctggcgaggggagctcccttctcatcttctgctcccatggcagcgtttgtacccctttgttacgtcccacgtttgatgggcactgggtttcaatttcctttagactgtgcctgactcactcatccccacactccaccgtttatccactcctttgttctcacagcggatgcaaggcaggaggagattccggggttgtccacgggtctggaaccccatgatcaccgctgttggcctctgggtcgggggaggggggacgactggcctcactcagaactcggtcttgtgatgacaagggggaggaggttgataagaatcacgcatcagatgccagcacagagtgtgtcccggtgcatggacctcttgtcacatggttcccttgtatcccttgacttgtcacaacctctcctcccttcctggtctgcttctataagagaagaattctggggactagg

SEQ ID NO: 34291 - DNA, 1149 bp, Mus musculus
tttagttctcagcacccacatggtggctcacagccatctgcaactccagtgccaggggacacgatgctccttctgacctctgtgagttcccacaggcgcacatacatacactcatgcagtcatgcgcatagctaaaaccaacaaacatacaaacatacatacacacatatgtaaattatatataatatacaatatatatatatatatatatatatacacacacacacacacatttgaaacataatgggaaagaaaaaagcagtcaaggttcttattaatgaaagcacagttaggtaggtaaaatagagcatggacacccagtgggataggatgtagccatgtcaaacgtcgccacacatctaacatgcccgtctgtggcaaggttccaaaacctgtcattcttcatgactcatcattacacaaaagtgttgaacaaaggtatcgaacaggtgtatcagtgccttaaaaaaaatcaccagagagaacaccttgtgctgtcaagaaggatggtctctgggggcggaaatggggctgagagaagagttggggagagaaccgggcactttgggcttctcacctcttcctgttttctgtaccactttgaattttaccgacagctgccacgtttgccgtaattggcaaataaattataagctgctcggagcaagcaaaagaccttggaatctcccttgactgccgcctttgggagacagagaatattttccccggaactccagggcagtggtgactctctggggacttggttggaagtgatcccatccctcgggaatggtagctttggagctccaagtttctccagaggcttggaagaaagatgtagccatggcacaaagttggcagtggtgcgagacgtctatttcagggctgacctcccgccccagccacgggaaccttttattggtggaggattttctaggaaaatgaacacagggaggaggtgtggaatttcttcgtaaggtggagtgaatgccaggggtccccatgtgccagcgtggttgactgtgtgcacacatgcatgtgttggaagtagagggggtagggcgggtgactgttggaaggtgccccgctctttggaaggccggagtcaggagggtgctatttcttgagtctgctttgaactgtctaccg

SEQ ID NO: 34292 - DNA, 1147 bp, Mus musculus
cacacgcaggcaggtctgaacctgaagaggaatgtgtttcctgcttctcttgtcatccgagcaccattgtccctagctggctggctctgagtgtgccaggaaagagaggacaggagtcagtgggtcatcggggactatgccctgccctgtgttagcagaaagccctgggagtggagcaggctgagctctgggaatctcagtattgtggccttcctgtcaggaatcagtagtcataaaggaacagatgataaccagtgggagagagggggggtaggagggagagagagagagggagagggagagggagagggagagggagagggagagggagagggagagagagggagagggagagggagagggagagggagagagagacttgtaatgtgttcattgtggaacccaggaggtgggcacgtcccctggtctcacaacagtagcgttgttaattatcttttttgtggtgctgtgatcaaagtcaaagtcagaacttcactcgtgctaaggaagtgttctaccaatgagcggtacccacagctattttactttttggtgtctgtctgtgtgtatacgatcttgtgatttctgtgtgtgtgtgtgtgtgtgtgtgtgtgtgtgtgtgtaggccagaggtcagtctcaggtattattccttgggtgccttccatattgttgttgttgttgttattattattattattattattattatcattattagtattttaaatctgaaagactttctcactgacctggacctccttacattggcaggccagtgatctccagggaccctctcgtccctgtctacccagcctggggttactagctctaccaacttacttggcttttttcccccactgcccctgtagattctgaaaattgaactcggacccccaatgctcgcagacctagagctttgctgaccgagccatcccatcagacacttttatttatttaaaaaagggacgcaaccgaaattgaccaccgttagagcacactccctgtgtctgccacctcagcccacagcccagaagccctctggggtctccttccaattactacctttcttcttctcccttgatttctcctgaccacggcctggttcccttcgaggttcagtttcacagagaaatcgactgtgcat

SEQ ID NO: 34293 - DNA, 1182 bp, Mus musculus
ggctctgagctcatggcctttgggtgaagtgggtggaacctaccagaggcagaaggccatgagatgtagcaggagtcttttaacaggccaccaacctcccattttacaaatgagaaaacctagcagaccaacattatatagaaaacaaacatgtagactttaatgtatccagcagcacacaaatgggaggtctgaggttaatgtatccagcaggattgatgggaggtctgacgtaatgtatacagcagcagcatttgtgggaggactgatgtaatgtagccagcagcatgcataggtctgacgttaatgtatccagaagcattcataggaggtcttctccagcaaattttcacaagcctaaccaacacttgcttagggcagattcacagtagagtatatctggcacctatgcccccacacactaggctgttgttactgtccccagttctgccctttttgacctgcctcagtaggtgtggtcacatggtgtgttggttctctttgaacccgatgcacggcagggttcttgagtaactgattctgtaaaaggagcatgctagagacctcacagcagatggcgtgggacttggtataacctgcccaccatcttaggtctgtctgctcctgagagtgtgagtctggagtcgaagacacaggggttgcttagcattggcaaaggacctgggcgcagtccataatgcttagatagactgaggtgtgtgtgtctgtatctgtgtgtgtccgtgtgtctgtctccctccctccctccctccctccctccctccctccctccctccctctctcctttctttctttctttctttttttctttctaagactgggcttctctgtgtagccctcgctgtcccagaactccccactgttgaccaagctagcacagaattcagacaccttcctgcttctgcttcccaagggctgggatcaaaggcgtgcgccaccatgctgactcttgtggtgttctgaagtgacagcaagtctctgaggtggtaaagggttgtatgggtaaagtacttgacagggagatatgacaggaggaacagagcccaggctcagtgccttgggcagttggcagatgtggcatgcattgggacctctgagcaggctgttctagacagtgattatctatctaccagtgtcttgttcctggattgcacagccccc

SEQ ID NO: 34294 - DNA, 1122 bp, Mus musculus
aggtgttagcactggagcttccacacacatacgtgtacaacacacacgtgtacgtgataaaagaccaaagagctgagtcttcttcatgttcttggggcaccagaactgtccttgaaccctcctgattttccccagccctcctagaaacctggctttgagcgctgagactcccttcccttttgatgtgaaggcctgcctgacctctggagcgacacagtggctctcccagcctgggcctctggagcagcatggtggctctcccagcattctggaaagaagtggcagctgtgggttgttttttccttccaagcaaggggggttggcggggactggagcttccatgtgtcatgagcacccgctttgatggggaccgatgagtcactgagccgcacagggagggttttcacgtacatggtttgtgggtaagccctctttctgccctttaaagcagaattctatttgatcccctccccacttctctttgtggatgagtttttccagacataaccaggaggcagcgtcgccatttgacatgacctccgtccttcaggaggctgtggtgagcagtggggtgctgtcttgctttcagggtggcatgatgattgagtagccactggcagagaggacggtggcccacagttctgggttggccctcagtgtctcctgcccgcccactggcttggctcaacagagacataaaagaaaaagccacagctgtccacacggaggaattcaccctaactcttccagaggtatttagacttgcccggtggcgcggtggcacggtggcatggtggcacaggtctgggggaggagaagcttgggaagaagttaattggccagagttggtgtcaaaagcctgaggcccttgtgacattaggtgctttgagttttcacagtagccccagcgcatacggagagccaaaggcaggcagagatactcacgggaacacaaatcagctcctaacagggctgcagtgtggtagtaggattgtaccaggtaaatgtgttcctggagtggtaggaaaaccagcgcagatctaccaaggcttgggtcagactctgtgcaaggggctgtgtctgtcctcaaacgggatagatttctaggaccatgataataca

SEQ ID NO: 34295 - DNA, 1199 bp, Mus musculus
agccgggtctggaccccagatccagtttcctcatactgagctgagtaccccaagccaggcctccactttgttcctaatggacttcatggcagtcccaccttattgtggccttgttacagaggtttttgggaaaccggccaagctgttgtttgagctctcaggagatcgggcttgtctcaccaatggccttctggtttgttgtttggttggttttgtcgctgttgttgttgttgttgttgttgtgttttcagtttgctgttctgagacaagagacccactaggtagcccagactagtctgaaacttgggcaagcatcctcctgcctcagcatcccaagtgtagagcgattcattaatctctgctcagcgctgcctcttccggctgccagggctgaaccgcactcacacttggccatttctcttctcctcgtccagtcgcgacaactcccccagcctgaaagagatccgaaacggctgccagcagccatgcgaccgaaagcccaccttacctctgcgtctgctgcaccccagcccggacctggtgtctcaggaagccacattgtctgagccacggctgaagtcggtggttgtggcctccagcgaggtccacgtggaggtggagcgcaccagcactgccaagccggcgctgaccgccagcacgggcaacgacagcgagcccaaccttattgactgtctgatggtcagcccagcctgtgggaccatgagcatcgagctgggcccccaggccggccgcacgctcggttgccacgtggagatcctcaagctgctgtgagtaccctggaactcactgtggggagggcggggtttgggaggctggtcctgctgccagccggtgttctgtaaggggcttatgcgcatgctcctgagtcctatggggtaggtatatgcgcatgctccaattagaccaaactgtgcggaggcaggtgtgtccccatactagggaagctaaggcaagaggatgactacaagttaaaggacaacctgggtcttatatagtaggtactaggtcagcatgagctactgaatggacgctctcaaaaaaaaaccaaaaagcacgtgtatctgggagtttgggtcagggttctccagcatcctgtaacatcaccagccgtttagctaatgtcctcagtcgtgggtacacggcaacctgagttagggttcagagggtggcggtgtctc

SEQ ID NO: 34296 - DNA, 1099 bp, Mus musculus
caggaagcctgctcaggctccagcctctgtgtctccacctcagccagcaggaaaggaggaagcagcaggaaacagccctcccttccctcagacagtcttcctagaagttccgtttttttggtctggctgtccatattcagtacctggtcatatataactgcaaagaatgctgggaaattagttgtaattgaggggacagctaaaagtcaaagacaagaccctcacagtccaggacaattggcatgtgtggctctctgccggcttggagctgagggtggcagccagctcttcacatgagagggtgtgcccacacacaacacagacgagcacacacacacacaccatgcatgtgcatgctctgcttgggagggtgctggcttaggttacaacccagatgtgactcaaagctgtgagtcacatcgcaggctgagccaccaccccgcagcttctggggagcgcaaggccctcggggtggtcagagccagtgttgactgcagacaaggcagagggcccaggcccacttgatagaggcatcccagcctgccctgaggtcatgcgatcatgccacccactgcaggatgcggacctggcccgcctgctgagctctggctcctttggaaacctggagaacctcagcttggccttcaccaacgtcaccagtgcctgcgccgagcacctcatcaaactgccttccctcaagcagctcaatctgtggtccacgcaggtgcccgccccaccctgccctcttcctcaccccctctacttaacctttcccactccagagtccatgggcccagccacttgctctccacacataaccctaacccactccccctgagacaagaggaagttggtggccttgtgcccatttcctagtcgggaacactgaagcccagggcaattcctgcacagactcctgagttgggagacacgggctgagagtttacctcagttcatcttaggcctttccaggttgctactgagaagtgtatgcatgaatattctcttaaagcctgctggggtcccagtttcatataccgacctagctctttggaatacacaggttcctctgtctctggaaaagacgcctcaagcacta

SEQ ID NO: 34297 - DNA, 2297 bp, Mus musculus
gcatgaagctctgtctcaaataaacaaatgtaataaaagttatcaggtgaaagaaaccatactgaggtttaaggatagaggaagctaagtggagtccaagctggctgctggtgtgttctgatccctcaccccctctgactattctgttagcaatgggaagggacctatggaagtcccgtctgatttcgtggcgctcgggagctttcccagaatgctacggttaaccctaaatgccacctgggagccagagacagggctcagtttagctgtgatcacgagaaaacaagcctcaggacatcagatgtgtcgtccaatttcagaaggcaattaaaattgtatctactctgggtgatggatgtctttgaggccacctgtgccctgggtcaccagcccaaccccttccagagccctgagatcccacagcctcatagtggacagggtgtgggtggtaggagacgctggctggtatttgaccaggtactttttttatcatccacaggccaagcttcctaacctaaaggaggttgatgttcgctacacggaagcctggtgaagccccctctgtgcacaggatgggctcgcacaaaacaaaacaaaaaagaaacaaaaacaaaaaaagaaacaaacaaacaaacaaaaaaaaacccgactcttgactaatagccgtagagcagagcagtgggtcccggggtggtcccagcacctggctgcgggatagatgggggagtcttgggggggcggaggggggacgggtggggaatcctcggcacgcccagcccccacctaattcttagagcttcatattggaacctttgaccttgatcaaaagcagccttggtggcaacaagaggaagaactgcgggtagggagggcaggggaggggtgggggggttccctttgtggattttctttgccttttgttgtgtgataccgtaggggggggcggggggagggcattcatccagcctgatgctgtccactcgggccagaaggaggacgctttcttcctggaggtgcaccgagccgagatctcgcccctaccattgggacaggaatgtcatgtcaccccatcgtcctgtgtctcccaccatcgctatgcaaagtggttcttgttgtacataagatttaaataacgcacctatttaagaaacgttgacaaattgtgggtctgggacccgctcttatttatgaagtctttgaccggccctccctcctcacctgcccccacttgcctgcccttctcacctcccccatggcgtgtagtactgtctggaccagtcagctgtcgggttagtgctagtggttctgttttgtttttgttttttgttttttaaggaaacaaacaacaacagggggggaaaaaaaaaagacctttggaaacttaattgcttttttttcttaagggactcttgtatgctaatgctctcctggtcagtcagtctgcccactcgctactctgtataatttccatgtgtctccagtttccttgtgggtggggatcaaggtgggagggaagaggaagaaagagatagattctccacgttgtagctcacacctcccctcctctgcttctgtgaatttggaagggccttgaccttccctccctgtataccccataggagagttggtcctccaaggtccagctgttgtccctcacccccttttaagctgtccttgtcccctactgagacttgcaacctgtggcctcccccccccagccctctgtggttcactaagcatgccccacgcccacttctttgcatggtctcttgggagagaagagctacttcacccagccagcctgacctcacccgactgtccacaccttccctccactgacgtggacactgcagcatccccttcccatcgtgtcccgaggcagaccaacctcatttctttttacagacagttggctttttcttaccaagccccttcactgtacagaaacaaccctttgacaattcttttgggagtcccccctctctttccccgactccagccctttttatgttggtttagcacaaatctccccccaacctccaaaccagaccccctaccagtcgatattaattgttttatatctatttaatcttattcgatggagaccatgcttcggttgttttatactttgccaggtaaactttattacccaccccacctccaactatgccctaatttttttaaaaaaggaaaaaaaaaacacacacaaaaaaaacaaaacaaaacaaacacagagactttgggttcgagtctcggtcttaattccctttctgtggcaggttttcttccgtgcgtgt

SEQ ID NO: 34298 - DNA, 1178 bp, Mus musculus
ggtaacccaggtgttcaaacacatgaacccgtgtgtgtgtgtgtgtgtgttggggggggcggcatttcataattaaactgttaacactggcatagtccaccacagtccctggctgtttcatactgacacccgtggcctagtgctctgagttcttagcagatcatagtctgtcgttacttttattgataaagtttcattgcaatacagctatgctcattttcctgtatttggtctgtggctgcgttcacacggtggtgactgctgagtgaggatagcgggtgacccatgcagaaggcatctgctcgcccctggcaaagaccatgccaggatggagccttatttatgtggctctgaatgacataggtttgacattgggtccagtctttgatcaccttgactaggtcctgaggaggaccttgcctgtcctttggtgactttgtgttatcttcgacatctttaaggagctatgggctcaggatctgaacaaagtccgggagcggatgaccaagtttatcgacgacacaatgagagagaccgcagagcccttcttatttgtggatgaggtgagtgggctggggcatgtcacgtgagcaggacttcctttatcccttcccctcggaaggtgtcactgtcaggtgtccgggggactgactccgtgtaaggagtggttttcccagggtggggattaatcctgcttttcattttcctgattcttacctgggtgggattacctgtttcgccactagagggcgttcgccatcagggagaagccaactgaacttgacaaatgtttgatggttgtgtgagccatttatagaggacacttctttttacaggtggccggggaggatcagaagggacatggcttgtcacttgctcgctggggctgtttatggcagtaaaatgtacctctgagccagtcggtgtttctgatttattattattattatttaaatgctaggagtgggtagatgggaaagtccctgggccccttctcggcctccttgtttttgccatggtaggaactgaacccaggaccttctgcatgctaggcaggggttctaccacagacctataacagtgggactctttgtaatgtttattttgtccctccacccggcccccaggaggtcagaggacagacagccttaagtgtaggtcctagtatgcatccttat

SEQ ID NO: 34299 - DNA, 1116 bp, Mus musculus
tggtcttgtccttggagaatccccacctggagacttactgtgtggcttctcatacctgggctggcttgagcatccttagctctagggcgatattgctttgggtagcaaagcttaactagctcttcctgattggctagctagcctagggcttaaccagtaagatttgaggctctttcctgcttccaatagggtctgactggcctttgtccaatgccagcaatccccggagggtgtaggtgggaggtgtgatggaggcgccccatgccctgcgctgcatgttccctctagctgctgcccatctttggcctttttcttgagtagagtccaggcctagttcaggcttctggtactgggactcctgaacccctgccttaggactcctggaaacagccatcaatgagttgtcaggagagggcagagcgagctgtaataagccctttcggatgcttgtggctcaggacactccccccacggagctgcattttggggagaaatggttccacaagaaggtggagagtaggaccagtgcggagaagctgctgcaagagtactgtgctgagaccggggccaaggacggcaccttcctggtgcgggagagcgagaccttccccaatgactacacactctccttctggtaacgcccccttcctcggaggctggtgggtgggaggtggtgtggtcaggctgtgtcctgcctggctctgatgggacatccctgtctctattcccaacaggcggtctggccgggtgcagcactgccggatccggtctactatggagaatggggtcatgaagtactacctgaccgacaacctcacgttcaacagcatctacgccctcatccagcactaccgtgaggcacacctgcgctgcgcggagttcgagctgcggctcacagacccggtgcccaaccccaacccacacgagtccaagccgtaggttcctaggattgggtgggtgacccatggaggtgtgaccactatggggttctcatttccaggaccccgttctctttgacaatgtgggttcttagaagtctatgataactattcccacttgtcagactttgtcccatcctctctctctcttctctcttgcttgttctttaataatttt

SEQ ID NO: 34300 - DNA, 1142 bp, Mus musculus
tcttttcaagtaattttggctacttatttagaatattttttctttcggggtttatttttattgtatgtatgtaagtattttgtatgtgcatgtctgaggcccgtggaagtcataagagtcatggattcccctggaactggagtgtcaggcagttatgggctgtcccatgagtgctggagagcaaacccaggtcctctgcaagagtagccagtgctcttaactgttgagccagctctccagcccctggggctcttagtctcgaataccacgcattctcaacatctgtccaacttatggtatcaaaggcaaataatgactcagggaggtcgccatgtttaaaggtgcaggaagggttgccttctgacccacaatcaagttcataaagttcccaagacaaagaagtaaagagatttgtatccatttgtatccattggtatccatttgcagaatgcaaaggctcacttctgaagtcagggtactgtgggcttttttgtgtgtggactggctcacccggactatgaaaacatatccttgccgttttacctttattgacttagggtcaggagctgagccgcggtgcaggcgtggaggtcagagaagagtttagcagagtccgctccctacgtccaccctgcgggtcctggggattaaactcaggttcttcatgcttcaaacacaacatctttaccactgagcacctcagcaggctcaaagtcgtgtctgtgacctgaatccgaatctgaattagcttttacttcccaagcttttcactgccacgtcctttggaaactaagccttctatatcgttatatcgtttctatattgttgacaccttatagtattttgtatttcttagaatctcaacgtgtggtccaggctgagctcaaacttacaggcttgggcaatcctgcttcgacctactgaatagcagggactccgggtgtgccccaccccacctagccatctttagttttacgtctgcattactgctttccccaatactctcccatccacttccagccttttgtaatttgttcttaggcttttttgaaaaccctagactgtcggattctttcccccatcagagtccagcccagttgcccagttaggtggaagtgcttgctacacactcaaactcctgt

SEQ ID NO: 34301 - DNA, 1163 bp, Mus musculus
atcccctaaagtcttggagcttctaggagcgacctagaggcttcctaacaccttaagcaaatgaactaaccttcaaagaacactgcctaagctccgcccaccaggtgtgttctcattggatccttaaagagccgccattgccaaggaccaagggggaagtggacattccccaaggctcagggggtatgctaggagcccagagcctcctccactcagccacaggtgacctgcgaggtagggtgggagttacccactgatgggactcaatctcctgtatttcaggctgagagagaagagagtaagcaacagcaggttctactcctagaagccgtgtgtgcgtgcgcgcatgcgcacggtgttcacgagcgcatctgggtacgggagagccttataaacagcccccaggaagagattcatctgtgacattcatcgtcctctctccgagccactcaccatagagatgacagttctgaagacgcccccgtgggcaggaggcgttgagaccttcctgctatttttccaccttggacaactttcttaacttatactacccctgatagaggatccccccaactgtgtgccttttgaacttccctgttctcagcctcattgaataaagacaacagtttcatgccgttaagcgttctgtacctgatctgtacagtaaacaggagttcctctgtggtgagcaagcttctacctgtgtgacccaggtaactgacttccccggaaggtgagctgagacacggggaactaattcattagattccaaaaaaaaagatttcagctaagaggcaaatgattctatagttcaggccaccactgtattctacacaaccccaaaggctggtcaggagctgacctcaatgtgtgttagctaccactggcaaagcagttgtctagacaaagctacatggaatctgcagaaatgggagatagagtctgcccttaagacattttttctttgactcatggctagtgatattggagtgctggggtgctagcttattgcatgtccttgttgtatctgccccgactcatcacatccagggtcctcttgagtctggtaggaggctgctgccaagatcctctggggccacagccaatagcatcattgctggtcaaagaggcagctgaaaggtaggtttacaggcaaatttccc

SEQ ID NO: 34302 - DNA, 1146 bp, Mus musculus
tttgccccttgatcattagaggttttcttttggttgttgcccttgtccaggtttggtgggcatcgtgttgtcttattttctgtatgttttacatttccacattagggtttatgtgtctgttggaatgactccatcttcccctgtgtgtaaagactttctcaataagcagctttttccttgtggtgtgaagtgtggtgtcgattcctgtgtcataatgataagtatgttcccagctgagccctgtaggggatccttctctgtagcccctttagctggatttgaggaccatgtacatcaaatccacgacaaagacccactgtctgcaggtcttaacaatcattcaaagtggtgtggcatagacaacagagcataaggtttgtgttctatgtagttgtcaaatagtgggagtgtagcctctatcagctgacagaagcttcctccgacatcctggcaattagctgtgattttgaggctggccatggtggtagactaaagcctttgtcctctaattagacttcagtccacatccaaaagttctattgggcaagtaaacacagctccctcctgcaggactcatgaccaggcttgtcggcaatgaacaccttgacaggcagtgtgtgcctgtgcaggtgactgacgggcagtatcaggagacctgtatttctcctctctgctgctcctgtgagagtaaccagacaggagtgagacctcaaagctttcgtcaatgtgcctgtctggagacctgcccaacagggagtttttgtcccttattctttggttgattggttggttggctttaagacaaggtctcacatagcccaggctggcctcaagctggcttaggcagctgagggtgtccttgaactcccaatcctactgcctctacctcccaagtgctggatcacaggagagcaccactataccctgacccctaacctttctcttttttctccttcatttttttaatctttttatttttgagattataatacaagtacatttctcccttcccttccttcaaaccctcccatgcaacccctccccactctcctttaaatctatggcctctcttttattgttattacatccatatacatatttattctgaactatgacctgcttagactgtgcactgttatttgtctg

SEQ ID NO: 34303 - DNA, 1100 bp, Mus musculus
agtttgtttgggggatgcagaaacaaaaccagcagagaatttaattgtccttagccagctgcatagatttttaatccttgcagtctcttttcaatataaattttgtttttcttgttgcatttggcatgatgtttttggcaagccttgattcttttttttaatttgaaattaaatgtgtgctatacatcttcctaacagatatgagactttggtgggaacaattggaaaaaagtttgtcaagaaaagggaccgagccaattacgaagaagatgaaaatggaactataaaagccataaaacctaagaaaatgttcttaaagccccaagactaaaatggatgcctccgatacaggggatggctgtgagcacagcatggtcggaactcatcctcctgtcgtcggtactggttaaagcaccgtttccctctaaagaaatgcataagtttggagatgtgctgttcttgagacagatgtgtaatggatgttatacatcctttttatgacattctcaggggcttcagatatgtgggcacaggccgctccctagatttttgacctgattctgtgtgtatatacccacagacaggccacatgcacaccgttctccagttactgtccaggaatgacaattgtaaactaattattgcctttgtttaactgcccttatatttatatttatatttttttggatcatgtctctccagttcactttggagtcacatctttgagaactttccagaagtgatttgtcaggaacagacatggctctcgggcctttgtcgtgttgagtagtgtggggtttgtgtattttaaacagtcatctgggtcatttttctaatgttctattaataaacttatacttttctgttttcttacactttgaagtaattttagtcttcctcagtagtacagccttatgcaaataataacttataaagactagctatgaactgagaatatactaatatctaaggttgaaccatagaaggtttccttctgtcagtcaagtacaataaccagtttcgtagggtacagcccgatagaatttagcactgactaaaccctacctagcacatgggcttcctgtctgtccagagattct

SEQ ID NO: 34304 - DNA, 1162 bp, Mus musculus
tgtcgtcccccccacccaccccaccccccggagccatataactgaaaattccaccagagagtcagagagagctcacagcaagtccctttctgtcttcctgaccatgtatcagccccctctctggtcctgaacttgagtttgactctccagttcagcaaggctagcctctgctccctgctcccagctcccaaaggagagcttgctccacttggcagttcctcacagtcctcacggccctctgctctcattagttcaccgtggatacacttgtgttcggttttgtcctgttggctacgatgggtgctgattgagtgcctggaacggaaggtttgtgttgttgccctgtgtgatgtaaatggtttcttttctggcactgtgtctggaccaggatgtccattctttccttccttcctgctccccaggccctggactcacctgtgcgtagtgtttttggtcagaagcagagcaggactccataaaggagtctgaggcctggccttcgctggccgtcgctggccgtcgctggcttgctggagaacatgctgacctgggatttgggtcccaaaccaaagactaaagaatcgctcttgcagtcagacgtactgtggcctgttcccgagagcatttgtgcccatgctttctgtgctgtcccttgcggctgcagtttgtctgctggcccaacccccagcgtcacaagctcctccactgacacaggagccacggagacaaggcttcagcctggtgtttatagccagccgggccttgtgtgagagccgcccaggcctgctgtctgtccccgtcctgcgttctaatggccattctcctctcctgaatatttaatgagcactgggggggggtcactcaagagtcaagtttttttgcttcagccatgaaaagttcaagtttatcaagaattcctggggtctttgtgtgatgtaattatttagaggtgggaggaagccatgcccaaggccgtggtggctctgtctcccggtgccgttggccagatggatcagcttttactgctaaccctgggtagagatctcactgcgctctggctcgctcctccggagagccagcagatggatttccacccagccctgacctccgcctctgcacttggttgtgagcaggtgcactgctaacacgggtttcttctcct

SEQ ID NO: 34305 - DNA, 1102 bp, Mus musculus
tccctttgactattccgatgcttttgtattcagttgttcctacagcaggcctcttgggacctttacgggtaagtgagttgtgtagttctcattttgagttgaacgttcatcccttgaaactgagaagactgtgaaaatatagctttaaaatggctgttgaactcagttgaaataacaaactcagaaaattgagattctatggaaacctcattatgtttttatctaaaccaagaggtctgtcttgacccagtttttttttttttttcttcttggtggcctaactacaggtgtgcttagctgaggaggaggaggaagaggaagagggtgagtgcagaaggaaggaatgaagacaggtagcaccatatgcaaacatgtgtccttccatctccacagctctcagcttaggccagccttgatgggctgcaccttccgcccacctgaaggctttcctcccacgacacctctctgccacagcatggtaaaaaggctgactctaatactaaacccccaaatatcacctgcttgcatttcctgatggctttgatgattcatgatattttgtataagtatttcaatatttaagaaaacccaagttccaccacggtctacaagaaccaggaagatctgcttggctgctaagattctctttagccgcttcccctccatgcacagcatctatctttctattcttcaaacttatccatctctttgctgctgagccaatgtgggctacagttctcccagcccctataaataagttcagaagctttagccctgtgctttacctcatgaggcaatcaatccagttttgtgaccttctatactctttccatgccttctattgctgcccgagagtctcctgacctccctatccaccatatttctaaatgtaactcttccatctgtccactggccctgaggcagaatggactctctcctcttgcaatctatcgacatagtatacgtgtgtgctcttagatcatgacccgctgcattgcaggcattttaaatacatctgaagcctccatgagaccataggcttatcaaaggctgggaaagtgtttggctcagaggtggagcggggtgactctgtgacgtggct

SEQ ID NO: 34306 - DNA, 1891 bp, Mus musculus
cagtcctgtccagagaggagctgaagtatacagtgggccttggagctgccagggagctctgctgcgttacggcaggaaactgaaagattgtaggattaaagatgttcaccggatgggtatatacaaagaaggaaatggaaacaggaagtagagtcagaactctgaataaagatgtctaaatacgaggctagagacgtggctcagctcttagagccgtaagctcttgtagaggacccaagatcggttcccggctgtcccgtgacgctgctcaccactctgcaactccaccttcaaaggcctcctcaaggactcgcactcacccgcacatacacacacaggaataaggactcacactcacccgcacatactcacacagggatgccagacacataagcagactgcttatttaccatggcattttgtagactagtgtgcacggagagtggggaattgagcagatgactctgctggagctgatactaatggtcattttcttctcccacaggctgccggtactgaatccagaatgttgttgtcccgagccaagacaaaaaccaagtggctttctgcaactaactcctatgtgtggacaggtttataaacgtgcattcttatcacagcctgcatagcctagagtacccctacaccccatccctcaaacttgctatcttcacatcctggtcagttctattaattattaaacactaaaattttggcggtttctggataagattgtcaaacgttttagtgatttttttctgagttcccctccccactgctcctctgtggtagttgctgtgtgataaagtggcagagtactcgtgatcacgtgaccacagcccctcccctggcagaagccgttcgtgagccgtgagtgtgtagggttctttgattttcagtgcaaagtgactgttgagccgcccgccactggagtgtcagaagtacttctccagatggcccaggacatttaatagttgtttgtgccgaagcgtctctcagagttttgcatgagattctagtagcgttggtaggacctgccatgctcatccggcagggtatcagagcccagtgaccctgtcctcccttcaagctactgactgaaagggaagagaccaaaagacccaagtgagcccagccctgtcagcaaggctgaaaaatgccctttgacttgtgggaggtgctggtttttaagaaatactattttacttgaactatttcttgtctaaattcttgcacaatgagttctattattgattaaagaagacagatttacattcaggattctggtgtctggaggcttagcctcaaagccagttttgatgacttagaaggcaatctatgtcactgtccccacaaagtgatttcatacaataaaaaccaagagtaattaaacattgaagaatggtgtggtccttcccagaggaaaccctggccaagtagagcgctctgctttctcgattgtgccgcagacagcttacggacaacttgtcctgtttctaaagtgacggggcaaggggagagcacctgaaactgtgttgttggccttgctctcaagtagtaggaattcctgtcatcagccagtgaatggcactacaggttgagcccctggaggtgccactttgtcacacggagacaaaccagctgcagcctgcatgggggacgttcttggtcttataaatggaaactcaggagctgcgtgtcctcagaagtcagtgggatggttcagaaagcagtttgctgccttctgggcagattctccaaccagaaaccccatcatgataaaggtgctagaactgctgctggcatacccttgtgtccagggggcttgttacctcagtgttcagatggacaaggggctgccatgttagattccaaactgaagcctcgggaa

SEQ ID NO: 34307 - DNA, 1349 bp, Mus musculus
cccagcgcggctgggtgccagtccacacccgggacctaaggaccctctccaccattcgctccctgcctgttcccgcatccccgcatcctattgctgagaccctccttggcgcggggaccccgagcgcaagccccaactctcactgccgctgagacgcctgtcccccaacccagacctcaagatcctctccattcctccctccactttatctcatctccacatcccatagctgggacctcttcttcccgcagggacacccccgtccaagaccccaactccacccggaccgtattaccctcacttccatcctcttcttccgcttccttgcatccccatatctcatagcctgggaccctcctccgcgtggggatctccagagcgagccctcccaccaccccatcgcggctgaggcttgggtccgcacccaccgaggaccctctcctcagtcgcccccctccacgttcccgcttccactaattacatagcacggacccacgctactccccttccatcgtggctggggcaccggtccccactggaaccgcacgaccctctacatctcctccttcacattcccgcatccccgcatccgatagcccagtccccgagaactgctgtaagtctggccgctattcccctcttcaggtcctaaccaaaccatcacttgagtccctacgatagggacaagaactgggcactgctagccccctcctctctatcctggattcttccctgcacttccccacacacagcccggaaccaccactgttctcttctctgcggatgtagatgagcccccgtgctgtgccgctttgcgagtgaagccccttccccagctcctctctttccatagaatcagaatcattgcctggacctaggcgtcctcacccccccccccagctccaccctgagcaactgtcctccttcactgtcttcctgtcctcactcttggaccccagactcactcctcatcccacctcgtgcctcatgcaccacaccgctctccccaccccagccctgcagagtggggtggcatataggcaggaaagagttggtggtccgtggaggggcttctgggggatgggactggtcctggggggggtgcctgtacatgttatggggttctgagagaatcggggtatttttgagtgtgttcatgagttcatgtgtgtgtgtgtgtgtgtgtgtgtgtgtgcacacgcacgcgcgcgcccacgcatgccagtgggtgccacatacccctacaagtgtcaggggactggaaaccctattccccacttggcttcccttgctagatctcagaacctgtgggtgtgtctgagcaggagggctttggaaatgggtgttct

SEQ ID NO: 34308 - DNA, 1136 bp, Mus musculus
agctcccttgccctgtttctgtgggctgcaggtaagcagagccatctgtcttttgactcacggagacttgaggagtggcacgtcttgtctggcttagcagatccctgacagacctccctgagtctaggaaaacgaagggagttggagggcctgggcatgccataggctgacttctccttctggataagggaaccaattcctccagggccctgaactgtctcagaccttacgatactgggacatcaacaccacacagaattggttaaaagacaatactgattcagtgggttcagggttagacatcaattcccttttctacgagttggggaggtcttagcagacaccttggtcagtcaggagctgctggtccacctacctggggtatggcctggacagagcagcttttggaagtgccctgcaattattagaacagcctcttggccctgggcacccagcacccaccatcaactgaccttaagggatttaaatgtcagcagagcaggaagtgactttgtctcaaagtgtgggtcccaggttaggactgctccccaatcccgtctctgctagttgcaaccagaacatccctgcctgccctctctccccatcccatacatgacgccatacttcttgtgggctgatcttgtcaccaggtttcaagatcaccaccttcagaaggaacccaggcaagccagagcaaggggaggtgggtcctgaaaaaacagtaggaaggcgtggagctctcgtgggcctctctgagcatggctgggtgcagctgtgtgctcagtgatgggagagtctagggggatgagtgtgcgcacacctgcagagatgcgtgtgggtgtgcgtgagtgtgtagcacgaatgtgtgtgtctgtcagcagccgtgggcaggctggcagcgcagtgggaagagggattgatagcttgtgaaggctggggagggcctctgcctgctgcagtctctccacgctgggtcccagcctcgaggtctcccggggaagtttgggcttccaagctgctcctgggagagggatctcagctgggtcacgaggctgctcagggcacctgcccaggctcatctcaggactgactccagccctcctctctccagattttccgccgcgccgataaaaatg

SEQ ID NO: 34309 - DNA, 1552 bp, Mus musculus
ctagtatatccattgatctctggggaacagaagcttctctgggccgtgctgatgcaggctggctgataaaggtctgtctgccccacacatgtcagggttagaaacagtctaaaatgcctctcacccatactatggttagcagcctgggctacttaactctggctcaaaagtgatgcctaccctgctagcccagctagtggagtttggtctcggattctcagaaaggctgtagctgtacaccattgtggcaccattgaccagtcactgtcctcttgcagggatcatgcctggccgctacaaccaggaggtgggacagaccatccccgtcttcgccttcctcggagccatggtggccctggccttctttgtggtacagatcagcaaggccaagagccggccgaagcggaggaggcccagggcaaagcgtccacaacttgcacagcaggcccaccctgcaaggaccccatcagtgtgagcatcgcagtagccagccacagaagctaacaagccttgaaccactctggtggccacacagcgcctcagagagcattctgggaagtgcctgtttccgaggaaccctgtctccagcttgtggctatcttactgtgttctgcccaggcacctgatgaggtacatcctgcagtgcctctctgtgcttggctctggcagaaggcacccagtgacatcaggcatcaggcccagtgacagtgcaccaaagacacagagcctggaagggctgtcgggacatactttctacataacgctacaaccctgaccaagcaaagacatgcttgttacaggctattttctatatttattgtgggagagtcactttaaagactgtgctagttggaaacagagctgttgctgttgtcagtcgagtgcagttttctgcagcgatgtcataaggagtcagattccgtgacctcctctttgatggaggacacactgaactgaaggggacttgcgcggatgtgggagatgcaagccttcgctttatttttttataactatcaactgccatcatgttttgtaatttggggatcttgatttcaccgttgttggtgaaggaaattttcaataaatatgcataaccttacaaagctggcatgtgtcgtgccccagccccctgcaccttcccattctctctgacagtgtagtatccgcattagctagcgcatactctgtaaaagtgtccaagtcaggcgatgctttggtgagccctactgttctcactaggtaggatggacagtcctacttgactctttttttttttttttttttttttctttttggtttttttgagacagggtttctctgtatagccctgactgtcctggaactcactgtgtagaccaggctggccttgaactcagaaatccgcctgcctctacctcccaagtgctgggattacaggcatgagccaccactgcccggcctcctactcgactcttaactccagaacattcttattactcccaaggaaaactcgagcctgttagccgtcacctgtaccttcccccttgccccacagctagtttgctttctgtaa

SEQ ID NO: 34310 - DNA, 1199 bp, Mus musculus
gttaactctcctgttccacagagaggttaggcatttcagagctgatgtgcaggcacactcctggattctcaggctgtatggcccctcgtgctaaggcaccttagcttaaacagtgtgactccgctgttagcactgcccagggcactaatacctttttacatctcgattcatcgagcatttcaaggtgtgctgtctgcttggcactttaggggttctattgctaatgcctgtgcttacatcttatatctaaatggcatgtggatgggcacacattttaaaagttaactacgcttgtcctactcctgtaaatacagttttgtgagagttggattttgttaaaatggaaattagtaatgctgaaaatactgcttccctgttctaaggatttgtacagttctgattgactgttgtattttgctagtcttaggcaggtcagtttccagttaagtggcaactagaaaatcagtaatttcctcatgagaactcagtgctcttctcattgtttactgcaggattggaggtcttaaaacaagagacagcagttgtggaaaatgttcccattttggggctttatcagattccatctgaaggtggaggccggatcgtgctgtatggagactccaactgcttggatgacagtcacagacagaagggtaagaaaagaacacataggaggactgcgactgtagctcagtggcacagcagtttgcctcagacatgcgaggccctgagttcaatccccagcatgaccagaataagacgttcatgagcttgaagatttgtgtacacagccctctttccgttgtccctggaatgatactggccagaagctggagaataaacaggtactgtgattgctggaatatttctgcatatacctgaaggttaacactcaggatacacaaacctctacagaccttagaatcccatctctattttcccaactgactgtgacaggcatgaggcactgtcacttgcttagtacaaagtcctgggctggagagatggctcagtggttaagagcaccgactgctcttccagaggtcctgtgttcaattcccagcaaccacatggtggctcacaaccatccgtaatgagatctgatgccctcttctggtgtgtctgaagagagctacagtgtactcatataaataaaataataaatctttaaaaaaaaattcctttaacccaattggccc

SEQ ID NO: 34311 - DNA, 1104 bp, Mus musculus
cctcccttcctgagcacagacacctgttcttcactctctgtcgcatgctgttctgtcctgtgtccttcataccaaacataagaaagttcatgtgcacctaagacctgtggcgctgggtgctggagtgccgctgtaaatgtcgtcttatgttgtggatttcctttagcgtatttgcctcctttctcacttctgcttcactggtccgcctagatccagactaggcctgtctggactgcatgccagtgaaatgccagttttcatttcataaaagaaaagttcagtgtgtctgtgtgtagaggcagacagttggctggagtagtaagcttacatatttctcaaaccaaacggcttgtttaagttgacacttttatatgtatgtgtggactggattttgtcaaggaaagaggaaaagtatgtgaggattttaattcttgccttctctgtgccttctgccacttttataggcagtggtggatgccagacaccggaggagcgaacatcccagctctgaatgagctgctgtctgtgtggaacatggggttcagtgacggcctatatgaaggggagtttgtcctggcaaaccatgacagtaaggttttatgtctgtgtgtagaggcatacaagtggcaaaaggatgagggtgtgggctacatgcttaagtctaggtttcagagagatgggattcaaaagttagctgcagtgcagaaagacctacagtgattttaaatagcacactagggaccggggctgtacctctgtagttacctgtcttgcatgtgcaagaacttagcttcagttcgcatcactgtagaaaaatgaactggacatgtgactcagttgataaagtatttacttagcatgcacaaagccctgagttccatccttagcacaacataaactgaccatataatcctagcactcgggaggcaaagcctgacaggtgtttgacgccactctgggatatataatgaaactcttttcaacaaacaaaaaaagtttatttatgtactttaaattttttcttcagaaaccgcatgctactagcacttttcccttgaagtttgaaaggattacttgtagttgatatgtaacaggcaatagcag

SEQ ID NO: 34312 - DNA, 1174 bp, Mus musculus
cttcagatgctgatgctgggtaggtgatgctcatacacaggggagcaccggggagcatcggggagatctgccttgactgcagctgctgctgctttccttctgtctctttctgtgctgtgcaggacaacactgcagcagtttgccagctctttgacagagcttttggcctgccttgtttaccactgacccatgcacatcctccttgggtctagtccctcctgtgtctccgggagaagcactaaaggttttcaatactggccttgaactcagaagcctcagagtgctggagttaaaggtgtgcagcatcatgcctggctatgactaaccctttcgtcactcattttactatagccttttgtgcagctctagtgctgtgaggtcctggcatgtgtctgttatctaagggcttaaaattgcagggtgaaagtagccgtcctcgcattgtcctgaggaagtggcacatacagtagatgtaactgtggcatcacacctggatagtgtctgttctggtggaagagacagacgaggcacgctgacggcctcagattggtgtgagaacatggagaagagtgagagacggctaaggaggctctggggaagcccatggccaggagagattgagggaacctgaaatgcaggggaaagaaaccctccagatgcgtgcgtgctaaggtgcagcctcctgtcaaagctgcgcactttcggacagaagacagaaatgaccttagatttctctgggagtgcttgacctggtttgaattattcattttaaattatttttcttcctttttttttctctctctctctttttcttttgtgtgtctcaatccagcactctgaataaccctgctgatcagatggatgtgattggagtgggtggcattgactttgaagataacatcgctcgcttttcttccaggggaatgactacctgggtatgctttctgtaatagcctaatgggactcacagagccctcggtctaagagcattgctatgtgttttgtcaatgcacaggcagagaagtagccagggctgtgggtatgtacacacaccacccgtcccctgtgaggacaagggatcaggaactttggtgttaaccaccttttagttcagtgaattgagctgtcttgaagatctgggtggattctgagggtcatttcccagttcatgtct

SEQ ID NO: 34313 - DNA, 1187 bp, Mus musculus
gtatttttaaaaaaacgaacaaagaaaaacaacagaagtattccaaaaagcagtttaatttacatagtgtaagggaactagagggagctgaacactggcgttagatctgtgaagtgactgcgcttgctcctgtttgttctttttagaaatgaaggatgttagatactgtaaactgtagaaatgatcaatgtctcagtggtgtcttagaatgggtccttttatgagggcacttagaggcctgggctaatcctcaaaggcctacgtaaggtaggcgggtgcctgtcgcccctggaggggagacagtgtccagcacagcccacttcttggtgcaggttcgaggacttagtttgtggtgtgctgtttgcattctcaggcgtgctttgcttggaacttcaaagcccatgctttgaagagtgtgcttgtccttagaaagcagagctgtcacagctctgtgcacgctcgcagaggccctcagaggactgtttctctttaaccaggtgtcttacacatcttggtttctggatgccttcaactatgccatcctaaagaagatggacgttctcaaccttagcatcggtgggcccgacttcatggatcatccgtttgttgacaaggttggtcaagtgactgtgaagggcagaatgttggatgacagctcctgtgtgtgttcttttataccttcaatagtcatcatttccactgaggtaatgacagctttgtgaaacagacggttagctggttagtgacatgaatttcagaaacttgcatgttacaaacccagtgggttagaggcctgggaacaggttttttttgttttttgttttttaagatttattttatttctatgagtacactgtggctatctttagagggcatcggatcccattacagatggttgtgagccatcgtgtggttgctgggaattgaacttaggacctccagaagagcagtcagtgctcttaaccactgagccatctctccatctgggaacaggtattttaaaggaacattccggcctccctggtaccttgatacctttctgtttaaacctgttttcctgacctagccactgggccagtgtgctgtgcactgtccagcccaggttcatgcagttgtcttccaaaagcttgtgcccgtcctccgggcctagcactgccttggagggggctcctttcttgggcatactt

SEQ ID NO: 34314 - DNA, 1147 bp, Mus musculus
cttagtttaaagtcctcgctacagtctgtcctgaggtgttcggtaggagaagacagctgtctcctctccagagtacagcaatgtaaaagctgcttagacgtcagcagccagctcttgggccatttcctttttttctgtcatctcgaggcgggccactggggagagtgatttttacctttagtgttttggtgtcacagaaggtttatttgagacaaggttttgcagtacagcctaggctgtaaacacttgtaattctgcttcagtgttgttagtgctggggctgcagatgtgtgttaccccaaaacggcttctatagaagttactgtaagtctttctctatgtactcttggttacagaagtcttaagaatcatttgggaataacatggcaactaagtctgccccatagtagtgattgccttgagcaacgtcctgaaacacaacttcaaggatgaccttgactctgagcatggtgtgtgcttctcttggtttctgatcatcatgctgtcttgattctagccaaccccatcgtgccctgtaatgaaacccggtggagccagaagtggcagtcatcacgtcccctgaaaagagccagtctctccctgggctctggattctggcatgcaacaggaagacattcaagtcggcgattgctgagagccattcctcgccaggtcgcccagacactgcaggcagatgtgctgtggcagatgggatacacaggtatgtgctacagacaaggaactttgtagaccagggacagggacagcattcagggagaccttctgctaggttgccctgccacaggtctgtcaccatatacatctgtccttcctatcatgtgtggaactgggtacagttaactgtccctacatttacctcttaagcccagcatctgtttctgtgacttttatttacttgtaaaaaattgtgtgtgtacagaatgtgtgtgtgcatgtgtatgtataggattgcacctgtgtatgtgtgtatacttgagtacatgtatgcatgtgaacatgagtgtgtgtatgaatacgaggggaagagagaaagagagaaaatgtatgagtgaatgtgtatgctaaggtcagaggatgactggtaggcatctcgtatgggacttgggaatggaatgcaggatgtggg

SEQ ID NO: 34315 - DNA, 2027 bp, Mus musculus
aaagtagtatctcttacagaacctattaaaatcggttttccttaggtatcatttacagcagaaagtaaagacctgtagactacactttccattgaataattgtggatgctgattagagataccctgggagatagagagctgcagatgacaggggacacagtctggggaaggcgtgaagggtgggacatgacatctggcttttgctcttcctttctagctctcgtccatctttagtctcttcacttctctcctagtttttcccttcactcctaacagctgtagggatgtttccctgaaagcagtgaggagtaaggaaatgtacacagagttgtctgtctgtctgtctgtactgtggtctgatccttccatttaaatatacagagttgtctgtctgtactgcggtgtctgatccttccatttaaatgcagctgaaactgtcatagctggctgggtcaggatgctactgatgtccctgtgtgctgtttttgtttcaggtccgctacagagcggtggattgggcatcctgctagatttgggtctgtggcgcaaatggagtttaggactcagtggactcggcctcaatgagagaagcccctgtccaagatggagaagaagcggagaaagaaatgaaagcctctctttgggccaaaccgtgggtgaccatgggactgaggttttctttatgttggacaagtctgtaggatggctgatcagtaaggctgcagcttttagccagaacagaaacccacttctgatcaaggaagagcctcgtgcgatttgaatttatgcaattttctgaccatattcactgaggaccatgaagctcgtcagcacctggcttcttgtgctggtggttttgctctgtgggaaacggcacctgggcgacaggctggggacgagagctttggaaaaggccccgtgccccagctgctcccacctgactttgaaggtggaattctcttcaactgtggtggagtacggtaatgacttgtcttcagtgttgggcctcccatctcactgttttcaaactaatataaatactggcttccgttcacctccgtggttcatttcaaatgtacacatcatgtagacgctaacctttgctgaaggtgtttgccctggactagaactgccagcagcactgtagctgggaggggcggatgcaggcgctcagctgacactttggaggtcacgcacgcctcaggcagaagggcagagcaggaagtctgcgacctggacctgaccggagctttgtcttcacttctgtagaataaacagccttagttctctgagttcctttccctattgggaaacgtcatttctttactggagtcagttttagtaaatgtggagggtttatcttattttactttatttattctttcagtttacaaatgtcttgcatgttttgccactcgtgtgacccacatgagtgcttggcacttgcagagagggtttgaatcctgaggaactagagtgtaggtggtgctaagctgctctgtgggtcttctcccgagcagcaggcactcttaacccctgcgccatctctccaacccccacccccccccccgtttatgttttctaaaatatgtttttgtttttgtttttgtttttttccgagacagggtttctctgtgcagccctggctgtcctggaactcactttgtagaccaggctggcctcgaactcagaaatctgcctgcctctgcctcccgagtgctgggattaaaggtgtgcgccaccacgcccggctctctaaaatatgttttgattatagagttattggtgactgtgaactgcctgacatgggtgctggaaactgaaatcaggttccctgcaaaaacagtccatgatcttaattactaaaccatctcaccagacctacacttactcaaaagcaaacaaaaaacaacaacaaaagcacaggtctctgcctttgaagtgcatattttgtgtgatttgagattcgtgtgaatctctgcatgttgccacctgtggtcgttcatactcatctctcttcttgctct

SEQ ID NO: 34316 - DNA, 1053 bp, Mus musculus
acacctttttcctcccgaatttggcctggtagttggtttgtggttgatctcctttgcttcctcacacataagaacactgtgtccctgatccttctgcctcccccacgtgcacacaccccctctacagcacctggcggtgtctcatctcactcagtaagcactcaataaaatggtaaaggcatcatgacctgtggtgttggttttttgtgtccaatttcccagaaccaactggagaagagtaggttacctatggggttctctgtgtagtgaccatagctgtgtagaacttgctctgtagatgcctctagcttcagattcagaggtcttctgcctctgcctcccaggtgctgctggcattgtgcatgtgccgcaaagtccagctgagtattttcttttcaaaaagttcatttcattcctttccacttctttgttttagaattcggcccctgcctagtttgtaaacatcagcgatctctcctgcacagggtacatcctatagaaactgactgtctacctgtggaagcgttatccaggacagtgctaaagtgactcagtgcaggcaggcctctcaagatgctctcacaggtattgcacactaacattctcattatatatatctccactaggtcaaagagtctctctcttaaggcaattttatgtgtataggtgctttgcctatatatgtgtctacactatgtatgtgcagtgcttagggaggccagaagaaggagggccatagaaatggagtgacaggtgcttgtgaactgccatgtgggtgtcggaaatggaacccagatcctctggaagagcagccagtgctctaaccactgagaaccctctccagccccttctgtaaagtgcaagcttactctagcattaggacttttacatcacttcagtgactactggctgtatattcttttacatcacttcagtgacaactggctgtatattctttgacccgtgatctctagggctgctttctgagactcctttccgtgatagggcctctggcctcagcagaatgtgtacgtagtgttagctgacctctgg

SEQ ID NO: 34317 - DNA, 1867 bp, Mus musculus
ccttcatgaggccgactgttacgtctgtgagcaaacctcagggaccacatggttggcccagggcgcatggccatgaagcctgaggacagaacgggctgcttcctcaacacttggagcgtgaccagctcgctcctgtattgtccgtcttgtgctggtctttttctttttctttctttcttttttttttttttttgagaagtcacctgttttccttttacaggtgactgattatagtattggctttcaagatgttcctcaggctgggcgtgggggctcacgcctttaatgccagcacttgggagcttgagacaggcctgggctacatagtgagttccaggccagccagggacatgcagttaaacctgtccttgaaaaaaaaattaatgttcatcaggaagacaacagaaaagtgttattttcaaactgtgaactgggagtgcaggtgttaacagtagacatgtgtcatgctgcatagctccatggggggtgtctgtgtgtacacactgcctttccctaaggtcccttagaaccatgtgtgtgctgtgtgtctgggtgaagttatcgataagactttacagtagactctgccaagacgaggttatgagggagcccttcccagagtaaacgcctgggctactccctttcatgtgctgaaagactttcaggctctacgctgtgtgggcttgccatgtcctacgacattgtttctttgagtacttttgtctttcccactctgtaggtgggttttgttgctaggctgggacacataataggttgtctttggatgtacctaagtggtggttcctcactgagtccgtgttctatctgacccccttcagagcttgttagagctggctttcatacacttttctatgtaatccaatttctccccaggagcgttgttgataaaatcatcacgtgtttgtggaatagtggttgaaatatgggcagcttttgtgcgtggtataaggtagttattgaagtgatgttagctcgtttttagcctgtgtgatgaatgtgtacattgtagggaatgcttttattagcgtgagggtcctttacgtatatcccacaatatgggggcacactgaaacttagtggctttcgttggtttataaaaccaacctcttgggagggtctcatacccagcacgtggaagcttggaagtcatggcagcttgtgcagagtggaggatgtggcgttgccccttgtggtgctgcgctgtgcctgggaagtgagaatgagcggcacgctgggacttggatggagttgctttagtgacatcccatcacctgtaggcccaagtgcactttgcccaggacatcagatgtgccattttaagttgtgactcagatctagatcagtgtcttcatgtcctcagatcatgggcagactaccatgcttggagacagaggaggaggagcctcggcggggacggctaccttactgctgagaaccttcgtgcatgtgataggcggcagtacctccacctgagacctaatcacgcatggtgattagggaggaaggcaggagactgaggggttcaaggccagcatgggctatatagtgaaactctggttcaggaaacaaaaacagcagcagagacgcactgtccgctctgtgtaaggtcctgtggcccagtattcagacttgtctatcaagtgcggagtccttgctccatgatgaggagtcagtgatgttctctcagcaggactcagctagaactcggagcacagtgatccgtggctgcagcagaagactcgaatcaggcacctttaggcttcctagctctcataggcagaccctctctgctgagctagtctgcctgcccactgtggacatggctttttaccaaggaaggaggaac

SEQ ID NO: 34318 - DNA, 1266 bp, Mus musculus
ggaaggggaggtgtttgagtggaccccagatcaccagaaagcctttgaagaaattaataaggccctactgatggccagtcttggcctttgcctgacccaaccaagcccttcactctttatgtggaagagagagcaggggtcgccagaggagtccttgttcagactttgggaccttaaaaaaggccagtggtttacctatccaagaagttacaccctgttgccagcgggtggttttcttgcctgaaagctattgctgccataactctgcttgtcaaggatactgataagctcactctgggacagcaaataactgtagtggcaccccacgctcttaaaagcattatccgacagccccctgaccgatggatgactgaacaagtgaccttcactcctcctgctgtcctcactcccactaccctactgtccgagacttcacctactcatcattgcactgacattctggcagaagaaactggtactccaaatgatctgaaggatcagatcagccttggcctgagagtttgagctggtacatggatggcagtagcctcgcagttgaaggactgaggtggtcaatgtgatagccaagaagatcctagaagaaatcttcccgaggtttgggatacccaaggtaatcagggcaataatggacctgcctttgttgcccaggtaaatcagcgactggccaagatattggggactgattagaagttacattgtgcatacaggctccaaagctaaggacaggtaaaaaaaaaaagatgaatagaattctaaaagagactggtgcagacttggtgctccttccccttgccctatttagaactagaaatactcccttttgattcagccttactctttttaagatcctttatggggctcccatgcccatcactgtcttaaatgatgtgtttaaacctacatgttgttgtaataatctgtatgctaagttaaaaggcttgcaggtggtgcagaaaggagaatgacatgtccggactggcccggcgcctccctatctcccgcccttctgacctaagttaaatgttatctgcatgtacagtctgctgatgtttaaatgaaccaatcatgtgaaacctcgccaattctcccaaccccagccccttttctataaaaacccctagcttccaagccttgtggtcgaatccactgtctcctgcatgagatacatttcgacccggagctctgccattaaaactacctcatgtttttacatcaaggcgttctgttctatttgtgattcttggg

SEQ ID NO: 34319 - DNA, 1117 bp, Mus musculus
gtgtgaaaatggttgacattcaggtatcggttgagagggtgaggagaagcaggaggcgggaggcccatctccagcctgaagactcaggctgagcatgctgtccttcgtctagggcccaccgggctgtgggctgctgctgttccgcgctggagcagaggctgcctgccagaaaggagagcgggtgctgcttgcccagtacctagggcagccaggtcagacccctccatctctgcatctcatctgcacccaggtgagcggcagccttctttctccttgggctctgatccaggcttcaccagagcttcggccagcaggcctgaggcacagccacaggaacccaggaatgatgggtccccgtgcaggtggtctccctagaggcaggtggaatgggtcatctgcaaacctagatcaggagctgggaggcagcagaggttgactctggctcaggaccccagttggtgcaagtgtctactgttgggagtgtagggatggatgtcagggacttctgagaacccagcccagaaaatacatgttttaggttgggtaggccaagttgggcgggacttgaaggctggtgggggtgccgtctgtcctctgggtgttgggcacctcctgcaggctgtgtggcctggagagggttattggaggctggtaccaggtatccactagtctcacctttctcttcttcctcagttctcgatctacctgatggatgagcgcctccccctggtgcccatgcttaagtgggaccatggcttgccatctgctcccctgcttgcccgcctgctacccccagctagccctggccatccacggcccctgctactggggggccagggtgggcagctgcagctgcttcatataacaggtcagccaggcaggtgggggtaagggggccgggtgggggctcgtggggacatgctagtgctgggactggtgtgcctagctctctgtcctttctccaggagagggaacttccatgccacagctggcggggcctcctcagtctctgccctccatcaccgaatccctctctgcctttcccctgctggaacctaagaagcagcagctgctgcaggaacgtctggaggcaccagtcataggtacactgggcaga

SEQ ID NO: 34320 - DNA, 1607 bp, Mus musculus
tagaggaagacttcatcaggagcgagctgaagaaggctgggggggccaactacgacgctcagtcagagtagctacagccccacagcccagagccatctgcctgctccgccaaggaggagactgccgcctcacgtcaccagcccaccagggaggagaagccatgagaggcaccagcgccaccagtgtgtccaaccctccccttccctctcccccctgtggcccctctcaagctcaccaagcatcattctttgagacccgcccccccttttgttttaaagaagtcattttggtgccagggtcatgcataccatctgatcccagaagcctctctgtcactggccctggacctggcatttacccctgccgtcaccgtggcctgcctggtctaagctaccctggccttgagttgctgaggcctggtcaggtgccaccccagcttgacctggctgtttcctgctagccctacgccggccaccaataccaggagctgtgcacaccttacagccttcatgagctcccatgcgcgcgcatgctcctcagagcccatagatgtggccccaggcctcacccctgtcctgttcagagtggccttgagctgtccctctggtagacactgcttggcagtaacaggtttaggtctggcgtggaccgagtgtgaagtgacaaatttgccttaaatcttgcctggcagtggctctgccacgtggtctaaactacccttttggcgaagcctttctgaagcctgagaggtctgagtctggctgggggggggggggggggggagttcagggtcaacctcagggcctccagggtgacaaggatggaaaggtcccctgcaaacagggaggctggcataggcctcagggcacctggaaggcagcaacggttggaatcttagtctgcaaattccaaagatggctttgtttgcttttgaagacagctgaggcgggcttggctcctcgagagcactcgaagatggttctttccctccctcctcgctcttattactctggggaaggatgctgcaccgggctgggctgtgaggaccatctctggcattccgacagtttacagaagtaaatgtgtttttcaagaaaaatgagttgggttgtctgcttcgtgtatgtgagtggttgtccgcactcactgaaggtgcttctggacccagggcttcccttcttcaggagcctcgggtagctcaggctatcctcaaacttttgatataggagaatggctttggcctcgaattcctaattctcgtatggccatctttcaaatggtgaagttacagatgtgtaccaccttgtcctatctcagtagccctttttggtttttcaagacagggtttctctgtataaccctggctgtcctggaacccactctgtagaccaggctggcctcaaactcagaactccatctgcctcccaggtgctgggattaaaggcatgtgccaccactgcctggctctcagtagccttttaatccactgcccccactcttccaggggatccaggttcagtctccagcacccacactgggcagctcacaactgcttgtaactctagcccagatgatccaggttaaccctgaactctctgtggcccagg

SEQ ID NO: 34321 - DNA, 1151 bp, Mus musculus
tgccaattagcctgaaatgtttcttttttttaaaagatttatttatttatttatttatttattatatgtaagtacactgtagctgtcctcagacactccagaagagagagtcagatctcattacggatggttatgagccaccatgtggttgctgggatttgaactcctgaccttcggaagagcagtcgggtgctcttacccactgagccatctcaccagcccttcttttttcttttaaaacatttttcctttttatgtgtggttgttttgcttgcatgtatgtctgtgctgtgtatcacatacataccgtgctagtagaggccagaagaggtgataccatggaactgagttagaggtggttgtgagccaccttgtgggtcctgggaattgaaccctggtactctggaaaagcaaccattgattgcacttaactgctgatccatctctacagccccttaacctgaaatgtttcttctgtcttctccagagttatctttcttttcatcaatgttctgcagtggccagataaataaaacactcctcaccctctaactcttgcctttccagactggcacatttacttcacaccctaataaaatgcaaaccgaggtcttctgtatcagttcgagcatctcccctcccctcccctcccctcccctcccctcccctcctctcccctctgcagctctggctgtcctagaactcactgtgtagaccaggctggcctcaaactcacagagatgcaaagtcacatagtgcatgtgcacgattttagtcctagtgcactcgaggcagaggtgggtggatctgagttccagcccagcctggtctacagagtcaaagttcagaaacccgcagatggcacctgcttctgcctcatgtgctaggattagacgagtacccccatgccctgacacagtgtctttttttttggtttttagagacagggtttctctgtgtagaccaggctggccttgaactcagaaattcacctgccttccaagtgcgccaccacgcccggcccgacagtgtctttaatgtctccagtttgtgtgggtgtgaatgccaacaagaacacaggtttgttctcggtggtagtgtccactaggtgcagtgggtgggactggcccctagaagcctgcagtctcgcc

SEQ ID NO: 34322 - DNA, 1174 bp, Mus musculus
ctggaactcattctctagttctatttttaagatgctcttttgataagaattgcaatgaaataatatttctcaaaaccaaaaatgtttcttcagaccaggtgatgagcggcagcatgtcgtgttgaagttactgtatcatattctcctgtagttcctgacaagtgtagtcctgagggctgagggaaagacagcacccctgtagagccagcaagcacaagtgcattagtgagcgtgccagttcccctgctggcctggctgaagccacagcaactgtccctgaagccttaggactcttcctaaggccacatctccgaattctcctcaaacagttctacccactggaaccaaggagtcaaatatatgagtctatggggggccattctctttcaaacaaccatagcctgtctatgtgcgtgtgcactgaatgcatgccttgtgcttgtgaaggccaggagagcatgctgcatccgattgccaagccagctcttcagccccattgctgctgttgtcatagacaaggcccccacatagttctgattatcctgtaactttctatgtagctagtctgggttagctcaaagaggattaaagatgtaagacaccacacctggcattgtttgtgattgattaattaatgacaggctctcacaacattggtccaggctggcctcaaactcagatagctcaagctggcctgaaacttggcagaccattggctttacccttaggtaaaggctggggtaaaggacatgagccagtatacctggcttttaaaaagccatctaccgttgctaatgatcaagagggctcagagattctctccgttggtccatctattcatgaataaatggtccagataactacacagaggagtagttcttaccttcctgtttccgcttagtttttctcgctcctctctctcggtcagggctgacagtggagtagcgcaggtttctctcagaccctggggttaaccccagtcagagattgaacccaagcaagtcagaatcagtcagctcagtgtctcaaagctgggatgagggctggactccaccccaggcactgatgggagttgttacaggcctggcctgtgtgctgcaagcaagcctaagaggggctccccgcttcccgcttctgtgcagaagcagcactgacggccaattgcgtctcttct

SEQ ID NO: 34323 - DNA, 1066 bp, Mus musculus
tgtgtagtgttttttgttttctctccgtagagcagtagttgtcagcctgtgggtcacggcctttaggggttgagcggctccttcacaggggcacaccagatgctcacattatgatttataactgtgacaaaattgcagttaggaagtagcaccaaaataattgtatatttggggataaacacagcatgacaaactgtatcgaagggtcgcagcctcgggaggttgagaaccactgccctagggccttccataccgagttaatgagtctgcctcccttttagactgtccagacgtggatggtcgggaccacccccatatctccatatctgaatgtctgccgtggcctagtgtctatttagaatgtgtgtgcatgaggaagagcttccttcttgtctgtctcccagcgtgggcagtcacagcaggcgacctcggcaccacagcaccacagccgtgccttacctcccaccatttttttgggggggcaactgctgaactttgaagcagtgtgtccatgctatccatccagttaactgttgaagtcctcctgctgtctgaatagcttctgtgggaattgtgcataatgctgggattaaagggtgtcactgcaccctgctgggacagttattttcatcacactaacttttgaatcttctcttgcccttgactccctctgagccacacccgaagcccttcttgcctttttttccccactgttacctcacttgctctcccccgtaaatgtgaactcactgagccttccctgcttgggaaggtctccagccaccatagaggtatgcgtgcttgatggaactcactttgagaaatattgctttaaaatgccctcaccttttcttctctttttaatgtatgtgtgtgtaagttttaccttttatgtatatatctgtatcctgtgtgtttgtctggtgcccaatgaggcaatggaatctcttgacctggagttccatacagttgtgaactcccatgtggttgcagggaattgaacctgggtctgtcctctggaagagcagccagtgctgttaaccacggagccatctctaacctatgc

SEQ ID NO: 34324 - DNA, 1319 bp, Mus musculus
gtactgtgcaccttgcaccctgtactctggatggatagacattgactggtcatttcttctcagcaggacaggagcaccagaggatcgagtttggtgtagatgaagtcatcgaacctagtgaggggctgccgccaactcctagctacagtatttcaagcaccttgaacccccaggcacccgaatttatccttggttgtacgacttctaaaaagatccctgaagccgttgaaaaagatgagacctacagctccattgaccagtaccccgcctcggccttggctctggaaagcaactctaacgcagaggctgagaccctggagaacgacagtggtgccggcggccttggtcagagggaacggaaaaagaagaagaagcggccccctgggtactacagttatttgaaagatggcggtgaggacagtgcttccccagccaccctggtcaacggccatgccacctcagtgggcacgagcggcgaggctgtggaggacgccgagttcatggacgtgcttcctccagtcatgcccaggacttgtgacagccctcagaatcctgtggacttcatcagtggccctgtccctgacagtccgttccccaggacactaggaggcgatgccaggactgcagggctgtgtgagggctgccatgaagctgactttgagcagccctgcctccctgcagacagcctgctaaggacagctgggacgcagccctacgttggcaccgatactactgagaacttcgcagttgctaatgggaaaatacttgaatccccgggcgaggacactgctgccaacggggcagaactgcacaccgacgagggtgcagacctggaccctgcgaagccggagagccagtcacctcctgccgaaagtgcgctctctgcctctggcgccatccccattagccagcctgcaaagtcctgggctagtctctttcatgattctaagccctctgcctcctcacccatggcgtatgtggaaactaagtgttccccccctgtcccatcccccctggcctctgaaaaacagatggaagtcaaagaagggcttgttccagtgtcagaggatcctgtagccataaagattgcaggtacagttaaaggacaggctgagtgggcctgggagccggctgttggtacccagtggtggtagccgaccggtgtgcaaacagtagtaaaggacttgtatgtgtcagtgttatccagtagtcaaacggtgtgtgtaaggaggaagatggagggagagggtgccgtgcctttctgtaagcagggaagacccatgtctgctatgactgttgtgacaaactccatgtccatt

SEQ ID NO: 34325 - DNA, 2074 bp, Mus musculus
atcacagcggagggcacactggcaagctagatgaccacgcttacccacacacagcgagcagagagtggacagagcatagagccaggctgtaagccccagccagtaatgtcctctcctccagccagcctctgctgcctaagcagtgccaccagccgagagctaagtgtggagttccgtgagaatttcacattcaaatgacctctgagatacagaaagacagaagcgagtgggaagacccccgtgggtgcaagctcactccagactgctctgctcgtttgccttagggatgggaggttggcgataattgcccctgctgaaggcctcctcttcgagcatagcttcttctctcaagccacagagtctcttcagatttttccagttgtccaaagacaactgtgaaatgtgaacgtctctggattttgagacaaggtctttctctgaagctctggctggcctggaacgcttagtctttgtgctctagcccgtctcagtgccctgcctgcgtggcatttccagagcttggtgtctgagagtgtccagtgaggctggctgcttcagttgcctactgtgactttcagtgtagagcataactagatcttcttatatgtgtggatttgcaagacaggatttctctgtgtagccctggctgtcctggaactctgtagtcctggctggccttgaactcacagatctgccagcctctgcctcccaagtgctggaattagaggtgtgggccaccactgcttggtcacctgttttggttttggggtcttttttctttgtggggttttttgttattttggtcctttctgagtgtgtgtgtccatccatctgtccacctgcccgcccacccacccatgtgcaattgtaattgtgtgtgcgcgcacgcgctagagaggtttctgaggtaaggtgcaggtcagaggacaaatcaggagtccgttctcttcaccacgtcaccgcaggagttacattctcattgtcaggcccggagaacgtggcttcacccgccgagcttctccctggccctcatgagtctgtttagccagctcttatcatagaatctgtgcggacgtacttgcttggatagtttgttcttgaaaacagtagcctcagcaggccctctcctttttagaacactctgtttccaatgggcccagaagcgacttgatagaggacgaggagctggaagacacgggcaagggcagcgaggacgagtgggagcaagtgggtcccaagaataagacgtccatcacccggcaggcggacttcgtccagacgcccatcactggcatttttgggggacacatcaggtctgtgctttcccacgttcccatggggcaggtgtgacagtgtctggatcctccctgccatctgccttgcctgctttccccttgctctaatgctcagctcccagggctctggcccattgcttgacatgggccgcttgatatgagtcggggtttctctgtatatagcgctcgctggttgtcctggaactgattctgtagcggaggatggccttgaactgtctgagtgctgggatcaaaggcgtgtgccaccactgccccggtttactttcattgatgtttttcaactttcttttgggaacccagggggcgtcagtcattgcctggcactccggaggaaggctggggcattcgaccctgacaggaaggatttcagctgggtgtcacatctgtcccgacagtcagagccacctcccaccagctctgctttgctcataaactgggacaccaggctgcacaaacaagattgaatcatagagtgttccctggatgaggtgaaatgagagatgaggcacttatggtttttattcagaagaagttagaaaaagaaagatgaagaaaaacaactaaggaaacaacaaggtcaggtggcgccttaccctcaaggctggtcgcctctcctcccagaccatcgacatggttttattgtcatcagcctgctccccttccccctcctgatggttttatagaaggagagcagcattaaaagtcccggtcccctggggattcccgcaatccccgttgcactagaacaggctgtgata

SEQ ID NO: 34326 - DNA, 1824 bp, Mus musculus
gttgaagtgttgctattttgtttttcagaactactttctccaggcatcaaaaataaaaattttaaatgccagagaacctataggctgtttgcaggtgagtgtgtttgcctctggtccccccaaaacacagtgaacagaggctagggtgccaggcaacactgccctggatcactctcccacagagattgttctaggagagcctggttgtcaggaaagcattcaggaccatgtttgccctgaattgtggctgacaggagagaggggtcttaccgggtgtcagtgtccacctgagtcagtagcctgcaggcccgagtggggccacctccctgtggagggggtcgtgggagtgggggcctgtggcagcagggtgagagccttttctcatgggttgcctgctctgtgctgtcttccagtggtctaccaccatggcaacagcgctacaggcggccactacactacggacgtcttccagattgggcttaatggctggctacgaatcgatgaccaaacggtcaaggttattaaccagtaccaggtggtgaaaccgcctgccgaccgcacagcctacctcctatattaccgccgcgtggacctgctgtaaccgtgcccgtgtgcccgtgtgtgcctgacgctgcttcctacagttcccaactcactcactacccacctctctagtggctctgtagagagactccctctgcgcccgtgggcttggatggaaggtgcctgagggcccgcacagcgcagctcgtgctgactgacttcagaagctggactgttgcctgggtgagggcacacgagagccgccgcttctgaagaaccgctggttcccgggcggaggaggcggctcgcaccgtgtcccagtctgatcgcgtagtggaataagtcccgcaccagcagctcttgtaaatttgtgaaaatgaattttatctttccttaaaaaaataatttttttaattcatcacactctcctcctttaccctgtagtttttgataaatgacaaaaacgagccagtcgtcattagagatcgctcttacttcaaaaggaaataaatacaaaaaaaacttgttgctggttcctaataggaaacacattttaacgattacgagagggaaaccgctgacgtagacaccgcgggtcagacatgtgggtagacgtcaggctgcagaggtgggtgattgtaactttattaccctgaaaagatttcaaatcacattcatgctgtgtacacatgaacagtgggcacaatgatggactgacaattcccagtgtctgctgtgtaatctcccgccacgcctctctgatgccgtgtcccccacgtacacagtgtattgattcctaggagtataaagttgtcacccatcaataaagatcacaaagttggtttaaagctgtgtttcttggtgtgctcagcctcggaacttagccaggaccctggctatgctgggttagtgtggctgttgctgagtgggggagggcctgtcttggagtcttgctccctctgatcttgtgacttaggtcaaagcctgcgtcttccctgagtatttctgatgctgcctcagttcctggcagagacgaagagggctctgccagccataggaagttggctgtacacggggcttgcacagggcagggcttccattggcttgaaaccctttactctggagcgccttccttccgttaaggggcagtgttccacccaagtcctgcttagcctcacttcaggatgtggagctggtggcccccgtgcttcctggaaacctggtgacagccagagggactcaggtgctcgttcttcgtggggtgttgctgggacaaatgtg

SEQ ID NO: 34327 - DNA, 1161 bp, Mus musculus
ctgcacttgccccatggctttgcttggctcggtgaacaccgacctcaaatcactctcttggcctccggctccgatctctttctcttcttgccacagtgccctgacaacgtaatggacttaccaggacagcccagcacccggccctgagttcggatatggcagagaccagagctcagtcatccaggctcaggtcagtgtggacttccctggccagctggcctgtcccttgactgctccatgccaagcccagggtaccactgacatttgagtcccagggccattgaagggtacaaggcagaaggcagatgaccccatcttactgccacatgtgagacccacagaccaccctggccattgggagaagtgtggctgtctggctgcctcgggctaacctgctctcttggcattggctccagtgggcctgccttccagaaacccccacttcctgtgcctgaatttcaccctgctgcagtcctgactcatagaaggctctttggtctataacttcttagaactaacagaagacatctggggcatgcggaaatacataatggtctgtgagaacaaaacacccctccccctgtgtgtgtgtgtatgtgtgtgtgtgtgtgtgtgtgtgtgtgtgtgtatgagccagagatcaaccgtaggtattgttccacagacactgtcaccctcccctgccccccatttttgagagacattctctcactaccctggaacttgctttcagccctagggaccctcctgcctctgggtccccactacggggattacaggtgtgggccaccatgcctgtttgagccttggggatccagttccgatcctaatgcttgcgtggtgaacaccttatgggctggtctgaccttcatctccagcctcaaagctgtttttcctgaggaagagcttcagtatgcttctgaattagacagcagcctcgttcagagctgacagaacccttgattatatgaagcaccccctcatttccagatagtctcgtagctcaggctagccttgaagccactacgtagctggagatgaccttcaactcccgagcctcttacctttacccctagtgtagggatggcgtgtcctacctggtctggctccttctctgcccaagggtcatctgtaatttctactctccatcccttgacccca

SEQ ID NO: 34328 - DNA, 1917 bp, Mus musculus
tctctgtctgagccttcagggtgggaatgtctgcagacatccgtgctcagtggcctgcgtgcacagcagccttgtgggcagatggagcgggccagctgacggggccatgagcggcttcatggaccacaggccacaggcacttgtcatttctcttgtgtactgccaggagaagcatgcagtcccgggaggccatcgtctcaccatcctgacccttgggatgtcgcgtgggcacccacgggtggagttgcttctcagtcatgaagaaagccagcacagcagcgctgggagtcctgctggcccatccccagcgcacccccttacccgaaagaaggggttccacagagactctgccttggaggcctctgacacccagcactgaacagtgaaagcagcttccagaacactccctgctgccccggaacgggcatcctttgacccttccagcaagtctgtgtgtgctcatccttgtgtgtctgtgtggtgtgtgtgtgtgtgtgtgtgtgagcatgtgtcagagtcagcagtgtcgttgaggcacgtatgtggtagacaagctgtctttcagactccagtgtttcagggaagtgggacgcactgctggcccttgctggcctactatgaatgtatcctacagtgtccagatccaaagaacaggcatgcctgtgcatgggcccggcctcctgcttttatttcactgaaaatttagtgtttgagggcgtggagctgaggttttgttgttccagccaaactgcaactgcaacagtctctcaacagggagagtggtagcccatgctgaggcccagcgctttggggcaggggccatgaggagctcagcgtgagaagccacctagggccccttggggcaggtgctgcagggtgagacagcctggtgcctgagctgtcagagtggtgatatgtgactatttctctacccatggcaccgcagtcagtggagccttggtgcgggcttagaatcccgtcagtacacaaacagctcccctcaggggatttgccttaaccgctggttgttgctttgctgctgggtgagagcagtctgacagagtctggggacttcctgagagtcttctcccatgcagacaccagtgtttcccttctgggaccagctgcctttctgtccctgggacaccatgactgttctttcggtgtcagttgcttgtgccctgccctcatctgggctcctgtgctactgaggtgacccccagggacctgagccgagccctcatgcagcgagcaatctctggggcccaagtccctgcagagggacatcgaggcctcagattgtctctgcgttcctttgcacacgtgtctgggcatgtaggctctggcggtctcaccctccagtgtggagtctgtgcggtgaacccaagctgagtatacttgacttttcaattcctcagtgtgattttatatgaaataaagtaacccgtccacagttctcaccctcctgcagccctcttcttcctgggtgacctgccttgcttttccaggagctgttgtgtgcctgtgaggggacctaggcatctgggtacaactcctagtgtcacctgggtagatgatgccctaagaccccttaactttcccttaattaactagggaatttttaaaatgtgctttaaaataaaactggctctaagcacacgagctgctgacctccttcagcgcagaggctagaacccagggatgtgttgtcacaccttggcagctagtctgtcaactgacggagtctgtctcaaacacaggagcaaatcagtactggggaggcagaggcaggtggatctcttagagcttgaagctagactggtctacataatgagtccaagaacattaagagctacatagagagattctgtctctaaaacaaaacaaaccctgaagagcctcaggcatccagttttc

SEQ ID NO: 34329 - DNA, 1141 bp, Mus musculus
atatgcagggaagggtttcctcagctcagggttccaggctacagtgtcggggaagacttggcaggaggagcagccgtcagcgggcaggaggagtcacatggcatccacagtcaggaagcagagaggagaagactttctgggtggctcattttctcccttgtatccagtccaggaccccacattcaggtggggtctcccttgcttacttaactcaatctagaaaatccctcatggctatgcctagaggtttgtctagtaggtgattcaagacccagtcaagctgacactcagaattaaccatcacattacccgccattgggaaggaaagcggcttcctcatggacgggtcagtgagggcagatgctgtgtagagagaggcattgcggtaggagagctgtagccctagcactgtctcttgctgcacagcctttgttgcttgaagactcctcccatccctcctcttgtaggctatcacctagcctatcttacccagagatgtcagcttactgtggttgctgtgataaatcttttgttttggttttcaagacaggttttctctgtgtagccctggctgtcctggaactcactctgtagaccaggctggcctcgaactcagaaatccgcctgcctcttcctcccaagtgctgggattaaaggcgtgtgccaccactgcccggctgctgtgataaatcttaagctgggcatatcacacacacatacacacacacacacacacacacagagagagagagagacacacacaccagtgatctccacactagggaagtgaggcaggaacatcactaggtagcctggactatatagtttcacccaaatctcactgagggaattcaggatggacagggtcagtttctgagaggctatagggaaagcctggtcctccttctggaacattccttggccatcaatccccatgtctgtcttcagggtctgcaatgcagagcacccatcatcctggtccttgctgatcctctcctccctggctcatctaccatgatctcccgatagctgtcctgggactgtcctgggacaaccttgctgctaacctgtcccccaggcagcgtctcagtagctgctgctgcagccttcacccagctgggcttcctgatcaggacgggga

SEQ ID NO: 34330 - DNA, 1099 bp, Mus musculus
cccaggtcctctctaagagcaacaagtgcgctaaccacttaactatctttccagctccctttacaattgtgagctagggactaagctgcccgcgttggccttagccttattctatagcccaggctgtctgtgaacttagcattctcctgcctcagcttcttcagacccagtcaccacatgacaccttgcccaagcaggacatgaaaagagtcagcccaaaggacaaagccacagtccatgtcaactgaccctggaagccccagccctccgcgtttactgcctctgtccactgagattaagtcgacaggtttagtccaccctcaagaacaggtgactcaaggcatgcacacagagatgtgggggtcatagcagaccgacgccccaatgccccgaggggtagtagcaaggatagaccatgcctgtgactctccaatagaggggttaaattagagttgtttccacaggagctcctgcccagaggcctcagaactgtgggtgctagaaaggagtgacactgacaagatcagggtgtccccagactgcactggaggggattcaggaaccagctgctctgcccccacgtgtgtgcaggctcatcctaattttcaaaaggcccgtaccagacctcagcttggctcgtcaaagcaggaagtggagccatgggctctgctgtggagaagctctgcaggccactggcacccttggcttgtgctcctgtcgctccagcctggctgcccccttacgctggtgacgcgtgtagctcttcttcttcctgctgatggaggtggcctccccaatacctatgttgattgccgtatgagcacacccctttgcctcatccgcaggctctggggaccggagagaggccattgtccaggcatctgtatcctcggtgactgtgtgtccatgaggccagaccaggccacccaggtgttttaagctaaacctttggcctctggataaaaattcagggttttgagccaggcatagtggcacaggcctttaatcccagcacttggaaggcagagaaaggcagatctctgagtttgaggccagcctggtctacagagggagttccaggatggccagggctacatgg

SEQ ID NO: 34331 - DNA, 1198 bp, Mus musculus
ctgtagggatgggggagaactgctcggtctcacccctgcaatgtggagacctggctcctgtgcaccatgggaatagagtgagtgctgtgcgtggccttcagatcaacggcccagccttgccctacttgcaagcatagaacacaggcaaggctacgttctggtgtcaggacacatttaattgggccagtgagatggctcagtggataaagacgcttgctaccaaaccccatgacccgagctacacacctacacacacacacacacacacacacacacacacacacacacacggtgctaataaatgtaataactttttttaaaagatccactgttacatcaagggtgacatcaagggcagtgcattgatctcaaggggcaggaaagaaacccaagattagatacctactctctggggttggggctgcagccatccttgtattatggcctggtcacagatgtgctccaggccccgagggaggctggaatcccccttccctcctgaattgtggagctgaattgtcctccctacccacccccacctccactccataagctccacagagcctcggccctcctcctatctttatctggccgtgaacagtcagctccccaccgtggcctggcctggggcagaccggctgccctttctccaggggtcagaggcagggcggcattgccatcgccagcagtagggctctcaggacacctcctgagacccatttatcacagctgcctccagcccagctggcagggccacggagctggctcttgtcagcatttttcctcagagcagacgcttgtgacacggagggaagagagggaatcttctgtcccatgtgggagctgccttccttgtgaggtcccagctgggccttggtctgtcttgtagtccccctgttccaggctacagcaaggtggtcatggagggggaagggcccttcccttccttccttgggcctctctggcagggaaagaggtgctggcttttcctacctggggctgttccatctaagatagatggaagccactgacttttacaataggaagatgatggtgcgggggtggggcaaggtggggtggggcagggcagggtaaaatgctggatacagttggaggtgttccagaatgggctggaagagccggggcaggcaaatggttgcagctgggaaccctcctgtttaacacaatcctgtaggtt

SEQ ID NO: 34332 - DNA, 1164 bp, Mus musculus
gctgccactcagtcagaactgctgctggtcctggcctcacatggcttctctcttatatcactctattctctcctctttttggtattcaccgagtgtgtgtgtgtgtgtgtgtgtgtgtgtgtgtgtgtgtgtatgtgtgtgtgtgaatgtctgtgtgtgtgtatgtctgtggtgtgtgtggtgtatgtgctgtgtatgtgtgtctgtatgtctgtgacatgtgtggtatgtgtatgtgtgtatgtggtgtgtgtggtgtgtatgtagtgtgtgtgtatagtttgtgtgtggtttgtgtatgtgtatgtgctgtgtatatgtgtgttgtgtgtgtggtatatgtggtatgtatatgtgtgtctgtatgtctgtgtggtatgtgtatgtggtgtgtgtgtgtggtgtatgtggtttatgtgtgtgtatgtatgtatgtgtgcatgtgcttgtgcatgtatgtgtacgtggtatgtgtctggtgtgtgtgtatgtatatgtgtctgtctatgtgtgcatgtgcttgtgcatgtgtgtgtatgtggtgtgtgtgtgtgtgtgtgtgtgtgtgtgtatgtgtgtctggtatgtgtgtatgtgtgtctggtgtgtgtgtatatgtgtctgtctatgtatgtgtgcatgtgcttgtatgtatgtgtatttagtagaatctcaatatatagccctggaagatctagaactttctgtggttcagaccaggctggcctcacatgcagggtgcagggaccgtcctgcctctgcctccttggtgcaggagtgagagcagcccagccgagctccctcctttccaagccttgctgtccgcagccagactgatggtccttttatcttcagctttagctttagttttccaagtgataggcttacacatgtcccacctcacctggacccttccgtgggccacccagcactcaggaaggatcccacccacgcttcaccatacctgctcagcctcatcttcagaaccacgtcacaggcccaggtaccagaccacatctttggaagaccaccgttcaacccactgcacagggtaggatagcacagggcttggactctagaattcttgtgagatcccaaaatgggtaaaacacctggtcaggacacaaggagtagaaagatggaagccaatccaggcacagatgt

SEQ ID NO: 34333 - DNA, 1193 bp, Mus musculus
tgacaggcatgcagggctgttgggtctggtttctccaggctgtgtggtgctgctgtgactgtttatacagaaaatcagtccgtgaggcggggtctccccagcccagcccagcccagcccaactcaactgccgcctctcacttcctgcctgaagggagcctctcctggggtctcaaagcctaaatatgtgcaagggtcccccacgtaggtccatatcagctgccagcagtgtccacatagctacgggcactgctggaatctagggagcagctctgtcctgaggtgcaggtccccagggtgtgtgtgtgtcctgactctatgaccaccctgttttgcctataggaggtgggagttcctaccctgcagatgccctcacatgcctcatcttgggattcagcagtctggtgtctaaggcttccctgacattgttgagttccttctagagctgagccagaccctgtagaccttggtccagacctgctcataggaggctttctccctaaataccccttttatgctttctttgattaaaaaaaaaaattagggggaggatgtttctagaatatggctccccaaaacctaactcttcttcccgcaggactctggctcacgaggcagcagcagtggtcgggagcgcctattggtggagccacctctcgcccaggaaaaggctgcgggccccgccatcccctcccacctactcagcaccccgtacccctttggcctttcccccggctcagttgtacaggactcccgcttccaaccactcaagtaagtgccagcctggggtcagggaaggcacaggggtggctccagacagacctgagagtttgcactggcagaggtagatagaatgccattagtctcagtggcctgatctgccctgaggtccttggccccatctgaccttgtggtccagcctttgttgagacagacttatcaggtgtcctaaacacatttaagcccatcctctgggtctggggaacagagagcccctccagcatctctatccactcgtggggaccttgagggacaggcagcttcccatctgtgcagtctgggcttcatgccaggctgtacctcactgagaggcaggacctgagcctggtgagggagtgtggcacattacctctgctccccacttccccctcccacagcctccagcggcctgtgcaccatgtggtgccccccagc

SEQ ID NO: 34334 - DNA, 1501 bp, Mus musculus
tccttggttcccacttctcagcatctgcaccccagcagccagtccccactaacagtgtgtggtacctagacagtgtgatggagactccggagtgagagtcaggccatgccctccctcttcctgtagaagctcctggcctcttaccacagcgggtcacaccagaggtctctgcctgcagccagtctgccctcccgctcgctcacccatggtccgggaggtcctaggcgcccatgtggtctgttccttgtggccccagacagtggacatgctctttgcatgcagtctctgcagggctgagcctgagtgagcagtggctcgcccagccgagaggcgccggctcacctgcctgggtcccggcctttctcctgcagtgccagggattcacctgagggcttcgcatctgctaggcaagcttatcctttgtggctcctgcacacaccagtcctgcctctctgtctacaggatggatgactcctattgcctgtcagccttaaggtctccgttctaccccatccccacccctggctccctgcctccactgcatccgtcggcgatgcacctgcatctctccggcgtacggtatcctcctgagctctcccactcgtccctggcggcgctacactcggagcggatgtccagcctcagtgcagagaggtaagctgtgttttcagcagaggtggggtggaggggactgttgagcgttcctgaggtcctcagcggggcctggcttggtggtggcgggatgcggttctttgtgtgtaggtggcaactcttgcatgtggctgctccactttgagctggggcgtggacttgccccccctgcacatccctttagcacgctgccctgttttccctcccaggttgcaaatggacgaggaactgcggcgggagagagagcgagagcgggaacgggaacgggaggccgaccgggagcgggagaaggagcgggagcgggagcagcgggagaaggagcgggagaaggagctggagcgcgagcgggagaaggaacgggagcgcgagctggagcggcagcgggagcagcgggcgagggagaaggagctgctggctgccaaggccttagagcccaccaccttcctgcctgtggccgagctgcacggactccgaggtcacagcacggaggagcggcccaagccctcggagcagctgaccccaacccgagcaggtacctgggctgagctgtgtggagggaatggcctgtgcctgccccagcagtaaggaggtgccatcccaacgctggcgagactgggaggaggtgtgctctgtcaccctgggtggatccaggatcccatgggtgcccccagaacagccaagacgctagggaggggagttgccatcactgcggtagaaccttggttggtctctgccttttgccatggtgatggtgaacaccagagtcacgccactgagatacccccaatctgaccttttgttctgtgtcagagttctaaagccaaggctagcctgggactcaaccgtccct

SEQ ID NO: 34335 - DNA, 3218 bp, Mus musculus
catgctttagcccccaggggacaggcagatctgggaggttgaggtcagttggggtcagcctgggacgcatagtaaggtcctgtgttaggaataaagagatgttatctgaggagaggcccttgtgcccgccccagggtgggcacatgtgcggggccggtcggacctgggattcagagcctgagctgaggcagcagtacacactggttctctgggagcctgtggtgccggaagaatgttctagcaacctccagaggtcactcacgctgctgtgtgtacagatggttctgacgcgcatcttctccccaggagcttcggagtcagaaacagaagatggtctctgagcgggagcggctccaggcggagctggaccacttgcggaagtgccttgccttgcccaccatgcactggcctaggggctactttaagggatatccgaggtgacggtttcccttgcactaggctgaacctatagtatagaaatattatctattttattaccttgaatatttaatatttttcactgggaggtttgaagcttacaaattgagaacgtgccatgcatgaaacaaagggttccaggctccagagaggagatcacctcgacgccaatgtcaccgaggcacctgtctcagctaggactcagtttctctttctgaggtcggcgttatttcctctctccccccacgtcatcctcctccgacactgacgtccaccgtgcatgtggctgagggagagagccagctggttgtttctggtatagctgtgccacgagagcccagcttgctgttgctgcggccctggggtttaacctcttcctgccaggagcgggactaatgcgccgggaaggctgggtgcgtacaagcaaagggctccccatcagtcccgtccgtctgtcgccttcccgcaagcgtcatcatcgaagccactgctcctgggagcacacaagcttctccctggaacagctcttaggaaaagaggcaaacccacacccaaaagtaccttgttttccttggggaagatgcgtggagctgtccacagatagcctacccactggattgctaccgccgtgtgtggtgttttcatacaaacgtacgttttgagagaaaagtcaaaggtgcttcagccttgtactgtgtatatattaaaaaaaaagttttgtatgtttttattactttaattattgttataaaaagcctgccatttttaatatgtggtttggggaattttgtttgtttttcctgtttgggggttttctttggtttttttgtttgtttgtttctgtttttctggatttaaaaaaaaagaaaaccttgcttttagtgtttgtactgctgctggtcagaatgttgttaactgctcagttctaggaagcaggagagctcgcttgtgcagtgtcccacacagcagggctgaggggcctagggctgcctgctctccaaagcagatgacccatgtgcggcagggactcggcaaagctgtgaggagctgagctccggagacaggcacagctctggcagaaagctcaacgctaagggatctccttcccagtttcagcacttcagtcagggctgaccaacttgaaaagagcctccgactgtcctccatcggacaggggaagaggaggccgagcccacccttagccaccaggctcagtggctgtacagagcagctggctgacatctgtccctgctccacccctgcccctacccgcacccctctggttctcagcaaactcagacaaggcagtgccaccaggcctgtcagcaaagcaccttcctctgcccacagccagtcagagaaaacgatccaaaggagggcagaggccgcacaccctgggccgagtcctgcccgacttcccagttaaatgctgcttgtgcccagtgctgctttcccaagctcaccccacctccatgactagaagcttctgcaaatctgcttggtaaatgtctcctgggaaaggcagaacccataacttaaagacacgcacagtcccttccattgtcccacaggagttcctctggctgagtatgccatccagagcaagcgatgccctcccaggtcagtctggggcacaagctgagccgctgactagcaatgcctacagcctttcccaatgcccttgcctgccctggagcttctagggccacctctagcatctggagaccgaatatccccatgctcagaagtaaagtgacaatcagaaccaggtacaagccagtaaagcggcagatgactgccactcagcccacatacggcattcttcccatcccacagtcttagagccagatgaggctaacaagaccacagtagcccccttcccaggtaccacactgtccctggagatccctccagcctagccctgctatagatctgctctagactgtgaaatcagcatgtatgtgaaaaatcccagtccttgaccatgtctcccactccacctgcaagtgattgctgccatctgtcctgggtgggatgcaccgagctagtcacgggtgtcggatcagatcttttaaaaacacttgtctcatgtaattgagacccgccaccatcgcagatgagtgacaagagagaaggctgtcaacacttcggtacatggtgatcttaaaaacacccacctgcaccatcacaccagactgtaccactagggcatccagaacaagccccaccctaacagtgggggcagggagggtacagccaggctcacagcactgagagtctcaaccagctaagctaaattgcaagctagatgcctcctgcccctgccctcagctgcccaggccccagcatggagatggcctgcacagcaggctcagcacctctgaggtgtgcattagccacttatagcagcagtctgtactctttcaagtacgcaagctttgacttcactacttgctgtagcctgtccccactgtctatccagtgcttacttcaaccctagaggctgccttgacccgaggaggcatctcactggttccgtacttgtgtgtgccctacgcctcactgctggggccctggacccagacccaggcaggagggccgacgggtgcctcggtcgctctgggggcagtttagatgctgtgaaattaaacccgttctaagtgtacttgtttgaattaactgtattgtaatattatttgttgaatgtagtaattaggtatttatgaatatattgctgtaatttctgacatcccgaaaaataaaatcttcctaaatcatgt

SEQ ID NO: 34336 - DNA, 1132 bp, Mus musculus
acatccccaaagcagacaccatccggacactgatcaaagacctgtgggacacacgcatggccaagcttcgagtgtctgctgacagttttgtgcggcagcaagaggcacatgccaaggtaggcatggttctcctgtccctgcccggtgccagtgggcactgcctgccagtgtgaccgcttcccagggagctgtcaggccatgctgcctgctcagcatgaaacagggatttgaagctgtgctttgagcagtggctcactgggacttgggggtttggctctcagagcctgcctacaccctcagtaccaggagccaacaactcacggttgagcagtctagctttgccttaaagccaagacttcctccgctcacttgcttttgtgtttcagctggacaacctgaccttgatggagatcagcagcagcggggccttcctcacccaggccctcaaccacatgtacaagctccgcacaaacctccagccctccgagagcacccagtcgcaggacttctagccagaggcctctgctgtgcaaaccctgctgtgtgccctgtgtggcggagattgggggaagagtgtggaacactggtaaggttgctgcccgtctttgtcagaggtcagccatactgcaagttcaactccattgaacagagaagccgccagcctttctcttccacccaaggactgcacgccaagcacagcgagtgttcgggccagctcagctcaagtgtcttcaagcttggcccgtggaaagctgtatgtagttgaggctgagcgtgagggtgggggtggtgatacaaaaagatgaatttcgtcttaacatgatttaggaagattttatttttcgggatgtcagaaattacagcaatatattcataaatacctaattactacattcaacaaataatattacaatacagttaattcaaacaagtacacttagaacgggtttaatttcacagcatctaaactgcccccagagcgaccgaggcacccgtcggccctcctgcctgggtctgggtccagggccccagcagtgaggcgtagggcacacacaagtacggaaccagtgagatgcctcctcgggtcaaggcagcctctagggttgaagtaagcactggatagacagtgggg

SEQ ID NO: 34337 - DNA, 1251 bp, Mus musculus
atcctgggagaagtcccttttagcctggacaactgtggggtacgaggttcccgagggggctacagtctcttgaaacattcttttttggctccaccttgcttccaaaattcctgagccggaattttacctgctcctcagaggagagtctctgaacctctgtccagggaaggtgagaagagagacagagatgtctcacaaggacctcaggccctgcgcatgcccgtgttatcaatgctacccatggggcttaagacaaggaagagcagtagtctagaccagggccctgcaagctgggaacacttgtcacaatctccaggagtcctgagaaagcaccccaactctgacccctccctcagcccccagaggggctccaggtattgggggacctgaggtactggggatatcttccagcctctgtgactctgatgctaggctgtgggagactagggtggtggcctgaagtgaaaaaggttaggcccagggaggaagctgacacagcagagccctccctccctgatgttacccttctctttctcctagtctggatggatgagctggggtcttatcaagacgatggagagctggaacctgaagcctgaagcggcgagacctgtgtggcagcaacctgccccgctgccccgggtgttgggggcgtggctacctgagcagctggatggggaacagcgaattgggtcctggaccaagacatggatggccagaagagtacagcaggtggctggcctcaacggagcagacatccgtggcctctgagtccgcaccaacccagaccccggcttggtgaagaggaggccaccctgccctacggtcaccgtgaccatggacctcggccctcgaggccccagagcagaaggacttctcgccagagcagggcctctgttttttacaagttgttttacaggtatgggacctacatcctgagcgagatttataaataaagctcctttgtgacttgcgggtcctggtttttgggttttggggtgtgtgtgccttcctcgccaggggcgacatcaccggcagtcgaggttgggagcccagcgtgtccaggcttttcaccaggtgtggaaataagctcacagagattgcgaagcagccaggaaattgttatttaaaacaaggaagtaccacaaggacagccgctattggcgaagacactcgaggggctcagttaccttttggggtgagacagagtgagtggtagggttattgagtggcatagcaagggtagtttct

SEQ ID NO: 34338 - DNA, 1217 bp, Mus musculus
agggacagaactttgagtcttttgggaggggaggcctggggaaggctgagagggaaccttggatcctggggtgtcctaggtggagtctagatgtggggtcatgggcatgagttcacttggccctgagctttagggctaagaaatgagaaatggggtccgaagcaggaagggttagagccacaggaacgataggttgctataggacgtgccattcacatatgtatcatttcaataatctgggttttttttattatttttatttttctaaatttattttatgtctatgagtacacggtagctgtcttcagatacaccagaagagggcatcagatcccattacagatggttgtgagccaccatgtggttgctgggaactcaggacctctggaagagcagtcgatgctcttaactgctgagccatctccccagcccctaagctctgttttttatagccagggagatcgaggctcagagagacaagccacccatttctacagtcaccctaggtcaggagttcccaaccctggctgttataatctccaggaagctcgacagacagcccctgtcacggaaatggagactccccggtaactgctaaatctcccagggtgaaaccccaaaagagccaggaggaagaaagctgggtgtggtggggtgctggggcacacctgcaatcctggcacttggaagttgcatgtaggaggccagtgttggcgatgggaagccctggctcaacatcagaagaaacctctcagagaattcctacaggtggctgtggggttattacagccacatccagagcttagcttagcccatccttggctcgctgtgaatcaccgtgtctgagttcagcttctctgaaggtgacttagcctggatctgtggagtctggtttgcctacaatagagactgaggtaccacagaaaagaaagctcaaggtggcgggggggggggggggggggagggcaggagggagcccagcccttggcacagccccagaagacctcctgcacaggctccaggcccaccctacgcctgggtccctagcctgtgccctgcctcacttgttcccctggaaacaggcttctaatagcctgaggcaggcagggaattgacagatgacagctctagtccccagggtggctagcatttgttttttaatctttactgttgcctaatcctcctgagagctttgcttctgcccagaggctgtgagg

SEQ ID NO: 34339 - DNA, 1206 bp, Mus musculus
acggtccgagggatggatgacctttgacctcacacctcagtaggaggaggagggagttctcttgagaccaggtctcacttggctcactcaggcctcaagcttcctatgtagccggtgctagcgctgaattccttatcaagcctgtgggcttacaggggcacagcaaccatgccgggcttggtgtgcatttcctgccaacaaaattgtccctcacaccaggcattggtggaggtagaggcaggtggatttctgagttcgaggccagcctggtctacacagtgagttccaggacagccagggctacacagagagaccctgtctcgaaaacaaaacaaacaaaaaaaaacacaaaaagattgtccctccatgctacccacctaagacaggctttttccttttccatttttgtcatgtgtgtgtctatgcgtgcttttgcatgtgtgtgggcagacatgcggggagaggaatgcaaagacgtgtgcgtgcactggcacttggacacctgaggttgatgtcaagagtcatccattgttcttcggcctcattcatcgaggcaggatctctcaatcaaagccagagctcagggatgtgcttgccagctggctccgaggagccccagcctctgctctgagcccggtggggattcaaaccctgctccccacgcttgcattgtgggcactttagctgcccctcatgttgcttttgaccagtagttcgcaaaggaactcaaccctgctccctcccctgccccccatcctcagcctcaaggcaggtcccactcaaagccggttcttctccctcaacaccccaccaccgctgccaccaccttgactccttttctggcacattccaggcatgacaaagactctcactgttctgtgctctgtggggtggctgagaccaactcccaactgaaccggaggagccaggctccaaagagggagtgtgcacccatgtgccccccctgcagtgaatgaacccctgttggggtgactgacaagcagggcttaggaggacccagagctcttgatccttctgtttgtgtatctcaagtgctgggcttacaggcagtgcaccaccaggcctcctgcctgccaggcaagcactcctccactctcacatctccttaggggtgccaccttcacaaccctccccacttgttggtagagccccatttttaagataccctgttccgcccaccctgct

SEQ ID NO: 34340 - DNA, 1064 bp, Mus musculus
tttgcttcttaagtacgttgatccccacccctccaacacccctgagccttctaaactgacttcctctgtgtgggaacacaggacctgttctgaaaaaaactaacttgtcaaagcactcttgcctagctttgactcctgccttgtgttcagggaggctgctctacagtgtggctagcaagtggtcctaatggagcagaacccagggcctcgcccaggagaaaccacctatactcgggcggaccttgtaacctctctccagcacctgccctttgtcctggttatatttctgttgctctgatgaggcaccaaaactactgtggagagggaatggttcatttcaccttataactcagatggaaggggaggcggctggaggcaggaactgaagcagaggtcacagaggggctgcttactgtcctgatctccatggcctgttcagccggcttccttatgtaactcaggaccacagtcaagggcaacagttccttaattgatagtccctcttctttgtgtcaagttggcaaaaactaactagcattgtattagggctctcagactgacagaatggggagaaggggatgacagcatttattagtcacaggctgtggtccaattatcccagcaacagctgtctcccattgggtagtccaagatttccctgttgagtctgcaagtccctgtctcagctggtcttaagtatatgcacagcgtatatgcacagcgtgggctccagtgcagtggtgttagagggatggagttgccagtgagcaagggtgagcaggcatgggtgagcagaaggtgtggccaggctcaagctggggttttccaactcggatccagtcaagaaaaatccctcacaggtgtgcccagcagcttggggtgtagttagttaattccatataatgtaatatagtgattccaagtcgtacagtcaagttaacgaccaagaatagctatcacagacgtcattattaagccatagcctttcttgtttatctcccaacttgcttctggtcagtgtttagcccaacaatagaaactaaactaggacttcattaacaagt

SEQ ID NO: 34341 - DNA, 1374 bp, Mus musculus
ttgtagaaaggcggggagccctcacactcaccttgcaacacaagattcccttggtatgggcatagctgtgctgctcgcatgggagctaggcaggccctgcccttctcaacactgtactcgtgcctgtcactgccctcccttctcaggtggacaatgccaagttcacgatggactgcgcagcgcccacgatccacgtgtacgagcagcacgagaacaggtggcggtgcagagacccacaccagtgagtgcagcgccgccttggcctgggcacgggctcgggctctgggtggtacaccgaggtctctatgcacaccgaagcaccatggtcctccagtgtttggtttctggtcgcatggatgcttcagccatgtccctctactgtaggttctagagtgccccgtttggagggacctgtccattcatgaaagtccacattcctgagtctcccagcaactgctctgtccttagcagcctattggtcttggtaggtatgaggctgactttcctgtctgtcctgcagcgactactgtgaagattggccggaggcacagaggatctcagcttcactcctggacagccgctcctacgaaacactcgtggattttgataatcatctggacgacattcggagcgactggacaaacccggagatcaacaaagcagttctgcacctgtgctagacaaggaccacactacagcgaagacggaagcatatttttacatttatagaggaatagtaggttagccggaagggaagctgcaagtgtgccttggagggggtgcggtcggcatccttcagggcggggctgtggagaactgtgggtcgcctaggctttggtttcttagtcctgtactgcccgatcccgcccgtcagctctttctgcttgtgccaggtcattcccattaaacagttctatctagccttttgtaatcctgagaagtgtacacggtgtaccttactctttactctggtgagtgtgtggggcttctcagcctaagcccgcgccaggcatcctgaaatactggggcagccagcatctgagcagccaagcagatgtggggctggagctgcactacttcacaggccgcaccgtgggattagacagcactgttgcctgagaaacctcgctgcacagtgagcacagcacactggtgacaagagcagaggtcccaagagaagccaaggccacgaacattcccaaagccagttcctcctgactccgctactccacatcttcagagtgagagctgctttgtgtttaaaatgggggggaggggtgagcttaaccccccacgatgtcccaagcagtgtccttgttagcttggatcatttgaccatcttaggaaatagcatgcaggctctttggtacattg

SEQ ID NO: 34342 - DNA, 1188 bp, Mus musculus
gggcccccgaccgtgccaccctcacccgccgtccaaggccgtcacctgccaccgctgcccaggcgaccgccgcgaccgccctctacaccctggggtgctcgcgaccggaagaacggggcccgcaaccggaagaccaagacggagccgcgaagcatcgcgggaatcagggaagccccgccccaagcccgtccgtttcagagcgcggggcggggcggggcggggcggcgcggctcggggcagggcggggcaggacgaggcggggcggggcggtaactgtcgcgaaaggccgagcgggtagcagctgctttccggcagacgttttccggccgaccggctgaggcgggaggccgcggccggaggtgcgagagcgtcacggcgtgcagcggagggtcgtggcggaggaccgcggtgcgtgggtcgcgatgcccggcgtgaagctgactacgcaggcctactgcaagatggtgctccacggcgccaagtacccgcactgcgccgtcaacgggctcctggtggccgagaggcagaggccgcgcaaggagcatcctcccggagcgggcagccacacgctcttcgtggactgcatcccgctcttccacggcacgctggctctgacgcccatgctggaggtggcgctcaccctggtaagctcgcggtcgaggccgcggcgcggggttccgggccgggcggagtcgggcgcccttcgcgggacgctgcggctgctcccggggagctctcgaggttttgtaagatgaccgagaaactcgaatgtgtggtggacgtccttaaaaccagcactcgagatggggaggcaagagttcgaggccagcctggtctacattagtgagatctgggataggtaacgtttaaagtttaaacttaatgtgtttgtgaggccacaaagaaaaaaatgcctatagcatgtaaatctctagttttacagaggtttttttgtttgtttgtttgtttttgtattttgtgggtccacttgccgatttttttgccccagacttgctgttttagcaagattataggttataatacggactgctgtttctgcgcttgtaatcaaactcggtttctctgcttaagagacatttgcaagacccggaattctaactctgcggtttgcctttataaagccctggactgatatggtcaggcgctgcttactacatcttggaagcg

SEQ ID NO: 34343 - DNA, 1152 bp, Mus musculus
agcatgggcgtcagagccagcgtgccgtggaagagcgggatgcagtccacgaagagcgtgtggctgcccgctccgggaggatgctccttgcgcggcctctgcctctcggccaccaggagcccgttgacggcgcagtgcgggtacttggcgccgtggagcaccatcttgcagtaggcctgcgtagtcagcttcacgccgggcatcgcgacccacgcaccgcggtcctccgccacgaccctccgctgcacgccgtgacgctctcgcacctccggccgcggcctcccgcctcagccggtcggccggaaaacgtctgccggaaagcagctgctacccgctcggcctttcgcgacagttaccgccccgccccgcctcgtcctgccccgccctgccccgagccgcgccgccccgccccgccccgccccgcgctctgaaacggacgggcttggggcggggcttccctgattcccgcgatgcttcgcggctccgtcttggtcttccggttgcgggccccgttcttccggtcgcgagcaccccagggtgtagagggcggtcgcggcggtcgcctgggcagcggtggcaggtgacggccttggacggcgggtgagggtggcacggtcgggggcccgaggacctggagcgccggggccgggagcggtgcctccgagacgcccccggacccgggacttgagcggctcggtgaccttggggcgcccgcttccccgagcgggtctgttgtctcgggtccccgctccggcctgccgggcaccgggcgttcccgctgtgccaggcccgagggacagcgacctgagccctgacgtcacgctacggtttctgccgccccgggcgttgattttttttttcccgggctcggacgttctttctcggggatcgaatctcaggggttgtgctacagtgaggcgtggggctcgggtcgctggggcgggtgacagggtcatccaggtcgcctgcgggacgcaggaacgggaagcgggccagggcctgagcctgggcggcctcctcccgcttgcccttcgcagtctctgtacaagtcaatttttaaaataaaactcagtcgcaggaggtgtgctaccgtgctatctatctatctatctatctatctatctatatatctagttctagcagtttcagtca

SEQ ID NO: 34344 - DNA, 1234 bp, Mus musculus
tttgggctgactggactgttttgagtgttttaagtgggaaacatgggaaggaagacagaactaacctgccgtgagtctgcttgttgagcacagcagtcttccctcagagtctcgagggccaccctctgcttcctgacacacgtgcattcctccagtgggacccaagcctcctgtactgctcagttctcacttagagtgtgagcccatgggggggtacaggtgcttacttgtttcctgacactgccatccagacatgtccagagttagcctcagtgaccagtaggcacttggtaagtccttggctgccagggtcacggtgaccaccaagactctgcaacagtcgcctttccctttttgaattttatgttctgagtatgagaccctgcggttgggtctccatttagtccagttgcttgtgtgactaacaaccctcagccctggtcctgcccctggtgaccgaggggctgcttaggtcaggcttccgtcttaaccgttgaccgtcaccgcccttctgcctagactgccgtccacacggggtttcaggcctctccaatgtgttgtagggagtgttgtgaagagtgaagactatgctttccccacttacgctgatcggcgtgactaccccttgcctgatgtggcccatgtcacgatgctgtctgccagccagaaggcgctgaaggagaaggagaaggccgactggagcagcctttccagggatgagaaagttcagtgtgggtatcagagggggtgcacaaacactcagtagtgtgtggaggcgattgcactgggtcagctctcccagctgggcttctagatacccattccatactgctggcttggccaaacgggagccatgtgacctcacagtcatgtgacctcgtgtctgagggctgtgctcacagctcttcattttccccttccatgtatgctggtgtgtgagtgcaggtgtgtgcacagttgtgtgttctagcctagcctgtgcagtccctgggatgggtttattcagggaggggctgagccctctgtaggtattctttaccttgcatctgtctcattcagtgtaccgcatccagtttaacgagagcttcgccgagatgaacaggggcaccaatgaatggaagacagttgtgggcatggccatgttcttcattggcttcactgcgctcgttctgatttgggagaagagctatggtaagtacagagggtgaggtaggcccaggacagctatagctct

SEQ ID NO: 34345 - DNA, 1207 bp, Mus musculus
gcagcgtgcctttgtggccagatggtttgctttgtatagaatatcgtgttctgtagcttaattaagcctcatgtccacagaggactgcatagtgtgagctaggagacccattggctgcgtggctggctgttcccaagcatctggagtctgggatgtcggccttttccatagtgtttggacactgttgcgcttgcctgctctctgacatgcatcctctctgggtcaggttgtgttgcattccgagcaggccctcccctcctgagtgtgattgcagactactaacatgccagccctctgagtggcacccctagctgtgtgctgggccaccctgcagactctgccactgacagcttaatccgtaggatttccctgctgacctttcacaatcgagggaggttctgagataggagttacagtgccctggattaaagcccgtgtgagagaggggttgggcaggtggcagggcagccttcctcaccaagttgttctgttccacagtgtatggccccatccctcatactttcgatcgtgactgggtggccatgcagaccaagcgaatgctggacatgaaggccaaccccattcagggcttctccgccaagtgggactatgacaagaatgagtggaagaagtgagagcccgctgcctgccggctccctgcctccctcactccctcggcatgctggaagctgccgtatccaatggtccatgctaataaaagaccagtttacgtggtgtctgtgtggttcattctttggcagtcactagatgaaggtacctgtctccggagaggctaggtttctcacagtggaagtgaggagggtttaaggtttttgcatcattactctgtgtgatgtcaggtgcgtgtgtagggaacaatgtggggcttggtgttcgcccttcattttgctgtggtcaagttcaggtcgccaggctacgtgacagaagtttctgtcacttagaagttactacccactgtgatgggtaaatatattctgagtaggggacttgcgttttaacttgttgaggaagagtgtataaaaatggaacctgacaccattgcatacactagcaagattttgctgaaaggacccagttatagctctctcttgtgagactatgccggggcctagcaaatacagaagtggatgatcacagtcagctattggatgggtcacacggcccctaatggaggagctagagaaat

SEQ ID NO: 34346 - DNA, 1101 bp, Mus musculus
tttttaaagatagaatgttgcttagcccaggctagcttacagtgtccctacagttttctatactgtatactcatagtcattttccctcatcaggttcccaggcctcctatccacctccctccagactcccatgcacatgtgccaccatgtgggacagtggttctcaactgtgggtcgtgaccccttcggtgcttgcttatcagatatttacgttatgagttataactgtagcaaaaccacagccatacacatgtaccactgaggtaactgtatggttgggggtcagcacaatgtgaggaactttattaaagggctgcagggtaaagatggttggggacctcctgccagtctcctgcctctcacctcgccatgtagcctgcatgtactgtctgctgtccctctgtctctgtctcattcctctgcctgtgcgttttcttctctcaggagctcaggcaggtctcagtcttagagagtcatcttagtggtgtgcttgctcctgagtgatgctgtggtggtacccagactccaggcgaggagaacccaggtccacactggaatccaaaggctgcttgttcactgctgtggtcctatgttcttctgcctgcatgggcccacggctgtgaagccccactgcacccagcctcccctttccatccgccttgccttcccaggacaggaaaaccaaacacctgtccctcgaagtagagctctctcctctgtcttcacacactgacttcggttctgatggcagaacccccgccttcctctgagccagcctcttagtgctaacggtaggtctgtgccagggcacctggccctgcccactgcttttcacggtgtcttgctgtcacgagagcccctccaagtgccagcgtgttcaccgcacagggcatctgaggctccctcagtcactgtgcactttcagcgtttggtgcctgtgggttcgtgttccgggaccaccgtgggtaacggtggacaagaggaactccgggatcccatcctctccacagaggcctgacaggaatccacttccactgtgccccttctcctccctcaggctggcgaattgggaaaggggaaggctatgctgatcttgaatac

SEQ ID NO: 34347 - DNA, 1179 bp, Mus musculus
tggggcttggagagatgtcacgcctaggtgacagtcccagcagaagctcagaaagcagcaccttcgcaggctggaggttatttttattagaaatgttgtggttgttactgagggaaaggaggcaggcaccccacacccttcccagggtgacgtcactgtctgaaaacagccatggtggactcgggggtcagcaggggtcacagagtaatctcactggtcgcccggtgtcccaggctggccctggtgctgactcaggagctccaggccccatattccagtggaattgctgactcccttggctggagaacagggatgccactgccctgccttttgctccactcatttgtcagtcatcagtctcagagactgggagcatggtctgtcccagccaactaaagctcccaggcacgtgtgccaccaacctctgtagggacctgggctgtccctggatctcactaagcttcagtttccatacctgtcagagaagaatgttgacctgactcttaaagttagagccatgaggcacctgatatttttattgttgttgcttggttctgttttgttttgttctgttttgttttgttttgtttttttcccgacagggtttctctgtgtagccctggctgtcctggaacccactctgaggagcagcctggccttgaactcacagagacccacctgcatctgcctcctgagtgctgagattaatgacgtgtgactccctgcccagcctggcctgaggcacctgctatgggaacactaagaaactcacagccatgggaatgagtgataatttaatacaggactttaaaactcaggaagccctgcaaaccaaaccaaatcacccccaaacaaacaaacaacccattagaggcagattctggctgtgccgagcacgaacagcccgtcagttcccaagatcatggcgctgacggagtcatgaacacagcatctaagtgtcagaaatctgcctaggacacagaccttggtgacaaggactctgcctaggacaccacaagaccttggtgacaagcaccaagctccttctgagagacatacaccctgcttgtcctctgacgttaactgagcctcagatcagatcagagccggtggctgagagagaactcagagatggttggtacctctggaaacctgctctcgtctcctcaagcttggggc

SEQ ID NO: 34348 - DNA, 1933 bp, Mus musculus
agcccaccacacaccggcttccctaaacgcacgccctgcttgctgcagacgaggcttgttgggggctgataccattgttgcatgtagtgtggcctcatgtagagaacagcaaggccctggaagtccgctcaacaaggcaggtggacatccttgtccccgggcctcaccaggccagtgccattggctgctcttgtaattttgctgctgcaggctgcacagcccatggattttggagaaaaggcgccttgtgggtttgcacacttggcctgccccgctgtgtgtggagatggtatgggtaaggtcaggggcaagcctcgggaagtttatagcggggactggactctttcgagtgaggatattgccggtgtctgtttatgtcccgatttcttcaggcctgccagtgtcaggacattaccgccatcactcagacctcagacatcaacagtgtgtctgtggggggggagctctagactccatgccttggtcctgactcaccttgtgtccctttgacatcagctgtctggctccttgtaacatgagtttagactctgggcccctctgctctgggctgtcagctctgcacacttcctgtccctgcatgtctacctatagagtgggtacttgacagtggcttctggccaactgctgcgccagccaggccttcttcacatcaagcaatgaggcactcgcctgctaaccgccttccttccccaagaacctggagctgaacacgctgatctggccatctggggcacctccccggctgctggctgcctcccccagccctcagcagctctctgccaggctcgctgtgaacagtataccgcccagggtataattgttcgttcacctttcaggacctatgggcattagagcagagggcccatcctgctcagctgtcaggactttgcgaacctcaggacacctgcatcgcctagtgtgggactgtcttctcaagacagtggggcacagaggacatcaagcgcctgacctgtaccaacctccggcccacatgacccactttccaagaagggtttcactgtgggtcgtgacactgaaggaacctgccgggtgcttttctgtggtggagtcctctgtgtttgcacagagaccagcacaaagtgctagcatgtgcgttctcagcccgtttcttgtgctcaccgagcctgtttggagcatggggtttgtctggagcacacacagacacacacacaacacacacacacacacctggttctggacagagggtggctcttaaaagctctcaggtcagctccgctttgcctagggtcagggaaggaccctgaaacagtagctgctgtgtacctggtgcctgatatcacctgtgtcactcgcctaggatgtgtggttctcctttcggttctcagtaaacctgtttttgaagccttgttgttgacttgtttctcgggtgttcttcaggtggagatgggagcctcaggaggggtggctgggaccgtgcatctcacaggcacacacaatacacacacactcacctaacattttatgtgtgtgttttgcttgcacatgtgcatcatacacatatgcccagtgcctgaagaattcagaagatgtgaagatatcaggtcccctggcactggagttacagataactttgagctgccacatggggactgggacctggatctgttttgtaagagcagctgggctcttagctgcagagctaacctctccaactcctatatgagctaaagagatcctttggtttttccacataaggatgaaggatcagggtgatttgttagagcttgtgtccttgtccccatccagtgcccttccccccccagggacaatggcagtgtggtggagggcaatagtgctgttctaggacagaaatgggtacatgttcagtcaggcatccacagcgaagatggcagctttgagaactcagatg

SEQ ID NO: 34349 - DNA, 1222 bp, Mus musculus
gctgagtggtagcctaggctctctgtgtatggactgagtttccacagtagcttctagggtcttgggcagccctgtagaagttaggtcaggttctgcctcccagccccgtgctcccagaaataagactcagactcaaaatatgacaggtgctgcagccatacaatacaaaaagacgttctccacaacacagttgttggtttaggcaagaacagctcactaatatttttttaatgcaattgcagaaaaagtcaggtagagcagagaataaaggcctctaaagctcctccattctaaaataacacagaactgggctcagcgccacgtgcctgtcagcctagcactcaagaggctgaggcaggaggattgctgtgagttctgggacagcgtgaggtatagaatgggactaccgtcaaaaacaaaacaagactcccctcctccccaaaaaggccccagaagaaatgtaaaccaacatctgcgtttattagttacttgtgtgagtgcacaggacattcctgtgtactgtcccggtcctcccctcccctcccctcccctccccccatgtcagacaaggggtggataaacatgcttgccctgttgcctggttacctgaactgactccatccagttgtctggcctccaggttccttgtggcacatgtgtacacacatacaaataaataagatttaaaaaataaaaataaaaaaagccaccggctttccctctctgactgggcgcaggagacttttttttttttttgatgctgtgaggattggggagaggatttcagctgtcaagaaagaccagagctggagaggtcttgcctgccgttcctgctcttggtggaggcaggagaattgggttcaaagccggctttggccgtatagtaagcaggaggcgagttctatttccaacaaccaccccccacccaaacaaacaggctgtgaatgaccttttcctgtctaacaaaagcaacgacaagcttgtgacttatttcccagagtgccaccaaggtctggacaccaggttctggctccccgaggggacagtcccggctttgtgacatgctgcctttgtctggtgtgctcctgggctgtgttggcactttgaatagctgctaacacacacctttgcttacattggctggcacagaggtggactgactgccaaggtcatggccagggtatgggaagacttggacatggcagggcacgggacctgggag

SEQ ID NO: 34350 - DNA, 1904 bp, Mus musculus
gtgtacgagagtgagagagatgaagacggcttcctgtacatggtttatgcctcgcaggagacattcgggacagcaatggctgtgtaagactccaacaaagccaatggttgttaagcccttaccaaggcaaaaagggatgttaccagcggacgctggacggctcaccacccacagatgagaacgtaggcacccacatagggtattaggaactgttcatcagccagaaactgagctccatgcaagtgcactcagcttggaaactcgtctaaactaggctattttgtgttcaaactttagaagttaaaaataaaatactttttgcatcctaagttgccaataaaaagatcaagttattttgacatttttctccctagtagggacttaaaacagaagagcagtgtcaggggcagtctcttcctgggacctgctgccttctctaaaagggctcccactcagcagagaagcccctctgaaggcccaggttgcctagcagaggcccccagagggccctggctttgccctaagcaggtctggtgttgtaggatatagctctaagccgggtcctggtcttgaccccagccacaccctttcactcagcagtgcagggacatgcagctcgctgctgtctagatgttaccatacgcccttctgctgaggccaggtctccgcttgtccaggggttgctgacccagcttaagcgactggagagctgtttctctcctggtttgaattctgtctggtccatgcctgcttcagggagagcaagcgctggccttaggatgtggttgtcaagtggtagactgcaagtccaatgctccagacttggctcacagctctttgttggtgtgtaactgtctctgtaagggtggttctgacagctgttgggatttccccatttcatgtcagtacatacatgtcagctgtgaggacaacagcaacagaagacatgcttttgatagacatgccacttcagctaaagctagcctctgcttcctgcatgtggcccgctgtgacaccaggccatccctggtcactcactcactcgtggtctgaggatctcagagctgcctgctgtcatggactgaagccagcatagccacctcccacctagctccccacaggcacccaccttccctgcatgcagctgtctttgctaaccctcaatgttattttacactgtaaattctcactgctctgtcttgtgtaggttgtatacgtcattatgtccctggtttttataactatggtgcgatcagtaaggattcctgtaatactgctttaaagatgctgctcagagggcgggcggcctccattataggacacctgtacactctgatgcactaataaaggcacaacgaacctgtcctgagtgatgtctcattgtcatcgtgggaactgggctctgcagtatacccaggctgctcttgctggggaggagaggagaggggaggggcggtaacctcctttccttggtcgataccttgccaccagctcctgcttttaaactcaatctctgactgacctgccagctatcaggtgccctctggtgccatgggaacacaccaaaagatttactcatgtggatagctgctggcacttgggaggacattgtaaccaacttcagcttagagcagacggcaggctctgcaaagctgctgcagtctcctcggggcagcctggacactactctgggtggcaggcgcctttggggtccagcagtgttgtcagcaggtcctcatcctggaagggcagggcaagtgatagcctagagtcctatgtaacaatgtttaaagctgagaaccttgacagccacgaatgacaaaagatctgagaatggccctatgtggtggcgcatgcctttagcctttaatcccagcactcgggaggcagaggcaggcggattt

SEQ ID NO: 34351 - DNA, 2814 bp, Mus musculus
actatatgatgccaggtttattcttttgtttcattgtctggtctcagcctccagaatgctgggatgattaacacgtcacaccccaggttcaccatggtcaggacagttggtcccactctgcccagctctgggttcccagcacctccatctctggttgtgcagtttcccattgatcctcaccacctgcagagcttttgaagcccagtcaatacctgtggccggagaatgcagtcgtggtgcaggttgccgcatcccttcccagtgccggcctgcatctgctcggtccaggccctccctgcccctgggtgttgccagcttgagtgtgaggtctatgcccagagaaagattcaaggcactgagaagtggtcagtggtgctctgtcggtcacttcccccagaaggtctcgtacccgtggcatgcggctgtgcgagggcgtggtcagtcctgagtggcatctcagagcaggtgggcggtgtgtgcacttttgtgattgactcaggcttcaccctcttctctctctctttctctctctctctctctctctctctctctctctctcgttctctccaggaacttttaggttgaaatacgcccctccagcagaaagtctggactccacggactgatcctttttttttttttttggcaacagaacattttattaagccatgaaaaatcacatagagaactgaagtcaagttgctgtggcgccatggagacctaaggaaaccacagagagctgaagtcgagtggctgtggagcttaatgtttttaacccaaaggtgctttacttaactatactggagagagtctagtgtgcaagttcgtcaaactcgatttcattgccaaattcctagtcttggagcttggtccaaggattgcctagtggacagcgctatggcatatcgtggccgtcacaccatcgctgcagcgtgaagacctgtctcctgaagctcggtggtccttctaggctcacgtaattccagggcagctatgcacgacctgagtcaagactgcaggtcggggttctctcaagtcccccagtcggatccgggacccctttctgggctaggaagcgcccgctggattttgctgtttcctaaagtaggagcctcctctctggcttcttaaggattgcactacctgacacaggcctctgcggtctgggaggcagactctgctgggacccgacaatgtaggggactcccatcggtgggcattggagttggcaccagcaggctgctccgccaaatacaccccgaagtcgattgcagggtgttctgtagacacttggagcagttccaggtttttaatatctttttctgtaaacagatttacacgatatagtaaataagtcatagcgcactctcgacaacttcatctgtaagggtccaggtcccaggggtccgttaccgaccgaggctggagaccacccctcccgctggaggctttgagcctgctctctccaaacaagaaccaactcttgaagactgggggatgactcggctttgtgggttggctgtgactgacgcgcctcattcttccggaagctggcaagctgttgtctcaaatggcttccccaggaccccagccccagagctcactgctgatggattcagacttgacacagacatccagcagtaatgcagacctgtgattcatgaacaaaagactggaaactgtcggcttcttttgtattaggctatgtgttgattgttaattccgttaaaattgcctggaaaacttcagtagagagatgcaagactcctcctcgaaaccgctcaccagttgcagtccagaccggggtgggggtgggtcctcactcctcagcatggtgtaaacgttcgacacaccacagcggaggcataagggacttaaacctccctccgaggttaaagggaattttatgctcaaataacattataatgctaaagccttcggtattagaaaatcgatggtaatattctgccaaggattttccagcctcctcctcatggagaagaaaaatcatagtccttaaacattcttcagacgggacagtcaccctcatacagaattagtgtaaatcacaaaatgccccagaactggaggcgttgtgatctaaggcttcatcgtattctaagatggctttgtctgtggagacccacggaaggcgtgagtgttgtggattctatgcaatgcaggatcgggagacggctgttctgtccatggcacagtatcacatctgttctgaggggatgtgatgaggcgttaggggatgctctgttgatctctcactcagaaacactacaaacgtcaatacaagaactgacacaactttgccttaaagagcaccagactgggattggtcgtattgtgttaataaggaagacttagagtgttcactgatgtttacgattttaatatttctgaaggccatcaccgtggcctgggtatgtgctgaaagccaaacttttaaattttttggtttttttaaacaaagaaatattttaaataaatcctatttcaacacagaagttgttgaaaactgtctcatagcaaaagaaaaaaaatcatatttaagttttctgttttgtggtcagtatagggaatggaagtgtcttacagctgttgacctgaaagacagcagtcttctgtggcaacacccacgttaccttgtggcggtcagtcgaggggagctccagcaccatctcggctgtccaggcagcagaagtctgtgtctggaagctgccggctgcctttggaagagctgtgtggtgtggcatttctgtgaagccgagcgaccggccagcgaggatgaaaggaccatggcag

SEQ ID NO: 34352 - DNA, 1173 bp, Mus musculus
gagactagacttcgtcagaaccccagcctttcctggtgagattgtacccatgagggtttcatgtccttgctcccaggccagaagatgtttactcttctcctccagagcacggcctgcctgggaagctggggccttttttctatacactgggcaagaagtagtcagtctctcccctaaaggtctttaggtctggtcccaggtgcttgtgccacccttgatggctctgcctctgtatgatggccatgtgtggaatacacccatcttaccccgtctgtgctgaccatggcatggcatcgaagagtctgcgtgtctcttggaggcctggttcctgtttaggttgtggtcaggacctggccctgtggctcactttatgttagactcagggaaagttgagcagattgtggggcttggcttgcctgtggtgggacgggtgtcttgcagaaccacaggggctggaaaggtcctactgcagctgctgcgggggcaggctgcttctgttgccgccgcggacactcaccttccttgtcgtgtcttccagctatcccagctctgccctgaagagaacttggacaaactcattccttgcttggctggcccagattccttctatgtggaacgtaaccatgttgatttggaagcaggcctaaggtaaataaggctcttggccaggtggctgtggctgttctggtgtgggcttgtcccttgtctccagcactatgcgttgtgagggtttgaagtacgtggacaaccttagagtaaggtgaggatgaggcgaaggaatcaaatgttgtacctgttgtggagccttgccccctgggatgtaagccgtcagctgtgctgagcggttaaaagcttttctgtgtcagagtgaagacaggcaggcttcctgagtcgtcaccgtgtccaacacagtggtgcatgctgtgctcgggctcactgggtctgttttcttagggtttttggtttgttctttggtttggtttggtttgttttgagactgaggaaggccttgcatttgtaatcctgcttctatctcccaagggctggggtcccaggtgtgctcactacacacagtttatgtggtgttagggatggaacggagggctttgtgcacgctggataaacattctactacccgagccacagccatggcctcggctgcttctcaagtgc

SEQ ID NO: 34353 - DNA, 1145 bp, Mus musculus
caggactttctgcccttggtgctgggcactggggtggcaactctctccatctttgctctgaaaccctgacctgctcatttatcccatactgctgttggtcctgtgatggtctgtgtgtccctggctgacttggaacttgatatataatccaggctggcctcaaactgaagtagatccacctgcctctgcctcctgagtgctgggattaaaggtgggacctgccatgcctggatccatcatcctctctttgaggctcgagactaaacctgcatgtctagggaaaggctctgcccataatgcagagctgtaggggttcaggaagagccagcctccgttcagctacccatatggcaatatggctggagttagtgcccaccacagagtctcaggcccaggttgccatgaggcttcagggtaggaaaggtggttcccatcccatgcctgagtggaaggaggaagaggctctgtgaggtggtgccagctcccaacttgggtgcctcccctggaccccagactgcacccagaaccccgtgtgggttatgctttgtcagaatcccaggagtggctggaggagtcggactcagaagaggacagcagctcagatgaagagagtgcagatggagaggatgaagaccaggaggacagtgctgaggagggagcaggtgagagccacagtcagatgcacctgcgccatgctgctgctgaggggccttgcttgacagtgcttgtgttggggtgggtctaagcaggttgccattcagtgtacccccgccctgacccctctgacctgcctgactgagcaacctcgttctcatttttccttttgggatgggaagatccgcagcacccagaggtggcccgtggggagcaattcgaagagtacctgtcccggactgagcagcactggctgaagctggcccggagccatgtggggcctgaagcaaaggagaagaaagtgttgaaagtagcccaggccatggcaaaatcatgctttgatgatgcagttcaagacattgcacaggccagacactagactgcgcaatggtttcaccatcactggtgtcgagccaggagtgaggaggccctgcagagtggtcttctgtgagccttgggtgcccacagtctgacgggggctagcctgactt

SEQ ID NO: 34354 - DNA, 1133 bp, Mus musculus
cccaaggcactcagccacttgtgtccccctccaaagccaagtgtgacatttgagttcttaggtatagccttcatgcttacaggtagatggggaagcacttagggaagggccctgtgcttgtgttctcagggccccagcgtgtgtaagccatgtggacagatagcgtgctcagagaggaggggaggggctgctgctttcctgtccttcttgatggttctgttcttactccgagcacagaaacattactaaaatgtggaaatctgtggggtctgggttcctgttttactgggggctgtggcctgggctttggggtgcacagcttggggctgaggctgagttctggtgccaggcctgctgcagagctgactgtgctttgcggccctgggggcctctgctgtgaggtcaggaaagtgtgcacagatgtcctcctcctcctctgctctagcggccttccagtgacgtctctgagctgacccacccgtgagcgcttctgggtggctgcagtggccagtagtgctagggggagatcatttatccgctaggtttggggacctgaggaacttgaccttggaggctaatctcttaacctgtgtacccagccccgagccctgagccccgtgaagagggagtcctgtgtcaggagcaggtccctgctgagcttcacagtgaaggatggtggcctcactccgggctgcgtgctggtgtgtttcagtccccacaaggccaacggctgacgatgagctgacttggtgaccacgacccagtgcacggtcgctagcacttttcaatggcaggctagctttttcttcctgtagtagtgcttagacctttctatgtcatactcagcactgtcggtcagatgaatgtggcatctgtgggaaagcacagagcagcctagccgactgcagaggagagatggtgtcacattctggattcgctgccttaggaccctagggaggcgcactttagctcatgaacctcctctagcaagatggcacctccacatctgtttcttctgcctctcagtagtcggtgccagggtccctcagaaggcagtgtcacacagctgagctttgagaaggacaggccttgagggttgctgagtggcatctctcttccttcacagggaacaa

SEQ ID NO: 34355 - DNA, 2148 bp, Mus musculus
caccatgctcaagtgtttttgtttttgtttttaagatttatttattattatatctaagtatattgtagctgtcttcagatgcaccagaagagggcatcagatctcattacagatggtttgagccaccatgtggttgctgggatttgaactcaggacctttggaagagcagtcggtgctcttaaccactgagccatctctccagcccctccccccatttttgtttttgtttttttgtttttggtttttgttttgttgtttgttttttcgagacagggtttctctttatagccctggctgtcctggaactcactttgtagaccaggctgggctcaaactcagaaatctgcctgcctctgcctcccgagtgctgggattaaaggcatgtgctaccacgcccagcatgctcaagggttttaacccctagtgttctcccatttctccagtcaagccctggcttccctgggtctgctctgagtgctccaagtggcatgttgctgaccctccacagtccccatgcctgtaggtggcatccgcatggcttgctttcagcatggtgagcataaggctcgtgtagatgaggaggcccagtggggctgcggtgcacatgggggcccgttctctgatagtgcagtaagatactacggattagggacatataaaggaaagatagtttgtttcagccctcctagactatgaaggcacactctgctataaagtgaactgagagggttggacatggatggttcatggcagatggggtcacagtggtgcatcatgtgtgagaggaagcacccagggagtctgaggtctgaggtcagacttgctatttccttagagcttgacttgcaaaaacacctgagggtctggagagacagctcaatggtaagagcactggctgctcttccagaggtcctgagttcaattcccagcaaccacatggtggctcccaaccatctgtaatgggatcaaatgctctattctggtgtgtcagtgtgtctgaaggtatgcataaaataaatcttaaagccacaaaaccagcctgagagcagcattggtctctaaggacagtacctcctgtgcccacttacctcccagctgccattcttttttttttttttaagatttatttattattatacataaattcactgtaactgtcttcagacaccccagaagagggcatcagatctcattatgggtggttgtgagccaccatatggttgctgggatttgaactcaggacctttggaagagcagtcagtgcccttacccgctgagccatctcaccagcccccccagctgccattcttgccatagcctctggacagtacagatggaaaggggatcagggctgacagccccgagctcagttagcatgcagggcttgtaggccgacctgagccctggtagagaggtaacaggagggaagatgagggatgtgtggaccggttggtccctgatcagcatagcttctgcatgtccccgggtgggataagcagcagcactgctggcaggacagggcccgggtgctgctcagcctttctgtaatgtagactgtaagatgaagtatagtaaggaggaggattgaagcacagacgtacaaagaagacacttaaatggactggcgtcttccccagggtaagcatcgttgcaagcagcagtgctccctgggtgctgagtagatgtgtgcgccctgccctcagggccaacagccagcaagcatcgctgctggacactcaaggctaggcctggggacctgagggtcccagaggtctaaatggtggccacatgcttctttccggaaacagtgagtcagcatgtcacctgaatggtggacggctggtgacacacaggggctgcagttgggtatagctgaactgtgcagacctgtgggtggacaggggttctgtgcagagcaccccgcagtgtcgcagcgtggatggccattggcggtggctctaaaatcaatcagccagagcccggcctccgtggagctgcagctcctctcgggtgctcctgcagcacagcagggctgcttctcaggactcctttgttttgcagagagtcaagaaagatgtggacaaaggcacccagcactcagacatgttcctgctgaagcctgcggaagggggagaaggtactgctgt

SEQ ID NO: 34356 - DNA, 1109 bp, Mus musculus
acctcccactcctcaggtacctctaactattacccccgagattccttcaagacagaggatgtttaacctagtgagaggagccttttatgcccttaacagaactgatccaagcgctactgaggactgctggctatgcctgtcctcgggtccggtccgccttattataaaggaatcgccttcaatggagatttcaacagaaccagcagccatacttcctgctcttggggtacaggacaaaaactgaccctgactgaagtatccgcgaggaatccaggtctctgtataggtaccccaccttccactcacaaacacctatgcggacaaattcagtccgtgtccagaacagaagctgattactatcttgtaccttccccggttggatggtgggcttgcaatacaggacttactccctgtgtatcaactaaggtttttaattcatctcatgatttttgtgtcatgatccagctgttaccccgtgtatattatcaccctgcatccagtttagaagaaagctatgcgggccggcggtcaaaaagagaaccaattactttaaccctggctgcattcatgggaataggtatggcagtaagagtggggacgggagtgtcagctttgatagaaggaagacagggaattcagtctttgagggatgctgtcaatgaagacctagcgacaatagagaagtccatagacgctttaaaaaaatctttgacctccctgtctgaggtagttttacagaacaggagaggtcttgatttgttgttcctaaaggaaggaagactgtgtgctgcccttaaagaagagtgctgcttctatgcagatcatacaggaatagttagagactctatgcagaaactgagagaaagattagagcgaaggaaacgggaacgggatgctcaacgggggtggtttgagtcgtggtttgaatcacgaccatcttggataacttctttaatttccgctgtagccggaccaatccttatgatatgcttagctttagttttcggcccttgtataataaatagaggaatggctttcatccagagtaaaattgatacagtaaaactcatggttcttcaaaggcaatatcaacctatagttcaggtaga

SEQ ID NO: 34357 - DNA, 1139 bp, Mus musculus
tgtgatttggcgggtaaagatggaggcggggtttcattctagcccaggctaacctgcaagtcacagactcccagagttcttcctacctagcctctcatcactgagcttttaggcataagccaccacccccagccttgaatcacttggaacgctgagtaggtatatctgcatatggcacaaactataaaggcccctggggtggcatggcctggagtccacctaggaacaagcactgagtgtatgggtgtcagacaagctccgtttaagggaggtcagacatcattgagaaaaggtgtccgacaagtcggagtggagctgagacctcaagtcccgctgtgagctgagagaagggctggctgcacagaccatcccaggagcctctagccaaaaaaaaaaaaaaaaaaccagaaagctaacatggctcacaagacaggtggggacgggggcctgtgggacccgggatgtagttgtcggactttccagaactgggagggaaggcaggagtttggttttctggactggcagacccagaacaacccagcaggtccaggcagtcagagctaggagggtgggaactaagagttcctgaggtccctgcaatgggagccagagagagctggtggctgtcaccctcaaagagaagaaatgtccatgtcctggacacgggcctcatacggtcaccatttctttccaggacttgggttaattcaccaaggcgctgggacttattgcttcaccgattacgatccggtctctgggtgctctgagcctttgcataactcccccacccacttctccaacccacgctgagccccgagagcgtgcacactcacacacacacacacacacccgcactccatggtctactctaggcaatgggagtatcccacgctctgacatatataccccagggcctttgcacaggcatgcctccctgagcttcttccttgctcttcccagtgactcctcccgtccctgactgcagagcctgagggtgcagctttccaccgcctgagttcactgaaacacctgagaatcgcctgcccacattgcccacctctgggtatctgtcagaacatgttgaggggactcctggaggctctggtgataactgtcccagaggatccgggctacgaagg

SEQ ID NO: 34358 - DNA, 2695 bp, Mus musculus
tgagagtcatgggggtacagggagtagacttggggtcccaccctcgctggtcttagcaggcattctgtggccagctgccctgcgaactggcaaaaaccccaccactggcaactagctcagacacggtagcctgacaacatagagcctgaaaaagttgtatctgaggcgcccagctctggctgattccagttggcgtaggacgtgtgttcaccatgtccagcctcatcacctgagatttcaaaagggtaaacggactggtgagagtaggcgggcagagctcacgcccgatcctccaccctgagttcactcctgtcctccctctccccgcagtctctgtgacggtgctctgccagaagttgatgcaggtggtacctcaggagacttagtcacgtgtcctgggtgctgccgcgctgtgcctgctccagacaactctcctttggaagatcagcggccaggcctgtcagccccacagctccagtgagcaccaccagccgcctaacacaatccactgtccctcaaacgtcaggtgtccacagtggctgtgaaagaaaactggtacgatttggtcccagaaggtgaccgtccatggtccatgcagacacagcacccagtatgaggcgtgctgggacctgaggcctggactttctgactttctggggactgccacatccaggctttctcccctgtgatttttgttttgttttggtttttgtagcgtgcatttgggtcaagtttacactagcgagatgattattttttaacaaaacagggtagcaaggagcaggagatgccgtggccgcacagtccggccctgtgggaactgctggccacagctcttttcccaaggctgtcgttcagtagcatagagtgcctcaaggggaccgcatcactgtcaccaggtcagaagaactactgagacttgcacatcacctgttccactgtggacttggactgacagatggacgacacatatgctagcttggactttagttttctgggaccctagagatggaaccccaacctttctcatgagacagagctctactgtgtgggtcacttgttaggttgaaaatgtagagctcagctctcgccgccctgaagtcctggctccatatgaaagatctctgcagccatgaccctaacagcacctagctgtccgctgcagggccttgtgctctgtgcacacaatgcagcagtgccccggctctcacacgcacagcactccccgccctgccccacctctcttagaaccagaccagcaccatggctctcccacccccacccccacccccaagcacctggtctgtccccattgttcttgagactgctagtagcattctgtcaaagtcactactgctccctccagccccacccttagccattgttcagaaaaataggcaccaagcacccctctgctctctgccaccagtgtggtgtgaccactccagctccctgagtatgaaagccactggctacatgtgtgggaccatcctgcagccttcccgttgtgctctgggtgagacagttgggtccagccagcacatcactgaaggagctgatctgctggagggacttcaggatgtgcgtcccctgctggcctctgccattgcctcagaccatggcctccctgaaggggtgtctactggaatggctactatgcagttcttacatagtggtgacttaccactggccaccctgacctctcctctgtgcttctggggttccctttcattggggtgaggaagcaaggtcaaggtcagagtgcctcttgaaggttctcccagatatgggaactggggtctcttccctggaaatgagggcagggacccagttccatcctggggtgtgtccccagatacagcctgggttaaagggcagggattcatggtgctgacccaggctctctgagaaggccctgtcattcctgtttgtgatgttctgaggatgcccatctgtaggtttttattttcaaatcaagctccgaccaccgccattttgcccagtgctttctattttggttttatcctaacatgtcactgccctgaaagacacccctacctggcccctttcaatggtcagtgtctgacccaccacactgggtccatctgctgtgccacctgagatagtgctgtggttataatgtcttttactattgtattaatggctagcctgttacattagactggggggggggtacagaggtctgctgttttgtgaggctttttgtttttttggggggttggttttgttttttttaaaagctattggaattctaagctgctgactgtgttctgtggtctgtgccaaattccctgtgtaggaagcatctttcctcccagcccacccaagtctcacagccgtacatacattcctctgctcaccaacccctgagggtgacaaggctggaaggaagccagggggccagggacacattaaggtcacaagagggagagggtttctggaagcctctaggtgggaggggcttggcccagaggaaaccagtaggctaatggtgaggctaactgtgctgagagcaccatctgaggggaggtgcaggaggaaaggagcccagcaagaagttaagtgatgccaggtcatctcacaacacacacacacacctgtctcatagacaggtcagacttggaaactagggttcactgctctttgcaggctagcatggcccctaggctagcat

SEQ ID NO: 34359 - DNA, 1847 bp, Mus musculus
tccattttttattaggtatttagctcatttacatttccaatgctataccaagagtccaggtgctcttccaggtctctgaaggcctgggcgccggctcccggaggattgcactctgaggagagtttcagtgttcatggagtgagtgccctgttctttctcgagggcacttctggggaacatagtgttccctggcttccatgccttaggaaagaccccgaggaagcactgagagtcaggttttagggcagaggtctggtttacgtggttgagtcttctggagtcctctgtgtttgtctctccacaagtttccttcacctagttaagactggattgggaaatgacttggcctccatcccgaatgaacccactggtggtaaaggtgcaggccatctccctctcaacaagtctggctccctcctgcaacctcaggcctgatgcgggcagcctggagcggagtctttgatgatgattggaagacttgttttccacattgttctgggtggccgagagcccgtgtgagtgaggcctagggaccatctcgtggcttgctgtttggttttgttctgcttttgagacaagacttctctgtgtagtcctggtggtcctagaactcactttgtagagcaggctggtattgaactcacagaactgtttgcctctgcctccagagtgctagcattaaaggcgcatgttcatttttgcctaagtgaagcttgggtgctgtcgacttgacctggagcccagtggtttaggtgcatttctactgctgtgataaacaccatggccagaagcaaacctggggaagggttttactttcctctcagcttgtagtccatcatcagagcagtcaaggcgggagctgacgcagaagccgtgagggttgctgctcaccagtttgctcctcgtggctcgctcagcattctttgtttttgtttttgtgtgtgtgtggcatccaggatcacctgcccacccatgttggcattgcccacagtgaggtaggctctccacatgagtcgttcacctagaaaatgtgttgtagactcacccccaggcagcttaagtgtccctctacccaaatgagtctagcttgtgtcaagttgacataagaactacccaggacactcagtgcctgggcttgtcttgttacagaatctttcagactagagctgagattccgtctgggctgagatttatctaatctcacagggccgtggctgtctgtgctgaggtgtgcaggaatggagcagcctagactcgggaacaaagcccaggcaggccctgggtggtgactagcgccacctgtgtcccatctccagccttgtgagtatgaaggatgaggcctgatgaccagcctaaaacactgaaggtgtgcaccctatcctgggtggagaatgggacccctacctgctcacgtttgatctcaggtggctgaggactcccctggactgctcaggagacgtaggggctgcctggcatgggctcctcagtgctgcggaactcactactctctccatggaatgagtctggcagggtcttagacattcttagctagcatgtgcctggagacctgtggcctgagataattcccttctagtgccagatcaggaacattgtatttctgatttgaggaaggaccctcgaaccctacctataactgtagagtggggatccgtcctgcctgggtgttggggagagctgtgtttagcagacagcacagagctgatcacgtagagatgggtctgtactctgcctggtggacctcttccctcttaccagggagcagccccacagcccgcttctgcatggagaacaggctggatggagggagaaggaagtggaagggtgct

SEQ ID NO: 34360 - DNA, 1372 bp, Mus musculus
aggggtgcctcaccccacaacccacccccacttatcctagataagatatttatccttcatctcccagacgcacaggatatgcacactggaggaagcggagataaacacccgcgaggcagggccaggattccgggcaggtgttgggactatacactgagccaccccccttccggtgctttctcccttgacaagtcctctgcgccgcctggggcgggagaagaagcacgcccttaccaatcggccctgacatcctgcacaggacttgtgaggaggtgtgagtcgactctccacccgcgtacaacattcggatcttgtgaaacacgccgcgataaacccatcagtagtcacgccgcgttaaacacatcagtagtcctcagtttcaggatcttaacgctccacgtgctctaacagacttgggggcgggggcccgcgaaggaggcggggtcgcgcgggctgagggggcgggggcctttgcgagctgaaccaacagcagcggcgatgggcggagcctggagggcgggtaacggtagagataaaaggccgcgcgggcggggcggacgcagacgcacttctcagtacgcggagagcggctcggccgcgcgcacgccgggtatccaggccgagccgggaacgccgagagcatggcggtcgcgggcgccaagaggcgcgcggttgcgaccccggcggcggcggcggcggaggaggagcggcaggcgcgggagaagatgttggaggcgcggcgcggggacggcgcggaccccgagggcgaaggcgtgaccctgcagcgcaatatcacgctgctcaacggtgtggccatcatcgtgggcaccatcatcggctctggcatcttcgtgacgcccaccggcgtgctcaaggaagcggggtcgcccggactgtcgctcgtggtgtgggctgtgtgcggcgtcttctccatcgtgggcgcactctgctacgcggagctgggcaccaccatctccaagtcaggcggcgactacgcctacatgctggaggtctacggctcgttgcccgccttcctcaagctctggatcgagctgctcatcattcggccctcctcgcagtacatcgtggcgctggtcttcgccacctacttgctcaagccggtcttccccacttgtccggtgcccgaggaagctgccaagctcgtggcctgcctctgcgtgcgtaagtaggggtccgggctggggtggggccgggctggggcggggccgggtgggcgcgagccaaggttcctgcgtttacagctcggcaacacccatcccagtatccctccatctgtccatccctgaaccatctcggcagttccaggctaaagtcacaggccccagaacccacgtgcgtttctttaatccat

SEQ ID NO: 34361 - DNA, 1121 bp, Mus musculus
actccatactctagttgtcatatctcctccagtctgctattttcgttatcccaaagtatccagtgtttataagttttggcaggaaaaacgtgcagtttctggaaaaagcccagcagatactgtagtgtttgttggattgaggctatgtggtcaatagagacactgatatcaaataccccaggagatagactaagaacatcagctttctgctagacatgcagtgtattcacgagaacacgtcagatgcaggtggggaggggtgatgactagaattctgactagtactgctcgaggtgaggggctcaggggaaacggagggtccaagcccaggttctagatgaattcacagcagtggttttactaatgccaccccatgtagcttagcctgctttctcagaatcagatgtgctatggaaacttaaggtgtatggttgaatgaattacacgatgcaaggctgactataaagccccatattacttaaagggtcatttcagttatttaaatccagaaaaagtttccctgggaggggggagactagacagttggatgcaatgagggccccacccaacaagaatgtgacactgaagttagggctgtggtggtcgttgttaatgtctcttctgttcataaaaccctcccagggaaccagtcagtggaagtgcttctaaccagcctcctgcactgttagctggaaggaggagaggctgaggaacctggagagcaggtgtgggtgggatcatggcagttgcttccttaggctgcaccagggttgcaggcagaagcttgcagtgagaactacctgccttgaaatggtgggaggtgctactctcctgtcctgtcctctagaagctcacactgacactggcctacttggatggagttggtcttagagctgtcttggaactgacactggaacatggaggagctggtacctccagagcatggagccaccaccaagggggatgaaacattccaagatactgtggatgtgattcctgtctgaattaacttctttgtagttttcatgtttacacactcaggaactgtccagtaagattctatattagcccatggtgcagcagacagcgttacttccccaaaaggagcctcctaatgacag

SEQ ID NO: 34362 - DNA, 1237 bp, Mus musculus
gaactctgaatgctgcctccttggagtggtggaaacactcatagcacagtggcccggctggcctgacccatggaggcgccgccgccaaaccccgaggagcgcccgtccgtccgtccgtctgcccgccgccgccccgtcagccgcctcttcgagcccgccgcagacgccgaccggaggtggcgccgagctgctggctgagggcggccggcggtggcggctgcagggactgaccagcagagggtttctataggcagctggggcctggagatgctagacttagcctgaagctcccagacctgcttctagaagatgtgttggaggtggtgtgaagaatggggaagtgagactttcattccactatttagggaaaaaaagccactagttagttatctctgagtgttcgaaagccaagtaaagccctacagcgaagcgcctgcagacctttagatccttcggtgcacagagctatgagctgttccacactgggacgttaatcatcccttctggttcttgacatttgttttgcaggtgacagaaaccgcataccctgtgacttctggactcttgctgtcagtgtgccccttcctcgtgctctggatgatgtcagagcaggacctggcggatgtggttcagattgcagtggaagacctgagccctgatcacccaggtacagccgtgagacagtcgatgcactgttgctctccctgtcttttcagtatcaaagccactctgccggacttcattccccagtaaagcagacacagcagagatgccagccctgtgtgaaaatttaaatcataggatgattgcagggctgcctgcatgtgtgcttgtgtacacacacacacacacacacacacacacacatccacacatacttatttaaaagagttctggccattgctctagatggctgctgtgtgttgccaaaggaggaggcaaggcagacacagagctgtaggtagcagtctcgtcttttctattgtgagtgagcacacagaggctggagaaatgcacaggcattcagtgagaaaaactgaactagtgacatgaaactattcatggcataaaagtcagtacaaatgctgagcacagaattctgggaaggtggctgtatcaggccagagcagtggctcagtggttaggagtacttcttctcttccagaggacctgggcttcttcccacattggacagcttccaaccacctataactccttctggcttttgagggcatcc

SEQ ID NO: 34363 - DNA, 1140 bp, Mus musculus
tcctaattttaaactgtttaaagaaaaaaatcaactgctttaaaaaataaaaaaaaaatgtctgtcctcggtaatagtcttagttaactacaatcagaaaggcttggttctaacagctgttgagttgtcaagcagtgcaaggtggcaaccccggaggcaacgcctgcctgtgactgggagctgcctgcacggctcctgggtgcatctgcactgtaccaacactcctgctccgtcatcaggctatgtctagccacagagagcaggaaggtaacttattcaccgtttgtataaaaatgcctgcgctggcccttgaggccttctggttagacaacacagtactggccttattagaatgcttgaagctgggctggccaggtggctcagtggttaagagtgccgactgctcttccgaaggtcccgagttcaaattccagcaaccacatggtggctcactaccatccgtaacgagatctgacgccctcttctggagtgtctgaggacagctacagtggacttatatatgaaaaaagaacgcttgaagcccaggagtataaaggatggctcaccaaaccactgcttccacagcaatgcagatgcttcagcaactactgctcctccaaatgtcttcagcgctaaagtgcctcactgccatccctacaagtacaactatgtgaaatcaaactcacagcatacctgcaggagagacaagccaggcacaacagaattaagtccatttccatctctggaagccgaatgtcactgctgggtgaaaccccatccctgtaacctcacaaacatttttatcatgattaagctttggcatcaaagaaaacaggccttcttttctttttttcttgaatttgctcattcaggtgcggaatctgaaactctggaccccacgccagctgaggctggcagtgttccatggccttctggaccccacgccagctgaggctggcagtgttccatggccttctggaccccatgccagctgaggcgggcagtgttccgtggccttctgtctgccaaggagcacaaacaattagaagagcacccttggagcccagcagccttagccgtgtccagccgggtgtcagatgaccagcaggggacatagatttccagcagaaggccttgggt

SEQ ID NO: 34364 - DNA, 1123 bp, Mus musculus
agaacaaaaattgagattatgcgctaaagatgctcacaaaaaggggattccaggggattttcaaggctaggaatgtaggcccagatggaagttctccagcaagagaccactggaccacttggaacagaaaaggatcttaagtgatctatataaaattgactctctaagattaaagacatcaaaacagaggaaaacatgactatctcggggcgggcaagaagagaagtaaattattttaaagtattcttcattgccttgaagaaaacagaaagttccgtgttcagccttcagtatctgagagctgtatagagacctgtcactgttggtacacaatgcttgctcgcatggctggtagccctggccttgtccttgtaggacatgacccagcagcttgagaaaggtctgttcttagatgttctctgaggcattgctaaagaactttgcttgccacaggctctgagccatgttgtgtgttctctgaccacatggaattgaggtagattttaatgaggaaaaaacttcccataggtcaagtaaaaaaaacttggattcatgaagatgacgtcattgaatgacatatgtcaaaatgtggactgcatcaggtgtgctgaggaacagctgcagacaagcttggggtggagaattacgtcgtctccatccaaaggacaaaagcagtgttggtgctcagggaggattacagatagaggagttccatgtataacaatgttcagttgatgaagtcctggtaccagaagggtgaaggctacaagctgccattgtgggcgtctccacagacgccctcaggcagtagaagatgaggttctcccagatctgtatggatggatcgggaaatgacagatgggatgacatgctgcctggacaccagactcgggtgggggcagcaggagaaggaaggaggaaagaagaaaagaaagattgttgttgcttctgaatgtctgagctgtctcagagcaagaacaggctgtgcttggtggcaacaagtgatgtgtcaccctaccccaggttgagtcaggttcagtcatgcatacttggtatattttgaaagtcatgtgacttaactctggtaataggaccatgtggttatcttaagcagaaaaatagt

SEQ ID NO: 34365 - DNA, 1132 bp, Mus musculus
gttacagtccctctgtgtcccaaacctccccagttctatgtagtcctttggaaggaactgggtggtctatcgattcctttgctgaagctggccctggaggaatccctagaaagaggacccactgtgatacctgacagcagtctccagccctccagccctgtttacttttgctcctttgagccacttgctcaagaccaggcagggtgggggctgggggaaggtgacagggctggtgtgtttgcaagtctcctgactttaagggctggtgataggaggcgtatgacactgggggcaccaagctcctgggacaagtctccacatgccatagcaaggtggccatgcaaggttacagattgacttccaggccatagctggatttgaaacagccatcactcttgcaaacaaagtcatttcaaagatgacaactccgactctctccttctaatctatccttcctcccagttagaattcagccgcgagctgagggaagcccagcttggggctcaacctggggaaagtttgtgtagagttcagctctggaccagagtggtctgtggcccatcaggcccagggtgtgtccctgctgtgcctcagggacacataagccctcccggctcaatcccctcacctgctgggcccaaatccacaggccctgggctaccacctctctactcccgcctccttagactcatggactgttctggctccaagtcctctggaccttgcatgcattcctttcttgtgggctcccctctctggcacctcaggcccatcgtggtcaccctcagcctgcagagccccgagcagggccacctgttttgtgcacttacgggctttggtcacatgctctctgaagacactttcctggcatgctccttgggttttataatctacatagggctacaacattccctctgcccagaggagagtactgagaccacaccgtggggtcactgcaaagctggaccctgggcagtgtgtggctatcagagctgcaaacatagcattgcctgtctgatgcagatgtaatagaaaatcagccacttagggggcttatgaacttgctcatacctccctgtgaggaaaaccaggctgtctagtggctgacaagttggaggccacaatgtctctc

SEQ ID NO: 34366 - DNA, 1183 bp, Mus musculus
cccagcagccaaacttcctccaggtaagcagccatactggagcctcactggcccttggataagtgaaggggggaggggcctgtccataggcatcacatggtgtccttgtcaaccctagaaccccaatcccttctgcctaccacatcctacctagggcctgccctgggcctgacatgcagccctgtgttcttgtagacagcctggcaggctttcaacagcactcgctgatgcacagccccctggttcccgctgacaaggcacccaccccatcctcaggactggacagtaaggccgaagtcaccaacggagagaccagagtgcccccccaaaatgggggcagcagtgagtcccctgcagcccccaggaccatcaaggtggaggctgcagaggagcctgaagccacccgtgcctccggtccgggagagccaggtccccaggctccgtctcggacaccttcaccacacagccccaatccagtcagggtgaagacagaactgtccagccccacgcctggctctagcccagggccgggagagctaacaatggccgggacactctttctgccacaatatgtgttcagtccggacgcgggcacaaccaccgtccctacggcgccacaggcctcggagatcctggccaagatgtccgagttggtgcacaaccggctacagcagggtgcagggagctccggcgcagcgggaacacccactggcctcttctcggggactaagggtgccacgtgctttgagtgcgagatcacctttaacaatatcaacaacttctatgtgcacaagcgcctctactgctcgggccgccgcgcgcccgaggacccgcccactgtgcgcagacccaaagcggccaccggcccggcccgcgcgcccgcaggtgccgccgcagagccagacccgtcacgctcgtcgccggggcccgggccacgagaggaagaggcgagtggcacgactactccggaggccgaggccgcgggccggggcagcgagggcagccagagcccgggcagctccgtagacgacgcagaggacgatccgagccgcacgctgtgcgaggcctgcaacatccggtttagccgccacgaaacctacactgtgcacaagcgctactactgcgcctcgcgccacgacccgccgccgcgccggccacccgcacccacgaccgcaccgggacc

SEQ ID NO: 34367 - DNA, 1232 bp, Mus musculus
ctccagagcttacagcagtaagaaagatgggtgacctaacacatagacaccggctgtctgctcgagtcatacaggtcactcagggagggaaggcctctcagatcctgtgggaaaggctgtgggttgctgacagaggaactacacactctgctgaccagtcacccagctctcagagaacttcccttagtgacagaactcatgtgtgcgtgctgggtgccaggagctgtgtctgcacctcaggggaaggaactccgaatggagtctgggcggaacacaccagaggacacagccaggaacacagccatgggagggaacactgggtcagctggaaaactcacactctggctttgtcccgcactcaaactagtctctggttccctcctcctgggtgcgcccagtcctgctctctgcatggcactgtgggttggtctgcagggctcctgatcatctctgtctttgaaagtgcttcttctctatggagcctcgctgtctcactgcacgagagaacagcggctcagcacatcccagtgctgcaggagtaaacgaacgccaccttgtcactgccccttctctgtccattggcccacaggtcatcgtcacggtcttcatcctactctggctctggctcgtcccgctcccgctcccgctcctcctcctacagctcctattctagccgctcttccagacacagctcgttctcaggcagccgatccaggtaagtcctgcctgctgacctctagcaggctcagtgctcacgggtgtgtggggtgggtcaagtgtcgtgtctctcgcaggttcctgggtgcctgcttccaaaatggtgtcagtaccctgcatcctgaggagccaacactgcaggggctggcctaggacctgcccctcaggtctctgttgagcggcaggtaggaatgtacagtgtccagcccagaagccctgggagagttaggcaagtttctttctgtgatagtgtgtctgccagtggcaggtgcccttcacctcagtcaggctggcttgggggtagggcggtgctcagtggtccgtctgtccctcaactgagctgatgctccatcgtgtcccttccctgcgctgctgtcactgctctttagaaagagcaaaactttggcgtggtgttcagtaaagcggaagtgtcagtcctcgtcattacctgggacacataaagacacgcaacccactgctttgggacatgttaccactaagcatttgtgtgggaa

SEQ ID NO: 34368 - DNA, 1773 bp, Mus musculus
aaagctcctgctgccccagcggacaggtaagtctctgcctacttccatgacaggcttgtcctggacaattgatcggctttaggagtatgggagacatggaagacaggaaggaaggacagacagcagtctcagcccactcctctttaacccctcagactagtcgggcacaactgcatattactgtcttgttgaagaaccctagacaagggccagtggttctcagggtgcctatatagtggggcaaataggagaggctgcgggctagcctacaccctccttgtctccccacagaagaagtggggagccctgggcacttacccaagggcaggctcttcgtcacctctgcctcacaccttctcaatcctacaggaagcgtccactgtcaccccagtctaagggctccagcaaggtcaccagcgtgcctggcaaagccacagatactgccacagcaggcaccaagtcagggaaggccagcacattgtcacggcgagaggagctccttaaacagctcaaagcggttgaggacgccatcgctcgcaagcgggccaagatccccgggaaagtgtagtggcccagctcactcctggagtagactcttcatgtttttataaagagtagggtaagcgcagccattttggattttccagtcaatgtcttattttggctgtgattctttttaaaaattaaaaaagaaaaaaaaagtttctcagctggaaaagaagccacacacaagatgaagatgaggctgagtcccaacctccccaccagactgaaccagcttcttccagaatagagtctccatggacagacggacagatcagcactgaacaggggacaccaactctgtgtaacttaagagcttcaggcacgcaggggctggcctcacccttctgcctccgtcctcacttctcccaggtgacctcctgggctgcagttttcagcagcttcctctggggacaggaaagccgaacacttctggactacaggcaccatccctccctccctggatcagaagtatatatatacttgcctaaagaagaatatatatatatattcttgcctaaagtctgattgggaaacatttcctgtcttttattttaagcatcaaattgttttagttgattaaaaaggaaaaaaacagaaaagacaaaaaaataataataataataaaggccaggggtattgttggggtgtctgtccaatgtggagggtcttttttgagctatctcctaaaataaaatattttgataagcactttctggtcctggtaatgtctgcttgggcctcggctgcctctctcccgggcatccatgccttggctcaaaatgggccaagcaccctaggagagcagatgctattacccgcaggagccaacgggcacagactgcctgtcattaccccccccccccggagtgttaagcctcagttttcccatcctgtggttgaggaaagagcagcccagctcttagcgctgactcggagtgatttaggggctacctccctcccgtgagccctggctgagcagggactgtagacacgattgcctgaccccagctataaagctgcttgtcattcttgctgtgaagctgttgcctggccctcacccaggcacatgttcaggcccaggctatgcaaagcctagctaagattgcaggacttgactgcggtgtccctccatggccttcattattcctgtgagaggagcacttgattaagatccagtcagtgcagacaggtcaataccacagcgtcttcctaggccaccagtcctgg

SEQ ID NO: 34369 - DNA, 1191 bp, Mus musculus
agtggtcatttagggacaactcgtagaggagagcgggggcgggatgtgagggttatgtactctggacagaaagatgataaaaagcagtcacttgccaggagaggtagatgttggggtccctgggaatctgctctcaggatgtaacccaccacaagcacgccagcatccccgcgtctcctgatcctgctcaaagaggcttgctctgggtccctcctttcacacgagatgagggtcactaagatccccacaatctagcccggaatggaaccccaggcagcttgagaggctcatcctgcgcaagctggtgtggacttaccacgaagggacccacccgtgtctcaccaccccccccaatctaatcctgccttagagtctctgacctgtaaagtctccggagcagcggctactgccgcaccccatgactggacactgatttttctccccccaggtcggaccaggacctcaagtcctagacgacactcatgatcatctgctaggccaggatggactgccacaacgggacctttgacctcttccacgtccagtgccatttggagaaaggggttgcccactggaactcgggagctggcctgctggtcagcctctcctgaagggctgcttgatgatcgattatactgggggatgtcgagtgtgatgggcagccatctaggcgatcacgggaacccctctcaagtgcctccggttccccgctggtttctgaagggctagctgacccactcgatggaccttccagcactccagacagctgctcatcagggatggggagtcggtgcctcccccctcccccaagatgctctgagggcctcagtaaccatctaagcgtgatggctcagacagcggtgcctctctgctgagactcaggccacagtttctttataaagcctcctggtgagggtaggggctgtcgagcccacaggtagggtccattgtgtgtgtgggtgcctcatgagggtgcagtcagtggacctgaggaccacaggaataaagtgtgctgttcctgcctgcccgtgtgggctgtgctttcttctttcttcctaaaccagcgctttagggtctctggtctactgatctgctgggtcctacccgccattgagttcagtcttgtttccctatgtagtggagaggtgggggctgaagtgggtcctgccaggaacacttcccactgcccac

SEQ ID NO: 34370 - DNA, 1206 bp, Mus musculus
gatgtactgcatccgagatgggcattttctctcccaagctccacacaagcaagaattttgtcgttttttttttttttttttccgtagctgaaatggatcggcacatttctgtgtcattcttacggtacagtttagtgacctttagtatatttacttgatacaaccgtcacctctgtttccagaactaaccatccattctccaacagaaacagatacaacttcctggttccacctcctgtaaaatcgtggctgttgaatggcttagagttccgaagatgtgcgagcacacgatacccacccaggccaccagttctgttcctaggagtgtggatggtacctaatcctttcacagccttctggctgacattttctacacagtgaatgggagttgctttttttttccatgctgctttttctacgtctgagtttcttggacactttccagctgcacaccaaaacagcttccttgtttgtctagaccgtcggtaattgactcaagccgtcccccttggaagccatgcaccggactttccttgcattgtgtataagagtgcttgcgtagattcctagaagtggatgaaccagccaagcagctatgtgcctggggcgatgttgatagctgttggccggctgccatcttggaagctggatcgattgctcagctctctctgctagagcgagagtgtgtgaataggccttctgcgccacagtagacagcctgtcagtcaggctgacagctgaccaatgggagttcactattgtttccttgtggcttgtgagatggctcgtattttcaatttctcttgcaataacttttctgcttcatacacacacacacacacacacacacacacacacacacacacaccagcagaaaggtggtgtgtttaatcccaacactcaggaggcagaggtcaggtggatttctgtaaattccagggcagcctgatctacagagtaagttccagggctacacagaaaccatgtcttgaaaaaacctaaataaataaacccaaagaagaagaaggggggaggatgtctctgtgagttcaaggccagccagaagttcactgtgagatcctgtctctaaaaaataaaaacaataagttaaagaaagaagagaacaattaatttactccggaatgaatagtttcacccatgggtatttttgtacattatcaggtacagagaccaaggtcacctcat

SEQ ID NO: 34371 - DNA, 1907 bp, Mus musculus
caacttcctgcagcatctgctgcaccggcacaagttctcctacgacaccttcgtggtaggcattccctgctgggccgtgggagtgctgagcgagaggccaccaggcacccaaacctgtcaagggcttgggcatgcacgaggctagctgctgagtcccttggtgcccactcgggccccctgaggctctgtagcagctgccgagatgagtccctggtaaggtgtttccttcaaggagactctgaagggaagcaagaagggttttctcaggagcccctgcccactcctaactaggtcagaagctcccacccccatcccatcatctgcagcctctagccacgtagggttggcttgctttttcctggtccccaaggttggagatctcatggccttgacaacttccatctaagaaaacccagttcttgtccaagaacagtgggttaaaggctcctactgcctgccaagcttgacaacttgagttcaatccctggtacccatgtgacaaatgagaaagtcctctgtcctgcccacactatggcacacacatgtctgtacatatacacaccaaaaactaagctgtagaagaaagattcttaccatctgaaacccgcgcctcatgatcacaaacctgcagagcactggtatgcacacgatccaaggctacctttggggacacatgtaagaactggggcaggcattctgtgaaggaggcttgggacacactgtgacagtgggtgtttgggagccatcctgctcctccctcatgcatctctgcttttccccaggactacagcatcgacgaagaagctgccttccaggctgccctggctctgtccctctctgagaactgaggcacagcctggccacccgcctcttatggggcagaagacacactcccgctttaagggatagggctgttgcccttctgccctggcacctgcacaggagtgcgcctcaccaggccaagtggaatgttacacaaggagagttggtctcagaatccccaggctgggatcctggctagctggccccttgtcatcaagcaggaccaccaggtcctggccagcagcactgggccctcggtgcttcaaggggcaagtgctggccattgggtcagagcaggtggctgcctttcccagacttggtgtctgtgtgtggagaaggatgaggtgccctaagctgtgcccagcagggccaggggaagaggtgcccagccaaggctgccagcccacccggtcggtccctagcttcgcttccaccgtgagcatttggtactggcttttgtgatatttaggaaccctgcgtttttctatcttatcctgtgtgataatcttttcatgttttctagagcaaagacaaagcagttactcttctatcgcaatacccaggtttgactaggaagagcagtatttttatggagcatttacaaagttatatttttaaaaaaaaaaatcaaaaacatgtgggatgagtgtagagggaggagcgtgggtgtggccagggctttgtctgtgtgacaggtggcgtccccaagccatgtgatctctgaggaggtggctcctgtctggtgctttctcttgatgacccagaagaaaccctagcaccggcgggccacttgctgtggctgctcccagcagatgtaggacagcccagacagaatggagtccttctgccctgccctgtcaccttccagagccaaccgcatccctcctcaggcagggacttcccttaccagtggtagagccctcaagggccagagagacctgcttggtggcaggtcaggcaagaaaacatttgtcagcatcttattctgttcatggcataaattgctgtcttttcaaaagagttttaaataaagtgtttccaagcacccacgcgagccttggtcctgggttttactgcaccagtgt

SEQ ID NO: 34372 - DNA, 1194 bp, Mus musculus
aacctaggccctggcgcgtgagcctggcgcttcctccgccagctcgggccgggaagcgcgaccctgactcccccaagcccgccatggtgcgagaattctgccacatatgttcttgttctctcaaagccgggagcagaaatgtgtgaagtgcgcagaaggcctgccggtggtggtgatacgagcgggagatgccttctgcaggtgagatctgggcagccgtccccaccccaccccacccccacccccgcacgccccttttccaggcttgcttgttttcttgtaaaggcgcggtaacttgtaagtgcttagccctaaccgtaaatagtggtgggaaccactggtgacgacccttgtcatctaaactaggcacacccgtcaattcaacacttcagagtccatgacaggagaattacctccgatctgaggccagcttgggctgcagagatgaccctgtcaaacaaaatcccacagtctcctgcgcaggtgcagccagcctccctttgcttctgtgttacagggtttgtttcaaggcattctacgttcacaaattcagagccatgcttgggaagaaccgggtcatctttcctggggagaaggtacgatgtgtggtgcctgggcgctcggctgtcagccctgctgtcttccgtttatgttcgtttcttcagctggcctactgtccctggacattgagggtagacttggtgtctggggctgtccaagaagtggacaagacatgctcatattgcggatgcatgcctccgtgctgatgctgcccttcccacccccaggtgctcctgtcctggtctgggggcccttcgtccagctccatggtctggcaagtgcttgaggtacatctacaccatcttctgggcgtaagcttctggattgaattagcaggggcctccttcctcagcctatactatggaagtttttggttaacactagacagtaccccaccccaccccaactgggacacctttaggatgtcccatatatattcagcaggtgtgcagtccagacacatgccctacacagggtcccaggctacatccctattgagctttatttgttaggacacagtttcaaagattggccaatcatgacaaagagcagagagaagcatttgccaaaaacaacgggagaagcagcataggtagaagggagtggggcagatggaacgggactcaagctaag

SEQ ID NO: 34373 - DNA, 1186 bp, Mus musculus
catcttcagtgacaaggtcagcccacctagcctgggcttcctggccggctacgggtgagtactgcagagggatctccgagagccccaagggttctgagtggtcccggctcacatgcccgcctctcccgacaggattgtggggctgtacgtctccatcgtgctggtggttggcaagtttgtgcggggcttcttcagcgagatctctcactccatcatgttcgaggaactgccgtgtgtggaccgcatcctcaagctgtgccaggacatcttcttggtgcgcgagacccgggagctggagctggaggaggagctatacgccaagctcatcttcctgtaccgatctccagagaccatgattaagtggacacgtgagagggagtaggagcccaggccctgggcaccgggaatgaaggagctgcctcagggcagcatgaccaccagggctggcagagctccttgggttggagtgtagctgcccaaggcacgagctgtgacaggtcctggcctacgtaagccctgatgatgctgctgtcaaagggacgctgtgtccctacccattgcgtccctgccagttggtctgggggcctggctctcccttcccacaagtactgtagggttttctaagtaaaacatttttatttatacaaacggactgtcacagaccaatccttttgtcctcgccttcctgcttcatggctccgcacgactcagctgtcttcctcctcatctgtaatcagatactcctggatttcctcagagaccgagcccctgtgggagagtgcagtgagaactaggccaggggtgtccccagcctccccaaagcataggcgttacctctggctgcggagctgagcctcagcaaggacgtagggtggcaatgggtccaaggagggctacaagagatggagtgtgagaagccacgggaccgtggggatagcttacagggacagatggacagccactcaccaggtccttcatgttcactcggcagctataacataactgctctgtgatgcaggcccgtgcatcccccctgtggaagcagaagtagatttatgtgcctggtctcactctgaactgtttaaggacactgccccctccacccctgctcacggggcaggacacaggcagggtctcacctcttgccaacttccctatggcagctctgggcctgaccctcccctgc

SEQ ID NO: 34374 - DNA, 1204 bp, Mus musculus
cacagacattgcatcctcgctgtcagatgaccaggtgccacaggccttcctgttcatgctgctggtccagtttggcaccatggtcatcgaccgtgccctctacctgcgcaagactgtcctgggaaagctggcctttcaggtggtcctggtggtggcgattcacatctggatgttctttatcttaccggctgtcactgagaggtgggtggtgtgaggctctgcacgttggggcctcagtctgtcctgaggtactgtactctctgggtgtggcacagctccggttggcctcctgaaccgtttgtcatgtctccctgacaccctgtcctgtcccattcaggatgttcagccagaatgcggtggcacagctgtggtacttcgtcaagtgcatttactttgccctgtccgcctaccagatccgctgtggctaccccacccgtatcttgggcaacttcctcaccaagaaatacaaccatctaaacctcttccttttccaggggtgagtgtggtctgcctagggatcgtcaggagcagtcagaagccattgcaggctggccctgctgatgcaaccctggccttggcaggttccgtctagtgccgttcctggtggagctgcgggccgtcatggactgggtgtggaccgacaccacgctgtccctgtccaactggatgtgtgtggaagacatctatgccaacatctttatcatcaagtgcagccgagagacagagaaggtgccagggcagagaggacggatgggtacttgttgggaattcacaatctgcatgcacagcagctcaaagaagggagctttctagaactcttgtggacagcggacttgccttgtgcgccactgggtttgtgtggtagggactattagctgtttgttaccagaattgtttcgtggtttagcatactcacagacaggtgttcatcactgcagccagctttaggccatcacctaatgtcctaatgcccacagaggacatttaggacatgtcctctttattgctccccatctcctctccacccttggtgatctgtagtctccttgacgtgagtttgcctgtttacacagaaccatttcataccaggcttcctcgcctcagcggtgatcctccacctagcaatgctcccaagatccttccttgtagcaggtcaatactcctgcttagagccacataagcgatcctgtgcagtgcaggaccc

SEQ ID NO: 34375 - DNA, 1156 bp, Mus musculus
tctgttacttcatcatcatccttaaccacatggtgacagcctcggctgcctccctggtgctgcccgtgcttgtgttcctgtgggccatgctgaccatcccgaggcctagcaagcgcttttggatgacagctatcgtcttcactgaggtgggtagcagcttgtagggtaggggctgggccacatggcccatggctgagtgccctgtcctgcaggtcatggtggtcaccaaatacctgttccagttcggcttcttcccctggaacagctacgttgtgctgcggcgctatgagaacaagccctacttccctccgcgaatcctgggccttgagaaaacggacagctacatcaagtatgacctggtgcagctcatggccctcttcttccaccgctcgcagctactggtgagcctgccagccagtgcaggggtggcagggctggcttggcaactccgggcattcctgagcccaatcgcctgcctctggtctaagcatgacctgacctgggtcaggctcctcaccaacccgtatcctccatagtgttatggcctctgggaccatgaggaggatcgctatcccaaggaccattgcaggagtagtgtgaaggaccgggaggccaaggaagagccagaagctaagctggaatcgcagtctgagacaggcactgggcatcccaaggagccagtgttggccggtactcccagggaccacatccaagggaaaggaagtattagatccaaggatgttatccaagatcccccagaggaccttaagccccggcacacgaggcacatcagcatacgcttcaggaggcgcaaggagactccaggacccaaaggaacagcagtcatgggtgagagcccagactagacccctgccatgttcctgggagggaaggagacacagatgacccctcagttggagatggccagcctagtacagggataacgcacttgggagcacaccattgctcagtgctcttcctgtatccatccttggagctgtccctatgcctgggatgagtatctatgggctgaagtcttggggccaccccgagagaggatacagtagcagttgctcctcaatagtgtctgccgggagtttcctgtgctgtccatgaagtggggtgaggtcagcctatcagggtggacacccagtcc

SEQ ID NO: 34376 - DNA, 1202 bp, Mus musculus
gctctgccccctccatcctgagccccgccccctccatcctgagctctgccccctccatcctgagctctgccccctccatcctgagctctgcccactccatcctgagctccgccccctccatcctgagctctgcccctctccatcctgagctccggcccctccatactgagctccggcccctccaccctgaactccacccctccatcctgagctccacccccttttactgtgtcctccccccttttactcccccctccttctaaaccccactaagtttccctttccttcctaagcctcaccccttatcacttctgtctatctcttcgccaaggcctatcccccctcactgaaccccacctccacaggtacggccagcaagtggggcctggtggctgaccggctgctggacctagcggccagcttctcggctgtcctcacccgaatccaggtgttcgttcggcgcttgctagaacttcacgtcttcaagctggtggccctctacactgtctgggtggccctgaaagaagtgagtgtcccaacctgggctgtttcctcctctgaagcagggtctctcctgccctggctttgttggctgctctagagccaggcctgctcggttacggcagtcgtcctggagtctagtcccgatgctgcctggtctgcccactgccatctgtgctccacaggtgtctgtgatgaacctgctgctggtggtgctatgggccttcgccttgccctatccgcgcttccggcccatggcttcctgcctgtccaccgtgtggacctgtatcatcattgtatgcaagatgctctatcagctcaagattgtcaacccgcatgagtactccagcaactgcactgaggtacaggcctggaggcgtccctagggcccggggaccacctgagaagttgtcccagtgattcctcatggaatgtggacggggacagtgactcctgcagtaagaatagaggggccctcaggacagctgtgcctagattcacctggcttcattctttctatttgggccttgacctgtccccttccccatcaaggtggccctgtgaacctccggtaggacagctgttgtctaccctggacccaacctgctgcttcagctgtgagatgggcttaagatagcacctacaggggctagagagatggctcaatggttaagagcagtgactgctcttccagaggtcct

SEQ ID NO: 34377 - DNA, 1094 bp, Mus musculus
tccttctgcgtcagttcgtgaaggagaagctgctgaagaagcaaaaggtgcctgcggcgcttttggaggtcacggtggccgacactggtgagtggcatgcgggagggtggaacctccacctgcactgtcccctctctgtctaggctgtcacttcaccttctgtcccactctgcagagcccacacagacccagacgctgctgcggagcctgggggagctggtcaccggcatctacgtcaaatactggatctatgtgtgcgccggcatgttcattgtggtcagcttcgccggccgcctggtggtctacaaaatcgtctacatgttcctcttcctgctgtgcctcaccttgttccaggtgacctagggaatgggcaggtagggctcgtgggtggggctctgtccctcacctgccctgctcaccagccaccccacccccatccttctgcaggtctactacaccctgtggaggaagctgctgcgtgtcttctggtggctcgtggtggcctatacaatgctcgtgctcatcgctgtgtacaccttccagttccaggacttccccacctattggcgcaacctcacgggcttcacggacgagcagtgagtagggtaccttaggggcagtaccgctgagcgctcttcagggggcggtagaggcaccttcctcgtcccgtcccatgctcagactctccgatctggttcaggagggctactggggcagggcagagtaaagggctgatggtgctcgctctcttctgccaggttgggcgacctgggcctggagcagttcagtgtgtcggagctcttttccagtatcctcatccctggcttcttcctgctggcctgcatcctgcagctgcactacttccacagaccgttcatgcagctcactgacctggagcacgtgccgccaccaggcacccgccaccctcgatgggctcacaggtgttctgccttcgagggccacgggtgttttttggtctgtgggaactggggttgacgctgggggctgtgtcatagagttagccgaccgtcctgcgcttgggcgggagccgtgaggcagccttaagccatgtagacttggcctagagtttacag

SEQ ID NO: 34378 - DNA, 1095 bp, Mus musculus
tggaccagagctatgtgtgtgccctgattgccatgatggtaaggaacagcccctcccccaagccccccccctcccagggaggagcagtccctcccctcctccccactccctggccactgcagtcttctcatagaatgcagggaggtggggtgtagttcatctcaaaacctgaggtccagttaccagtaacagtgctggaactgcccatgtaagtcaccaacatcccgtaactgtgcagtgggtgtgtgtacatgttgtgtgtgggctacctcatgggaggccttactgttgggggctgaagctctggccgagtgtcccatgcagtccctgctgaccgaccctggctgtgcctgcaggtgtggagcatcatgtaccacagctggctgaccttcgtcctgctgctctgggcctgcctcatctggacggtgcgtagccgccaccagctggctatgctctgctcgccctgcatcctgctgtatgggctgacgctctgctgcctgaggtacgtgtgggccatggaacttcctgagctgcccaccaccctgggccctgtcagcctgcaccagttgggactggaacacacacgctacccttgcctggacctcggtgccatggtgagtatcactggccgtatctgggtagcggtaggatttctccctgggaacccagtgctctgctcgttggccattggtttggttgggtagagattgaaggagagtgtatctgaagtcaacagtgggttcctgcgagtccaccctagaatataggcgttgtgaccgagtatgtggcatgctgccgcaatgtccttgatgctgtgagtgtctgtgtgtattctgactgcccgacagggctccactgtgtggcactgaatgtctgtgactcaaatctggtccatttgactcttgggtcacccaagtatctctgcatgaggcaggtgtggtgttgcctgcccactgtaacctggtggattttaatacatctcaagtgagactatatgtgtactagtgtatctatctgtatgcatctgtatgcatgtgagtgtaaacttgtgtttaccaagtctgggcaaagtatgtaagatcgggggcctggggc

SEQ ID NO: 34379 - DNA, 1016 bp, Mus musculus
atggtggctcacaaccatctgtaatgagatctaatgccctcttctgtatctgaagacagtgacagtggactcacatacataacataaataaataaatctttttaaaaacccaaaaaattctttccctctatcccaaaaaggcctctccccgggaacctaacaaaactgacacaggatcttcagggacagatttgggacctgggtggctatcttgtcttttagggcatcctgtccaagatggtgcaaaatgatatattccagaatagctggggcatcctatgcctggcctggcagagttttgtgttttagagtagcatggggctgtggggttgcccactcagtgagaagggagagaaaggctggtttcaggctgtgggcaacatcagagaggcagctgtgggacaggcctcatctcttacttcagctaagcagatgaggctggagtggcctcggtggtgatgaccctgacgtcacttccccatgacttcagcaggatgatgacgatgacgatgatgacgacgatgaagacatagatgctgccccagccgtggggctgaagggagcccctgccctggcaaccaaacgcaggctgtggctggcctcccgcttccgggtcacggcccactggctgctgatgacctctggacggacgctggtcattgtgttgctggccctggcaggtaccccggggcaggggctggagtcttgactctgactggcatggcagtggcggcggtggcggtggcggcggggtgactcagcttcccgatgggtcaggccaggagtgacgcagagtgcctgtgcccaccccatcccctgtaggcatagcccacccttcggccttctccagcgtctacctggtggtgttcctggccatctgcacctggtggtcctgtcactttcctctcagccccctgggctttaacaccctctgtgtcatggtgagctgttttggtgccggccatctcatttgcctatactgctatcagacaccatttatccaggacatgttaccc

SEQ ID NO: 34380 - DNA, 1147 bp, Mus musculus
actgctagaaccttctggcatgggacctctggggaggataataaaaaggagtgggtgtcaccaaggaagctagcccttgggggccaaggtcagttctgaggctattccacacatttggactgtgcccaggaaactacataggacagacatactggcagtggtagcccccagaagagaggatcagtgtgatcctttggggctgtccttgtggaagagacctgtggctctgaggttttcaatgatggtggcctcagcagccttgtggcttgaattgacagttctgctacagtgggttgattgcccacaggcaaagagctaaaggctaactccagtctctgtataggtctcagagggcagatgcaaggaccagagccctgtgtcacctctgtctgtctgcagccaagggcttccctgctgggtgggctagctggggcagttggaggctgagcatggccatgggacatgtacagcatggccctgtgtgacctgggtcccatagtttgatggctaactcctggccggtgtctttcccatgagtgatcagtggaacaagatctttgggggctgctactcagtggggcctgaggttggggatctatcctgtttgctgtcctgggactcactctgtagaacaggctggcctcaaacttagaaatccatctgcctctgcctctgcctctgcctctgcctctgccttccaagtgctgggattaaaggcatgctccaccattgcctagcggcttctttcccgtaacactctaaatggaggcagccagccggcaattcacttttttggaggcatttggccccatcgcccaggccccttctctgggataccaccctcctcgtgacttcatttccagcctccacgcaggggcaggtgagcatcactgtagtcaataatggtttcttgtttttctgtttgcttcttcttgttcccaagacctagcagtgatatccctctatgctaactaagttagaaaattcaattgtgtctcgtctgttcagggcttggacagtgttggtctttggggagcagggagcaaggccaatgtagtatctgggccagagttgcttcctaaacttccctaaacagtgtctggcagtcccttccccattctgggctgacattcttatttagaaacca

SEQ ID NO: 34381 - DNA, 1205 bp, Mus musculus
cactttttggagttcatcagttggcttgattgaccagcaggctctgttgctgtttctacagaatgctacctaccacacacagcgtttcatacctgcaccaatcactgtacgtaatctaagtgtgtgtatgtgtatgaacacaggtccgtgcgtgtcacagcatgctcgtggaagtcaaagggcaagcttgggtgttggccctcatcttctaccttatttggcacagggtttctctgttaatccctgctgcttttgccaaccacctggcctgaccgcttctagccagtctctcctctctccctcccatctcctggtagaggtgcgctgggattacaactggcttttgcacaattctgggaatccaaactcgggtcaccaggcttctgtggcaagccaccaagacgcgtccttagcctggctttccatcttttcacgtgggttctggtgatctcagccgaggtccacgtgttcatgcggcacatgctcttggctcccgacacgggcttttgatcactgcccctcacgtgcttggttcagtgctggccattcccggtatgtgaggtcgaaccagtgtcctcagaggcaggacctgtcacatcagggatgttagataggagaaagctctcaggggcctgtggatgaagggactggtgggtagtcagctgggtagacaggtgggcaggatcgacaagccagtggaaagctgggtagacatctacctgaccggaagcagcgagtgtgagggagggtgcagcctctgtgagactaggctggacgtggccctggttgggctgagaaatagagccctggaaagcagagggatttcagaaagctttgcctccacaaatgcacttcccccctgcctcttgggccaaagaagatcgatttttttttttaatgtatcattgttgaaaacttcagatttgatttaggagagctgagccttgcatggtagccaatgtatgtcaggaagaagacagcaccctgactccagagaggcccttgggagccaagagaagtgcagtcgtggtcaacaccctgccctccccactaccaccaccctctccacccctgctgccaggctccttgaagcagcaggtgcccttggaagttgggctacatctcatgtccactgtgatcctggaagaagactgtgtcaggcaggggctgtgaagagggtacaagctgaattcagaagaagtcac

SEQ ID NO: 34382 - DNA, 1189 bp, Mus musculus
ggggagaggtaacatgtggtcagggaagtggacaggactgaccctggtggaggctctgcgagcggctcaccagacttgctccaggctctggagagctcacggtgtattaagggaagaactcccagtccgaggctaaatttgtcagtggtacacagtatacagggccaggaccagccccttcttcagcttcctgctgagggcgaagaccctctgagctccaagtggtctgtgaggagggtgtcaccttcaggagggacagttctgcgggccaactccctcccaaatgggatagggactattttctgcacccatgtacttcccagggccctgcccatgtgctacccggcctgtttacctgtgacagccagtagagatggctgcagataggtctggcttcctccctccagggaggagtgggtggggatggctgatacggaatggggcccaccctgtaccctgagttctctcctcttttgttgatagttgtcgcctgtgggtaggtcagctttgggtggcttcagtctcatacctccaagcgactcgcatagagtacagactgtgcctctgtgtgataggcattgtgggttgtttagggggggagactgtgagcagggtccccagttagttagctgactgactaactgggaccaacgcagcatctgctgggaagaggacctgtcacggtcggattgagtttctcctcgtgtcttctctgtctctggtctctgggctgtcctgagaagtttggggtgggaggcaagcatccctctgccagcttgtctctggtgccagcagtagctgtatcatccatccttgatctctttgcctgatgcagccctggttgagagccagggctcagcaccaagccatttcctgctggtcttctgggcattcactgccttcagcacctctgacctgctctgctaggagtggatactgtggagttgctccaagttagggagaagccgagagccgaggaaccacagtgccttgcgggccatgtccagctcgctgggcagtgggcatccctccctcccacctcctccgggcgtccatattcagccttacctcctgtttgttacctgtataacctacctcatctcagcctgtcccctcttgctctgcgacttcctcaaagtatgacaaggtcactgtgggctgagggaaacataaaagttgactagctgtt

SEQ ID NO: 34383 - DNA, 1146 bp, Mus musculus
tggggccacaaggttaaggcgaggacagacctttgggaggcgctgtggggtctgagtgggtggatggcctaaaccgtacctcagtctcctccctaccactatgcccttgtccctcacttgaaaaggacattgtcaactcctcctgcacgtggcttgttctaagtactgtgaacccctgtgcctgtctgtgactgtctgcctctccaagctgagggtgcagagctagtgtgtggagcaggtttctcatctctttctgatgctgccctcaggtagcattagatctgtggggactttgcaaatgggtagttttggggttctgggtcacagtgtcctctcctaccctgtggtctggtggtggtggtggtggggtcaaaccgtgtggtttgatagtctaatgggaatgcctctctttgacagtgtcgagaaagctcctgcctaccagcgcttccatgctctggctcagcctggtctcccaggccttgtcctaccctacaagtatcaggtgctagttgagatgttccgcagcatggacaccattgtgagcatgctccacaatcgctctgagactgtgacctttgccaaagtcaagcaaggtgttcaggagatgatgcgcaagtgagtggtgtgggggaggggacctagctgcccccagtgtctgtccggtgcccgcctgcctggtccctctcattctgccctctctcccataggcgctttgaagagcgcaatgtgggccagatcaaaaccgtgtatcccacgtcgtatcgcttccgccaggagtgcaatgtccccaccttcaaggacagcatcaagagatctgattaccagctcaccatcgagcccttgctgggccagggtgagtctttggcgaggccctgggccttctcgatcctcttggacttgcggctgggcagttggacgggttggggctcaccacaggtggtctttggcttacagaggctggcggtgccacccagctcacagccacgtgcctcctgcagcgccggcaagtcttccggcagaacctggtggaacgtgtcaaggaacagcacaaggtgagggcctgggtttctggaggctcaagcaggctcagtccctgctccgagtggacagtggccttaatcactctgctctctatgtagctgcttt

SEQ ID NO: 34384 - DNA, 2913 bp, Mus musculus
ctcttacagggacgacatttaattggggttggctcgcaggttcagaggttcagtccattatcatcgaggtgggagcatggcagcatccaggcaggcatgatgcaggaggagctgagagttctacatcttcatctgaaggccactagcagaatactggttgccaggcagctaggataaaggtcttaaagcccacgtccatagtgacaaacctaccccaacaaggccactccctgggccgagcatcacagtcccttgctatagttttctttaaatgtaagaagggctgatacctaccctataggctggagctggggcagagctgcctggaaccccaaaactggggagttcaggattacgtcaagatcccgagaggacgtttgtattctttagtcaaccatggccatgtgctagaaacatgcctctcttcatattatccctggtcgtgtctaggcacagaacagctaagttggtgttctggttggaaatactgaaatgagtatttcaaccttctttcctccaggtcttcctggcttcactgaacccccccatggcggtgccggacgaccagctgacccgctggcatccgcgcttcaatgtggacgaggtgcctgacattgagccagctgaactgccccagcctcctgtcacagagaagctcaccactgcccaggaagtgctggcccgtgcccggagcttgatgacacccaaggtgaggctctctgacttgtaacttcattcctttctcctcagggagtatggctgcctggccctggagggcggaggtaacagctgagtgccttcaggttaccagatacttcctcagctgagggcacaaagaaggtgtgctttgtacgcacacgtgcggctcatcgggctgtgtgtatatgctctggtggggctatgcaaagagcagccttcacgaggttggggattttatgaatcttttgtgacctctgacctgtgcctaccctgcagatggagaaggccctgagcaacctggccctgcgctcggctgagcccggtagccctgggacctctactccaccactcccggccactccgccagccaccccacctgctgcctctccgagcgccctgaagggtgtgtcccaagcactgctagagcgggtgagtcctgggtctcgggtagggtggacttggtgacaggagtgggctttccttgttgaccattggctgctgacccatccccatgcagataagggccaaggaggtccagaagcagctggcaaggatgacacggtgccccgagcaggagcttcgcctgcagcggttagagcgtctgccagagctggcccgcgtgctgcgcaatgtcttcgtgtctgagcggaagccggcactcactatggaggtggtctgtgcaaggatggtggacagttgccaaactgctctgagtccaggtttgtgcaaagcaaaacaagggtgagagggtgggcatggtcatgctcactgtgttcttggcaaggagctaggtctatttctgaccagggacagtttgtctgccatggtcttggggacccccaattctgccacttataggcctgctcaccaggctcggagcacgggtgtctttgcctctttgctgttcgttctcctggtgcttgagcacggtgtcccccatggctcttggctctgcttggatccactgtacatagcagtggataagccttgacaaaggcctattaatgggatgtcgggcacctgggtgcgtgagagcaaaccatctaggcttacacccacaatccacctgtgcaggggagatggagaaacatctggtgctcctggcagagttgctgccggactggctcagcctgcatcgcatccgcacggatacctacgtcaagctggacaaggctgttgacctggctggcctcactgcgaggctggcccaccacgtccacgccgaggggctgtgactttgagctccttgcctgtttctttcatcagtacacgacgcacttacgcctttaagcctcgccagtgtgggcagctatcgttgcccatggatctcataaagtgctggcattaagttgcttcctgaggctttggggcatcccagactcagctctaggggaagtagactctgaagagtagggtatgttggatggccattgcacaaactactcaagcattaggtatggtcaagacccaagatcaaggtccaggtggaagcctaggctggcatagccttgcttccccatgagacttaagaatcacacagaccttggactttcctgatttcacgggacgctgctctgagagtgaaattgggccttctgtaaatatgtgaagtgtggtttcttttcaaaccttatatggccctgcatgtgactgctagttttggcttttaataaagtcatgtaagatttaaataaaatactactgagatgaagctgaacctgtcaccgtaaaatctctttaaatgctgttgtgtgatgtggggcaatgggctatggacagacatcctggtcctggtgggtggtaattttcacatggacatggacagaaggcgttccatcatgtctcctggacccctggctcctgtcgaagttacagcccccacaggagaggcatgtggcttttagtcatgtagccaatgtcacaagcttctggcattctggctagactccttcccacagttacctagcaacagcaagatggcaaagcccactataaggggctgtttggcccctcctcgctctcttaagctctctggcttttttttctctttcccttcccccctctctccacgtggccatggcctgtccttctaccttctctttctccttgcctttctacaataaagctctaaaaccatagactgtctctgatcatgaaggcccaccgtgtttgaatgatgatcggataggctttctcctaatgagccacttttaa

SEQ ID NO: 34385 - DNA, 1606 bp, Mus musculus
ccctgagctgttcagaaggcaggtaggatccccaaggctgagatgatgagttgatggctacccagtagccatcaacgttcttctagccgtagtcagcaagacctagtgttcctagcaagtgttgacctcgcccatacttggcctctagattcccatgcccctcagctccatcccacaaccttccctccttaccctaacaggtctagactccaggggcttcctgtttggcccttccctagctcaggagctgggcgtgggctgtgtgctcatccggaaacaggggaagctgccgggccccactgtgtcagcctcctattctctggagtatgggaaggtaagcgagctgtgtgtagaggaagggcagggtcttatcacggctaccagtgtctaggagtaaatgtgggtgctcagagaggttgagacattgggtcaggtttacaccacccagaaacgctcgaggctagggaggtggccacttgttcgcgcctagactctgtcttacactacttcctgtctgcaggctgagctggaaatccagaaagatgccttggaacccgggcagagagtggtcattgtggatgacctcctggccacaggaggtaaagaaccaacccaagacaaacagacttcaaagggccagaccctgtcctgggtgctgactaagcaaagagcttgaacacctcctctttctctgtcccttccccccaggaaccatgtttgcggcctgtgacctgctgcaccagctccgggctgaagtggtggagtgtgtgagcctggtggagctgacctcgctgaagggcagggagaggctaggacctataccattcttctctctcctccagtatgactgaggagctggctagatggtcacacccctgctcccagcagcaccaggaactgcttggtggctcagcccaggcgcctaagtgacctttgtgagctaccggccgcccttttgtgagtgttatcactcattcctttggtcagctgatccgccgtgcctgtggacccctggatccttgtactttgtacacgtgccacacaccctggagcatagcagagctgtgctactggagatcaataaaccgttttgatatgcatgctgcttctcctcagtttgttgcatgggtcacattccagggcctccagagtgacactacagggacaagggggctcaggtgggaacccataggctcagctttgtattgaagccacaacccctactagggaagcagatgttatctctgtcagtctctgaggcagctgactacataaacaggtttattgcttcactgttctaggctgttattccattaggatggacgaggatgaaagcagtgacccacagccactatatttttttctgttgtttgtcgagatggggtttcttaatataaccagccctggctattctggacttgatttgtagcccaggctggcctcaaacttaagaggtccactgcctctgcttcttgagtgctgggatcaaaagtacgcaccgcaacacccagttcacagtcactatctcaaaaaagctattttgttgcagggcatggtgtatagacctttaatcctagtgccttgaaggtaggcaggctgcttaaaa

SEQ ID NO: 34386 - DNA, 1227 bp, Mus musculus
ctgcaagtgcctgggagaccttgtccttcggactgatgaatggaagagaccagctgccctctgcccacccatccctgcatggacggcccctgcaaccaggtgcaaggctccaagactgctcatcctggagccctgaccctgtagtccgctctcgagcaccacagcccatcttgccaactggctcctgaaaaggaagccggggccttgatcaccgtaggtacgtcaacccagggtctgaagcactgtcactgtccctgcatacatttcaacctaggtgccgtacacaaaagtgaagatttcagcgaaatgccaaggaagtgccatctatctggcttctcccccaggccaaccctctgagccaccctacctctttcgcactggctacaaacaaaagacaaagacagcaccttttccagtcaaggtggcatctgcactgccccatggagatgggaagatgacagcctaagtttctggccctggctcagggcagtatggggccacttctgtaacctgccacctctcatatgctccacataatctccaagaccctttctctgaaggctcatggacaagttttcacatctgtgcagtaactgcagagccaaggttgagctgtaacggttgggaaatgatggtgaagagactgagaggaagaataaaggaacaggagggggttagctctggtagccccaagtctatttttgggttggtttgagacagggtttctcagtgaggtgctggctctcctagaactcactctgtaggacaggctggccttgaactcagagatctgcctgcctctcttgggagtgctgggattaaaggcgtgcgccatcatgagaccacctatcctggtcttttgtttgtttgtttgtttttatttttttcaaggcagggtttctctgtgtagtcctggctgtcctggaacttactttgtagaccaggctggccttgaactcagagatccacctgcctctgcctcccaagtgctgggattaaaggcgtgcgccaccaccgcccggcatatcctggtctttaaaatcgagattatgatgggagactgtgtgttagatctccacgtacctgttgcatgagctttccctggggattcagaaacagatgccccagatacgattccagtgagagcctaaagtaaccatcgtgtccaatgagttcactgcctacaagaacatgaatgacccccagagcagctgcatcaaccaaacg

SEQ ID NO: 34387 - DNA, 1195 bp, Mus musculus
agctgcctttggaggtagcatattgtgtgggtccagtcccttctgtactgctatcatgatctccctctccagcccggcagcctgctcctcatcagtagggacaccacctccagaagccatggagcgggtcatggccacgccacggggaccgtgggccctcagggcctgcgccgccaaagcgcccactccgcgaagtaaccttgaagccatctcgcccgagacaagcagatgcatttccgggccctaagcctgatcttatggtagcattttctcagttgagattccctcctctcagatggctttagcttacatgtagttgacataaaaccatccagcacagacagccaatatcctagagacacctgctttctgggtgcccatgactgcttccagtccctgtgacccagaagtgcttttggaattccctcaagggatctgaggtttatagtgaatagaaccttagcgttgtcacacactccatatgctcccctcggggtgttctttgggggtacccattgttggcttctcaagagtttgggtagtttaaaagtcagaagaaagaaattccctctcatgcgtgtgtggctccctctctggaccattgcaaggccacttaaggtctccttaaggcagggtccagaaaagcccatctctgcttctgccagactagcacccatccaagaggttgtatgccaaatcctaccagcaccggtgaatgtctggaaggctctctaggcagaactcatatccacatggcctgttgggtaccagatagtcccgatgttatcctgtttgcacaaggggtcagaaggtgtcgtgaggagcctgtggtgccaccaacagtgccatactctgcactcgagcaggtggagtggggcccacgagggttttcacagtttctagctacccagaacatgaagactgtaaaattaacgtctgaaacgtgtacaactcttgctattagcagaccttctccccactgtgggacaatgattccaaagagcccaggtcttaggtcctcatccctcaagggccagaattagatggctgaaagttggtctcttgccagagtccggtctaaagagcgtcatcctggagcctaagccagggctattccagccaagtcaggagactgtgtccatcacttccaccctcctaatcttaagttgagaggccaatagaggcctgaggtcta

SEQ ID NO: 34388 - DNA, 1233 bp, Mus musculus
gagataccgagtatgtgcagagtgcactgagctgctgtttgggggacacgtcctgttagattccttttaaccagtgttaaaataaggcctgaagacacaaaatgaatcctcaggagagaagtgttggacattggcctcatgcctggacgtgctgacctttatacgccccaccctgtaccctgttcctgctgtgcttggtggcaccaagactcagggccccaagtcagcagcagagtaaaacttcaacccagggcattgtccagaaccacagggacttcctgggcacatgcccaccaactgggtctgcctcagctttgcaggaggaagtgtaatgccagaggtttggagcagcccagtgtacagagtaaaccataggtgcctaaacacgaacccctcccactttcacattagccctttctgggatgcacccgtggtctgctttagtcagcccctgcacacatctgtcccctcatataaatcttctctgggtcatccagctggtggccagctctccctgaccaggcagcagtagtgaagaatccacgtggccgtggcaaggccacatggtcagcagtgactctggctgtgcaccagcagctgctaccatagcctcagtgaggctttggcttgcgggctggctgctcacacacacaggttgccactgtaacagagcacagtgatctcacagtaaccccatgtctcacatacaggagcaagcatagcccaaacccagctctaattcctacccttttccccattttcctacaggttctgtggggaccccattgccaggagtggaagtacgcatcatctcagaaaacccgcagaagggttccccctacatcatccatgcagagggaaacgagagggggacaaaggtgaggtcatcgtttgaaggtttcttcctcaccatgcaggggtggggcagccatggacaggagagatgctgagggatgtgacgggttgtgtgctagtgtgtctgagcctcgcccaagaggctcttccattccttcccagagcagcccaggcctccccatagctctgtccctggaggacattttgagggtccatatggttttactaaggagcatggggcagcacagcagcaatcctcacagactaggcctgtgggagcgttgagctgtcaggtaccggtgccatctgaaagcccgtgtgttgagccccttcatctgcaggaaagtgggtctcaacttcatatgtgacttttaactt

SEQ ID NO: 34389 - DNA, 1198 bp, Mus musculus
gcacgcatcaaggtatttgtccagatataccacacttttgcatgggcacacacatacatacagacaagctcatgaaccagacttgaagaggggcacagtagcagaactggtacactaaccagtcctgttttcctcaccttctgcattgtggtgtagcctgttccctcacctctccttctacaatgtcacctggcctgtcatgtatgggcccaacgtatgttaacacacatagacacaaacacataggatcatggcacacactactgccccagcccggaagagacaaagacaggtttcctgggcttgttgtcagacagcctagatgagtcacagagccccaggctagtgagagtctcaaaaaaacaaggtgggggctggagagatggctcagtggttaagagcactggctgctcttccagaggatccaggttcaattcccagcaccaacacggcagctcacaactgtctgtaactcctgtttcaggggatctgacatacattcagttaaaatactagtgtacataaaattttaaaaagttattacaaaaaaaaaaaaaaaacaaaaacccagggtggatggagctgaagagacggtggctgagcggtcaagagcacaggctgctcagcttctgtctagccctagctccaggggatctgatacccctggcctacagaggcacattattctatactcaccccaacacacacacacacacacacacagagaaagagaaagagagacagacagacagtatgctcaaatactaaaacaagtatataggtgggccttattttactgttggattgttcagttttaaaatctccatttgtagctgggcttggtgatacatgcctttaatcccagcactcgggaggcagaggcaggtggatttctgagttggaggccagcctggtctacaaagtgagttccaggacagccagggctctacagagaaaccctgtcttgaaaaaccaaaaccaaccaaacaaacaaaaatctccatttgtgtctttggtgtttttgagatggcttcaatcttctgactgcccacctcctccctctggcattgcaggtacacatcgccaggcctgatttctgggtctgcagcaagcacttgaccagctgggctacagtccctgccctgtttgtttgtttgtttgtttgtttttttttttttgaggcagggttttgcttctt

SEQ ID NO: 34390 - DNA, 1490 bp, Mus musculus
cacgcacgcacgcacgcacgcacgcacgcacaccccaggctcacagaacagttactccaatctgatggtcagaatgggggaggtccatctgctgggtgcaagtctagccctgtcctcacacagctgatacccagaggacctgggcttcatcaggggataaaccaggttctgggctaagaagcggggtggggtcctgtgggtgaagcctgaaggcagtggtggaagccagggcctggccgtccctctcaccttgtatgttccacagacatgtttgctgatgcggcagcaacatgaggctgcagccctcaatgccgtgcaaagaatggagtggcagctgaaggcccaggagctggaccccgctgggcacaagtccctgtgtgtaaatgaggtgccatccttctacgtgcccatggttgacgtcaacgatgacttcgtattgttgccagcatgacactcggaggaaggtcacaggacacaaacaagggccacataggtcgcccagtgctgccgatgagtcccggcagcggaggagggagcaccgcgtccatcaagtgggaggagcccagagactgcacctggccgtgtgtctcccctccagatgcagtgaggtagaaagcatctccttttaccagttgctgtgggagcacaaggcccagacactgcagagctttgccaggccttgggacaaggagaccgtggccacagacaaggtggctctgtgtcagccatgccctctgggttttcttccagctgatgacagggcacttgaggagtcgcagagcagagtgtttttaattcctcgttccattctgatcaactaatggaaaatagactaaggcgtccaccttcataagcagtgacctccaggtcagagaagcaggaaagtgctgtcccgccatggtccccgggacaggcttggacactggtgccggcaagggtccggctgctgcctgcctggacacagggacgcagccaggactcttcgatagtgtttttaatggagtcaaatccacgtggtttgtatatttccctctaatcttgggcattttgtttctctttctgagaaggtaacttgaaacactacagagccaataatcctatagagtgtatccgcaaacctgtacagttttatatacattcacaatgtacttttgctgccttctagataatttattttgcaacacattactgcacagttgtaaataacttatgtactgtaacatcactttcagttatgtgtaaagaaataaataaattaattaaaatgttctttgtacatggcactgtcccttcaggtagccggttctctcttgtgggggcgggatggtaactgacacacatacctaagtacacacatatctcttacagtaactgacacacatacctaagtacacacatatctcttacagtaactgacacacatacctaagtacagatactgggctgcagctgcacacttcattttggattccagatagagggacagggct

SEQ ID NO: 34391 - DNA, 1195 bp, Mus musculus
tctttgagcctcacagggagctacatgtgctgcccatccccgccgctgcatgctcctcctccgatgcatagtgatagagacaacaaaaatgatttacacagttcaacccacctctctgtgtctgccttggaagtctgactccatacggaccaccgcagacatgtcctctcctcattgtctctggtgtatttacttgccctgggagacacttccacagggccatagggatatgatgggaaggttcccctcattgctttaaccaatcatggttgtttagcctgcaccctcaccccaagacatccagccttggttcaggattctacatgcacatctccactgaatgcaccctgttcactcaagatccccacgctcccacagtgctcctttggcataggtgcgtacacctgacccagctgcttgtgcctttcctgccattatttacttgtagggttcacgtgcagctctgctctgtggtggttccaggtaaccgtcagactaacacaagtttctaggtgtggggttaacatgttcacagtttttaatatgtttatcatggcttaccccttttgccttatatttgcagattgcaccccctccctctctagctgagcccctgaaggagctgttcaagcaacaagaggctgtgcggggtaagctgcgcctgcagcacagcatcgagagggtaagtggagcctcgggtagggggcatgctggcaaggatcttaagcttacctgttcctctcctccttcaggagaagctgattgtgtcctgtgagcaagagattcttcgggttcattgccgggcagccaggaccattgccaaccaggcagtgccattcagtgcatgcacaatgctcttggactccgaggtctacaacatgcctctggaaagccaggtcagtgacccccaccagtacatctgctcccatgtatccaaactctgcccaccctgctcatgactgctgtggggacctagccccaatgtgcctcagaaggcacagtaatgtcacggacaaagccctcaagcctacagagtctctgagacaactgtgcatgcaagtaggatggatagcatcctccctcctctccctggctgcaggtctgatggcagccccatcgtgagctacaggtaaccagagctgctatgttagtgaccatgattggtcaataattgtagcaacaagacattagggcc

SEQ ID NO: 34392 - DNA, 2231 bp, Mus musculus
cattgagttgttctcctcagaaaagaaagacaggagtgatcctgaacgagagcctgccaagaggatagagaaggagttaaagccgtacggctcgagtgccatcagcatcttaaaggagaagaagaagagagaaaaacacagggagagatggagggaggagaaggagagacacagggacaagcatgtggacggcttcctgagacaccacaaggacgagccaaagcctgcagccaaagacaaggacaaccctcccaactccttcaaggagaagtccagggaggaaagcctgaaactcagcgagactaagctgaaggaaaagttcaaggagaacacagagcgagaaaagggcgactccataaagatgagcaacgggaacgacaaacttgtgccatccagagactccggcaagaaagacagcagaccccgggagaagctcctgggagatggcgacctcatgatgacaagttttgagaggatgctgtcccagaaagacctcgagattgaggagcggcacaagcgacacaaggagcgcatgaagcagatggagaagatgcggcatcggtctggagaccccaagctcaaagagaagaagcccacggaggacgggcgcaagaagagcctggactttccttccaagaaggctctggggctggacaaaaaggtcaaggagccggctcccacgctgaccacgggtgaaagcaagccacactctggaccgggtacagagtccaaagactggctgtctggacagcccctgaaggaggttctccctgcttcaccccgcactgagcagagccgacccactggggtgcccacgcccacctcagtagtgtcgtgccccagctacgaagaggtgatgcacacacccagaaccccgtcctgcagtgctgacgattaccccgacctggtgttcgactgcaccgactcccagcactcgatgcccgtctccaccgcgtccaccagcgcctgctcgccgcccttttttgacaggttttctgtggcttccagtgtggtctcagaaaacgcagcaggccagacacccaccaggcctatctccacaaacctttatcgctcgatatctgtggatatcagaaggacacccgaggaggagttcagtgctggggacaagctgttcaggcagcagagtgtccctgcgccctctagttttgactccccagtacagcacttgctggaagagaaagctcctctgccacccgttcctgcagaaaagtttgcctgcctgtcccctggctactactccccagactatggtatcccctcgcccaaggtggacacgttacactgtccaccaacagctgtggtcagtgccacaccacccccagacagcgtcttctccaatctaccaccaaagtcttccccttcccctagaggtgaactgctgagcccagccattgaagggaccctgcccccagatctaggcctacctctggatgccacagaggaccagcaggccacagctgccatcctcccccaggagcccagctatctggagcctctggatgagggtcccttcaccacagtcatcacggaggaacctgttgagtggacacacaccgctgctgagcagggcctgtcttcctcctcccttattgccagtgcctctgaaaaccctgtcagctggcctgttggctctgagcttatgctaaagtctccacagaggtttgcagaatccccaaaacatttttgccctggagaatccctccattccaccaccccaggaccctacagtgctgcagagcccacctaccctgtctctccaggatcttaccctttgccggcccctgagccagccctagaagaagtcaaagacggtgggacaggagcaatcccagtggccatctctgctgcagaaggggctgctccttatgctgctcctgctaggctggagtcgtttttcagcaactgcaagtcacacccagatgcacccctggacacagcccctgaacctacgggtgttactgctgtggctcaggtagaggctctgggacccctggagagcagcttcctagacagcaatcctagcatatctaccctcagccaggtggaaccagtctcatggcatgaagcctttaccagccctgaggatgacctcgacctggggcccttctcactgccagagcttcctctccaggccaaagatgcttcagatgttgaggcagaagccgcaaaggccagtcctgttcctccggcggagagccctccaggcccca

SEQ ID NO: 34393 - DNA, 1294 bp, Mus musculus
aaggccatccttttagagagtgacctctccactgagaataagctgaaggtattgaaacacgacagagagcaccttaagaaagaagataagctcggtaggatgaagccggaggataaggactggctctttaaggatgagaaggtgctgaagagaatcaaggatgccaacaaagacatgagcagagccttccgggaagacaaagaccgtgccagcaaagcagagagggagagggccacgaaggacaagtccccgaaggaagaaaagctcagactgtacaaagaggaaaggaagaaaaagtccaaagaccgagcttccagactcgaaaggaagaatgacatgaaagaggacaagctctccaaggagaaggagaaggccttcaaagaggacaaagagaaactcaaaaaggaaaagctgtacagggaggacgctgcctttgatgactattgtaacaaaagtcagtttctggaccatgaggacaccaagttcagcctctctgatgaccaacaagagaggtggttttctgacctgtctgattcctcttttgatttcaaaggagaggacagctgggactcagtaacagactatagagacatcaagaatgactcggtggccaaacttatcctggaaactgtcaaagaagacagtaaggaaaagaagcgcgacaacaaaatccgggagaagcgagattttaaagactctttcttccgaaagagagacagggactgtctagacaagaattctgagaaaaggagagaccaaacggaaaagcataaaagcatccctagctatctttctgagaaagacaagaaaaggcgagagtctgcagaagggggccgggacaggagggatgggcggattcggtctgaagaagtgcacagggaggacctaaaggagtgtgggttcgagagcagcttcaaggacaagtcagactgtgacttccccaagaacctggagccctgggaacggccccatgcagcgcgggaaaaggagaaaaaggatgccctggaaaaggaaaggaaggaaaagggcagggcagacaagtacaaagagaagtccagcgagagggagagaagtgacaagtccacccttgacaagtgtcagaaagacaaagaatttgaaaaatgctttaaagagaagaaagacggcaaggaaaagcataaagacatacacagcaaagacagaaaagcatcctttgaccaactgagagagaagaaggagaaggtgttctctagcatcatctcagaagacttctcagagagaaaggatgacaggaaggggaaggagaagagctggt

SEQ ID NO: 34394 - DNA, 2528 bp, Mus musculus
aggactcagtcaaactcaacttccctgctgcctagttcatgattgtttgattctgtctgatatagcacattagtttaaaacagttttcattttctgactgttaacctgtgcacaaattttctgcccaagtataattatttcaaaaagttttaaatctgcaaacttagcaggctagatgttcattatgcaaagcgccacaattgttttaaagggacgccgtctcagggtgtaaggtaacaattgcccagctggccgctccttagggagagcagcgcacatcctctgtgcttccccccagtttaggcagggtgaagctttcagggattacataacaaataccccaagtttctgtctgcaggctggactgcactgcacgaggcgtgtaaccggggctattacgacatcgccaagcaactgttagccgctggtgcagaggtgaacactaagggcctggatgatgacacacctttgcatgatgccgccaacaacgggcactacaaggttggcatctccctgcagccctccagtggctgctctctccttaacttctggactattctacagcttcatgtttctctgtcctagctagttttcacattttctgagactgggaagtgagctttgtgttgtcatcgttgctgtcccctgttgcctctcaccccacccaatcccttttcaagccttaagacctagctgttgcttctgccctaggccagtacccagataacctgagttttgataactcgcaaacagcactgcagtgactgtgtagtgctggctcttctgactgcatgagtggctactgagcccctgttctcgggtactgagcctgcccagaaggtcagagtctcggggagagaggcagcatagtcaagattagattactgtgctgggtaagacttcctctcttagggaaagggcttccggtagggaaggaaaccctaagatatgccagacatagctcttcttacaagagaatgggttgcagaagtggatttattagctacaaactgaagaacagtaagcttggtaagaatgggaacatctgcccaagttaatagtgcagcaagcaggtcctgcctggttgtgccagaacctacagctctcaagaacccagtggtgcacagcatacacacatatacatacatacatacatacattacatttttagatttaatatggagataatgacatgatggttcatttgcttgctggtttttaagagcccttttagaaaaatgttctgaaagggtctatgcaatgtctgagacttgtaaaagaataccatggaaggtgggtagtgataaaactgggagggaagagccactatctaagtcttcatacatccatgagttttcacgtttttctttaagtatgtaaaatgtcacaactataggaacacagtaagctgaagaacaacagtggcctctcaggagagatatatggtgtagtcctaaaggcagcttcctggatggaagaagtagacagataaaggagacagaaagagtaggctgggtagaaacatggcctgtatttctggccttaggagaaagtcacagaaggtactgaccgctaacgacagacatcaggaataggtctttggtcccagcactgcaggaaccaaattctgacaacagcccacacactgaaggaacgagccagctttatctgcgccgtgatgtaagccaagccagcgagactgattccctcgactctgaggcaggctgtggtgatttgttacagcagcagtagagtctcacatgcgctaaaaactcttcatggtgatgataccttgagctggaaacagtttgtgagtgacaagaggatgtgttaaagcttgaactgaagttgaggatagattgaaactggatgtttgcactggaatagagtgagttactgtttcaggcatatgctgataaatgactgaatagagctgttgaaatgtcaccttgaatgtttctgtcacccatgtaaccacctttatgcatgtaaaatcaagcaaggaaggagttctcttattttctaatgtaaatgaaaataaataaaccagcttacagaaatgtggtctttgttttctctatttcccacccccagcccctctgtgcccctctttgggagctgtgctgctgcccagctctctcttgggaaggggagctcgagagaagattggggaagagcaggagagacctggacgtgacctgcttgtcaaagggacccgccctgtgcagtccctcacaaaggcacagagccctgctagacacttatggctctacacgtagcccccgcaacaggggggcctcctacaggcatggcagggtaacacgatttctcaaacagtctgttaatatcaacgttaatgttttgtaggtggtgaagttgttgttacggtatggcggaaatcctcaacaaagcaacagaaaaggagagacaccgttgaaagtagccaattcgccaacgatggtgaacctcctgttaggcaaaggcacatacacttccagtgaggagagctctactggtaagccagccca

SEQ ID NO: 34395 - DNA, 1120 bp, Mus musculus
cagccagtgggcccatgttctgaatcagaacaaagctgcaactttcccagtcttggtgggcaggggggttgtggttgttcggggccttaacccttggacagtatgatttgcacctttaactctgccagcactctatgcgagttatgttgtggagtttgattctgacttgtagggagagttcagtgctcctcatcaacagtgccgtcctcgtggtgggaggctaaggcagagagcaaccctagctaaaggaggagcagtcacagtcaagccttttagtcctagaagcatatatgtcctagaacaggaggggctgttgatcgccccagtaaaatgtttgctttctttggcacatgaagccaaagtcgtgacttgaggatttaacccggaaacaataactgaaagcattgctctctctctcttgtaggataaagataaagtttctctaaccaagactcccaagctggaccgcagtgatggcgggaaggaggtgagagaacgagccaccaagcggaagctgcccttcaccgtgggggccaatggagagcagaaggactcggacacaggtaccagactgggtttaacactgtatccctggaggagtcttgccatagctattgcaccagtctgtacagtgcagcccagagtaataacagtaagggcaagagacagcaggcctctaggtgatggctccccacagctcccaaggcacatggatttgtggcagaacccagggagaacctgaaatcgaggcagctggtgtagtcttcctaagaatggataggtctaagaatgcagaacaggagcatatacgggttggggttagcacctttcattgtgtacgttcccagtcggattctgtcttgctcaaggagaaccctggggtctgctactggcttgcatatccttctgaatttgatgatgcaggcaggactccactctactggtcttttctcctccccccttttttaaggcctctggggcagtagaacacaaatggcagaggaagcctggggtgaagcattgggtttcatgtctgtcatctcctagcactgaggacgttgagatgaggctgctgatgtctcggggtgggaggtttataaaggcttgcatggatgtcgca

SEQ ID NO: 34396 - DNA, 1189 bp, Mus musculus
cgaggttcccactgtatacatctataaaccaggttggtgtgttgcacttaacagagatctgtcttctgggattaaaggagagtactgctgcctctctgcattgttttctgcaccagccataccagtttatatttctactagcaacttaaaagggctctctcagtgcaaacatcccagagccagtaaggatacactcaagacagttataacctgttttttttgttttttttttttttgttttttttgtttttttggtaaatgtgatctttgttggcagatatggcagataaaaggtgaatagctctctattaaagaatgtctggggttggagagatggctcagtggttaagagcaatgactgctcttccagaggtcctgagttcaattccagtaaccagctcacaacagcctgtaacttactgcctgtaagatgtggcaccctcacacagccattcaaccagacaaaataccaatgcatatttaacaattaaggaatgtctgtttatgcccatcacctgacttctgcaggtatactcctgggtctgggctcctttctcagcagtgtccccagcttttgctttctgtctctgtctctgtctctccctccctgccccccgtgctctttggttgttttgtggtgtgttctaaggaaagaagacatcaagcctggatgctgagctaactgtaaatgctgacaaaccagcccgccaatctctcagcataacctttgttagcatgggtcctgactggcctcagacttgagtctcctaccctcttgtagtctgctgccccacagacaggctttcattatatgcactgtcctttggactagaaagggttgtggtataagatggtagcactcttgctttttgaacaagtatttgaataatagtgtgtggtagaaatacttttcttagtgtaccctacttctttcagctcctagtcctgtgcttgcctgggcctgaagaagcctaaagtcaccaaggaactttgcctatacgtggggctttgcatttacttcctaggaaaagatactgccttttaatgtgctaggattcaattacactttttagtttaattttatgtgtatggtattttgcctgcatgtaggcctgtgtctgacatggaggcaaataagggcactatagtctctggaactagaattataggtggttatgaacttccacag

SEQ ID NO: 34397 - DNA, 1106 bp, Mus musculus
attagatagtcatgtgtatttatacacgtacattttgactccgagcttgcacttggagaatgatttagcactccctgtacttaactgttcagctctaccaatggtttttgttttataaaactgccatcacagccaggatcatggcattgattgaacttactagccttggtcagcttgcttgttttccttgtgctcagacatctgtaaggaaggagattgacttttgttcatttgttactgtctggggttacagagagcatttccacatcttttctttaatttttgagagctactcatgcatctttcatttctaagacgttatcatacaaaaggtcatagaaacaggataatagacattgtaacccaagggaccaggcagagtggtgcatgtctaactttatcatccaggaagtggagtcaggagaactgggagtttaaggccattctaggactttttctcagtgtcagacacgtggggatgtaagcttgggtttcccatgatggtatgggaagggacaaccatattacccatgagattggtccccaccttttgggttagcttccttcccttcggacagtggttctcaacgttcctcatacaccaccctttaatacagttcctcatgctgtggtgacccccaatcataaaattactttttgttgctatttcataactgtaatgttgttactgttgtgaatcgtaatgcaaatatctcacatgcaaccccctgtgaaagggtcacagcccacagattgagaaatactatcttaggggctactccagtgcctgtaccagtagtcctgctcttatggttgtcatctcctctgaaactggagttaggacaatttgtgagccaccatgtgggtggtaggaattgaacctgcgtcttctgtaagagcagctagtactctagttcaacttacttatacttgtttttaatagctttaaggctttaattcgtagcctataaagagatttaaggacagaccaagaaagctcactttatctttgtaacattcacgtggaacatcttgcttggtacagcaaaaccaagctagattttttttttttttttttactatgttggggagcaaaagttggagat

SEQ ID NO: 34398 - DNA, 2238 bp, Mus musculus
caggaggtgtgtctgactagtcacagatccactgtcattaacaaatgtttgctgatttatattctatatcatgtggtgttttgtgttgaaaagagagaatttatagtttggtttattatttattgatagaccttttagggttttgtttcaccactttttgttagctttacccttccctttaatatggcttcctactcactctcaagtgttctacaaagagccagagagtgagtagttgaggctttgtttgcagcccttcagctctgttcttgttgcagaaaatgagcacagatgtgctaaatgagcctgatacctgtcagtcaagttttgttaacactgaaattacagttttggagctgtggatacgtcttagtagttaagaatgtggttgcctataatgtaaaaactctgggtttgatttccaacatcacataaactgggtgtggtccttggaattctgtagaggcaggaggatcagaattgcaagggttacacactgagtttgaggccagcatggactacaggagacactgtctcaaaagaaatcaatgtaatttttatctgtcacaaattgttctctttttaattaattaaaaaaatttaatctacctggtgttttgctcacacgtgtgtctgtgtaccacatgcatgcctggtgcccctagaagccagagagggtgtggaggtggggttacagacagttgagctgccatgaggctgcagggagttgaatccaggtcctctggaagagctcgaatcacaaaaacattttgtttcagttaacatacagatgtaaactcttcctagataatagactgttattttattttttagaatatatttgaccttagggccccaaataagatctcagactcttgtcacattggtgaaatggaatggcttgggtttgctgaaggtttgtccctgacactttctggtagctctttgacaatggtgactttacttctttcctgtttttggagtaaggtctcactgagtgccatggctgtcctagagcgcctatataaccaaggctagccttaagatgtgtgatttttttttttttctttctttcctgactgcctcttgagcgtcttctaccacactgtgtgccacaactggtgctcttctttctaatgtttaatttgggatatagttgttttcacattatgttctttgtccactttatattcacattttgtagtttaggggcctgactctggtcaggtactggctcctactgtcatcttcttttcaagtataggtataggcagatagacagattctttttaaaagttgtgttatatctgagacatgcttggtctttctttggcttgtaaacagaatcgaatagggagcatctatctccctgtggagttttgatctgtatagaaggaagctgccttctcttacatggaaagctgtgggagcaggaaatgtagtaattgtcttgatgtgtattaaaatcagcccaaagtctcttccacataaaatcgttggccttagaattactaagtatgctgagatgaagtattcataattgagccagttctggctagttaaggaacttgtaaaatattgctgtgacaaccagaaatgtaattacctatgtgctgggcaggcctgttgctgtgtactccatgagtgcatcacccatgatcgaggaggaaagttaataagggtaataagagactctagacttagtgtcgtagtggaacataagggcaatgaggctcagatgagagccctagactctaaacttagtgtcgtagtggaactggttataggaataaagctagcttgggcatttggaacggggattgcaggcatgttttatcatacagctttattattttatttgaggcttgcacatgaaagttgcagagactggccgtggacttcgttcttcttactgagcctcttgagtagatgggatcacaagtctatctgtctgttacttagacttgaaggagaagtgcagggtcccccgccccactctgtagctttggctctcttggaactccttctgtttaccacgatgctccctggaactcagagatctgcctgcctttgcctgagtgctgtgattagaagtgtgtgtcactaccacctggcaaagggactggactctgcaggggccagggtgggcaagaattcaatcactgagccacccatgtcatttgtgctagttactcctaaaaaaggattgcctgtcagtgtctggaggactatatcaca

SEQ ID NO: 34399 - DNA, 1133 bp, Mus musculus
gaacttagagttgttttaagtgatgtcaccagggtggggaagttagaaggacagtgtggggtgaagagctcttccacagtggtggtggccatcagtggacacctttgtaccgtgtttttgtaagacattgaggttgtttaggagggagattcctttggggtgactttctttctggaattttggggtaacccaggtgggctgggggagagtatccaagtgtggtacagaaatgtcctgtcattaggagagtaggatttcctttctttgcaataggatgtcttacagtatggttttagtttccttctagttttcatctgcattcctcttcactctggcatttgggtgtgtgctagagcctatagcttgtatgtgcattcccacttctcagaccttggttgaatctgggtttcaaagaccacagggtggtgatggccctgtaatcctaagttttagggagacaggcaggaagattgagagttggagaccatcccagaatgcatagcatattccaggccattctctgtacaagtctcacacaaaccccaagcccaaaccacaatgttcctctggtcccccctgaagtccctggaggacttgcctgtgtgactgtttctcatgttctctaactgttgtgtcctgttgtggggctttgtgggcccctcctccctttttgagacaggttttcatgtaccttagtctagtttggaatttgataacttgatatgtattagaggttggccttgaaccttaagtgctgggatttcaaggaggtgcttgtatgtatgcctgcctgttctgcctccctccttccttctcctgattcctcttctcccacttctgccccctcttctgccccctctcttctgccccttcttctgccctctcttctgccccctcttctgccccctcttctgccccctcttctgccccctcttctgccccctcttctgtcccctcttctgtcccctcttctgtcccctcttctgccccctcttctgccccctcttctgtcccctcttctgtcccctcttctgccccctcttctgccccctcttctgcctctctcttctgcctggatggactttgtttgctaaaaaggggaagactgtttaggaactcaccttgtaaacagg

SEQ ID NO: 34400 - DNA, 1219 bp, Mus musculus
agagagattatccacacacaataagaaggtggggggtgggggagaaaacggggccagtgagattatagattctgaaagccagtctttagtgacatacttcctccagcaaggttagacctacacgttccagaccctccccaaacagcatgaccaactgaggactgagtgttcaaactcaggagcacatttcaaccaccacaaggtctattgtttcactacgttgatagtgaaaacatctctttagactatatattcatttttgccagatggtttagagtcctccatcctaagagccagctatagcatgtctgcagcactcatctctgtcctgtcactttactactctgtgcgtttgtgagaggtgcgtggatggggaggtcagagttgggagtcagttctcctccaaatgtaggttctagggaatctactaaggtcaaaggtcattagggttgtgtggcaaaccctttttgtgtgagctattcactgtttgttgattttgggcccaactgtatactccatgttactcctgtacaactgacgagtaaccttgatttcttattcaacctaagctaaaggatcaggtgccgtttgttttgtgcctactgtaggccacacgggactctgcataaggacttgggtagctctggtgtcctgtggtttacattttcgagggagatgtgggcagcttacttcagagaggacacagtgttcaggaaagtgacaggttcagatcagagaagcctcgaagtggtcagacagggcctgcatgtatttcagcagaaatgttcatattaggagctcttctgtcccagacagttggtagggagttaagagacttttggtatttgctctcatagttttatttaataagtcagtacaaaatgtaagccaagacaggtgagagggagttaggctttcagtagttgcaggagcctgagaccctataaaggaagagtagagaccctgtgtgtgttcagaactggatgatgaattcacctcaggtttagttttattttctgccttctgtattttctttctatttgtgtcagtacataggtaactaatacttactgaaagagattggtctttgaaggtcatctgcctttacagaagcttctatatgtctgagaaaatggtaatactgggtaggacataatattttatctaacaaacatttaatacatttactcaagacaggatttaatagtgagtgtttttg

SEQ ID NO: 34401 - DNA, 1494 bp, Mus musculus
tagttgttattcccagcgtccctattattatcgtgttttgaaatgggagcaggcggccctcgggctgcgagccgagccggagggggcgggcgagccggggacctggagctgcggggtgcggaggcgcgcaggcccgagtgggggcaggaatgcggggcggcggggggcgtctgggggaggggaaggcgggactcgggggggagagtgggaggaaagcggtgtaggcgacggctgcaggagcagcctttggcctcaaggaacaatgtgagacgttgcctgaaatgttaatttccgttcctcatttcatcatcccctggcaaggcggtagctgcgagagtgtgtgtgcgtgtgtgtgtgtgtgtgtgtgcgtgtgtgtgtgtgcgcgcgcgcgcccgtgtgtgtgtgtacgtgtgtgcagggttggccctgccacatggatctagccccttcacagacggatgtgcggttcagttcctatgtatgtggcttggtgtggagtctcattttttttctcaaggccttgtctttacctggtgctcctgtaggtttttctgtttttgttatgtttctggaaagctcgtctggggtttggaagactggtgaaggttaagctggttcacaggaaggctgtatgctccgaaatctagttacatgtgtatagttctcatgtttcacagtggtttctgcagtcgtgagaagttttacacccacttgagaaaactgggcagttttacaaattttccggtagaaaaatttggtttttgtacctatttggtgagttttctgtggtcctttgaacactttccattcaacacgttcttccattcaactactgaatagaagtgcacatttgtacgtaaaattttacttaggctgttgggttgcctatgagggataaggagacttaactcagcaaagactgtaggtgataatgggttgtggagaaagctatggaaacagttactgtgttttgctgtgtgcagtcctagtcagtggtataatttgggtagttccatggtagagtctcggagaatggtacttgttgccctgagacctttatttctttttggagcactagctgctctgaagactagagttctgtctgtgtcttttgaaatgattgcacaaatactccaatgtcactttgcagctatacctaaaacaaaaatgccttgcttaactttgattgtgacccttggattggatctccatatagctggtgtttcctcccccacactccattcagctgttgttctcctttctgtagtttcacgcttaagagcaggatctcccgtgataggctggccatcctgaatggaatgggatgggagggaacaaaggccaagttgctatgacatttttctcttctttgtgcttgcctcgtgcattccttgaaaagcaacccaaaagataccgctaaatttgaccttagcttgattcttttaggagtgtttctttttcttgtcttccctttgtcctcctgtggtaaacaat

SEQ ID NO: 34402 - DNA, 1099 bp, Mus musculus
ctgattgtttgaatttacagaacgcggaaaaagtttaatgatggtttgcgttagtagtgatttggtttgcaaacgagctaaaaattcgaatcccagcgctgtagtgaccgagacaggcgtatccggagctcagagtacattgttgtgaacatttcgagttcaagatttgagttccatgaaacctttgtctcagaaaaatgcataaagtaattgtgacgagtctgatatgttggtataggctttttatcccggtacttaggcagaggcaggctggatctctgagttccgggccagctagggctacacagtgaaagccaatttcataatataataaaatataaaataacaagtaaccagggctggagagatggctcggcggctaagagcacgtgctgcccttctcggcacccacctcagacagcttcacagccaccttcagaggacttgacatcttctgacttttcaggaactcacacccgagtagagtactcacacatatagactacatataaatcttttaaagtaaatgggacctggggagatgacctgtcggtcaaaagcactcactggctgctcttccagaggatctgggttcgattcccggcatctgtaactcctgttctagaagatctaacattgtctaggggctccccaaacatgcactagtacacatacatatacacagaaaaaaaatacgcttctgcacagaaaaaaatctacaaaaaaaaagttttaagtagtcaaacttccagccttgtcctatttaaagagcatctgtgtatttgtgaaccagaaaagctaagtgactaaaatcaatatttatacttctttgttttgttttgtttttgacttttggggttttgtttgtttgtttgagacaagttttctctgtggagccctggccttcctggaaatagttctgtagagggtttgggtgttttgttttgtttgtctgtataaacaaagtctttacagagcacagattatgaaatcatgggattgcacatcccggagtgatgggaccttagaggtgacctttcttccctatttgaagcaaatacagagtttagaggacatggtatgataaaaactgccctgc

SEQ ID NO: 34403 - DNA, 1044 bp, Mus musculus
gctgatggtcaataaactgaggcaggattagaaggcgggacttccagtggagagagagctaggcaggtggctgttttaccactcgaacacggaggacgtgggaacaagaagctgaggagaggaagccagccacgtagctgaactcaggttagaataaatgggatattaacttaagagttagctggggaacgagctagcttatggcctaggaatgtattaataatattaagcctttgagttgttatttgggaactgtgtgtgggtggaaaagcccaaagttataattggcacctaacgttcttagaatctaggcttagagcccgagacgccacggggaagggcggtttagccattctgtggtggtgggcagactgctgtgtgagctgtgagcggagcagctcaagtccagcggacagggtgggcaggaagctgcagagaggctgtatgtggagacgccagccactttcccccttgaggtgcagtgtggctggctgctggggacagggggtgctgtgagcagttgatagatgggggaaccagatcctcagggcacgtgctgctctgggaagccaaaggcccatgggaaatagcagaccagtccgggccgactgcatccccagctcgatgcccagtgtggtagggcatgtgggcctgagactacctgcaggtgcctgcaggtgaaggcctgaagctgcgaagaagcgtgatgggtcagggaggcctggccagggttggaaaaccctagaccaagatgagtggacattgctgggcaccaacaacagggtgctaactgaaccacggaaggagcaccggggccaacagaaaagacatccaagcccagacacaagcctctgaccaggtagttatctttgaaattgtgctaagtgctgaaaagaaatcgaatatagaaagtcatagggggaaagtctctgaaggaaggaaagaattagagcttgaaaaaagaaaaatattttctatggtaaaaatggagagaaactcaatgacacagcacatctggatcccatatggtttgtcttgcttttc

SEQ ID NO: 34404 - DNA, 1132 bp, Mus musculus
atggatcctgaggacccagcccaaggacctggcatggaggtctttcttgtctcagctacggctctgtgattagtgcagtgaaactgaacatgtgtccttcgtccctcagacactggccaggtgtccttggcgtgaaggaggctccagtgaaccttctcctgtggctcttccgcgcccccccccccaacctcaaagagatattttatttaaataagggcttcgatggatttcatagcattaatactcaacaggtagactgacaatctgccaacgggtttgttaccttacatacacagttagaggcagggccaccttcctcaagagtcttgagtgcgctagaaagcaggccgttttctgagctggatttctctgaactactataaaaatagctgtttgtccccaagagttggctgaggaacccgttgcttgtcacattggcccagcactaacaagtctctttgtgtgctcacagctgtgtacgctggctccttcagacgccctgaaactagtctttgtcgtctctgcaggaagaacagtttctgttctttggcgtgcggaggatggagctgagcggatgttgtgctgcccgtgggaaactcaccaaggggctgagaggcctagtcatggaggtcccagcccagcacaggctgtaagcttatacaagcgagcctcaggccagcacctctttccccccctgcttactacgaggtcacctggccacaggtgccttggagaaagggctttaacatgctctggtctgttgtcacatatgcacaggtttatgttttagaaacaaacagtgtaaacgttgatttcatatgagagtcattacaaaaatcctagtagggccgggcatggtggcacacaactttaatcccagtacctgggagacaaaggcaggtggaacgctgagtttgcggccagcctggtcaacatagcaagttccaggctagccagagttacatcatgaaaccctgtttcaagatggagggtggggggtgggatcgggggtggggatgaagaaaatcctaacaggacttggtgactggctcagtgtagagttcttgccttgtgtgcatgagatcctgggttgtatcaaaaattgaaaggaagaaaggctggagagatggct

SEQ ID NO: 34405 - DNA, 1046 bp, Mus musculus
ggcctctaacccacacctgcatctgctttgagggttaaaggcaagcccgatcttatgaaggaattttctcattgaagttttttcttctgccatcactttggctgtgtcaagttttaataaattcaccagaatgtgccttacagaggttgtggctctaattttataatatatatttccatatataagccaaagctggtttagaacttaatttgtagtctatggtggcgaagactcaggattctcccatcgcaacctgacaaatagtggggatttacttatcccagggggtggttctgcgcccggagggctgaggcagtgagtcctgtgcacaggtcctgtaggctcctgacttctgttctctttccaggtgtacaaaaaggaaaaggccagagttatcacagaagaagagaagaactttaaggcttttgccagtctccgaatggcccgtgccaatgcccgactctttggcatccgagcaaaaagggcgaaggaagctgcagagcaagatgttgaaaagaaaaaataattctgtgttggagagctgcaataaattttccataaagcaaaagctgggtttctttgtctttttttcttgagcaatagttgtgtgttgcaggtttgagttagaaggtattcctaagagatgtgattgagtttcagcattttgggccttagttataactgagtgggtgggagactgctgttaacaccagctgctgagctcaaacgtcgtaaatgccatagcccagccctaaaattaacttcagcagggtcttccttggggtggtcgctgtctactgtatcagtagctgtagcaggctcttctaacttagcccagaggaaggctggtgcctggattttgtagtaacttgcccctctcttccctggtgtgacaggattaggtttgccccgacagtgacttagaaccatgggagtcctgtattaccctgcatgtgcagtgcctgtggtgcctgaggcattcttactacatacaaagaggagagccccagagataggttttggggcctgaagttttttctttttgg

SEQ ID NO: 34406 - DNA, 2363 bp, Mus musculus
ctgtctgtggggctgtgtacctgctctagtgttctgtcctgaccccgaggacattgtgggctggagcacagtcttgcaaagaccgtcccacttgctggactgttgggcagggcagagggaaacccctgtgtcggactgcacagctccccttccatcagaatgcggtgggtaacccctgtagccagcagctcaccatagaaggaggttccatgctcttcctaagagtgtcacagtacgtggctgtttctgcatcttttcacccattgtcccaggacagctttgagaacctcagtctgagtgggtcctcatttctgggttcaggtctagctctgcacacagtgccctctgcttgctgcctttcttaccacagtctcttgtgttggtttccaggttggctgccctgaggaattagcacgtccgtggcagctgctgcctcccttgtcctgtgattgttctggaggcttctgcccaactgcttcactttctccaacccttcgtagctgcctgggctcttttccaacctgtcaggctggcgccttagaactgagccttaggttgggcagcgggtctctgtcctggtattgaatttgcacaagtgtgtggtgacatatgtgcttgtgggccacagctggaggatggcaagctttctgttgtcctctgcctatgtggagttgacagggtttggcctgcagatgtgtctggacttgagcccagtgctttggggccttgagactccagcgactgcacacccgctctgtgctgcggccagggagggtgagaaccatcgctcctttgccaggtaactcttgggagcctctcccccttctgcatagaggaaatcccagtgtgtgacagcccttaaggttcctgtggactttgtgtaccaaggtgtccagtgccaccaacactgacctggggcctttacaaatggttgctctcctccatcttcccagggctgcggtcctggtgtctactgccggccggctgagtctgcgtgggctttctgtctctcagctccctttcccagcccacagggacagaagtaccatccactttcaagtccagctccttcctaagagattcttccaccttactctgcagctgcctctggaagaactttgggctgctggggctgagctgtctgcttgatgctgacagactcctagtgtcagctcccaggccgccttagagctgctcattcctgaatgactggctcccctgcccttttagacaaaggctgctgctttcagccttctccaagggagagcctggctggctaacagagggagcctgagtcagtcacatctggcagctggcagcaagctcttcatccctccacagtgaggaagctggcagcgagcaggtagacctggagactgcacggctgctgattggtcttctatctcctgaagtttactcatgttcttaaaactcctggtgactttgttcttttgccaacgtagaaagcacagtggacgggttgtgtttgtcccagccctctctgtaggctgagcagtgcagcggcgcccacaggtttacacacaagtttggtttggtttcttctgttctgcactttggagtccctgggtattccacattacaagttgatgttataggtgggggctggaattgttgccctggatgtggggaccaaggtacaatctaaccatgggcccccacaaggcttcctgaaatcaaatgttaggtgttgagagtagctgcagtctcgggataacttgtgagttccctgggtcctggagggtgcagggtttgtggaacagtagtagggatggggagctgggctgggttcatcagaatgggcgtgtctgccttcacagtgctgtcctaagtaaataaagggattggtgaagaacgtctcagacttttttttttaaggagttctcggggtggagggaggtggctcagcagttaagagcagtagctgctcctccagaagatctggattcaacccccagcatccatctgtaactccagtcccagggtacctgacacactctgacctctgtgggcgctgggcccacagacatggtacacagacagacataggcaaaatgcccctacacaaaaattagtctcaaaaagttaaagaatgagatgtcaattgtagcccaagatggccttgaattcaaggtcctcccactctggtctcccgagcggttcagcttatatgtgggtgccacacatacctcgtttatttaccatcctccattgttaaaactacctctcctctgctttgctttgtgcccaaagtagtttcagactgacttcctggggtttggggtaggttagctcagtggtagagcacttgcctagcaagttcaaggcctccaggaagtggtcag

SEQ ID NO: 34407 - DNA, 1134 bp, Mus musculus
agcagcccaggtgcatggccttcatgcctcctccttcctcttccagcatcctgaactggcaaggcatggcctccaggctgtccctgctccagtgacatcagctggcttcccctccttcagggctgcagcccagggtgtcatggtcgggcagaggtgggaaggcatcctaaagatacacagagcagacctttagccagatgttgcccagctctttcctgttgtttgaaggctcagtagctccaaggctgtggctgctcaggcctctcgggtgaagctctacacccttcccgctgtggttcctttggcctttgtcacctgtctgctatgcagatgtggctctggaggaacagcagactggacccctaggctgctctgtggcactcatccctgtctgggtgcccgtcctcctgattgtggcattgcacttcacagagctcgcccattcctgagggctgtacctagggaaactagagaggcacgcaagctgctcacagagttcctccatgaatatttccctctgaatcataggcccttcagcagaaaaatgtggagtgtgcccgggtgtatgctgaaaatgccatccgcaagaagaatgaaggtgtaaattggctccgaatggcctcccgtgtggacgcagtggcctccaaggtgcagacagctgtgaccatgaagggggtaagtgccaaaccatggggccgtgtgaccagcgtttgttgtagggtttagtggcaggacctggtgcctttctagagtagagggaagctggaccagcagcgaacctgggcatcgggcagcatgggacatggggaggcctcaggacagcctgggtctcctaatgtcattccacaagagactgggagttagacagagctcttggttccacagcagagcttcccttcaaactggagagacccgaggactcctgtgtcatcagttgtgttcaagtagctgagttagggccctagtggcctgtccctggtctgcagtcctcggtcgcctgttactctgtttttatccctaatcctcttctatcccaggtgaccaagaatatggcccaggtgaccaaggctctggacaaggccctgagcgccatggaccttcagaaggtgtctgcagtgatggacaggtttgagc

SEQ ID NO: 34408 - DNA, 1219 bp, Mus musculus
cagctccaggccagccctgaagctgcccttctcctgcagcctgtgaaccggagctcatgcctaccttcccccaccaccgcaataagcgtgctgccccagctgccgctgaagggcagagcaaacgatgccggccctgagcctggatccagcccacccctccacatcctcacggatcatcagccgacgactgggaggccccagcaggcctttggctcctccagttggctgactcctccctgatatttccctctgtccagatgcagaggggatttgtggacagggatgtggctgagtggggtacccaggatagactgggcagttgtagcaccatctggtggcctgtcttgtctatcattgaaggcccgcttctgggggaacagagctagtgctgagaggcctaaaggtcccattcagtgtgtgtgagaactggagctgggcactagcctggaatgagtaggcctgggagataactcttcttggagactaggagctgcccaggacagatgggctatagtgaccccgggcaggagggagcaagggttggttaactggagtaggatacttgtaagactgtcagaatggaagcccttggtggacgcggctggcactggtgcccaaggagaggattggtggactgagagataaaaagcctttccagaagacagtttggcaatcctttaatgtactgtggggtttcgatccatgcaacatggacagtgtcctccgagggccctgcatgaggagcaggaacaggcttggctgaggtggacccgtgtcctctgagggcctgcatgaggagcagggacaggcttggctgaggaggtgccactagaggaagtgtggcaaagtggtgatctctgtgcctgggccttcgagtggttgatgaaaatccagcccttcactatccctatcctgaggattggcagtttagggaccctaatgaggggtcctggtctacccgcatgggagatgagggtataacttcttcctggttagctgcatgcccagaatgagctacgtggagtggggcggtgagctgctttttggcaatagcctgagaagtggcttgtacatgctcccttcctttctggctggtaggtagctgatggcagagaatcactcctgctgggtgggagtgacagctcctcccactgcctgggagtgtgcctcactaacagcagaggtgaaccggggtcctcacagctaagtaagctctgct

SEQ ID NO: 34409 - DNA, 1173 bp, Mus musculus
agacattgttttcctccaagggagaacctaaacccttgtgtatgctaagcaagcattgtggtcgagacaaggtccttgttgtatagcccagcttgaccccaaactcaccatcctcctgcctcagcctacaggaatattccactgtacctcgctggcaggtagcctcccacgactgtagtattccagaaagtccaatgtgctttctagatccaagctaccaatggaatcaaagctccagggtttaagcttgggtctttctaagtgtgaccgtctacaacagctctaggcttccttggagcacttctgtgcatagcacccttagggagaggatgtctacacacaaggagcactggccagaacaccctccttagggcgttgcacctcgacttaagagaaaaggggcttttccctaaaaccacacagctaggaggctctatccttgccagctccaccccaacactatttctgaactattcagtgtgaaggccacgcctggctgcctctgtcctctggggcggatgggtgggcttctagcttgacagaactgaatgaaagtcctgagatctcaggtattcccgtggagcagcaggctggtggggtgtggagggggagacgttaccatgacaaccggtggaggtttacctcgcccacgtgcattctgacgtcattgccttcccactcaaaattagctcagagcggccctaccccctctaagtggtctgccatctgacctaaggactaggccagccctggacctggccgcctaacctggacccaggcaggaataagatccctgctgttctgatctgctgttctcttcccagtcttagcagcctccttttacagatggggaccagtccacatcttagaggagttaggatgaccataggacatcaagtacctccctcacccacccacgtctaccctagaatttccatggcaactagggcagtgagactactttgaggacagccatataagttctaggtgaatgactggtaggcatgcatcccaacacgcccacgagccctcaacgcagaaccctcccctgaagaggatctgcagccctcaaacagcctggacaaggacgggagtgaaggagcaccactgatgccataccttgatagtggtgaactcctttctccagggcagcaggtacaggtgcacagcggc

SEQ ID NO: 34410 - DNA, 1184 bp, Mus musculus
agggtttgtacatcacagccttggcccaagccatgcctgaccaggggtgggaggtgggggggtgcctatcatgtccctgtgggtggcaggacactgagcaggggcagcaagtgtgtgagcctccctggcccatggaaaaagaggtcagagccatagcctcggggtccagctgcccctcacctcttggtcccatgctcttccaagaagctctcatgtgtaccctgactagtgcagctagagctctcctgagccgggcccagaggacctagtgcagaggtgattatcttctagtctcaggcatttgctcccaagcttccaaaagcacctaagtccatagccaagtagaacatcagaagagacctagtgtatcctgccattgagagtgttacttgggcccagtattactatggccaggaggtctcctgggctgttgggggacaggggtacaaggattatagccagcctggccaagatggctccagagaggcagagcgcgtgtcccttcggccctggtcccacagaccgacctcttggcctttgcccagcagcggtgctgatgacttgctgcccatcctgtccttcgtggtgctgagaagcggcctcccccagctggtgtcagagtgtgcggccctggaagagttcactcatgaggggtaggaaggggcccaggctagtgggtgactaggaggctgatgtgggggaagggtctctgtgggaagagctggggacagagcagctctgacaaggggggacaagggaacctcaccccccccagtacaaaagcaatggctatagtaagccgtggaagccacaagggggcccgcagcaccaccgccactttcggacatccctctgagatccactgtgcatgggacactcttacccgcatgctctgtagccttcagaggaccctgtgcaggagccagagggtgtctctgatcagcatctgcccggggaagagcagtatgcaccacagggccatcacaggacctggactgacagtggggaaaggtccgccctgacccagctctctagcaactctacccgtgaccgagtcattgcccaagcaagaagggaagatgttgccctctggcggcctaggcttgtccatctgtcctctcagtcgacacgtccttccccactccacacaggtacttgattggagaagaagggtattgtctgac

SEQ ID NO: 34411 - DNA, 2092 bp, Mus musculus
tggctgctggctctgaggtggggtgtagtctggggtccaatgagcaagcagaactacaccggcagggcagtgaggactgagtgaaagtgtccttaacctcacgtcacctgctgagttcaagccgctcaaggcgcccagccagccagcggcctctcaggtaggctccggcttcacagcctgaccctccatggtcccagaggggctcagaggcccaggtggcggctctgcttccagaggcagggctctgtcctgggcctgggtcagaggatggaccatggacatatgcacgttgaggttgtgggccttttcaaagcgtcggccgcactggtcacaggcgaagtccagctcagtctctgctttgtgtttggtcatgtggtacttgagggatgctcgttgcctgcactggaacccacagacctcacacctggagggcagaggcaggtgaggtaagctgcacttgtcccagtcacaggcagtgcccagcccacacttactgcagtggcttggctcccgagtggcgcatctggtggacgagaaggtgcttccgctgcttgaaggtctgcccgcactcgtcacagatgtaattgcggacctctgcaagagcagagcggtgtgagcagcagccaccgccgatgcccagtctgctccaggagaggacggtgaccactgctttacacagcaccggggacctttaagaacccaaccttatttaaaaccaaagacgattctgatatgaagaacttcactgataaaagtttctagctagtcgacggtggtgcaccaaccactaagtcccaggactcgggaagcagagacaggtgattctcttaagttcaaagatcgtctggtctagagagcgaggtctagcacagccaggactacagagaaaaaccactttccaatagacactagttcattaagagatttccaagttcctcacagcgctgttacacggctaggtcttccccacagaaactgtttgcatttcagacctttctgtttgcttttgagacaagatctcactgcgtagccatggctggccttccagaggactcagagagatccgtgcaccaccatgcccagcctgacctttgcgggcacagatctctctctgggattcaccccaaagtgagccccaaacagcgcagataacgtggtggaggggaagcgggctgatgcactgtgggaatcagcttctcgagctactcaacagaaactacagccacatcaggcatggtggcacacgcctgcagtctcggtactcaatagttcaagaccagcctctgctgtagatcagatttgaggccagccattacatgaaaactctcaaaaacaaaactgttgagaaggctcagcaggtagtcacttgccaccaagactaataacctgattcaaatctcagatctcatgtggtacgagagccgatagctacaagttccacatgcatgctgtgtgcacacatgtgctttcttttacaccgtggccactgcagcactatgcaccaactgtacttgttccaaccgatgctgtctacacagctataaaacacctctgacctctcagctaaagagtctgtttcacctctttgttttttgaagcaggatttctctgtgtagaccaggctggcctcagacttaagaactcctcctgtgtctgcctcccaagtgctggggtcaaaggcgtgggctatcacggccccacgaatgtttcacctctgcagagagctgctgctgtgtccactagtgactggctacacagcttgaagatctggaccaaaggtagttagtcatcaggagacatgcccaaatgcgcttatcaaggaaaatcaatatatagctgggtttcaccataaaaccaagtaaatgatccatcaataaaatgccgaacgctaatgtaaaaagattttggtcatttatataaacccctgaaaactttaacaaatctatctgaatgaatgccacaataatttttttctacattctaaattttgggtggtgtgtacatgccatgtagaaagtgtgtgagatcggaaggcaatgtaggagtcggttcttcaccatgtaggtcctggggagatcaactcaagtcatca

SEQ ID NO: 34412 - DNA, 1225 bp, Mus musculus
ggaatccatgatgtctgtgtcctccctgatcaaaagtactccaaatcctgctcagtaaccaagccggtcttgctgtcaaccctgctgctaagggagctgcagggagctcagatgactcctctgactcctgtagtgaacagcatgagttttctgccacactcttaccctcatggaaactaagatatcatgctagtaattgggcctgactctcttgggctagcccagttacaggcccacatgaacaagcaggaatacggagaacttagtagtactatggcctcttccttcaaagctgctggggccccgatatcccattatgaggtgggtagggctaagctggttccctcacagtgctgtacaccgtgtgacttacgtacagggatggccccacctatcaggtcctccctgaggagacagacacaatcatctgtagtgattctgggccctgcactgtgtttgagaggagagccccttgctgttaaacacagatacctggtggccaggagtgtggccattaactctctgcaacgatgtctgtgtgtcagtttcgcctccgcgtcagcttccccagcacccagccccgcctggatcgcagctgctgcgctgcactttgcgtggagaggagttaggaaggaagatgtcactgcacatctgcaaaggctggactgccaaagagaggaggtgagacagtctccagggaggttggcccactggctttccaaagacaagcagatttggggttttcactctttttcacagttaaacgattagcttagtgtttattggtaaaatgctttacttttggaagtgctttgtcgggcttgtttttgcctgcattacaacttagaataaagctaccagccagtgtccacactgtgagccaaggctgtagctctgcctctctgttccagcttctaagaagcaaaagcacagtcaggccttgagtgctgggccctagagaaagagtcctaaacacccagtgccttctccaatgagtacttacatgacctctggtgtgtggatcaagatttgttggggacagaggaaatgtgaaccagcacttgggaaggaagttgccgcccctctcacttttcaatatgggtcccccactggctcataaagtatatcccaacctaagaactctatcagcagtagagctgattatttgctgactgtaatataaatgccccaggattcttctaagcccattttcctgttgcttttg

SEQ ID NO: 34413 - DNA, 1210 bp, Mus musculus
ctgcacgtgtgtacacctgtctacacctagcacaaagggcagtgcgtggccccagagagacctgtggtggtatgctgggtaacccctgtgctcatttatgtttacaatttaaagattgctgtgtttggttctatggttttgtgtgctgggggtaagggtaggctgaatctagagtctgtgcatcccaggcaagtgctgtaacccgcgcaggcccctgaatttgcagtcctcttgccttagtctcccaatagctgggctactacatctggctagagatggccttcacatgtaaaagcttgtgtccttgtccctccttactcctcatccctgtggagacaaccttctcaaggtcatctctcagagtccccagctaaggtccacagtgagctgagaacccttctgccccggttccggtttggtgacaggtccgagctggagggtgaagtaggccctgctctttcccaggagatcgctctggacttggagctggatcaaggttctgctgtgccccatggctgttctacgccgcagagtcactttctgtttcgggtgttcagaagacggctgcaggctctggcaaggccagacagcatggctaccagcctcaggagacaacaagaactgctcacatgcaaacggtatcatccggcggactctcatgccagcgtctgtctttagcttccactactaattgcttatttctattatgtctactccatccaagcttggaatggtttcagtgtcttggtggctctcataggaacaagtgtaaaaggtgtttcggattctagtctttcttcttagactcaagaatccctctagggaagatgtacttactataaagaacacgtttttgtccttttctttttgtctttaaagtgcagtgcgactgttctcataatagaattttccagtaaaggattgcttccttagacagtggtgcatccttccacctgcttgttgaaattttatttatattttttgaagtgcatttagggtatccacagtgaataagcaggaattaagagctggggacaaaggcagcgttgagcacatgagctcaagggcaaggtcagtgggaactagaagggctgtggctttgagcagcatcacttgatctggaaagtattgtacagggcaaggacaccctgtccatgctgtctgtcttcaccacgatgcacccctttctttccaaggcttctcctctgcc

SEQ ID NO: 34414 - DNA, 1164 bp, Mus musculus
taaataggggccgagagtcctctccgtctccctgataagcaagaaatgctctcaatgtgtcactgaggagacccttctggtgtcattgctgcttggctagctcagggtgtgtgtgtgtgtgtgtgtgtgtgtgtgtgtgtgtgtgtgtgtgtgtgtgacagtacaggtgtagggcagcctgcatgcactgaaggggctcagcaaggccagggctaagggagaccccagggagacctgctctgcttccctgctcctcctgcgcccctgctcatgatgtgctgtgtctgtcagggctgtaatgggttcacaagaaggtggcaggtaagatgccctggtgggcgtggtccctgggtgtgcccctgtgaatgtttcatactggctgtgaacttctccctgtctgtttcagtttcagttcgttgtgttaagattgttcccagaggccagagcaccttgtgctccagagcatgcagcttgcgtcccctggagacctctgtaccttccttctgcagactggcagcgtgctgcgctctctctgtggagacgggacagcttccaagagctcctgaaggacaaggaattttatgtaggtttccctgtcttccactgtttcacatggcctgactgcctctgtgtgtgtgtgtgtgtgtgtgtgtgtgtgtgcgtgtctgcctgtctgtctgtctgtttctatgtttgtgttcctgtttaccttggcctttgtccaagtggaaatgcatggagggttggtctataatgtgttgttgttgttgttgttatagaaaataagattttgagatctggtgtgtgagattgctttaagaattttcataagaagaaacaaaatataagatgccatgaatatttgaagcagagtattacatcaaggttatgggtttttgtttggttgcttggttggttggtcgtttcggacaggatctcactagccctggctggcctggaactccctatgtagaccacgttggcctcaaactcacacaggcctcaaactcacacagatcccctgcctcttcctcgagtgctgggattaaacactgcccagtttataccaagatttgttcccccaactcctggcctataaaataatttcttttcttatcagataacaatttagctaggcacaagctaattgattaaaagtgaaga

SEQ ID NO: 34415 - DNA, 1175 bp, Mus musculus
cagtttcatgtgtaggactggcatggagcccagggctttgtgcacgctgagcaagcattccgtgtgtgtgtgtgtgtgtgtgtgtgtgtgtgtgtgtgtgtgtgtgtgtgtgtgtgtgtgtgtgtgacagttatatatgttacttttttgtaatttttaaaattattttttgtatatggatgttttgctgcaatatgtgtgtggtgccctcagaggccagcagagggcatcagagactggagctacagatggttgcgagccacagcttgtttgttgggactcagactcaggttctctggaagcaagcaccgctcttaatccctgagccatctctccaagctcctcctcctttttgtgtgttgctaggagttaaacccagtgctttgagcgttataggcacatgttccattttgaatgacatctcctgtctcagtgctttcatttttgatactgtatgtgatttccaccatcatcaaagagaaggccttccagagacagtgcccgctctccacacaatgcagtgcacatctgacatacacagctgtggtgctcagtaatggtgcacatctgtggtgcacatctgtggtgctcagccgtggtgctcggccacacttccccaagcatatgagctttttgtatttataataatgtcactgagtgtgactcccatttgacctaatctttaaaatgtccctccctggttcagatgccacctcggctcaaaggacagaggccgactgtgccaaagagcccctgggactgctcacagcagcactggaagagctcagagctttaatgacagacccgacccaatacagtggtaagactcgggatgaggcagtgtgtggtagtgcttgtgctccgggtgcctgcgtgccaccatagtgacaggctggctggctcattcctggagatcggtatttggcaggtgaacctgcccaaagactagactgagtggggattcagagtgatggggacgatgtggccacccttccattcagagcaggctccaagttgggtgtgacagcttggccagtgctccctagcgtcttgtgaggccacgctgtcgcttggttacatcgttctttccatgccttacataactgcatgtgtgtttgcagttatttctgctcaggtggccgtggtttctgaaaaactaaatgctgttctgggac

SEQ ID NO: 34416 - DNA, 1160 bp, Mus musculus
gttcgtgtgaaagacgttcttacttggctatgaagcatggcatcttaaactcttgggtggtagcagtaaccagctgggtaccctctgctggttggagacctcggggaagattgttgctaaagcccagggggtctctccagccttttctgaggtagggcatgagttctctttcttattgtagaatcctgttcagcctccagatttctaggatgcgggaccctgaaggtccttcaggcccacttttctgtcctgtgtgtgtgacctccctcccacgtgtctgtcttccgctgtggtatgcagctcctgccttcctagtgtgtctaatctcctgccctgcttctggactcttgacatcctaagatggctcacttctctcttgatgaaaccacatgtcccatgattcatttgacacgtgtggcttcatggcctggttgagaaagtgatttcctggcttgcatgatggtgagccccgttggttcttggacaggatcccggctatgaacagtgctttccctcttggccaccccctcatgtcatttgcaggattcctatctactccggacatacgtgctgtggtgtggtaacagagaattctctgaagagcttcttcagtcacacgctaactcagattctgactcacaagcccgtgctgaaaggtaggccgccgtgccgtggccactgtctgcccattttggggtcttttcccctattcctatggtggaactctcacagagatatcagtgactcttgggtgggcttgtggctctgtcctccgcaggctcctgagcgctgagacctgggggtgaaatggaatgctttaaggcccttgagatcatgacactagctcagagtctggcatccttgtcgtctggaacccacatccctctgattctgaggaatgacctcagttaacaaaaggaaatggtcgtgtcaacagtgttgaacaaattaaaacagttgacatagaaacttaaaaaacagggtattttggatggttggttgcttggttggttgggttgtttgtttgtttgttttaaaataaacgctgacttgaagtttttgtgtttcctccccagtgtctgatgccattcagatgcagaaagagtggagctttgcaaagacacatcatctgctcacggatctgcactgcagggtgagtg

SEQ ID NO: 34417 - DNA, 1177 bp, Mus musculus
ggttctccctctcggctttctccaatttccaaggttgatgtttgtgaaccggctcacagctcagttttacagttcatttctcgacagtggaagccacccccacctgtaagtgtggcttgcttgccgagtgccagtcactgggtgtgtttccacccaatccagaccagccctctgtggtaagtgataccactgtgcgagaggaaactgggactgcttagtcacgtgatctttgacgccagtctctctactggaggctgtacccagacccaggagaaatgtcggtggtgtattttctcttttcaaaatttattcctttttaaaaaaaattttcgagacagggtttctctgtgtagcctgggctgtcccggaactcactctgtagaccaggctgctcaaactcagagatccgcctgcctctgcctcccaagtgctgggattaaaggcgtgcgccaccacacccggctccaaatttatttcttgggtttagcgaatccatgtattttaaaattcagacagcttcttcttaaattttatttcatctgtatgagaattttccctggatgtgtgtatgtgtaccgcgtgcatgtcggatgcccgcggaagctagaggagggagctgaatcctccgaaactggagactgttacacggtgctgtggggctgtcctgtgagtgtgggggatgtcggccctctataagagcagccagtgcccaaattcagaaagtttaagggaagaccttgaaggaggccttgtgttggtgtgcctggatgcccgcccatcctccctactcacaggctgccaagatcgtgagtgtttcctgcacataccagcactcaggcgtgtgtacttcctcctaaaggcaggcgttgctttctgttttgtttttctccctgagtgggagccttggatcaactcagcacacaaaacacatcttattggtcctttatttgaaacagggtcttcctttctgtgttaccgaggttgaccttaaacttgaaatcttattgcctcagcctcccagatctgatttcaagtgaatttctttttcttttctttcccttttccccctttctttcttattttggctttttgaaacagggtttctctgtgtagccctggctgtcctggaatttgccctatagaccaggctggcctcagactcaaagattcatctctg

SEQ ID NO: 34418 - DNA, 1178 bp, Mus musculus
cccgtgccaccaagtctggcttaggttagattagtgaagggacatccatgtttagccaaaatggggtaacagccactttctagttgaaacaggcccaaagaattaaacaaagagtataaaacaataggctttaagactgggtatcaggttaacagtaagaagctgacagcgagcttgtgccagcctggggatgtttgccttcatcagctggacctggggtaggagctagggcagctggagatcttagaaaaggagagggagaggagagagcagcacagagaaacctggagatctgcctctgagatgtacgtgtgcacagagcagtcacatgctcgtaatcccagtattccaaacactgaaacagggggatcatgaatttgaagctggcctgaagaaaaataatacttatttaataactccactacttcaaaagaaagcaaaaaaatgaaaaaaaggaacaaatatatgtgtaaaaaatagcaagatgataaacataaacacaattctgtccaactactacatcaactgtaaatggcctaaataacccaattaaaatgtagactatgctggcatagctaacctgccactgtcaacttgctgtggaagagagctatgaatgtaacccaacacacaaaaaaatttacattataaagtagagcttttgttgttttaactgaagtgtaaactttgtagatggccatgtcaataggttggacatgggacctggagagatgtgtcaatggttaagagctcacactgcttttgcagaggatctgggtttgatgcctggctctcacaaggccactatcaactgtcccagggcatcacgtgacctctgcaatcactgcatgttgtgcacagacatacacgcaggcagacacccataaaatatcataaaataaaaataaaggttaacattttttttaaagtttggacatgcctgagttgtacacttctgagtttgagtaaaaaagcaagacccagagctaagatacagtggctcataactggaaccctggaactcaggaatctgggacaggaaaactgacaagaatctgagaccaaatcctgtctccaaaaaaaccaaagacaatgaagaaagtagattttagagccaagactatttccagtgataaagcagttcgtcccctaagaaagaatcacaatctatatcatta

SEQ ID NO: 34419 - DNA, 1429 bp, Mus musculus
gtgacgcagggcaggacggggcagtgacgtcagagtgggcggggcgtgacatccgagacagctaagggggaggggcactgtggatggcgagtgggaggtggggttcagttgggtctaggcttcactgaaggagtagggttgttctgtccggggcaatgggatggtagggtaggcttggtttcatttctgcgacttgagggaggtctctcttctgcaaacatttcggcttattcatcacagtacttctgtgtgtcccagctacttgtacctatcgtatcgtattcctcgcagcagaaaattgggtagcagtcctgagccccgtgtttttccttacgacagactgacctgggtctgcagtttcatatgtgtataaattatgattctgacttcatgtgtgggcagataatatgtcttttcctcgtatctccaacttccacatatggtaaggtgtcagtggccattttcgagtgagtaaaaagatgtaatgtgtctgagactctcagtcttgcagtgaattgtctcagctagctgggacacacggaagtactgggtcttcctcaagtcgcagatatgaaaccatgtctatcctactgttgcagcacccaagacagcactacccccagttgtccccagctttttatcagttagcaggtttaaaagttcctagcaaagatattgattggtgtgagaaatgtcacagacattttggaagtttggttcagagattgtttatttctcccataaggaaaggaagggatctgtcctgtagtctgtggcgatggtgaaatatgtcttcccttggtacagagaactcgcctgcctcctctgactttgagcctgagagcaacccccattcctactgtttcttctcccttcactagtacttttcttagatttacttttgcttatcatcatttctttttcaagacagggtttctctatgtagtcttggctgtccttgaactcactctgtagactacttagagatgctgtgtctcagactcggaaattcgcgcacttctgcctcctgagtgctgggatcaaaggcatgtaccaccaccacccagctatgtttacttttaaacgtacacaaaaattaggaaaatacaaataacccgtatgcgcccatggcccagtttctgtcagtctacatgcctttaatataattttaatcccatttctcttaagaggtgattgcaaaacagagcctagatatcccatcattcacccatctgtagccttccttgtactgggattcctcccttgacggcagctggggttcactctcagaccttagggatctgagaccattggttcttaaagattttacagctctcctgaacttgtcctgcacttcgctttccctggttctttacggctttcacctttagccttggctccctgtcctctgcttttgcctccctctgtc

SEQ ID NO: 34420 - DNA, 1103 bp, Mus musculus
gacatacatgtggtgcgtatgcatgcatgtaggcagaatatacataagagaagaaattaaagtccctgcatggtactcaataaatggggtcactgtggcttggggattctgattgtcatgcctaacagtgatgcacatcttcagtgcactgactaagccagaactcatcacaggcttagagatgtgctggtgctgtgtgggtcaggccctctctgttcccagctctctctgttcacagtcctccctgttcacaatcttccccattcacagtcctccctgttcacagccctctcttttcccagtcctccctgttcccagtccttactgttcactgtcctccccattcacagtcctccctattgacagtcctccccattcactgccctctgtggtttcagctggacggagcctccaggtgtgctgcactgggacgctcagttgctttcatctccccatcgtttttgcagataaacacggaggatcttgaggatgaccttgtggtaaatggggagagatctgactgtaccctgccggactctgtgtcatcagggaacaaaggaagggctaaacatggaaacgcagagaccaagcaagatggaggggccaccaaagcagggtcctcggaacaggtatagaggatcagtcacatggtatagagtcacatggtggtgggacactgtgaggcctgccagagagagagccccgaggtgctggccacatccaccctgcactaccagtttcttgaattcttccgaatttgagctcaattgtttggttgccctgaggaacctgggtgggtttcctgtagaaatctgaaggccagcagttgcataagtgtgtccacctgctcttgtgggagagcctgtgcctgatgacctgatgagaacatgcagcctggtgaagctcgagttctcacgggacttggctacaggaggtgttgtggtggagcagaggcctcatagagcccctggcccagggagccccttctgcaggggtggtagagcacagcagggaatggttgccaaaatgaagatgggatggcagcgtccaggtggctgggtggtcctgtgagtcatctactataggtcatgggaaggcccgaa

SEQ ID NO: 34421 - DNA, 1207 bp, Mus musculus
gttagtgtatgcagccattcagccatcaccaccatctgcgtcagtcagttttaaagcaggccctactgtgctctgcggttgtgcgtgaagggtggagtccatgcgtcgagaggccctagcttggcatccttcatttgccacctttgtggtcccagctgtagcatgtatcacacttctacctgtttgttgctatataactctatctgtgtgtagaccaaatcttgtgtatctgtcatcagttgatggacgtttaggttgtttctccggctgttgggaatgtgtctgtgcaggttttgtgacgatgcatgttggcgaacaagtgggtatgtggtattagcagatcacaacaccagttgtatctcctggtataggaagctctccctctgcagcttacagatgtatgttgcgctaagctagagtcattcaggaatgcctaggaagtctgtgtgccatccctcatcagggtcccagttacatgacctccttccttccagaactttccttgttgtgaatttttataatcattgtgtctgtgacacccccctctggtgtttgtggcccacagagagagccctgtacagcatggagtgtgcattccaccccttgttcagtctcaccagtggaacttgcaggctggattatcgcagacctgagaataggtgagtctggtccaccctagagtgagtaacgggtaccctcaagtcacatgagtgactgttgtgatacaagattgtcctgtccctggggatggagcagggctctgaaggtccagggtaccttttaagctttgacgtgtttccagctgaactgcagagggctggctcaaagaaccaggcatcagactggccccaaattaaacctgttcaagttacaagtgagcataacaagccatggagcagtgagacctggagtcatgcttctcatggctttggagggacccccccccccccatcccagggaggttgaagttctgcagcgcactttgtggctgtgtctcctggttctgaaatctgagatgagcttaggtttagcttgacttcagagatcacacagggagcactcccttctggccttctctgagcccgaccaccctctggttttagctcatgcgtgcccttccttccttcctctgcttctctgtatatccctgggctgccgtagcaggccatcccccacctcagtctcatccactgtccactggtgcact

SEQ ID NO: 34422 - DNA, 1168 bp, Mus musculus
tttcacatacacttggttagagccaagcgtgtggcacctatgtagagacttggcgtccagcgttcagaagtagctctcttgagccaaggatggttcaaggtcagacttggcaacatagtcagatcccatctaacaccagaaaaacttcattcatgtgtaagtgcgtttataactaaacaaagaggacatatttcctggccacttaggaaattgggggacgggggggacgggacacagtgctggcccctcggccatgttctgttgcttttctgtcactctaacgcacgggaactgtctctgacccaggagcttctacctgaccctctacaagcagatgagtttcttggagaaacgtggatgcccacgtactgcgctggagtactgcaagctcatcctgaggtaagtattcacttggactgtgtggccgcctgtgctcaccacagacccgtggggactccagccgtgacagcatttcctctgtctcccttgttctccacaccctgctgcctccggaagccttgagccagatgaggaccccctgtgcatgttgctgcttattgaccacctggccttacgggcccggaactatgaatacctgattcgcctcttccaggaatgggaggtacgtgtaagccgtggaaactcgggccttgaaaccgcagctgtggctcctttacctttctggcccacactgtgtatgttgggggacagccttaggacaagatgctgggagcctgactcagagtgcaggtagagcaggcagatcaggtagaccgggtagatcgggtagatcgggtagatcagggcctccggcttttttggctcccttgttattacttttgctaaagatccagtcttcctagagggtgttccagcagccctgtgggaacttctgtccacagacctgaactgaaaaagtgtgcaaaacagtggtgctagtggtgatgaaaggttggggacacccaggactccctgtggtcacacaggtagcagtcacgacgcagggtgccatatgagactggcacaggcaacctctgtgcacagactcacattctgcagaagtcctggacagacagacatataaccataaccagtcccttgtaccttgccagatttgcctggaaataaaactggagggtgagctggaccgcactgccacctggcccag

SEQ ID NO: 34423 - DNA, 1125 bp, Mus musculus
tcagcattcaagcagagagggggacaagagggttagaagttcaggatcaccctctgctacataattaagttcaaagccagtctgagttatatgagatcccatctcaaaagagatgcatgaggggcctagaattcaaagagacgttaaaaaaaaaagaaattgtcctaagcaggtaaggaatactttacagagattaaagggtatttgatctagggatgagtggggaaccctgaccaagaacccgagtccagtggcaggaacaaagaccatagccaggcaaggccggaggtctgtgtctcataagctgtttgtggaaagctccaggctgctgaggtgttacagctgtgtcaggtgtctcccaggcagcactgacggtttgcatcccacaaagcctagcggaggctctagtctgtggagcagagtcttagctgtgcaatgacagcgagggccccctaaatcttggtccattgatgccttcctgggagtctacgtgtttcagactggatgattgggtttggagtacacataaaacacgctttaggactgagccattctgatgtaacggtactggctggcaggcccgatggcctgaattcagtccccaggactcatgtgctgcacagtgagagctcgctcctgtagcttgtcctctgacctccacacaatacactgccaggtgcacacctacagaattacacccaggaaatggaaaagggacagtttggggttaaagcactgtgcagaggcccaggctgtgaacttaaagcacacatggagggtgactcacaactacccatgattccagctccagtgtacacttaaggaggtctcttaataggtgctctggggcaaggggccctggatgtgactgagcaggggcccagagcactgccccttcagcagaatattgagggctgacttgtttccatctatcagcctaatgtcatagcccattcctaagggggccatttacaggagggactccgtgttcaacgtacatgcctggtaagaggtcacaggtcacatgaattggtgctgaatgtctttttttctccagcatgaattggcaaggccatgaagtctggatacaggctctacaacttctgctcgtgggtcagcaggggc

SEQ ID NO: 34424 - DNA, 1267 bp, Mus musculus
ctggggagggcaggcctaagggcatggctcccaccagttgcctcacctatccctgggtttggtgggatgatctacacccagtcctggggagggttactgctgagatgggcctcattcaatgtgagtttccaagttggaatggcctgtggtgagtttcagccaaggggaggaaggactgcctaggaatggatgtatgttgtggaaatgacaagcaagcgcggaaaacctggcatcctgcctcttcctttcagcagctgtaagtccatccggatgaggatgtgacatctggagctgcagcagctattctgcaaccacgtgacaacgaattccaaaatgaagagccatgctctaggaacagtgaagcagaggataccccaggccttcaggaacgtcccacctgcaggcctgtttcctgagaggccatcagatgatcggcttcagaagtgttgctcagccttgcaactgaattcatttctaatggtgaaaaataaaaccagtccttcacaccacctgtggatcatcatcgggaaaagtaactttctgagacagagtctcactgtgtagcccgtagtggcctggagcttgctatgtagaccaggccgccctttactctgtagaccaggctggcctcggagatccgcctgcctctgtctcccaaatgttaggattaaaagagtgcaccaccacacctaacctgcatgtcatctcaacagctttaaagtctggcctgtcacccaggtaggggtgacagtgtgtcccgctcctcccgtacctccctggcccctttcccaagaggcgcctgcctatgtgttctgtgcagaattgttggtcatttgtgcattttcatgtagtcagggagaaaacctgtttgctgcctctcagagaaagttcacaagaaatgaaagactttgaaacaaaaacatggtgatatggcctttttaactttgttttttttttgtgtgtgtgtgggtgttttgcctgagtatgtgtctgtgcactgtgtacgtgcccacagaaaccagaaaaggacatacaaagaggctgttggatcccttggaactggagtcaatatccctttttcctttctatttctttttgttgtttatctatttgcttatttttcgagacagggtttctctgtgtagctttggctgtcctgtcctcctatcctggaacttgcattttatgtgaggctggcctggaactcacagaggtccgcctcctctgcctcctaagtgcttggattaaaggcatgcgctaccatggc

SEQ ID NO: 34425 - DNA, 1104 bp, Mus musculus
ctcaagtaaggggacaggaaggaagatccagttccaagaggtgtgtctcataggagacagctagaagcaagggcctgactagactggagccaagtgagaaatctgccctcttgaggcctagcacagagccggctgaagagttccaagaccaagtgaaacccctccaggagtaggacctaggattccagactttctgtcagacacccttggataagcctgtacccctgggctagcccttatcactggggagttctgaggaaatgccaccaggggagcatggttagaggtagctgtgttggctttagggggagggtaaggattgaggctgctttgtggggttgccctgctatatctaccccatgtccccagccttggggaagtgaaggagccagggtgttgttggagaaaggggatgagccatgacgagcctgggacactcatctcagccgtgctgggccctgcaggtgggatgctatggaatatgatgagaagctggttcggttccggcaggcccacctcaaccccttcaacaagcagcttggtccgaggcatcatgaacaggaacccagtgagaaggtcacttctgaaggtgagctttggtgcagggtgacaccctgctgtgtagattgacaacttagatcaaccctgtcactcttcctgcttgtagcccttccagtgggtggtcatagtcacattccacctgctctgaggttttctttgtcttccttttttttttttttaatttgtttttgggttttttgtttttttttttttgtatttgttttttttttttcaagacagggtttctcggtatagccctggctgtcctggaactcagcttgtagaccaggctggccttgaactcagaaatccccctgcctctgactcctaaatgctgggattaaaggtgtgtgccaccaccaccctgccttcttttgtcttccttatcagaatgaacctaaaagaacgggagttatcaacctgtgggtctcaaccctttgggggtttgtgtaaccctttcacaggggttgcctaaaaccatcagcaaattcagatatttatattatttataacagtagaattgcagttatgaagtagcagtga

SEQ ID NO: 34426 - DNA, 2472 bp, Mus musculus
tcgagttccatccctgcaatccacatggtagagagagaaccacctcttgcaagttgttcctgttttttataggtgtgtcacggcatatgtatgccttggcatgtgcaggtacacacatacacacttgacaagagcttgggtatgagtgctggcggccccgctcgttaggagaagccagcagctgcgtaccaggctttgtggaaaatcctgcagatgccgattctgtttctgtcctgtggcagcagcgagcctctctgaacttgtaggaggatactgagaactggcctagggagggaagtcttctgggcagaccccagcctgtctttctaacctcagggactgttactacgacaactcgaccacgtgccccaagtgtgcccggctcacattgaggaagcagtcactattccaggaacctggcctagacatggatgcctagaacactggagaacgccaggcaccgtatccacccctccggctggtgcctgctggccttgcccaccagatgtgcattctactctggagacgacccccccccccccagtatatcctccagacctcttcgtctcgggccagaaggaagtgactagtggccaccgggactcattcctcaggtgcttgtggagacttcgagtgtgtatacctggctgttgattgggtgtgctgctatcggggggtcaaaatactgcctgtgccccattgtaggactccttaggcagaggagcctgggtgtgactctccaggaaggtgggggagtcgctctcttatggcacagagccctccaggcctttaaaaccaatccttctgcaccatagagatggccttgctcctgtctagtacacccttacaactggtcagaaacttgagaggccagtccagtaagaccagaggatgcctcctgactgagttttatctctgctgaggaagatttaggttctactcagaggcacccaacccttttagcaccttgtctcctgagggacgtccggttttctctgactggggctgttcactactgtgtcccgtggatcttcccctgcatcctgagagttgtcatcgtcatccttaatctgtcagtcacgtgtgcttccccacccccctttgtacaatagggagggaaggggtctgtggaacttctcttggcagatacgcctgcttctgccacagcctagtccactttatcctggtgctctgagccgggcagctaggaacccaccctaaagaggcttagcatccagttccataggtgggactgtgtccggggaggaggttctaggtcaggtgagcctgtcagttatcattggcctcggtggcattcgggggatgaagcttttccacagaggtcactgtcctgctgacgcagtgcactgcttgaagatgaccagtcgctgggtgttaacgtaggagcctgaggtcaagagctaggaatatttgctagacccccagcaggaggcccacggcccatacaggaaggtctaagttttgaaggtgggtggggcctacacctttccacctccatgcacacaccccataaatcctacgatggaagatgtgtggagacgaggggaatctcacaataatgtggctcctgtctttcttcctgggaggcaggagttggttgtgtctgcccctttgctccttgtctgtgaattgctgttgacacacacaactagtgggcaaaggccagggcatgtcacaacctggatttccttcacctttaatgaggcacaagaagggacttctcaactggccagttgaagcttagcttactggcgtgtttgggggaaggacggacacactgccacctcctcctcactgctctttgccatcaggtggctttactcatgctgtttttctgtttcagttttcccatctggaaagcattggggagggggagttgacctgcctcagggtgaaagatcaggagtcctttgagtgtgatgtgggtcaacaatgggtccctgttccgcttcctctttggcgttaaagagggtcttaaaaccaaatgccatttcccatacccccaaatctgtgtgtttcctgccattgtatcacatgtctgtcctgagtccttggcccttcttgagcctcctgtgtaatcaacatcacgtttccaactataaatcatagtgtctaaaggaaatgttactagtctgccatttgttgggcaaagtcttgggccttctctgagagcacactccaaacctccttcctccatacttcacttccaccattgccttcaggatgatgcagatctggtagaaacatgctatgagtccacgggtgggtatgaagagtctagccagcaaccgaagcccatttggatggctgacactttctggaagagtatacccaatggtatccatcatggaaccaggctgccagcggggaggcctggtcacaacaattgccactgtgatcttggtctcattaattacgggatatctaggttggtgtgtggtgaatctggga

SEQ ID NO: 34427 - DNA, 1138 bp, Mus musculus
tggtgtttttagcaaataaataaataaataaataaataaataaataaataaataaataaattggtgttaaagtttaggactgcctagcattgtggtgcatgcctgtactcaggaggctgaagcacgggcattgtaagttctagtttagcttagcctgggctaccaaacagcttctgtttgaagcccgcagagcaaaatgtgactgatacttttatgatctaaagctgctctcaacgcggtctccaagttccccttcttcctctctctctctggggttttgtttgtttgttcaggtacattctgcataaatgtgtctgtaggctggagctcagtactgggtcttaatcacttttcaggatagctttaattttcctaactacatttattcattggcgtgtgggggagggggagagaggagttgtggaaggtggagaacagcttttgggaatttgtcccctccttcatcacctgcgtcccggggatgggaatggggtgcttgtgcttggtggcaaagtcctttcctgatgaaccatctcaccagcctacacctggagcttgctgggtggtctaggctgactgccagcatgcctcagggagcctctgtctcttctgccctggcactgagtctgtaggcacacacgtcagtgcctcagaactcagatccccaactttgtgcagcaggcatgtaactgactcccccccaccccccaccccctgccctggtttggttcttgacttctcttttttttttttttttttctccgagacagggtttctctgtgtagccctggctgtcctggaactcactctgtagaccaggctgacctccaactcagaaattcccctgcctctgcctcccaagtgctgggattaaaggcatttgccaccactgcctggcttgacttctcattccctgaaaatttctgtttgtgtggtaacataagattcttctttctctccctacattccccgcgccccaccccttttttataatctctgaaactgtagaaccaaaaaatgctggccctggaggagatggaggcaacagaggagggaaaggagatgattttccctggtggaaacggatgcaaaaggtttgtgtgtatctgaagaccagaatcagatgtgctgttccttc

SEQ ID NO: 34428 - DNA, 2947 bp, Mus musculus
ttctttggtcagatcaccaccggagctcaggacgacctgaggaaggtcacccagagtgcctatgcccaggtgaggagcagtgtccctctgtgtggccctgtgtgtggctgccttggacaccacttaccccgggcccctcctattcttcagattgtgcagtttgggatgagtgagaagctgggccaggtgtcctttgacttccccagacaaggcgaaaccatggtggagaagccatacagtgaggctactgcccagctcattgatgaagaggtccggtgcctcgtcaggtctgcctataatcggaccctggagctgctcacacagtgccgggagcaggtggagaaggtaagtggggcccaggttggggtgtggaccatgctgatctccgtgggcctacttagcttaggttctgtcatggatcaggaccactaagtgcatccgggtcctgggcacagcagcctgacgggtggccatccttttcaggttggcaggcgtctcctggagaaagaagtgctggagaaagccgacatgatagagctcttgggccctcggccctttgcagagaagtccacctatgaggaatttgtagagggcaccggcagcctagaggaggacacatcccttcctgaggggctgaaagactggaataaggggcgggaggaaggaggcactgagcggggcttgcaggagagccctgtgtagcctgtggccaccggggcggcttatgaccactgctgactgggagctgctcagccatcgcagagcagctgtcagagtaactgaaagactaattaaaacaggtgacaacttcgaacacacgtctcagataagaccatgcaaaattcacagaaaagctgctagactccagcatccagccaaggagatagctgagggaacaaaggtgtggcctgcgaccataggccctggacctaaggctggccggttctccaggttctgtgaagcctgagtgatgtctttttggagggattccaggtgtggggctgtgaggagctacattgtgtttgattaagtttccaagtgagcctcttacagctgcttctgaggtaacctgctcaagggctgagccctgactcagcacagataaaggttggtgaagaagtaaagaaaacataagacagttaaggaaggaaggcgagccgggcagttgtggattaaaggcagagcatgcctttaatcccagcactcgggaggcagaggcaggcttgattcctgagttcgaggccagcctggtttacagagtgagttcagggcagccagggctacacagagaaaccctgtcttgaaaaaccaaaaaaacaaacaaaaaacaaaaaaaataaaaataaaaaggaaggaagctgctcagcccttaggaaggaaagccagcgcaccagtagatgtgcagtggaggacagggaccgtggccaccccacctgtggcagcgtcagaaattctgtttcgtcagtcagacctggcttctagcctttgggtttctctgcctcactgatgggagtgtcagatttaattccgtctcacagcagtccttcctttctccagcatccatgccccccccccttttgaaccacagagggtggtttaggttgagccctctggctctggtgcatggggagggctttggaacgccaagcctccgtgggctgcaagaggcctctctttcctgttaatctgggctgtgtcgaggcctgctctgtgagagccgagtgcttggagtggagctttgggttccctggatgttgttgtggacttgctccaggtttcggggggacacagatctcagggctgcaccatccgctgcaatagcctgcgttggggctgctcgtggccctggggaggaatctacttgctcccttgactctgtaaaagtgtgtgtgtgtgtgcatgtgatagtgtgtcttcctcaactgctttctatctctactgttttccacttacatctgcacacgcacgcaccacggtgcacatgcgcagggcacaggacaacctctggagtcggggctctcctctgtgtgggttccagagatcatcaggcttggcagaggcgcctctacccactgagccatctcgccacccagtctaccttgctttttagatggagtctcgtattgagtctggctgtgtttgcaggtcagcaagccccagggatcctcccgtctctgcctgcccagtgctgggattgcaggctcacctttatcctggccgttccgtgaacgatgcagggctgtagtggatgttcatgcttgtgcacaggcacgctaccgaccctcctgcctttcagctgatgccatagcttcccgggtgcctggccaggatggtggaggcctgtccttctctttggggcccggctaagggccagattgggtggactgggtgtattagctggatgtaaagactatactgggtgtgcatggtatcgcacattctctaaactgtcacgctcgcctcagagatgtcatcaggagacagatactttcaattttcactgtttgtaaagtgtacattattgaattttaaaaaaattatttctaattgtatgtgtatgggagttttgcctgtatgtttgtatgtatgtgtgtgtatgtacatgtgcagcacatgcatgcagtaccgatagggtccagaagagggtgtcagatcctctggagctggagttaacagttgtgagccaccatatgggtgctgggtgttaaacttaggtcctctggaggagcaaccagcactcttacctgctgaaccatctcttcagcctcatgttattgaattttaaacccatatcatggtgtcaaccaaattattcactgagcaactcagggccctggggtcttgtgttcagttccctctgatgaggtggggtgatcccttggtgcccagaaggcctgtgacatggtagactctgtggtagggactccaggaccagcactgacctgct

SEQ ID NO: 34429 - DNA, 1193 bp, Mus musculus
ttccttgggctcctccacagtgaggaatgtgtccacaattgtcccttgccgctctgggtcactggggggctgtttctcacggttctgctccgcccttgttttcgtccaggatggtgaacgtaggcagctggctcgagatagtgggtgcagacctggtgaaaacacagaaaggtacagtcaagaattcagtaagatgggggactgagtctccaccttgtggctctgccagtctcagttgcgtggtttctgggtgcacataggcctgggtgtctgccactgcactgtttataggatatgcagggacttttctgatgtccctaggagtcactgggctttttttttttttccctctcattgttttttgagacagggtcttgctatccagctttggtggcctggagcttactacaaagactggactggcctcaaaatcagagatccagaaatgctgaaattaaggccatgcaccactatgtctggctcaagtcttgagactgtctgccctatcccccacattgacaggccactaccaaatccctgacttcctaagtagcttaatatatcttgcggccctgtaaggctgacagtgtctgtcccatcatgagacctcagctgctgtccagggtgcaggcagtatggggctaggataacagttgggctggagttgggcttccactctgcctgcctggccacagatgtcacgggccatctcctgactcagcatacacatgcaggctggaggggaaggcagagctaacaaggggtgtcaccagataaggttagactccattctgcaggagagctgggccgggaacccacgagagggagccggggtccaccttcatgctgctgtcttatctcagagcccacagctccctggatacatggagtccactccaccaacctccagaagcacgtgagctggcagagtcctcactgggactggtggtgcctttcataagaatgttgatttcctagcaattgggaggcagaggcaggcagatctgaatttcaggccaacctggtctacagagcgagttccaggccagcccgactgcatggtaagaccgtgtctcagaagagaaaggaactgtgactttcttcgggcccttggcatacggtataggccctaatcccggtcatgtgcgcctgtcttgacttggggctggggcttagctcctttgcttttccta

SEQ ID NO: 34430 - DNA, 2136 bp, Mus musculus
cccaagtgctgggattaaaggtatgtgtcactgctacctggctgagaccatgtctttaaaaagaaaagaacactgagccaggcatgttagtgtaagcctttattcccaactcccaggaggcagaggcaggcaggtctctaagtttaaggacagccagggctacacagaaaccctatttcaaaaagcaaaaacaagctgggcagtggtgacgcacgccattaatcccagcacttgggaggcagaggcaggtagatttctgagttcgaggccagcctggtctacaaagtgagttccaggacagccagggctacacagagaaaccctgtctcagaaaacaaaacaaacaaaatggaaggactgaagcatttgcggcaaaccttgtgttctggccacaggggttacaacatatcctgctgacatggggcttaggagaggatggaaggatggaagactggggtctcacccacacagcccactccagatgatagcacctcctcctctcctgaggagaagccactcaagtggtgaggggcccaggttggtggctgcccccgccttgtgcttagcttaacttaaagtccacacttagtaagttatattttcatttggctcaattgtagaagtcgagggaaggtagataggggcatagcaatgcaaagtatgagcaaggacaagtactatacacagttgggtaaaaatggtgtctttctaagtagggatctgaggggaccaggagccccaggacatccccagagcaccccctttatgccttttttccctcaagccagcgtgcagcctcacctgctggtgactcagtggcaaggttttcgtcatcggagtccgcaaagacctcggccaactcctggtcagacatgtccgtcagctcagtgaggtccaggagatcgaagtggacctccagagaggagacgctgctcagaggctctaggggttccaggagacacaggcacctctcagtcccacttgaagctaccaagagccttagggacctctttgcacagaatccacaggtgacccggcactttgggtattcatgtgtgctttcatacatatgtgcacacgtgcaggccagaggccgacgggggtcttacttacttctctgctgtaccttttgagatggggactcatataaccagtttgtctagactggctggctggtcaggaagtcccaaggattctcatttctgtctcctcagtgcaggacttatataaaagcacgtactgccatgcctgatttttcctacaggagggctggggatctgaactggggtccttaagcttacagagcaagcagtttacccattgagccattcccagaactggcacttcctgtaaagccagtactggacaagaccaggcagactcagcaaccgggtggctctgcacactctagaccggagagctttctcagcgcctccattctacagacaggacaactgcaagcacagttgcccttcatggggcagggctgccgcctctcatacgcaggctgctggatggatggatggatggacagacggacggattgtcagtgatacttacgcctcctctctgtgacctgcaggaaccctggtgctggtattgggatgccaacctcctcctcctcctctgccacaggtgtacggcacatgtcccctgtctcatgagctgaaacattcagggcagcctgtggtaccttgacgtccttaacgatctctgtaaccaagatacagtgttacctccacactcatgggaccccacatccctccaggatggggctgtgtggcaagtagggaggaacacgaggccctcgccatgatgaggggttccatttcatggccacaaggaagcagagatacgcggctgcttccctttaagctgtcctccctgggtgactgggcaaaggtgtctgccagtggatggagggacagacagacagaccactcagcactgcagctccagcgtgcttagtctgggaactctacatcaggtttgccagcattaggctccactgtctcccacaccgtagcttgtctagttatggtatgtttattagtcactcgtgggttcctgcctttcttctgggcactgactgacttataaaaaccctgtggagtgtttgagttcaaatggaaaaga

SEQ ID NO: 34431 - DNA, 1191 bp, Mus musculus
tcactgggtagtcctggctgtcctagaactcacgatgtagaccatgataacctggtacgcacagaggtccacctccctctgccccctgagggctgaggttaggtgtgtgttaccatgcctgccccagctctgtttttagttgagggcattcatagctggatatggcggcacaaacctataatcccagtgcttacgaggtggaggcaggaggagagcaagatcaaagccagtctaggctggttagagagccattgtctcaagaaaaccaaaaccaaaccaaaccaaaacaccaaccaaacagttgcagggagatggcccagtgggtagagctcctcaccatgcaaacctgagctgggccctggaacccgcagtggaggcagagaaccagctcctgacagttgtcctctgacctctgtgcgtgtgctgtggcatgcgcacccacacacatcacacactagtaatgaatcatgtgaatgtgagtgtacgagacgaagccctgtgctgtgtgtgactgccaacaggagcagatggaggacatgcgtaagaaggaggaacacatggagagggagatggcggaggtgactctgcagaaccggcggctggccgacccgctgcagaaagccaaggacgagatgaacgagatgcagaagagactggggaaccacgagagggacaagcagattctggtcgtgagtgccctgctcaagtcttcccctcgctgaaccctcctcttcctcagtgtaagagatcaagagactcgaggcatggtgacataggccctctcgttcttggactcctgggctataagcaggctggcgctgctgtagactagaccccggttttccacacattccgctcatagcttgggtggggcccagctgctggagtcttcccaccagttgttccttgctgtctccaggagtctgtggtatgtgagtgtctgtgactccgaagtatttatgtctcctaccccctatctctctgcagtgtacaaaggcacgtttgaaggtggctgagagggagctaaaggacctgaaatgggaacatgaggtcctggagcagaggttcatcaaggtgagcaggtgtgggcgccatggcgggctccgagtccaggagtaagtagggcctcctacctgagcctacttttcctgttctttgtttggaaatagggtctcaccgtcccatgtggcc

SEQ ID NO: 34432 - DNA, 1099 bp, Mus musculus
ggtcaggattccagaagctgggagggacctcgggtgggtggaaggggaagtcacgggtgggtgagggcgctgttgcaggaagcccgtggaaccgtccaggaggggagggaggggagaagaagcgaggaggggagatgtgtgtgcggccaaggctggcactcactggctgggcccgtggtgcgtccagggcaggcagaggagggctggtgggggctctgggggaggttgtaggcagcgtgaggcaggcagcgcgaagaagcgaggaggcacggtgggctggggcgtgtcgtgtgggtggggctcgggccgggctgaggggcgggcgtgtcgctgtgtggtgtgtgtctgtcggctgggggctgggctctggtctcggggctcgtgtgagctcgtcgtcgtcgtcgggcatcgggcgtcgggcgtcgggcgggcgagtgagcgagcgagcgagagcgcagcaggctcttggggcttgtcggcgccgcccaccctcacctacggccataccaccctgaacgcgcccgataaagtctgatctcggaagctaagcagggtcgggcctggttagtacttggatgggattccccctgggaataccgggtgctgtaggctttttggactcccctctgtctctctctcccttttggccacggccacggcgacccaggctcaggccagcgccatccacaccccacaaccccccaaggagcccaccctcgtcctctcacaggcttgccctctcacgggaggctcctggagccctaagacagggcacaccacgctgggcacctcggcaccaccctgctgagttagctagcaacgggacacgggacgggagagcctctctccatttgcaccgagcccaggctggcctgaacactccatcctcatccaacaccgcacttgccttccaccgtgtgtgtgtgtgtgtgtgtgtgtgtgtgtgtttgaaagagagagagacagagagagagagagagacagagacagagagacagagagagggagagacacagagagagagagagattctgtgtatcttgcccctcctgccttctgctaattcacctgggtccctgtgtgtgtgtgtgtgtgtttg

SEQ ID NO: 34433 - DNA, 1088 bp, Mus musculus
cattgttgctggtatccagcactcagactcccagctacagccaaagaagtctaaaagcaggaccccggataaggtgcgggacctgtccaagtcttggtggaggaagtattgctgcctggcctgactctcgcaaatagcaggtgtttaagctgcaacagctctttatggacgaggctgtcataggatgagccccaaagcaccctcttctgcccttaacttcctgtgtgcgggagcttagggctgagattcatatgcaaaatacgtttttttaaaaattgaaagttacattttttttctgttaagtctggaagctttgagctgtagacctccggattaatttatattccatatgaaaagggctcttcaaagcggggtgtcagcatgaagttctgctgtgttgtacaggacaaaggagaatgaatgggaccttctcctgattaagggctactgagggctcagtgcagggcacgtgtgcaccaggcttggtgagagtgagcaagcgtgagctttgaaaccacacgagccacccccggttttgtaagggcaaagatctgaaaccagcaagggccttctgcttacgaaacctcgagcccatcccttctgtttactcagattctcttaggattttaaaacaaccaaacatcccacagcctactggcatagtgttggcgaacagtgcacttgcttgttacggttttgttttgtttttttaaatcacgtgaccagttatattgctatgaaaatggtggagatgcctcgtagaaggcgagtgctgggtgcacatgtgacattttcttcagggagcgactcatggtgagaccagagagggctcttagcttgcaggactggcttctgcagggcatctgtgtcctgctgttaaaagcaggaggaggtgcttgtctgggagctttaagtgtgctgggctcatatcgtcccgtttgcaaggaattgggccaccttgagaggccatagttgatggctatgggacacacacacactttttccttaagtccaccaaaatgcctgcctgtacacacacacacacacacacacacacacacacacacacacactggctggtttgctga

SEQ ID NO: 34434 - DNA, 1646 bp, Mus musculus
aagctctttcacagggttgtaggtatttccaagacgccataggaaccagacagtgaatcatagctatcagtttgctgtgggcaaggaacctctttttggccacctggtaacaaaattttatgtctgtaaattttttcttgctatttaaaaaaaaaaatcaatcttacgtttttctgtaggaaaaaaaaaaacaagtaaaagaacaggccatatttcaggtcaaaggcttcttcctgctggtaaatgggactgaagactttcttacatcattattaaaaggctaattgctgaaccactagagtatatgaactgtttgtgaatgatattagccatagtctcctgaggtgtttccttgtggcctgagtggtaacattgttttgcttatggagatgctgtaactgacctagtgactcagcttatcctattgtgcatggctgtctggaaagccagcgtacaagtggggctttgcctgccctgtgtacagagggtgggtgggaaagagtgaattatttaattttaaatgttataataaagccaatgtagttgagaccaaggaaatgagcattgagaacacaaacttgaagtctggtgccagggttgttggacctcacaccctgtctctgagccacccggaagtgacataaaggacgctgtgtgatcaagttctggacacttttctgggatgcgtaccactggactatttatgtcacaaatctagtgggttgacgctgccctgcaagttttcaatgtccctgcatcctatgaagtcataatgtctgactgtactggaggttttcctgcattttttacttttcgaaaatagaggtttgggctgagaattctaaacgcatgtgcctgggtgggacgtcaagtcagggttctcatcaaagctgagaagtggctggaatgttcagcttggtgtctggggaggatcctgtgagctatgtagagaggtggctcttcagcctgactcagtgtgggctgaacgaagtacctgcagaacacacggtagcaggctccaaaatcgtcacctcaagcatgcgtgcaagcaaacttccgagaactccgttttctgctcggcagacgtgtgagcagctacccagaagtctcaagccaaaaggggagcctcgctcgctggctcctctgcaggtgccttatcgacctgtgctcttctcttttcccgtgtcaaagatgttggacaggatcttgtacttgaaacatactacaaatgagttactatgaaataaattctgacctgtggaccgagctgctcttgcttattctactgaaaggatagaagctcagatatgccttggcctggacaggttcagaagcttccctgtattcagggaaagtacctagtatcacactcactcagtacttcctgtacctagtatcatactcagtacttcctgtacctagtatcacgatcactcagtacttcctgtacctagtatcacactcagtacttcctgtacctagtatcacgctcactcagtacggctgtgggctctggtcttgttctgatggttggcaccctctgcatttgtttgtttgtttgtttgttttgttttccagataggtttctctgtataacctccctggctgtcttggaacttgctttgtagaccaggctggcctcaaac

SEQ ID NO: 34435 - DNA, 1327 bp, Mus musculus
cggagtgcactcgacctaaccggagcatctccagaactagcaagctctccgctaaactttcagtagcgccctctcccatttaccatagtggacatttttgttggggaagttgaggcaggaactcactctccagcccacctgggcccctaccttaggacaatcctcctgcctcagcctccctcccaagccctgggattccaggtccccatgcccagctcacaggctggcgagcagtgtgagccagtgttgatgcagtcaggtctgccgggctctgagccgtttggtctttacaagcacaggagtatctgaatcacgcttaacggttctcaggttcagcggtgggtcctggagtacagccgccggagcctgaagaggctggagtttttactaccatcttttctactcggcacagaagtagatcttcctggggaacggtgtacgctggcagccggggctcagcagccattctgcgaactaactcagcggacagtacctttagatgccacatgtatgcagacccctgccccacacgtacccttcacgttctgttaaatccagcttgtgctgcccacagcacgttcccacagcacagagccggtgtgacatgacagaaccctgcactcagtgagctttctttttaaactcccaggaaatgcagttgtgaatgtgagagagcgtgcttttctcattgcgcgttggttaactcccaggagatgcagtcatgaacgtgagcgtgctttcctccttgtgttggttatgcgtatgacccggtatgaaaggactctggtgtgaacagccagtgcgtttcttatttaatccctctccccccaccccttttacactgtttctgtgatccacacctgaaatgctaaacccacaggactcattaacacctggaaataaagtggaacggagtttctcacgcacagtacactgtcctgctctgtgcagtcgcgtgagcctgcccaggctgctcggcttccacgccaccctcaccgtctcccggccagaagacacactgttgaccgcaatgcttttcctgaagctcagtgtaggggcatcgaccgccacctcttcgcatgggtcgttgtttcgtggtcattttcaggaaactcactacctctaggacaaaggatattgcttattaagaaatcctggccaaggctaaagtgctttggtttgcatgtgcaaggccccgggcttggtctccagcaaacacctccataccacacacctacggtcacacctaggtcagacgtgctgatagcacacctataatccctgcactcagtgaactgagacagcagagggcgctcatgagttcaag

SEQ ID NO: 34436 - DNA, 1293 bp, Mus musculus
ccttagtagtgggacagaccatggaagccatagatgctggcttgtttatgaagacaagtccccaagtcttgatattcttgtaagagtttttattgtaaagattttgctctttggagatacccacaccgagtgcctttaaccggctctaggcgcttcccacccacccctcctgtagtccagtcagagctgctctttttcatcagctccacattccacagctggcagggtgtcctgtccactgttcaggactcaccgtgcagttcgccatgcacggagccaaggaaggcaggtatggagatccgggctgttctgaaaagccagagctttggcggctgcggaccgattacacttgataggttttgtttcatctcgtcttcatatagacagtgagacttcaggattttctggccagagcgagggtcaccttttctccctaagtcatcccttagacgttcatttaatgcatagtttaatagttctggaacattccagtgagcgacacgcagagagcatgttcagagcaacgatgacgtttcttttgagtcactttcctttaactgcagttggctgcttaagtctgaccgccattcctctcttctaagagagatagcggatgaagatattgagaagttgtaatctgcagtgacatttaatgaactgggtttgtttggcctgtggggatgggaccagcagacaccgttagggtgtccttgcctgcatcatgccctccttttacagaacttaatgacggctttgtgcacagtgctgatggtctaggttgaaaacctggctgcttgatcgctggcccgatgatctttgctgccatactgtgggagaatttcgggcaggtgctggcctgatggtaatgttcgttcttcctttaatagggaaccactgtcagggttttaaaaaagaggttttaaagaacacgtgtttccgtgagatgggtgccttggccgccgtgcagaagagactcccagaaggatgagcaccgtgttcttctggagagatggggagctcttttgcctgcacccacgcagcttctgagcctgctgggtaagacccagtgttgggtgtgtggctgagcattcccgtgatatttttactttgggttcttgagtatgataatttctagaatgcagactgacttcattccacgtgagactgtcacacgatgtcatctgaaaactgtatcaagctttgaaaatgcacactaaagaattttttttttctaaaaaaaaaaaccacttttaaaatatttgcctagttttgtacagtccccattcatgtaca

SEQ ID NO: 34437 - DNA, 1184 bp, Mus musculus
tgttcctaggcacagcagcctgccaactgcctagattggccttaggcaaggagcaagagggcgccacaaggcagagatgctgccatttccagtttgcagaataaagaattgggaagaattgaggaggggctttgctcactgttcccttgcaaggacaaggtttggtttggttggttggttgttttgttttttcaagatttttttatctgtgcagggacaggggagggggcggggagggggaacccgtggaagccagaagagggtgtagtccctgcagctggggtttcgggaggctgtagcctctcagtgaggtcactaagaactgaactcgtcgtgtgcagaagcagcaagtgctgtaactgagtcattgctcctgcccagtgtttcttgtttgtaagtggaaaggccgtctgcttcatggagtaggagcaggatctttatttaagtgtcataagcaggaaaggtcacaggccgtcaagacagtgaggtggtagagctgaggaattaatctgtgccatcttggtgtgttctgttctcaggggatggcattttgggcgctggctcctgtgctggtgttcctatccttttctctaggaatagtggtctggtgtctgtcactccaagggaaaatgtatccctgttagcagaagacctggaagagtctttgacctcctcagttggtggacggggcagtgaggtaaggatcgaagatcgtttaacatttccttcatcagcacattcacaccaggccgcgggcaaggtctgggagatcacttcctggttatcttgcacccagtctctaggtcttctttcccagagcagctgcttgtaggtcacgggcattccttctgctcttacctctgtatctttgagttgggacttgggacaattcatgcttccttctctcctttacctttcctaggagcagggtgcggggcgactgctggtgtggttcctgggcccagggggcacttgtggcatcacatacattgtgcagccgtgggattccggagcactggcagtgtggatgtcgcacacaccatccagcggctcctgggggtgctggttggggagtttcctgtggtcactcaggaaggtggccaggcttagcctgctgactgtccagaccctaaggtcctgttcccacctatgccaggcagacctgtatgccaccttacgagggt

SEQ ID NO: 34438 - DNA, 1932 bp, Mus musculus
ttctcaggtgacaactttaaaaagggaattagaaactaaaggcctaactaatttaagccactgacgcacctacctagggccactgagggaaagtttgacgcgtccatcctccattaccttctggcgtcagagttctggagcactacagggctgtacctgtccaaatgtgcagtgctcaccatctgagcaccagagtctgatacattttgccaaaggaagaagtcccgttctgtaaactggaaagcttctatttttttattacctccttgtttaatgactctttttgagaagcaaggtacagataaccaggcgttatcaacagaggtggatgaaaatccatggcgcatctgttgaagcatgtattttgaaaaaaaaaatacccattttaaatatgtgattcccaggtatattgtagttttatattttaaatttttattaataaggctgaatctgaataatataattttcagccttgagtatgatgactcttgcagaggcaaggcatcagaaggaacatcagcctttggaaagtatcacagttaagtcacatgtggtcctgctgctgagactctaagtcctagaaaccttcaggagtcaccgtgtggcaagtgtggctgcccttccaagcaccagagaacatctaactgcagaaccaaggctaggagatgaaactctgctgggtctggggggaaggaggctcctgaattgtttattgtgtagacatggatcctgtgaaggaaaaacttaaacccgagggtaattgttgcagcatccagttcatgttgacgatttcaacagtcatgaaataaaccactctggtttccaaaagaaaaagtagagtggctcacacccacctgagctttaaaaccagccagcgcttgagactttgtttcaaacagagattggaagagtttggaagccctgctccatggagtgcatggaaccttaactgggagctgccggataaaggtacccttgctctctgtgcttatggtttgtcacctacagtgtcacagctcttacagcagtgacagtggctaatgaatatgaatttgctcttttttttttcctttggtatcagtgctgttaactggatgttgcggaggaagtgggttttttgtttgtttttttgctggtgatgtagagcctgagacacagctacgctgagaggtagttaaatggacacacctgccgtgcctcttgatgagaagcagtgtcaccacttatgttacctggggaaccgggtaatgagcatgaggccccatggatgtgtgtgcaggtcttggggtgagtaggcagcacacctgtgacggtcaccttccactgtccacatctgctcagctccttgcagggtgtcctcagaactcggagttgttgcagatcagactggtgagaaagcattatgaaaattgaattgagtcatcacgttttctttcttaatatggttaacattttatatcagattaaaatttatagtgaacttaatctgtgtctgtgtgttatgatgctgaggttgacccgaggttctccacacatgctaagtgctttaccacgaacttacattcatgcttcagcctcatggctatcacttcttttaaaatttggtagtcactttattttctttattttttcccctctagttttccagacagggtttctctttgtagccctggctgttctcaaactctgtagactaggctggcctcgaactcactactgcccctgctgcctccatccacatattaatttcttttttttttaaagatttatttattattatatataagtacactgtagctgtcttcagacacaccagaagagggcatcagatctcgttacagatggttgtgagccaccgtgtggttgctgggatttgaactcaggacctctggaagagcagtcagtgctctcaatcgctgagccatctctcaa

SEQ ID NO: 34439 - DNA, 1142 bp, Mus musculus
agggtagcagcaagcaggcctggtgtgcataggacacccagatggccctcccaagtcttccttagtgatcctggcttttgtaagaggttggggaaggcggagatgaaaacaaggctttacatttcttggctctgggggggtgatgctgggatgctggtactgatggaggaccatctcctccttgggatgctggtactgatggaggaccatctcctccttgggatgctgggatgttggtactgatggagaaccatctcctcctccttgtcatcaccttccctggagccatgggcacagaagccactagagcacggtggcactgagagatgtcactgaggtgggtcagacccgagggccagtcttcacactgtgcttcacactgctcccaagaaaaggtgacacctcaattaaggtcgcacaagaccttacatgataagcccagcatctaggcctgtttctgttcacttcagtcaggcaagggagacacccacagggaggcaggggcattctgccctgagctccattcttctcactttggctttctgccttccctcttgtgtttcagaggggatggtgttagatgagaaaaccttccagggtgccctggagttcagaaacgtgcacttcacataccctgctcgcccagaggtgtccgtattccaggatttcagtctttccatcccatctggatctgtcacagcgctggttggcccaagtggttctgggaaatcaacagtggtttcgctcctgctgcggttgtacgaccctaattctggtaggtggctagtgacagtgtgggcagaggcatctctgagctgtcagtgacttctcctgatgcctgttcccaccccatgcctaggagagaccacatctgacaacactttcccatattcctacccttggaaatgggtcagcaagactgcccagcagcacccagcaaataccttctggtgccagcagccatgggtgctgtggactgtcccatacccacactggaactctgctgacatgtgctgacatagcaattctggatttcaagaggccttctgatggcttctgcctcagggctgttccttgactgtttttttagggtcttctgtgtccagaccagacagtttagatttattttgtatgttctgcct

SEQ ID NO: 34440 - DNA, 1187 bp, Mus musculus
gcaggggaaggtttaggagtactcagccttcagggaagtcacggcttgtcaaaaattaactggcacactcgtgtgtgtgtgtgtgtgtgtgtgtgtgtgtgtgtgcacgcgtgtctttcatttttgaatccagattgcccctgggtgggtgtacacatgcgacctgtcgggagccaaatttgtttttaaataatagaataaattagtaagtacatgaactatacttggatgagtttagatttagtcaaatagcctccttttttccccccataccgtatctcactgtgtaaccatggctggcctggaactggctgggtagaccaggctggccttgaacttggaattccaggtgtgcttcaccacagcagggtccccctcttctttgtatgagtatcattacagtgttagaactcagttggaaccggggttacggagttcaacgtacagattcttcatgtgatttagaaaactagagaagtctggcataatagttcacacctataaccccagcactcgggaggcagaggcaggaagatcactgcaagtttgaggccagcctggtctacatagtgtgctccaggaatgcctgtaatcctttgccttagttcgggttatatagctgtggagactatgaccaacgcaactctcataaaggcaaacatttaattggggctggcttacaggagcagaggttcagtccattaccatcatggcgggaagcatggcagtgtgcaggcagacgtggtgctggaggaaccaagagttctacatcttgatctgaaagcaaccagagaaagactctcttattcaggcagcctcaaggaagctctcttctacactgggcagaacttgggcactaggagacctcaaaacccacccacacagtgacacacttcttccaacaaggccacacctcccccacagtgccacttcccaggggccaagcatattcaaatcaccacatcccagcactcgggtgacagaagcagtaaagccaccggaagttccatctgtgtgcagtctatatatatgtagcgttctaggctagccagagttgtatagcaagaccatgtctcaagaaagaagaaaaaaagaaaaagaaaaaagaaaaaaagaaagggaaaggaaaggaaaggaaactagaggagagcctggcctttgggaaggttcttccttgtggtcagtca

SEQ ID NO: 34441 - DNA, 1187 bp, Mus musculus
aggcctccataggatactcccggcctgccgtccttaagaccactgctctcggggtcacttctactctccgggcctctgcggcacctcctgcattgcacagttctccaagatgtggagactccttggtctgccgaccgcacgaaggcgaaggcacccaaaggtctcaagcaagagactcaggtcgtaaggggcgacctgagtgccgcgcatgcgcactccgccagtgaccggcgagagaaagggctcggacgctccaggttcacaagtcgtggagggcgcaggagagcgaaaaagcttccgcgtgcggctggcgggcgcaggcgctggcgactgcctgccggacaaggcactgccggggagctagcggctggtcgccgcccaggggtggaccctacgcggcggaaggcgcggcccgggcgctggcccgatggggcgggaggggcgggccgctgctgcgtccccgccctgtgctcgggccgggcggggagggtcccggggcgtgcggcccggccggttggtgagactgtccgggcagacgcagcgccatgcgcgccccttctgctagggcgctactgctgattccgcgtcggggccctgccgtgcgagcgtgggccccggccgtctcctctcggatatggctggcttctgaatggaccccgctcgtacgcgcgtggacctctctgatccacaagccgggttcgggcctccgctttcccgcgcccctatccgggctgcctggcggcgtggggcagtgggccacctcctcgggggcccgcaggtgctgggtgctggcaggaccccgcgccgcacatcccctgttcgccaggctccagggtgcagctgccaccggtgtgcgagaccttgggaacgactcgcagcggcgtcccgcggcgaccgggcgctcagaagtatggaagctcctagggctggtgcgccccgagcgcgggagactgtcaggtaagaacctgggggtactagtgggccagtgggcggccggtgggcctcggcctggccttggccttgacaagggcgatcaagtctgctgacacctgttggaaagctatggatgctggctggcactccccatctgagcctattactagaatatttggtccctatcagcttgtcagcatctgctttggggcattctctgaataagttagagtttcctcctttaagaaaaaaaa

SEQ ID NO: 34442 - DNA, 1346 bp, Mus musculus
gaactgagaggccacacggacagcatcaccagtctggcctttagcccggacagcggtctgattgcttctgcctccatggacaactccgtgcgtgtctgggacatcagaagcacgtgctgcaacacacctgctgacggctcttcaggtgagcttgtgggcgtgtacactgggcagatgagcaacgtcctgagtgtacagttcatggcttgcaacctcctcctggtgactggaatcacacaagagaatcaagaacattaagtttttatccaggtggcagactgggtggggctggaagactggtcacagtccaggacttgctaaaaccgaatcagtgattgcaaaagagccctcccctatcccacatgcactcaacacagccctggtgcacaagactccagttgagagctgggaggctcccaggctcgaggcctcctgcttcatgcaggcaccttgcttttgcatctgtctctaccatgggtgtgctgggacaggtgcagaacctccctgtagcagctgtagacagtctctcctgtggctgccccttgagggaagtgggaacaggaattaggaaaggaggggatgacgtctttccttttccatgatgataaaaccaggatttttattattataattaataattttattattgagaagaagaaacctagcactggcagcaagtgactcctggcactggctataatacttggaattttgaggttcagggaattcagactttggtggcccagtgtatcaggagaaaggggcaccatgtgctgtgctctgtgggcaggcaggtagctactgaacatgggctcctgcagggatggaggcaaaggaggttcttcattggctgcacttgtgtcagcacttgtaccctggggagaagcactgtggtgagcagagggtaggcctcagcgttgcaccagttacccagggttccatccctacaccatcaacaaaattatgataaagaataattttgaataagtcacaagatagacttgagaaatgctggatttaaagaagactgcttattccaagctgtggcttattggtctttttccccctcgatgacctgcttccacctctctgcagtgtcggtagtgaacaggggatgaatcatgaatgcgcactcgcaagtattgaccatgctctgaggacaaagcaagtctgctaaaggattaaatatttctgttttctgaaaagagttattttgtattttgttttctattaaaatgtatttagtttcaaaaaaaatgtgtggcatcttatttatactttcagaatagccgagtgcatcactggacctagagtagtgggcagagcataagccagatgagacacag

SEQ ID NO: 34443 - DNA, 1225 bp, Mus musculus
ttcaggtggcagtgtcctgctacctcaaacgccggcagtacgtagactcagaaggccctttgaagcaaggcctgagactctcacagacccctgaggagatggcagccaacctcacaggtatcagggtcctatggatgtcccggaacgggagctgtcagggcccacatgggttctcagcaaagggtaggctaccaagcttcagtgagcagctctgaggggcactggcctttagacctttcctgtccctcaaaactatcctcactgaacttgtggaggccctgctagagccgtgtatctttcctcagagagtccagattgttttctgtcttcctggtggtaggtgcagcattttgtcccctataagaccctgagtgccttgagcagggcctctgctggcacagaaccttgctcctgggagggagtcaggcctatactgtgaactccctcagttctactgtattcacgaatatccctccatccacaatgtagtagctacatatgacattttcttcaggtcactaaagatgacatctggaagtcaaggtcagtacgacctaagtgggtacctgctgctgcaaggaatttgagggcgtctttctccgtttgcagagcttcagtgtctctggatgtcgtgtgaaagtttgccttaaagttacagtagaaatcaagagcagaatggtgtagactctacactgggttgtgcagaaagcttaagtttcttctttaggaagcaaactcaggccagatgtgatagacatactcctataattccagcataaggagacaggagaagagaggataaagtcagagggggcatgcttgcatgttaaagagtgagaccccaggctgctgctcctgctagcttcccggaacatgccatgctaagtgataccccacactccatcatccctgtggtgccctgtttcacatccaggcaataggcctgggggaaatccttctctgatacctgtccataacatagcaccgagataagaaaatgctgctcagggagaaaaaaacattttgagatatatatttttttagtgtgcattattttaaaaaaaaatggtgttttgcctgcatgtatgttttccctcctgtgtgagggtgccaaatcacttggcactaggttacatacagttgtgagctgtcatattggaaggcatggcctctcagattgacaaacccaggccatagcacatgtaccatgttaacatgggctaga

SEQ ID NO: 34444 - DNA, 1139 bp, Mus musculus
ctcagttcccagtacctccatggcgcctaactcatgactatctgtactctagtctccaagactctaatgccctctttgaccttcttggactcctgagtgcatatactcaggcacatatacataaaaaattttctttttaaaagatactgtccattttctggtgtctgttcagttaggccttattataatactattttccttttttaattgtagaagacgtgtagcaatggctgctgtttattctggtatttcctttaaacttaaaagcaagacaacttcctgggaagataaactaaaattagctcactttgcttggatttcccatcagtgctttctaccaaataaagaacaagtaagtttaacgtagaacttgtacgttttatgatctaaaataatttcatgtacagcttggatattaacatttaaaagattagaagacatgttggggagaaaacttgatttgcagtcactgtcagtgaagaagcagtggggcttttggattgctaggcgggaagttgagaagttggaaagtgctagtctgagggcaagctagaagcaggtaggtaccagttatgatgttctattgggatttcttaagttgctgtggctaaaaagtaggcagtgcagctgtggtaggatgacaagctcatggaatagggctggcctccatccagtgctggtatcagactgtattataattgtgagagaagtgacgaggtgtggtttgcagaacagttagcttacctgtcagtgtccacacctactacgtgtttgagtcatcttgacagctaggcagttccttggtcagcgctgcacaacatgaaacaaaagggtaatcctggtaggcttgagcgagagcccagctcgtctgtcacacctacggacagtgctgcagagtagaagtgagcaagggcaactcagtccagtgtttgtccagcacacctgaggccctggctttcttatcgtcagcatcaccaccaccatcttcacgatctcacacatatggcacacacagaagactcatacacacagctctgcgagctgaagcatcaccttttctcagtgtattgtgcttgagaaaacactgttacaggaatggaaactgcatgtgtccaaagcccttttctcccatagacact

SEQ ID NO: 34445 - DNA, 1194 bp, Mus musculus
gcactgcagccagtattattctctggggatctccctagccagagctgctctggatagttcaaacctccctttgttgctaccaggtgtagaaatggagttttggaagaaggtggaagagtgtgtaggccagtccaggtctctcagtaggtactgcttagaacagctgtatcttcagaaggtgaaaaggactttaatgcggagtaattcacaatccaaagaagcccttcaaaccttgaggtttgacactgctcacattcttgattctagcagagactgtttaagtcagaagacagcagctgcctgggataggcaggtgtcgacaatgaatgagtccatatatcctgtagcacactggcacttgattgtatcaaacctcacagttttaataccctacctttgtttgaatgatgtgagatatgtggccactgtcttgttaagaactttaccagcaagtaaagcccagggaagcttggcacatggtgagccacatgtcacacttgagaaaatatccacagccctccttcacagccctctctttccagagatgcagtccctctactctgccttcctgacgtgtatcattgcagaatgttccagcactctgtgctctggagctcatagtgacctgagtcttgttagtcagcagctcccctggctttctggaaaggacgaccacacaatcgtggctcactgggaaaccagattggcaaaagttggacctgaaggtgtagaaccaagaggagaaattgcccagaattttctatccatggtcaagagtggttttccaatcaagctggatgaagaacagctaaaaggcctcctggagctcttagaagtcatctctgcccttcgcctggacagcctctcgccatcttaccacgtgcatatgtttttcctgctattctccatggctgtctccacattagggcattgctcttgcccactagccctccagttcttggtgaagtgctaccggctcctcagtagtctgcagagaggaaagaatggccgcactgtattcagggttatgtacgttagtgacatctttgaggttgtgctgacctcactgttgcaagccagtgccgagtttcaggttagggaggatgaccctgcttggctgcagcttcttcaggtgtcaggggtgttcttagagcagctgatgcagatgcttacccaagtcaagctgagcttggt

SEQ ID NO: 34446 - DNA, 1640 bp, Mus musculus
gtcttagcgagtctcaaggccagggttctggcttcgccaatttcatgctgctggctaagcttcagggtttttagcatattgcctgggtttgctgagaaccctccttccttccttgccaggtaaccttgtacccacctgtgaagaacctgcttcaggaggggatttatctcatcttggatctttgcatggagcgggatatccagtttcttcgggcctcactacaggctggagcgcgagatgtctttaaggatctgcacagcgactacctcaagtaccacaaggccaagcatgaaggagagaaaagatatacggcctaggtcacaccacagaatcacctgggacaccttgcagaacattcatagttcagagtcctggaggatgtaaggcttctgacgttctcatacacgttgtcaacaaccatggaaaacacacacacacacacacacacacacacacacacacacagtctcactgtatatccttgaatggcctagaactcactatgtagaacaccaggctggctttgaactcacagagatccctctgctttctgtatgccgagtctaaatgtatcaccttgcccaccttggggattatatatttttatagcttttttttttaaatgctaaatgttctttgatatcccacccctccagcaggataaagattgaaccaggccctcacacacactaattgcacacttctgcggctcagccacacctgcatgcctcagtgcacctttgaaaactaagtgtggtataagagacctggaaatcgggactgggcttggtggtgcacatctttaatcccagcattcaggaggcagagggaggtggatctctgtgagtttgaggccagcaaagccacacacagaaaccttgtatcgaaaacaaacaaacaaataaacttggaaatgggttctgagatgaatttaatggaaaattcctgaccattatgactgtacctaatgtggtcctttctttcctctcttctggctgtgaactgcgtagaattgggtctataattgaatcctgtgtgagtaattctgctctttaagttaaatcaagttgcacagagacactttccagctgctacactgtgccgtcctgttgggaattctagtggtgctggggaacagccagggcccagcagggtggtgtgcacttgtctggtagggaagtcctctagcacaggagacaggactcctgcttgttcccacttcagtttgagaagctgattacaaatcttttcctactcagttcaaaaataacgttaacagttcttacgacctaagcaatatatcatagtggtcttgattattaagcctttattatcgcttggaaatgtcttgttttagagtctttgctgtatatatatagatacatatgtgcatatatatatatatatatatagtaaattgatcaaaaatgtgttttaaggtttcttaatgttttcttttgtaatggctgtcattatcttaagagttaataaaaaaatttggtattttttaatgtcacatagtattctgctgggtagacatagttgcttcatcaaataagttcccctcattgtcagataaaggaatcttacatacttttccttttataaatattgcctatggctagattattttctaagac

SEQ ID NO: 34447 - DNA, 1211 bp, Mus musculus
attagctttaggtgtgaagaaagcccaagacctctttgtgatccgatggagaccctatagaaagagcagatcaatgacctggggttctgttgtcagtgagccataaaatgttgtcctggctcagggtatcatggtttagtgatctgcagggcaagggagtgctgtgaaaactgcagatttggggctggtgagatggctcagcaggtaagagcaccgactgctcttccgaaggtcctgagtccaaatcccagcaaccaaatcccacaaccatctgtaacaagactggatgccctcttctggtgtgtctgaagacagctacagtgtacttacatatagtaaataaataaatcttaaaaaagaaaactgcagattttgaaatttcagtagtgctcccattgaggtagcaaggtggatcctgagagagagacagaggatgccgccaaactgtggagtgccatcttggatcccttagtgggtttaaacactagacgactctccacatttagctcatccccttgataagagaaaatgtgcgattcctttagcgtgtacaacatgactgtgaggataagaagagcagctttactgagagcctgtagattttttttttttagcgataagtagatggcatttcttctgtgtttggtgctgatcacagcgggctcttgttccatctttagatagttcttcatgctctgctgtttcattcccaaggggccccaggcttcagggttgtgctttggggattgtctgagggcatcctgttaggatttctgctgcttcagcagccaggccaggctgtgcactgtgtgccctgcctgctaaacaacaagtctgagaactgctgttctccatttagcaaaacccaggaagtcagctcacctcagactacagactgaataaactaaggagctgaaaaccagctgtcagcatttgctggaaagcccggactcgatgctgtgattccgcagggcagaggctccacgttaaagcaatttatgcatgatgtttaaaattgcatttcatttgtataggtatctccccctgccatatttactcttgcctccctagatgatgatatgcacttcaagaatgcctttcctttgagcatcttaaatgctttaaaattttaatcacgttaagtttccctggggccctggtatgctggcagtggatggcgctgcataggagggaagggatttctgttgaaa

SEQ ID NO: 34448 - DNA, 1137 bp, Mus musculus
tacagatggttgtgagccaccatgtagttgctgggaattgaactcaggacctctggaagagtagtcagtgctcttaacccctgagccatctctctagcccaagccactgtcttaattaagcacctagagccccacgggctctagttgcttgtttcttcctgcccacctgcccctgtatttttgagaaagtcagtctccctcttgtctccctttccacatagagcagctaagggtgaactctgtcacccactagggttcctgtgcccacttccctgtcgtatcaggtactgagtgttggaatgctcacctcttgtcggtgacttgaggtctggccttgccttgagcagaggtgcttgtctacccacatggtctcagctccttcctgccgaggtctcttttgatgcaagacctcagtagtgcttcccacaaaggctgcccaaggagcttgagaacaggccgggccaggcgggcagcttgcctccctggatggttactgtactctgatgtaccagagaagctcaccacagcagaacttgaccttgctctctctgggtcggaagacttcctgacctttggcctgagcattgtattcgggaccaactccagcctcagaggttctcctgggagtatataccttagtctagaaggcctttctgtctcacttcccagagactatgggcccatttggagtggaataagaggatgggggaatcaggcttcaacaccagtcagctcacctgctgagactgatttttttaggctcccatcctggagtgggtttgtgtctgggtctgccagtaccctcctgacatggcttggtctgtaaagctgacttgtccatacttagtcttctccggtacgtgggcctaggaagcatgtgtcatgttgcacagattggatttcgtgtcagcaggctgacatgtagacagtcgtgattcacaggggctgggtatgtaggaaagcagaccctcttatttgaactctcatttctggagccatagtttgggctttcctaggagccatatgtcatcccgaggctggtgtgacaaaacttcagtggacggtggctgtcactggccaagctaaacctgtcgcccatggcccagcctatccttgcaggctgtcatcctggtgaat

SEQ ID NO: 34449 - DNA, 1174 bp, Mus musculus
tagtgagtacaataaggatttttccctttttcagcctgctcttgcggcctgccttctcaaaagctcgtgcgatagctgcttgttacctctgcacacagttggttgctcactctgcgaggtgtcatttccagggtttgcccatggcttcctggatgttgacttacaatttcttctcaggccatatgtctctggatgccatgtcaagtcccttataaggtgggcaggtctgtggaggcaacctgtgactgtgggagggtttcagtgagaaaaagagctgggtgggaacactgggcaggctgcctgcctttgagcttcgtgtctctgtgaacccgaggctctgggtcctggagtgtgccggaactgacagtggcttggcatatcgcctggaaatccagctgcccgaggcgctgggtttggagctttttgttttgttttgctctggtccccagtgaagcagcaggtaccgttcatttcacttgtacaaggcacagaagcacacatcagcgatgatgaataatgccagggcacctgctgcgtggtggacgggagcaaaagtactactgccctgggactgcttgtctcactgcctggggctgtggggtcataaagctgctcttaactggctctgctgaccctcaggagtcatgctgcagggcagcgtggctgtgccgcagtgaggaatgagcccgccatgttcccctcggtggggctggagtggtgtccagtctggatgcttctagcgagtccatcctgcatagcctctcattcaattctggtagcagtactaactgggcaatgttgttagcccatagttcccatggtccggtagtaccggggggttctgctgaggcctgggactagaggaggaagcagcccccgcagcagggtaaggcctgggttcttcggaccctctctgcaggacgttgtgccccttcagaatggtggtgctgaggtatgaagtcttaggtctacagggcggtgccttgcttggttggcagccaggggagactcttcctagagtgtgaacagacatggtgtctggagggcacaggtgaatgccattgacaggtaggggggtgtgtgtgtacgtgtacacatgtacacgtgtgccattcattaaaaaaaggagaagcacagcactgaacttccacactgccagggataagaggagttt

SEQ ID NO: 34450 - DNA, 1189 bp, Mus musculus
atacatgttcattactctcatttgtgctcacacgcctgttcgtgtatttcatgtgtgtctacaatataccataatacacgttgtacacataacatggtgcccacggtacatgcctatttgtctgtgcatgtgacatgtgtttgcatgcatgttctaacattccaggtgaactccccagagacagcctggccactgtttcctcagaagccgtagtgagctgactctctcttcctgcagaaatccccagggatcctttaggatctccctccccacctccactccgttaagtcccagcgcctgcactcggatggaaatgtttgctgttacgcttctcggtttgattaggtcgttggattaaattaattgtcaggctgcctggaactaaagcctcttaaaatgaaaactgttttcactcaggaaatttatgcaagatgaagaatgggaaaaccttcctggggaggaaaggccgggtcacctgaatctgcctgtccctgctccccaaagccaggatgtacacgccagcaggctccttttgttctgttctagatgtgtctccctcttagagcctcttggttacaagtgaaaaccgcccaggacaggagtaagctgaagagggaacgcttggggtaggagggcatctcacttcaccaagaggaaggaaggctgccaggaactgggacctggagtcagcctgggccaccacagtctagtggcctggttctgtgccccagatcggtggctctgctactttttcagtggaggtgttttctgctcagatcttgtatctgtctgtccctagtccagcttctcagcctgggctgagcctccttgagggaacccacgagcccaatttaatatgggctcctgctgcgacctatctgcagagggagtatatgtcatgcagatgagggtagctgataatggacaggacttggatcatcagaaagcattttgtacctccgcgttgtgtttgtccttagcctgagttgctaggatatggtggagggagaaaggaaggacggtcagcacaggtatgaaggtgcaggaactctgttctgagaagggccctttctggggtgggatttgctctttcttatacgagttaaacagagacctttgagcctctttgtggggtcgaggtatctgtgtgtggaggaaggctgtactgttgagcttccgtcaaagcttg

SEQ ID NO: 34451 - DNA, 1182 bp, Mus musculus
cctgtgcccgcccgtcctccctttgccgaggacgggcgttaactgtgaggctctagccatttgtaggactgcctcacagcttctgagggctgaggtgatgcgtgccatcgtgtcacagctagatgggtctgcaggccccctccgtggcattctcacaccctactatgctttctgaaagcaaatggtacaacatcacagcaaggtgggacctgtgtccagctgcaggcagatggtcatggtcagagggaggagctgctggagagtcctgacagtgattgagggatcacaggagctcctgacctcagtgcagacaggccttccgtggagctttctggtccccaggttcagctatgcttccctagtctgtctccctccccctcagaacatgaacgcttcagtggggccagacatgagcctgcctttgctcatctgcgcctttggaactagcatgatacccgcctgtgaccagtgcctcagagaccccgaggcaagtgtgtgagaggtcctgcaatttcatggtctgttataccacataaaaccttctccatgactacatgtcaccctagagaagacataggactcttgactctagtgaaagtgcccacaggaaggagctgaagcaagactgactggtgaatgtctgggggaggcgcaggctattctagagccttctccctaagaataggcctgcatatgaggatgactgggtcctgtctgccatgctggggtttctcgggcagccacactgttcactgctccacaggctgggtgtcctcacagctgcagagagtattcctaaggaggcctcacaggaggctgtgcaaacaccctgtcttaggctgtggcgttttctacactgtagagatgtgcccctctcccgatggccagtgattctgctgacagcagtgggactcagggaaggaacgttttaggcgtgttgagtgcgtgggctgttgcaggagtgagcagtgaatacccatagcccaggggtgtttagcctcctaggaccctcttcacagggagcaaagggaggagggcatggtgattctagtgaggtcagaacagtcagcagagctgggcgtggccgcaggagcatcatcctcagctacctagtgagtttgaggatagcctgggctacgtgaaatcgatcaaccaaaagaacagtcagcacgatgggtggtc

SEQ ID NO: 34452 - DNA, 2769 bp, Mus musculus
caaactgcgacacgtgggcagcaacctgtgcctggatagccgcactgccaagagcggaggcctgagtgtggaggtgtgtggcccggccctgtcacaacagtggaagttctcactcaacctgcagcaataagaggcccccggggcccaacgtccacccgcacaccggcccagtttgttgatcacgtaattacgtttctgaaactttccgcaaaactatatacctcagtgttccatcacggtctgacagtcttaagtctcaagtcttcatcgaggcatgagcggggcagacagcagtgcagaagaggaaaggagcccctggggctcaggacagagggtccctcccaaggctggcgccctctgcctccctctttctgcttcctgctcacaccccagcactggccggaacaagtgggcaagcagcaatcatgtttatatctcagacagaggaagcaggggcaggcgcccccacagtgagagctcgccaatctccactctgttttacctattcaaaatcgtgtgtgtgtgtgtgaaccaggcatggtggccagtgcctgtaatcccatcactcaggaggctgaggcaggcaaggccctgtctaaggaaaaaaaaaaaaatgatttccacaaagctggcctttccttgtctgtccctgcacccgggctcagctggcctcccagccacgtcccctcttccattgacatacttgctgtatttgaacgtgaactttcctctggtggacactaaatagagataaagagaatcatggtccgttccctacgcttccccgacatcatcttgtgaaccctgcaacgcagcgcagcccagagcaaaggtgcatctctggggcctcaccagccggcccacgctgctcctccagtaggggcatccccaaaccactggccccacccacaagcgtcaatgtttaacttcagcgaggggatcgcagctgggttagaaagtctgctttgtgcccattgtcatctgtaaaactaaataggtcacctcttttggcaagtattgctttgggttttcttttaaaattagatttcttttctttaggaaaactcaaccccacagcttctaactaatgtgagccagcaggaccctactgccttgtgacagaccagggacactggacagctgtcacccactatccctaggctcacagtggtttgagaccctgtatgttgggtctttggtactaagctgccggcagagcacagaagagcagctcttcagcctgtgggtggaccccacgtgcccgtagccctggtgtgggtaatacccccggtacatccacaggcaactgcaggaattatgggtagagttcagatcacaaggcctgcgcactcccactgaggacctaggcatgtgttagccacagaggtgacctggatgtggggaagtgacacctggtgggctgcaggcatcatacgtgctcatctcgggtatcccagagatctcgggaatcagagttccaggtggtcagagggcctgtaggtgagtgctgtgcctcccgcctgctccagaaggggggtagctggtttcttctacctgaggggctccatgtgtgtactcaccatgtgtgtattcgccatgaccatggaccctctgcgaaggcctggccaggtgctgaccctctgtctttctacccctgccaagcaaccaacagaagagacattgtaacagacagggtgcccacatgtctaattaagttcatacaatgtccaccttccaatgtaggctctgggaactgtcactcccaggtacaggtgcaaagctgtcaaggacaaggcaggagtttgctggagtccggtcaccacgacctttgctaaccctgacactcctgcactgcttctatcagagtgactccacagatgtgagacaacatggggcgtcccaaccacacgtgtaccccaccccaccctgtggcctcttaacctttgtaccatctgattgtctggccaccagggtgccaactcaacccagctccgagcagaggggggtgtgggcagggcccgtcggtgagccatgtttacatgacagtgtgccaaagtgactcgccgagcttgtattgctttgtagtcatctgggctatcccaccctcccaactcctgtttttaaaactaaaaactcccaggagccctgggcgcacacaggcaaaggtggctgtcttctgtggtggtccttgagtctccgtgaagctgaaaatgatggtgtctgtgagtatgttttgcaaattcaaaatatagtttggtaattttttttccagttgatttttaaaaaaacaaaacaaaaaactgctgtacagagcttgtactttgtccattttatagatggaaaccatccttgaaattgtttaacttaaataaagagaagatactttatagataatcctccgccgctgtcagtcttggtctccaccaggtgtgggtggcaccaggcagagggctggaacctgggtcttgcttctgcccacacttctatttctcatcgcccccttaaaacacatctctaaggctgtggatcctggacctgatgtaatcgtgacaattgtttgcagcgtggaacaattgggctgtgctggacacctggccagcctctgcaatgctctgcctaaacttgccctgatcctgcacaagccgcttcctgtagtctgccctgaacacttggcccacactctttaggtaccaaatttcttatacctcggtatttaaaatgcacagtcctgctcagcagccatctggggctcccctacctatcctggtc

SEQ ID NO: 34453 - DNA, 1234 bp, Mus musculus
ggtgacctcggaaggtaccagcagtaggaccagtggaccgtgctccgctttccagagtgtgaaagatcatgacgggctcaagttcagaccaggcaagcttacaaaatggacccctcggtgccaccccacagcatccggggcatgggttcctagcactctcccatgagatcagcttagatggctcccttggaagaagagatgcagtgtggtgccattaaaactcagagccagggggggcaggggcggctgcagcttgctgactgtaaacagggtgctcctgttctgtcctccacgggactgcagcgagcagggcgaggaggggagaacaatgccgggtttttgttttttttttttgttttggttggttgttttgttttgttttgttttcaatgtatcttcaggttaattccctactgttgcttaaggtctactgtgaacagatgtgccccccactccccactctctgacaccacataccttcacagctccctgcatgatcacagttctgtttctggcctgtggcaggttaggaagggccgctggcttccaggacagatgtagctagctatggctaccaaggcctggggagcctgcagactgaatactctgtcaccttgtcactgttggcagaattacctgtcttgagaactctatagcatcatgaaaacaaaatccttcacctccctctgtctgtgagaatggggtcccctagaaagtcacagcaggattaggaggccctggctggggactgaccctgtgggatctcccataggcccaggtccttcccaccagaggttgacatctctccatggagcctgagcctcaaggtgggcccactgtccccacagatgggatacaaggatttttccacaccttgcagcccttcctcctgatctaatggcacctaatgtccccagatgcagactgtcctcggcaggggctttggggcacttcctcatcctttcagtgagccgaggcgtggctggcagcagaatgctctccacaccttgtcacatctgtgtccactctctccacaagcaccctcgcctgcggtgggacccgcaatgccacagatcacaggcccaacttcagtttgtgtttaagataacctttgctgtacccttaatgggatcaaaagcactttcaccacacggagaaatatattttcaatttgtgatgcttttctacaaggcccactcttcctgagttcaggtgtttccaacgcttagggagc

SEQ ID NO: 34454 - DNA, 1127 bp, Mus musculus
agtcctaaagtctccacgctccacactgagccacccagccaggctcccatccttccagcctgctgctgctttctcctcagaacccaagaccccaaatcagagtgtcggagagtctgcacgcatgtctctctccttagctttggcatcttctcaacaggatcctcggtcatctttaggtttacagtccaccctggggctctctgctgtgcatgggtgggcaggcaagtagactgctctgttgatgtcatgggaattgatctgacatgctctgtccatcttgccttggcttcttaccatccggcctctgtccctttttctgcttgcctggccagcccacatagccttctgcccagagagtttggggagctggaaatggaggtagggaaagccacctaggggtcaggctggatactgcaagctccttcagaggccctccaatcccaggtgtcttatctgtttgttaccccaggctcaggcactgtgagccactgggctggcacagagccaatggcacgtggctatcccagccagagggcattgtgaacaagagccatgtggcaatatcatgtgacacttgaaaagacctggatgcctgagacacaccttcacaccaggctaatcaccttacaccgagcatcctggtttgctctgattgtcctggtttcagagctgacgtcctgggtcgggaagtagttctcggacctttgcaaacctggatgggtgttcatcctgtgaccctcctaacagtgatgaaccaactccatgcccatgtgaccatgcatagtcgagaggcaggagtccccacccaccgtctgtgaggctgcagtgctgcctcaggagtggtaggctctggatgtctcttacctgaccatgggagaacaacacaggttgctgcttggtccctgctggcctggacccacaacaggaagtgaccatgtggtcacatggaatggaatcatgcataagagtaacgtgttcacggttggaaatcagacgtggtacgagaaagatgcaaaagatggggcagctttgcagtttttatgagaatgtggcagctgagcaaggtttgcgagctctgcaggtaacgtaagagccgtagggccaggtggaagagaaagcattagacc

SEQ ID NO: 34455 - DNA, 1237 bp, Mus musculus
gtgtcctattaggctgacaggcagtgccaggcagcacagagctgtcctgtcaagctgacagtgtcaggcagcacagagctgtgtcttctcaggctgacagtgtcagacaacacagagctgtgtcctctcaggctgacagtgtcacacagcacaaagctgtcctgtcaagctgacagtgtcaggcagcacagagctgtgtcttctcaggctgacagtgtcaggcagcacagaactgtgtcctctcaggctgacagtgtcaggcagcacagagctgtcctgtcaggctgacagtgtcacacaacatggaattgtgtcttctcaggctgacagtgtcaggcagcactgagctgtcctctcaggctgacagtgtcacacagcatggaactgtgtcctctcaggctgacaggcagtgtcaggccgcacagaactgtgtcctcttagctcctgtctgtattcactccttcccgagttacactccaaatgacgtaaggaccctgctttgctcttttgcatttggatattcactttctcagctctgtttttagaaagaccatcctttctctattgaaccgtcttggcacccttatcaaatatcggttggtggctgtttagaggcattctctctctctctctctctctctctctctctctctctctctttctctccatttaccccctttctctgcagagactgaacccaggtctggcgcaggctcggcgtgagccccatatcgatccagccccgattttccatcttaattctatttatatctctttttgttctcttactctatgaaaaaaatgccaatttcctcacaataatttgaaaatattacattgactcccagaacaagccattttcaggctgggaggctgcaactcattgctggagcgcctgcctgccatggaaggctccagctttcgtctccagcaccgagagtttaagaaagagcaaggtctcctgcatcagaaaccttcaacattctatcatacagttccagggtttatggcttgtagcccttcatgtcacacattcatggatatgatcataggcgtgtgtgcatgcgcattttcacacacacagagagagagaggggggggagagagagagaatattaaacgcatgttttgcccaaatggctaaatgtttgcttaagtcacgactgaagctgactgtagaatgaacttctaagataaaaagaacgccttttgaagtttagtttaaaagcgtttacat

SEQ ID NO: 34456 - DNA, 1166 bp, Mus musculus
aggattacaggcaggcatcagaggtgctggggatccgaacccaggtcctcatgtgtgcacagcaaactcctcacccattgagccttctccccagccccaggactagggctttagacagacacccatgcactctcggggaacatcatgctagagacttaggaaacatgacagcccattttcctgttgagctgttttgtatgtgactgccatcttaagaatctcttatttacaccgggcagtggtggcgcacgcctttaatcccagcacttaggaggcagaggcaggcagatttctgagttcgaggacagcctggtgtacaaagtgagttccaggacagccagggctacacagagaaaccctgtctcaaaaaaaaaaaaaaaaaaaaaaaaaaaaaaacaaaaaaacaaaacaaaacaaaaaagaatctcttatttacaaagcaagttcctacatggtgtcaccagtgtctgttaccaacctgtcattaccatcttgtgtccaaggtactttgagactgtgtcagacgtgctgaactcagtgaagaagatggaggaaagcctgaaacgcctcaaacaagccaggagatccccagccaccaaccctgtcagctccagcggcggtggtatgagtgatgacgacaagatccgactgcagctggccctggacgtggagcacctgggagaacaggtactaggagcatgtgcctgctctgagggccaggctagcaaagctgaggtgtcacctccctagggccatcgatagaaaagagtcaggcccaatttgctgtgaagaagggtgtgtgccaggaagtagacaatagaaaaggcagagggatcccgagtgtcccctccctccccacagcaggttccctgggtgcttcagcacttgctcaggctgtccacagagctgcccttgatgcctgaaatcctgagccagtggcagggcctgcagcttcctgtcctgtgccatatagagcactgattttgacatcatggtagatggctgatggcagctcgtaaacctcccatgagggtgtagtgacatccactgtacgaccatttacaaatgtaggcaactgcctttcttgacagtcaggtctatacgtagcctgttatccctgccacctaggcagggggattgccacaagtggaattgtaagacccaat

SEQ ID NO: 34457 - DNA, 2732 bp, Mus musculus
gctttctggtctgtagcactgaggtaaattgaggtcggggcccctgaggcagaagtagctgctttcatctgggtcattgtaaatgaagtgccatgtttaggttgtgtgtggctgaagcagttgcccgcatcttattttgtcgcccttgttcctctgcagatcagctccagtaatgtgctcttgaagacaggctttgattttctggacaactggtaaatggtgctacccagaaacacagccaggagccccgcgtggcccaccgtggtgttcagaggagaaggcagcactgcctgcgtcttttcctgttttctctactcctttcttagtctttttggaaactaggaaatgttgccaggttttccccgtttttggtaaaaccaaatagataaatatgctattttcaatgatttgataacaagttttacacttgggatttttaaacactaggtacccagtaagccttgtaaataaaacttctgttcccagctccatcccaccttccctccaatgaggttccctgaccaagtcacaaaaggtcgcaaaagtgactctttcttgtcacttcctgttgagggctccctgggtagatatgagctgttggctgtcactgtggaagactcatccttaaaaagtgtgctcacctggtaccctttcttcatagaagccaggttaagcactacgtatccttcccctcccaatgcataggaagcagactgcgggcggtggcaggcaggtgccctctgagctggcctggtgacttactcagagctctggtcgcccttcaaaagcagctgcctgttgtatccagttcctgttgttgtatatagagctgcatcgcgttccttggctctgtaggagattcctttgggaagttattaagaccgtcccgctagcgtcccagtcctgaccgctgtaggagtcagggtggtgacagctgtgctagacatcagggctcttctgattcactgaggtagaaccccaggcttaagcgtcattcatcccagtctggtctggctgcatcgtgcaggacacgcccccagacctgaccgcattcctggtggttccggaagcttccccttgcagccccaagagctcacagcaacaaggctgggcgaggagtgtgtgcctcacccggagtttgatgccctctgtcctcactgccctgacatggcctctggaccctccatgcacctacaggatgctaagcaaatctgtgagctcggggtggtgtggtctaccctttgctatcactccgttctcctcacccgaagccttaatctccacgagcactcctccgagagcctggtttcagtactgcaagctgtagcctccttaatgtctgaagtagcttctggaatattctatgtagctccaaggtaaagcacgtggcaaccccaccctcaccccccccccccggccactctcccctcctctaggaagacatgccaaagctgtatacttagccaatatcgatgtgatacctgccaattagcttgtgtcccgaacctccctcggtcccagtccctggtggtgctggggtttgccttcctctagcaacttttgatggagtcatctttccgcactgtttgtaggggagttgatacagaggaagagttgaaacctgtgcaacaatgtttttcctccccatgggtctacgctccataacattggtgtagcaggaggagactctgacctgagtgtaggcagcctctgtgactggtcccatgggtgactctcgcagtggtgtgtctcaaggagtcctctgaagagcaggtgggaagtcgaagatggggagtctaagagggatcctataggacccgcctgacctgggaattgtccttgtgcctgggtggagtccataccacgctggcttcttggtctccccccagggaacatgtgtcagtgaccaggaaatcagaactgtatctatcattttcccttcctccatacatcatgatgaagtatgttcattattcttctctgaagcacattctttggctgaagccgctgtatgatgctgggttccgccacatgcccaggctcagcacctctgggaggcagctccagggctctgtgtcctgctcttggtggctgtgtccaacagaagctctcaggaacccaggctctgcgtgtctggtttgtccctgaatcccagccctccgggttggatccgatcctgtcaggagcagtggagtctgcctcctggccaggtgccctcctccttgggccagtgtgggagtggccttccattcttcactccgccctctcctttgatacatactttcgaaatggtaaattcttactgagagcttgtaatttggtcctattttatactctagcctttaataaagccattttaaaaatgagagtcagatctgtttcattttctgctgtttagggaggggatcagggtactggcaggttaatgccaagttgtgtatctaaggtgcaaagaaatatttgctcaccctagataggtcactaatagaccaaagagaggagtccgtccaattctacttagtgagccagtgaatttattggatgacttaccaatacaaccctttctcaatgtggtgggttctctcggggctccaccactgaagtctccaagttagcctctccctctagattctagctccacccaagctcacgtgcatcagaagggtgtggcaactggaacctcagttggccctttaacatgacttcctacctcgcttccactgtgttctaga

SEQ ID NO: 34458 - DNA, 1304 bp, Mus musculus
gaggctttccacgagatcgctgtccaggccgggtgggaaggctccagcaaagggaagtgagtgtaactccgaccctctctgaactgagtcgggtccaggctgggccagcaaaaagttgacaattcagtgaggagtgcggcagggtctcaggagagaagatctcttcccaagtgttacatacagctcttggaacaaaagactcaaaggaatagttctcgcatgcctttaattccctgcatggctttatatacagttctgggggtgattcagggtttgacagcaggcacctctcattggcttggactgagagtttggggggaaccttatttgcatgtgggaaggcttggtgctattcctaagtggctgatagctatgcctcttctgtgggggttgtgggggcggtaactccaacaggagccaggatcactcccgggtcccagggttcaagatctagcctggactggaaaccaggctgtctgcgcgtcacctgttgccgcacaccctataagttaagatactgagttatttcccgctaaagcttgccataaatcactgttgcctttattcttcagaacacactcaactcctgctgctcaggaaataaaagcgagggttgccaggtttctaagccaccagttagccctctctggaaccaccattacagctgtttccttggttgactctaacatcccaccaagttgacagtttagacgaaccgttacagctcaccagcctttgctggcctctcgcctggtgtggccacactgtgcactgggatggcctgtgtgctctttttcacaagtcggagccagtcgggctcctccctcacttttacagagacccatctttggtttatcctggaagctgtgggtaaggccgcagcactcctcatgagctctgctccacaggatcgctgatccggaccagcctgtcctgtggctggatcagatgccagctccaagtctcagcagagggttcaataaccacatcaacttaatcaggtaggggcctgtgtgctttcttgtgtttgcgtaggagtggagcagtgtgaggggccctggtggccttggcggggaacacacccagggtagctgtgcacccacaagtatctttcctgctggtccactggcacaaagtgcttgccgtgcacctgcacaggtagagccctgcccgctcaagggtggactctcgaaggatggagggtgtcagttttcaagaagtcgtcaaacagcagagaaatcgatcagatggggaattccgtatttgcctaggttgctcgtgagcctgctgtggccaggaccacc

SEQ ID NO: 34459 - DNA, 1226 bp, Mus musculus
tcacgagttcaaactccacacacccgctccctacccacaccatcaccagctctgctgccgccgaggtccggatccctctgcctgtgtgctctgtctagccacacgcaaggattctcctttgccagggacgtttgggattgttttctggctaattttgctattaattccagttgcaccccggaacaatatggtcccttccttacccattcttcttacctccaccaccaagccctgcacgcatggaagctactgttctgcctctcagcctgcctgccctctgcctgggtgctgatctgggccctttcccaccccccacctcctccactggcatcagctggacaggcagctctctcctccattggggatctgcctgtactctgtctgctcactcactttgctcctgtgtatgtgtgtgatcccttggcaagaatccttctccttccgtgttggctttgcttgctcttcctaacacacagcaggagtgctgcagctatgcatggtccactagtgtgaagtctgactcaccaagaataggctccaagttgacagagtggctgctgcccacacagcacactgtagtggaggaagagaaaccatgcttcactccgaggttctggagagagtcaggaaaggtcctggcatgaaagacctctttggggacgggggactgggagcatacagtgtcactcttggccagactagtttctgggaaatggctgggaagtagttctggttttctgagcatggagtggaagtgtggaagggagaagggacagggtgagcaatgaggtcagagagaggcctcagtttctgtggggctccacagcgtggcctcgctgctgtagctctcagtgaccgagcacgtgcagacagcacgggtgtctgacccactgattcttccctgggccccacatgtgatgtgcacacgtatgtctgcatgcgcatacatgtgttacatactgtggtgggctctcatgcatcctggtggcagtgtgaagtacaatattgtagggttgggtgacagcacaggtgagtgggacacccagacatctgggcacagagaagaatgtagaagacaggggggcagctttagaaacccggtgaacaaagcataaagacgagccagacggattcttcaagaggaggcatggtggtcattgtgtgtgtgtggtatggtgtggggtgtgtgtgtgtgtgtgtgtgtgtgtgtgtgtgtcgctgagagc

SEQ ID NO: 34460 - DNA, 1128 bp, Mus musculus
ggaggctgagataggagtattgtgagttccaggccagccctggttacagatgtacagcctgcacacgtgcacacagagaaaggacggcagagaatcttgtataagtcacctgtgtgtgctggggaagagtcctgctcagtgctgacctcttgcaacattgtccccttgcgctgtctgtaggaatttgtcagaggttgatgggtctgaccagtgctctgcaggagaaagcctgcactctgcagttagaggcctccatgtccacacctgcttgtgcttccccagtcttcagcctcctggcctgtgtgaatcacagcaaccacccctagagctgtgtcctctttcagtttagtgaacatcctgtgaagaacctgtatctcgtatttagttcgtagagttctcagcactcagatgtcgttgctgcttagaggccaacaagtggctcacactctaacagaaggacttcgtgctttaaaatttttatttacttacgtggttttgtttgttttttaatgagtgctctatctgtatgtacacctgcattccagaagggcatcagatcccttcttagatggttgtgagccaccatgtggatgctgggaattgaactcaggacctctagaagagcagccaatgctcttaactgctgagccatctctccaggcccctagacctggaaatgaaattttaaaatattaattttgaaacttgagctctgcttgtgttaaaaacacacacacacaaaacttgtggctatatgatgttgataagtctgtattctcagaaaattgatgagatatgttttgctcattactttcaggtccttaagtctatgtgggggtggtgacacaggctttgtttttcagtggaatttgaaatgcaaagatagatgtttaaataggtttcaaattgcagttctatatacaaatggagagtaaaaaactgacagtgagcacaagcccctgtgtagacgacacctgaggtgttgctgggatttgaactcaggacctctggaagagcagtcagtgctcttaaccctgagccatatctccagcctgagggagagattcttgagcctattctttgtgacttcttcctttttagtggcctggttcacttttgaccccaact

SEQ ID NO: 34461 - DNA, 1143 bp, Mus musculus
tacaaaatgagttagttcggagacagtcagggttacacagggaaaaccaaatgcacacaatgaaacagtgttctgaaacagttctgactatttccacctgtataagtcacatgaatgtgactgtctggctgtgtttggggggggggggtgaaaatattcctggtgtgggtggatgtgtgtgtacacgctagggtctattcactgctggttgagaacttgtaacttagatgaagaatgtagttaataacattggaaatccacatgggtcattctcagcacaaccactgagtgtcatgtggtgcacaattaaagtacttggaaggctgaggcaggaggcctgtctggagttccagaccagcctcgtaccctacacctgctttgctgcggtaggtatgcctcttggcatgccctcggctcacggcttctttacctgacccagtgacactgtctttgactgtcagatccatgggaaactctgcatgttttgtttgctttgtgaagcatacctgcggtggtggcagctgcaggactcgagccagagtccagcccccgatgacgtgatccggtacgccaaggagtgggacttctacaggatgtttgtgatcgcttctttcggtaagcagatgctgagcagtccgtgtttagctaaccatcgggtcactgttctaatcaaagctaagacctggtgagacaactagtaatgcaggagtaaacaccatatctcagctcagccactaacctgccgtgcgagtttgtctgaatggcctgataggttatttccctgcctgtgaaatgagccaattcgaaccagattagattatgtgaaaggtaggtttattgggaagttgctctccagtgagttcaccggctccaaaggattgaggccaggggagtcaccatggattgggggtctgatggtggagggagaggggaagaggaagagagaaagggggctagggcacagagggaaagagaggagagcaatccaaatgcccagattacacagggagctgtaaagttcaaggttgcggcagggtatgccaggtaggaattgagggattgctgggaggagctggccaggtctgccttgataagtaagatccacacctcagtcccttgtcctgggtatgagacttaccatca

SEQ ID NO: 34462 - DNA, 1866 bp, Mus musculus
cacactgcctccctgtgcccagcgctcagtgctacagcttccttctgtttgttcttcatctgtcattcatggtgttccttccttctctgctgtgtggagctccctcctgtgcctccctgtctggcctatgggctccttcctccacctgaggaagcaggatcctagggtgaagaaatgcaggaggacccacagcaggagagggagccatactcaggctcatgtcgtcttcagtatgtcaccttgggtgtggagcgctccactcctcacatgccctgtggtgtagccctgtttgctgctgtgctgtgagccagcccagcttccttcctcctgggcctttgggggtgtggctgctggagctggcctccctcctcagtgtacgtgtatggctcctcattctgggcgttccgtctgagctgctgcgtccctgacttcccctttgtggaccccctttccatgccctgggtccacagtgcgaaacttcacagagctgctgcagctctgtcaaaatgttcccgttggtgctggaattctagccccacccccttccttccttcacgtgaaagggtgggtgggcctgttcttcccagatccctctcctggccagtgctgcgtcctgtcccctgcctgatacttggtgtatgcaagagtattgccctccgtccgatatgcccacactccagctgctactggttccctcctatagaaagctgccacgttcactcctgagaaggacatctctccacactccaccctggtgcttctacccagttggcacctcaatagcagctgccttccaaattcctaccgcaggccacccaggtctgtgttccctctggtgcgtctgtatgtctggctgtctgctgtaattcataggaaaatcaactcaccagtcttcagaacccactacagagccagtggcctactgtgtgatcttgtgctttgttctgtcttcttaaaattacactgaggagagaccctgcctcccgctcccctgtgtcctccgtggctcccagccagccttggaagcagggcttctgtggtgatcagaacaggccccacaaagtagtcttgctctgctgtctacagctttattcttcactctctggcaggaccagctacctcaaaagagaaggcacaaaagaacccaaggtctctgctttctgtgagtgaagccaagactggggatttctgaacgtacccagacaccccagaagatctgaaccacctataccaaggctgaacgctctcaggcagcactgtggttcccttataggaatgatagctctgagctccatccttcctgctctttagtgtaatattttattacactggtggctttaaccctgtattttgtgtctttctgacagaagcactttgaagttatctttcagaataaatcaagctttttatacatttccagttcagtaactaaggttgtcttttgaattacctcagccagaaatagccaagataatcattgtagttctctctgtaatggtatgataaagactctacaactagggtactttataaaagaaagtgtttcgttcagcttatggtttcagagggttagagcgcttggcagcctatagagagttcacatcttgatccacaagcaggaggcacagtgagcactgggaaccacaggagtgtttgaacctcaaagcccaccccagtgccacacctcaaggtcactccttgtaatccttcccaaacagttccaccagctgggaaccagcagttcaaatagatgggcctaatacatggtggctcgctctttttaagcactctgtgagttcaaggccagcctagtctgcaaagctaggacagccagggctacacagagaaaccctgtcttgtaaaact

SEQ ID NO: 34463 - DNA, 1174 bp, Mus musculus
gaaacctgttcaatgtcctagtgtggggactctcagcagggataatgtgccttacacccagcttctccgggcactctgaaaggtctggcaacactagtgatcctacagtacaattgagaatccatctccctgccatgaactgcacccctgcagagaaactcttctgtggggtcccacagccttggttccatacctcagccttgcatgttactagctgtgtgtgcttaagctactttgaaaactttgaacccaccgtaagtaacattgaacttggactcttgtgggaaggggtaagtatcatcctctgcataatcccctgtgtgggactcaagccattaggtgttatttactgttttatggtatttatgcttaacccatggatttgtggaaggctacgggggcggtgggggcagcaccctgttctttcaagcctcgttggcttggagaaagtagcagctggtgactgtcaatatatttttctgaatttatttcagtttaattggtatgcttttataagcttacagctgttgttctgtgtgtgtgtgtgtgtacacgtctgtgtgccatgatgcgagtgtgttggcatgagaacaacttttaggagttggttctctcctgccacctgggttccttggatggagcttagttaggtcgtcaagctcggcggcagagaagctttactcaccgagccatttgccagcatgccggccttcatgtgcttctttttgatttttgtttcatttgttttattgaatgtacgtgtgtgtgtgttgtccatgcatgtgcacatatgtataggtacacacctctgcatgcacttgtagagggcaaacgttgatgcccagtgctcgcctccctagaactccacctcacattctgagacaaggtcttttactgaatctggggttcacggatgggccaagatggctggtcagtgagtccctgggatcctcctgtctctgcctgcctagcactgggatcccagacatgtagtgacctcgtgcagagcctataaaggttctggggattttgcctgggtagcagttactttacctactgaaccatctccttagctctttggggtattgtgtatacgttaacgactgagaatatttgtcccaaattacagccccacacaccacattctgttgcatattgcatggtagtcagtgca

SEQ ID NO: 34464 - DNA, 2105 bp, Mus musculus
tgagcactgccagccaggaccagagtcccagtcgaaatgactggctttgctttctgccttttaatgtattgtgtaaatatttatgctcagcccttaagaaaggcagagaagtgtactgtgtaaatactgaccactaagaattctaaaaacatttcagaggacaaaatggtggacaaacagctctgtgctctgagtacagaaggatcaagcttaagtcggctctggatgaagattctgatgaggcctccagcaaattaactacagcattggttctctgcccgtgggtggcacttatcagatatttacaccacaatttataacaatgggaaagttacagttatgaaataacaaataattttatggttggggtcaccacgccatgaggaactgtattaaagggtcacagcattaggaaggttgagaaccactgctctatggaaaagccatccttagggaaacagggtcatgcctgagttcttgctctagccatggtacaggacctggcttcagttgcctcaggcccatgcagttgtgggggacatatgatgcaaacagggcttgctaggagggaagtggcctgcacaggaaactcactgtggccaggaaaggactgcaacgtgagtcctgactgagcccccagaaagagctcaggtgcaatggatcagagggagagagagggccatgtcttttgagttagggtcctagaaagcaggcagattctacagtagaggtcagcaagcagccccattggggaagggtagcgggtccttcagagggtgagagagcccagagggttttagcatgcttaagattttgactggcatcacatttcttgagttagaacccaaaggggcaagctaaacagtgaagaactccaagcagctgccccatcgtgtttttaaatgggagttttaaggactagaactgtggtttttctttttttttagacagggtttctctgtatagccctggctgtcctggaactcattatgtagaccaggctggcctagaactcagaaatccgcctgcctctgcctcccgagtgctgggattgaagacgtgcgccaccactgcctggcaaagctgtggttcttatgcttgcaccgcacacacattgtctgagctgttaccccagcctcttctggtcacctcttagtagtcagaaggcatgtggccatgaccggtgtccctgtgtccaaagctatagcgtggtccctgtgagtacgtggacatatgcaagtaagacaggcagtactgaaagactgaatttgttgaggggctccagctttcctcgatgattaaatctcagcccttagagatacagggaatttttttttaattagcatgtagctgtagcctctagctattgcttaagcaggtccagcttcaatcagaaatattcaaggtttatgtagggttgggcattgtgattatcatagggtggtctttttatcccctccccaaagagatcttccctagagctaaacaggttttacaggagctaaaattctcaagtttctagttaagacagtttgatggttagcagacagaactcactatctaccagggcattggtggtggccagttctcaagggaaaagaatacatgtgaccctttccggaaatgagcagtgagcagattgacagagcagaagccaatggttccggtttgctatgctgcctcagctcagactgtttcccagtctgttttcttctttaaatctatttatttttattccataataaatcatttcattaaaaaaaaaacaaaacatgttgctgttttgcctacatttatgtctgtgtgagggtatcagatcccctggaactgcaattggaaagagctgttgccatgtttgcctgggacttgaacctgggtcctctggaagagcagccagtgttcttaaccactgagccatgtctccagcccctcattcagttttcctgctctcacataacctagcattttccaaataagctcagtaatcctaacgttaaagcttgctacgttcctcttctccgctgagctcagctgcaggtgtcggggcggcagctctggcctggtcttcacagactcactcagttattaatttgtacactgggggt

SEQ ID NO: 34465 - DNA, 1232 bp, Mus musculus
acatttgaactctgtatgctgtgctgaggatttgaaggtaggagtctgtgacaataattggtgtaagttgagaaccacaaggacaacagctcgagtgtgatgatcactgagagaccgggttgtgacatgcggccaacttgagaacctcccagttctcagaggtgttcaagctgatctggggctctcctgcctcctggcggagagggccctgggtgatggtcagatcatgctagggtcaaggccaagctgtggacagatcacaggttatggaggacaccgtggggctttgagtgtggctttgatgggaggggaggactgagtgggactgagtggcttatgaatgaaggagcagtgcttgggccggaagagccacttgccctgcccacgcagtgaccttcagatcactgggcatcttacagagagagaggatgtgttggaccatgtatcctgccttggagcatggagcttctgggatgtgtggctgctttctcattgagttcactctgctgctctctctgtagataacaaacttcctgaggaagtggtccagtccagcatcctcctgcactctaacctggccagccttgtcaaagaccaggtggttctgaaaatgaactctggaagctcacaagtggtcaacgggcttgtgcccgaacatatcgccctcctcatgtgctctgcctacaggaaccagctgctcaacatttttgcccgtccttccttagtcgccctggctttgcacatgacacctgggctcaggaaaggtaacttctaggaatgtggccttcaatgtccgaagagacccagctctctagtcccagaaaggagtagtgtagccacatctattctctacaaaaggaggctgccctgaccacgtagaggtctagagttggaagaaggtatagtatcatgtggcttagcgccccatctagtcaggaggttgaggcagtaggagcttcaaggagtttagggacagcctggggtagatagcgactacggtctcaaaagaacaacaaaagcgatggctcagtgcttaagagcgtgtctgctcttccagggatgctgatgtaggcccccagcaccagtgttaggaagctcacagctgcctgcaactctagccccaggggatccaacaccctctcctgccctccattggttcctgcacatgtggggcagacatacacatatacatgaaataaaatgaaaataaatctttaggaaagaaagaaact

SEQ ID NO: 34466 - DNA, 1614 bp, Mus musculus
ggaacaacatcttacttaaactgtgtcccagattgatctagcctggcactcgccactcagcggggttgggagtgggtgagcttcaaactcacggcctttttgtctcagtcacacccagctgtagtgacatttaccctccctctgggtgagaacttatggtggattcttaatcacaatgtcctagtgcatgatgcgggtaagagctgcctggatgctataggctcagaaagagggacatctagacgaggtggccactgactttgtccaggccaatagagcccactggaaccagctaagtgatcagtgggtgggccacagcccgctacagaactatggcaatgctcaagaccatgttatctcatgagctgtctttgtcttaggatgtaagaagccaataggaaaaccagccactgcaaaactataacaataatggagcagttgtagaaaacacagttccatagtgacagtcacaaaggacttactctgccacaaatgggcactgagaggaagatgtgacgtctgtctccttgagacctctgagccatgcttctgccaggaggaggagagcatgggagtgtcggtgtgaccctcccaccgtgatggctgctggccggcattcgtggcactgtgttgtcaaataaaggagtcttgaaaacatttcttgggcagcagagctcaggcccctccccgtttactgccactcagattcccacacctaccccactctcaggctgacctccgaggtttagtacagcagcagcactgaccacttatctgtgcactgaagaagggacactggtgcgtgttcccacccacagctccatgaggggcccaatcaaaccacagggcactaagaacactgtgtgttgggtgtgtataaaaccaaggacgttcatgtctagattagctcaagtctccaggacattttgttctgcataagtacaccttccgaacctgaaaagcagtccagctcactgttctctgtcagtgttttcaataaactgttcttactaaacaaacaaaagctttaaatctgacacacttccatcataactattttgtataagggactcaacctatatctttttacttcaattacgttgtctcaaccaagagcaaatttgacagaagtgtgtaataaattatttagtttactttaaactttatacccaatggtcttattaacaaattgaactaaacagagtgtgtgcaacaaagagatgcctgtgcgatgtgccgtgagtatacctggagggaagagaagttactggtgacctgtgactccagcggcagtggacgtatgccgtaggctggggctaggtgacagaggaaaggacggtggatgtgtcaagagaattgtctcagataggttctttgggtcaccagagaaaaaaagccataaatgaatgccctcaacacagccttttattttttgtgtcctgaaagctgaagtccagaatgaaggctctcacaggttcgccttaggtttggatgggcgctgagtccatgcgcactcaggaccacagaaagtggacagaaagtggacaggcactggtcctttctgatcttttcagtacatcctgcacccccccaaaacaaaataatgactgatct

SEQ ID NO: 34467 - DNA, 1460 bp, Mus musculus
tttctcatactaggcaagcaccctacccactgctacacctgctgccctgatggtttttgaaacttagtaactgagtagagatgcacatacctcaagcacagggaagggaccttctgtgactcttcaaatgctgtgctgcattttaaaaaacaagagcctggcatgctggtgcacacttttaatcagagcactgggaggcaggagcaagcggatctctgagttcaaggccagcctgatcaacaaggtgaatttcaggacagccagggatctgtagagaccctgccttaaaaacaacttttaagagaattccagattgtaatacttacttcaggttgttgagtagggataggtgggtaggtggagcccctaagcttttatttttttttctttttctttttttggttttttttttgtttttttgttttgttttttgttttttcaagggtttctctgtatagccttggctgtactgaaactcactctgtagaccaggctatccttgaactcagaaatcctcctgcctctgcctctgcctcccaagtgctgggatcaaaggcatgcgccaccatgcccggcttgcccctgatttctaaagtgagctctgctctgatcacttaatgtcctgttagaatgtgggtgctgaaacccattttcccactagcttgtagctgtgggttttgtcaacgatgccatgtttttatgtccattgggtctaaaggctatttcttgtctcttgaataaaagaggtagtagtaagccataaaatgatgtaaaaccctaaatggcttctgcagtgattcagggttgttaagactcctcagcttcattaactcatcaggccagcagtttctctgtctttttctagctctccatgcatagaaagatcgcagaggtcaccactgcagccttccactttcccatgttagggtttgttgatttaaatcaacaatgaagaccaagcgggtcttgaactcacagaggtcatcctgcctctgcctcctgagtgctgggattaaattatgctccactatgccttgctaagttagagttttctacataaccataactggatgtcccagccaaacaaatgtactcatttctcttaagctcactggacttggatttgatgaaattgtgtggctgcgatgccgatttggtgccacttggaatttaatagataaaccgtgcataaggcctcgaggtgtaagaaggctaacatgtttccccacataataaatggctgtatctttatggaaatggaagtagagaactttattctgctaagaacgggctaatgtgttcctctgtgtagctgagggaatgcagtctgggaaatctgcaggaagcttgaaggattgtctagcagtggtagttccacacatgctgacgtgctgtgacattaaccaccttttgtttgctttaaaactaactgcatagaccaggaatcacagactgggtta

SEQ ID NO: 34468 - DNA, 1869 bp, Mus musculus
tccttccctccctccgtccctccctccctcccttccttccttccttccttccttttttcccctctgtcccatctttatttaccaagcagcggttgcagaattgagagtaaagtggataccgaatgtacagtgcagttgttttggaatgttaaagtggttacttggttctgcaggccagatttgatgggaacgtaagtgaatggtttaaacttggtgctaaaatgtaactgatgtataacatctcaccaagctgcctgattccttggagagcagaaaatgcctaggcagcactgtgaactctacaccaaagtgcgagcaaagatgaccatctgagctctggaaggttgtgtctgtctgcatccgggcaggggacgcagacatgtggctcagtttatcttgtctcctgtctgttcctccaccttgctgactttgctacacggtgcataaatcttgtgcattttggggtgaacctggtttgtccggtgttcccctgtataatttcctccattacgtcccccaggggagctgggggagtcctgctgtagttgacccttcacagggcctgccttctccatccccagaggtcacagtttgttaccagagagtgtgaaggtagtttctttgttaccgtgtaggcttattttcattcctttgtagaatttaaagatagctagaagtttcctccctcaccccagtattattgaaccattggaagtgtcccagtgcagggctaagcaatgctgacaacagccactcaggagtggacgtcacagggtgtctgtggtcagctctatccaactctcctcccagcagtggccactgtggcctttcagcatccctgacagggtctttaggtgcaggattgggtgacaagttttgctatttcttaaagcatgaagttaatagtatttaatgtttataggtaaatagctattaaaggtttttttggatatatgccatattttcactaatttaacaggttatagacaattaaatatttttgtgccaaactacctaagttctagggctatgaaacaaattaggtggtagttcacacctttcaggagctacatcctcagtgagggaaacctgcagattaatattggtgctttgtgatggtgctgggtcagggttttactctggcactggttttgagttgagttagcttgttaaggaaggggaagggcctcaggctgggagagaactgggtacatcctgtagaaacacaagatggtgagctggatggaatgtgagatttgagcagagggcaggagggagggagagtgtagacaggttgagggtgggactgcacctgctgtgtctgtctactaaccacctgtgcagagtagccaggtgcagtctcggcaacaccagcttctcagcatggtgagaatgctagaaagtgggaatgtaatgagcctgtagttgttacgaagatttgcccctaagagtagttacccttttatctgtcattttatcagtgaaatgtggattttgtttgtattttcccactggaaggaaatttctaacctcacagtggagctgaagttggttcagctccacactttagggccacagctgtactcctgttttacagaatttgtgcttacatcccagttccatgctagtaaaaagcagtgtgagaaacctttccttggctttgcccaactgagtccacatcctaactgggacctctgaagaaaagggaaaaacattaaaaccccattctgtcttgttccaaagctctaagattgtatttttttttcaaagctttacagaatttaaaaataaacagtgttttgatgtaaagtggttgatgtgtctttccggtttgatttttgtggtgctgatgggccctgactcctcata

SEQ ID NO: 34469 - DNA, 8232 bp, Mus musculus
gaagggttgacaaaagaagaatgcagataccaaggaggaagaagctagcacttgtcacatggctaagtcccatcatagaggacttgatgtctactggtagcttccttcgatccctccacgtgagcacagcagtggtgtgcgctgaagcctgacagcacagttttcctccccactgcagggcttctggcattagttgaccacacacagatacccagagctctactcagcgcctctgtgggtgcagtcccttggtataccgtgctgactagtctgagctgagccttgataagccgagtagagcacgtgttccttttcagagggcttattctccatccagtctgagtttctttccttcactgacatgacatgggaggggatttgtagttggccgttcagagtggggcagcaccaggtagttcattccccaggttttggttccaaggccagctcagaagacaactccgccaagcaggtcagaagcctgccttcttagtttgcagtgtgcaacagtcaggacagtgaagcctagaaactctcctaacttctgttacttaaagcatgggctaatggcttgggacaactcgggctctccactattgggacccctgaccttccatgttggctcattccattgctgcaaagcttccactgagctaggttctcccgacctggggttgctcactgacctacgccgtgttttttataatggcttagaatggttttacctctccttaccacagaatggatcttacaacagtcactcttgggtatgaatcagagttccccgtgctcactcatggactgttatcttgtttttcaggccatggttgcttgttacccaggcaacggaacaggctatgtccgtcacgttgataacccaaatggagatggaagatgcgtgacatgtatatattatctaaataaagactgggacgccaaggtatgcaactcaattcagcagagatgttttttttcgacgatgtggtttttttccctcatggatatctgtagacctctctcgagtctgcttcagtctggacactcagagtggacttttgtgatatgatacctataatgctgtgcttgaaaacaagcactaatacgaacacatagcagcatgccttgtgcagtacgcacctatgggtggtgctgtggtgtcagtgggcccagtggaacacaccaggaatcccggtgcctgggaggtggaggcagaagattcagaagttcaaggccgcccagttcagggaaggtttccagctcgagttgagtgtcaaccagccagctctccttgagcagcggggtgaggagaaggaggatgtgtttgtcatcccaatctgtctctaagagtttgcaaggtgccttgggattcagtaacctacaaaagcaaagaagcaggccatattcctactggctgacattagtctactgtctaacgagttctaggtcaggcaacgcactcaactgcccttcaactttgagtccacccgctcaggagcagcagtgtgttgggcttgctggtgcatacctatgatctcagcatttgggaggctcagaggttaacgttggtcatccttggctacatgaggaatccaaggccagccttggttatttgagaccttgtttcaaagtgactaaatatctctagattggtgattttggtctagtgcttttcctcatagtcggaaacacaagggccagatctatatgcatgtcccccactcctcatttagggtccctgtgatattcagtggactccgtgtactgcctgtgatgtgtatccagtccccgcagagagcggaggttgaggtacacgggtgggatgaatggagttgagctcacatcagctacgattagaatttagacccaggctacacagggatagctgagtacagaatgggttaggatgggagatgactcagcaggctagggtaactgccaccaagcctgaggatctaagttcaatccctgggacttaccaactcccaaacgttgtcccccccctcctccccagcttccttatgtaatgagtgtagattaaaaaaacagagaccgccagctcacctgcttgctaagcatctgttgaaagtttaaagcaccgtggttgttttcctgatagtacattactaggtaagctactgggcaaatgtggcttcatgccttccttagcatgactagaaatactcactggttttcaaaccttacaaatagggttggaaattgtgcatatttgtctatggcaagggcttacaacaaaaaggcattttcccatgcatctgtctgccctatccgtggagtctcggctcaccgtcacaccttgctagttacaacataactgtatctacaaatagtcctgttaatcattttgagtcctttaactctgcctgctgcctgtttaacctggtgccattcttggtggcgcatactgacatactctgctcttttcccaggtaagtggaggtattcttcgaatttttccagaaggcaaagcccagtttgctgacattgaacccaaatttgatagactgctgtttttctggtctgaccggcgtaaccctcatgaagtacagccagcatacgccacaaggtagtgttccactcacgggaacttggttgacagtgtgacagggcagggagagttcgaagggtgaccctgaagtttctgtggagcagccgcctgctgtccaggccctctttcggcgttaggaccttcttgagtgatcatgagtatctgaacatgctcctgggaatgtcagtctgcaataagccatcctttgcctgagatgacctccccaactctgctactcccaaccccaccccacccctatccccaacatggttgcacctgttatcactgcccactccaggattctgtgggtgttttcagagcgctcttagaaaactagtaaagggggctggagagatggctcagaggttaagagcactgactgctcttccagaggtcccgagttcaattcccagcaaccacatggtggttcacaaccatctgtagtgaggtctggtgccctcttctggcttgcaagcataaatggaggcagaacactgtatatataataaataaataaatcttaaaaagaaaagggcagtttttcagaagtaattcagagagcagaagtgaggagagaaggaattgtcagacggggtggtggccatatgtgtgtggtgcatgctgggaagacagaccagaatcactctccacatctgtggccatgtgtggtgtgtgcccgacatcgcagcgccagaactgttgcaagtttatcgccagcccaggctacatattaaactccaggctatgtgatagcagcacaaagcaatcggtctgtttttttcttcatgtctctttcattggactttaaggtttagattctaaactgactatgttaatccatacactctcttgagggtggtggtggtttcccatgtggcatcagttaatgagaagattcagaagaccctgaaagcacagtgtgaagcgcaggcttgcagggagtgtgcctgcttttatcagggaaagtggcaggaaaggttcccccacccccctctggcttagaagcagccaactgctggtgagatggaccctccccagtgttggggtacagtggccaaggttggtggccatggatgaggtcctggagcctgcatggcatctgtcctcttcctgcttctgacccgtgcggctttcatcactgaatcacagtgggtggcagctgcctggtggagcctggagtcatagggaccctgacaggaaacctgggaaccaggcacggcacatgcagtgaggccagaggtgcagtcaggagaggggccaccgggccagattccaggtgggtgagagaggaggctgtcgagtctggggctgtgaggaaggcagcttggggaagtagcagagtctgctcgtgaggactcagggctcagggaaacgcttatcagatatcagacttcggatcggcagttgacagacagcctgggacgtgggcaagagctgttcagaactagctgtatagccgtgttccctgaaaaagaccatggtaggaatgggagcagcccgggcagagcgagtcagctgctggctagtgttaggacacaagcactgtggtgcctgccgccggctctgctctgtatttgagtcttcaagcaaggtgctgtgattgtgtagccaattactcgggctgttgcttttcccatgaactttggcctggatcctcagattctgtctgacctaatgatggctctctcctgagggaccagtggcctgaggcatatgctcacaaacacagcgtctgttcctttgcgccactgtttacaagtgctggctgccacatgctgttagctctggagtcagacacagtgagacacacttctgttgtgccatgaagtcacctgcttttagctctgaacagacctgtcacaccacatttatttgtgttcagttagatgagggcttttggggaaggaaccctagaagtctatgagtgttgcataacttcctcagagacgcagtcaaagatggtggactgctggactatgttcctttgtcccaatcactgtccctcctgggtacttgcccttcctctatctgtccctgaccatgcaggctgggtggacatggagagaggctatgagcctcccttggctgctgtagctcatctgcgggatggacaggacccgcttgccagttaacacctctgtcttagaggctgcttcacgcattacaattgtcaggaacactttcttcccagggaccattctgatcctgtcttaaatttccttctaggtacgcaataactgtttggtattttgatgcagatgagcgagcgagagctaaagtaaaatatctaacaggtaaacgcagctgggcgtggctggcaaggtcggggatggtatcttccaaaagccacagtacagtccaggaatgtttctgccagattcctgaagtccctattttaaacaggatttctctagttggccttcattctgacttgttgaaattgtccagtgcttaccggtttgatgcatgtctgagttagatagctcaaacacaggcagagcttttctgcgatgccaccctgagcctgaagctccttggtgctcttcaggttccctggtcccctccccttgtctttcagatagacggatatctcttcctttcacaacattcactctaaagaatgtgtggcgggctggagagatggctccgttgttaagagcattgactgctcttcgagaggtcctgcgttcaattcccaccaactctatggtagctcaccgccatctgtaatgggatgtggtgccttcttctgtcatgcaggcattcatgcaaattgagcactcatattcataaataaattttaaaatcttaaaaaagagagagagagagagaatgtgtggccataaggaaagtctgtacagaaggggcagaccagctccgcagacaggtgtgcggattcccaggtgccagctctgtgtgtaggccatggacgtgtgcacctgtgtgtcctgggacctgaagcatacccagtagtcccaggacccactcagtgggttctaaggagctggactcagagctgtgccttatgtactttcactggctcagtacttttcagtactcgggtggctttaaattaaagatgtcactgtttctgacgaggtgtctgtgcttgtcacagaggcaacgggaacagccactagggtagaccgatgagaagagccgctggagaagtgaggtgtttccggcgccatcacgggctctctggtgctttatgattggctgcagtctcagagcctgttgcttcatgagtgaatgcctctttttcttgcaggtgagaaaggtgtgagggttgaactcaagcccaattcagtcagcaaagacgtctagtggggccttgggtccggcagtacccacgtcacctacagcctctcagttgccttctgtggactcgtggacaggatggacagagagacacctgcctggtatttcagctgggagccaggcgacttcgccgggtgtcatccaacagagggctccatctgctgggactgtactgtggggtcagctccagatctgtgactgctcttggctgctgacccaagaggagacgctgtcggaggagagtagcttttccatctggacacgaaacaagggccctttgtaggaatttcttcagtcttctattttgccagacctgtcacctaactgagttcatttcatctcttttttatatcaagttttgaattcggggaatttttgtattaggtacaatttatcaaaactgaattaagaaaaaaaaatttacagtattattctcaaaataacatcaatctatttttgtaaacctcttcatgctattaaattttgccctcaaggcctcctgcgatgattgttgccagtgagtgacgacgtgttgcttctgcctgaacgtaaaggacgggcgggcgctgtgtcccagcccgagtgcacgaggtttttcttggcccgtctctcagtgattccaacctgtaaaggtcactgctctcgcgcttcgaccgacctaacagtagatggttgccactggcactcaactaactcaacatagttacaagaggaaacaagccacaggagagggtttgtctcttcagttaatttttttaaagcgaagtgacgggcactaaatgaactcggggctctccctcagcttcgggttcctgagacaaagggctttcttctgcggcaggtctagcctgcctacagccgtgtcccactgccgcaggtttccttgtggcttctccgtagttttgactgtgcttccagacccttccaggtcagggctgtgttcttgtggcagggcacctggtggacccaggcacgtgaatgtggtatgtggttgtagcctcaatcgtggccatcggctccttggacagccacgagccattttcatacccaataatgaaagctgtgtgctagcttagaaatcaaagggggtgtaaaagcacacattctttgttttatgggtttttctctttttagaggacagagggacaaccacacgaggctgccagactcctgtcacctctacagtccccttagaaagccagagtttgcacagattgtgggtataactcctgtccccttaggtgttctatctccgaccttgatctttgccaaaatgtgtgtatgcagaactatttctgtgtattttccttgacacccgtcttagcacctgtgtagtttgtatccggttagaaaccttttctatggaaagctcagtaattcttattaagagattgctattgttcatgtaaaacatgaaaacaaccaagtagagccgtgtgtggatgagggcccactcagcactgtgcttgcttgaggggctctcggcaggaagtctccttctgacccatatccgctgaccacacctctccagcaagtgcctctgccgctggccagctcaaggtttgcccacctggccccgaagcaccgtgtttcggagttgggaggaactgtttggcattgttggcagaaggtgtgattgcctggagcagcagccttttaaattctggagaccctgtagtcctttgtatctcagacctttactgatgtaccaggtcccagattctgtggcaggggatggggtggggtgtgcttgccagacgaaatttaaattatctatcttttgggaagtgtgtgctttcctggaggtcactgtgaaaacaaacaaacaaatcaggaccgttaaccccttaatgcccacttaaactcaatttcatgttaggactcttgtttaaaaccatttgtggcctgtatgtgttcatcctggttagagagaaagctttatgacgctgtttctgttcaacacattaaccagctgtggaacagccctttttgcacgacaggcagggcacttcaggattcgcagagagactcgtgtggtttggaagtggtatttcctatgaaagcctctcacgttgcttgtaaagctaatctaattaaaaagatgtataaatgttcttgaaaaaaatcataactgttgtcacctccagctgtcgtctgtttgcccggcccattatcacaggccttccccgagagcccattggttagttaataactgccgtccatcttgggtctagtccacaccatgcagcccactcccttctgtcagtagcagagtgagcagcccagcccgcagatgctccaggagcagaggcacggtggctggtggctgcacccgcgttctcagc

SEQ ID NO: 34470 - DNA, 1196 bp, Mus musculus
agaaaccctgtctcgaaaaaaaaaaaaaaaaaacgaggaaaaaaaaagagagagatcattaagaacacagacaaattagggcgaaaataattacaaaatgtgagagacttgcatgtgagatttgcataacatttttttataaccaagaagttagataaatggtctggagagatggttgagtggataagtggtctcccacaggaagctcattcagttagttcctggctcccttgtctggtgtctcagttacctgcaagtccagctgtgtgggatctaatgccctcttctggcctctgtgggcaacttcactcacgtgcacaaaccacacagacacattaaaaagacagcaagacaaacaaaccaaagatgtcagagaaacagtccaacagaaagatttgaaaagctgtttcacagaaggggataaacagccgtggtcgagggtgttaaaagatcctcagggggcaggggatgtggcttactcagccttgagcttgctcagcatgaatgaagctgggagttcaatccctagagcctcataaacaggtctggtgtcacacacctgtaatcctagaatgttggagctggaggcaggaggaccgggaatttggcgccacgtgggcttcataaagtcctgtctctcatctgactggttgttagggaagcagaaaccacagcgggaggctagtacacatgcatgcacgcaggcaggcaccgtgcaccaggatgaaggctcggggtaccagggatgtggatagagctgatgaccgtacagaaggttgtcacacatgtgttcattgcttagaggaatgcaaaatggtaccgccactctagaaaaacaggctggctgtgtctcagagagttaaatataaacccatgatgtgagccaggaattcgattgctgagcggctgcaaagagaagtgagaactggcccatgtggccatgggggtttcgttcatccttgcctacgacagcatggccgtttcattgatcctcacccgtgtggccatgggcgcttttcatttaccacagcacaaaatagaaggcagcccaagtgtctaccatctgcaagtagataagctgaggcagggggatgacatctcagtaaaaggacgccttgtccttgataaagcagcgtggtactccttgtgcagctaagagaggccacactgctggggcccctgctgagatctggtgc

SEQ ID NO: 34471 - DNA, 1198 bp, Mus musculus
ggctggggctatgatggctcagtgggtgagagcgcaaacgtgaagagcatccccagcatgctcgttacaaaactgtatggccacacgtgctcgtaatcctgatgctgagacaagacttacttgggcttgctggctggcagcctagctcttggttcactgagagacccccatgtcaaggcagtaaggtaccaggggtatagcagagtctcacacatcttcctctggcctttgcacatgcagattcagtcatatgcacactccagatggacacacacacacacacacttcaagtccactgtggtggcacacacctataatcctagcatgtgggaggtggagacaggagggcaggggttcaatgtcatcctcagctgcatagggagttcagggctagcctgggctataagagacctcacaagtctataagcacaaaacaattgtgattactgtgtggagctccgcaagcctttgctttctgtgttaggcacatgctgctagcacccagtgacttaaccttcactgtcctctggcctagatgtcaccttccttttaccacctgcccaaactgttaatctctaggagcccttttcacccccgagcctgtgggtgttctttccaattgtggtcaactcccctctctgtgtactatgttgttcctgacccctaattttccagataaaaatagcccaggccagcctggtcttaaactatttttaactccaagtactgggagaaaggtctgctttgaaggtgaaatgaagctctgtgccagtccctatgacaggagccaggcagggttctaatggcctgccccttgcagaggggtggcctgtgtgcttgcctcctcgggcccctattcccctagtgcctgagactctgcagggcatgcttgtgtccccaaagctcgcagcgcttaaggtatgatgttatgttgaaaatgacctcagacataggttacaaggtgaccccccaagagagaggtacaccatcagagttaacttcaacacgtgacatcactctgtggtgttgatatgtttttaaaactgtcacgcccagtcgctaagcagtagggcaagctgaagagtttatttaacggggctggagcattgggtgttctgaggacctgcgatcgattctcagcacagcacccaccttgtgcagctcacagccaatgcaactccagctctggggaacctga

SEQ ID NO: 34472 - DNA, 1175 bp, Mus musculus
tgattttttttttgcgtggtgattggacccaggaccttgcacatactggcaagtactatcttattttaactacaatttcatttctggccattggctccattgttcattgattttcttttttgagacaggatcttataatcctgtgtccaccttctaagtcctgtgattagagacataaaaccacatcagcttcctttaaaaacaaagcagaacaatgctatatctacttttaagctggatttcttgtttctcttgcatttaaaaaatcaattctggcaatttatgacagccagtgggggtgcttataagattatttatgtttaatgataggtcttggttctcttttttttttttaagatttatttacttatatgagtacactgtagctgaattcagacacaccagaagtggtcatcagatggttgtgagccaccatgtggttgctgggatttgaacttaggacctctggaagagcagtcagtgctcttaaccattcagccacttctccagccccttggttctctctcttttcttgctttgtctgtttttggtcctttgtcctttttgttgtgaagctgccgttcccatctgagtcttcttcccagcactttgtcgtctttggagccatggcctctgtagtcccggctgatctcaggactctttggcctaagcctgtcttgtggtagacctgtaggtgtgcatcaccatactggcttctgcctttctcgggactgagtgtgtgtttgtatgtaagtgtgtctgcaggtgcacacggagggtgggtctttcttctgataccttctgttctttgacttagtcttttgagatagggttttcactgagcctagagcttgctactttgcccaaactggcactgagtgaggtccagtcatctgtgtgctcctctgaccacagtgctggggttagagatgtgcagcactgtggctgggctttcttagggtgcaggcatctgaactcaggccctcacggttccatagtgagtactttacccattgaattacatccccgcattctgaaccgactaatctttttgtttgttataatttttagtgacagaaacagaaatatatctaaaatcgaagcttctgggaaacccatttgttttcctgcctggccaagcttgtgtttcaaagcttggtctctaaacatatcct

SEQ ID NO: 34473 - DNA, 2216 bp, Mus musculus
tcacagtgtttcctttgtgtctgtggctttcttgtttgtcttttcccagcctcccgcggaaggacaagagaagcagctggttacatggagactgaagctcacccctgttgactacctgctgggcgtggccgacctaactggagagttgatgcggatgtgtattaacagtgtggggaacggggacatcgacaccccctttgaagtgagccagtttttacgccaggtttacgatgggttctcgttcattggcaacactgggccctatgaggtctctaagaagctgtacaccttgaaacagagcctggccaaagtggagaacgcttgctatgcccttaaagtccggggttctgagattcctaagcacatgctggcagatgtgttttcagttaaaacagacatgattgatcaggaagagagcatttcttaagcagccccactctgctctctaaggagctcctgggcgaccagttggtgagactgttctgagtgtgcatctgagtttattgtggcttctgtagacgttccaagttgtactagtttgaagttgtaaacagctgtatataagtttgtccacagggaggttgtttcttacactcccgcgcatttgcatacagtgtttgtatatgtgctcgctctattgttgtgtgaacgtgcttccgattgcactttctgccacacctactttagttcactttgaacttggagtgacattttgggtggaaggaagtctcttaagtgggtgattctgtctatggagggaaaagtgtggagaagcttcctgcgtgcctacgttcctcagcaggatcatggcaggcctttaacgtggctcagtacgtgaaacagcagtttaaatatggaagttatcagtgttttctaagtgcaagttttggtggtggtataatgagaattcacttaaaattctggtcaagtttaggtcgttttgaattcgtaggaagcagttttcctgaagagttgatgggtatctggatgttcactttcccacgttgtcttttcctttctcaccgatgtgggaaggaaggagctgacactggtcatcactggtgacgctgagtaactgactccacactcgtgtgtaggttgtgagcagccaggccctttgtcgtgtgttaggtgtggtgcacttgtctaccccagccgtcctgggaccccagaggagcagccacagtgctcccagtgctgacaacccaagccttgaccctgcccttggtgtgagctagcgatgttgccaaagaaaaagaattgtgagtaattcagcaataagacgatggccaacactggagggagcgtcgggcgtgggttcatctccccagtcagtcagagtcatctgtggtgagagcctggcttgagcgtggcctgcggctgtcaacgccacatgctttcaacgagttctgtgacttttcacaacttagatactgggctttatttttggaaagaatatctatttgtaaggctggttctttgaaagtgtaattttccaaaaagtctcaccaaaagtaaaataaagtgtgtacatgcctggtaagttagacttgttgtcctggtggtgatgaggcttcgccttcctgtagtaagatggactcctgagctgtagtcagtcctggtacctgctctgtctgtctggtttttttcagctacttcaagtggaatttataatgttaaaataatggattgaagaatgttttacagaaatttaaagcaaactttaaataaaatattaaaatacagcagccctctggttaagcttttaagctccattgtgtattgtgggcgtggtgggcgtggtgggcagaggtcagacacagcttgtgcagacgggtctgttccttgcactgtgggtgacggggacactggtgggtgtcaggttgggataagggcctttttcatccggcgaggccacctcgtgactcccagagcctggtgttttgatggtatttagaaatatatagtgaatcagtaatgtgatttttgggtaaaatgggacatttaagattggctcgggtaatgtggaggtctatttttcctcccttaagccccgagacaagatgtcctagtggtatgactcaacctgaaatgtagtcagggacttcccttgtgtctctgtggtctgcatcctctctcagtgcctccccgggttgcctggtttcagatatggtagggatgctccagaagtggacgtccttgtgttctctcaggtt

SEQ ID NO: 34474 - DNA, 1105 bp, Mus musculus
ttacagggtcacataaaaatatcccagggatgtcagggcctgagtttagactggtttttttggttttgtatttggtttggtttttggtttgatttggtttggttttttgagacagggtttctctgtgtagccctgggtgtcctggaactcactctgtagaccaggctggcctcaaactcagaaatccacctgcctctgcctgttatgagaggaccaagcaaaggtatgtgttgcaaggggacacaatgtcaatcttgtttatgacaacagcacacatgtgtatcttatatatatgctctattatccttacccattcatatgttgaagggctgatttcataatccatgaggttcactgtgaggttctgcaagggtggcagagtagggggcgccagcttgaacatcttcattacctcattatcaccaggtctagctcctgaaactttacagcattgatcaatcaggttaatatgtcacaattgattctagtcctgcttggcgatgagactgcctcccaccccatgaacacttgtggattggcaccacactgagcccttcacagccagtcctgcaatcacagatctgtctgaggagagtgctccacagaggggagagtgctccacacagaggagagtactccacacagcggagagtgctccacacaggggagagtgctccacagaggggaaagtgctccacacaggggaaagtgctccacacagaggagagtgctccacacaggggagagtgctccacacagaggagagtgctccacacagaggagggtgttcacaggcctcagaatgaccaagtcctcttcctaaggctcagagttggttcaaaggggggtcatggggaatcctgaccccccccccatgggcagctgttcctaatcaatgtcctttctaaagtgcctttgatgtcctctttgcagtttgagctgtgaaactcattcaccagctaaaacccatgactgccctgtgaattctgcctgtaagcatcgagtcactgatctctgggtcccctcaccctagcaaaccgtactgtgtagcctgggctctggatggttttagaaaccctaaacctccatctactgtcctggccca

SEQ ID NO: 34475 - DNA, 1429 bp, Mus musculus
ggagggttctgccaacctagttgcctctgtccaggtggcatggagcggtaaagcttctgattgatagacttcctacacagcggctccgctcctccttaggaacggagggagccaggaggctagagtgactccagggtctgtgagcagcaaaacccaggggccctcatgcagctcaggggggcaggtggccagctgccctctaacaccatctgtctccgatccacacaggagaagcaggacaaggcggtgctgcaggctgaggtccagcacctgaggcaggacaacatgcggctgcaggaagagtcacagacagccacagcccagctgcgcaagttcaccgagtggttttttagcaccattgacaagaaggcctgatcagctcgctgctcctcaccttgggaccacgggctggtcggcctgcctgcctgccaccctgcctacccgtggtcccttccaagtcagcaaagcagtttttacatgtgctttccatcacctgtaggtagatgtctcactgtctgtctgtgtctctactcaccccagcaggcaggtcaggggcctggactcccgcatagctgcagcagaagatgaatgtaactgctggtggatgctgacagcctgtagccgagtggtttccctgacgatgctcgggtctccttcctgtggggagagaacctaggcaggtgacctgcagagatgctaagccagtggactatggcagggctgtagggctgtaaaataactatggagacgagaatcagacatgtactttaatgttaaaggtgctctatttttcggatgtacagtagttttatttccacagccgcattatcatagcaataagaagggcacgcagtaggcggtctgcagagctctgtcagagacggaccctgaagtttaacactagcacgaacgctgttgctgtagagacgtatttatttgcaggaacaaacggtgcctgaatattaacagtgttctgaattttttttaaaagagatgcatatgccttgtgaacggctggacctgtcagtagtcactcctgcgcgcgtagtttgctttcttgtagttgctctgctgcagtcagtcagtctaccctccccgatagagcccccgatgctgagtgccagcaggatcctgtgtccgacaccagatctgtttatctttgtacagaacctctgataaagtgtcttgtatttaacactcttatttaagcttatttaaccctaacttgttaattttatatgatttttgtttcacctgcgctagctgtaaggcgggaggcaggcaggcagtgactgagctcacctggacctgactgaagcaggtgggcgagctgaggaccggatgctgctggctaacacgttgtttgtattgcttctccatttttaactgttatatttgagatgaacatacattttgcttttttaataaa

SEQ ID NO: 34476 - DNA, 1099 bp, Mus musculus
tggccacatttagggtgggttttcaacatatctcagacaggcacacctgtcacctcagaaatcacagatctagtcaagttgacaaaaccaaacatcacacccagcacccatgtgtcttctgcactgtccttggctgtaaaccaccatggctgaggtggtgccactgaggacaactaggacttctgctgggtgtgggctgctaagctgtggtgagacagccacccttccagggaagaggacaggagcctggagctagctcctgttgaccaggacagtgggaacagaggacggggctgtgtgccaaggagacattccagctgcttgcttttcactagtgctgttcaatgcagctcagtgcgagataacattatattcagaagtcacatgagttctagttcctggatgattcccaccctcctcggaactggataaaagttggcattctgtaaaagccaccttggggtcttgtagccctgcagcatcttttcaaagttcaggccacttgtaagagacctggtgtcaagagtcaaggtacctcagggactcgtggaatctgtatagcaaagagtttcgtgttactgctaagtggaaagtgttcagtgttcttggacacttgccttcagtgcacgcccttcattaggcaaagaaagggagttgggggggggggatttctacagcagctgtctattaatacgacaggctaagggactagaagcctatgaggagctggcctgaagcacctctttggcctagggttttgtacttatgagactggaggcatgagcagctgagttgaaatttgagtcactgagtggcctacagcttgcctgctctttgctgtagcatttcccccagttgtatttctcagcttgctcctgccacacccgagcgtggggagcctctggacacagaggcttcccgtccagcaagctatgtggtagagaggtcacctgccttcccagcccagtggccagggaccacacgtcactgctgtatctgctatgatgccacctttggctgtcttcacagtggctcgcagcactcaggaagcccttcagctcactgctccaaaagcaccggctctctggacagttccaaa

SEQ ID NO: 34477 - DNA, 1253 bp, Mus musculus
cttttcatcttggccagtgaactgtaggtggatacttatgggagggacaagagagccacttagcctgtcagagctgagaaagtatgcagtgttagcaacatttttttatggttaaagataaaagagaaatgaaaatacatctgatcacatttctgctccacacatttacatctgctacagtcgttcctgtgtggtgcctgaagcgaatcctgcatcctgctaacgtttctctaagagtgctggtgttgggtttctgtgagagttccagtcagccttgcacaacaggatagtcaggcacacctgagctctgtgacagtgtaaagaggcttggtatcagcagaggcaagggtgaaagatgagaaatcgcctgtagaccggtactgacctgaatcatgtcaatcacaactgactgttttctgtcttctaattcaggcaaaggaatgctaacgacagaagtattaaagagtgctgccgaagccgggacagtgtcaccacagcccctggagcacactcgtcgtggcctcagagaaaccgtgctttgaggatgctgtttgcgtttggtgaaaaaggcaaccacctttctgtctctgtctgttacagtgctgtgtgacgaccatggagggaggctcacaccactactgctgataactgcttcctgttcctgtggacatgagtgatccaaggccgtcacaggcagagaagcacaagcttggcagagctgctgccaaactcaaggacccttccagaaccatgcaggctgatgattattttgctcggaaatttaaagccatcaatggcagcatgggacctgctactttaaacacttccagttcgagtgagggcggaggaggtgggggtgggccagccaatggtaccccagcagtgcccaagatgggtgtgagggccagagtttctgagtggcctcctaaaaaggactgctccaaggacctggcttgcaagacgctgtgggagagtcgttctcagtccagctatgagagtgttacctctatcatccagaatggccaaaatgaccagggtgacaggcagccagaggagcagctggacctggactttgtagaagcaaagtacaccattggagacatctttgtccattctccccagagagggctgcaccccatacgacagaggagcaacagtgacatcaccatcagtgatatcgatacggaggatgtcctggaccaacacgcagtcaaccccaacacgggagcggccctgcacagggagtatgggag

SEQ ID NO: 34478 - DNA, 1236 bp, Mus musculus
tcttttggcctcagctttctgagtagctgggaagacagagctgcgccaccaggcctgacattaggaagtttctatagaatatatagaatatagactatatagactatagaacacagcctatgctaccttgtcattgtaactttactgtttcaggacaaattctctagagcagtggttctcctcaaccttccctgccacccttcaatacaggtcctcatgttgtgataatccccaactgtaaaattatgtttgttgctacttcataactgtaattctgctactgttatgaatcgcaaatgtctgatatgtgactccaaaggggtcacgaccccataggttgatctagagagccattcacctctgcatccaagttgtcaaagtggggcccagtgagcagggtgtctatggctggccctgctgctgtcttggtgagcgtccctgagtccaggactgttctgtgatagtcaccttgctgctctgtttccttgttactagttcctttgttttggaatttggttctgttgacaactcagcccttcctctcaggactgttgccccgggctggggtgggtaatgacactggccaccgagtctgactcctgagtttgaaccctggacccatgtggtggaaggaaagagccgactcctgaaagtcattctctgtccttcacacatgggacatgtatgtgcgcctcccctcctctaaataaacgtgaaggaaagaatgtgccgcctgtaccttagctgaccctttataccgcttcctgtacccctggtgggattgatcaattgcctaggcacccagtgggtcatctttagccataggggctcccttttgggggctccaaggaatcatgttcttatagccaagcactaggacatgtgaagtgcttggttttagtaactggctgagtctctttccccttctcacaggctattatgaaagatggcacctaacttgctttacgagttctgctgactgagattttctaagtcagaagtgagtctgtgttttactgtgtccctcgttagacctgctttgtatgtagttagtgattaggaaatatatgcttaatgactgactggctcttatacattaggggaccctgtggctttctaaagacccaacagaaaggacatggaaaaggggatagagctagaccgctgctcctgccctaagatttgcatcatcttatgtcccttgcagttaggggaagagccggtgcttccctggtg

SEQ ID NO: 34479 - DNA, 1151 bp, Mus musculus
aattgctgtcaggatcactgtggaggatgttatcttaaagatgtggtgcgaatgaaactgtgtgcagagggtagagtggagcaggcaggtggcttccttgtggtctgctaggagctgcgtggggacagctcacgcaccatttcttccggcagcagtgaaacagttgtctatagtttcaggtgcacacatgagctccagacagacagcaagcacatggatcattcactttatcctcaggatacctgtgtgaagcatcatagaagtccacagggaacgccttggatgactgacgaggcagaagtgtatgctaattgagaaactgctgcctctgacaggtgtaaagtttccattcagcttcagtggacatcgtgccttcttcctgtagccactagggatgttgacaaaggacgattgtgagtctcgggaatggaggtgggcagattccattggctccagagagtgcctcatgaccctcatcccttcactcattatgagagttgaggaccaattcaccttctattctagaactgggatttggggccaagtgggagctctcttgatgacttgtggcttttctgtgactaggaacatgttgcaaacacgacatcaagaaaactgtgtctgggttggagatatggcatcatcattaagggcactggctgctctcccagaggactcagtttggtttccagcacccacattgggtggctcacaaccatctgtaactttcacctccaatggggtctgacacacactttgggcatctatgcacactgcacacatgtgcacatacccacacactcatacacataaataaaatcgcacctccttgtcagtgttttgagttacctctgcagtctgccttcccagcacaatggcgcctagcagttcccaggaggagaaagattaaatccggagttgtctgagcagcctccatgcctgggggaaagcctgcagcagggattgtgtatcctgttatgaaagtgcacatctaggagatctctacagtatactaattttgaaacctcggggtagcgatggcttcagggtggttatgttaaacccagaggggacctcggggaagtggcaggtagagaatgtaagacttttactcagtagatcagcagtaattcatgctcttgtgcttccag

SEQ ID NO: 34480 - DNA, 1289 bp, Mus musculus
acattttaaaaaaaaaatggaactttggattcttggggtgggttttaatccctgggcaaatgaggtatgcacctgtaactcataggagatgtgatcacctggtgccatacactggggacgaatacttgaaacagtgtactgcagtaggcggaggcagattttatatgtaactggggactctgggtttgcattccaatcattttgccgacagctaagcagcaacatttatatttataaacgaaacaaaacaaaaatctatagagatgtattttataagtaggtttaagtgtcctggcttgcatgtgcctatccaaaatgattatttttgtagagtctaaattaactctatttataatgaataggccaccatccactgtgtacataaaacatataaatatgtttatattctgtacatatgtgtaggctaacagatatccctgtacttcttaagccaagataagagatattttttttttcttcttgatttctctttatactaaagaacccagaattgctaccacaagctgggaggcctaacaaactcaagagaaaatcggtacgatattctgttcctgtatacatttctaccctcttgcaacggtgtaggaccagacaacaagtgaggaagagagttggtgagaaggtgaatctatttggactggaaggcataccaccacttctacccacttcacaggtctggagggcataccaccatttctacccacctcacactaaagcacaatggcagtccccctctcccctgaacagattatgtcaggttaatctgagaattctacatttagaatctgaaatcaataaaatcatggcagatggcaattttgtggtttattacaactgatgtttttctctatgtacattgtccgtgtatgccccacttgagagatactatacaataacagtgcatctgggatgtcaggatagatactacacagtaacaaatcactggtgtttctggcatgtcaggacatttaatgagaccaggtaaagaccatctaatacccagcagaggggacacctgtggctctgtcacccacgctacattctgagtgtggggctcaggaaagtccctttgtatccccaggatctaggtaccttgtgggtggaagaattatttaacacaatggctgtcacattatatgcctgacccttcatagaagagagtcacagggatggtttttgagggtgtggagtttattaccaagagttatttatgacacagacagacagacaacagcaaaatgggggttctgaagaaaatttaggcccca

SEQ ID NO: 34481 - DNA, 1264 bp, Mus musculus
cttggcggcttccgctgaggattcggcagcggtcttaggggccgaggggctcatggaagtaaagctgaagacaaggagtggttccctgtcaccaagctgggacgcctggttaaggacatgaagatcaagtccttggaggagatctacctgttctccctgcccattaaggagtctgagatcattgacttcttcctgggtgcgtccctaaaagatgaggttctgaaaatcatgccagtgcagaagcagaccagctggccagcggaccaggttcaaggcttttgtcgctattggggactacaatggtcacgttggtcttggtgttaagtgctccaaggaggttgccactgccatccgaggggccatcatcttggccaagctttccatcgtccctgtgcggagaggctactgggggaacaagactggcaagccccacactgttccatgcaaggtgacaggccgctgtggctctgtgctggtgcgtctcatccctgcccccagaggcactggcattgtctctgctcctgtgcccaagaaactcctgatgatggccggtatagatggctgctacacttcagccagaggctgcactgccaccctgggcaactttgctaaggccacctttgatgcgatctccaagacttacaactacctgacccccgacctctggaaagagactgtcttcaccaagtctccttatcaggaattcactgatcattttgtgaaaacccacaccagagtctctgttcagagaacccaggctccagctgtggctactacataaggattttgtacaagaaaaataaaagaattaagtcttctaaaaaaagaaaaaagaaaagaaagaaacagtgtgagaaaggtttgtagtgggtgtttaacttctatttaaaaaaaaaaaagttcaaatcatttggaagcattcacccagcagaaattagttggtattttaatagaacattgttttctaacaaccgctggggtccttagcacaggttctggggatcagaacaactcttagagttgaatgtggggtgactcctctacagacctggctgaagcctgattccaaggctccatctgcccctaaagcttgattccttctgccctggggtagccttgattcctctacacttagatttcctgctccatgggcattccgacactgtgaaatactacagtgaattgagaaaggaacccattaggtctcactgagggaaaataaagagtgtagactaaagaggtgggattttacactgaagttcaa

SEQ ID NO: 34482 - DNA, 2007 bp, Mus musculus
tcttgtaatgcccttacttactggaacccaggttgacttaatttatccttctccaatagtaacattcagagctcctaaagaacataacagtaaaaggttcttcctgtaatacagggaaactaacatgtcttgttcaattttcttctgcagaaacgagcgggaaggaatcccagccaacctgatccagcagctggatgtgtgtgtggagattcctcagcagggcatcatccgctcactaaatgtgcatgtgagcggggctctgctgatttgggagtacaccagacagcagctgctcgggtgtgcggagccaccatcctgaaggctgggcctcacctgcgatctctcatggtgctatggtgacttataaccttctggactaacgaaatattctgagatgtcctgggattttcttcgtgtctctaaccttgcacctcaatgccaaaaccttttcatgtgccttaaagtatatatcattatatatattgtcccctttttagctaacctttttaaatattttaagcatttatgggatttttaaaaaggaatttttaagttatggtcttcctagaaaccggtattgtcagactggcagaactaaagttgttatttatgggcacctgtgcccttctgttttgagaggctgcctcctctccctgctgctatgcacctgtgtattcctgctgagagagggagcacatgtgacaagacgtgagtcagcgccaatgatgttctttatcctcaggtcctgagcttcatttccaaagccaaggattgagccctggttgtttgagctagggttcaatgagattttctttacatggttgtgtcctcacatcatcacccctgtgccgctgagccactcccgtgaatccctactgaaagcaagaacaaaatccatcaatgctttctgttcagataagtgcattattcaatggtaatcattatcattgtccagcaaggaacttgctaaccctggaatcctttgagtaatacttaaatatctcccgaagttttgatctgcaacagtgtttcaaacatagaccaccacatctccacacccccacttcctccagatgccactcctgtggtctgacataacctacattatcagtctggcttctttcaggtagccgagtgcattcccagctcatccaggtctttgcttgtgttgttggtattccatccatcaatgggatagagtactcctcctgccataggcatctggttttaaatgacttgagtgatgctgcaggctttgctttcagttcatttgctgaggtagctaggagtggggcttgtgggtttaaaggtcagcatgtttgactgaaaacctctgtagagggctttcctagtttacagtatcaccaagagtgtcttgttctgcatccctgtcatcacttggtattgtcagactttaatcgaagccattctaactggtatctagtgacacagcagtatggcattaatttccattattctaatatttaatgataaggaggctccttttgcccactttttaaatgggatcagttatcttatcaagaatcatgaggtatttttttgttttttaattctggattcaagttcttaaagaaatatgtgacttgtgagtattatctccatatttgtgagcgcatccttaggcattttcttaatcatctttgaatagacccagttttcccttcccaatctacatagttatttcttctttgtcttactgaagtaggtagcaacccaggtattgtctgatcactgaggacatttgaacaaatgttaacccattgattagttaacttcatccaacttcattgtgtagtttttgtattaaagtgctaactgccagaagcacgcagaataacctatcttagtttttatttattttatgtgcaactatatttgcctaatatgcagctcttattccaaagggggaaaggaaaataaacaatgtatttttataataaactttttatataatgattttatgctttttcttagaatagatccctc

SEQ ID NO: 34483 - DNA, 1144 bp, Mus musculus
gaaaggtaagctttccataaggctaaacatgatgtcaggttattgtctgcttacaacagagcagatctctggatcctggtccttctgggtctggttaggcaagcattctgcactttccccacagccttccctcttccagtgacaatcaggcttccctgtaaagccagtggctcagtgtgtccagggcagcctcattctgctggctcttccctcagtttgaccccctgtgggcacctgcatgtatgtgttacatatacatacaattgggctgtatacaagtgttaacaagaagaaaggatatttaaaaagtacatctgaagatgcaaagaggattgactctggctaagttacatgtaggcactattatttcttctcaggttctactttgggtgaagcagacagccagtcagaatgggctgatgtccagaaaaaaatcatcccatggggacaaagcgctctggaatcagacctggagctcgagtttcaggatcgggctgccaagctcggaaagtccattagcagactgatcgttgtggcctcactcatcgacaagccgaccaacctgggaggtaaagtcatctaccctttgtggctgtctgttccatacacagtcctctaggcaggcttcagaggaaaggccggggtggtgtgaaccttgtgacatgctggagacagtcttggtaatgggccattctgtacagggctgtgcaggacctgtgaggtgttcggggctgcagtacttgttgtcggcagccttcagtgtgtcagcgatagacagttccagcacctcagtgtgtctgcagagcagtggcttcctctggtggaggtgagtgtgaagtcgcttattgcattctgtatttgtgaaggtgttttggcatgtagtgtctttgtgccagtttctcagtgtaatccttcagtactgagttccaggtttagtctgtgacctgcggtcgtgtggcagtccccttagccaccactcagcaggctgtgatgtggagggaaccttcctgatgctgtctggtgttctgcattcgctttaaagccccattgagttttaatgctttgtcggctcattgccactaaggtgagaccatcccagctgatgaattatctgcagcagaaaaaggcagaaggctacactgtc

SEQ ID NO: 34484 - DNA, 1198 bp, Mus musculus
aggaagcagtgtttcattggctacctcgaagctggttagacctgaaagtagaggagctgaacattatctagaaaggtctctgagaagtgaagacatacccacctttgatgaaaatggccccagagatgcttgactggcttttcatcttaaaggaaagggacaatatgtataacattcttcagtggcttcttgggtcagcagtgacttggtgacaaaggtctccctcgaggagctgaagctgtagcttggtagtagaaaaggagcccctgggttcagaccctgggaaggtgggctgcttggctgattttgttgaaagccagaaagaaaagctctgggatgcaggaggacacggtgctgccaccctgtgcctagaggtggcattgaatgattgcccccttagtgacattggaattgaactgcagattcaaacccaaataggataaaggggcagaaacagaggtgtatagaatgctgctttgtaacacttttcaggtttgcagttgtctctgatactgttcttagtcacagatgtggtaggaggcttaccctgaccgattcccaccctgtctcttcaggatgagtcagcatccaggtccagaactcgataccatgagaactccctccagcaccgggtgaagaaccgtgtgtggcagactctgcttgtcctcttccctgcatttgatcaggtgtgatagttctcatgttctgtgtcttagttagtgtttctgctgctgcaaagaaataccatgaccaaaagcaagttgggaaggaaagggtttattggactgtttgtcaccaaaggaagtcaggacagaagctcaaacacagcagaccaggaggaaggagctgaggcagaggtcatagatgagtgctgcttactggcttgcttcccctgttttgctcagcctggtttcttaaagagccaggaccaccagcctagggatggcactgcccacagtgggctgggccctcccctattgatcactaattaagaaaatggcttacagctggatctcatggaggcatttcctcaactgaggctcctttctctcttatgactctagcttgtgtcaagatgtaaaatccctttcatttaaaaaaaaaaatctgtgtatgagtgaggcagagacaaagagagagggagaatgaaggggaatgtgagaaagagacagacacatggagagcctgacagacagtc

SEQ ID NO: 34485 - DNA, 1176 bp, Mus musculus
tgtccctgtcagctcagttgttccccccatcaaggaacttcccccagtgtatactccagtgtggtcctccctgtaactgcgcttctggtattcttgactgaccgccttctgtggtccaaggaaccctgtaactgtaacgtccaagcaggcttgctgcatgaagcagggataaggatttgactttattgtctttaaacgtgggacataatgtttctctactgatggaacatggatcaggaataattatggagctgttttcgtttcaatgcatcatttttgaaggagttaatgcttttttgaaagaaaagttaaaaatcgtgtgtgtgtgtgtatgtgtgtgtgtgtatgtgccagaaggttagaagacaacttatgggagtaagtccctttttctctactatgtagattctgaggatcaaactaggtcatcaggcttaattgcaagcacctttatcctttgaaccatttctcaggccctgagaacacatcttaagccctaccttttgttgtcttacagaagaaagcagcttcatgccagactggctggacgccaggctgacagcgctgatggtcctgctggctgtggacgtggaaggactgaagaccaagttcaggtcagggtttcttcagtgctaggagtggtgggtgcatgggggagaaagaggctagttaggtttttcaggggcatttagacttttcagagattggtggagtcactgacaggccagaaccaggacactagccacacactaaagaaatgtttaatttaccagcccattaatgggtgtagggtcggtcagtgcttgcaggttggtaaactgaatgtcagatttacaattaaatgttaaacaatgtatcgttttatactggcaccagaaaaatagatgataagatcccagtgtaaactgtaaagtgccctgatggcagtaaaagtggcagttaggatgggctagcctctgggtacagggcagaagtgccagggttaagtgggactttggccttgtgtacctcgaccttgacaaaccacatcccttctagacagttgtagtgccaaaggcatcctttgtagcgtttttcattttgcatttttaaaaacagttgacgtgacacatcttttactagtttatccttttcttttttaaatttattcattgacagtcatatgtgagcacggat

SEQ ID NO: 34486 - DNA, 1204 bp, Mus musculus
acagaggtaagctgcaagcagcggtttgaaagctctataaaagccccctcttcccatggagctatcactaaccactatgaaatgcaacagttgctttcaaaattatattcctcagtgcccctcatacttcaatgaatggcggccccatgagattgtatcaagctctgatttaaattcagtttatgtggaagtcagaagattggatcggggaaattagaaatgctttgttctgttacattttaagaataaaataaccttgccatggttttcctgtgtagctctgtgactggctacgtgtcaatgaaagatactttaagcaatcctcacttggtggctctgatggacaggaggcgtcattaaatgcttacgtgaagaacctagttcaggagttcgtgaagtctcctggttgggaaagtaagtgtgaactcttcagggaaagacagaatgtgctctgaagtcacgtgcagattgacgtgtaggcataagccattgtgctgtgtgagtctgaacctcagccacaggatcagagccgctctctcctggccctgtgggttgggagacttggggatttgttgaaccggtgtcagtgtaggtgtcaggggctggagcgggaagaggacccacagggcaggtgtgtgtgggtttctagtatggaaactcgtgctgagtgcaaataatgccaataggtttattttcatgatttagaagcaccacgttaattgtgaactgatgaacatgtttatccgcttgatacgtgcgtacgagtgtgcatgtatatgtttgcatatgtctggctgagcactggtgcatgcggaggctggggcttgtcatttgccctctttttttttttttttttttttttttttgaggctggctctgattggctggctaggctagcagcttgaggcagggtctgattggttggctagtgtggctgaggcggggtctggttggctagtctagctggcaggtttctcctggggatatgcagttgatctgatctcctgtctgcctgcaagcactgagattgcaggtggaccaccacctctgccagcttttacacagctgttgggaatctgaacttcaaactcctcatccttttacagctggggcttaaacgcctgagccatctttccagtctccaccaaccagttttagatagcgtacttattatttccatcactcacttgtaaagacctttctt

SEQ ID NO: 34487 - DNA, 1219 bp, Mus musculus
ttaacatgcacccttttaaaaagcagccatctggggggattgcaggatatctatgtgaatttagggccagctagaaaatttaggccctaggcctatttccaatcgggaacttcggaactggtgtaatactatgtctgcagcaactctttttactaaaaactgtgagtggcaggaggcatcacactcccaacaaagttgaaggaaccttatgcggtcctatgccgggcagggtatgtgtgggtgggaacctctcgccgcgcacgcgcactcgcgcttagggtggccggcgcacgcgcacaggtctactccccgcgaaatggagcgggtgttggcggacgcgcttctaacgcagagtcgggagcccggcgagttgctgggcgcgctgtgcggcggggaggcgagtgcggagcgggcggagaccctgcgcctggtgctgcagcggctggaggagcgcggcgcgggcgccggcgcgctggccaaggcggcacacgaggtggccagggaccacctggtgcccttactgcacgcgtcccagggcggagggcctgcgaggccccgcgtgctccgagcggcgagtgcggcgctgcgctcgtgcgcgcgcctggcaggaccggagctggcagtcactctggccgaagaagcgctgcgcgagctgccgagcgcgccagccgtggagctgctggccgccgtggcgccgtgtttacgcgcgccggaggatgccccgctgctgcgtcgcctggggcgcgcgtctgtggagctggcgctggccggggacgcgccgccggccgtgggagcgcgcctgctgcccgcgctggcacagagcgcagaaccggctctgcgtgcggcgtgggacgcgctgagctccgcgggaccgggagctgagggcagcactgggccagaactgctggtgctgagcgcactggccgagaagctgctgaccaaccatgagcgccacggggatctcgacgcccgtctctgcggccgcttctggagaaccgtccaggcggggctgggccgcgcgcaggacgggctcacgcgaaagcgcgcgcgctacctgctgcagagggctgtacaggtgtctgcagagctggcggtggactgctcctgcagcccccaggacacaaaaggtacccacttgtctctctaaaaaacaaaattgtgtgtgtgtgtgtgtgtgtgtgtgtgtgtgcgcgcgcgcgcgcgtgcctgtgtaagttta

SEQ ID NO: 34488 - DNA, 2639 bp, Mus musculus
tttgacgacaaaaggtatgtactttaaggcattttcttcttttgttaacgttgttaggctgtctgtgtttgactctttgggtgacagttgctgttctttgtaggctgcgacttggctgcttttgtttttttttgttttattttgttttttgttttttttttgtttgtttgtttttaaagagcacttggcaaacaaatgcttctagctgtatttgtatgcacttattttaaaaaagaaaaaaagccaaatacatttttttctgacattgtaagattgccttactgtctgtcatttctcctcgctggcctctctcaggctggaggccagttggtggaggagaaaggaagtgagtggaagggggacacctgtcacaagggcattccccgtcccccaggaaatgtcacccacctttccgagggagggaaaatggggtttgaatcttgtcaacggttcagctcttgcaatactggtcgtcagaggtgctgctgaaaggttatttgcaacattgtgtgttcagggtttgttttgttttgttttttaatggaaggcaagctagctgatgtttgctctgcccacgtgaccggttgtaagctttcagtgctgcgtgctcctcctcctcggtggccccaccggtggttccagctgtagaagtagttgtcagggtggtgtggaaatcaggtggctttcctgctgaccagcctggctctgaggtgctccttaagtgttgcaggccccgggtgaacttgtgggattcgtgttttcttctgttctggtgtgtttggtctacgtgttcagttcttgcctgcgtgctgtcccccttgtgacgagtgcttactgcagtgtgcacgttgatagtcacagccttggatgctgccaggaggacctgtgggcactgtcagtggtgggcccagtgtgggtagaggaagcctgcagtttttccttaggtgtgtctgaaatactaagagaataatactgttctgaaaaaaaaatgagagagaacctagtgagaatacttacatgaagggtttttacataagcaagccccacctctaactatttttagaagcctcttgtaaactaatttcttttggtcactattttgccttagtgaagtgattgtttttaatgtaaacaacatcaggtcattagctaccagtagtggtgcccttagtgatgctggttttgtgggttttttttttttcttcttctttgtgcttttttttggtttaatgtcaacaggaacactaccctctcaaccctgacttgaggtgtttgtaacttggccttgtcggctcaatcatggcttctaagtctactatggtttgtgtgttgttcacagcctggcttctattttaatttgaaaatagagattatcaccagcttgacatcatttctagttacttagttcttggttttgttttttgttttgtttttagtttttgtttttaaccttttttttttttctttagtagtcaagttactaacacttgacactgaagcaaatacagtatttcttgtctggtttttcttgagtgcacctcggcctctgttatcttgttaccagttgtggtgttacagccgggcttgcatgattagaccagttgatcctaactgtgactcaggtccgacaggtctctctctgaggcagatgtacacacacacacacacacacacacacacacaaagcagagtcagtttcacctgcccataaagacatttgtgaagggctcaactattatggtctgtactataaatgtgtttctaagcactttattataaactggaatttggcctcatagatgttacaactagattagtcatttgacctaatttgctgtggctgtctgtaatctcagcacagataaggtctccaaaaaaaccaagaataaagaaccatcctgctgaacagaagtctgtccagcagcagaaacggccacctgtggtttttctctctctactagtagcaaggccagatctgacctgtttaaaaggggccgtagtttgagattaagggtggacttcagaaggcttgaagctaaagtgttgtcctggagtggggcggggcagggtcgggggagtctttctctggcctactctgaaaccggtcacacggggccctcggttgatcttttcttgtccttgatgacactgtggatgtagtccacagctgggtagagatgtcaggttcccaacactgcttctgctgtgactttgatatgctcagaatagtggggggggatggggtggtcggtcaggtttttgtttttttttcttttaacagtttatagaatttaacagatagagttagtgtctttcatgtggcctcactctggagttaatgagaacatacacgtggtttacagcttttctatatacctttccctggccaccaggtgttttgaaagtgtgccacctttcaaactttgctttattttttttttaagtcgaaggtgataatttttctatatctgatgaaactcaatgtctactgaaataagtgtaatctgagctatcaacggtatattttaaacccacgctatggagatatcacctgcattctgtcatttgtcagatttacagtactttttttttcttttagcattaaataaaaataaaattgggagcactgaatgttttcc

SEQ ID NO: 34489 - DNA, 1089 bp, Mus musculus
gggcggcggcgtcccctcacccggctcctcctgcggcgcggcgggctgtgcggacatggccgcggcggtggcggtggcggccgcctctcggcgccagtcgtgctatctgtgtgacctgccccgcatgccctgggccatgatctgggacttcacggagcccgtgtgccgcggctgcgtcaactacgagggagccgaccgcgtggagttcgtcatcgagacggcccgccagctgaagcgtgctcacggctgcttcccggagggccgctccccgaccggtgcacagcccgcagccgccaagccaccgccactgtcggccaaggacctactgctgcagccgccgccgcagctgggccacgcgggcgccgaggccgcgcgcgctcaggctatggagcgctacccgctggcgccggatcgtgccccgcgcctggcctccgacttcagcacgcgtgcgggtgcaggcctcccacagtcggccgcgcagcagtccgcgccggcgaacggcatcctggtgcccaacgggttctccaaactggaggagccgccggagctgaatcgccagagcccgaaccctcggcgtgcacacgccgttccgcccactctggtgcctctggtcaacggttctgccgcgctggggttgagcggccgtgctgcggccacactggccgcggtgagcggaacaccgggcctgggagctcagcccgccgagttgggcacccacaaacgcccggcgtctgtgtcgagcgcggcggcggagcacgaggcgcgcgagccgagcaaggagaaggcgcagcccgcgcaccggagtccggccgacagcttatccagcgcggccggggccagcgagctgagcgccgagggtgcaggcaaaggccgcgcgcccggggagcaggactgggccagcaggcctaagacggtgcgggacacgctcctggcgctgcaccagcacggccactcggggcccttcgagagcaagttcaagaaggagccggctctgactgcagcaggcaggttgttgggtttcgaggccaacggggccaacgggtctaaagcaggtaggggcgactgcggggcgaggggagaagggatgga

SEQ ID NO: 34490 - DNA, 4328 bp, Mus musculus
gcttggctgaagatgatgtggaatgagccagataccaacaagataaaatctcagtaaaataatttaacagttagcttggaagctggtcagctctgggggattaagggcaaattatgctgtcatgaactgtcccacactgacgtctgccaaagcgaatatgaactttggtagatccattgtctgttctatttatttttccagtgaaaagtattttgatagagcttttcattttataaatacactgagttaaccaaatatcatggatttccgtttgttcttaagacatgcaattcaaatgtaaatacagtagagtattacttaggtagaaactcgtggtgattttaagattggaaaagaatctgaggaagagttgaataacacacattctaaagactagaacattttattgtatgttgtaaaattgggtagaaatttgtgtttgtgaaaactgagcattaaaaccttacagagaccgtttctcgtttacttaagaaaatgtgcggtgtgttgtctgttgttaattccattccctccgtgtgtttccttaaaagcttctgtctattagtggcttcctgtgctctgggcacttaactcctaatctttcaaacaccgggatgcaaacagcacagggattagacctgtgtgcaccctgacctggagggtgagctttgcctgctgtctgctcgcttggctctttatacagactgaggctcagtctgcctgcccgtctctggggtgttccatctcagcattaggtcagttggttctgttgagtgtcttcaggtccacctccagctggtgattatttcagaataaccagaccttgtacttgtttatattctgaatttgcatgtttgcctgacttagtatttctcaattaaaacctcttaagtggagtaatttctttgtcagttgctactgatgtgaagtgattctgttactgttgtgtaaattaaccagaaactcatccttaaggaagctggggtggtcttcttgtgcaagtgtttttgcttttaacagaattatctcttcagttctactatggattgattaatttatcttacacagtgacagcggcgtgccatcttgacgggagatcttgtggtctgctactatctgttcaccaagcagcattctcacaggacagctcacttgcatcagtgctgtagacttgtttgcttggctgtcctcacctttgcctgggtcagtgtagtgggaagaatctggaaatggaggtttagttagcttctttctgcctgtttggtgtttggataacagctttggacaactccattcactcaagagcctttctctaatgtttgctggtggaatgccagacgtggagaggcacacatttgagacctcttccatgagtccttctaggccttttgatcccaagtccttaaacactacgttcttggtaggtaatgcatgttttggggaatgatgctacaaatatgccagttgcattttgctggtagaatctttagtcccaagcatcataatggtgacttgtctgagattgacatcactgtagagtcctatgcagcccagacgtggagaagaccacagggcactgcttacagaggtactctgcagtgtgcactggatgccctggccctggaagttgcagaggtggagatgctgttttactttgaggctgattaagccaagtttgtttgcacgaaggacagatgtggggctttggcactgtcacttgtgaacactagatgcttgttttggttgcgacaactactttccttcatagaaacaaatgttgcaccccagctcacctgaagttaaatagatggaagcagaacactagatgcttgttttggttgcgacaactactttccttcatagaaacaaatgttgcaccccagctcacctgaagttaaatagatggaagcagaaagcgttggtgctggtcagcaaggccagaaggcaagattaacacccaactgagataaaagcagttttaagtgttgccatgggaagtctggagagggaatacatgttagggcatgttggcatgctgccttgggtgccactgtcttaactgaaaacattttagccagctgcctggaaagatgtaaacagccccagtagtgcacactgaggccaagtccaggtgctgtgttcctgcatctctgtccagcaggttaggtgtgcataccaccatgcacctgtgaccttgaaccagcctgcaaaccagagtgctgatgtactgtcatggaagtggtgtggctggtgccagacaaatccattcttctcacgtcagaaaatgaagtgttcattgcctgtgcctcagctgtattaaagggattggagaacatctggcttggtgtgtatttgcagaactgaatgctgttgattttggtgactacttagaaaggacaccgcattttaggttaacaccctaaggccctctcccatctcacccctttagtaaacaaaagcctgtttactgcccagtatggaaagtattttaggttctaagttaggcccttcttccttgatcccaggaggtgagagaatagcagtgtctgctgtgggtttggtgtctgggatgtgaattctaagtgggtgaagtggccaccaataggaaagggagaaacttgatgacagtgactcagcacttttgaaatgttcaagattttaaatttgttacaatccacagttacactaagcagtttccatgttttgggagtaaggtaattttacccttacccaatcaatacaggacaggttaccctctccctggtgtgtgtaagacacaactaaagctacaattgaaggctttggagaattaaccatttaacgtgcttactactttagtctacccacaggatgaggctacatgcaaaaactgcccaagtcaaatagttttgtcaagttaagtaaggggctggaaggtgaaaagttgaccctagagaatgcttcagctaccctttggggcaggtagccctggcccctgtgtgcaggtgtgctgtaggcattgtggagacaggggttgggggggggggtgtgcctgctgtacttgactgaagtgtaaagctttggtaaggatttggcctctagcagtcttaggtttctgcatttaccacggtgacacagcccctacagggctgactaggaacagcacatcctgtgctgttgaagctgtccacatctcattcctaaaggtcctctctctcttgtcaatcagggctccacggacagcaaaacattccctcaccccttttcagtttccttgatgtgacttacctctttttgtttatttcttttgagacagggtttttctgtgtatttatagctgtcctggaattgttctgtagaccaggctggcctgaaagttgcctcctgcctctgtccgccccccaaaccctgggtttaaaggtatacaccactactaactgttgaggctcagtctcctaagagctgggatttctggaatgtatcagtatgcccattttaggacccaccttttggattaaggaatatcgcaggaattagaacatagtcttagtagaacagctcccttctgactctgcttatcactgataaggaagacgtcaaggctgggttgtgagtttgaggccagtcttgggcacacagttctaagccatctttggaccccgtggagactggaaggttcaggatttgaattaggaagggtaaactgacaagattaaaatcatggagggtgggggctgggaagttttttgtttgatgcttttcatatatcttaagctggccttgaactcttgatcttcatgtcttaatccatggagtactggatttacaggtctgctatgcctagctacttatttatttaggacagggtctcactatgtagctttagctggcccagaactcaaagatccagctgccttcgttttccagccctcacaggaccaaacaggaactcagttgttcccaccttcattcctcagtagtgttagtatcaggattagatcctatcagggtgatgatggatgctctaattcccaagtactgggaccacaggcatttgcctccatgtttgtttttcaagagtttttatttatgtttctgacttgaatttcataggaaactgttggaaagttttagcttggtgttaaggcagagtttccagcactttctgaaatgaccctaaacactgcttccatgttatactgtgtttatgtaaagcagtgttctctgcatcaactatgaagttgaaatatcagccagctctaaataatgctgatggcgctctgcagcttacaggatcaaatgctcacccaaaattgttatgtaaaaagcacacccatttcttcttccat

SEQ ID NO: 34491 - DNA, 1023 bp, Mus musculus
aggttcgaggccagggcagactacacagcaagttccagaccctactatgctacaaggggagagcccgtctcaaaaacctaaaaagcaaacgcatgcacttcaagtcacaggcttcctgaaggacacagtgagatgagatgctgttctcagccggctcccaccttcgtctttcattagcaaggacagtggattagaggcttctgactcagcacgccacaaacacgtgctgcccctgaccccctggtcacgggatgacgcacaaatccttctgcagtgcacgccccgcccccagcttggcgtctcagccgcgcagactgggtccatctgcgcgtgcgcaccaggcgttcccgcgcaggcaccgccgcggacagcccgccgcggaccttcccccggggtcctcgcgcgccggaagtcctcgcgctcggccttttccgtctggactggaggcaggcggctgcgagcggccggcgtgctccgatcggtcggagctaaccgctgccaggcgggctgccgcggcccggcgtacgccccagtcgagcgaagatggtgggccggaacagcgccatcgccgcgggcgtgtgcggtgccctcttcatcgggtactgcatctacttcgaccgcaaaaggcggagtgaccccaacttcaagaacaggcttcgagaacgtgagtgggccccgcgcgcccccgagtgctccccggcgtcgcgctcttgcggccagggtcccgcctgtgcccgcgggcctccatcttggaggcgacctggctccatcttgctggcggtggaatgcatgctgattcgggggaggggtagcacttttttgcctttccccagctctgtaattctgggggatggggggtgggagacaggtctttagctcaggttaaggtggttatcctccagtttcaaggtctcaccacgcccagctccattcccccccactcaacttgtgttgaagacagggtcctcctgtgtagctcaggctgtaacccgcgctagcctcgacctcgtggcagccagcacc

SEQ ID NO: 34492 - DNA, 1275 bp, Mus musculus
ttaggtgtgtgtgtgtgtggaggggggggtgctcataagaaaaatactcttccaggaaaatgtgatgcttaaattagtatcactcagaatgaaacagctgtcccagaaagtttaaagacagcatctaataaatgatgttaattaaactgcagtctttaaagttgaatgacatgacaacatggtgctgcattccctaagttccagacacatcttaccaagctggggctggatccaggatgaagtgggggaagcaggaagccaaggctgattcaggcaggcagagtccagtaggcaagagggtaggataagttttcactcttttagttgtaaaagttctgtctttgggaaatgccatgtagaaaacctaatgaggtctttaaaacatagctctaggggctggagagatggctcagcagttaagaatactgactgctcttccaaaggtcctgagttcaaatctcagcaaccacatagtagctcgcaaccatccgtaatgagatctgatgccctcttctgttgtttgtttgtttgagacagggtttctctgtatagccttggctgtcctggaactcactttgcagaccaggctgaccttgaactcagaaatccgcctgcctctgccccccaagtgctgggattaaaggcgtgcgccaccatgcctggctgatgctctcttctggaatgtctggatacaactacagtgtacttacacataaataaatcttaaacaaaaaacaaacaaaccccatagctctagaggctggagagttggtttcttggttaagagcatgcactgctcttcagagtacctaagttcaattcctagtacccacgtcaagcagttcacaactgtctgtaacttgagctcctaggtccaactcctctagtctccccagactttgtgcactttttcactaacataacctacacacacatatatacaagtaaaaaataaaagtgtggggctggagagatggctcagtggttaagagcactgactgttcttctagaggtcctgagttcaattcccagcaaccacatggtggctcacaaccatctgtccgatgcactcttctgctgtgtgtctgaagtcagctaccgtgtactcacattaaataaatattaaaaaataaataaaagtgtgtagcttttacagcagagaaagctctatttcctgtatccaagactggataatttatggttggttttccttacagtatttagaaccttttcagttaaatttcagcaattttacctgatcactctggagcattt

SEQ ID NO: 34493 - DNA, 1179 bp, Mus musculus
ctcggtgggccagagacccttcacttactttagttagctgtccttcaactagatagacctctcctaagtaaggacccatgttttctcaatcaacagattctgttttcagactgtttggtgggcacagaaacctctgtaggtcgtagagagtgttgagtgtccagggcctagggcagagaatgacaataacgggcacccacagagtgtaaagtagacatgaagagcttatgtggctttcctttagtactcctgtgccctgtgctgctgccgccgctgcctggctttagtatgtcagaaaatattccttaaactctttgatatagactttgttttctaaaggtagcgcacagcagaagccagcagaaggtgtctgcagtcaggaggcaggactgagtgtcacatgctggtttttttgtttgttttgtttttgactcctcctttctttggttgttccttaaaaactagggaaagtgctctagcaagtgctgatctagaagaagagcttcatcaggaccaagggcagggaagaaggagaaggtctcagtctcggggtaaagtggcagatggagaagcactggacgttgccctcagccttgctaaggatgggggccaaagaacaaaaatcccagtcaaccccgaagaggagcggttaaaaaacgagaggactgtgtttgttggcaatttgcctgtcacatgtaataaaaaggtgagtggaagggggtagaatgaacctagagaagctattgactaaggttacgtttaatgagctcatagttgataactaactcattgctgcatctttgtgcttcctaatcagcacaccatagatgggttctgggatgtgtgtgtgtgtgtgtgtgtgtgtgtgtgtgtgtgttgcttggctctcagccctaatttaggcttgtgaaggtcatgtttgaaatagtagtggcctatttctgttttttttcccccctcttcacctttcttcctgttaatgccactagaatgtaaaccaatacacataactctccctccctccctccctccctccctccctcctttactgttctgtcttgcacacatgagaggatgcctaacacagtaaaggttcaaagaatatttgctatgtggaagaatgagttttgccttctatgtgggtgtagttggtagtctatgcaaacctcaggctcaaat

SEQ ID NO: 34494 - DNA, 1145 bp, Mus musculus
acaagccaggggaagcaagccagtaagtaacatccctccatggcctctgcatcagctcctgcttcctgacctgcttgagttccagtgctaatttcctttggtgataatcagccatgtggaagtgtaagctgaataaaccctttcctccccaacttgcttcttggtcatgatgtttgtgtgggaatagaaaccctgactaagacacttgcatgtttcggcaacagtcatgggaagtgtcttctctcatgttcggacttcaagatgggaaacatcctctgccttagttttccaaggaaaggttcgttgccgagcttcacttcacaaacagcgtcggccacgcaacgttctttctcttcttgtggttgtcacttattaattctgagactgtggaccccagggtcccgtttgtggtctctttagagccagtaaacttatcccttgtctttctctcttgcaaatacttgccacttcactgcccaattttgctttccctctggtttcagttaaaaataaagatttgggcagaagtatgtggtgtgctgagaatcctgggaggaggctgtaggtcttgtcacccaaacggttcatttgtcttcgagcttcagctggtgtggtgtgagatccaacccagaggctttgcagtctctttcagctcagtggttttaatgacagattgttttatatcctttcataggcccgtgctggatagttttatgtcattctgtcacaagctacagtatctgcaaagagggaacagcagtagagaaaatatccctatgaggttggcctgtgggcaagcctgaagcacattttcttaattagtaattgatgtgggaggacccagcccatggtggtaggtggtcatggggtgtacaagaaagcagtctgagcaagtcagtaaggagcagggcagtaagtagcattctccaatgacttcttgagttcctgtcatgacttacctggatgatggacctataagatggagtaagtcccttcctccccgagttgcctttggtaatggtgttttatcccagtagaagaaaccctaagacaggtcccaaatgtgtgtagcagaggtagctagctgtagagtttcatgctgcttcccagaggtcatggaacaaagaactataaatatctaagtg

SEQ ID NO: 34495 - DNA, 1151 bp, Mus musculus
agggtgatctggagcatctcttctgagcgcagtgctgggtcttcagatacgccctaccacatccagtttatgcgatattcgtgatgggccctaggacctttgcgtgcaagctgagcattctgccattggcacttagtccccagctcctcctggatgctattgtattacacactgagtattcaactaaacatgtgcagatgctgagacactctatgttgaaacatactctgcccatatggctttgtgagtgaatatatgtgctgctgacctcaagacaatagcatatcaccccctcccccccccaataatgataaactctcttattacaagccgagggtcttggtggcgcatttggtgtgtgtgtgtgtgtgtgtattcctggggattgaacccaagatcatgtgctcaataggtaagtgttctaacaacaagccaccctacaccctctcctctggtttcaaacaggtcataaaaagagaatttagaatttagacaactagttgaatgttttatctctagcagttcaactggtgagcgctctctctctctctctctctctctctctctctctactgctcccctgcagtgcactcaaacattagtttcatctggtccatgtgcactcccctgtagctgatgtcatctctgcggcacatagatctttctaggactttgtgttcactgagcagcagaggcatgtgcagttctgtgcctagtgacctttgcctgtgtgtgccttatgtgcatagctttgtaagttagggggaaatcccccatggtgattttggattgccacttctacctatgtgcacgaaagacttactctctgttttttctggccggggctgtaaagagatcgttttagtgtagcctttgcctcctcaggtgaggatgagtgacttgtggttgaaatttattttaacaggttgtgtcaaactgttaagagatattgaaaatgtttaatatgagagtcagaggcaataaatcacaaatgcctgtcgaaacagatgtccaagacacatggtggatggagccagtgtctgcacagagacttggcgtccctccccagtcaggcccttcatcctcacctcgtaactccacagtaatagacggctgggagagcgggtggtgaaggagggatttaacaccac

SEQ ID NO: 34496 - DNA, 1105 bp, Mus musculus
catagaggtgtttttaattaggtcctcagtattattttaggtacatatatcctatgtgaacaaattagaacaccttcgatcctcctgttatatcaatgctggggtaaggtgctattttaatctatttttgtgttaacagcatttttatctggagacctcagaccatgcgttatacaattgcacggaaagtgcgtgtttggaggaattaaacattaaggactggcaccgttgtcttgccagccgtgcactctgtgctgtcttgatacatagattctttaaaaaggacttctctcaaggaaggaagaaggtgggatgctcttgggaccttgagaattttgatgcaggaatggtagagttgtcaatgtattccctttgttatctcctgtgtgattccagacacacaccgcctactcttagattttcatcacacactgaagaagtactgggcagtgagtgacaatcctcggtctggaaggtggcccagcatcccacaccccagagtctgaggcaaaaggatcaggactttggggctagccttagctacaaagggagaaagactctttctcatacaaacaaacagttatctgcctttatgtggtgtcggcttggtgctggcactttactctggttttggtcctggtactctgttctgttgggtgtgtgcacgattctctggatttggcttctccacttggtcagcttcactaagccagccctggctccacattgccttgtgcttgggtccctctggcagttataaatattgctgttttttttaactttcctttctggtatgacactgtccataccccttgtcctaaccctccccttcccaagctcagcacctggaagtggcctgctccttttctgtcacagcccttaggtgactctgatgaaggcaggttcccatgcattccacccagtgttttcctttgtttgtttggcttttgagagaagcactgggtctctttccagttccctgacatgtcagcccagccatgcttttattgaatacatttgttattgttgaggaatgtctgcttataatttgtatttttgaaagtatttttctctttaaacattttgtagcaagcattttgataaa

SEQ ID NO: 34497 - DNA, 1194 bp, Mus musculus
aaatcctgccactaggaggaaaacagtacttaatatcagtatgtcttttctccatcagcctgctgatttatactgtgtcaggtgcatagacatttctcagcgaggtcctacctggctagttcattgattgtctcctgcgtctttaagctcactccctatagaccaatgtttcatatgatagaaaaagaagtgttgaaattccttatgatgacacaaagaagtgattaattttgtgtgagcaaggcaatttttcacaaagagtactttgtgcatgcaaccaaaagaattttaaaggcttgtgataatttttgaaagggtgtacatcccaggagagagacttcaaaaaaaaaatatacatccaaaatgaaacatctttcctaattggaaggatgtcagatgtcttcagtcacactttctcacttagcggataagagagatgtgtcctaaaaccccgtgatgattttgctttgttttggttttgactgttccctcttggggaatgccaagctctcccggtaagttttaatgacaccacattgactggaagactctgaggtatcaccatagcctggtcccctggtccccatgtgatgagatccttaagacatttccccaacactcacatcacagtcttcgttctgctctggtgtcggagttacagaaccctggccagtgacttgcctgaaatggcatattgttcctgaaccacagtttgaatgtgtggttctctgggcagtaggtgcctctttagtaacagccagtttatctctatcactttgaatggatcactcagaaatgtgaccaaaggccaaacctaaccatactcctctctttttggttggattcccactgccattaatattagaacatgagtcctattttgtattaggaagcaactcataagggctgggaatatagctaagagtacttgcctagcatttacagcgccctgcttccagatccacaaaattaggttaagtaagttaaaaaaaaaaaaaaaagtaagtaaatgaacagataggtaggtagatagatggataaaatcccttcatgagtcttcttagtatttctcctttgaaaaaccttgagagaccttttcaactattcagccaccttaataacaacaatgaatagcaggcatagtttgccaacatgtttactttataaatatactacaatctcctttttgtcagc

SEQ ID NO: 34498 - DNA, 1156 bp, Mus musculus
atcgagacagaatctcatatatccaaagctgatcttgattttacgttatagctaaggatgaccttggatttctgattctctttatctcccaaatgctgggattacagttgtgtgccacagggtcaagattatgtggcaccgaggtgaacactgtagcaatccacttcctactgtcctgtatgctctaacttcaaatggttttaaacgacatgtcccacagtggagtccagtggtgctaacattctaagtttgggtttgttccacttggtaggaattggtaaaaccttcactgtcatgatgtcattgttcctacggtcagaggagatgctcgactagtgtcacttccatgtgacaacaaactggacagcaaggatgcatctgcaatggttgatctggttgagtgggcagatctcgtgctacttgttcagcagggtactttggaggggtgtgaccagctgtgtaggtgacagcctgccattgacttcaggaacctacacatctggaaggtggatgaatgaaagaagtttagaagctaaagtatacatgaacctagatcgttggcaataagttgttaaagtgattgttgaagatgtgagttcagtccccggactctatgttttaaaagaggctgtgcactgatgcatgcttgtaatcttaactctgaggatgaggagtcaaaatgtccttaaagcagctcactggcagccaactttgatgagcttgtaggtacaaccagttgtttctgttcctctacccaagtatgctttaagtttttgtttgtttgtttgtttgtttttgttttaatgaataagctatttttagtttagagcgtcttgtggacgttcatttgaactcttctcctttgctggcacttggtattgatacctgtttccttcctgtcttgtcccctctcagccatgatcttggcttttcattcgtcagttattgtttgtttgttaaggatctcatgtagcccgagctgacctcaagtactgggaccgcatgcatgtgctactacattaagcctctaatggttatttttctcactacacatctcaaaagaactgtgtcttaagatttccttcctgccttgaacatgtgtgctccatgcccacccccgtgttcaattaaagccaactatttcgcttgccaggag

SEQ ID NO: 34499 - DNA, 1153 bp, Mus musculus
ttatagcataccccccctcactgtggtcttatttttttctctctacactgtagagtggaagagaccacaggattggaactttcagtaatggccaggtgtgcctcatgactcctttcttcaggggaaataatcccatggatgtctaagctttggaaaacggttggttcctgtgttttcttttgttttctagctttctacactggcaagttaattctggaccacttcatcctctcgttgccagacatggtaatgccttcaaatgttttgagtggttcttctgccaaagacttctttcatctgtttacttcattcttatccacgtttccccctagcaaatggttccaaggcctaacttttacatttgtcaaatctgcatctttcttcctcaacattcacccttcggtacccccttctcttttgctgtattgtgtttccctggccatcgttgctgtctcaccctttggaggtttatttgcctccttcatacccactgctctaaagtactgattctttttgtctcttcttcctgtcacttcgacatggcagaaattgcatgtagtagttgatccattcattgcaagctgcagacctgacttccagtgtagctctctccaaacacaccctaaattcagaaggaagttacttctttattgtgtgactatggtggctcctgtgtcccttctccctggattcttaccagcctccctcatctcttttctcttcttcctcctccttccttcaccccctgcctagtgatgacgtttcacagaatatgtctctgatatttctccctgagttttgccgccgttaccttttccttatctggtgtaatatagtatgttagtgccactattggccacctatgagcctgctcaaacaggccaatcagcactaccttccggagtctagctaggtggatattcaacagaaaggttgcagaagcaaatccattttgtcttgcttggtattcttacctcatggtcttaggtctcatccagtttccttattccttgctgtttcctacctcaggctgtgttgagagtttgcctgccccttgctgatgcacagtgctctgctgtaggcctgtcttccctcttacttaaatttcatccttcagtgcttgtgtctgcacactgaggatccactttaccat

SEQ ID NO: 34500 - DNA, 1190 bp, Mus musculus
aggaagatatactgatcaacttacatgtcaaaaggatgcttcaactcccctccccaccccacccccctctgccagatgaggtccctccaatggtcacccaggttagatggttacactgtctttttccaggacctctggcatgcgtgatatgaattcaccttagtgcttgtggcataccagttttgtgcctgtgccctggatttaggtaatgtcttgttttgttttctgagataaggtttcatctattccaaactgtcctcaaacttgatatgtagctgaggaccttgaacttctccaacccaatgctgggattacaggtgtacccacataggtcaggcttattctacactgggagtcaaagaaggttccatgtgtgctaggtaagctctctaccaatggaactttatctccaataggtttatgttttggttacaaattatacccagctatgggtctttcttggacttaaagaataatgattcaaagacacttaagggcaccacacttagatatatatgaacagaagttccacagacgtgactgtctctatgtgatgagcttgtatgatttgaatgttaactgttacttttgtttttttttcttaaagcaataagtaattattgaaaaaccataaacttatgaaaaaccgggcatgatttgagctacacatatagcgttagtacttggagtcagctggataaagagtatattgtatatctagtaaggctggctctcctgggcaccacatttctttgtatggccatacccaccattgcttctactgagaacccagtgaagacactctagctgtgacatctaggtgtgaagcaacttcttcttgtgccaggaccacgtccttttcccacctgaacctccatcctcctcatcttgctgccctggccagctgatgccccagactgtatctgtgtcacatccctgtgatgcacagtaggtataggtatcagctacctactgtgatagctaccatcacagtaggtagctatcagctcctttgcctgtcctgtgtgtctggctcctgcccctgccctctatctggtattgtagcatgatatatttactgactctcagagaatcctgctgtgggtctggaggcagcacatactcctagtttgccactgaggtagatagtctcaccttaaaacaaaataggcctctcgtggagaggattc

SEQ ID NO: 34501 - DNA, 1140 bp, Mus musculus
tattgacaaatgttaaatatgaatgtgggatgaaggaaccatgtgaaggaagatccagggagagctagtgactgattagagtggggcacaaaattgactaaatcagcctggagggagaactcaatcattaaagtacttgtctagaagcattagaagcttgaatgaaagccccagcactcatgagaaaaagttggatttgatggcacactcttgcaatattagcacttatgcagagaaagatggagtcttgggattcaggagtcagatagcctaacctgttggctcagttccaggtcagtgagagaatgtcttggaaagtttggcagtgcctaaggctgacccctacacacacacacacacacacacacacacacacacacacacagagagagagagagagagagagagagagagagagagagagagagagagaataagaaattagctaaatattttgtttcagctaaggaagatttattttggctcagtttgagagaatgcagtccatgatcccttatctacatgttcctgggcccatagtacgataatccagagataaagcccatcacaggagaaaccatgctggctggagaataaggtagttggtcacatgacatacacatcaggaagaccagactgatgaatactgctgcttagcttactttctcgttttactcactgtgggcccaacatcagaggatggtgctgctcaaattcagggtttgtcttcccctctcagttaaatccctctggaaacagacatgcttagaggttgttttccatgatgattccatgaagtcctgtcaagttgacaattgggattcatcatcactttaggcaaatactctatgactgagcctgaaaaaaaaagttcttataaagtaatactgacaatggtgtaaaacacactgaagactatgtgagaggcatgtgccttatacatccttccatttcagagatgtttttggtgccctttaatggggccccaccattctgccacagtaacacagatgcctcgctctgtggaaatctgctttatctgatcagaagcaaagtggcatatgcattccccaaatatacttttattaatcagatgaaggagatccccatgctaaagttgtcttaatagactgctaaaat

SEQ ID NO: 34502 - DNA, 1182 bp, Mus musculus
ataaaatctacagcccccagaaactgtatcctgaggacacacctaaaattggtagggtggttatcttaaatttttcacttcaagcatagtttatattctaatcagaaaactggagacagtctttctagtatttactacaagtaaaaatgtgccagtctagattgagtcaaagaaatgaaagctcaattggttatgagttggatgaatatgggcttggcagttatttaacatactaaaagtggagtggaagccctgaagacatttatgtggtatgggcatgagattgtcagtcataaggaaaaggcaatacctgacctaggtataagagtaccaggacatttataacccgcagaacaataggtgctgaaattacagtgtcaacagtatggtctaatggtgtgtagctaggctaatggtattagtactagtgtgtcatgcaaaaagacaagatgattgccgtttgtggttctcagtgtcaaggggaccccaggtcattaggttttctttggagtagcctggtatagcttagtaactgggctgcatttgttcatttttaacatgtatgtttatttgcatattcctggtctctgtttttcttgtgatcttttcatttttttccctttgaaactttaaagatactgaaaagtacagtgtttttgtttcttttctaacagataaaaatagatgtttaaaagcaaatgccaaatcttgcggagaatgtatacaagcagggccaaattgtgggtggtgtacaaatacggtaagatttctgatactgttctatttattctctgatttttagacttattcagagccttgtccttgggaagtgtcagataagatataccattttaattaatgtttattgaatagtgtatagtagtcagaattatgctgtttgacaaaatacttgtcttagttaattttatttgttgtgacaaaaaaccattcttaaggtaacttataaaacaaacaaacaaaacatttaatttgcggctcaaagcagagtgtcagtccatggccgtcatggctttgagcattgccccagacagacagacatggagctggggcagtagttaaaagcttacatcctgattgacactatgaggtagagagagctaactgggaaagttgtgggaatttgaaagctcaaagcctaactaacttcagtgaaaggaaata

SEQ ID NO: 34503 - DNA, 1190 bp, Mus musculus
ttgctattttttatcctaacagacccttgcttcaaatttagtggcaggtagtctgtaacaataatataattgaaaatatttgagaatctagccctgcaaattgatacattcctttattcccctgcatttgggaactagaggcaggcagactctgtggtcaaagttagcctggtctatttttctatttttctagttgttttgttgtttgttgctggagtatgctttcattttgctcagagtggttccttgctaaaggtaaattttccccaaggctcctgtatgttctataagaacttgagttgctacttgcatgtgtgtatatataaacacagtggacttatcttatgtttgtacatgtggagtgagcatccctacttgatactttgctaatgtgaggaaattgttacactttttgttttatgtgactgtgtttggatctttctgcaggtgcaatgaggggcgtgttgggaggcactgtgaatgtagcacagatgaagtgaacagtgaagacatggacgcttactgcaggaaagagaacagttcggaaatctgcagtaacaatggagaatgtgtctgtggacagtgtgtgtgtaggaagagagataatacaaatgaaatttactctggaaaattctgcgagtgtgataacttcaactgtgataggtctaatggcttaatttgtggaggtgggtaagcaccagcagtagctacacacatagttcctctaatgagatcagatatctgagagtctctgggttaacacacagaaggggaggggctttcttctatgttgtggcttgtttttaatttgtgaataattgctgtgattatacattttaccattgttttgagaaatgatctttttcgttgcaggcaatggcgtgtgcaggtgtcgtgtttgtgaatgctatcccaattacactggcagtgcatgtgactgttctttggacactggtccatgtctagcgtcaaatggtcagatctgcaatggccggggtatttgtgaatgtggtgcttgtaagtgcacagatcccaagtttcaagggccaacttgtgagacatgtcagacctgccttggcgtctgtgcagagcataagtaagtactgccaaagtgtttcacatagtcacattcactttactgaccctacaccactagagccagaggagagtgctgatagagtatacttcaa

SEQ ID NO: 34504 - DNA, 1098 bp, Mus musculus
agtctttagctaaagaaatagattttatgacccccaaataaatgacctgctgatcatattttctactgtcttctaagctcccttgttagagcctagtagcttctttttgtttgagacagggtcttaccttgtctggtctggaactcactttgtagatcaggctgacctcaaactcctagaactccattttgagattaaaggtatgtgccaccacacctagcctggaacttagtagcttttaaataggtttttgggacagtgcagtctcttgagtgttcagcactattaattttgtaagatcccatccaactctttgtggtcatgtgaactttgtatatactcagtctttttatgctcacgattaaccttttcatttgtagactgtcctactggtcccgacatcatcccaattgtagcaggcgtggttgctggaattgttcttattggccttgccttgctgctgatttggaaacttttaatgataattcatgacagaagggaatttgctaaatttgaaaaggagaaaatgaatgccaagtgggacacggtaagttatgaaacattactgagagcagtaggatggttcctgaagtaaatgtaacttattaatggtgaggctgacctttaaagtcttctttaaatattttatttcccccaaagttcaaaatccaaagaagttgcatttgctgaaaacaagaaacctcctattcaattaataatttaggaggatatgatactctgtatatatagtggccattgtgttttagttctttagtaggtcagattctaagtatgctcctcagctcatttgtctaatataaaagagaatcttaaatgataccaccagtgtctctggccacactagagctcctcttcccctccatacactcatgattcttttcatatggtttctggaatatacaaccaaattgttatttctaaggctagactgaggggagggctgactagaaggtgggattacaacaggccttcttagatgatttctaggtgtgtttgcacatttggaaatactcagcctgagcttaatgtatattttactctcttcagattgcatctctgtaaaaacttgcttaatag

SEQ ID NO: 34505 - DNA, 1806 bp, Mus musculus
tttagggtttccataagttggtacaagatcttcagagactctaatggcagctgtaaaggttctgtgtggaggccttttgtgaggtagccctctagggatgacggactggagtcagagcacaatattttaatagcctgagacttttgggtcagagctggccttctcaccactgtgtcggattttatctttgccttctaaactctatttgacactggatattggaagagacttattaagacaactgcagctattaatcttgttttggaacactgattttagagagtaactggcaatttgtgttttttttagggtgaaaatcctatttacaagagtgccgtgacaactgtggtcaatccgaagtatgagggaaaatgaatcctactcaggcggattttgcaacaccaagctcacagcagcagcatcttagtcacagtagggtagttttggggctctgtggccagggttttattcacatgcaggtttggaaaatgtacaatatgtataatttttaattttttattattttgaaaataatgttataatccatgccagggactgacagaagacttgagaaaggatctttatccttgtcagctgaggtcacagtgtgcctttttaacccttccttctggaccattggaatcaagctctcactagattgaatgacactgctagtgccaatgcagggcagagctgagcagcgtcgcagcatctgaaccatgactgattttcagcttcacagggtggccagggctggttatacagaatcaaagaacagtccttgctggtggctttgttctttgtttagcctgctggctgccctctgggaattcccagtgatgtatgtggaagacaagagtgttgacagtttccaattaaaataaaattgacacagttgatgttcaagtccattggaaaaattctgagaggtgggaaggaaatcttagctttaaaacctgtgtgccattgtgagttacttgatcctgtaactccgacgccttttctttataaatccaaccttggataaaagtactgggaacttctctgctaaaaagtccctgacttagcactattcacataaaggccataattttagtagcattgctgagtggggaccttttgggttgagcttattttacctttttttttttctttaattcctggtgctcctttatcaccttctctaatcttttaatgtgtctgtttgcaatatgggggttagactttttatcattaccttttcttttccttggctgtacatttacctttttcacaaatactgtaagctgtcctgctgcttgcaggactacagggcctgggcagggccccccagcaacaattcacccacagtgcacctgcacatgcctttcctacatgcttgctctgtctcgaactagtcacaatcttgttttaagtgccttttcattttgacagtgctattaactgaagttatttattaaaataaaaaggcctaaatacattaagtgatttgttttggctctgtatttttattagttttgtgcatttttatgtgttaaagatatggtagagaaacgtggctcaaaccacttaagccaaaatgactcattttagacatgtggggagtgggtagtagaacagattttagttaggtgttttattcttacgttagcagaacattttatgaatatcattttaggctactagatgctggagaactaatagttaagagaggggttgtattttcattcttaggaagaactagggaaatcttaactttcttttggttttagtttatttttctgtaaaactatttccataaaaaca

SEQ ID NO: 34506 - DNA, 1174 bp, Mus musculus
ttctaaagaaaataatccccaaagaaatacataatttaatagttagtattttcagttcatcaaaagactaatgctggctaataggatgtaggtgtcttttctttttatgttcatactggcagaatcatcaacttatcacttacatactctaatcaattaggtagttagctaattgataatgttgtgaatgtgggtgcatttatgccgtggggtcacgtacataagtgttccagtatattttgcatattacatgtgtgagcatgtgtagtggctagtagtgaacattgagtttcattccaactgtgttattcattttgtttcttttgagacagggtttctctttgacacataactaacaggttagcttaagcagactggttagtgggcctcagttttaggtttataagccatttactgagctatctcgccagtcacactgcccatttttcttcctcttttccattactcctgacacccctctgcactcacatagagaccaaaggtggatgtcaggtttttttctcaatcattatcttagtttaaaattatttattcatttgtagtccctttctctccctccccctcccctgaaggctgtgccctattccttgcctggacataatgggagagttggccttggtgtcatgagagcaggagtactgttcttgcctctcatggggtgcagcaacttgggagagcaggccttgtaccttgcctggcagcacagtagagctgactgtagtatgggtgggagtgatgatgtgagcatggcagacctggccccatacctggggagtgtgggcaaaggagagatgcccttccccactcttacccgttaccgcctatggcaggcaggaaaactggccctggctcacaagggtgagagagttgtcactgcccttcaattgctgcagcactcaggagagcattccctgtaggtcccctaggcagtacagtagggctggacttggatgtgggctttgttggtgagctggccctgaaggtgtgagcatgggagggtataccatgctctattgtgcagtagagtggacaagggagagataccttcctccttttcctcattcttcactattatggcatgcgggaagagttggccctgtggtcctgagagtataattgtccctgtccatcactgagtgcaacacttgtgaga

SEQ ID NO: 34507 - DNA, 1165 bp, Mus musculus
cttttagagcaacaagagtagatgattctctatctctctgaattgttttctgatccatgactgtctcctgactctccccctttgatcttccaggtgtttgtaaggattgggtgaggcctgtgtgggtctgacctcacatcttggtcacattgaaggtgttgaagcaaccttctgtacttttccttttgggggctttgttcattttcctccatgatggaatagggccgcttgcgacccttgccaccatcagcaggcttcctcccagttacagtctgcttttcaggaccttcggtcaactctaggggttttagttgtttttgagtctctccctgggtttctgtacctgacacttgttaggctgttctcttggaagctctaggtcttgaggctcctgaggggtcttcttctgagccttgccaggctctctaaataccatcctgttccttcctggcatttcctttttggaccttgtcccaaagcttcagactctgtctctatcccactttaatcctggtatttctgttttcggacttttcctgaagctttgggcttcatctccaacccacactgtgtagattgccacatggagaactgcttggattgctttttcaagtgtgttgactataatatagtactgcctttctaatttccaagggaaagcaaccatatgccttgctccgggtgggtactcttaggttgttcaccctgatgtacaaagaatcactcttccagtagatggttggtccaaggtcacgaacctatgaggctcctttataaacagttgactttgcaggttagggtcagtcaaagaatggacataattaagatgtcaatatcggagactgatttctgtgtagtcagaggttggcagttcaccaggggtccactctcgaaaaatcggaggagttctaagaatacttcgtaataagtatctatcgttcttgggttctgtaaccagctaaatatccaaaacttcgaaataggactcatcttcctagttaatcactagtaagacaccaggcctaaatctagcagctaccgcaatggaagcaaccttaaaaatgatgtataactcagagggttgccactaggcatagccttcaaggttccattgctcggtgtgatgtcacctgaaagaacactaagcaatgtttttgaagggtgg

SEQ ID NO: 34508 - DNA, 1250 bp, Mus musculus
aacttttgtgttaaaatctttttataactccaacttttgtagggtcatattgaagcaattatgtgagattttaatgaagtgaatattcctggacaataaggaagtatctgaagagctgggtgtggtggcgcacacctttgatcccagcactcgggaggcagaggcaggcgaatttctgagttcaaggccagcctggtctacagagtgagttccaggacagccaggactacacagagaaaccctgtctctaaaaaaccaaaccaaaccaaaccaaaccagaaagaaaaaaacaaatatatatctgaagttttatctgaaattgtttgttccaaaaaaaaaaaattatactttctcactgcatcttgctattacattctggatgcctgcccagaaacactttagccagaagattctcagtaattaatagaaatttaattcaacagatactcattaagcacacaccctatactgagtagtattaaatactaggagtgaagttgtaaacaagtaaaagaggttggggtgtagatgaattgaagaacctatgtttgtcattgaagctctagatttagtactgattaccacaaacacagacaaaccagcaggaaacaagaacgaagtacctagggagctgaccttcaagaagggatggctggtacaagcgaacaaataagtaaacatggtgtgtgtggtgatcataaatgccatgtaaagagtataaaagtctttgagcaaaagattacttttcaatggcaaaaataactactaatcccgactaatttattaccagaaattactattcctgatccatttgtctaagctctaaacacaactctaatagtttccttgaacagttaaattgcaaaagttaaaatgttttcagtgaaaccaaacattgttcttgcagtcacagttggctgtttcttactcacagtttgtctcagttcaggacaggggttgcatttttatctagtcagtgaaaccaaaagcatgttcttggaaagtattagtaaaattgatgaatatctacccagactgagtataccagggggaaatttttgtgatttttgtaattgcctcaattaaaaaaaataattaaaaataacatgtaaatgttttaaaaccatcatgttctttaaaaaaatgtttataatgaacaatttttaaaattgtagtaggattttttaaaaattctatttgcatatacattttgttgtctatttttttctcttttgagagggtatctcata

SEQ ID NO: 34509 - DNA, 1099 bp, Mus musculus
gaacaggctgttcttgaacccacagaaacctgcctgtctctgccaagtgctggaattgaaggcaagtgccaccatgtccagctaaatacatttaaaaaaaagatataagatttttagctattcctaaatcaaaatttgaatattgttcttgtgaattcaagtttccaagtaagcaagttagccacgttgactgatcataatgaaagactccgagaggaacccctcgctcaggcctcaggacagtagtggaccccctagaactcatgagagaccaagcttgattccatgagagaccacatgaggctttattcgggggaaagccagagctctggggacaactcatatcccacacaggggtagaggagtcaacctcgtgaggaaaggggtcccagtttttataggctctcagggggaaaggagaaggggggagtaggggggagtagggaatttccagatctaaacaatgtctattctcaagaaatgggtatgggaggggtacaaggaaagagtctggtgcaggtgtagcaactcaggattggcccggctgtggttgctggggagattttcccactcttccccagcaaacaatatcacaaacacctggcaatgggcttcatcagtgggcacacacatgggttccaggaactgtcaaaacattggcagacacacgggttcaaggagtggccagagcattgtgtaactctatttttctaaatcagtgaagctagttctcctaacaatgaaatctatcttgccaatatcagggcttctgtgaccttttacattctgtcaggatctttcaataagaacaaaatctcttgaaatgtatgtttactcattaggctaattttaatatttccttattattgaatattttagaaataaacttaaaggcaggcatagaattgaggcaaagacaggcatgagttctcgtctgctccgaagtctgtgtcccagagttaaaaactggcctagggttacatagtgaaagtgtactggctgtttttttttgtgtcaacttgacacaagctggagttatcacagataatggagcctctcttgaggaattccctcaatgagatctaactgtgccacacct

SEQ ID NO: 34510 - DNA, 1371 bp, Mus musculus
tggcatcccatagcacgaatgctccaaactttgtccttgcatcagtcggtgaacggatttgtgtgctttccttcagtatcgttttattataagaacctccaaggaaagatttgacatatagctaagttagattggtctccaccagtgtaccaatattctaggaaatcgttgagccaaccttgggttttgaatttagttagaatgctactcattcagacgaaatgccaccagtgtagatagtgaaagaaatcaggcattacaatttactagataagagctagaaatcccagggctagttctacaaagtaaacttagaataacagccaagtcactcccatatacaggaatttacaatggcctaggaagaaggaaggttgtggtctaagaaggaactagagtaattacttagaataacagctgagtcactcccatatacaggaatttaaaatggcctacagagaagatggattattcaatagactagaattggaactatggcaagggcataaagcccttggccctggcttctaagaataagctgaccttagttgggcctgctttttatcccagttgtaaacactgtctggttccttgtagcttttatgtatgcatttctgttttgtgtaaagagttattttgcatcgggctacctcagtataccttggttgatcttaatgtatcacctaacttccttgttttcttctgtgatataagtctcatcctcgctttgagacattacattcagatccaacactttctctgctgtttgtcaccctgctgactccttgcccaactgagtaccggaaccctgattctcctgagggttgagggactgactgagtccagtccgaggcacaactgtaaggcatttttttcaattagcaatcatggcgggagagccccattgtgggtggtgccattactggactggcagggggtggtgccatccctggactggcagtcttgggttttatatgaaagcaagctaagcaagccaggggaagcaagccagtaacatccctccattgcctctgaataagctcctgcttcctgacctgcttgagttccagtcctgacttccttggtgatgaagagcaatatggaagtgtaagctgaataaaccctttcctccccaacttgcatcttggtcatgatttgtgcaggaaatcctgtcttaaaaaaaaaaaagtaaatcagacattcatttccatcatttcttctcctttgaaagggcatcctggggtgtcagtcaaaagtataggaagaaatatgtccattgaccctgcaaggcctaaatgcaacttactgtatgttttctaccaatagaattaagaagtgtttgtgagtttttgttactactcatttctagca

SEQ ID NO: 34511 - DNA, 1188 bp, Mus musculus
tccccttaaatgaacattaaaataggttaaaggtttggggagacagctcagatagctggcatagtagtttgcatttgtaaccctagtgctccagcagaaagatgggaagtagaaacaggaaaattcctgcagaagctcaggggccagatactttggaaacttaaggggaaatttcgttatgatgactgaataagtgaggcagggattagaaaaagtcgttatataaagtagcaaaaatgagagatcctgtttgaaacaacctgaaaggcagaacattaaaggttgtcctctgacctcttgtcatatgcaaccaaaggggaaattctgttaataattgattgaaaaaccatgacagggattagaagtcaaactacctgggctttattctgggtgccttaggtggtagatcatttctagtccctagttgccaatgggatgatgccattatttattgatatcattaatattggcttagcattttggcacaatgtgttggtcctgttttctgtgaatgtacatacaccttgtgtgcatgcttccatacattattagtatcctgtctcgttgttgaattgcttcttttctgttatggcttctgaaatgtaggtttctcgtagttatatgatacaggaatatactggaacccctgtgatctgattttttttttccagattagataatatgatgttggaagtttgaggcttttaatgaactccctgattgtctgaagggacaaaaaaaaaaaaaaattagaaatcatctccatatatttggaagaagactatttctgagtgaccaagtagtggtaagagagcaaggtagagcttttaagagtaccagaaagagtcagtgaaggaatactgctggaggctatttatttgtgtaaacagtattataagatgtgttagatagttaaatgccaggattcttggaaatttgaaaaccaatggactttagagctataaaaaattatcagagccaggtgtggtggcgtatgcctttaatcccaacactcaggagacagaagcaggtggatttctgagttcgaggccagcctggtctacaagttgagttccaggacagccagggctatacagagaaaccctgtctcaaaaaaacaaaagaaaaaaaattatcagtctgattttaggactataagagatcattgtctgagttctgcattttgca

SEQ ID NO: 34512 - DNA, 1212 bp, Mus musculus
tattatatttaatagcatgataaataagtaggtccacttttattgcattgtatatatatgtatatgttcacatttttctttctctttaaaaggaaatcattggtggtatgctggatctagaacctagactatggaggaaggggatccgagaaagctttgaggaccagaggaagaaatcattgcagtttgctcagtggtggaaaccatatgatatcaccaaaagtaaaagctcttaagtgtaggttatgtttcattttctatgctgaacccattcagtttatgtctattatatttacaaacaactgtgctttgggctctagggaaagcagcagcagcagcagctggccactctagtcactgacagccatattaggtcaagctgttttcttcctcatggttcctggaaacatggtttgggtgactgtggagtaagaacaactgtatcaatattatgggctcacatttcattctgtgtctactagatgtaccaaattactcagttactctagagatggacttgtttctagaggtctagcaaggctacaggggaaagtgtgtctgcttccaggtagagtctgccatctaggttcttttgtgctttttaaacaagactggatgtattcagtactaattggaagtttattttcatagtttcatggaagagtttctttactaatagcatatagtatcactatgtactatcttggtttaaagaaaaggattaaagaattaaatgataaggaaaatattcataaatacaaacttgtttgttctagaccttgaaatagtctgaattttggtaatcataaaaacagttgttctaaataacacaattttcatttgtttgtagttcatgtaaatgtagccaaattactgtattgggattgtaatgtctcaaatgttaaagtaaatgtccaggagatgttctgttgttccaacttgattaaaggtacttaagttttactgttctcaacatttgatcttgagaaaagcttggttttataaaatatgaattgtattctttttaaacatgcttttaaaaaaccaaatgttttgttaatgcctagataaaggatgccacagactaactcattacatgtttattttaatgtcaggttgtcaatgtttccatgtatgttgtttgtatgttacaaaggcaactgttcttttttcaaatttcacaaatgtattgaagcttaatagctttaactt

SEQ ID NO: 34513 - DNA, 1177 bp, Mus musculus
tgttttttcacgagatgaagatggagctcggtggctgccagagagattaattcgtcagatgaacacagattctgactcttctggtaagtatcattctaaagactaaaattccttttgtgcttagaattcagctgagagcgaaagctcccaaagctgttctccagctactctctgagccagctcccgacaggaggcctgagactagcctcagctttacaatttgcatttgaataaagtacctagacttccccaaaagaagttctgctttcctaccttctcactgtcgagattttgtctttcaagcaggtaaatcaacattctcgaagcggaccagcggatgtgcatccccgcccccctagagcacacaggaggctgctgttatctcctttccaaggacatttccagcacgtggctttcagtctgagttaaaaattaggtttaccaagagggctagaagagtagatatttctatattaataaagattggtttttattttgatagacaggcttagccccttagctgacctctggcttttcacccttgctgttactgcaaggtgtccttagctcaataaggctgtggaaaaaacagggatgagaaggaacgacttccagctcctattttagccacaaatcgtggtgttactaacgacataattcttgcttaggctttgctaaatctgaggttgataattctcctttaggagctgcacagcactcagaactgtgcatactggtttgtgatcgtacaaattcagtatgggcattgcttggtgcagagtcactgcaggggaaggtccagcttgaccatttctgagtttcctgtgagataaacccggtttgaaagaggttggtaccaaattttggctaaaaatgaaaaatatttttcggctctgcctcacctcctcaaaaggtatcaagagccacaggtgtgggtcttatcagtacccatataagcgctgccttatttaacttaattaataggggggagagagattggagacgtactattgaaagggcaagcccttcactgcctcccacccaaataaaaaagccaattggctttgtactacagagccggccgaaccccttctccctgtttcccacctatcatccaaaaatgcggaggtcaactagaaagttacctaccaagtactaattagcatcttaaggtcag

SEQ ID NO: 34514 - DNA, 1196 bp, Mus musculus
tatcatgaaaagaaagtttaccaaaaaggagtgggaaacaatcagaagttttaatgatgaatggactcagctggatatgttttaccggcactgggtacaattcctttgtaattctataattattccattatattcactagaaataagagtgaaagatttgtagttactgctaataccatatagtgcttgatacaaatggacagattcttgagaactttgggatttttttaaaaaatctatataactctatagaaacacatgaaccttatttaacagaaaatgtcacatcacagttcttataatttagttaattctcttagcaaccctttgaggatggcattgtttggtcattacagtttacacttgagagatcttgaataatttacacagactgctactaagattgttttcggtgctattacaatgagcaaaataaaacaattacaactttatagctgtaacaaacatagaaatcaaaatgtactatatctattaatgttataaaaagttttagctattgaatcctctaagagaaaatgtccctttttctctctaggcactgaaagaaagcttcataaaagccattggagttggattgggatttgaaatgcagcggcttgaatttgatgtatctccattaaacatggacattggtcaggtttataaggaaacctgtttgattttggatggggaagaagaaaaagaatgggcctttgaggtaaggaatttattataattattatagctaagacattccatatttattcacgtatgtgcgaataatctagattgttcctgaaatttataagaatgtcaacagtgtagagtacatatccattgtgagcttgtgtaactttctttgaaagtaattcaattccttttaattagtaattaaaatctgatcattaaaactatctttcaagacataatggtgcctgcattcagtttcagtatttgggatctctgtgaattggaatccagcctggtataataaaagcagttgggatttgtgttttctaaatgttactgtctgtcctagttagggttactattgctatgataaaaagccatttggggagaaaagagtttatttggttcacacttccacttagtccatgctaaatgaaatcaggagtagaactcaggcagagtacaaacttggagccaggagctactacagatgccatggagaggtg

SEQ ID NO: 34515 - DNA, 1209 bp, Mus musculus
ccaggcccagcctgtaaactccggctgcgattggcttgtgcgactgtctcgttagctctttctccagagtgagcagctaaaacggttctgagaaactctggtcccgccctttccgaggagagcgagctaagctcacaagacgtcacgccgtgccgcagagctctgggttgactctgaatctccgccccaaaccgccctgccggcttccgtaggagacgtacaggttgggggcgaagctgcgtcaggccacgcccccacgctcaaccctgaactaaaggtgggggtgggggggtctgtgaaacttctaagccgggcgtccagctacttcgcacagacgcctgaaaaggggtggagcctggtaacgtctgttgcgaggtgctgcccctttgcgcagactccggagcgacggggcgtggctacgtcagcgtctgctctacctggcttgaggatcagcggaccgagccggtcgtatggtgttccccgctaagaggctgtgcgtggtgccatccatggagggcgttcgttgggcattctcctgcggtacctggctgccaagtcgagccgaatggcttctggcgatgcggtctatccagccggaggagaaggagcgcatcggcaagttcgtgtttgcccgcgacgccaaggcagccttggtacttgaggcctgcgacttttgggaggcgggccgggctgcggactcccacgtgcgctcgtggcgttgcggtctcggagcctccggagtgcgtgcgaccgtcttcagccttcgtatcccggaggcctgggtcactcacatctagtcttcccttgtgaggttgcctgtggagacccttaccctaaaattggaggcggggcctatggagtaatcgtctgtttactaatgaatgtgtttatactttgaaacttagaagccataaatatactttctaagcagtgtacttatgcgattagtagatagcaatacacaccgtgtgttttatgtctgaacaggctggtcgtttgatgataaggaaattagttgcagagaaattgaatatcccttgggatcatatccgtctgcagagaacttcaaagggaaagccggttcttgcgaaagactcgttgaatccatatcccaatttcaactttaacatctctcaccaaggggactatgcagttcttgctgcagaacctgaggtacaggttggcattgatatcatgaagactagtttt

SEQ ID NO: 34516 - DNA, 2519 bp, Mus musculus
aaacaatcttgagacaggtctggggagaaggttcagtgtgtaaatggcacaaacctgacatttctgcaacttcccttcaaagctgactgctgtggcatgcatctgtaacagcaacactgctatgacagacctaggagaatagccctgaagcctccagtctgctagcttcaagcttgcctcatgggaaacaagaaaaaccctactttgcgcaatggcccacattctcctgcacttacatatacatgtacacaaataagcaagaaatgaaataatagtaattaaaagaccagtaatggagcaaactgataatgacgaaagcaaatactaaattcgcgttttttttcttttctgtcagtttgagattgaggaggaggaagagatgctgtcatctgtcataccagattccaggagggaaaacgagctccctgacttccctcacattgatgagtttttcaccctcaattccacaccatccagacccacctatgatgagccccatctgctcatgaacatagagaaacagaagctggagctggaaaaacgccgacttgatattgaggcggaaaggctgcaggtggaaaaggagcggctgcagatagagaaagagcgcctgcgccacctggacctggagcacgagcgcttacagctggagaaggagaggctgcagatcgagagagaaaagtggaggctgcagctggtcagcaccgagaaaccggctctagagaacgagctgggccagggcgagaagtccatgctgcagccacaggacatcgaagcagagaagctgaaacttgagcgcgaacgtctacagctggaaaaagatcggctgcaatttttgaagtttgaatcagagaagctgcagatagaaaaggagcgcttgcaggtggagaaggagagactgcggattcagaaagaagggcatttgccttgactgttcttgttcctgggcttagcaaacaatgaggaattgtagctttccccctcagttcatgcaaaggtggtcctggattagctaccccatcaccacccctgtttaatgtcagtgtttttagtaggaaaaagataggaatacattggtagctgtgtgctgcagtagtgtactatataaatgctctgcccaacacaaacagaatagcagaggatctgataggcacttccacattagtaatactgcatagagccctgtcttatttgtgcaccccaagtttacaatgatgtctgtagtaaagtttctatccagtgattctccagtggagtttgggctcccagaagacatttgggactatgggatgttatttggtggtcaaagtaaatgggtgtaggatgctaccagcctcaggagaggcttcaccatgtttagcatagttgtcttcacaagaaagaattacccagtccaagatgtcattagtgccaagtttgaaaaactgtacacttggcctaactgtgcatctttatagctatgttctatagttttagaatattaaaactttagatatttatgtggttagatacttaaacggccaaaaccattttaactgtgagacattactatgtagtatgttgaatatagggagtggtggagattgtaggtccgttattcaaatggtattttctatcaatagactgagacttagaaacctgggagcatctgagattgtttaaaatgtgtcattttgaaaggcagttgccttcaagaatcaacacatgactggaaagctttagttctcccttctttgaagctgttgtcatagtttttatacagaactaaccatttcagtcatgtactgaaatgttatgtaagagaatgatagaagctagtaaaaatggtaccagtgccaaaaaggtaacagaaatccatgatgtggaacccaatgaattgtcgattgatttctaagtgaagaatagtcatttgagactgagagatgggggaaatatcctctgcatcagtgacagtggtgttgaaatgatagtagtaactgtgttattgttagggaagatcttgcttaacttaaaatctacaggagtctgtgaaaaggtaccttctgactccagaatctgaaattcagagaaatcctgcagaaagtaaacggctgatactttatatagcattgtgtttttatctttaccccttcaggatggctaaacctgggaattctaaatgcaaagggcagacttcgcctgctgatttgcccacagtgtcctgattgtggtttatttcagtagtgtactttctcatgcacaacaaagttgcaagtggttgcacgaattcactttgtgttttctgttttctggggctgatagctttaatacaacacttctgttgacacactatcttgattctgtattctttgttaatttaagaatggctagaaaccatgattgaatataggtatgcaaagggaaattatacacatgattacttactctgattttgacatagtgttatttttttataattctattaaatacttctaccttagaaataaattttcctgtctgaaagtttatcattcagagtt

SEQ ID NO: 34517 - DNA, 1722 bp, Mus musculus
ccatgggcccgagagcactcttgaataaaaatcctcttgcaatttgcagcaagaccatttctcgtgagtgattttggggtgtcgcccctcctgagtcagaacgtgggggagtcctcatgttgtgggtctttcatttggtgcgttggccgggaaatgtgaccacccctcacacccgagaaccgacttggaggtatggggatcccctcttgtgtgcgtgtgtgccagccggtgtctctgttttgagtgtctgttttctgaaacgaacattggaacatgtgcttgttatgttgtttgtgtcttgtcctatgtttctgaagcacggcaaagtctgagtttggatccatctgagtttattgaatttgtgtcttggtttcagggttacgagatcgtgggtttgagtcccacctcgtgccttggttttcaggttgtgagatcgtgggtttgagtcccacctcgtgctttggtttcagggttatgagatcgtgggttcgagtcccaccttgtgccttggttttacacctggcagagtgaggaacaagtgtgcttctctggttttggtcgtctaggtagaagtggacgatggtgtttgtagacaatgggatgatggggttttctgaaatgcgcgcgtctgtatttgcagctgttcttttgggccgtaaggaccggaggactgtggtcggcagacgtgctaggaggaccacaggctgtggccctgggggacgccctgggaggtaaggagagccagggatgcctggccgtctctggatcggtcagagggaccgagttttgttgaagcggaagcttccccctccaacatcgtctaatccttttgcctgcttgtggaggacaagaaagggtcgagtgtgtctggatttgttggtttctgttttatgtgtttttgtgtacgtgtttagagctatgtgaaaatctagagaaacaaaggtaattctcataggtgctttataccctgactagagatagtttacacctgagatatgagaaaatgggttttgagaaaagcagtactctctgactatctggagataatttggtaataaaaaaataaaataaaataaaataaaataaaataaacagtattaattggtctttggaaccccgcacctgtagttaggaatctagtgtggctagagaagccctgctaggcgctgattataaatgctgttcttatagggaccagcagcttctcaagttctatggtaagggaacagatgactgtttttcccacaaaaattggattcatcaggtgacaaggtgctcctctcttgaaattacagctagaaaaaaaaaaaaaaaagaattttgtttggtttaaatggacaaatgtatacgaccatttcatttttgttcctaaatagtttcaaaagtataaatatgttttatatgtcttggttatagattagtggctcataagttattggttatgattaaaaatttgtaacattggtaacaaaaagttgacttaaaactggtaactctgggttagagtaatttagaactacaacatgcagcatgagacaacccataggaacaggtctctaaagatacgcctgaattgggtaatattctatgtaattcttatcctagaaacccgatttataatagatatattggcggctacaccttcttgtgtttgtgtgcaggaacagacagccaaactttgtaacaagtaatgtttttggagttcatttttaaagaaaatag

SEQ ID NO: 34518 - DNA, 1122 bp, Mus musculus
tttttttgtttgtttgtttgtttgtttttcttttgttttttaaatttttttaaaaatatagaatggcttcctgagagttgcttttagctaaaatcctgagaataaaatatccctatgacatctcttctgtcctagtgataaaccagagtgatccagtgagtctgggactacctcccgatacataccatctcgccatgaagagacaggatcagaagccaaaaaggacaatatcctaaatatgctaaatatggatagtaatatgtgtacactatcgcttaaaaggagagcaaacaacaaaggctacaggacaaacttgcctgcctaccacccctttaccctcttggtttgaaaaggaggggaaaatgttctgataggtctttataaagaaagattatagacggtgagcaagggtgggtttgaggtgtctggggtaggtgggcatctgacatggcttcttgtttggcatgtttaattatgtggtttaacagtcatccttgcaatttaaggtgacacttaaaataaaattctctcctgatgatgacttgagccctgacactcaatgggagaatcagcagaacctgtacggttttatttggagttaacattctgttgtaactttaatttttttctttctttttttctttttttcttttttttttttttttttttttttggttttcactggacggaaaaagatgttcattttaaatattgaagtgtacaagttgcttttttacaataaaatcagtgtgtacacaaaggacctgatgcttttctgtcagaacagatgctcaacagaccttccaagtttgactgcataatgacatcacgtcaaactttgtctccccaacttcgtattttttgatacgcactttgcaggatgacctcagggctgtgcagattgagaaagggatttgaatcatgttttaacgtctccgtactgatttgtgggcacagcttgctgctgtggacttgtacccttgatttttatctcaatttgacatattctttttaaaatgggccttttcccaaacctcacggcagcacctatctgctcccaccgttactgaccttttgctctgtgccatctatgagggacagccactggtgtgtcctcattgg

SEQ ID NO: 34519 - DNA, 1227 bp, Mus musculus
aagctctcagttactgctccagcctgcctgccaccaggccgagggatgtcttagctgatgcccaaggtgccaggtaaacttaactggagcctgatgctgtgcatctgcataaggctggtcctgggaaccaacaaacaccaaggcgataaggttcccttggggagagataccatgctgggtgacaccactataaaggggacatttcacctttgtgtgtaccccttaattcttttataccaatacatttgtgcatgccttgaatactctttaaaaatggtaagaaagaataatctattaacaaaaacaatgtgttagctccaggctcactactgtgtcaaggaactcctacttgggcctatgtttgccttctgtttccattcttcagcacttccaactgaaatcattacttaccacatacttgtcttggttcattgctcaagttatatagctcagttgtagctaaactagagaaaaaacataagattatgactgcttttttgaataataatattttcagtaatttggtaaaaccagtaaattgatgtgaaaggaatagtttttgccatgtgtaaaagagtcagctttgtaagccgtatttgtccccacgtctgggtatagcaaattggatcgccagggtagccagttgttctgtaaggtaggttgctacatccactccagtagtgacaagtgcaacaggccccgaaaacctgggcactgtcccgaggcaaaaagttcacagaaacttaatctcctggaactgtggcatcctgtataacaaatgctccaatgtccttgctttagttggtaaacggatctgtgtgctttcccttaatattgctttattatgagtgctcctacagatagatatttttgacatatagctaagttagattctaggcagtccttgatctgagtctgggcatggatagccaagtcactgccctacacaggaatttaccattatctaggaagaaggaagtttgtgatctaagaaggaatcagagtagatacttagaactatagatagctgagttacacccataaacaagtatttacaatggcctagggggaaggtggacttaacaatagactagaataggagctatggcaagggccggaagcccttaaccctggcttctaagattaagtgaaccttaggcagaggtgtttttgatcccagttgttaaacattgaattttatcccagttggttcctgccagtcctgtg

SEQ ID NO: 34520 - DNA, 1187 bp, Mus musculus
tctcaccatcaatggaagagtgttcctctttctccacatcctcaccagcatctgttgtcacctgaattcatgatcttacccattatgactgctatgaggtgaaatctcagggttgttttgatttgcatttccctgatgactaaagatgttatgtgcttctcgaccattcgggtttcttcagttgagaattctgtttagctctgttccccatttttaaatagggttattttgtactctggagtctaacttcttgagttctttgtatatattagatattagccctctattggatgtgacattggtaaagaacttttcccaatctgttggttgccgttttgtcctattgacagtgccctttgccttacaaaagctttgcaattttatgaggtcccatttgtcgattcttgatcttagagcataagtcattggtgttctgttcgggaaattttcccctgtgcccatgtgttcgagaattttccccactttctcttccataagactcagtgtatctggttttatatggaggtcttcgatctacttggacttgagctttgtacaaggagataagaatggatctgaagaggtctgcaaccctataggtggaacaacaatatgaacaaaccagtaccctcagagcttgtgtctctagctgcatatgtagcagaagatggcctagtcggccatcactggaaagagaggccccttggtcttgcaaactttatatgccccagtacaggggaacaccagggccaagaagtgggagtgagtgggtaagggagcggggggggggggggtcatagggaacttttgagatagcatttgaaatgtaaataaagaaaatagctaataaaaaaaagaatggatattcagttctattcttcatctacctgcctgtctgtaccaataccatgcagttttttgttgctgttttgttttggttttttttttttaaatcaggaatgatgattgccccagaagttcttttattactgagaacagttttcgctatcctggttttttgctattccaaatgaatttgagaattgctctatgaagaattgagttggaattttgatggggattgtatagaatctgtaggttgcttttggcaagatggccatttttttctatattagtcctgccaattcacaagcatgggagaacttcccatcttctgaggtcttcga

SEQ ID NO: 34521 - DNA, 1207 bp, Mus musculus
tcttatgcattggtaaaatggaaggaccccctgactaatgaatggaagggtccagatccagttctaatttggggtaggggctcagtttgtgttttttcacgagatgaagatggagcgcggtggctgccagagagattaattcgtcagatgaacacagattctgactcttctggtaagtatcattctaaagactaaaattccttttgtgcttagaaatcagctgagagtgaaagctcccaaagctgttttccagctactctctgagccagctcctgacaggaggccggagactagcctcagctttacaatttgcatttgaataaagtacctagacttccccaaaagaagttctgctttcctactttctcactgtcgagattttgtctttcaagcaggtaaatcaacattcttgaagcggaccagcggatgtgcatccccgcccccctagagcacacaggtggctactgttatctcctttccaaggacatttccagcacgtggctttcagtctgagttaaaaattaggtttacctagagggctagaagagtagatatttctatattaataaagattggtttttattttgatagacaggcttagccccttagctgacctctggcctttcacccttgctgttactgcaaggtgtccttagctcaataaggctgtggaaaaaacagggatgaggaggaacgacttccagctcctattttagccacaaatcgtggtgttactaacgacataattcttgcttaggctttgctaattctgaggttgataattctcctttaggagctgcacagcactcagaactgtgcatactggtttgtgattgtacaaattcagtatgggcatcacttggtgcagaggcactgcaggggaaggtccagcttgaccatttctgagtttcctgtgagataaacccggtttgaaagaggttggtaccaaattttggctaaaaatgaaaaatattttttggctctgcctcacctccccaaaaggtacccagagccacaggtgtgggtcttaccagtacccacgggaggaatcgggtcaatgtccacccaagccaaggttaaaagcccactcatctacggatgagaaaatcatttgatcacctcagttaagcgttgccttatttaacttaattaataggggggagagagattggagacgtactattgaaagggcaagcccttcactgcc

SEQ ID NO: 34522 - DNA, 1383 bp, Mus musculus
gctttgaataactagtgtggaaaaaaatagcattctaatgaaaatcaagtttgatatgctggttttgaaagtattgacagtagttgggatatttttggtttttgttctgcatcaaaaggcactgattcctttgagcaagtaagagctttctgtagttgcttcctttaacaatagaatatttgataccatgttgtatttcctcagctttgaagaacagcttttcttaaacgctgaggagattttacagtttttactcaagtcagaacttatttttaactgggacacagaaggaccattctgggttttttttttgtttctatgcggtgtatgcataaaacacataacttgtttgttttgttttgtttttaactgaagatgaaaatacaagttgatgagattccctccttgtgaacattttcctgaaaccataacctttcagattaagcagattctgtgatttattggctagtttaaaggcaacaacatcagaattgatgtattatcacataattacagtggtatatttacagagtgttgtacgcgtcccctttggaaaatggaattagactaagtaatagtgtgatttaataacaagacttgggctagaggcagatagagctctgacctaagaggccagctgagaggcagaggcaggtccaggtcagccactctatgtaaaggttcctctggtgaactttgtagaaagttaaagtctgtactaaaaggttatgatttatggaatctgtttgatgtggaaatagaatcgtggctggagctgacgttgacaatttaagacctgctaagtgagtgaacaaaatttgctaatatcatttaatgacctgcatgctttttctttaccctgactcattccttactggtaggatcagtcttttcagtatttgggttatggttcaatgagccagaaaagtaactttgtagtatcagaatgtcatccaactgtatatttactttattgtaaataatggtgaacagtggtcaataaatagttttatattcctttaaaaaaaaaagtgtaagccatataaactcgttccttcccaacttgttattggtcatggtgtttcatcacagcaatagaaactctaagatagaatttagtaccaggagtaagatattgctatgatagatccaaccatgtttgggggaagattatggaaggtttttggaagtttgggctagaaaatccattgagtgttgagggctcagtgggttgttctgtgtgagcttcaaagataagaatattgtgagcagtgcagaagatggaggcctggcttgttaagtttcaaaggaaaacttaaagattctatcaggggctggagagatggttcagcagttaagagcactgactgctctttcagaggc

SEQ ID NO: 34523 - DNA, 1190 bp, Mus musculus
cggaaagaagttctgctttcctactttctcactgtctttcaagattttgtctttcaagcaggtaaatcaacattcccgaggcggaccagcggatgtgcatccctgcccccctagagcacacaggtggcagctgttacccccagtctcaggacatttccagcatgtggctttcagtctgagttaaaaatttaggtttacctagagggctagaagagtagatttttctatattaataaagattggtttttattttgatagacaggcttagccccttagctgacctctggcttttcacccttgctgttactgcaaggtgtccttagctcaataggctgtggaaaaaacagggatgaggaggaacgacttccagctcctattttacccacaaatcgtggtgttattaacgacataattcttgcttaggctttgctaattctgaggttgataattctcctttaggagctgcacagcactcagaactgtgcatactggtttgtgattgtacaaattcagtatgggcaccgcttggtgcagagatacttactgcaagggaaggtccggcttgaccatttctgagtttcctgtgagataaaccgggtttgaaagaggttggtaccaaattttggttaaaaataaaaaatattctccggctctacctcgcctccccaaaaggtaccaagagccacatgtgtgggttttacccacgggaggaatcgggtccatgtccacccaagccaaggttaaaagcccactcatctacggatgagaaaatcatttgatcacctcagttaagcgttgccttatttaacttaattaataggggggagagagattggagacgtactattgaaagggcaagcccttcactgcctcccacccaaataaaaaagccaattggccttgtactacaagagccggtcactccttctccctgtttcccacctatcttccaaaaatgcggaggaatatcaacttagtgctattttcacatctttcagtcaaacttagccagagttccaacgccctacttaaaattcaactagaaagttacctaccaagtactaattagcattataaagtcagagtctgcagctccaggcctttcagttagttgtttactagaaaggacagtcttaagccagatacagtttaccataagaaaagttaaagattcccagtgaagcaagttt

SEQ ID NO: 34524 - DNA, 1175 bp, Mus musculus
cttgctcaggggtggagcttcctgctcattcgttctgccacgcccactgctggaacctgcggagccacacccgtgcacctttctactggaccagagattattcggcgggaatcgggtcccctcccccttccttcataactagtgtcgcaacaataaaatttgagccttgatcagagtaactgtcttggctacattctttcttccgccccgtctagattcctctcttacagctcgagcggccttctcagtcgaaccgttcacgttgcgagctgctggcggccgcaacattttggcgccagaactgggacctgaagaatggcagagagatgctaagaggaacgctgcattggagctccacaggaaaggatcttcgtatcggacatcggagcaacggacaggtacacatgctagcgctagcttaaaatttcagttttgtaaagtgttgctgaggatgcggtaggatacgaattaagcttgaatcagtgctaacccaacgctggttctgcttgggtcagcagcgtgttaatcggaactagaaacggaaacaggcaggttagccgcagctttttaggaagctgcttaggtggaagaagaaagggtttattaaaaggaataggcggattgccccagttaataaaaaatgcatcataagggaggaaaatgtcccaaaaagcagagagaaatatctctctgggccttatagcaggagtactctgttaccttttgtgtcttgtctaatgtccggtgcaccaatctgttctcgtgttcgattcatgtatgttcgtgtccagtctgtatgaatgaatgttctatgttttgtgttggataataaagatggtataaaaaactttatctgcaaagccgagagctgccacgtgtttcatccaggaatcagacacgtggcgggagggcccctgctggaaaaactgttcgttttaggaaataaggtcgagtgcacagcctctaagtttcagagtaaaaaagctaataaatggttcatgattaatgtgtttgacaatggtaaagtgttttttatttttatggttgtagctacaaaaattattattctctgattggtctaaatgtaactgcttcatttggttcctttttattggtaatgtgctctaagtgttttcacaatcagctcataagttgttggttaagattaataattg

SEQ ID NO: 34525 - DNA, 1171 bp, Mus musculus
tgtatgctttctttcttcagtggaaaagaatatgaagtatattccaacagaagacgtttcaggtaaaatagagctagtgcttcagcacatctccgttacttttagaagctggttttcactaatgttcttctgttctcaggcttgtcattggaagagcagttgcggagattacaagaagaacgaacttgcaaagtgtgtatggacagagaggtttctattgtgttcattccgtgtggtcatctagtagtctgccaggaatgtgccccttctctaaggaagtgccccatctgcagggggacaatcaaggggactgtgcgcacatttctctcatgagtgaagaatggtctgaaagtattgttggacatcagaagctgtcagaacaaagaatgaactactgatttcagctcttcagcaggacattctactctctttcaagattagtaatcttgctttatgaagggtagcattgtatatttaagcttagtctgttgcaagggaaggtctatgctgttgagctacaggactgtgtctgttccagagcaggagttgggatgcttgctgtatgtccttcaggacttcttggatttggaatttgtgaaagctttggattcaggtgatgtggagctcagaaatcctgaaaccagtggctctggtactcagtagttagggtaccctgtgcttcttggtgcttttcctttctggaaaataaggatttttctgctactggtaaatattttctgtttgtgagaaatatattaaagtgtttcttttaaaggcgtgcatcattgtagtgtgtgcagggatgtatgcaggcaaaacactgtgtatataataaataaatctttttaaaaagtgtttctgatgtgattcatgagattcctttagataatcagctgtgtatgctttgtaagtaaagtattgggtgaagacttcgtcagtatcaaaaaattgagataaatctacatgagaatttacaagaaatagtttacgtgcctggtgtgtaggtgtttgttaggattggaggttaggaaccagacattgataagtacctttgtgcaccaaagtatatatgacctgttccagatgtaggtctgataggcttgtaaagatttgaagtgttattttttttttaaagcaggccgtgatgttgcatgcacacttcagtctctga

SEQ ID NO: 34526 - DNA, 3354 bp, Mus musculus
cacacaggcagctctgacactgtgtgcttcagttggtatgggtatagctacgctcacacaggcagctctgacactgtgtgcttcagttggtatgggtatagctacgctcacacaggcagctctgacactgtgtgcttcagttggtgtgggtatagctacgctcacacaggcagctctgacgcttctcacagaacatttgttcatccctcctcaaaactaggagacaccatcagccaaagcaccctgccgtcacagcagagccgcttccccgactacctggaagccctccctgggacaaatgtggaccttggcacactggaaggagatgcaatgaacatagaaggggaggagctgatgcccagtctgcaggaagcgctgagttccgaaatcttggacgtggagtctgtgttggctgccaccaagctagataaagaaagctttctcacgtggttatagagctgcagggagccactctgagtctgtgagggatccacagagcctaagatgtgcacgcctgaaattcagataagtcagtgggggttctctggctaacacagaaaacagatgaaccagtgtccatcgttgttccgcttttctctgcccgtcgctgctcttacgttggttgctgacctcttcacggccggctctaaagaacccgaaccgcagacagattcctttgttaactctgctatgataactacgttctctgggattgctgggggatggcctgctggataatggatgttctgccttttgtccggtggtcctttcaccatcactttaactgaacacacagactgggaactgaatgctctagaacattgttcaagaggtggtttcttcagctgccttgggtccaacaagccagaggcattgcgtctgatctcgtggaggacggaggggacccacgctgaagactggtgaactttccattcttctgttagcgatgccgttaggccatagtgacctgggtcttatcttagacgcttatgaggcatgagacagcttccatagaaatatattaattattaccacatactctagattaggtttgaatgaatattttctgtgggtgttttggttggtttttctctgcccccccccccttttttgtggttggtcttggtggaacgtaggcaaattaatgaattcgtttatagctgtagcttggggtgggcaataccattcttttggtgggaaatctgtatttcttggttttttaacatcctatttaaatcttaaatcttggttatctcctctctacatatatacacactcttattatgtctatggtagtgtgatagcagaatatatctttataaacatttctttcctttccagtttattttttaaatggtagccttgaacatatacatttagacacagtagtttatgtttcacaaatactttaaattctggttggagcaattgcaggtgtttgagggagggtgggcagtgttatagaaagggctctagtgggtaaagccaagaggcgcctcttgccctctgtgcactgtggtgacaacagaagccaacagtgagtggccttacttcccttagcctgatttcatgccatgtagtgtctgagctgtaagctttagagaggcaggcctgccttctgcctccacctcagctttgggtgtacactcagatactgagactgataatccacgaggtcaggttgagtgtcacctacaagatcatgcttaggaaacctcctcccgtgtctgctgagtggaccctggggtagtgtgcagaatgctgcgaggtcataggtaaagtgatcagactagcaagtgtggggtagttggactgagcagagctacaatgaagcatgattatggctttatttttgcaagattactagagtatgtgtctccaggagtaataatggtttccaaagagtattttttaaaggaacaaaataggcatgaattaactctgtgtataagctatgaagtaatagttggttatgaattatagtggcaccagctagcacctctgtcatttaagggtctttgagtgcttctagaagaatcccttattttcaagggttcataatgaacaacaattttcccccctggctaaagctgctactataaaatcctcagcttaggaagatagaaatcttttggccctttgatttagtatagcacaagaatgaagtagaaaagttttattcagtactttgagtgctcaaaaaatacaatcagtgtattatatgtgattcataggtcagtcatttgaggccattgactctaaggcttttaattagaaactagttgaagactcacccttgaattaagtctggggaaatggcctcccggaggatgcagtgactgtagaacagagatgaaattctactctagttgacaattgagcagatggatgatccacaacagtgcgtggggaatgggcagatgataggcgtgccgagcgcctatgattggccagcagctgcagaataaaggatggcgtcttctgtgggcagactagctgtagtgtggggagggggaggggaggtgggcatgagctgttgaaaggttaccgggctatgatatagaaaagcttttatgaacttgtttctcttcagtaaagacttatctcgctctcagtaaagaagttcctaagtttgcagctgcttaacctcccccacaaggtggatgtgccgtcttcctcctccctcagcatggtgcgccttgttatacctcaatgtccagcagcccctggtgcctgacagtgctctctgaccttatcaaaccctccatgctgactgtgggagatttaagcaccctgactctcactaaatttgaatcacggcctgaacgtagtctttcttgttgtgtccagcagtgtttaatgcttcctggctgtagtaggtagcatacaggtaagaacttaactggttattcttgaatttcttttacaataaaccaatttttataatcttaaaatgtgtcaacttttttacatttgtgttcttttcaattaggacttctgagtctctctgggggaaaaaagatgagtttggttggggtttcagagcaagcagtgttctgtttcataactgtttcctaaatgcagagacttaacttctaaagagaaggaaaaaaaggtcccaaggaagcagctgtggaatgtgcgatgttgctgtgataagtgttaatatgaaagtatgccttagtcaggcagtggtggcgcacgcctttaatcctagcacttgggaggcagaggctggcagatttctgagttcgaggacagccagggatacacaaagaaactctgtcttgaaaaaccaaaaaaaaaagaaaagaaaagaaaagcaaaaaaaaattgtgccttacagaaaacact

SEQ ID NO: 34527 - DNA, 1175 bp, Mus musculus
ggagcccgcgcaacagccgccgccccagccggccccgcaaggccccgcgccgccgtccgtgtctccggccgggacccccgcggccccgcccgcacccccggccggccaccaggtcgtgcacgtccgcggggactcggagaccgacttggaggcgctcttcaatgccgtcatgaaccccaagacggccaacgtgcctcagaccgtgcccatgcggcttcgcaagctgcccgactccttcttcaagccgcctgagcccaagtcccactcgcgacaggtaagggtatcccgggggcgcggggccgcgtgggggtgcggtgctgggggttgttttcgcggagttggccgcagggggggtgcacaatgcgcgcgcctccgctccgcaccttcgctctgacgagggggaggggaggagggggagggggccggcgtcttgtgcgggaccccagccgggggtacccgatctccccttcccgcgccactgcagtctccggtggagctgtgttaactgccctcttgttttcgcgtgccggtgaggggtgggggttgaactggtccattgagtttctggttccttctcccggtcccctccccctccctctcccgaaagcttttctgttctcgcggcccaggcgctctccggatgcagggttcgggctccccagcccgagcgaagctccctcgaccccccactcgcctccgccgtgccctggaactcgcgcgggcgggatcctttcacactcggtgggctcacgtgtccttttcctaaatcgtaacctattatttactgttcggcccgaaagcttttaaatgagccacgtctgtgtgttgcgcaggagctcggctgcgctcacggtgcagaggtttctgcgccggcctttgatagcgcgttgcaggttgactcataggccgagttctgcccggctcaactgtgattaaaggtaatgtttgggaagcaatgactaattccaagctcgccattgctctttaactgactgcggatgtgaacatggctgcttatccgtatccacgacgcctggttattttcccaactggatccagcacagaagtgaaaccgtttcaaagtattaacattccgataggtcctggtagatttctttagtgtcgctccccccgcttttaattacttaatttttaaagaacttgctttaggctaa

SEQ ID NO: 34528 - DNA, 1222 bp, Mus musculus
tttagagtatcttatttagttttaaaataaaattaatttaatgaatttttaagaagcaagttatttcttcggcctaaaatatatgttaaacaaccccagaatcttatatgactttcgagtgtttctgtaaataaacaaacaaggaaggaaagaacagatgacaaaagcattcctctgcattgtattgtgttttttgagacaggacatcatatcgctagtcatgaacacttggtcctcctgcctctcacttcgcaagagctgagattatagggtgcacagcacacctggcttcagaaagctactcctaaggatctggagaggtggctcagtggtgaagtcctgctgtgcagcatgaggacctgagttcagatccctcgcacccacataaaaaaggtctctggatcatcccttaggctcagaaacagtcagacctcagggctccactggccagtcagccaaaatggtgatcttcggtttcagtgaaaagaccctgtctcaaaagaagaataataattaagttggagcctgcacgtgcacatgcagacgagcacatctgcccactcagaaccacagcactcacacagtcaaaggaaattcctccaaagcacatattaccaatagtaaaatatgaaaagtgtgaattattactgtccataggatgccctacaaagagcaggatacagcatcgttgaaattgatgcatgtactattttgatttgagttttagtcttcttaaaagtcatgatctgaaaagagaatgacctgtgaacatctgcagatgtgacagttaagagaaccctctgaactctcttacagagcagccagccaagggcaagtctgtctcctgatgttggatccacagtgcaaagaaaatactgatgagctgtgatagtcactacttagtggaatcattatttttgagaattcctgtaaataagttctgtaattctgcatttattaatgatttaaaatactagacttttatgtttataaaagtaaatcataatgtacttaatgaaaatgaatttactagcttatatttatgctacaaattatactttattatgtattttcttgatacatttttaatgaatgaaatatttcattgttttcaataagcatgctactggatataaattttctctatttaaaaataagagactattttattattcaaattatgtattagggatgatagtgaatctttgttttctgaagttcc

SEQ ID NO: 34529 - DNA, 2094 bp, Mus musculus
acatcagaatttctagagaaaataagcagagtatacatacaacgttgtgcatcgatgtatctatgattttaaatgaaataagataatggattagaattaatgtgtagagagtaacagttgacagacagatgcatccagaaattacagcagtgaactgaatgcattggctgtctcataaagacaatgacatgataggtaactgataaaagtttggctccttcattttctttcctccttattctagtccttgtacactacagtgaggttttgctaagctccttggtcaaggtaaagcctgatgtcttttagtatactaactaataacattcctgtctctggtaaccattttctgagacaaaaggtagcttttataacgcaccagtagcctgactacatggctttctgttgaagcccttcgcatagtgttagatcagaacccctgaagagaagctggtttgctctcaaagaccagcttgacagtaaagattcaatatcttcgtccactgctgatgcacagagaaatcccaacttttccttttattttaatgtagatcccagcattcctgactcccagttgtctgtgagctaaaccaacagatgcttactggggacttagagcttagtaggacatgggtatgaaatccagctctgctttctgatctattctgtgtcattatttgttgaagttccttccctgaaacaagacataaacatgctggttcatgttgcacttgtgcttgcgatttaatctttcagaatttttttcttcatgttaattatatatgtaaggaaaccatgatgatatatgggagagaggctaagggtactttcttcctgaattaagtaccctaaagttaaagtatgcaggagcactacagaaatgaagatttgtgctctggagtgcatggaaggtgtgctggacaggagagcattgaggtgatggaagagtcacgtctcaaactgtgatactattgatgacatgaagaaccttacctgtgagacagtgggatgatgaactgtcatatgtacactctgaaagctacaatatacacccaaataaatgcctatagtttgatcaatgtgaggatgtcttgggggttgatgtaattcccttgggtgtgctctgcaagtatccttgggtttgaaacactgatgcgtttggcaggtgatttttggctattctgccatcccacttcatttggttcatacaagttagtcattcaactgaacaattttcctaatgtattgtgtgtcagtatctgaaaagtacaataaactttcaatctctccagtgtccatgcagtgtgaagaagcattatctccttgcttgtgatgtgatgtgatgtgatgtgatgtgatgtgatgtgatgtgatgtgatgtgttataggcaggactgaaatattcaccaatagccccattgcggaaagactttgtcagagagatggtgggttaaagctataaaagatatactttatatttctgttaacccccaactactgaaacaccaagtagtgacaataaaaatgcatgagacatcctccattttctcttttgtagttactcttccatatggtgcctgccttcagaatatgaatgaggtcgagaatacatgaaatctctctgtgcttctgtgaagattccttgctgctaacttctctcccaacctcacatccttctcttccacagacgctaattaaaatagttgctcagacctcagctctgaacagtaattggtagtgcagccggagcatgctttatctaaaaaggcctttcagattgtggaatattgtggataaataagataccttatgttctaacagatactctaaaatatgcaatgattacagggatgagacagctcaaatcaagaaattcctttccagttcttatgtttgctatatgtagcttaaaagaccattcaagcagtatttttaatatgtacagaggcaagtttcacagactggaattttccagctgtagaatcatacaagtgctcaaaatactgtaggtttcatgtttgtggatgagatgctttcctccgtaccaggtttgtgctaagggcgcattagcagctagagattgacatgatttat

SEQ ID NO: 34530 - DNA, 1207 bp, Mus musculus
ctcgaaggacccttttgtttctgttgtcttttattgtcgctgttagttttgggtttaacacagtctcattgtgtagcccaagctggccttaacctctgcattctccatcctcctctgctttgtagtgctgggatgacagttgtgtctgcccattgccactattcacatctttttttttttttttttgaatgaatgaatgcttttcttctattggaaattttctttatttacatttcaaatattttcccctttccagatctccccttcagaaaccccttttcctatcctacctccccctgcctctataagggtgctcccccatacactcccgtcctcctgccctggcattaccctacactggggcatcaaacaccttcaggcacaagggcctctcctcacactaatgtccaacaaggctattttctgccacatatgtggccagtgtcattggtagctccacgtgtattctttggttgttggtccagtccccaagagctccgggagggggctctggattgttaacattgttgctccctctatggggctgcaaactctctcagttccttcagtcccttctccaactcctccatctgggattcctgtcctcagtccaatcaatggttggctgcaagcatctgcctctgtatttgtcaggttttggcagagtctctcaggaaacagccataccaggctcccatcagcaagcacttcctggtgtccacaataacatctgggtttggtggctatacttaggatggatccctacttggagcagtctctggatggcctttccttcagtctctgctccacacactgtctccatatgagacagtgagtattttgttcacccttctaaaaagcactaaagaatgcacattttggtcttattcttactctacatatggtctgtgatttaatcttgagtattcccaacttttgggctaatatccacttattagtgagtatgtatcatgtttatttatttgtgactgagtcacctcacccaggatgatattctcaagttccatccacttgcctgcaaatttaataatgtcatcgtttttaatagctgaggagtattccattctgtaaatgtatcacattttctgtatctgctactctgttgagggacacctgggttgtttctagcttctggctattataaatatgcctgctatgaatatagtggagcatgtgtccttattac

SEQ ID NO: 34531 - DNA, 1166 bp, Mus musculus
cctttaaataatgctctattgatttttactgatggctcctctaaagggcgagctggatatcttattagtaatcaacaggttatcgtagagactcctggtctctcgactcagctcgccgaattaacagcagtactgaaggtttttcagtctgtacatgaggcttttaatatttttactgacagtttatatgttgctcagtcagtacccttattgaaaacctgtgtaacgtttaacttcaatacgccgtcagaatctttattttcagaattacaaaacatcgttctcgcctggaaaaatccgttttatattggccacatacggtctcactctggtcttcctggacctctgacagaaggtaatgatcgcattgacagagctctaataggagaagccttagtttcagatcgggttgctttggcccaacgtgaccatgaaaggtttcatctttcttgccataccctaaggctccgacataagatcacaaaagagcaagcgagaatgatcgtaaaacaatgtcctaaatgtattactttatctccagtgccgcatctaggagttaatcctagaggccttatgcctaatcatatttggcaaatggatataacccattatgcagaatttgaaaaactaaaatatatacatgtttacattgatacttgttcaggatttctttttgcttctctgcatacaggagaaacttcaaaaaacgtaattgatcattgcctacaagcatttaatgccatgggattgcctaaacttcttaagacagacaatgggccatcttattccagtaaaaactttatttcattctgtaaagaattcggtattaaacataaaactgaaattccttacaaccccatgggacaagaaatagttaaacgtgctcatcgcaccttaaagaattggctctttaagacaaaagaggggcagctatatcccccaaggtcaccaaaggcccaccttgccttcaccttatttgtcctaaatttcttgcacaccgatatcaagggccagtctgcagcggatcgccactggcatccagttacttctaattcttatgcattggtaaaatggaaggaccccctgactaatgaatggaagggtccagattcagttctaatttggggtaggggctcagtttgtgttttttcacgagatgaagatgg

SEQ ID NO: 34532 - DNA, 1281 bp, Mus musculus
ttttctttcaagcaggtaaatcaacattctcgaggcggaccagcggatgtgcatccccgcccccctagagcacgcaggtggcagctgttatccccagtctcaggacatttccagcacgtggttttcagtctgagttaaaaatttaggtttacctagagggctaaaagagtagatatttctatattaataaagattggtttttattttgatagacaggcttagccccttagctgacctctggcttttcacccttgctgttactgcaaggtgtccttagctcaataggctgtggaaaaaacagggatgaggaggaacgacttccagctcctattttagccacaaatcgtggtgttactaacgacataattcttgcttaggctttgctaattctgaggttgataattctcctttaggagctacacaacactcaaaactgtgcatactggtttgtgattgtacaaattcagtatggacatcgcttggtgcagaggtactgcaagggaaggtccggcttgaccacttctgagtttcctgtgagataaacccggtttaaaagaggttggtatcatattttggttaaaaatcaaaaatattttccggctctgcctcgcctccccaaaaggtaccaagagccacatgtgtgggttttaccagtacccacgggagaaatcgggtccatgtccacccaagccaaggttaaaagcccactcatctacggatgagaaaatcatttgatcacctcagttaagcgttgccttatttaacttaattaataggggggagagagattggaaatgtactattgaaagggcaagcccttcactgcctcccacgcaaataaaagagccggtcgaacgacttctccctgtttcccacctatcatctaaaaatgcggaggaatatcaacttagtgttattttcacatcgttcagtcaaacttagccagagttccaacgccctacttaaaattcaactagaaagttacctaccaagtactaattagcattttaaagtcagagtctgcagctccaggcctttcagttagttgtttactagaaaggacagtcttaagccatatacagtttaccataagaaaagttaaagaatcccagtgaagcaagttttttctttagccctagattccaggcaaaactattgagcatagataatttttcccccctcaggccagctttttctttttttaaattttgttaataaaagggaggagatgtagtctcccctcccccagcctgaaacctgcttgctcggggtggagcttcc

SEQ ID NO: 34533 - DNA, 1201 bp, Mus musculus
cccaagataggttgataaaattcttaaatgtacatgatatgatatttcctaagatgacttccttacagcctttaaataatgctctattgatttttactgatggctcctctaaagggcgagctggatatcttattagtaatcaacaggttatcgtagagactcctggtctctcggctcagctcgccgaattaacagcagtactgaaggtttttcagtctgtacattaggcttttaatatttttactgacagcttatatgttgctcagtcagtacccttattggaaacctgtggtacgtttaacttcaatacgccgtcaggatctttattttcagaattacaaaacatcattctcgcccgaaaaaatccgttttatattggccacatacggtctcactctggtcttcctggacctctggccgaaggtaatgatcgcattgacagagctctaataggagaagccttagtttcagatcgggttgctttggcccaacgtgatcatgaaaggtttcatctctctagccataccctaaggctccgacataaaatcacaaaggagcaagcgagaatgattgtaaaacaatgtcctaaatgtattactttatcttcagtgccacatctaggagttaatcctagaggccttatgcctaatcatatttggcaaatggatataacccattatgcagaatttggaaaactaaaatatatacatgtttgcattgatacttgttcaggatttctttttgcttctctgcatacaggagaggcttcaaaaaatgtaattgatcattgcctacaagcatttaatgccatgggattgcctaaacttattaagacagacaatgggccatcttattccagtaaaaactttatttcattctgtaaagaattcggtattaaacataaaactggaattccttacaaccccatgggacaaggcatagttgaacgtgctcatcgcaccttaaagaattggctttttaaaacaaaagaggggcagctatatcccccaaggtcaccaaaggcccaccttgccttcaccttatttgtcctaaatttcttgcacaccaatatcaaaggccagtctgcagtggatcgccactggcatccagttacttctaattcttatgcattggtaaaatggaaggaccccctgactaatgaatggaagggtccagatccagttctaatttggggtagggg

SEQ ID NO: 34534 - DNA, 1166 bp, Mus musculus
ctcctacaaaccacttgttagtggtctgtcatcctttagttttctttcattaacagttaccatttattaagtttgttaggttgtttatatattgactactgtctgagtgcttaagcaggcattgctttaggcgttttatatttatcaatagttattctgtgaggttaatatacttacacagaaggaagcagatgtaaatgcaaggtaactggaggccgtgggatcagtctgcttagcttcactgttaccgttacaaaatgggttctcacatcacgtatgatctcacatcactacttctaacctcacccttaaatacctcaccccctcatcccacaggccgcccacattcctctcattttcctcgagtccacctctcccaagccgtcacatcttgtgttttctctgacatactagtgtcctcttccttctggagattttcctgttagctgactctcactgggcggccaggcgcatgcgcatcgctccgctttgtagcgccacggggcccgactcccgacagcccccgcgcgcagtgcaggctgggggaacatggccgcttccggtctcggagcctgcctggcgcggggctgaccgcggctgcggccccgtgcgctcctccctctgcatctcgcgccggcggccgcggagggcgcagcggcctccagtttctcgcgccatggagaagagctccagctgcgagagtctcggcgcgcagctcccggcggcaaggctgcccagcgaggactcactgtccaggtgaggccgggcgtatggggacggaggccgggagcaagtgtagatggagacgccagggcgtgcgggaagagagactgaggctgctcctgcgggagggaggccggggcatgcggaggagagacctgggcctagagaggctggaccccgaagagggcaaaagccgcgggcatcccgtgggtatggagagcccagcagagcagtgcttgcttcctcctctgggcctttggtgcgagaagtgaaaatacagtttctttatggccactgcccctctaattcccgctcattttccggtcctagattttgctccagttgtgtttaaggacgcagcgttttttactttatcaggagttcagttgtcaagggcgtgacattttcattcttgtgctctaatcacagtttggggaccagcc

SEQ ID NO: 34535 - DNA, 1232 bp, Mus musculus
cttcagctgtcattataggacagcattcagctgccacttagagcagtgggccttcaggactgtgggtggcattggatatggaaatgccaagggatattgagggcttggatagggtttgagaaatctgggcagtgaattcagggctatttaaccctgaaggaggtagggattccaaagcacgagccgttctcccagaggaggaggttggagtctgtctggtcccttttgttgttgttggggattgcctctccccagcctgtgaaggtgtccaccaaaaccagaaggtacctaacacttttgactgtgagcatgtgggtaaagtcaagctgccagttggttccagggagagagcctctggcctggtgaaatggaaaaggggggctgcagtaacaggagttggaatctgctatttgacagatttttttttttttaattaaaggcagtagtagtagcctgtaagaagtgcaaatcctcaggggtgggctgcaggtgggcctgaacaaagagaaacaagtttggctactacgatgaaaaagctggtgtagataggacagaatttgtccagtggcaggaggtgatggtggggatgtcctattgtgggtgagatgggtccaggcctccaagggctgcagctctagccaccttgtcgtcattggcttgtttatttctcatagagatgatcgaattgtcatgatgggactggcagtcagttcctatagctgttgggagatggcggacttttagcagtgctataatttggtgttagttggttatggatccttcttttgttgtaagtagtccaaactctttccagatggcagcaagtgataggaggatgtgaatggcttacttggggtctgtatagatggttagggattgtccttatgcaaatcggagtgcactggtgaaagctattagttcagcctgttgattagtggtgtgggcagggagggtctgtgcctcaaccacctgtatcgaacggacattatgacatagcctgcattttgggcccccttatgtatgtgtaccaggtatagatggcctgaagcaaatgtgccctcttgtatgtgggagggatgaggcagtagttcctctaggttttcaatgcaagcatgagatgggagtggtctgtgtttggttggggaagaagatttgagatgtcgaggggtgggcatgattgaaaaattaagtgtagtatcttctactagcgcctggagagaaagaatccagat

SEQ ID NO: 34536 - DNA, 1920 bp, Mus musculus
ttaggtatacagaagaaaataattctataaaaatctaaaaactgcaggtccatagtcctgaagttttaagtaaatgatatttataaagtagcatcttccaggaacatctgaagcaactgaatgatcagaggtgacaacaaaacatgaatttaattccactaaggagctaaaggtggggctgtccaactgcttaaacagctaatgccacaaagctcaatgaatggttaagacctcaagtttgtctggattcctgttgcagtgattttgtttgctcttgcaggaacctatccacagcagatacaaagaacttcttgccaaaagagcagagcttcaaagaaaagtagaggaacttcagagagaaatttccaaccgctcaacctcctcttcagagagagccagctctcctgcacagtgtgtgactcctgtccaaactgttgtatgaaaggactaggcccagggcctcattgccaggaacctgacattccagcaccttatgggtagaaaaccttccgtgtttaaaacccatctactggagaatccttcggatgctgtatttatttcaaatctctcttagatgagtttagaaacatagcagtgcaagtgacaatgaagatgatctcattcataattaaagtatgacactaatcttaagtcacccaaagaatactaaagtactgcagtcctgtattcacactgggagcaagtttttcatttaaaaatgtcttaaaaccctgagcacctggtcagatctccaggaggggagaaaagcaaggccacctgctgttgcacctgagagcacacgcattgaggcttgtgtcagatccaaatattcctttctcagtttccccaagttttgtgatatttaatatagtaaaaagcattgtcttgagattattatggcatagtaggttttttttttttttttttttttgctgctgacattgtaattagcatattctcaacagcaattaggaaacaatgccttatatatgtgctttggggggttgaagggacaaagtagtagctgtcatctactccatttgtgtattgatcacaaacatcacagaagacatcttaaaaccttactgttactctactttatctaaatgctatttggcaagttttaagacagtattttaaaaacttagaagtctgactttatgtgctgtgtaaatctcacatggacactttaccaaagagcactctgcatgagttagtctcagtgccagcaagtaaagccttgcttctctgctcacccgagtccggtgctggtggggacagttgactcctggggtctgttttactctgtacaagagccatatgtaatgtactgtaacaaacgagcttcttaccacttggtcttttaattaaatgacttcaaactttgtccttgtccacagttgtctaaagtaccctccccaccccacccccaaaatgttaacctggaattatccaatccaatttaagcccacctgtctttgacacctaaaatcaaactgtaaaaagcattgttccgtaactcattgtttgaactgtagtcctggtgttgattttggaattagtacatcacagatctcctctttcctactttttttttttttttgcttatatattttacctggatattgagcccagagcctcacacttgccaggcaaatgctatactattgaatataccccagcatacccagtatttacaagaattggtaccaaataatttggttggtgtaaacttagctataaaaatttttttgaggaggtatttatgttcccagcattcaagtaagatttctgtaacagttcactttcctcactagtctgctttcttccctgaaacctttgaccatcttggtatgacatcagagggatgctgatcatacggtcacccaaacggcagagaaatatgtcactccaaaacct

SEQ ID NO: 34537 - DNA, 1723 bp, Mus musculus
aagcctgtccctctctccttaaggagacttttacagtatttatatagcacttatttacctggctgtgtattttacatatgtgatttataacttctgcagatctatgtgcttttaaaaaaacccacctagaatctatcacttgagtgttagaggaagattatttaagtcaatggtgtacttaagaagttgaggcagaagaatcaagagtttaagactgaacatagcaagacctcgtatcaaaaacaaagctaaaagaaaatgtttttattgaattcattttttccctgttttgattatttggtcagctggagaaacaaaacatagataagcagaagaaggaattaaaagctaacaaaaagactcttgatgaagaagggaacagcagcggtcgttcatctggagtcccaaggaccgcaagtaagaaggatctggccaaacagagacctggagaaaaaagcaggaaaaatcttcagttactgaaggacatgcagaccatacagaattcactgcagagcagtaatctgtgttgggattactgacaccaggtcataaatgatgtacctcactggtcataaacgatgtacgtactggacatgagcagactttccaggtctcatgcttgctaagctgccattactggcaggtgttaggggccaagcttcattacagtctattgtgctatgtagcacaactgatggagatggagttctgcggcagagaagcctcactgtctttgaatttgctgtactcattcactgcactttgtaaacaaatgaccagttttttactcatgggtgtgttttttaaactaggtatatatgtaaattgggtttgaaaattcagaatatgagatagtccccatagtcagtgcttgaagtcttgttttttaaatcttcccacagcatgaagtgaccactactctcccttctccagatgaccattaaatgtactgttttcaagaagactttgttttgctttggtattttagacattgatcaatcataaattcacttaagtcagttatccatgaaatatgtcacaatgtcttcagaaaaactatataaacagttgttactgaagtaaatgaaattttggaataaagaatgagaacgtgggtattgtaaaatgtacacgtttacagtttttagacagtatctatttgtaatcatgttaagcactgtttaatcttgacttaagagaagctcatgcttttagcatacagtatgtgaattgaatacacacatctatcatgccaatgtaaattatttaactttgagtagatcgacatgttataatctttataaatttggtacttcaaatcaataaagcagtttttaaactttgcttaacagccagctaacaaaggctttatttgtcatacaaactcaaaaagtgcatgttagtatcgtgattgaggaacgagaatatctgaggcatgcttgtcatccttgtgcttacagagaccaagctcagtgttcctgaatggttcagacaggctggggaacatactagccatctactaagttgaatagcatgaattgtttgttacttgggcaccagaaggccctatcacttggtgaattttctagttagaaacatagatttttaagcttcatgagtcacctgaaattgtatataaatttgtgtgtgcagttttctgatgaggtttgcaggaacaatgacctgacaaccgtgagtccatagtccccaggaaggtaagaaa

SEQ ID NO: 34538 - DNA, 1157 bp, Mus musculus
gtcaatcttcagatctccaaaacctttcagatttgctgacacttttctctctcgggctggttctacaccctgttagcagctttcctcagcaggtatctatcccatgattctgaaatctctaacatcctgggatctccaacaaaatctaggcttcaccttcacagcttctttcagtgacctctctctgggcctccatgcaggacttccctgacatatgtctgcccacagcagctttccttagttgtggagggaaactccgaaacccctttcttacatccttgactgtaagggcagaaccatgtggccgaagctgccaagttcttcttactggggtggaacttggccccttgctcaaatacattcttgtcactttctgttttttgatgttttctgtcactgcttaagcttcactttaattccttgtcacaagttggaagcctagcagggtgaggtcttgcccggaggccattactccttttattctatttagcaccaccctttcctttaaatttttatctccttgaacactgctagacttaactccagcacatcctggtgccccctttctcctccaactgtatgctttgtatttttccttacttgtttttattgtagatctgcatgaggatagtcactaataactgcatgacagaattcatactaagtggccttggaacctcctctgccagtgttattaatccaaaactcttcaatttagcctcaggcagatttttcagagaagggcagaaagcagtctcattctccaaaatactgtaggccacatgaaacttcatgagctgggaccccacagttcaaattgtcaccagcactgtcttccatgaccctggttgcatggcccattaagtcccaatttaaggcattccactattttcctaatacaaagtcccgaagtccacattttaccaatgagcaccatggtcaagcctgtcacagcaataccctgatcacttgtaccaacttctgtctttgtcaatgttctattgctgtaaagagacaccatgaccatggcaactcatccaaatgatgagcttatggggcgcattcatattcaaatcaccacagcctctgtagctcagttgcaagtggtatgcttctgaggtttttagagcaagatgtcattcctacaaggaggagag

SEQ ID NO: 34539 - DNA, 2137 bp, Mus musculus
gtccttctaaacagagccataaagaaatgaccgtcacatttctttactgtgctaggtgtttttcaggtttaccttgctggggctgaacagtggtttcaccaagccaaagcattctttccccagaaaaatctatttgggcaactgggttaaaacaaagcaaaataaaacaaaaacacagcattgtcatagaggagaaaaaaagcagccaaaacctcacatttttgcatcagtttatgttgtttgactagactatcttcagagagcacaaccttatgtgtttatagctttaatttgcattatgttaatgaaccagtgaagtgcctagagagctgcccaggcacctggaggactctggctgaacaccttcgcttgaggaaaggtgacttgtgttcctcacatccatgctaatctagactgtccctgtctgtcacagtaagtcatccagggagcttctacagagagctcctcgggggtttcctagttatgtgggtgacttctcttaggaaaggcctgtgggccagtgttctgttaggctgtgctcccctctgtctgccacctttttctggatgttagttatctccttttccttgagattttgttccagagagggaaacaaagatggctgtagacctgtcagcataggtagttttagactccaggatcttgtttaaaatcctccatgtggaggaaaaggttttgaagacagggtggtttctttaaagagactattgagagaacctgtgccaggtttcttgcgttcggttgggtgtgtggactgtgtgttcaccttctttagattgtctgaactacaagggagtgtttagaaggctggcgaagcacaggggtaatgccccatgctaagactttcatttaggatagagtttattattggtttttaaaagtaagtgttagaaacagtttcacttcatagctccatccatctcttgtgcaggtaaactgagtggcggagggaaatagcttttatgtgctgactgagagaaggaattctcacgggtccctgaataagctttagaccaaaagggaagacaagggttaaatacagtgaccacctactttttggttttggttttgtgttgccccagaaatgtcagtagagattgggctgtggaaatcattagtgccttcaatagatttctctcctagaaaagcttccttttagttcttcaggatcagtcaataatcaggagaataagtgcatgaaaacacagcaatgtacttatgaacctaagtgaaccagcctcaaaaagttgatttgtgaaggcggctccacctccatgcttcagcagatacagcattcccagtgtgcatgctgctgtgagaatttgctgtcaacccatctttatccagtgcaaacttgaaattctgatgcggttttccagggtggcatttttttttcagagtattgaatttacgatgtagtaatttatagtgtagctttttatacataaatgtgatattttttaaaaggagctacctgactcagtcggtataataacagagcctattataagctgagctgcactcgggcggggctcacactgtgccaaacataagcgtgcaaatgtgtgtgaaaagcacgtctgattgtgaagccctcaactccctgctccttgtattaaaagcagcctgaaacccatgatggttcatggtttggatggctcagtttgaaatttcacatttgccagcatctatgctaattcttaatttctcagataactatcaaaaacatcaagaaagtcaggcttagtgactcatacctataatcccagtgcttgaaagcctgaggcaagaagatggtggttttgaggccagcctgggctacatagtaagttcaaggccagcctgagctacatagtgataccctgtttcaaaaactaaaaatgagagagaaagaaatatgtaagtacccttaaatgtgaaagtgggcgtgcccccttgtctgtgggagtggtctgaatgctttggggcagtgggggggggggggggtgaacctgcctgagaagtggtttctcaggccaggtttcctcaggcagactcagaggggaaaggcttttgagatgagactacttttacagatattccttgtctcagtccaaggaataacttgccacccctt

SEQ ID NO: 34540 - DNA, 1057 bp, Mus musculus
cctcagccactgctcccactcctccctcccaagtctgcctggatctcaatgcctttcacaattgcacatcaccagcctcctgctaatcatcaccagtatgctgtgtctttttctgagtacatttccccccatcgttaaaacatgtctttcctcaacacccttcaagtctctccaccgtccatctctgttaccaaatatattacagcatcaaatgtgtcctgtccaccccctgctgtttataccatcttgccggctgccaaaatatcttgctgtcctctacctcatccctaaagagcctataaactcagccttctcctgggttcatcctctgctggtcagtaatgctagtccatattttaaataaataataaaacctttgccttctatctatcaaagtagaaacctttatatttatacacgagacagaaattgaactatttctaccatgaagaatttaacatttagcaggaactcagagtgattgaattgctagcctaacttggtctatgttagatggtgaatactggtgatagacccagtggcttgaatgtagagtaaaaattccccaaccgtccagattaacctataactcttcagtgggacaggagattcctggcagacaaatgaggtagtgttttagacaacagtttgattggtggtgtttgggccttaaaacacatatctcatagacgacaactaatgaaaggtgtttagaaggtcagattggatcatattagcctatttgatatataatgtagataaaaatcccaaaaaactggatacatctgaatttgacttgattaagcttctaaccccaaccctccctgttcccaatgggaaaaaacttaccttgtgatggcttttgtctcaattccccctggctgttcttcgtgtatgtccagatagtgtcattaaggaagagaatgttgtactgaggcaggaatgcagtttctcccctccagccaggctcctaaccagaggtacacattcacatgtagatggtggctgccctgccctgcttgggagtgtagatctgaggtctctaatggtcttcaga

SEQ ID NO: 34541 - DNA, 1463 bp, Mus musculus
cagatcccaggccacttgggcatcttctttatactaattgaatagacatgcgtacaggctggtcaaggtaaacgagaaccatgtcaggtcaccttgggaacatggccttgccacttggctccgctcctgcaaacctgaaagaaacgttcctcatcatggaagaactggatgtagcttttaacttatgaaataggaggtgaacttgaaagcccttctgaatcctgattgtgcagagcagctgcataatgaatgtacacatgaagaccgtagctgaactgcacgagtcagatgccaacttcatgactttccatgtagacgttgtctccttaagttgtgagtgatgtatgtagcatgctgtgaagcgcctgttctagttcttaactcatcagtattacggagttacccttgcgttccttggtactttatattcaatgtaatcagaagctgtgatgtatccccttcctagtcccatgctttgttgctgtaaatttccttatgaagcacgtgactttggactcatgtaaggtggatgatcttgaagactgctacacacacacacacacacacacacacaccagtctcttattgtgtatggtttaaagttagggtaagcttttctccagtagactattgatgcagtttagggtccacaagttcattgtcaggtggcagactcctttttataggttcaactctgaaaatagcaagctttgtcaacagccacttcacccttgttctagcgaagcagaccctgctgtaagtgtaggctatggtggttacccataatgccctccacatgcgtcggcagttatgaagataacagaacccatgagagcttcttgtatgtataactaggcttgatttgtgttgttttgttgctggtttggcagtttgactaaggctaacccaaatgggccagctcgtgtaatactctagtggtttaatgcctctcttctcgttctgctgctgtcgttttggtttttgagggatgggtaatattatttgaacagataaagaaggaactgttactgaatcaagacaaacacacctgaagtaaaggagctgtgtattaacctgttaacaattcataactgcactttctatgacattttgaaaatctatttataggtacagaacaatgggttttgttaaactgtatcacgtttatacctgcagaatttatttcattgttattagtaggaattttattggttcaataaaattgacaaagctgatcctgctttctttctttaatgacttgccgttaagagtgctctcacctcaggttgcctctgcctggtgactgaaacgtgctctgggagctgggaaggtcatgggaagatagtcttaccctggtagttttgagccgtactttcttttctcttgatctttagtagcactagttcagaatgtagaacaactgttacttttaaagagtggtctcagaaaaggcaagttcatgt

SEQ ID NO: 34542 - DNA, 3432 bp, Mus musculus
gtccttcctcatagtgcagaaggctcgttttcagatctcttggagcatttgatcatagaacttgagggtcttctcttgggataaagaaaggataaataaaggctgtggcacttagtggtggttggccagcatcctgctttgtccttgagtgagcagtgtggtgatgtctgaatacttccaggtgtcgtgtggaacctgagaagtattgagatcatgtctctgtccctgtggtttcagtaagtagattcttctatgtgtaagcactatttctctctggaggttcatagcactaagctgccaagaaaaacacgttcatttgcaaagaattaagagtgtgtgctaaacacttgacattgttctttgtttctcagaagctagtgaccagcaacgtggagtgttcagcaagtccccaccatgcctgcagggtggggctgctcccttccacacccagctttccttaggggtggagacagggaatggtgggacctgtgttgttccgtcccgcagaggtctctctttggagcccatgtataaggcttgacatttttctgtgagtagatttagaggcagttgttccaagtgaattctggcctcagtacaaagaatccagtggttctgacactcgggacaaaagctctggtatcccctgtagagaggctctgtcctgctttgctccagccactcacacatagttaataaagtggctgaagctcctcccttcccagagctgctgtgctggggacgctgtctgcagcccgcccgagtcccagagattggtgtgagcagtcagataaggctgatctgggagacggaggaggtggccatgacacaaggtgttgtcaggagaagatgattgtgacacaaggtgttgtcaggaggagatgactgtgacacaaggtgtcttcaagcagctcctttgtgagtaggctgcagagagccatcctgagtgggaggttgtgttgtttaaacacatggtgtcttctttgtctgcactggatggagcagggtttgtttctatgtgttctccaggtgagctcacaccctctttaagaaaaggggtcttgtggatgttggaagcaaggtctgtcaaacattcttaaatggtgatgctagagaaaagcgagccccctgtaacttccctaaaagccgactcagccactaagtatacatgttgactttcttctactttttttctagttaatcagtgtgatttaaatgtctttagctgatgtgaggactttttaaaaggcagtagtttgtggtgcagctccgtggaacaggttgtgtaataagaaacctcagaagccaggcttcaagggggccgggtgtgtgtgtgtgtgcggggtgcacccaggccagcctttcagtggattcctattctcatttagtaattgaatggtatattacattatatgtaagtgcatacatataaggtggaatttttctcaatataaaaaaagaaagaaagaaagaaagaaagaaagaaagaaagaaagagaaaaagaaagaaagaaatgtaagaaagagaaagaaatccttttgttttcctgtgagctcgctccttggggaggactacagggctccccatgtaaaatggctgttgactcctctagcacaatggcctccaaggtctggcctgctcctcggattccctttgaagtgagaggtcattgtcttttgagaatggatttaagttttgaaaatagcccacattgttccagcacaagggaacgaacatagggcaactagtcagaatcagaaccccagggccatcagatgacttggtgaaaaggcacttccaccaaagccaagacctgagtttgatccccaggaaccccatagtaggagagagccaactgcagcaagttgtcctctgactcagacacacacacacacacacacacacacacacacacacacgcgcgcgcacgcgcgcgcacatacatacacatgcacacacacacttacatgcacacacatgaacatgcacatgcacacacacacatgcatacatacatacacatgcacacacacatatatgcacacacatgaacatgcacacacacatacatgcacacacacatacatgcacacacatgcacacgcacacactcgtgcgcacacacagtttttagaagactacctaatgtgtaggaaaagggttattagtacctgcaacctctagggcctcgttttcaagcccgcttctctctccaggcttcatatgtgtgcaacccctgcatacactacagacctaagtacatataaatatgaacagccaataggtactctgtaaaatggatattcttaagtgcatgttattgttgtgtgtgccgtgactgaggtgtgtgttcgtcatgagactttgcttcttagctgaattaagactctgccctccctccgaggcaggaaataggctgcagcttctggaatcagcttctcacgttttcccgcctttgttgtgtttactcgtggctttgtctgagagtctgttctcacatacacacctgtaagtatttattacaaggtagaatggggacaggcagccacagtacttgtatttgaatgtttccagggagggacaatggagccccctcctcagtgaggtgctcacagaatctgtgtcaaattctgtgaaccagggccaacactggtaccagcttcaccctgacctggggccactgccctctctctccactgccttgtgtgtgtataggtgtggttgtgtgtgtgtgtctctgctgggggcatgtgccgcacttcccagcggactctggtatccatgtgtaacctttggcacctgtgttactggactgcattgacaggtggtgtacagatctgtacagatgggtctgtgtgaagagttggggagtcccccccacagtgaatatggatactgttggtcagccaaagattttcctattctttgctgcttaaactttgtgccttaatattgtaaataataaatgtttaaaacagcaaattggctcctcttttaccttctttgttcctaattcctccagaggacatagatgaagctcagatgtcacactgagatcttgcacatggagcacacctcgtgatgctagccccagagccttgtggctgcccacagtgaccctcagcccacacagacacagtcatagctgttggagaagatggctgtggagggaagaagtgtgagaggctgtgctggggtggggtgggtgggagagtggggggaggcagaagggacattctctctgatcatatgcaggcatcttgggaggcagggctcatggatggtggcctgtgactgtgggaaacagctctgccttggagattcatccaagcagcttggataccagggagcaaaccacaagtagacatattttgtgctgcaggatgggcaggaagatggtagctgctttgccaccagaaaataacaatgag

SEQ ID NO: 34543 - DNA, 2150 bp, Mus musculus
gcctgagttcccagatggcgagatgatggaagtgctcatctagcgtcgtcctgtggcgcttgccagcatgctgacagatgagaacagaggctgaaagaagagctccagatgggcagttgcagtagcaactgcaaaaccaggacaggtgtggactcgtcacaatgttaccaaaacagctggctcactatctgcagagggagtgagagaggacgcatgtaggcttggaagcagagtagagaaggaggaggagtggaattttccattgtagagaaattgtatgtcttagggaggctccatgcttccccattcttggcttataaacagatgaagaagagctgggccttccttggaatccccttgttccctttgccttttagcaggtttggtttaagaagaatctgctagaaatcctgaaagcccatctcggcataatggtgtgtgtgtgtgtgtgtgtgtgtgtgtgtgtgtgtgtgtgtgtgtgtggtgtccttagcaaatacatccaggataatggggaatttcaagttttgtcaccttcttggctgtttcgtttgtggtttgtgatttcagagagtgtgaagctttgcttgtttggattggatggtattttctaagcaggatgtgagcaagatgcccttgccctcacccatcctgatttctttgagcttatctgtctcatctctacttactattttattgttgtatttttcctgtttaattagacatagcagagttccttatatatgggacttaggagactaccatccttgctgtggtgtccagatggacagagcctcgtgttggcaccccaactgctcttcccacctttgcttagcagaactgcagctgtcagccttattgtgagctagagatacctggctgaggagtccatgagttgctgacataacatcatgcctctgatgtgcatctctctcacgtccacactcttgctaggaggttgacaattacaccccatcgccctgtggggaagacttccttgtgaataggtgccacaggaacccatgatggcttacccagagctctctaggtagcatgggaggtctcagcaggcatccccagcctttcttgtatttgaagctctcaggtggtcttttgttgctctcccctgccccattctgccctggttgctgttgataagcacagtgccatccctgatcaattctttttccctgtgaatttgtttcataacccatcagactggtagacacacagcacaatcagtatcacagaaagggacacgacttacctgaagtgaggcagcaaagtcatggaaatgagtccctatgaacaagaggcaggacctgaggctgctgccacaagctctcatgttcattgctgtggaagctggcttcctggaaaccccagaagaagctgcccaggggagggtgaactatctccagatcagtaaggtttatttccaagtccccttcctcatcactcctttttggctcaagagaaaaatgaaaagtggtaattctgtgacgtcaagtccctcttaagtgcagcactgaaaatagcttggctcagagagctctgcttggatcatgtgtcctaggactcatctctaggatgagactgtggcctccccaggttgaggtggtacatgtattgtgagagacgtagcctggagaacagagaagaagagaggcaaggggaggagagagcagtggtgtttccctacaggaccctggaccatctgacaagacagaggaggtgggactagactacccacactccacttggcagtgggaaccaggctgggagcctcccaccccctccttaactcttctctcagatcttgcagcctgagtactgagcttgccctgtgccttgtggggaagggagtgagaaggcagcataagaggtcttgccagttgagacagaagcaggtaggtgcaggaactattttggatagggcatgttgttcagttgatggcaactaattctcttaagaacatattgtctcctattaatgttggggacaaacccagaaagggaagggtatagagatggggaattggtgagatcttccagccctgagaccatgtctgagccaccccaaacttaggctatctcccagcataggagtgagacactgcccagtttactcaaattctagtgtacgtgtt

SEQ ID NO: 34544 - DNA, 1147 bp, Mus musculus
caggcttgttgcttatcgtctttggccaccagtgggcaagtcatcttctctcctagaacctagccatttcttcatttttctttccctatagagatgtccctacagacacagtttatctagtttggggccagagcttctgcttccctggtatccccgcctccactctttctcctcgagatgtgatccacgggcatccttagcttagtcctgggagtccccagcagatggctactgtcacagccctcctgggactcccccatctgctgaggcaccgggaaggtgcactgttggatctacattggagagcatggaaagcacagcttgagaagtttgcagattgctgatggttcaccatctctgccgttctccaccccaaatctcagattcactgtgaaagtccctgagacaagcattccagagttttctaactaactggcattttagtgaaacctttgttcttttttggttttgctttacagtattaaaaacctccatgccaaaatcatagagaaggatgccatgataaaggtcctgcagcagcgatcccgtaaggatgctgggaagacggactctgccagcctgaggcctgcccgctctgtcccatccatcgctgcggccactgggacacattctcgccagacttctcttaccagcagccagctgacagaagagaaaaaggaagagaagacgacctggaaagggagtataggtgagaagaggaccctatagaagagagcatatagagagcggcacctatagaagccctgaggtagccaaccaccttatcactgcttaggcctggggtgccacctgaggtcaacttatgcattcttcaaagggggaggaaagccaaacgtgttggattttgagggttaaatgagatacatggattccaaaggttatgtgagctcttgggcttggactcatcttgtcactgttgttaacaagtcttagcaggacaagcctaaagtccctcagaatgttactctgggaccatctctgcaactgccctgcagtgtgtctatacccgtggaacaggaaaggatcaaggaatgtgccaggaggatcagtgtcacggattaggtcattctgtgttgtgcaggcaggatgttgagaattctccaggagtggatcttagatggagtag

SEQ ID NO: 34545 - DNA, 1569 bp, Mus musculus
tttgagaggtatttgggtacatctgtggagatttctgcagtgtgtggtttttatcagaaataattttgcaggacacaggtaatacagaaactaaggatattttttggtgctgatccaagagaaaagtatttttaaatatcccgtaccctgggtctttgttcagtttagcacattgacttgtatttttataagctaactccaaattttcatctttaacatactggtgcagtttagctgtcttctctgcatctccagtttctttaattctaaacaagaaacactaaaaaattcgtgtcttaacatctttgtaagtttaaaaaaagtagtggaatgtttagatgttttgtttttgaagatgtaggccattctgagaaaagcagttgggagatgtttaatccttgaatgttttacactgcctcccccaccacattcataaccctgtggacagtcctacctcaccctggtcaacccatgtgacccttactgttatggccagacagtgtctccatttagacatgcacaaaactgtttcttggtccaaaagattaaaactgccctctgaagtgttcacctttctctcttgctggattaggcattactcataagttccaggaaatgtccagcactatccccacggccctcattttctacaagccatgacaaaggaaaaaggacaaggaattctaacagtgaggaatgattgtcatatgggaccagaatatcatgtggctcaggctttcttaaaacagaaaaaacaaaaacaagcaaccaaacaaacaaatgaaaaaaacaaatcaaaacaaaaaaaaaaaccctcatagtatggatagtaacacagagtgtaaatataaatagaatacaagttttgacagggcagaaggcaacttgcatataacttcaccagatctatggcacatttgttcaaattacattaacttttatcttcttggtgcctgcaacatagtttttgatggactctcaacccctgtatattcctgaggggtcttctgaacatgagaacttgaaacctaggaaaaggacactgagggctcattgtcaactttgaattacctagtaaatacacctttaatatgtctggaagggagtttctcaaaaagtttaactgaagaaaggatgcatatccagatgtggttggcaccatcacctgggctcaagtcccagattaaataaagagaaaacaagccaagaaccagtgtttgtctctgtttcctcactaggtagtgaaccagctacctcacatatgctgttccttccccaccatgatgactgtctcttaagccatatgatacgtttttcctaaaggcgtttgtttaaagtgtttgttcacagcaagaaaaaaaaaaagtaacacacaaaaacagttgttcttgtcaatatttttaattgtctatcattttttaaatgactaagtcattttggttttgggccagcccatgtaactcatctactttagattagataatagttgtttaatcaaatgaatatggagctaaagagataagcagcaatgactgctcttctagaggactcatactcattttccagcac

SEQ ID NO: 34546 - DNA, 1151 bp, Mus musculus
atcttcttcaatttctttctgccctacttttgtgagagtctctcattgaacctggaaagttatttactaaagttcccttgactagtacagcaatcgagatctatgtttcagtgtcttctgataattaaaaacgaatcatctttgctctgtttcctctatctccattcctttgtgctgtgattgagccaagggcctaccatagggggtcatacatttcaggtcaaaccacgggttaccctttcccctctttaaagttgaatagtatcctcacttcactgtgttgctaaggctggtgttaaagtagaaggtttagtgaccacatgaggctgggcaaccctttttctatcatgtctagattttaaacaatttttgccttaaacttactaattttagtactgttttctgttgattaggtggattttattttgttaggtggtgatcttttccatgaaaacaagccctcgaggaaaaccctgcacagctgcttggagctgcttaggaagtactgtatgggtgaccgccctgtgcagtttgaggtcatcagtgatcagtcagtcaactttggttttagtaagtaagtacatttacatttgagagatggtttttttgggtgtgatgtctttgttgctgctggcaaaattcccttacaaagcaactttaaaagaaaagggtttatttagcttataatcccacattacagtccatcattttaggaaagccaacataggaactttaggcagctagttttatccacaatcaagagcagagcgattgaaaacatacatgtttactgttctgctagctttctttctttctctctctctctctctctctttctttttttttttttttttgtttttgttttcgagacagggtttctctgtgtaaccctagctgttctggaactcactctgtagaccaggctgaccttgaactcagaaatccacctgcctctgcctcccaagtgctgggattaaaggcatgtgccaccactgcctggctcagctagttttttgtagtctcatacagtccaaaactaaaacttagggaatggtgttccttacagtaggctgtggcttcccctatcagttactgtaaacaagaccatttcccacagacatgcttaggcctgtaggcagtccttcactgag

SEQ ID NO: 34547 - DNA, 1213 bp, Mus musculus
tataccccccaaaacaccaacaaacaaacaaacaaaccatcttataagacaccactttatattacaatgtcttgtttcacagctgattttttatattttttagtggccagggtgtcatgttagtgatgaggtgctagctttgcacctgctgtgtgctttcggctgctgtaggtgatgtgtagttagaagaaggtagtgtcttcatcactggatttagttttgggaagacactgtcataatctgtttttgtaattacaagttgaatgtcctttatccaaaattattaagccaaaagcgctgcaaaatcttaaagttagactcagaagtttttggttttagatcctgtttggttttgggttttcaccttgggattctcacctgttaaggtctgcacaggtgttctaaagtcaaggaaacccaagttctgaaaacacaacattctgtgagtaagacacacttgtgtacagggtgtgcttttgatgtgggtgtgctgctcacccagaccactcatttctgcagacacactcatgctctttgaaactttgacacaggcagatgccctctgtgccctggatgttttaagctgtgctgggtttgtgaatcactttggacggtcaatgtcggtggagaaggttgacattagtccggttctgctgcagaaaggaagcacaaaactcgctctgtacggcttaggtaggtgattgacttcggtcagatgtgatccctttgtccacgccagtggagaattgtgtgtgtggttggcaaatacagtgttagagatagtttggacccatagggcttccaaagggggggaaattggacaaatttgattatttcttattgatttctataaaagatggtggagttttctggtaaaaatgttcttagtatttctaaggactgatagctcttcaaacctaatggcagttttagtagaaaataaaacacgcaaacaaaaactttgcactgttttggaccttttatttagagtcacatttacaaagctggatggatgataagtgcagactaggtagcggaactgcattttgtgtcacagaagtccgtgagaggtcagagcatactattcagtatggtaacactggcctttgtagtggggagagtgaaatctggctgttgtgagttgtgacacactagatatcagagacagacgaagacctgttattaacaggttatatatgttaaagttaatttt

SEQ ID NO: 34548 - DNA, 1595 bp, Mus musculus
agcagagcacacactgcatgtgagggcacacatgtacacagtagtattagtaataataataatgtcaatgaggaaactgaacgaataggatagaaatgtcttggatagtttctgtccttgctttcctacacctcatttgctttgattaatgtttgtgactgggaaaatgtatgtgttgtgtgttatagatatgtgcagtgacagacaagtcctgcctggcagatttttactctaatgcacagagaactgacttgggcctttatatttcacagttaaagggatagatgtgataaatgtgacttgctaataccattttaattgtaagagtttctttcttagctcagagacgatgagtggtcactgacatagcataacgtttgtgtcatttcaggatgatgacgatgaccctttcatgagcagtagttgcccaagaagaaaccgaagataatgtttttaatggaacttagaaattgcatgatgcaggaagaaatcaaagcaccacatactgacttcacagctgaagatgtttaagtctgggcttatattttatcgttttctgaacggtgactcccttaagccatttcctagcccaatgataaggagattgcagctcttcttagcctttaacctggttgttattgtctggggctgctctgccatatcgagaacattaacttcctgacagaactgtgttttctgcttgtaagaacttggctaaaatcccattcttaaatgatgattagagaaaacccctccgttgttcatttctgcttcatgatcagaggctgtcagcctctgtgccacagctagcagttgatgggaaagcttacagacttgagtggcatgtgctgtaaccatctcctagatctccagaaagccaggccctcctgtgtggggggcacccagcaccctgcttgttatcaagtgtggatatcagagcttgctagaggaccgtctactaggaccagaagggtcttatatttaaataattagtagaaggtttttgttaagaacattttggctgttttggttttgatttttattcatgttatagcagagattcagatcctgtgcccattgggcaggactcattttcttgatggctctgtcagtaatgacaagctctttttctttctcgtatacttgtcaggaagaaaaggctaatagaatttttctgttttcttaaaaataccggaaagcttttttaggcaaagcagcatctgaccttgtggttagttcaggctgccatactgcagcagtacagcttctgccggtgttggtgccggacctcctccaccagcagcacactggcttcagttgctgtaaacatctctgagtggatgatcccagaactgaccgaaacagcacacttatatttttttacttgttttaggaaggaaataaataaaaatgttatcccttctgagataagataaataatctcattccctgtcccacactctaaaaacttctgctggtcttaattttataaggcaagtgtgttcagtcactctgataaaatctgaaccctctagcatgacaacatgatgttcttcatagttgtagacaccagtgcttgggctaaacagtgcctg

SEQ ID NO: 34549 - DNA, 1161 bp, Mus musculus
ggacttagcagctaagggcacttgccgctcttgcagaggccagagtgttggtttcaggggatctgacatcctctcttggctcccgagggcactgcacacatgcagtcagagcactcatataaaattttaaatgtctaaaacatttaaagaaaaaaaaaaaaggttttgtttgtttgtctgtcttggttttttgaaacagggtttctctgtgtagccggggttgtcctagaactcactctgttaaccaggctggtttcaaacccagagatcctcctgcctctgcctctgcatgctgggttaaaggcatgtgccaccactgcctagtgaaaaaatggtttttaagcatggttttattccgcagcagtcagatgaagttacagttactgtttgaagttttcagtgtgacagtgttgacaatgcccgtgcctttcacacttgatgagactggccagggtcccaattatttttatttgctttgtttttcagtctgtgggagatatctgaaagccacttcaagtacccaatcgtggagcagtacttgaagacaaaaaagaactctagtcatttaatcatgaaatacattagctgccggctggtgacatttgtggttatactgttggcatgtatctacttgagctattacttcagcctctcttcactctcggacgagtttctgtgcagcatcaaatcaggcgtcctgaaaaatgacagcaccatccccgatcgcttccagtgcaagctcatcgccgtgggcatcttccagctgctcagcctcattaacctcattgtgtatgctctgctgattcccgtggtcgtctacacgttcttcatcccattccggcagaaaacggacattctcaaagtgtatgaaatcctgcccaccttcgatgttctacatttcaagtctgaaggctacaatgacttgagcctctacaacctttttctggaagagaacataagtgagctcaaatcgtacaagtgtctgaaggtgctggagaacattaaaagcaatgggcagggcattgaccccatgctactcctgacaaacctgggcatgattaagatggacatcattgatggaaaaattcccacgtccctacagaccaagggagaggaccagggcagccagagagtggagttcaaaggtagggtgggctctct

SEQ ID NO: 34550 - DNA, 1167 bp, Mus musculus
gcccctaaactactggccctagaagaagattattagaggggacagggctcggaccccctccctgagcctagggtaaccctgactgtggagggaacccctatgaactttttagtggacacaggggctgaatattctatattaaaacaaccattgggaaagttaaaaaaacaaaaaaactatagtaataggagcaactggacagaaacaatatctgtggaccacctcacaaacggtagatctggggagaggaaaagtaacccattcctttcctgagtgtcctacgcctttactaggaaaagacttgttaacaaagttgaaggcccaggtcaggtttacttgaaccagaccagaggtgacacgggaaactcccacctccacggtattggccctgaggctcgaagaagactatcgactacaggaggagtccttactcagactttgggaccttggaaaaggccagtggtttacctatccaagaagttagaccctgttgcaggtggccttcttgcttgaaagctattgctgccatagctctgcttgtcaggaatgctgataagctcactctgggacagcaaataactgtagtggcatcccacgctcttgaaagcattatccaacagccccctgactgatggatgaccaacactcgtatgacacattattagagcttttgttgactgaatgagtgaccttcgctccccctgctgtcctcaatcccgctactctactgctcgagattgatgactctttacctactcatcactgtgctgacattctggcagaagaaactggtacttaaatgatctgaaggaccagccttggcctgggcgtccgagctggtacacggatggcagtagcttcgtggttgaaggtaagcagaaggcgggggcagcagtggtggacaggaagcaagtgatctgggccagcagcctccctgaagggatgtcggcccagaaaaccgaacttgtggctttgatacaagctctacgaatggcagaggggaagtctgttaacatttacactgacagcaggtatgcttttgccactgcccatatacatgaactaatatacagacaaagagggctgttgacatctgcatggaaagacataaaaataaagaggaaattttgagcctcttcgaggtcatacacttgccaaaaaaggtgg

SEQ ID NO: 34551 - DNA, 1252 bp, Mus musculus
ggaactaaagcactgcgttgatgttactatgcagtcagaagcagcctcgaactccccccaggtgtggggttaggggtgtggccctcatggcctgctcttgaaatgcttgtttatgaggtcatctgagctattgggcagattttccgtaactttgtaaactgcaaagtgaatggactgatgttggtttcctccatagttcgtaacggacctgagagtggcagcaagattatggttcagtttccccgtaaccagtgcaaagaccttccgaagagtgatgttttacaagacagcaagtggagtcatctccgaggaccattcaaggaggttcagtggaacaagatggaaggccgaaacttcgtttataaaatggagctgcttatgtctgccctgagcccctgtctgctgtgattttctccagaacaagttccagaaatactgactgtttgcagatcagttataagcacaagggagagatgtcttccatataagtcccgagtgcagactcatgtgcactgctgctccaatctttcacgggagccctgtttaaaagttacgtttactttgcagcctgaattctctcactttataagtgacgagtactttggaatgaaaaatgtatgtacagttatagtatgcagtatggggagatgtaaaatagtacattttttatacagctaacctgaaaatattactaacttaagggcttgaatttgctttttttaaaattccatctttaatgttaacataaactttgtgtttaaaaaaatctccccaagtattttgtgaatttctcataacccatatgagctgtctctcaagtcagctgctcctgctgtttctttaaaaatcacccaagaacatcttacaacacagattcactgagcaccccaggccctgttcctgaagttcaccaagatcacgcacagtagtcttccctagtacctggggctcttggggtgttggggatgtgaagtgcctttgtagccctcttcctcacctgggtcttcatgaacaggtcaaaggcagagggaaccaaaggacgtcccataacacagtctctgttttccctgttagtagtcactgcctttgcattccacttgaaatttgacaagttgagatataaaggagatgtgccaagtgtgacaactcatgcctctaaccctaggactaagggttgaagaccggaagctcaagagttcaagttcagcttgatctgcaagagttccaggctatttggggctatgtaggaaaa

SEQ ID NO: 34552 - DNA, 1562 bp, Mus musculus
catatgacactcatattaccatattatttaacatcttcatgtgaggggagcgtattgggaacatagatagctaattgagatgctcactttagtaaaccaatcttctgtctttatagcccagcaaagtctaccttctcttcataccacagatatgaatatggacagggaccttccattattcctgctatctaggaataacttacatttgggtggcattactaaatttttcaagttcatctcacaagggctaagggagtattagacacaacagtgtgggatctttgcactgagttttaaaagcccactgtggaaatcagtgcactacgttctcagcactcaggactacccacactcagaagtctgcagttgccttccacagatgttagtagcattgatgagccaggctccgcctgaattaggtctctacccaacagtttgtaccttcgtaatactgtttgcaagataagaaagaaaagaaacagcaacaaaacacaacacctaacatggccactccccatcatgagatataaaactaccctcttattatgtggtgtcttaaagagacacttttgtgccctttctttggctatatagactgttgagacagtgaaccacaagaaattggaattccctcaggaatttcatggcaggagaaggaaaaggctgaagcctggtgccagccagaggaggaacttgtcttctggaaagatgtcacgtacctctcaggacaaacaggaacccagacaacagtggtgggcaggaccacagcttgatctgcttagttaggtatacctcgtgccttctatttaaacctgaacctcatgccaggacccagcatgaattctgcaggatggtgggggaggggtgggaatccagagacctgtttattcctcttcccaaagtgactacattcaaggaatctttttgtgcttttcaaaggatattacactattactgagcgctgatggctagcatatggtgatgatggttagaaaactccttgctgttctgtgtcatagaacctgtgatgatcattagccagaaatcaactttccaaccttcccaatggcaataagatgtgggtctaggaactctttagaactaagccctaaacgttttctgattctttactttgtaatgcacatgtcttgtattatttttaataatagtgttatttttaattaaacatgatttttgaggtgaaactgaataaaatcacttaatactgttttttttttcttttctttcatttgtttgtttattgagacaagagtttctctgtgtagttctggccatcctggaactcactctgtagaccagattggtcttgaacttgagatctgcctgcctctgcctcccagatactaggaataaaggcgtgcgccaccactgcccagctgatcagctgatagtttctttgaatatcttacttcaacaaaaacaatattactgggctggaaagactgcttagcggttaagagcactgactgctctttcagaggtcctgagttcaattcccagcaaccacatggtggttcataaccatctgtaatgggatctga

SEQ ID NO: 34553 - DNA, 1121 bp, Mus musculus
gctagtacaagtacatcactcaaatgccaaatcagaataactagaaatgttcattcagtagggataaaaagatacaccatgtactagtcccacacctaaaattctatgagttgagagtctgaggtgagaagtttcaagtacaatctgagaaatggaaactttgtctcaagatcaaattcttggctgggtagctggcacagtaaatataagttcaaaaccctagcagccaggcacgtatgatggctaaatctggaagctctgattttagtgagaagccttcagtgaatagtatttggagtgctcagggaaggtaatctattatcagtgtgtgtgtatgtacatgtacccaaaagaacattaatcctttttgagcaattttcccattgggggaattttagctgagatggaactctcatgcataaactcaatagctgaaagtctacccagtaaagggcttaggattttgcactgcatggtatctgcactcagcagttctttcctgttgggtgttcaaaagacagtgctatagaaactcactatctggcatcgttggtttcttggctttgtgcatgttaaacctggtatttctaatgatacagtttttcatatgtacataaatttttgtatgtaggtgtgtcggggagggcagaacaacttgcaagtttgatctcaatgtgggggtcttaaactacctggtcttaaagctttctcttcttcctagggtgacacgagtgaaccctaccctaaaatggtaaggcattatttttctttttcttgctgtctttacttactagatgcatcatatatgagcctcattgtacataagaatgggcattgttggtcattgtccagaactggtcgatgtggctaaattgagatacaggtcatgcttccatcacagcagatacattacagtggtgacaatgagacctgtaacatttgtctgttacactcaagtatgttaattcattttataataatttcttatgatcaattttgtaggtttaaagataacatgaagggtccttaaaataaattgaagaaatcctcaaatcttctggtaagatgttaactctgaaaccacatgtgagatgaggtaattctgaaattcactgccaggt

SEQ ID NO: 34554 - DNA, 2020 bp, Mus musculus
gtggaaatgctgtattaggggctgtatttggtatttggtattgaaacaagccagtttccaaagcccccaaccattattggtattactatgaagagaattataccaaatgtgtgggtggttacaatgacattatacatttggtcatcacccattagtgggcctcactgtcctaatccagcgtggattaggatgcttagtgctggtcccactattcctgctcggtattgaataggacatagagagttccaatatctttagagttggttgagtaagcattagactgtaaatctaaacacagaaattaagccctctttttatcaagccttaagatgataatcatgatgaattgcaaatttgaagttgtagagaaattactaaggcttctcccaccccctttctgataggtaggagtagatggaagccagaagtagggtatttagctgttaattacattttcgtaggtttgattcctgccaatctagttaaggtcttagcttaattaaagtgattgatttacattcagtagatgtaggatatagtcttatcagaagttaaacttgttcgttttcttggacttcgatatcctaaacttctacatgattagttgggatgaaagggggagggcaactgtacttataatttttagggagggaaaataaagttgtgtttgaagtttatgtggtgggtaattattttggggttattgttggttggaaagatggtaagtaaaatttaataaatgagacatatataaaagaatagatgtaacactgctattgaggctattagcgttcctaggatgaggcagttattttgtagaagttctgtgatgatacttcattttgggagaaagcctagaagagggggatgcctctcctagggatagcagaattaaagaggttgttaatagaattattggtattttgtttcataggaatgaaattgagttaattgttgtggatgaaggctataagtggaataaatattggaactgtaaggataatataaataattaagttaagttagggtggggttgtaaatgaggatggccattattcatcctgtgtgggtaattggtgaatatgctataatttttcacatttgtgtatgcttaagtccacctcatgttcctatgagaattgcttggttagtttctgctaaggtggaaataagtcttattatagctatggctcaggctggtgtaataagtcatatgtgttcttgggtggcgatgagtataggaaaaatgagccgcttattaggaggattgaaagtagaataatggctattgttatttcttacgagattgtttggactataattcgaagggctccaggtagggagtattttgagtttgatgctcatccagatcatgagatgaaatatactgaaaggcttgatgttgctagaataaataaaattcctagatttaaattgattaggggtgtactgtgggtaattgaattcatagacttagggctaatgtcaatgacagggttggggcaataataaataatgatactgaggtcgttagggggagtatcagttcttttatgaaaagtttattttaaagatttattttttattttatgtatatgagtacactgtagctgtacagatagttgtgagccatcatgtggttgctgggaattgaactcaggacctctgctctgctctctctgggccaaagatttatttattgttatatgtaagtacattgtagctgtcttcagatactccagaagagggcatccgatctcattatggatggttgtgagccaccatgttgtttctgggatttgaaatcaggaccttcagaagagcagtcagtgctcttaactgctgagtcatctctccagcccttatgaaaagttttatagcatctgcagatggttggagaattccaaaatggcccaacaatgttgggaacttttcgtaattgtatatactctatgattttacattctaaaagtagaatgtaaaaatagcaattagaatggggactagaaatgttaataca

SEQ ID NO: 34555 - DNA, 1282 bp, Mus musculus
ctacattttctgtctttctttcttccttcttttcttaatgagtattcccctggtgagtagtatagatgacaataaatgttgctattttttttcccttgacctgaggtaaggcaattttaagaaggaaaataaaaaactaaggtatacaaatgcagagaatgacaccatctggtactaaaatttactttgtcttaattgcccctaatcctactttgatccctcaaattcacattttagttaaagtcaagaaatctgatgttgaggatcatgcagtattgagtcatgctgtctcaaaagaagaagcgtgtacaaacctgggtccacttggaaagccagacgatgaggttagtcgtactatttggtgtaatttatttagcagtttggttttatatttgtttagttcattaaaaacttaaaagactgttctctgagatctactgaaatagatcagtgatgaaaatagccaaatctgagcatcagaaggccttttggtctggggcatgatctctctagttctgagaagcaaaactacaaagcggtttgtctgtggtgagagaaggaagagtggtgtatggatggatggatgagggtgtgtacatatctgtgtgtgtgtgtgtgtgtgtgtgtgtgtgtgtgtgtgtggtcatctctgagcaatgatgaaaaggttttagtactgaattttgtcactgtgaaggctcctacacttgacctgagctcagaattgacaactggcaaatgtggatgatttgtggtttttctagatgtgtcatgatcatgatctaatatttcccttttacattttaggctgaaacacaagagatttctcaggagccattgtcttcagtaactgtttctactggaagcttcttaagttatgaaatcacagatttgagcctcacagatccaggtactatcagactttgtgaacatgtttaaggaactgcactggctggactgcagtgtggtagtggaagaagcactgcttcttagtgtgtccaagggattaggtttggggtagaaacgtgtcgcgtacaaagaaaaaagcatcagtgtcgaatagaatatagtactgtgcaaagtcaagtgtgcattctggcacattttccctcttggttccaccaatgtcagcaatatatattgctatgacatattatgtttgtgatgaagtacccagacattattaaattactgtattataaatgttaattaaatgttttcattacattcaatttcagagtcattttcagaacagacagagcatctagaacaagaatctacc

SEQ ID NO: 34556 - DNA, 1282 bp, Mus musculus; identical to SEQ ID NO: 34555

SEQ ID NO: 34557 - DNA, 1214 bp, Mus musculus
cttcacacagctggccagactgagagtgagcagggactttccccatcttctgcacacgtccacatgttacctgtttccagatgtggacagtattggctgtgtcttttattgcccaaggctctaatgctcagggtcaatttatgccttgaggttactgaaatcctgagaggaacaggagaagattgtctgtggtgttggaattccagctcaggcctgcctgcctatcaagctcatgcgtctacgctcctaacagcagtccccaggctgacgtagctcttcattctccccagtcacatgtgttcgttgtgtttgcaccacactgtgtgtgtgcatgtgcacacacgctgacaagttcatgcaaggcccctaatttgtttgctgattttttttttctttccactggatatcagaggcctgcagggtgaatgtggaaaaggtggtactcaaggcctgcgttacaccatgtagctggtgtctacatagggaaatgacagccctgctgaaggccatgcttagtgtttgagcacgtggtctggggcctatgaggtcccagtgctccatgcacagatgcaggagtcctcgggagtaggcagagagtcagtcacagagactgtgacttgagtctggacgatgtgtgtgacagttagtgctacaaaaggagtaaggtgatgcatgcctttaagcccagcactctggaggtagaggcaggcaagatttctgagttcaaggtcagcctggtcctggtctacagagtgagttccatgacggccagggttacaaagagaaacctaccccctcccccacccccaaaagccctaaacctgaatggaataatagtggcctgcggcatgagagagacttgagagtgatgtgcagtaggtgccaaaggtattgccctaaataatagcagattcaaggcctcaccttgggtctggcttcttagaacacaaattgaaacgagccatgactaacctgtagagagcagattggcttttattacacgctgcatttgacagataaagaccccaggggcaaggtgcctgttcaaggtcacagtgtaatggagaggagagccgagctggatcctgccccctggcccgctgcagtcattactctggcagccctcctggaggaaggagctggctacctgggggaagttggtgttgtgaattggatgaatgagttcccagtccagatcctgacctgtctgtctc

SEQ ID NO: 34558 - DNA, 1146 bp, Mus musculus
agaagataaaggatttcaacatggtataaattaaataggcacatggtttaaaaacctctttgaagcaccccacaatagcaaagtacacctcctgtgtatgtgcacagagatgcgttgattgtgttttattccatgggtgatgctgctgacaagccctgaaggtacagtagactccagctgaccaccgtgcaagcattagatagttcccagagccagaagcgctctattgttctgctctacagagcatagaggagcactgggaagcactgacaaggttctgacttcctctttcagccgtaggtgaaagggccagtgaggacctggaacattgctgccctagctgtgtcttgttagggtttctgttgctgtgagaaaacaccacaaccaaaagtaattatggaggagagggcttctgtttacacttccacatcacaatccatcatcaagggaagtcaggacaggaactcaaggcaggaacctggaggcaggagctgatgcagaggccaaggaggagtgctgcttactggcttgcttctttctcatggcttgctcagcctgctttcttacagcacacagggcaaccagcccaggggtggtgccgcccacagtgggcatagccctctcagagcaatcatcaatctggaggatgccccacagcctctcctctcttccaaaatgactccagattgtgttaagttgacataaatctagccagcatggttaccattgtaggaaatggagttccagaagtgttggtgacttaagcttgagtcaagagaacctgatacttgacccaattcagagatggaagaaaaatgatttttcatgtcatagtcagtaatgataaaacacattcagcttaattttagtgtaaagcttaattatagtttcatcctttgggagtgtgtgtcttatgtctgaatagtatatgtgacatgataaaaagccagaaaagaaatccaagaaacctgcctggtggctccatagatcccaaacagggaaagaagctcacagtcttttatacagcaggagactggcttgctgtagggtgtgctgtagggcagaggtcacaggaggtgaggccccttaaacagtaggagactgcgggctggctgtgtagtgttctagtcacacgcttccttgtct

SEQ ID NO: 34559 - DNA, 1127 bp, Mus musculus
tccccgcccaggaagcagcatgtggctctttgtcagctgtgttcacggtgtgttctactcggcatgctcagtttatttttgtgttttcacctgttccttgtggaattcaagtgcagtgggtttttaactggtgggtcactgcagggctttttaagttccacacacagagtgtgagcatcttatcagcccggatttcttatggaggaaggctgctgaatcaacagctcatatgaaagtccccaggttatcaacacaagaggagtcacaatacagaaaggaagatatgctgggagaagaggagatagttttaatttgtagtgtgagccactgtttatatgcaaagtataaaagaaacacacacttgtttaagggtgtctgaggacgtatttaccatttgatcatttttctctgatatttggctttacagaattctatcttctaaagatttttggagaagatatgttgactctagcagctcttccttttgtttggggacttggagggaggggaagcaggcacacatggcgaactcgtgtttgctggatcacatggtgactgcagtgaccccagcagttacttcctgtcatggtgggaactgtccctggaagctagtcagttgcataggtgctattttctctgtgaagcattgagaagaaagctgttgcttactcccaatggctctctgttccctgatgctccgaggaatgcattggtgtctgagtccactcaaaacactgttcccacaggactttttaacacaggctctttccctccatgtgtccccctttctccacagttgaagaagtcggagctgggaagttttcaggttagatgtgccagttaatgtaaagaaagctatgtttgtggtgctccagtactttcctgttctgttctttctgacctgtcaccaaagctggctctgagtcttgttagatggtgtacttaaagtgttcataagccatttatggccgtgcgcttgtgaatttcctatcagggtttgatcttatttggtatatgtgcatttgtggtcctagagaatgccagcttaagtgcacatcgatacccttgctaactaggttttacatagctcaccatttcactgtggtgcccacagatgcagcacatct

SEQ ID NO: 34560 - DNA, 1153 bp, Mus musculus
tttcccatattatgagcactaaatgaccatacacatctctgtgagttatggccaggctcacaaacagtggaacaggcactgcatcacaaatgctagtagtcatgcaaactaaagtaagacgcttagcaagaagagtttcttcatgatgaaatacctttggttcccttctgattgttacagcactgttgtctggattttatgaaacattccttccctatttaaggggcaatgaccccccaaatttccttgaataatcagacaaaaatgataaggcaaaaggttatgaaaactgaagtcagatgcctgaactgaaggccagagctgatggaaaagtcgttttctacggcagtgagttatttccatgttgtggattaggtggttcatttagtgacaatttttaaatgaagtgtaaagagtgaatagtgtgcatatttcacattctgtgttcacaccaatgaactaagtcttcaaaagtcagaggcttacttacggatcctagcaggaagcatggatatagttccatgagaacatgttccttagctctctggaccctattggaagataagcaacctataaccataataaagaaaggaacatcgaaaggactgcccagaaatgcaaaggaagccatattggagtatcacagatgtagctgatactgtgaggaaataagatgggaaactgaggcaaaattctaagagttgaagcaagacactgaaggtttcaggaaagagaacatcaagcagagcatcaaagaaggaggcagaatctctaaacagacagttgagggtcttgaatgtcctcctgaacggccatttggaactttttgaataagagggctgaatgactcagtgtggcctgtgttgttttgttcactaaggttgatccttgtggtgctaaatcctacattagttacgtttttaggctctgtgaaaaagaaaggcaaagcaaggaaggagggctttagcctggctctcagctctagggtccagtggatcacaatgacagtcccgtggcaggagcttgacatagctttcacagtcagaatacagagaaatgaatgccagaactcagcccactctttccatttacagagtccaaagattccagcatggggaatggagcctctcatatttaggatgggtttttgctc

SEQ ID NO: 34561 - DNA, 1237 bp, Mus musculus
acaaggttccacagaaaaaagtaaaacttgatgaagatgatgaggacaatgaggatgatgatgatgattttgatgaagaggaaactgaagaaaaggtcccagtgaagaaatctgtacgagataccccagccaaaaatgcacaaaaatcaaaccaaaatggaaaagacttaaaaccgtcaacaccaagatcaaagggtcaagagtccttcaaaaaacagggaaagattcctaaaataccaaaaggacctagttctgtagaagacattaaggcaaaaatgcaagcaagtatagaaaaaggcggttctcttcccaaagtggaagccaagttcatcaattatgtgaagaattgtttccggatgactgaccaggaggctattcaagatctctggcagtggaggaagtctctttaagaaaaggatttaaacagtttgaaatattctgtcttcatttctgtaatagttgataactggctgtcctttttataatgcaaagtgagaactttccctactgtgtttgataaatgttgtccaggttcaattgccaagaatgtgttgtctaaaatgcctgtttagttttcaaggatggaactccaccctttacttggttttaagtacgtatggaatgttatgataggacatagtaatagtggtggtcagatgtggaaatggtagggagacaaatatacatgtgaaataaactcagtattttaataaagtaaaaaaaaaaaaacttggaaaaggacatctgaaactcaaatgaaggggaaaatatgaagcaaccaagacaatgattacattcttaacgaaaaccatgctgccattaattaaatgtattttacctagatgattatggatgagttcagaagtgatcagtattaggagtgaataatgaggtatctgtctaaaaaaaagtactaataactttgtagggaatatttatataaaataaagaatttccttaagacttggataaaatattctaaaatctaaattgcatgtgcagatgggttcatctaaatattttataaaaattctatttttatacaaactactatagcaaatagaaaacaggaaatgcaccctaactgattttataaatccagccttgttctaatattgacacatatttgaagaaatgagtatattaaaagacacagcatctcccatgaatgcccatggaaatgacactttacatggtaataaactgaaatgaaaactgtgtgtcactgaatttaaac

SEQ ID NO: 34562 - DNA, 1137 bp, Mus musculus
agttgaaacaatctctgaggctgggccagatagggctagccattttgaagttgcccacagtgcagattttgagagaacatctggccctggaaagatgttgggactgatattagtgttatgggcaatttttttggttaggtgtgcatgaaacacttatatccatggttctggtagctggaagaggagattcccatgaccagggaaatgaggattatctcaagccacactcaggaataggtggaaaatcttaggcctttgattaatggaagtactaatcgggcctcaacttgacctatgtgaggtgggttcaagttgtttccataaagcttactagcattttttaaaaaagacgtcttagacatggtagcattaccactgtttgtaaactttacagaagttcatattgaagaaaagacagtagactcacacctttatctcatagtagaagcttgggaaatgattttgagtaaaaagcatcagaactccttaaggtgacctcagggataatagcaacccacccatggagtgaaagggcaaaagctcacttgaccttgattatcggtacaaatacagtccatgaagtcagggcttctttactctatccagaagactgaatatatagagattgtattgacagctttagcacaatgagaagaaattttaattctgtctttagaaaacaaccaaagcaaatttaaaatcttgagcttgtggctatgataatagaaatcagtgctcacaagagctagattaatagcttatcagaacttaattggttaaactctgaacttttgaagccttaatatagcaatagcaagagaaagaaacttgaagcactttaaaatttttataacataagccactttcttgtacctttacaaattacatttacatcatgcttttgtatcataactgaagatttcatgtcctaagaccatacacatttttgcacttttttctatccaatcattgactgcaagacacaagtagttgattagtgagagcaggaacagtaaagactgttcttttaaataaagaaatagtaaaaattatattggaatctgttttgtacatctatttcttttctgagtttggtaacaaggtaaactgcatcaagatctagtagtagctctagga

SEQ ID NO: 34563 - DNA, 1605 bp, Mus musculus
acatcccaggctgactgtgctttcctgattgatgttgctggttttggtgaatttgaagctagtatctccaagaacgggcagacccgtgagcatgctcttctggcttacaccctgggtgtgaagcagctaattgttgctgttaacaacatggattccaccgatctaccatacattcagaagagatatgaggaattcgttaaggaagtcagcacctacattaagaaaattggctacaaccctgacacagtagcatttgtgccaatttctggttggaatggtgacaacatgctgaagccaagtgctaatatgccttggttcaagggatggaaagtcacccacaaagatggcagtgccagtggtaccacgctgctggaagctttggattgtatcctaacaccaacttgtccaactcataagcctctgcgagtgcccctccagaatgtctataaaattggaggcattgagactgtccccgtgggccaagtggagactggtgttctcaaacctggcatggtggttacctttgctccagtcaatgtaacaactgaagtcaagtctgttgaaatgcaccatgaagctttgagtgaagctcttcctggggacaatgtggtcttcaacgtaaagaatgcgtcggtcaaagatgttagacaaggcaatgttgctggtgacagaaaaagtgatccaccaatggaagcagctggcttcactgctcaggtgattatcctgaaccaggcaggccaaattagtgctggcaatgctcctgttctgcattgtcacacagcccacatagcatgcaagtttgctgagcttaaagaaaagatcaatcgttattaagaagctggaagatggccccaaattcctgaagtccggtgatgctgccattgttgatatggtccctggcaagcccatgtgtgttgagaggttctctgactatcctccacttggtcattttgctgttcgtgacatgaggcagacagttgctgtgggtgtcaccaaagctgtggacaagaaggctgctggagctgacaaagtcaccaagtatgcccagaaagctcagaaggctaaatgaatattattcctaacacctgccaccccagtcttaatcagtggtggaagaatggtctcagaactgtttgtttcaattggacatttaaatttaataggaaaagactggttaatggtaacaatgcatcgtaaaaacttcagaaagaaagaatgttttgtggtccttgtgtgtgtgtgtggcagttttaagatattagttttaaaaatcagtactttttaatggaaacaacttgaccaaaaatctgtcacagaattttgagagcattaaaacaagtttaatgagaaaaaaaaaagtgctttgaaattaagcatgtggagtacccgtggttcagtctgggtgtctctcacttagttttagggctttctcagtacatgaagcagtcacctgaaaggcgacgaggctttgcgtaggaagagtcttctgcacaatggaaaccatacttctttttatataagttttgcaatccataactatttcagatgtctttattatctgtagaatcataaatgaaatatttttacaaatattcatattgtgat

SEQ ID NO: 34564 - DNA, 1230 bp, Mus musculus
cacgagcaatgaatgaatgaaattacaggatatgctacccccaaaagaaaatcatttggggatggagtgatggctcagcaggttaacctcttttttttttaattaggtattttctttatttacatttcaaatgttatcccctttcctggtttcacctccaaacaccccctatcgcctcccccctcaaacagcttcccaacccacccactcctgctttctggcccaggcattcccctatattggggcatagaaccttcacaggaccaagggcctctcctcccattgatgacggactagcccatcctatgctacatatgcagctagagacagaattcccaccaggtgttttctttggttggtggtttagtcccagggagctctggagtactggttagttcatattgttgttcctcctatggggctacaaacctcttcagctccttgagtacatactctagctctttcattggggaccctgtgctcagttcaacggatggctgtgagcatccacttctgtatttataaggcactggcagggcctctcaggagacagctttatctgcaagctggatccttaacttcgtaactttgatataaggattggctctaagggctgggtcagtcgggctggagcggaagagggaatttcgccaggccctcccacacaggggaagacaccccccaccctcccaccccccccacccctcctggcatacacagcaatgaacaatcagagaccttgtctcaaataagatgagatatgaggatagacactagagattatcttgtgacttacacacacatgcacacacgtacacacacacacaaagagagaattttaaatgatatttaaattttatcatttcagcaaactatgttgttacacttgctaattcatatttttaaaccagcaagttttaaatacttcattacatattaaagttaaaagatatactaacttctttttaatgtaatttattttttaacttctctattcttatcatctactcctattgatcctattaatttttagatatctgcagcaacactattttagaaaagaggaagatacagatttcagaatagaatgataaaactttaaatacttatcctacaattaatcttgaattttgtaaaattgtctcatctatgcttaggttcttcacttaaaaataactattgttcttattttctgggtcaacacagttctaatcaaacctatgttctgaa

SEQ ID NO: 34565 - DNA, 1158 bp, Mus musculus
catagagtaggtggctgaatgactcgatgcagagtgtggctcatcaccgtgagagcctttgctgtctgtcctgtataccttttcatgctttctcctctatgacactttacctttacttgactcgttcattctgttcctacctccatctcatggtaagaattataatacggttttgtttgctttttgttttattttgaatgcttagctatgcgaatggcatagagctcatatgtgtacaattaatggtataagttgaagagttgggcattcaagaaccttggtaattggtggacttaaagtcatagcctatgtcccaagaagccaagttcatctttgataatttagttaaaacagataaattaatagtgaaaaacataaaaagcttttatttatgtgatcacactagggagagggacaaagatccaacagcatccacccaaagtccattttggctgagtgagattaacgcttaaatagagggctagaaataatgtataataaagcagttgcagtcagggtatggccccacctaccatgaactcattatgatttggccttccatttgatttggtactggattttggccttctattcctctggtctgagattccttgagggtgggggatactcaaaacttatgagctttcaaaatgaacatgacagtattgaaaaagacagcttaactgctatttgacatttttcttccaaaaatttctatcatcagcgtttattttttgcttgttactgatgtcaatgtaaaaggaataataaaacttgttatctttcttaatttctttgttttatggaatgtagccatggtctgacccattttgggactctgaggttattactaaagtgtactgcagttgataattcatttttttccttcctatttttttttaataatgttactctaaatatttcaatgtgtaactttagtgactagaaatggaattgtatgtatgttcagttttagctgaatggaggcaaatgcttgtagtatccaccgggttgtctacacactagaatctttttttcttccttgctttttactttcttcactggtgttaaggttgagaccttttctttctttttttaggatttatttatttatacaccagaaaagggcatcagatcctattgcagttagttgtgagc

SEQ ID NO: 34566 - DNA, 1675 bp, Mus musculus
gtcttgaactacctacaaccaaaaagcaggagaaacaaaaagatatagctgattgattagaagagaaatggaattcttaatgtgtgtggtgaaatagttgcttgctgctgtaatctttttgttgtttttagtctgtcgttttggggtcatcatgaggttcttcaaagccaaagtctgttaaatgtttgtgcctctatcttcctttcgagttgcataatataattattcaagtctcctcactagaactatagttgttgcccttacacttgaagggagggaaagaaaccataagtataattgcagtattttttagtataaattattataagcaggaagtgaaagaagttttgttttgttttgtttaatcctgataactcctttttcccttaaatgggaaagcaaagtggtatataaaaaactgagttggcctctccatgaacttttgttattataattcttgaaaatctttaaggaaaagactttttgtttcttcctatgcagtagttactttttgtagtactaattctgaagtggagtcaaaccgtctgtgtgtgctggctgagtttataattcatttgcagttaaattaattttagaaagttgcttcaatacttgcattacctggcaagcagtataatttaagtctataggaaataaactaagattatagaattacaatttggttaaaattcatcataagagtaagcaataatgttaaaatctctttcctgattatttaaagaactctttatggtgttttgacaaaattatatctgatttatagtctaaacactcttatgggtgatatctgtctccctgatgaaaaactgtatctgttaaattgtgaatgtgtagcttcgttgaaatacattaaggtgtgtgttgcggcttgaatctgaaatgtacctggaggcttgttttgagctgttggtctttcaacttagggctctattttgaaggctgtgaaacctttagcatattgaggggtgagcctttaaggattatacagtcttgctggtctgatccagtcaggacatatgaaccacctctgtcccatactcccactgctgcctcctcagccattatagattgtatcctctgaaaccgtgagccaaaataaaccttacctcccttgagttgtttctgtcatgtgttttggtcaagacaagaaaagtaatatacaacgggaaaattacagtctgtctgtattttagaatacctgaatgttatgttttaagttaatttagtagtttaattcttgggagccattttaagggtttcatgaagagttttacatataatggttatgtgttatacttcattttcattagttgtagatgacacagataaacttagatcaaaatgaaagttgaaggtctttatttctcaaactctttggtgttaatagaatcctaacaaagtttcattagtctattgttttagttagtaaagaatctatgggggctggagaggcagctcctttaagggcactagttaatgggttcaattccctgcattcacgttcatttcacacacaggaccttcttctggcctccatgggcatcagtcaattattctgtgctctttgatacagcaagcaacctatttgcatgaattatcattctgctattagtagataactattaaagatattatgaacctcaggcaacaagta

SEQ ID NO: 34567 - DNA, 1099 bp, Mus musculus
ggctttccagcacccactttgggcacttaacaactacctatgacttcaactccaaaggatgtaatgctttctttcagcattttttttgtgagcacccataaagagaataatttaaaaaacaaaaattactctgaaaattgggtcttgtatacacctaagggaaactttaaaagctcattaagagatctagaattcactgacaggtacttaggggtgtgtgtgtgtgtgtgtgtacacatacatacacacacacacacacatcatttttatttctctttgtctttgtttttaacagctccacttttgaagtttgaaaagtaaggattggtttgtgctactgttttgttcaggttattttattttactttaatctatgttcgttcattcagtattgttttatgggcttattctgacgtttgagctttcaatgtcagcctgggttttgtttttattttttttttagaaaggttttattggtctctttgatttctttcatatcagtagaaggtcatgtagaaggtcatgtttttacctgactgcttatcttctgttcttaccactgtaattctcctcatcttgcatgggccttttaattaatgatagtttctcatattattgggtatatagcattctctctaaaatacctatcttgccgagattttacatttatgtatgtatctaatatacatatatgtatgtatatatatatatatgtatatatttttgatttttagtttttatggggatttttagatgtgaagaaattctttaagaagaaacttccaaagacttttattttcattagtgatctttaaatacttcatgtcatttaaagattttgtattaaaatagcaagatttgttactcatttttcgctaagcaaatatactattcaagtgaataaattaaaaaactatcttttcaaaacttttcctaattacagactaatgattaaacatgaaaaagggaaaacttcccaaaggttgagaacactgtcttttttgcaacaaagacattgtataagtatattcctgttttatgttatttgttataatctttttgctgcctgcaaattatatttgctatttttgttttggtc

SEQ ID NO: 34568 - DNA, 2114 bp, Mus musculus
taataagtaaataaattatgcacatgtgactcttaataactttgcaagccttctagttacaactgctccttaagaaaattgattaaaagtgcaattagtcactgcccctttacagccaagtatttaaaatattttgtcaacaagttattaattcaaaaaattagatattgtgaaattttaaaaccttaacttcttaaaagacaaaaaagagaaattgtatccctgtacatactatttagtgcattcccatgcacactattaaagtcttacctttattttcaaaatctaatattttaatgtcaaagagtttaataaatgctttatagtatcttaaagggatctacttattggcttatagattgatcctaaaacagctaccttattagaaaagggaaaaacaggttttctccacagaacgctgcagaagcatattagtaaattcgtgtgacgagctagtaggtaagttgactcatgtcctgattaaattgactaaaaaactaaattaaattcatgttttagatccattcttacctgtcattttttcagtttagactagcttctagccttttaactttatggcaatagtacatcagagactgtatattcaggcttagtaaaattagtcatttaatagagtcataatgatttttctcttttcttcagtgtgaccagctattctaactcaatcttagactagtctaatattcagtccaatgttagagattcctatattctaaattacctagcaaagttaattcagagcacatcccccacttcccctagatccctaacctcagaaggattgctggccttacagctagtagaaaaagctattaaagagcaattggtcacttaatacattggtaaaatagaaagaccccctggctaacaaatggaagggtccagatccagttctaatttggggtaggggctcagtttgtgttttttcacgagatgaagatagagcgcggtgactgccagatgtcagatgaacacagattctaaatcttctaaagtatcaccttgaggactaaaattcctcttttgcttaaaagtcagcttgaggactcaggctctgaaaaaagctactctctgagccagctcccgacaggaggccggagactagcctcagctttacaatttgcatttgaataaagtacctagacttcctcgaaagaagttctgctttcctactttctcactgtcgagattttgtctttcaagcaggtaaatcaacattctggaggcggaccagcggatgtgcatccccgcccccctagagcacacaggtggctgctgttatctcctttccaaggacatttccagcaggtggctttcagtctgagttaaaaattaggtttaccaagagggctagaatagtagatatttctatattaataaagattggtttttattttgatagacaggcttagtcccttagctgacctctgccttttcacccttgctgttactgcaaggtgtccttaggctgtggaaaaaacggggatgaggaggaacgacttccagctcctattttagccacaagtcgtggtgttactaatgacataattcttgcctaggtcttgctaaatctgaggttgataattctcctttaggagctgcacagcactcagaactgtgcatactggtttgtcattgtacaaattcagtatgggcatcgcttggtgcagaggcactgcaggggaaggtccagcttgaccatttctgagtttcctgtgagataaacccggtttgaaagaggttggtaccaaattttggctaaaaatgaaaaatatttttcggctctgcctcacctccccaaaaggtaccgagagccacaggtgtgggtcttatcagtacccacgagaggaatcgggtccatgtccacccaagccaaggttaaaagcccactcatctacagatgagaaaatcatttgatcacctcagttaagcgttgccttatttaacttaattaataggggggagagagattggagacgtactattgaaagggcaagcccttcactgcctcccacccaaataaaaaagccaattagccttgtactacaagagccagtcgaactccttctccctgtttcccacctatcatccaa

SEQ ID NO: 34569 - DNA, 1224 bp, Mus musculus
atatttctatattaataaagattggtttttattttgatagacaggcttagtcccttagctggtctctggcttttcacccttgctgttactgcaaggtgtccttagctcaataggctgtggaaaaaacagggatgaggaggaacgacttccagctcctattttagccacaaatcgtggtgttactaacgacataattcttgcttaggctttgctaattctgaggttgataattctcctttaggagctgcacagcactcagaactgtgcatactggtttgtgattgtacaaattcagtatgggcatcgcttggtgcagaggtactgcaagagaaggtccggcttgaccatttctgagtttcctgtgagataaacccggtttaaaagaggttggtatcagattttggttaaaaataaaaaatattttccggctctacctcgcctccccaaaagatacccagagccacatgtgtgggttttacagtacccacgggaggaatcgggtccatgtccacccaagccaaggttaaaagcccactcatctacggatgagaaaatcatttgatcacctcagttaagcgttgccttatttaacttaattaataggggggagggagattggagacgtactattgaaagggcaagcccttcactgcctcccacccaaataaaagagccggtcgaacgccttctccctgtttcccacctatcatccaaaaatgcggaggaatatcaacttagtgttattttcccatttgttcagtcaaacttagccagagttccaatgccctacttaaaattcaactagaaagttacctaccaagtactaattagcattataaagtcagagtctgcagctccaggcctttcagttagttgtttactagaaaggacagtcttaagccagatatagtttaccataagaaaagttaaagaatcccagtgaagcaagttttttctttagccctagattccaggcagaactattgagcatagataatttttcccccctcaggccagctttttctttttttaaattttgttaataaaagggaggagatgtagtcttccctcccccagcttgaaacctgcttgctcggggtggagcttcctactcattcgttctgccacgcccactgctggaacctgaggagccacacacgtgcacctttctactggacccgagattattcggcgggaatcgggtcccctcccccttccttcata

SEQ ID NO: 34570 - DNA, 2013 bp, Mus musculus
tttgtagaaagtgtgagaagacctgagttgttatgcagcaattgggatctctgtgaaaacctagggactgggaagagtttgtattgagtagcaagaaactgtcaacatgtatcatgctcccaaacacacaagaactgaggcagagagtcttcaccctgagcattagtgctaaagtcagcactactacgtgagcacaccagagtgaatcttgcattaaaaaatggagagcaaactggccagctctttattgttgttggctcacaagccaagatgcttctctctctttttttttttttttttttggattttttcgagacagggtttctctgtgtagtcctggctgtcctggaactcactttgtagaccaggctggccccgcctgcctctgcctcccaagtgctgggattaaaggtgtgcaccaccactgcctggtgctttcttctttttaaaaagaaaaatctggcaggggctgtacatggcactcaaattctgatatacatgctgtttataaaaatcttcatttaaggtttggtcagtagcattggctttcaacctggagcagttttgctgtccagggcacttgtcagtgtctgggtaggttttagttttgagaatggagggagatgtgttagtgatacagaaagaggacatcacagatgctatcaaatagcctatgatacacagaagtcttccatatcaaggaattatgtgtactactataaaagtactgacgttgagaataatctcatgattctcacatgaggagaaattttttgcagctttttaaaagaaaaactgcaatgcagttctctctgaaatgtatgaaaacgcatactgatgataactatgaaaatgattttagccacagtcccatggtgtatgaatgtgaggttgtatttacaagtcttttttgataacaactgagtctagctctttagttttcttgacctttttattagggttagggttctctgaataactcttagtcctcatcataaacaattgaatgtagtattttttttactatagctttgtaaattatatctttatttcactttagtaaccttatcctgaccagagacatgtttagaaatgtgtgatgttctgtactagattgtgtgggtatttttgagtacctgtgtcctattcattgtggtcagagcatgaagcttcctaacagatcctttagttgggtttggctttctatccaaaaagccaaaagaataacaaggacctaggatttcccatatccatttaaactccttttatagcggaagactcacagttttatctgagtatcaaatagttccactataagaaatctttttcagtttttcatgcaacttgtattctctacatgccatgactctggccgttgactcataaatagagataagtgtgtggcattctgagaaaaacctcttggaaaaaaatctgatttttgtttttttaattcattttgtggccctgaagatgaaaactgcagtctaaagatgacagaatagagacatcacagtgatactagtctgtattgtggcttttgaaagagtttaccttggaactcaatttattaaatagactttctcttccctgagaaaacaataaaattgattacaagattacaatgggactgatatttgtttccctgtttgctttgttgtttggaagtgagtttcctctcctgttggatgctgtccaaaacagatagacctctttctctgaaaagctaatcactgatacctttatgtacagatttaattggtatcctattagatacagatttttaagtactttaaatcaagtattcatgtgacatttcaagttgatgtgttatgcttttgacagctgtgtatagatagactccaggttactgcaggagtacatctcaataaagtacatccctttaaacctatcatcagtcagaaacaaagtagcaatctcaatgcatcctaagacttctggtatgtttgtgcatggggatggaggccagaagatatctgatgtcatgtgtac

SEQ ID NO: 34571 - DNA, 1103 bp, Mus musculus
cttggtagtagctattattgcagtctaccttaaaccattttgtttacattatgaacgtctaagtaagagtacatagttttactgagacacctttggcatataagaaattacatataagttttaacatctctgtgcccatagaaccatcaccaccattaagattaaaaaacaaaaaggtttgtgatttgcctattattgtacctccttgttcctagaccaaccatttgcttgagtataagcagatcaggcttctctgctggattgtgtttgggaaaacctcaatgtttttcagtgaagaaggggaggccagcctcagaaactcattttcttgttcatcctatatatagattcatatgattctctggtggaacccacaggccaaacgagcagatctgcagaaacacttaattggagtccagaatttggagactgttatgtaggttatcttgggaattggaaggaaacttggcaagtgatgctaagcaggtagaattgtctaggaggccagaacctgcatatttcacaagacttaatgctttaataccttggcaaagcaattgaaaccctcctattaaccagttcatgccttaagggtctcaaaattgatatttagtgaatgttactggtttatctttatttctggagcagaataattttataagccccaaagattggcttaatgcatattctgaaacagaaaactcattcaacatctttgaaacttctttgtctcacaatatcctgactaggcgcatatgtatgtgtgtgtgtgtgtgtgtgtgtgtgtgtgtgtgtgtgtatatatatatatatatatgtatatatatatatatatataaacaaaagccagcacagaagcataatctgcttatactcaatcaaatggtaggtttgctagagaacaatggaacaatggggaggaataataggcaaatcacagaacttatggagatcatcttaatagaagtcatggttttatgggtatagagatgttaaaaacttatgtggaatttcttatatgccaaaggtatctcagtaaaattattcactcttacttggacatgcataatgtaaacaaactggtttatggtagactgcgatga

SEQ ID NO: 34572 - DNA, 1204 bp, Mus musculus
cagcctgcttctgtctcctgagtggtgggattaaaggtggtcacaccaactatgctacttgagtactgatactgttaacatggtttgcagacaacacgtgtgcctgcatgagtttatgtgtactccataaatgcaggtctctgaagaggcttagagggaagcataagacgctctggagctgatattacaggtagttgtgaacctgctgtgaatactggaacggaacccaggtcctctacaagagtagtaagggatattaactattgcatcatctctccagtctccattggctaatactttttttcccctgagaattcactttgtagaccaggctggcctcaaactcagaaatctgcctgcctctgcctcccaagtgctgggattaaaggcatgcgccaccaacacctggcaactaatacttagtatacactgatatgtcaaaggccatagcctgaggagaaatcccccctcctcagctttatcaaaagacaattccttgagttccaggagaacacaactggatcggccttcttcatataggtggtctacttaacaacagtttgagttctggggcacagcctaccttctgaatactatgagggaactctggctgccaatgttgtatattgatgagattaattgcagcagccaagaactcaagaaacaaaaacctctaaggagctcagtgatggctgggagagaagtcatttttctcagtagcatatttacctgtaatttgtccatgcttcagtaattagctcccacctacgctcatgaaacaattgcattggttttggggcgttcacatgcacaaacatagaagggacttgttggaaaggagttcagtgatactcctgaaagtgaccagaatgcattatacatgtgtaagagtgtcaaaacgtggggctggagagattgctcagtggttaagaacaattgttgatcttggagaggaaggatctggacccagttcccagcacctacctagtagttcacaatctgtgcccccaactcccttttacccccacagacaccagttatttggtgctcatacatacatacatacatacatacatacatacatacatacatataaacacgacaggtatgcagtgctcatacatacattcatatgaacatgacaggtatgtggtactcatacattcatatgaacatgacaggtatgtggtgctcatacatacat

SEQ ID NO: 34573 - DNA, 1331 bp, Mus musculus
tttaatgcccataattttcatgtcagctctaaaattctttgctggtgtgtctggaagcattcttggagttttattatgttacagttttaaattttactttcagggttttgtttgtttgtggtaacctaactatgtaatccatgatagcatagagcaggctggccttaaacttggagcagtatttcttccccaggccttttgagtgctgagattttgggtttgagccagcctatccaacttaactatatttcttttactattatttgatttccttttcttttttaacccccctaagcttatatacgtgcatactgtttttgttttagttactgttactgtttctgttttggtgctaggaattgaatttgtggcctcaaggatgctaggcaggtgctttaccatcaagctatagttctaacttcattgttgaaattatgtggaccacataaagggcttttattgtttcatttgtttgttttttggataatatctttataatctggctggcctagaacgtgctatgtagaacccggaactcacagagatctacctgtctgcctcccagagtgctggaattaaagttatgtgttcctatgcctgccattgactatatgcttatttgtaaacaatttatttatgtttttgtatcagtgttatactgtttgatttctgcctatatactggttttgtttttgctgttctttcttaagacaaggtttactggagcttagactgcctttgagattaactaaatgatcaagaatgacctaatgaccttggacttttgatcttcttgcctttatctcctagtatgattctaggcatgtaccaccatactttgcacgctcagtgcttatcaaacttcatactaagtggacatctctagccctgtaatacattgttaagcctagaatttttgtttttatttaggtccttttgggcttaactgaaaggttttggtttcttatgactttgtttttttttttttttttaagcctgtgggggaaaatgcctttagaattgttaatgcagtggtaatctacaaagcactttgggtaggatggacattgtaacaatggtaattctctcaatgtgtgtggcataccttgcaaattgtttatagacttgttcatggtagtttagattttttcctgtttaattttgttctctatcattttatgtagttttatatgttgtataatattttgctttttaaatttgtagtatgtaaagatactgttgacttgaaaatcttatgttttatgagtttttataatttttttcatggatgccctgttaacctgaaacaattttacttttcttatttgggt

SEQ ID NO: 34574 - DNA, 1133 bp, Mus musculus
agggagatggaccatagaaatgacaataccaaaatattgccagaacctatagctctctgatggtatagaattcacaattgaaaatacagagacacaccttctcacaatgtgaagaaagcttactccaatatcccataaacctggcatgataaaataaatctgagccttctgatgaattgcagctgtagggacaatgcagtccctgttcccaggcggaggtctctcagactctgaggctttgcaaggagctccttgggtttggtgtgtaaatagcaatgtgagtttgtgtgctgtaggagggatgctgctgcagctgtgaacacgtgatgaagctcaatatgctgctgctgcttttcataccatagtcttaatttccttcataaaggacaagtgcaggagctggcacacttgttcaaactttatattgttcggaggagcattaaatgctgtggtcaaccagttgtcctattatcacgtgtttgaaactactgaacgtctgctaagcatgttctccttcgttaactctaatgtcatattcagtcttgttttcagactggactcaggctggccttgaactcccagtgtagctgaggatgacctttcgctcatggacttcctgtttccacttcctaagtgctgggattccaggtccgtatcacctgtatgtatcttactcatatcaccgcattctctgagtacccatcccctttataatagcatctttggcttgggctgaggccccagtcagcagcatatctatttctttttgcttatcttcccatgttttctgtattgaaactattcccagtgtatagtgttcacatgagtccttttctcacttggtacctccctccatcatcaagttgctgagtgaaatgaacaatataacggtcccctaatctccaggagggactttttaaataaatgtgttttaaaatcatttaattatttgtgtattttgtgtatatatgcatgtgtagtttgtgtgtttagatgcacatgtggaactcagaggccgacatctatgtcttctgcctatcatgattcctgcgttagggtttctcgtaaaactgtggctcaccattttggctaggctagctggccagcacgtgtctgacgtcacatccctccca

SEQ ID NO: 34575 - DNA, 2330 bp, Mus musculus
acacaaaataacagcatgcttggcttctggagtagactcttcctggcatgcagtcgctttcatatgacaaagtctgaaaatgaggattttttttttccctctactcatacaaatcgcagcattgtggaatgacgtttccactcattgtcctggactatcaaatgaaattctaaagaccctatctgaacagtcatgctgagctttagatttaacatgaatttgagagggtcatagattcttttggtttcctagacaggtaatgatatttgtagataatgatgttatttttttttttctattttagttgtttccttacataaattagtatgatgtccagcacactagtgaaagtagtaaaagcatatttttctttagaattataatgaggtatgctctccattatactgatttgcttattaggatagagggtttttttaatatctggattttgcataatggttttatagtatttctttctttgtgaggcaaaattcctcttggattcattaattgctttccctgtatcctctgagatgactatcctcattggctggtagcactcaagtatctaggatttcattgttccataataataaatactggaatgactaaaaggactccaaaataaagcagtcatttattaatgattatatattatttgttttctgatgttaactttaaattcttagatacattcaacttggacattaaggttcatttttgttttgtgtgattgctgaggatcaaacaagcccagctgaggcaagcactctgccactgagctataatcttgagcccagtggatcgattctactacttcatgttgtttatgcttgctcacataaagactaccatagatattcttgagtagcattggcatagaacttttccttatatgtgaagaaatggagtagggataagaagagtgcctgtttagcaatgcacaaggctgtggtttcagtcctcagcgccaccaaaacagccagatgtaaaacgaactgactggttttagctgtagattagaacagtgtcatacactgcagtgaatgtattcctctcctgtcctaattctaaacctgttcaggtatcctgatttagaataattgacactgttttaggtacccgttttctattaccttaaactattcagtatcttttatgtttataggacacctaagatttacagtatcatttaaattttttgagtatatttttctaggcatgctttcattttcacatatgaaatttattttttcttgtattcctgatgtttcatggttgcataattaactaactttgggtctgccttgtatttcaatctgcaataatttctccttgtatttaaattgagttaatcctcagtcagtattcttttggagagtatttgtctcaaactacagcatgttgcctcacactgtaatcttaggggttgggaagccaaggcaggaggatcacagatttaaggggagcctgagcctgggctattttgtgagacactgtcttaagaagacaaaaataaaaaaataagacaagacaaatgtgcccagggaggagttggggcctggtaaataatctgggagggaaaaaaattttgtcttgaaatacttaactttccaatatagtttttatttcattgactctggcaggtatgtacatggttatatattttaattttctttttgtatccttggttaaaaaaaatttgggggggaggtgctaggattcaaagtgggggctttacacatgctataacccaggtgtagatgtgtcttttatatatactttagttagagttttaaaactctgattacttgaaaattcctgattaacaattcttttagaccattatgtataatgcaactagtaacaaaattggaattttagcaacttttttcttctgtatttgttgcatgtaccttttctgtaatgttttcactgaaaattttacccagtgcttgaaatttatgtactccatttactatttagttgctattctaaaacattaaatccagttttaaaataaagtgtgttaatgttgtttctttctgagtggactagacagtttgcatacaggttgccatcattaatctcctgagcatcacaaagtcagagacccagaagcaagtgcactactacactgacattgaagaaattcaaagtagcagaattaatgtcatagaggatttgctaaggagacattaaatcatacaaagtaggatttagctgaaggagtgctgttcctcaataccccaaagtagtgtgctactcaggcctattagagataaatccatggtgctaggatgtaaatgtctgttcactaggattgaaca

SEQ ID NO: 34576 - DNA, 1192 bp, Mus musculus
caggatgtatgcttgcgaagagatgtgtaattgtcatgagttctgtcaccaggggcaatatagagtcatatgtttctttctacattttattttattttatttattattattgtgtgtatttgtatgaatgcgggtaaatgcagagtactttttggggggtcagttctctctttccatgtgagatcctgggatcaaactctgggcatcaagtgtgagcattaacaggtgagccatctcactagccccagaatcaatgttttttataccgtaagttcctttatctataaagtgagaacgctctctttctcagttggcagcacagttcctagcttgccctctggctccaggggaggcgtaagtgctgtggcatttcttggtaggaatatgtatttatgtggtttgatgagtgtatagatggcaggggaatgtcacactgttgtggagtgacttcatggcatgtgaatgtggggattacaagcagctctgggattttatgctgtctttctttcctatcaggccttctttctagagagcctatctacgtctacgaagcaaacatagaggtagacgggacggtgactgacaaccaggcaaattgttaccaggtaaagagagaggatatcattctaccagatacaacttcccatctgtgatctagaagcatttccttctagagtctggagttgacacagactcagtctctagggctttcttaaaggaagtacattctcactagggggtgaaggttatcttgttgaattttcctggggaacagagccttgcaaatccttctagcatttttgttattgcttattaacgtgtttgcctggctggggattgagccaaggcctttttatccatgctaggcacatgctttactactgagctctatccccaacttcactaattaatgtttgcttagatagagtctggctatgtagcctaaccttgaactcgctagccctggctggtctcagcctccctatccagtgttggggattacagacatgggcccccgctaactaatcttgagcttcacttacaactgcatgtcttttgttttgttgagtcttctgacagtaagtcaggtgagagcacccttttctcagaagcgctgtttatcccatatgtacagtttgtttaggactgtgctgcagtgagacagtaggaccagaagagctgctagcctggc

SEQ ID NO: 34577 - DNA, 1105 bp, Mus musculus
gtcttggtttcgtcagactgggacttacactactaagaagtcaaggaatgtgcaacagcccccaactgtgacagtttactctgaaaacatgaaaagaactcatactcaaaatgacccatgaacttaaggaaagaaacataatcaggaagtggccctcactacttcctaagaccttactaaatatgcgagacttcacaatgaggggaaatcactgatgtaagatgcattgaaggttgtagttctgttaagtattttaaaatcacttgtctcaacagttgagaaaaccttcatgaaggtaaggaatgttagaaagttaactatgaactcaattttcagtgtttagtaagcagtataattcatacccaagagaaattaactatatggaaattttgtccatgtgtgctggcagcaataaggcctgttgagtgatatttattgtgaactttcgccctgattcctgtcctgatatattcctggagttataatacattttcttttcttcaaggaactccattttatgttggctgctataacttctggatagtaagctggtgttatgaggacttttgaactataaacattgttttagtgtactgtagattctgttgttggcttaccaactattaaacattctaccctatagtagcttacagcagctgagtttcatgatatagtcctcaccgtcattaaaatgttcctgttcccttttcacaacttttagataaaaggtgataaataaataagcaacaagctagcaaagtcctttccacaaatacattgagctaggaattcataaatgcatcagtccttgatagagccggagccctcaagatctagatagctctcccatcctacactgaactctacggcccgaggatccagccgtcagtgcatgaacttttgggggtccatttcagatataaatcatagtacaacccctcctggcttctggtaattcctcaagattataaataacttgactgcctggggacatgttttataatcattataactggtagctgttttctgttgtgtgtgtgtgttgggagtgggagaggagatgagacatgcactggaatctgttcccttcttccaccatgtgggt

SEQ ID NO: 34578 - DNA, 1446 bp, Mus musculus
gagctcagctacctgcaaaggcttgaggtgctgggctgcaccctgtcagctgacagcacgctgctggccatcagccgccaccttcgagatgtgcgcaagattcggctgaccgttgggggcctctcagcccagggcctggtcttcctggagggaatgcctgtcctggagagtttgtgcttccagggtccccttatcaccccagacatgcccacacccactcagattgtgtcctcctgcctcaccatgccgaagctcagagtgcttgaggtgcaagggctgggctgggagggtcaggaagcagagaaaatcctgtgcaagggcctgccccactgcatagttattgttagggcttgtcccaaagaatccatggattggtggatgtgagggcatcacccatccatctctggaacctagcctagcttggagagtgaccttataagcaaactgaagcatgtaaattcatcaggcgtgagggaactggaggtgtcaaggaaaggaagctaggaccttggggcttcctgagctggggttatctgtaatctgggtcacctcagacttgtcatcaagcctctggaagaccccgttcacacatttaggaataggcatcatagctacctcatgattcattttaaaatctttaacaccccttcccctctttcttttccagtacctgggactcaaacccatggccttaggtctggtagagaagcactgctgtgctgctgagccaccccagagaccttagagagggctcattttcaagtggaggtgtgtggagttcagggctccgaggttggcctggttttctacatacatggttgagaggcatagagggcaggggcaagggagcatgctgttggattgtcctagttttctagaaggttctcagtcatatttactgtattttgtatcctgtctttttcaagttttctacagcatatattttactattaaagaaaaataatgtttttcaaagtgtgttgcacttatttaacaagagttgttccttgccagaacctgttattcacggacagtttttattatttatctacttatcttttgtattacatttattcattttgggtttgtctatgtgtgctacaaaagcccatgtgtgaaggctgggggacaactgtgggagtcagttctttcctatcctgtgggtcctggggaccaaactgaagtggtcagccttggtgacacgtgcctgtacccattgagccagcttgccaagctatttattatttttgagacaggaggtcattgtaatgatcatgaaatatattggtagctgaggattactttcaccgcctaatcttcccacctctacctcccaagtgctagagtctgaggtgtgcactgttactcattacttaggggatgctaagaatggaacccggggctttgggcacaccaagcgaatgctctaccccctgatccacatcc

SEQ ID NO: 34579 - DNA, 1142 bp, Mus musculus
tgactgtagttgaggacaatatatatatatttttttaatttgaggagggagggtctggatcttttgtctgcagttatgtgtgcaccacatgcatgcctgctgctgacagagaccaggagaaagcttccaattccctggagccaccacgtgagtcctgggacataaagccaggtctctggaagaacagtcccaagtactcttcacctgctgagctatcgccaacctgaggatgagcatttaagaaaatgtattgttgtgtgtgtgtgtgtgtgtgtgtgtgtgtgatggggtggagggcacttgaggacaaacaaacaactttgccttttcggcagtcttaagctccactgaatattatttatagtttgagttcttagatcagagcgtccattcctttatccagggtggatgttgagctacaggatccagctgtgagcagatggaaggtagtcatctctccgtcaaagttccttaacacgtgtccttcagatgaaatccacgatgggatgaacctggagctttattaccagtagagggggattccttctcctcctcgccctgctctgccctgccctcctctcccatcctcatctgacactggtgtagatggtcatttttaacagttcacatgaataaaaacttggctgctgctttgctgctgtcatacttgtgtgagagttgtgtgtgagggcagagctgctgtctagtagttagggggtactgctacttgaggggaagattgactggaagctgggcctggttggtgatgcacacctggcatctcaacacttggaaaattttttgtcttgaaagtcctgtgtagaccaggttatgaactggctgtgtaccacaatgaccgtgactcctgcctccactacaagtgctgagattgaaaaggtctcagttttgcttttaaggaattgccaggagctgtggatgcctcatggatttcatctaccctccatagtatggcccaagtttggaaatggaaaggaaggctgtctgttacgtgtagccctagacaaatactagaggatgggtaatttgtgaagaatggtttggttttggttttggttttttgagacagggtttctctatgtagccctggctgtcctggaactcactttgtagaccaggctgtc

SEQ ID NO: 34580 - DNA, 1225 bp, Mus musculus
tggccgtgaccagcactccaggagctaagcaggaagtttgaggattcaagagtagcctgagctgcataggaggctatgtctcggagataaaaggacagagtcctgtccaggccatctgggaaaactgagagagagctgctcaggtcagggtggctgccctgggagtctctgtgtgccatggctgcaagttagtcagaagatggggacaggatgggctgtcttgtgtctgtgtctagggctttcttacccacctcaggtgctacctagaccaggtgcctggtagtctccccaccttgcacatgtctgagagtgcatagcacaggctcacatgcatccgcatacgtggtactgtgctctcactcccctgagcctgggtcctttcaactgttttgttgtttgtctgactttgtttttatttgtttaggtgaggggttggtaagagtgtatgaaggtcagaggatacaacttgcagaagttgattcttcgattcttgtaggtcccagggatagaacccagatagtcaggccgtgtgacaagtgatttttgttattgttgttttgaggctttgcttcagtcactattcaccttctttccagcagccctggcttcctgaccccgcaggagagtcacaacccagtagagccgctttaatgtctcctgagctctgccaatacagtgtggaaccttgcctatgggaccattgtacaggcactcacacacagtccttacaacctcagtgccccagcgagtactctgctgtgcctccgtgttgcgcaggtggagactcctactgcccacagctgaagaggtcaccagctccagtgaagagcttggctgcatgctagctggctgcaggtctccagagccttgacattgccccaggagtaggggtgggcagtcatctgctgtgaggtttcagctctgtgtccaggcctgagaagaggtcactgcgtgtatgggtgcttcaattcctgtgcaccgtggatgactgtcctggctattcagatcgtgctatggtcataggcacgtgaggatgggcgactggtttgcaccgttgggacatgcacatgggaggactgtcttcatgggtgcacataataagagcacaggataagggtgtggttgcttgggcctgagggtatgggaggtgttgtgggtgcgatcagcataaccttgtagggaactgggtgcacaggtcgggcaggtctggcctagctcctaggtg

SEQ ID NO: 34581 - DNA, 2426 bp, Mus musculus
ctgggccacagctcatcactgcacagtgacagggctataaaacccatgatgaatatgcttgagactgaatgcaggcaggagccccatctgctgtgcagcctgtgcctgacctccactgtctgctgtttcacaggtcagatgcagaaaccatttgaggatgcgtcgtttgctctacggacaggggagatgagtgggcccgtgttcacggactcgggcatccatatcatcctgcgcacagaatgagggcaggcacctggccagcctgctctggctgccacacagcccacggatgcccttcctgctactgtcacacagtatttattgttcctaaaatgactgggaggggctctgagcatcccgctccctgtttgcccctattcggggctgtcctagccaggctccttctggaggaattgacttcagaagggcagtggggatggggaggcccccaggctcagggggtcagaggtgacctgatcccccaggtctcagaggcaggcaggagggccttctttcttgttagttatatgctccattcgttcctctgttcagttgcaaaaagcagacgctccatacctggcggtgcagcaactcagcctcagggtgcagtgcagcaccctacgcaccttccattaaatctggaaccactggttggtggtcctgtatcattaccttcctggtgaggtgtggggcccttgtctcagggatggggcttttacccacgtgtccagactcttctctagctctaaaagaccttcttttccacagcttggggggtgctggcaagaattctttccactagctatattcccagggctgcaaatacctctgagccccaccagtccagacccacttgtataagcaccctggggactgttcaggtatgcgcagaccaccccaccaccccaccccacttccagctgttaggtctggagtgatcccaagagaacctggcttagcatctgccttggcacacccccggtgcccatccctccccctcagcacacagacagactgcttattggtgagaacaaatcacccagcatctgccacccacttctgactggatattcctgggctcagccacaagacctagcactctccaggtgctgtttccatggtaacagaggccccctcaactggaggagaggggggctttatcagctcccagaagaaaagagatcctattggagggggctgggaaatggatattgctttgagtggcaggtggggagagaaggcggactctcccaccttggctagggccctatgtctcccacaactgcctctgagcctaaggactgagggctcagaattcaatcaaggtttctgcatatacccacaagtgatggggggcccagcctgggggatgttctaaccagcaaggcttgggggccagagcaacattaagcctggaccccaagagagccctccctccccacaggcctgagtctcatgaacagagtcacctgagcctgctcccatctggctgctttctagagcaatcgctctttgccagccgcctgctggagcatttgtcattaggaaggtttaatgagttttttcccagctcagacaggcacaggctgagctgagttggctatacctccagcaaaatgttctccagtgggccagtggggactcaaggcaaacagtcacagttttgctgtcttgcaacagttgggtgggctcaggaggcagtggcagccctccaagtatcatgggacctttggagggaagaagaggacctctagcttagcttgcaacaccaagagctctgggaggttctccctagggccactgccacatctgatccactgcctgtaagaagcaggtattaccatagtggtaatttgtgcatccctatgtgtggccatgtgatttggtatctatgttctatatgatcccaacccactgtctagggtctgtcctttggacccctgccaacctcttttcctgtctacacaattgtaaaaacctaagactgaacattgctgttagataaatgagccccaggagcccactcagcgtccccagcatatattattaactacctgtggtttccctcacctgctccaagttcccacccagacttgctactgggaactggctataaatcctgggcctttaggatggcaacagtgtaacaaccccccacccccaagggatggaaacttctctttgtgcagactccactgctcattcttaatgggctcttcttagacttgacacaggggattctgggttattgctgcagtagggaatggcagcctcctgattatagccaaacagtcatctatgatttagagcaagttggttaactcagcaccacatagctcaagacagacaaatgaacagaagtggatgggtgaggcgggtaggaccaattgctaatcctttgtagttgcagcatgtgccgagtaatt

SEQ ID NO: 34582 - DNA, 1186 bp, Mus musculus
taatcacacaccacacagcctgccctcccctcacagtgagccaagaggattgggctgcagctgtttttccttttttcttgtgtgtgttgtatatgcatatgcctccccaagtgctcccccaccctcgtgtgtgtgtgtgtgtgtgtgtgtgtgtgtgtgtgtgtgtgtgtgtaggacaaaggacaacttcaaggaattgggctctcctcttctccaggcatggcagaaagtgcgtttacccactgagctatccaccagccagcttgagccaactttttgttgtttattcaaggcagggtttctcagtgggtttctcaggtttctcagccctggatgacctggaactcactctgtagaccatgctggcttcaaactcacagagacctgcctgcctctgcctcctgtgtctgaggttaaaggcacacgctaccaccaccctatagataacttcctagcacaagtctgactatgtctttgcactgcacatacagacttacaagatcagagagtgtatctcccttcttgatgttaatttctagctagatggtctttaatccagctcaggactagggctcttgcgattgtatgaaagaagtgactacgccttcagttaagacctgatgacacaagccttgatgaggaccaaagatatcactcagccatcactataacaaatggggcccagaactcagtctggagccaccatgtatcccaagatgtggctattagcacagtaactgggcagtttgggggcaagaccaattctttctccccatattcatttctctctctctctctctctctctctctctctctctctctctctctctgtgtgtgtgtgtgtgtgtgtgtgtgtgtgtgtgtgtgtgtgtgtgtgtgtacatttgcagattgtatatgctgaggtgcgcatgggtgcagatgcatgaagaggcttggagttgatgttagaaatcattctctattactctcccactatatccattgaggcagggtctcttaatcaaacccagagcttactgatagtggtcagtctcattagccagcctactttgaggatcccctgtttctggcttccaaggctggacttacaggtgggctgccacacccatgcagcatttagatgggttctggggatcctaactccaatcctaacacttggtgttgagcacttaaacagctgagc

SEQ ID NO: 34583 - DNA, 1181 bp, Mus musculus
acggtgagtgaaagaaaccatcttgtctttttcccacctctgccatcttctgccatctttgagcccttattctcccttcacataacacctgtccctcctgtctgtcaggtaatgtcttatagtacagaacctgaagccaagccttaaggcaagggtgctgcccagtattcacaaggctatgggcttcacccgcagtgcatgcacaggggtaggggtcatgtggggtggctagatcccagcctcaagccccattccctagcagcacttgagcgtgggcagggccctgggtttcatccagtcaccacagagaattctgggagttgcggcctgtgagggtgagggagctgtggacccttgccaagggcacagcctgtgccatccatgacccacgatgtccagtaggagaggcagagggagttgggttggcgctcaatgaccttcccatcctccctcaggtgaaactggcctcgtggtcccgagagaagcctggaggctggtacagcaccttccgccgagggaagaaggtgggttccaatgctgacatggaggacggcatgcgtgagaactgttgggaactggcgtgggtaggcagagaaggacaagtacttctctacaaagtcctgggctccgttcctaacactgaataaataggaacttcaagtgttcaaggcaatcctcagctacaccatgaatccaagaccactttgggctacttgagacttggcagaagtgtcaggcctgtgggtagactgcaggtggactgggaggtgtcttcctcaccctaccttgccccactgcagttctcctatgtggatgctgatggctccccggtgaatgtggtccagttgaccttcctgaagttgttgagtgctgcagcccatcagaggttcacttacatctgccagaactcggtggcatggctggatgaagctgcgggtgaccacaggcactccatccgcttccaagggaccaactgggaagagttgtccttcaaccagacaacagcagctaccatcaaggtctcccatgatggctgtcgggtaagaccatggaaccagggactggcgggtgtggagtggggaagcctctcgtcaccctcctctgacttactctcctaccccctcatggccaggtccggaagggacaggcgaagaccctctttgaattcagctcttctgtgg

SEQ ID NO: 34584 - DNA, 1204 bp, Mus musculus
gatcagagggaggaggctatgaggtctaagaagagtgtacccctgcacacccctttctcctttgtggattttcccttgcaagggggctccatgccgggaagctgcccaaggaaccagtgtgggggtgtagggagcagggaaggcttggctctggggctccagccaggaagacttgattcatcctagaactaggtcagctttttttttctcaccaaaaacttagggggaaagaaacaaccagtcaacagacggatgtaccagcaacatctgtggggcagtgggggaggtgctgctagtcccaggccactcgcttcctcctgaactgtgaggacaggaatccccaaatctaagcaagtattatggagtttggggcccttttttttttttttttaacttctcgattttcagacagaatctcattaagttgctcaggctggccttgaactcactgtgtagagcaggtagaagagcctcccacctcagccttctgagtagctatcaggactggagattatacaatcaggcccaattcctatgcggttctggccaaaccttctcatcctggtgtctttctacagcagaacctgtggacgtactggaagcctggggtgtgcatagagaccaggctggggtggctgaagggcctggcttctgccccctgaggattccacagggtgaccgagcattcagggtgggcaagtccagccttctcagtgtccccacgtggcagctcttcccaggtgagttaggacaggaaggcttgggagggggtcatcctggaaggatctacactgtctaacctgttccctttacctgtctacacagatgggcattttcctgagaacttttctgtgctgctcacactgagggcccagccagccaatcagtctgtccttctgtctatttatgatgagaagggtgtccggcagctggggctggcactggggccagctctgggcctccttggtgactccttcaggcccctccccaagcaagtcaacattatggatggcaggtgagtatgggggaagggaaagggacgccctgtggaaattcctgcactgagacttgttccttttgcaggtggcaccgtgtggcagtcagcatcagtggtaacaaggtgaccctggtggttgactgtgaaccgcagcccccaacatttggtcaggggcctcggtttataagtacagctggactcactgtg

SEQ ID NO: 34585 - DNA, 1108 bp, Mus musculus
cattgcagcagcgtcaaagtggttcccgtgggtgcaagccgcggcatgaagaagctcttacaggagaagttccctaacatgagccgactgcaggacatcagtgagctgctggccacgtaagtaagaaagctggtgggtggcagctgcacctgtggagcgcccaaggtaacctgttgttttacacaggggtgtggggctatcagacagtgaggtggagccagatggagaacacaacaccacagaactgccccaggctgtggccggccgtggcaacatgcaggcccaacagagcgccgtccgacttactgaggtgagggtggctatggtggccctctcagctcccagtcacaaggctagcctgactctcttcccattcccctgtgttggcagattgggccccggatgacactgcagctcattaagatccaggagggcgtcgggaacggcaatgtcctcttccacagttttggtgaggggacagggtgaggccagcccgtgagagcagtgtcgagtcccactgtgacgttgacagattgtctgatccttcctcacagtacacaagacagaggaggagctgcaggccatcctggcagccaaggaggagaagctccggctgaaggcacagcgtcagaaccaacaggcagagaacttgcagcgcaagcaggagctgcgcgaggcccacaagaagaagagcctggcaggcataaagcgagcccgtgcaagggccgacggtgacagtgatgctgaggacccaggggcaccgccagaggcagtgggggcaggtcagcctgaagatgaagaggatgacgctgagtatttccgccaggctgtgggggaggagcctgacgaaggtatgtggcagggtcctctggtgacaccttggcccttttcatttcttctccattaatcacatttaaccacttctctccctgcagacttgttccccacagcggccaagcggagacggcaggggggccctctgggcaagaagcagcgagggaaggagcagaggcctggtaataaaggccgaggtcagggtggcaactggcaggctctgaagctacaaggtagatcccagagaggcaaggccaagccgagacccagagcc

SEQ ID NO: 34586 - DNA, 1172 bp, Mus musculus
gtgtggacgtggggacctgggagggtctcagctgttctgtggtagtgtgctcttctcttccctgcattacctgtggccaagtttgagtggcttcgggcatggtcatcctgatgtgtgactgatagcttactctaacttgggtatgcgtgcgtgcatgcgtgcgtgtacatatatactctgtgtgtgtgtgtgtgtatgtgtgtgtgtgtgtgtgtacatatatacgcagtgtgtgtgtgtgtgtgtatacacgtatatactcaggcaacatccaccatgtatgtgctgggctcagtgtggccataatctaatgtgtcctgtgggggtggctgcctcttgtgacttgtatggaactttgcttctcactgtcatggatgagtggcctagggacatcctcactgttgtgtgcctgtagtcgggatgctgccgggctggtggtgtccagcgctggggctctgcagtgctggctttgttgtgtctgccctgtggcttgttcactttgctcgtgacactagcagagactttgaagagtggtagcttcctagatgtgatgtttgggtcaccaaaggatgactgggtgtctgtacctgggggctggggcagaataatccttccgtctgctgctttccagagctggagcccgtgcaggccgcccagagcaagacagggaagtatgtgccccccagcctccgggacggggccagccgccgtggggagtccatgcagccaaaccgcagaggtgaggaggtgggaggcccgcccccggaggcaagggctgtgagtactcctgcagtgtgggcgtggggtccagcggtggcacccttctcactgccatctccccctgccctgcccacaaagctgacgacaatgccaccatccgtgtcactaacctgtccgaggacactcgtgagactgacttgcaggaactcttccggcctttcggctccatctcccgaatctacttggccaaggacaagactactgggcagtccaaggtgggtgagctggtctgaggagtggagtgggtagctggagtaggcatcccttgacccacttcttacacctccatgtctgcccctggcccgcagggttttgcttttatcagctttcaccgccgggaggatgctgcacgtgccattgcaggggtgtctggttttggctacgaccatctt

SEQ ID NO: 34587 - DNA, 1188 bp, Mus musculus
taagatttgatgtttgttttctagcacccagatagatggtggccacggtcatctgtaactccaaattccacaggacctgctgccattctctgccctccgtgggcattgtacacacctgtagccatacatacacggacggaaattacccattcacactaaataaaaatgaataaatagtttttaaatgctgcctgaagtgacctgggtgacggggatggtagctgatgtctgtgatcctggtagttgaagtgctgtggcaggaggatcactgagttggaggtcggcttgggcagcagagcaagacactctcaacaaataaaaggccttgaagctgtggtgtgaggtgtacaagactaataagattcctgttctcagactcggctctcagttgctggtccaggcatttcagaggagggtgctcggccggggattataaatctgtggtaaagtagtattcccctggtatcctcctcacaggcctgagaatacccacaggtcctacaacggatcctatcacactgacatcaacatgctttactggagcgacgaggaagctgtggtgaacttcagcgacgtgcagggccgctgtaccgtggagtacggggaagacctacttgagagcatccaggattattcacaagggggccctgaccgcttctacttcctcgaggtggagccaagcttcaggggcaaatgtgcaggagcagggtgcccaagacagtggctcgggctggggcagggctcagtgagacagggcctttgttcagcagacgctaggctaatcctgggtgtgtctttcgacaggagaagctaaggaggcagctaattcatgtgtagatctgttttttattttgtttttttttagtgaatttttaaaaaaatttttattttcatgagaattaattggtattttgcccacatgatatatgtctgtgtgatggcatcagatccttgaaactggagttcaagacaattgtgagctaccgtgtgggtgctaggaattgatcctgggtccttagagagagcagctgctacctcatctccccagagctgtctgtttggtcttttgagatagggtctcactgtatagccctagagttctgtatgcagattaggttgaccttgaactgacagaaattctcctgtctcctccaagtgctggaattaagacttgtactcacaagtctt

SEQ ID NO: 34588 - DNA, 1153 bp, Mus musculus
tagaggtgggcgactgcgtctcggtcattccagatgattcctccaaaccactctatctagccaggtatgcatgcctgccttttctcttgaacacctcaagtccaactttgtcagaacagaccccaggttctgctggttacatgagacatttcttccccgtcctgtcttatgactgcagggtcacagctctgtgggaagacaaaaatggtcagatgatgttccatgcgcactggttctgcgctgggacagacacagtcctgggagccacctccgaccccctggaactgttcctggtgggcgagtgcgaaaacatgcagctttcctacatccacagcaaggtcaaggtcatctacaaagccccttctgaaaactgggccatggaggtgagttcctcctttcgtccctatgttctgtcccaccgttagagccgaggctgacacgagtctgtctccatagggaggcacagaccctgagaccacactgcctggggctgaggatggcaagacttacttcttccagctctggtacaaccaggagtacgcaaggtttgaatccccacccaagacccagccgaccgaggacaacaagcacaagtgagtgtgggagccaatagcaggcctccccgtgcccaccctgctctgtggcgtcaagaaagttttacttcccagttgtgctctttgctgaccaaagaggcctaacatatggaaatgtttaaaatgtatggaccggttggaggttaccttgagcaaggtgtggccttctgtttaaaaatcctcatttgtggtgctgcgttgtagccctgggccttggacacgctggcagaacacacctctgctgttcacagcctcggccttgtttctagtattgatttctatctttgagctgtggtccccaagagctgtctacaaagtgcagacataaagaaggggggcaattatccagatacctgcagatgttcttgggtttcagtggctgctcctgccacttcagagcctcgagcttttctgctcttgccttggcttctgcaggttctgcctatcttgtatccggctggctgagctgagacaaaaagaaatgcccaaggtcctggaacaaattgaggaggtggatggccgggtctactgcagttccatcaccaagaatggtgttgtct

SEQ ID NO: 34589 - DNA, 1123 bp, Mus musculus
ccctgcctagaactccccagcgaggggctcaggtacactgcggcttagtggtacattgcttgcctagcatgcgtgaagtactaggctcttcctcccccagtattacaaggaagcaaaatattcaaaacatctgatcttcttttcttccctttaaagaccactgttcctccttctaccattaatgtgaaccggttcacagaggactccctcttacgccacgcccagtttgtagtgagccaggtagagagttacgacgaagccaaggacgatgatgagacccccatcttcttgtctccctgtatgagagccctgatccatttggctggtgtctccctgggacagaggtaaggatgtagcaagaatcagattggaggcttgagaccagaggaggcaatctcctgtgtttggttctctgaaacggtggccatctccctcaggcgagcaacaaggcgcgtcatgggtgctaccaaggagaaggacaaagcacccacgaaagccaccaccaccaagctggtctatcagatctttgacactttcttctcagagcagattgagaagtatgataaggaggacaaggagaatgccatgaagcgccgccgctgtggtgtctgtgaggtgagccggctatccttggcaccccttccttagatgtgaaggagagcactccatgctttggggtagcctcctgaccctctctgtccatctggggttgaagtcggagtgtccaagacctttggtcttgctgatgctaggctacagatcctgggtttcctgagagatgctagctccgcctctatttcctgtgggtgttgagagagcagacgctgaccccaggagccaaagctgtcccctccacccccacccccgggcacatttcctgggattctatctagaactgaaagtgcacatttctctcagtttagacttatggctgcagaagcctcttgctttgacctccaagagctggccttacagacctgtgccaccgtgcctggctcttgtgaattataaatccttttcatatagatagccttggaatcaacctacattacactaaacaagcaaacacaaacttcaaataatgtggtaaagctacacatggaggcgccggcctgtgatcctg

SEQ ID NO: 34590 - DNA, 1120 bp, Mus musculus
ggtggctggtcactgttatctcttccctgctgctggaacactgattcccatagaggatactgtccgccagtaatctagagggctaggccttaataagcaggagacctctgaggggcccgttgaagcctgccctgtgatggcagtcaggagtggtgtctctgtggcagcctcggggttgaggccaggcttccatcagtgagttattcagccaccttcctggtaggggaaggtctgagggcacacagcccttgtgctagaagctgggcgccataagggactccgtgttaactgagtgactagtagaaacaaaccttgggcaggatcaggccgggcactacaatgttctttttagtctggagagtaaattcgggttcggttcctgatacctatgtaggagccctctgaccttggtgtgtgtgcttgtagtgcaggggagggagcgagagtccgggtgggtgaagggcggtcttggctctcagtgttgggtttggtggtaaagtgatgtttgttgcctattcagtgtgtactgcagtcgcgggcacctgtgtcctgtcgacaccggtctcattgagaagaatgtagagctctacttttctgggtgtgccaaagcaattcatgacgagaatccatctatggaaggtatgtgaagtgctcaaacaagggttgtcccaagaagcaagcacatctaggaggcgagatatccctcctatgggaggtactgcttcaagaaagagcttgaagttctgccattaaccgacaaaatgactttggaaaggcagcctgctggctgggtcgctggcggggatatgagttgtgagtcaccatgtttttagtcttgtttcttatagaaagacatcttttctacaggtggtattaatggcaaaaacctcgggccaatcaatcagtggtggctcagtggctttgatggtggcgagaaggtgctcattggcttctccactggtgagtgtctgcaggcacagcatcctggaaccacccgcctgcctgcctgggcttgctgggctctgggcagaggtttcctcgggcctggggaatctggtggctagtgttgatcataactggcctggaagcgggtcctccacacgtaggacagtcaaatgct

SEQ ID NO: 34591 - DNA, 1150 bp, Mus musculus
tagggcagacttgtcctgggatttggacattagcataatttgggcctcattgcctgaccttaaccaccttccttcctgggtaagttcttaaccctaaagtgctgtccaaaccaagagaggtcctgttcctttgtttaggaggagaagagacgaaaaacgacacgtaaaaaactggagtcacacaccgttcccgttcagagcaggtgatggtgttagacagtcccagaaagcggggtgagagatgggttcgtgaactgtcacagcagccttagcttctggtgggagtgcagaccaggatattcggcttctgctgggcacgttggtagagggtcccttagacctcctcgtcctgacagtcatcgacgtgcatggggtggcttagggggggagagtgagcgcaaggctgctgctggtgtatttcaagctgatgaaatggccaacaaccttgcgcttccttccagatcggagagaaaagccgctcaaagcaaaagtgtgatcccgaaggtaagtgcatctgtgggagcctggccggcagggagggtacagcagttcctgatgctgggggctgccctcaggccgtgcctgttccttcccacagatcaactcaccaaagtgccccgagtgtggccagcacctagacgaccctaacctgaagtaccagcagcaccctgaggatgctgtgagtccctttctgccctcacccttttacccccctgccacctggtgcccacgtctcactgtcccctgtccttcaggtggatgaaccccagatgttgaccagtgagaaactgtccatctacgactccacctcgacctggtttgatacttatgaagattctcccatgcataggttcacttccttcaggtaatcgccgtgcttggctgcctgtgatgatgtcctactggtagatgcccctattcggggcatccatgtataaagtccttcagcctaaccacagggctctggagatgctcaccctgtaaagagccaagaggccgattaagttcgggtagacattagccacatgagacggggtttcacttgataggcggttgtgggtgaccttgccttttgtgcagttctgggatgccagacctcacgtacgctaggcgggcacttcaccggctgagtcacatttccagccccggt

SEQ ID NO: 34592 - DNA, 2232 bp, Mus musculus
gccacgcggatgttgctggtcctcagacgctagccctgctcaagacggtcaccatcgtactgggtgttttcatcatctgctggctgccggcttttagcatccttctcttagactccacctgtcccgttcgggcctgccctgtcctctacaaagcccactatttttttgcctttgccacccttaactcactgctcaatcctgtcatctatacgtggcgtagccgggaccttcggagggaggtgctgcggcccctgcagtgctggcggagagggaagggagtgacgggacgcagaggtgggaaccctggtcaccgactcctgcctctccgcagctccagctccctggagagaggcatgcatatgcctacatcaccgacatttctggagggtaacacagtggtctgaagggaaaatgtgaactgatagttaaccaagccacagagagctctgtggggagagaccaggtgacctcatgatgtccctcagtgctgcaggtctggagaaactgaccacagctcataggtcaggtgaccaacggaggcactgactaatcagattgtagtactgtgactgtggggatcattaagggtctagggtgaccgcaggctggagcttagggctagacatttgccacttgatacaaagggtgtcagcattctgtctgtcctatcttccagcccccctggttcccgtcctgccgcctcctttttagggcctctctacatagccttgactggcttgaactttctatgcagaccgggctgacctggagctcacagcagtctatctacctgtctgtgttctgagggttgggtagcagctcacccagctcctgcccccttccataaacaaccttaggcctctgaaggaaatgctgtctgcagcggacccaaggcttcttccctgtctttctgaggcctaaatccacagcttccccaatttcatcaactgctgcttcttctctttcctttcatattcggggaaaggaaaccactgtgggggcagggaggaggcctggcatcccagtctttattttcagatctcactggccactcgctttattggtgagccgagagggatcaggtgaggcagtatggggcagctgttgaggagactttgggctctcactctcggggaggtgatggtcattcctggaactcctccccccacacccagcctttctccccatgagctcatcacctcttcatcctatcccaggtaccacggcccttaaggcagggcagccttgagctggatgtggctgcttgcaacttgtctgtgctgttttttaaaattgggacagggtctcatgtagcccaggttggtctccagctcactgtgtagccaagactggctgtggacttccgatcctcctgcctccacttctggagtgccagtatctgtatcacaggggtgtaccaccaccacctgtcttgaaaattgccatgaatgacatagttcacatagccatgggtggccaaggacactcctgggtactcttactgcatcttcccttgaaggactttgctaaatcctgtggagaaatagaaaaatccaatacggtacaaactgtatttatatgtgtctgtgtgtcaatgtggggtctgtgacctcctatcccagtgtgggtgctgtctgacctcttctgtgcacatctgtatcaagactgctagaaagatagacaggggtggggtgtgtctgtgggggtctggccatgatcaggcctcctgggaattgctgattcatctctcccacgcatagaaacctcttccttgaagaaatatgtgaaagaaaaggctgaagaaggggagatttgggaggcaaggagcctgtcgggagtgtgtctcccctcatatagcttcccagatgtcctccttgtgctggaaacccagatctgggccaataaacagttcaatttctcttgctgctggtggttatgtgtgtgtgtgtgtgtgtgtgtgtgtgagtgtgtgtgtgtggaaggcagaaatttctgaccattcgtggcctgccaaggcaccccagccatcccccactccctcactcttagctctgtctgagctggaattgcatgctgtggcttctgagaaataactggccaaccttgaccttttccctggcctgttggaaggccgtctggctcttcacagtgactcattccgcccagggccaccatgttttccttcaacgatacaccttagcaggtgggtttccactcttctccatcccaagt

SEQ ID NO: 34593 - DNA, 1151 bp, Mus musculus
tcagtttggaaattcctagatcgcaggggccagcgaggcaggaccacccctctctgccagggcacagtctccacccggaaataccgaagccctcgttccggaggggaaggcgcgaggtttcccggaaagtggccccgacagcaccgcccctcggccccccgtgagccagagactataaaagcgccgcccgcctcagtctgcacccagtgctagtgctgagctccgctgctacctgcactttgccctggccctgcaatggcttcaacccgtgccaagcccacgctacctctgctcctggccctggtcaccgttgtgatccctggtgagtccgaggtggggtcgctttggggggcaggtctccaaactccaggacccagagcgcggtcgaaatccctgcttcccggccagcggaacatcacataaattcagctgttaacgggaagtgggattggaaacccagggttgaaaactaacagcccggagttcgaatcccacgtagcatcactccatgggtgggttacagaacccaaaatctcggtctctctctctctctctctctctctctctctctccctcccagtccctccctccctccccctctctctgtcctctctctctccccctgtccccctcttcccctcccttcctttctttcctgttttgagaatgatgccttgacacgttagcctaggctggccttgaactcagtcctcaaggcctcgcggctcttcgggttacaggctcaaaacacactactctcctaaaacatgcacgtttagaacctgggctcatggtctgtgcaatgggaactgtggtcacagtccttgtcatggggcagtcagaatatggctgaggtggggaacagatggtctgaggggctggcccgtcctaaagtgaatcttgaggtccggttccctcccccacagacacccgttcctcatcctcacccctggggaagtccaggctgcttctgcgctggggaattccagggttggtgtaccctggagccagagtgagccggctcaggactccccaccttgctgctgcctgggggcggcgcctgccgtcctcccaagagaggaagattcagaacttgttcagcagctatcaggaggctcccgacttggattcccgcaatccataactcctag

SEQ ID NO: 34594 - DNA, 1413 bp, Mus musculus
gtctgtcaaacaggagatgaatggtacatacgtgtgccatgcctttagctcccatgggaatgtcaccaggaatgtgtacctgacagtactgtgtgagtatcccaggatataaggctggatgaggggtgggctaggtgccagggcctcaagtctcaccattcccttctgtctctaccacacagaccactctcaaaataactggactataatcattctggtgccagtactgctggtcattgtgggcctcgtgatggcagcctcttatgtttataaccgccagagaaagatcaggatatacaagttacagaaggctcaggaggaggccataaaactcaagggacaagccccacctccctgagcctgctggatgagactcctgcctggaccccctgcagggcaacagctgctgctgcttttgaacagaatggtagacagcatttaccctcagccacttcctctggctgtcacagaacaggatggtggcctgggggatgcacacttgtagcctcagagctaagaggactcggtggatggagcaagactgtgaacacgtgtgacccggacccacctacagcccggtggaccttcagccaagaaacgctgacttcattctctattgcccctgctgaggggctcctgcctaaggaagacatgatatccagtagacacaagcaagaagaccacacttccccccgacacaggaaagctgagacattgtccccaactcttcttgatgtatttattaatttagagttttaccagctatttattgagtaccctgtatatagtagatcagtgaggaggtgaatgtataagttatggcctggaccctgctgcagatgctgtgagagtctggggaaagatcacatgggtcgagggtttctctactggtcaggatgcttttctcataagggtcgacttttttcaccagtcacataaacactatgtggactggcagtggttctctgctcctccacatcctggagcgtcccagcacctccccacctacttttgttcccaatgtcagccaccatgccttagcagctgaacaatcgagcctcatgctcatgaaatcatggtcccaggcggctccacctcaaagagaaagcctggaaggaaatgttccaactccttagaagggtcgtgcaagctgctgtgggagggtaagcacccctcccagcacagaaacctttcctttgaatcaataaagttttatgtcggcctgagtgtcttgtgagtttgtgtacagtcatcacatcagttaggcaaagccctaaggactgccgactcccataatgcctcagggttgtctggtaacctaaccctaactctgagtctgtggatcaggttggtccccacccccaccccctttcttttttgagacaggttctctttgtggccatggatgtcctg

SEQ ID NO: 34595 - DNA, 2151 bp, Mus musculus
gtctgtatgtctctgtagccttgtcatccaaggggtctcggcgacagctcatgctgcagtggttttggcccctctggttcccactgttgagcttcccctcatctcaagttggcctaaggtgtgggtggtcttagccccagaagacagatgagagacagctggattaccaccaggcctcagttctgagttgcaggctaggtggcctcagggtgacctgccccacctctttgactccccaggctgttggttcctctccaatgggctccagtgaagggctcctgggcctgggccctgggcccaatggtcacagtcacctgctgaaggtacgggcaggaggaggggaggcacagggctgggcaaccctggctctgggaggccactgacctggccccccttgctgtctgtctccagaccccactgggtggccagaaacgcagtttttcccacctgctgccctcacctgagcccagcccagagggcagctacgtgggccagcactcccagggcctcggcggccactacgcggactcctacctgaagcggaagaggattttctaaggggtcgacaccagagatgctccaagggcctgcaccaagttgcttttgggttttttctggtatttgtgttttctgggattttatttttattattttttttaatgtcctttctttgggtaatagagaaatctctgcaaaagactttgctgaccaaccagctggagctcaaggaatgtggggtatctggggccacaccattacctgtgggcttgctcctggagccaaaccctgcagccttaagagagaggggcctgacctgctctctttccctccctagctccaggcctcctctcctgcctcgtcactcctgtgttctggcctcttgagtgcctttggaggtgtctctgacctgtgaggatcagagacagtccccgtttttaaacttcgacaattgacttttatttccttttctaatttttattattttttaaaacaaccaggatgattatcacatctactcccccatccgtccagaaaagccccaaattgattccttcagggtctggcctgcccaggctctattccacatgtgcaggttccaacagcttaaccctattctcttcccagtcatctgctgcaggtatagctgtctcatgcccctgcctgcctattctggccagtaccctaagccccaagatctccagcccctgccccagtatccttgccttctgatgccttaaagttgggccacaggtcctgctgggtcagagcctcacagatgcggagctccaaaagctccgctcaggaccaaagagctctggcctagggttcatcctttctccaggtgtctgccctgtggacagaaggctaaagccttgatcttggcaaaccaccccttttgcccaaagcctggatgcagagaccagtattttctgctggcttcaacagtctcccctgctgtctgtgaaaggtgaccattgtacccaggccactgggcctctaccatgttctttcaaacccaggtcattaccatccccaggctggatcactggagcaggcctcctctctgtccatgtgagggggacctaggggctctgcccttagccagctgagccaccaccagcctccctccccaaacatgataacccaaacccactccagtgggtgtatctcaccccctcaccccacccccaccccctgcatagacctttgctgaattaaagtttgtaagtaaacggttttaaaaaaaaaatcagagctggctggttcttgatataaaccatgggccagcaaactagctcagaattctggtaacacagacagcctgagttttatccctctgccccaaatggtggaaggagagaactgactcccgcagattgaccactgacctacacacatgtcacggatgggctcatacacacaatccctaaaaatttaagttgggcttggaggccagcctggtctatatgaattgcttagagacttaagaatttctcagtctatagagattctgtctcaaacaaaatttaaatactggttgcacataaccggtaattccagcaaaggaattcggagatcaaggccagactaggggatcctgtctaaaaattagagaactcagaggttggtcccaattgccgaacgtagttt

SEQ ID NO: 34596 - DNA, 2151 bp, Mus musculus; identical to SEQ ID NO: 34595

SEQ ID NO: 34597 - DNA, 1268 bp, Mus musculus
ctgctgttgtttgtgctttagaaattcaccgagctcatcggccatacccagggccagatgaccgtgctgaggctcacagagctgctggaacgaggagagaggctgcctcggcctgacaggtgtccctgtgaggtgagtccaccagcagatgttccctgtccccacccttacgacacagggcagatggccccacagccccatttctcccgcagatctatcacctcatgaagaactgctgggagacagaggcctccttccggcccaccttccagaatcttgtgcccatcctccagacagcacaggagaagtaccaaggtcaggtgccttccgtgttcagcgtgtgctgacagtcaaaggcatcagggacggccccacacagaggcctccacacaccttataccttactctgcctggaaaccccacctgtgacctaagtttccttccttggccctgagcctggccatgacctgaacagaccttgaatatgcaaaggggctaattgggattcctgagtctattcgttctgggcccatcttgtcttttcatggttgagacccccatcttcattagctgggaagaaactgtttgctttgccggaggcccgagggctgtgtgggggggtccatcttcagcaagatgtgcagacagagtgagacttcaaaggaagcagtaacacttctgatcacccctaaaccactagccaagctgcagtgtgactggggagccagtggggagcatgggggagacctgggttctgtccctagctggttaagacagacaccaactagatcagttcctggtatacaggaggcactcagtagctgcttgttagaggctggggagatggctccgtcagtgaagggcacacaaaagtgcttgctttgcaaggcttgagttcagttcccaggcctagttagctctgcgtgggggcacatgcttgccatggggaagcggagacaggcagcattgtggggctcactggcaagaagcctaggccatccagtgacactcaggccaactagagtccctgcttcaaaacaaatagtagagcagggccccgggaagaatacccagagttgccctctgacctctgcacatacatttgcatacacacacaggaaggccatttgtcacatatgtgggactctgccagttttaccctttccttgctgtgtaacctcaggaaactgtcttgacctctctggccctcgcatctcagctatggggatggtcaggctttctacctcatagggctgatgatgggttgc

SEQ ID NO: 34598 - DNA, 1177 bp, Mus musculus
ccatttcccgccacccccatcctctgtttagcctacattgcctgcctagtggctgcaagccctagctgaaatcctgtagaggtttacttattccaagaaccagccatctctgcttggttccacccaccaagtgccacctctccatctctggccagcctagcttggctctgaaagccccactcctaaccttgtagagcactgggtctcaaccttcctaatgctgcgaccctttaatacagttcttcatgttcaaattattttcattgctacttcatacctttaattttgctactgttaggaatcgcagtgcaaatatctgatagggtatctgatactccatcccttgtgaaagggtcattggaccccaggggtcgtgaaacactggttgagaaccactgttgtagagatttgcgtttgacccttcccacaaagcccctcccctccccgcacgccctccaagctagctttgctggcagagctcttgctctggctcttccttttgcttgctcaggccagggctgagcttgactcgctctgccccaccccagggcatggcctacctgcacgctcagcactacattcaccgagacctcgccgcgcgcaacgtgctgctggacaacgacaggctggtcaagattggagactttggcctagccaaggctgtacctgaaggccacgagtactaccgagtgcgcgaggacggggacagcccagtgttctggtgatcaagagctggcattgtcggagggggcagggtggaggagacactggggtgcagaagaaagctgggcggggcctagagatgaggcgggcgtggcttaaggaccaaagggacttgactgaagcccactaagccaggttgacttggcttagtaggtgtgtaacccctcaggcagtgccctgaagggtgaggtcccaacgtcctttcacctgcctgtgaactcccaagtccagtcagccagtcctgagcctcttctgtttccaggtatgccccagaatgcctgaaggagtgcaaattttactatgcatctgatgtctggtccttcggggtaactctgtatgagttgttgacatactgtgactctaaccagagtccccatatggtgagtgacagacaccccactttacccttgtgtttgcaagggagcttttctagaaaagcaggcatttacacttc

SEQ ID NO: 34599 - DNA, 1369 bp, Mus musculus
agcccaagctgacctcaaatgtgctacataactgatgacctttgctcctgaccctcctgctgccacttcctaattggtgggatcacaagtgtgtaccaccatatctgcttgtctgtggtgctggaatggtagagtctcagaacactgggcaattgctgcacccgctgagtcacatgctagcttctgcagttctatattaccagtcctgggtggagtgggtgctgagcagccttgaaggaggtgcaggggacactgggcatcatgctgctggcatggcctcatctgctgtcctccctctctccacaggatgccaagtatcacatgcagcgttgcatcgattctggcctctgggtccccaactccaagtctggtgaggccaaggagggggaggaggcgggccccggggacccattgctggaagccgtccccaaagcgggcaacgagaaagacgtcagtgcgtgacccttctccggaaaaggaaacttagccaccatgtccctagctcccaacttcttcacttgtgctgctcctcacatcctggcccatggcctgccccgtgtcccctctcctcccacctgtccccagcgctcatcagactctctgcttcgggttgaggggctctgctgtctgcagcctcctacccccatcagcgttatgccaaagtcctgggggcctggggaggggcagcagttgccaggttggtccaccgggttggggatacaaatgtccccatctaggcaaggtctgtccctatgggtctatggtcactgtttttcttctgtctagcttcctgtcctgcaactggcaacaatgtccaataaacagttccaggtgctggaggccgctggttcagtgctgtttgaggcagagggtgaacctaggtggggagaactggagtgctaacagccatccatgcctttgccctgtcctcacccttcagaagtcctaggccttctgtgtctctccaactgtctgtctcagcctcccctaactcctccctctgtctcccctctccccctagcactccatggagacaagaggacacgagtttgagggtaacctgggcatgagatatatgtggcctttcacactagactttgcctctgctaggggaacatcttattctaaatttttatttgtgtgtgtgtacgctcgcacgcccgaatgtctttttgagataggttttgtatgtatctttggctgtttgggaacacactatatagaccaggctggcctcaaactcagatatccacgtgccactcactacctcttgagtgctggcatcaaaagcatgagccactcctggcttaaaatttaatttatgtgtatgagtgttctgtacgtgtacatgtagtggctgcagaggcca

SEQ ID NO: 34600 - DNA, 1193 bp, Mus musculus
cacactctccactcaccacagaccacctcaacgactcctggccctcctgagaaaaaagaaaacagaaaagtggggttttttctcttttctttttttcacccttccccccctgcccttgcccacagggcctttttgttgaagtggggtatggagagccaggaactgaagtcccccaaaaaagggattttatttttttgaattttaattgtaacgtttttagaaaaagaacaaaaagaaaaaaaaaaaaagagtgaaacacatcagctgtagatgctctccctcccggcccctgggcccacctcgttccctcatcaccctacctatcaacctcagttccaaggcgccatcctcctgcctcttttgagacttgctccttgagattcaagcctaggtgtggcactgccctttggtcagtccctccatacggagggagtctacaacccgattgggaatagccaccgggagaggctgtcacaggagaggctggcccacagcaggcctctccctggctcactgtcctctaccacaaagtcttccatgtctctcctctctgttttctatctttgtttgttcaactctggccacatggtgaaagaggtggtcagacgggctgttgctttatgatccagggactcttggtttcaccccgaccaccagcctcagcctggggtcccaagtctcaattcccttctctggatgccatcttcctggtccactctgggtcactttgaattctctccgttggaggaagggggctctgttccatgcgcacaaacacatcctccttccagctgcttcttcctcttgtttctgccttaacgattcctgtggccataggtgaagtctccatggctccctcctgctccctgggtcctatctcccagcatagatgacactcctttgccagcatccactcaaccacccttcagccccgtcactccactcccctacaccaactctcattgccctaggaggaagcaataatggtggtaccacatcctcccatcctgggcagccctccccccccatcttactgagcctgaccccccacccccagccacaggcagtccctaagcaatacagatagagcaaggccattttctccaagccatgggggtgaggggacttttaaaaaggaatgagcccatttccccctgccacatggaaccagtctgcagcagggcagtgggggc

SEQ ID NO: 34601 - DNA, 1220 bp, Mus musculus
cttccagtgtgctagatggactggattccacttagtcctgggacagtaacagaccactctcggttgacagcagaagtacatcaaggtgcacttcagtgaaggtgatttcgtccaccaataggaaactcagcccggaacagacctgaaaatcttaggccactgggggtattttggggtcaggcaccggagctcctcagaagtttcagggcagctgttcagaggctaagccaggtaggcatggtccagctggtccagaaagaccctgaactgaaagtgctttcctccatccgcctgcagatcctcagctcctcctcagtcacggaacggtaccccatgttcacagtggctgaaggccacgctcaggaccacagcctggatgccctctgcacccagctgtcccagcccacactgcggctaccttgcacaggacgactactcaaggccaaaaggcccagctccgaggactttgtgtttttataatgggaagggatggggaaagatgccagactatttatttttttatttatgtcatgtcaggtatgggatctgcaactccagtggtggtgctggacccctgtcctcatgtccccgtcctccccaacacagctgagacctatctgggcccccagctgcccctgcctcctcaggagccagggaaggagagtgggctccagggcactcactcagggcctaattcaagttctgtagcctgcattgggtcactggtcccaaggtcccaaaggtcctgtcctgggagaactgactgtggctgataaagatgcagacttgaacatgcctggcgttgttgacatttcaggctgtctgtggagaagacagtgctctggtagcctcatttcaaagcttaggaacagcagtgccctctcctgcaggtagctttcgtaggctgccaggcagagtttggtcagcagcttagttgtagaggcaggttggctccctgtggccctcaggagtggctctgctgtttcttccgttggcggcctaactggcggaagtgcagccttttggggttgagaccaaaggcctgcaatctctgtctgctgaacttgtgacctccaagtgtcaccgtgggacccagcagcctggccttcttgctcttctgcttctgggatgctggcttctctgggcaggatgtgtgggccaacccctcttccttggatactaaggtctcagcctggggtgtcttctggtcagctccattg

SEQ ID NO: 34602 - DNA, 1884 bp, Mus musculus
gtcagcattaagccatgtgagatccccctgggagagtggcatgggaaggcctagtgtgtggctcagtggtagaacccctgcctacagtcccccaatgaggggccagggctgtggctatggtagagcacctttctatctttgggatccagcctctgccaccaaaaaaaaaaaaaaaacaaaaagagagagaaaaccaacaacaacagaaactagaacccacccaagcgaatgtataaccgagactagcacatgcacagtggagccagttgtttccttgatgattgcagggctacgaggctggaactcacgctgcctctgtttgccatcaagagagagttccagacagatatcactgatacccggaggataaggagttcagggttgtccttagctacacagttctaatgcagcctgggtgacagaggtggggatgaagagaagtttctcttggtacataatgtctttgcattccataaggttgaaaaaaacaaactgaatcattgacatattatcagggatgtttttttttttttttttttttttggttggtttttttgagacagggtttctctggctgtcctggaactcactctgtagaccagcctggcctcgaactcagaaattcacctgcctctgcctcccaagtgctgggattaaaggcgtgtgctaccactgcccggccagggatatcttaatttcctgcttttctgaaaagaatctcaccatatatccaggtggactccgtcttaccacccttgtctgcttctcggggactgactgcagttacagaatataccagcatggcttggaccttaaatttatttgctgtaaatgttttgacattaatctgttgggggggcatcacatgttccatggcacgtgtgtagaggacatgttggtgggactggatctctagctaccgtatgggctgcaggggttccagtccctcagttagttttgttgtgtatttgtggtgacgttgggatagaatgtagaacccagggctctgcgtatgcaagcatcagtgactgagcactagtcctgcagctcttcttgccgttagcatttgctgtactggaaaaacagagcaccgggtgttgagaaatctgtaagaaaagtctgggccccatgagagccccaagtgggccacttgccaagcagaggaagtcttgggaagaggctgaaggcacattggtaggctcagtgagggctgtggagcgctgtggagttgtctgctttcttacatttaaggcacttctcagctcttagctttggtttctccatggaggagcaaggtgctgttgctcatggtagctgtaaaaatgtcatcaaggacctgctccaggttgagcatatgcaaattctttattatgtgcacgataggcctaaagagatggctcagccttaaagcgtattggctattcttccagaagaccaacgttcagttcccatcgcctccaagtcacctcatagctcactgtaactacagtctaaggggatctgattccctcttctggccttcaggagcgtcacacatgcatgtggtgtaggcatacatgcaggcaaagctccatacacactgagtaaaaataaaggcagtaaaaaatgaaaataaatgcacagtagatcatgttgtcttctggtaggcccgcaatagatgtgtttctgtggtgatgtgcccagccccaactgccatgtaattgtgagcctactgtatacctgtatagactcagggatcatggtagccatggagacccgtggctgcagtgtccttgtagaatcacaactgtggctcagatatggattgtagtgttaggggtggtgccagggtttttgtgtgtattgggacagcatcctatcacctgagttccaggctcaggctca

SEQ ID NO: 34603 - DNA, 1163 bp, Mus musculus
gatggttgtgagccaccatgtggttgctgggatttaaactccgaaccttcggaagagcagtcgggtgctcttacccactgagccatctcaccagccctctttttttcttttttttcaagacagggtttctctgtatagccctggctgtcctagaactcactttgtagaccaggctggactggaactcagaaatctgcctgcctctgcctcccaagtgctgggattaaaggcttgtgccaccaccgcccagcttttttatttttcaccttaaattgccaagtcttctgcctaaccctccccagttgcagcactatcttcaggctcgccataaataccttccctacacccttttttaaagacccatctagggggctggcgagatagctcagtggttaagagcaccgactgctcttccgaaggtcccgagttcaaatcccagcaaccacaaccatctattccaggccttcatatttaaccaaggatcaccttgaactcctgagcacctctgtaccttctaagggacagggtgacatgcataccctaccacagtccattgatgtggtgcagtgatcagtgatcgggagggaacccagggctttgtgtatgctaggcaagcgctctaccggctaagccaagccctcattttctggataaccctttgagggaaccagcgagctgctgttatcttccattggcaagatggggagcctgaagtttggctccaagagggtaaaattgtccaacagttttgtttgtctggttttgttattaatgctataatatagtcccagacagcctggaaatcattatcctcctgcctcagtgctgcggggatcacaggaatgctcgatcgtgcccagtttacgtggtgctggggctagaacccagacactcttgcatgctagacccatgatctaccagctgggctcaacccctcagcttttagctggctccagctcataggctccaggagaggagtccttccttatcatcagcagacacaggcagcctgggctcgcctcacctctgctgggagtgggataggcagattccaggggcttccctgcttgcaaggacactgtgatatacatacatacatacatacatacatacatacacacacacatttacacacacacaaacacatgcttgagctcacacac

SEQ ID NO: 34604 - DNA, 1152 bp, Mus musculus
ctggagagaaatgacggttcagccgagaggccttacttcatgtcttccactctcaagaaactcttgaataaaaccaacaagaaagtagcagaatcctaaagacacctgcctcccagccctctcaggacgccgggataggtgcttgctgtgcagctgggtcagagtccccagctcatcagacttgcctaacacatcactgcctctctgcaccctccccgagttcccatttccaggaacctagaggactggggcatctctttcctatgccaaagggcacttgggagttttcagtgcagccctggaagatgggacagaatggatctctccagctcttactggctcagatggtgccaatatggtgaagtaacttgaagtcgaggatgggagatggccctaggatgtctgcagcaagcttctttgtatttcagtaacccttctggccaagagggaaagactggatgagagtgggcaagtcagctcagcgaacactagcgccaagctccccagcggggacagaattggatctccatagctgatgtacctaagggccagcaaatacacgtctcactcttagtcctttgtagcctaggcagacagtaagggatctacctgcttctcttccatcaggctccagaactggatggagccaccaagagtgccttcatatgtaaccccacctccagcgtgggctggctatggtcacaggaagaagtgtgcacccagaactggaggagtcttctggataaacagacagcatctgcgaggagggccctgtgtgaggaacgattggtgttgctgctggtggttgggagtagttgtggaaagcaggcctctgtacttagaccctacagagttgctttgactgatgacttctaaatggaaaacttgaggttggaaaatgaatgaaaatagggcctgtctccccagccctttttctgccagtaatgcacactgctctctttgtaagagatgagaaacttaagttcacccaagggatggtttcagggactgaggtgtgggtgtgttctatattccaaattaactaggcctatctggtttctttcacttgaaactagagaatctgtttgccaaacttcttgatcttgggagccagtagactggttcttcactttacctaccgtatgctaaggc

SEQ ID NO: 34605 - DNA, 1269 bp, Mus musculus
gttacctgcggtccaccgcagtctgaaaatattaagtggaaatttccagaaagaaaaaattgataagttttaaattgtgcaccgtcctgatgcctgcgtcattcacctcacttcatctcatcacgtaggcattgtatcatcatcacttcatcacaagaagaagaagggtgagtaggacgatgctacttggagacaacattcacattccgtcctgtctaagcctttcctgtgcccgattgaccgattaaactactgtacctgtgtgtgtagaggccaaacccagaccgtattggttttggtgatgtccgcggtttaaggcttccattggggtcttggaatgtgtaccccgcggataaggggggactactgtagtatagcgatacgtagagtgccccattcctgctgcagcctggagagtctcctctcaggtcctgggtcacgttcccatagactgtcttctgaaggatggaatggtactgaggtgagggtgggctgctggctgtccttgcatcatttttagcgtagttttcgcatttccagcgtcccatgagaatttttgtgaatgatgatcgccacgtgatggcaaagcattcttcagtgtacccaacacaagaggagctggaggctgtacagaacatggtgtcccatactgagcgggccctgaaggctgtctctgactggattgatgagcaggagaaaggcaacagcgagctctctgaggcagaaaatatggacacacccccagacgatgagagcaaagaaggggctgggtgagtctctgtttttgtttctgtctgtctgcctctgtgttgtgtggtgtgtgtgtgtgtgtgtgtgtgtgtgtgtgtgtgtgtgcgcgcgtgcgcgtgcgcatggatggatggatggatgtgtatatatgtttgttgaggagggcttaggtcttttcaggcagggtctcatgtagcccagacttactagctcactatatagccaagcctgcccttgaattcctgacattgcatgctgctatcttgcctagctcatttagtgtttctttttttttttgctggtttttttttgtttttgtttttgtttttgtctttttttttttttttttgtggcaggatctcactggatagcctgtgctggccttattttgtagcccaaggtagcatgaaaatcacagagatccttctgcctcagcctcctgagagttgggattacaggtctgtgtcaccatgtggcacagataagctagcatctcttctaagaagtaccaacctctct

SEQ ID NO: 34606 - DNA, 1185 bp, Mus musculus
tttgaccaacaggactctctctgtcaaggcctggggctagggcagtcccgcctggtgggcggaggtggtcccctgcgctacaggtggatgcctgtttgtgagaagcagagagggagttcatttccactcccccacctctttttttgtttttgttttttgttttttgttttgttttgtttttgtttttcctattgtaaattccagcctagctaatttgtggggatgtctactagaagatagggttagcctatcttttcccttccctaccgattgttccttttagagtaacttttcttttttgattttggtttttgtttctgtggtttaaatttgggagagggcctcccaatttttctgacttcctctcagagcagagctgatggcactttagcctctccttcccttgtccagggtggacacaaattgagattgtgggagactcagctgccctttaggaagctgccacatcccctttgtacctgacagaaccccttggtcaaactgtgccttgtcttcttattccatccatgaatagaaacgctatcagtcaacgatcccccggacgttctggacaggcagaaatgccttgctgccttggcgtccctccgacacgccaagtggttccaggtttgcattttgttcttctctttgtcttttggtagagaatgcctaagttttgcaacatggctaactttgaccataaagtgtccataacattgactgtaaccgtgccgatcttgttagcacctgcagcgtgcagctgctaaaggaacgcgcctcaatcaatttgacttgacagccctgaggagactcatgctgagcgggggctgctttgcaataagggtaacaggcttccacatatacaatgcgtgagatgctggccacttacttggtggctttgtacccctgcaatcgtgtacccttggcaaagcagcaccatgagactcaagttttttcatgtttgcctggtgtcctccatggtgccctgagtatgaagagtctgcactttcttcctctaggccagagccaatggactgaagtcatgtgtcattgtcatccgtgtcctaagggacttgtgtacccgagtgcccacctggggtcccctcagaggatgggtaagacacacttgtgactaggggtggggttagtgtttgtccaggcaggccctttgagagtgtagccttc

SEQ ID NO: 34607 - DNA, 1210 bp, Mus musculus
acggggggcagccacgacaaaaggtttgttatggaggtgagtaagcaggtggctggctagaggcaactctgagcttcctgggaaagaagtaagtgctctgggggaaggcctggtcctctccagaaaggctttggggataggctctcaccctggaggagatgctgggttagttcagcccctacacactgtgtgtttctacaggttgaggtggacggacagaagtttcaaggtgctggttcaaacaaaaaggtggcaaaggcttatgctgcacttgccgcattagaaaaacttttccctgatacccctcttgctcttgaagccaacaaaaagaaaaggaccccagtacctgtccgaggtggacccaaatttgctgccaaggtgaggatttacctttgacccctctgaccatgggtggaaatgtggatgatctgaaggtggggcaaaccccattcctctgcgttctctttcagccacacaaccctggttttggcatgggaggccccatgcataatgaagtgccgccacctcctaacatccgaggtcggggccgaggaggtaacatccgagggcgaggacgggggcgaggatttggtggcgccaaccatggaggaggctacatgaatgctggtgagggacctttttcatgtcacctactggcctactccaggaatgattgtgtagtacctttccttgggaggctcagggtgagtgcatgtaaccctgtaacctgtctgttcttttgcaggtgctggatatggaagctatgggtacagcagcaattcggccacagcaggctacagtaagtgcactttctgtgtctgcacttgggaagctgcggcagcatagtctgggtctcattagggtagggtgctggcctcagcatctctgaggctcaaggccaccagccgtacctttttgcggtgaataggttagctggccctcaagacccccacctccccatccccaaagtgtgtccttgacagttttaatgctaagacagcctttgagtaccacttaagttcctttgaagtcggcattttaaatttctctgctttaagcaccagtctttgagaatgcgccttcctgcccatgcaccgctcttgtcttgagaaggagccttcattggggggtcacacgagcagagaaatctaaaacctgaatttcaaatgtggcgctctgtgccctttttcaaaagaattctaatttcttc

SEQ ID NO: 34608 - DNA, 1610 bp, Mus musculus
ccgtgctgtgtccctgtgcttcactggggttctcaaccgtggctttccaccgcagcctgtctgaaactgttagcctgcagacttaagacaatggcagtttctatcatgaatttgcctttgagcttggtcatttcgaagttcacactaagtggaaaaacccttttctcagagatttttttgtgtgtgtgtgtgtgtgcagccttgcacagaattctagagccagcgttgttcagcatcaaggcaaaagcccacctttgctttttatggaaagcattcttttatttaaagagacagatactggcacgtttaatctacctttgtcttaatttacagcaggttttgtatgcatttttaaccttttcacaagtttccacttctggttgatgcctttggcagtgatgaaactgtttcagcacatgtgaatccacaatagctgactctttccttgcctttttactgagcatgtaaacctccgggacggccaggactgtggactgcatagagcagggcctcccaccttttgtatatgctctggtgggtccttggggcgaggaggttctgtggctgttttagttaagaaagtgaactcgcaaaggcatcaaaactgcgcttccgttacttgtgtgagaaatgacacaggcttgagaggaggaaataacggtaaaattttgcaagtcctgatggcagcgtcagtgacggactcctggattggatttggctatgttttctttttcacaatggggctttaaaaatgagctggaagagtcttgacaccatcaccagaggtttttcccagctccccctacccccaccatgatctacactgcctggcacacagacactgaatctgtgtgcctagaaatttgtcccagtgtgtaatgtacagagtcccttccttttggtggggagtcttgtgatactgtggctaggcccctgctctgcagtctttgctgcagaactgcccctgccttgacttgcaagatttgacgtttattcaggcaaaaagtggtcaaaatggttactgtgtgatttgtttcccaaggttcgaaaagtcagtgaaactttctaagattttgcatgatgtattttattttatttttattttttagaaagttattgttggcaaataatgtctttttataccaggaaatagttctgaatgacgttgaagacctacccttccttattactattattttttaaatgaatacatgttaaagtaatgagccctccgtacttgagtcttcattcatgcctggcttcaggcaggcagctcagttgctcagcaaaggaccctggggaagctagggcagggtttggaggagatactggggtggggttggggagtggggagtgatggggccctcggcttcccagtatcctcactgagtctccatgtgtttgctttcttgcattgtggaacacttcctcctgcagtgttgtggctttgtgatggggatgggagagacctgtctagaggagggcctgcacaggggtattgcctctcctggtgcttgtgctggtagctgggggcagcatcagcatgggtgtgaggtgtgcatccacaagggggcaaagggaaggggtggtgcccttagttttcaacctgg

SEQ ID NO: 34609 - DNA, 1196 bp, Mus musculus
gggctccattctctggccagaaagtcaacacttgacatcagcccctagaggcttgtcccacttctcagggtagcagtgagtgagaggcctatatgacaaagcaggagctgccacctcagcgtacaattctgtcctctaagccactttcatcttgcaggaggctactcatcacagtcaaactacagctcacctgggtccagccagagctacagtggtcctgccagctcctaccagtcctcacagggtggctacagtcggaacacagagcacagcatgaactaccagtacagataaaggcccaggctgcctgcccctctcaaccttctgcacctctgcctccaacttgtctcgggagattgagtctgcacatcaccagttgccatgttcactgggccagtgcccacccgtccacgttgctgacattgccacgctttgaggtgtggtggtcgctgggacccgtgccgtgacccctatttagctgtgttttggactccgtgtcttcagtggtttgttagttaccattacgtaaaccttgtctgagtagtgttccgaggtcttgccgttccggatccctctgtctgtttatgcctggtgtgagttccatcgggtgtctttaaatagttgcagaagggatacgtcatctgttaatgctttttgtgaagtgagttaatgagccttcattattttaatgcttagtgtttcagttttataagtgaaaattttattttaaaaaacagtggtttttttttttgggtatgtctggatcattcagacagtacatttgaattccgctgaatgtagataaataaaagaaaaacaaaagaatgcctgtctcaggcctgggtgtctgaccccccagccatggaagaggggagcaggtcagagaagacatgtttactagcgagagtccatctgcaggccttccaatgtcttctctgtttggatggtgttggttctccaagtcctcattcactctacaggaccccagcagtctcaaacttgcacaactcctcctacctcagcctcccaagtgctgggatgtcgggaacagggggtgcatcaccacacccaggtttgatatggttttaagtctaatcttacactgaggcagagcagactgggctggataaggtcccccagtttgagctgggactggagcttgtgcatgcccaagggcagtggttgtcagcctcgag

SEQ ID NO: 34610 - DNA, 1180 bp, Mus musculus
tgcttggtctttgtcttggccttaaaaattcttacaaaccatgatgttacaagctcctgcatcatgtcagaggctgctgtcagcaaacttggtctgaaggacatgtccccatcttcccagatctcataatttagaagctctgagctgaacaggaggaaagtccatgtttcttccactggtggagggaagaaagatacatgggggccaacgagatagcccagcaggtaccctctgctctgcccgactgcctgagtgtgatctgcaggcagaagcacagaaccaactgcaggttgtcctctgacctccacacacacaggcactgacaacacacacaaatgtgcacagagggctgaagagatggctcagtggttaagagcaactgctgctcttccgaaagtcctgagttcgaatcccagcaaccacatggtggctcacgaccatctgtaatgagatctgacgccctcttctgatgcatctgaagaccgctacagtgtacttaaataaatctttaaaaaaaaaaaaaaaaaaagtgcacaatgctaggcttacaccagtaactgcagagttgtgtgagttgaggcaggaggagactgagtttgaagataacatggcctgcaaaagaccctgtctcaaaaactgaaacaaaaacaaaacagaaaagtaaagcaaactgtctttgtgtccttttcctttgaggccgtagctctcacctcataggtgtgtgtatgctagtgtggagatcagagaacagcctgcagtgtcccctaattggtttctctgtgttagccctggttgtcctggaactcactctgtagaccaggctggcctcaaacctagagactgcttgcctgtgcctcctgagtgctgagagtaaaggtgtgcactgcctctgccacctagccactacgcacttatttttaaatcaaggtctcattgtaactcatatttggctgtgtagtcatgcttgatcttgaccctctaccccttatggtaggattacaggctagtgaatgtcagcacatccagtttgcctgtgttgtagatagggcccagagctccacacatatgtggcaagcatccggcgagcatgagaaccgcagcctggcttagccttattttcttagacaggatgtctcacctacctggaacggtaccagtaggttaggtctgctggctggaa

SEQ ID NO: 34611 - DNA, 1243 bp, Mus musculus
ccccaatctgggagcccctcgggtgggctggaagggctgggtccccatcctcaccctgcttctgccctcactaccctccacctccccgtatctttactttctttgcagcagaagagcgcccgctgcgcccagccggcccaccattatccgcccagccgagccgtccctgctcgactaggctgcagggggcaatgttctgggggggtcctcgtgcacccacagtgtaggacagttttggtggtctgggccctgctacttgccctccatgctgggaccaggctccccgtgggcaagccctgccctttccctcctcgccctagtggacatgacaatgaagggtgaggaggcccacagcacagcacatgggggctttgcactttgggatgaggaggagctctggctagcagaacaggaactgcatccttgggaccatcaggaaaaaaaggtccaggctagtgtggggggactcttctggagctcctccagagcctttgttctttctggggtccaggaactgcccacctttcctaaggactcctcaggagtgagccaggcccagcaggtccagtgctgacccacctggctcaagttgtatatatagagctcctttggccatattaaccacacaagctgagcccagcccaggctccgcacccagaggtgcctttgtgccttcctcaggcctggagggcctcagctctggccaccctcactctcctcagccccggttgtggtttgggctgtatgaactggggagacatcagaggcctcttggctcccaaccagatgtccccacagggtgggccctgggtgcctctgcagcctcggctcccaccgcctggattgaccactgttaagtgcctgcctctgtatatcctattaataaactaaaataaagggaagccctactggtggctacgtgtgtgggccttttgtgtgtgtcccagctcaggagattgagcaccccctcatgaggctgcccacactcatttacacgcgtgagtcttgtgtcatctgttctgagcccctcttgtccccatccgtaccaggcctcacacacagtgctcatgggaaacaggaattctatccacctctgtgcgatgctgtggccaagccctcctcccagccccgccagccaccgggaccaggggactcagttcattcagccatggtttatggtctttttctttcgtgccaggcgaccacctccattggctcctgcccgacctttcttctgagcttc

SEQ ID NO: 34612 - DNA, 1212 bp, Mus musculus
cactgaactatttttgagacaatcttaggttttccaagctgggctctacttgctgtgtagcctaaagtggccgtaaacatcatgccacttctacttccctcctgctgggatagcagaattttaccaccatgcctgactttggggtgtgattaaacttgggttctgaaggcagactaaactggatgtgttgatttctaagggtctctgtagcaactgaccacaagtttggtggcttagagctgttgggatatagtctctcatttcctggccacaactccgaatcaaggtgtctccaaggccactttccctctgggtgtggagggaagacggcttcctctcttgcaggttccaggggctccagataccactacttggccatctgtagccaaactccagatacccctcatttctgtgacttctcatttgtatctgtgtacttgtgtcctatttttgttttgttttaagatggtctcatgtagagtcttcttgggccctagtgccttgtccagaagacaccaactgtttcagccacctatatttccagaccccaggatctgaatttgagtttgttcatgggctgtaaggagggtttgtcagaataccaagaggaatctagtgcctctgctgtttatcaatctctgtgggtactataagggcccggcctgaactcagggatcttgacaggtggtagttagtcagctatatagtctagctagccttaggacaagtctgtgcctatttccttacctgcagcaacgcttttctgatagcctgggattcctctggccggctgaagtgcatgaggaagagaagagagtctggagcaggggatttgtagcaagtgtttgtcaacagagcatttctaaaatgacatattctttggtaatttcacatatgaatacattgtatttaaaccatatccacactgaacaaaactcttttacagatgttatttttattttgtattgtattgttactgatattttgaaacaatgttttatgttgctcaaagtggcatcaaatttgcagtatagctgatgaccttgaatttctagtcttcctgcctccatctctccaggcctgggattagagacatacagcaccatgctggtttatgccgtgcgttgtgtgtggtggcagactttgtgtccactgagcttagccccagtgttcatcagggtagcatcagaaggaggagctggctctctagga

SEQ ID NO: 34613 - DNA, 1246 bp, Mus musculus
tgttttcaagtgctcggtgtcccgagagacagagtgcagtcgtgtgggcagacagtccttcatcatcaccctgggctgcaacagcgtcctcatccagtttgccacaccccacggtatgtgttttggctccatggtagagcccaggagatggagggatggctttttttttttttttcttttgttttttttgagaaagggtttctctgtgcagccctggctgtcctggaactcactctgtagaccaggctggcctcgaactcagaaatccgcctgcctgtgcctcccaagagctgggattaaaggcatgcgccaccactgcctggccaggatggtcatttaatagaagtgttaccatacaaacctgaggacctgagctcagttctcagcaccacatgaaaagttaggcttagtatagtacacacgtgtaatctcacagcgagggagatggagacaggtggatccctgcagctcactcaccagcaggccttgccctatcagagctccgggctagagagagagaaagtctgcctagaaaaactaggtggggaagagattcctaaggaatgacacctgccacctggagctgacatcttgcctctactccacatgaacaggcaacacacacacactctctctctctctctctctctctccctccctccctctctctctctctctgcacttgcatattcccaatgccttggcatatacttgtagccccagctgctggggaggctgaggcaaaaggaaggatccctgcctgaagataaaagtaagttatagttgtgggcaggtgtggtggcacgtgttcatcatctcagctgctcagaaagctatgatatgaggatcacttgagcataagagtttgaaaccagagctggagagatggctcagcggttaagagctccgactgttcttccaaaggtccggagttcaaatcccagcaaccacatggtggctcacaaccatctgtaatgaaatctgatgccctcttctggggtgtctgaagacagctacagtgtacttacatataataaataaatatttatgaaattaaaaaaaaagagtttgaaaccaacctaagcagcttcatagcaatacccttgctctaaaaaaaaaacaagaaggaaaaaccagcccatgaagagacttttaaacagatgccctgcaccagtatctcactggctgctgtgaatcctctggatctcagttctttgtttctccaaaagggccaaactgactctct

SEQ ID NO: 34614 - DNA, 1300 bp, Mus musculus
ttgctatgggaacttggacaattttgtacacgatgtcgccgctgccctcaagtacccccagcccaacctttggtcccgagcgcgtgttgctgccatactttacatgagatcctgttggggcagccctcatcctgttctgtactctccactctgacctggctttgacatctgctggaagaggcaagtcctcccccaacccccacagctgcacctgaccaggcaggaggaggccagcagctgccaccacagacctggcagcacccaccccacaacccgtccttgcacctcccctcacctggggtggcagcacagccagctggacctctccttcaactaccaggccacatggtcaccatgggcgtgacatgctgctttttttaattttatttttttacgaaaagaaccagtgtcaacccacagaccctctgagaaacccggctggccgggccaagccagcagcccctgttcctaggcccagaggttctaggtgaggggtggccctgtcaagccttcagagtgggcacagccccctcccaccaaagggttcacctcaaacttgaatgtacaaaccacccagctgtccaaaggcctagtccctactttctgctactgtcctgtcctgagccctgaaggcccccctccatcaaaagcttgaacaggcagcccagagtgtgtcaccctgggctactggggcagacaagaaacctcaaagatctgtcacacacacacaaggaaggcgtcctctcctgatagctaacataggcctgtgtgttgcgttcacattcatgttctacttaatcctctcaagacagcaaccctgggaaggagcctcgcagggacctccccagacaagaagaaaagcaaagaaggaagggtgattaataagcacaggcagtttcccctattcccttaccctagagtccccacctcaatggccacagcctgccacaggaaccccttggcaaaggctggagctgctctgtgccaccctcctgacctgtcagggaatcagagggccctcaggcagctgggaaccaggctctctcctgtccatcagtaatactccttgctcggctgcccctcccccacctttatataaattctctggatcacctttgcatagaaaataaaagtgtttgctttgtaagaaaagcctgcaaaacagcagggtagtctccagggtccaagaatcctcccatcttcatagggagggcaggacaagtagtatccccttgagtttggcctgaaaaagaaagactcctaggaatggtcccaggaggagggtacatcctcaaccaac

SEQ ID NO: 34615 - DNA, 1160 bp, Mus musculus
cccaccagtatggtcaccagatatatacttgttacattaggtcctgtggcttatcccagtgcagtggatacagtggctctttggagccctgggcctggccttgtcagcagccgggctggtattcacactgtggcctgttgtccgagaggatacacggctggtggctgcggcactattgtctactgtggtgctgcttcacgccctcttggcgctaggctgtaaggtaggttccaggagattctcaccagggctgtggagtggggtgtgctgccacccaactgtacattcattctgaggtctttctgcagctgtacttcttccagccactgcctctggaccatgtggtgccagcaccccaagctacacctccatctcccaatgtcctgctgcccagttcaatccagcccatgacaacctcctaggaaggctcataggtgagggaccagtttctgtgttggttgaggatgtaccctcctcctgggaccattcctaggagtctttctttttcaggccaaactcaaggggatactacttgtcctgccctccctatgaagatgggaggattcttggaccctggagactaccctgctgttttgcaggcttttcttacaaagcaaacacttttattttctatgcaaaggtgatccagagaatttatataaaggtgggggaggggcagccgagcaaggagtattactgatggacaggagagagcctggttcccagctgcctgagggccctctgattccctgacaggtcaggagggtggcacagagcagctccagcctttgccaaggggttcctgtggcaggctgtggccattgaggtggggactctagggtaagggaataggggaaactgcctgtgcttattaatcacccttccttctttgcttttcttcttgtctggggaggtccctgcgaggctccttcccagggttgctgtcttgagaggattaagtagaacatgaatgtgaacgcaacacacaggcctatgttagctatcaggagaggacgccttccttgtgtgtgtgtgacagatctttgaggtttcttgtctgccccagtagcccagggtgacacactctgggctgcctgttcaagcttttgatggaggggggccttcagggctcaggacaggacagtagcagaaagtaggga

SEQ ID NO: 34616 - DNA, 1136 bp, Mus musculus
gagccagaggaaatcccaaaaagatctcagtaagatcccttctcaccactctgggacctgtgtactcacccctgctcatggccttcctgctcctccgtctactgcactgatctatgctgccatacagttcaattgtttccaccatgggacctagaggctttctgggtcctcttctaagcctctcaccaccaatgttagcataactcatttgcctaccctagtcagggaccttcatgacttccctaacaccctctgagttagccagacctacccaccttctgctttccatcttggtgcctccctcaactaaacacgagttttgctcttcatgcatgactgcccatttcagggcctggtacagtcccatgtttaagtaaatactacattgattcaaacataaacccccatttaccatataggtcgggacggtttctaagatggtgccgcacaaagttgtggccaggatggggcagcagggagcctttgatcctgtccaagacctggaaagcaaagcccagggtctagaatgagaatcctggtgttctgagaggtgtcagcacatcctactgaacaagctcgaacatgtcaccactgtgaaggtggatttcaggcctgtcaccttgctttcagcttcttgcagcctctcctctcaaagtaaggacagtccctaagttctggatggtcttgcaactacatctccaggatgtaccctctcactggacctggtctatcattagaggttggcttgactgggaaacattctggctttaagtcacacacctatccacgcctactttgtaacctagcttttgccttccagccccaccatacccattcagtcctcaagtatagtggctggactccaagcaactccaagtgccttacctgggaggtatccacatcaaaaaagctctgatagtagtcaaatgtccagaatctgggctgtggtttttcttcctgtagaagctataagacaaaagactcagaacttgcctgctcagccagggtaagaacagaggcagatcatcggggcctaggagactcactgatgtcttgtcatcctcttcctcccctacttcagctccatagccaatgcctgaacccacaaccacagccacgtgctctcgggaggtcag

SEQ ID NO: 34617 - DNA, 1200 bp, Mus musculus
tcccactgccacatacgtgtacacacacacaatcaatcagtcaatcgataaatgaattttagatggtgacagagcccggagcaaggtcttctgggtgtctgtataactgtggctgagcttttgcctggcccatttatgatcctgtgtggtcagtcttctgaatggaccctgggtggagcatcaaagtaaaggagcactagcctttcctaccttcaggaatcaagtctgggttcacagtagatattgtgccctgagccagccatgctggaaggatgtcagtctgggggcgtcctccctccctagccgggccccaagagtacgcgtctcggcctctctgtatcgacctgggtgctggctgtcctattttaccactattgaccctgaaggctatcgaggagggcacgctggaggagatcgaagaggaggtccggcagaagaaatcttcacgtaagcgtaagcgagacagcgaggccggctcctccaccccgaccaccagcacccgcagccgtgacaaggatgaggagagcaagaagcagaagaaacgtgggcggccacctgctgagaagctgtccccaaacccacctaacctcaccaagaagatgaagaagatcgtggatgctgtgatcaagtacaaagacaggtaagctgaggcagtgctggaggggtccctgagagtgatggagaagcatagagtaggacctggtacacagctacactggaggcctgtgttttcatgcccgacctagaacgtctagggatacatacaagtatcttccatcatgacaggaaaagagcaagtggcagaatagagaggcactatgtgggtgtcagcaaaggtggcatgtgacggttgctctgtctgaaggagtgcaccctgcagtagcagcagcagatgcagctgttggcatggtgattggcacttaggttgtggcttgatatatgacgactgaagcctctgttcttcctgctgtgtccgtagttcttcctctccctgtgtcatttagatgttgtgagtttgtggaccatgtcttgttccttgctgggttccacttactcttagagtggaatgtctggtgaggtctggccacatgtgagacagtgcatgttttctgctctgccgaagccggcatcaggctgtgctgctcctctgtggtgatgccgtgtggttcccacgaaggccttgcctagcctgaggtggga

SEQ ID NO: 34618 - DNA, 2052 bp, Mus musculus
ttatttattatatgtaagtatactgtagctgtcttcagacactccagaagagggagtcagatctcgttaaggatggttgtgagccactatgtggttgctgggatttgaacccaggacctttggaagagtaatcagtgctcttaactgctgagtcgtcttgccagcctccttgatgcagtttttttttttttgccacagtaagataatttatcccttaaggatctaggcccttccacagcattgagaacaccatggacaagggagagtgcctaggccgcagcctactcacaaactattccccctgttctttcaggaccgctcaggaagtggcagtgaggaagactgaaccagacattcctgagtcctgaccccgaggcgctcgtcccagccaagatggagtagcccttagcagtgatgggtagcaccagatgtagtttcgaacttggagaactgtacacatgcaatcttccacatttttaggcagagaagtataggcctgtctgtcggccctggcctggcctcgagtctctaccagcattaactgtctagagaggggacctcctgggagcaccatccacctccccaggccccagtcactgtagctcagtggatgcatgcgcgtgccggccgctccttgtactgtatcttactggacagggccagctctccaggaggctcacaggcccagcgggtatgtcagtgtcactggagtcagacagtaataaattaaagcaatgacaagccaccactggctccctggactccttgctgtcagcagtggctccggggccacagagaagaaagaaagacttttaggaactgggtctaacttatgggcaaagtacttgccttgccaggtgtatgggttttgcattcccatcacccacacaccctaaacaagccaagtcagtgagcttcaagttagagcctccacctcaatgtgtacgtggaaagcaatcaaagatgatgcctagcatccacctctggccctcatgtgcagatgtacacacactgaattacatacacgggacacacacatccacacggaggcagtccatgacttgcactggggagatggtaccataggcgaaagtgccacaggcacagggccaggctaatttagtcctgcagtcctgtgctcttaagatgaaggcacaaagaggaaccccaggcgctccaactagcatgccaggcagtgacaagaccctgcttcaaatgaatcagagcccacattcagtattgccctcttacccgatgcgatgcccatgccctcacatatgaatgtgtatatatacatacatacgtaaaataattcttttttaaattatagacatttttgtgtgaatgttttgcctgaatgtgtgtgtgtgtgtgtgtgtgtgtgtgtgtgtgtgtgtgtgtgtatcaagtacattcctagagcctacagaggtcaagggagggcattggatctggaactggagtcacatgaggctgtgagcaactgtgtgggttcctgggcctttgcaacagcagttagtactcttcaccactgagccatttctccaatctcaaaaagaagcattcttttaaatgaagactgaaataaataagtaggacttgccttggttctgtgcctataagccccagttctgcctgcagcccttttgccctccagttctccattaccgctcagtctttggccatccgtagctaccagctgccttgggagccacagttgtgtgacagctctaaggcgaaaggggaagtgttgtactccaagagaagtgttgtactccactccagtggtggaagtttgtcccaaggtcttacagctctgaagagaaaggtctcctggaagtctagagccaaggaataccacagagacacactgtacaacaaaccccacaggagacttcccaggagggaaagatccgagagtgtggcagcagaggcaaagatctccgatttcaaggcctgtatagtgaattccaagattcatagggttcataggccctgtctcaaaataacaaaaaatttgttctggggccaggcatatagtatacaccttta

SEQ ID NO: 34619 - DNA, 1219 bp, Mus musculus
tctgcccccaggtccacgccctttctaatgctcttggccgtggtagcagtgcagacttgggtttcatgtcatgaggatctgataactgttggttacttggcacaactttagtgccaatattgtaccagtatgttaggagatcaggtggcctgtactctaatctcaatacccaggaggcagaggcaggcaggtctcctctgtaagaccaaagccattctgttctatataaagttcaaggccagccaaagctacacagtgggaccttgtctcaaaataaatttaaaaaataattaactagcagggcgtggtggcgcacgcctttaatcccagcacttgggaggcagaggcaggcggatttctgagttcgaggccagcctggtctacaaagtgcattccaggacagccagggctggctacacagagaaaccctgtctcgagaaaaccaaaaaataaaaataaaagtaaaataataataataattaaccaattaaattcaatatgtttttagactttttgttcaatagccctgatgtcggtattaacgtctgacaggttgccctggctatgctgggtacatttgtcacctctgttgcgttctccggttagctgatgcagccatctttgagttctgctgttgacacaccttcctttccttctgctctcacagcagaagactcatgcagcaggaacgagttccagtgtagagacggaaaatgcatcgctagcaagtgggtgtgcgatggcagccccgagtgcccggatggctccgatgagtccccagagacatgcagtaagtcccctttatttgttggtggttgtagaagaacctatggcctgtgcgttctaggcaggggctcttcccgtgagtctcaaccctccctggggtgttactagacaaggggctctactgctgtgccaagaccctgcccaggaatggtaattccattcgtgagttagaagaaggctcagggtgaccatccccaatccaagtattcaaaccccaaggtattttgtatgctttgatgatggatttggaaggtttcatacctgacctcatgctgtggcttacagtcatactagtccactaacagggctgcatgggtgcttgtgaccagccttcacacacacacacacacacacacacacacacacacacacacacacacaggggagatggacctggtctcaccaaatcatattccttttgagtgacaactcc

SEQ ID NO: 34620 - DNA, 1153 bp, Mus musculus
tctctgtgtagccctggctgtcctgtcctggaactcactctgtagaccaggctgaccttgaattcagaaatccatcacccaagatcagctgtggtttttttttgtttgtttggtttttttgtttttttttgttttttttttttttttgagagttatttgccccctttgaacctccttccacttagctggattacaaaatggaattctctgcttcggtactttgatttgtttatttctgagatgggttctcatgcggtccaagagctgggatcatggatgtgcgatgctgtgctcagtttatgctggggaacaaacccagagcttcatgcgttctaccaagggagccgtaggtactcctggtagacgctgctttaggcttgaggtgctagtgacattcatacaattcagctccatgaaaagaacattccagaactgacgagagctgtttccttcctactaccatgagtgtcctgagatcaaactcacggcatctggcccagcgacacttcttccaccccactgacctgcaagttggaaaaaaaatatgcataacataaaaggatgtggttgggctggtgagatggctcagtgggtaggagcactgactgctcttctgaaggtcctgagttcaaatcccagcaaccacatggtggctcacaaccacccgtaatgagatctgccgccctcttctggcgtgtctgaagtcagctacagtgtacttacatataataataaataaatcttaaaaaaaacaaaaaacaaaaaacgatatggtctggggctgagccattggtagagtgctcgcctcacatgaacctgtgtggtgacacacgcctgtaaccccagcgttcgggaggtgcaggctggaggtcaaggccagccttgcttacactgaatctgagaacagctctcataaaaaaaaaaaaaaacaacaacaacaataaagcacatttctttttttttttctttttttaaatgttaggtttttgctgtttgttcttttgtgctgaactcagggcttcccattgctaggctgagttacttgttgcttttgcctgctcaatgccatgctgggcatggtggtagaggtctatagttccagcaatctggagcctgagataggaagcaaacacacttgcaccagcctggacca

SEQ ID NO: 34621 - DNA, 1109 bp, Mus musculus
tgagccacacactccagcgctgaagtgtaatcttaccgcgagcaggcaaaccctgtagctcaggccctcctgactgttctttgcctctcacagtgacacagtgtgatggccccaacaagttcaagtgtcacagtggggagtgcatcagcttggacaaggtgtgcgactccgcccgcgactgccaggactggtcggatgagcccatcaaggagtgcagtgagtgttggggagccggggatagcatcagtgtgtagtcactgtggggctgtgagcccagccagcgcccccgcagcatgtaaaaggctcgctgtgcatcatagatgtgacagagctttggctccagggcaggacaggcatgggaggcaggggtggctgggagatgcagcctggattcagatccctggcacttatataaatacattcttcgtctggagatggcttagcacctaagagcactggctgttcttccagaggactcaagtctggttcccagaacctaagtcaggtggctcagaatcgcctgtaactctagctacaggggggatccatctcttggcttccggtgcctctggcttctgaggtcatctgttctcacagtcacatgcagacacgcttatacacatgattaaaaataataaaaatgaatgatcttccaagtgttttgcgaaggcagtgcagtagcgtagtgttccccgtggaaagtgtacggcgctaggacagccagtctgctttctcaatcccacgcagagaccaacgagtgtttggacaacaatggtggctgttcccacatctgcaaggacctcaagattggctctgagtgcctgtgtcccagcggcttccggttggtggacctccacaggtgtgaaggtgagtctgcagcacattcagccacccagtgaacccgtgcctcagtttccccatgtgctcagtggccaggagtgcagtccccactgcttagggctcttaggagagttccaggggtgaacactgggtcctggcctgactgttaagagcaaagtgtatcaatggcaggtcctgcctttggggatcctcatcacgaatcgaggttccagctcgagcaagggctccgttgctagaactcttgcctt

SEQ ID NO: 34622 - DNA, 1132 bp, Mus musculus
tctgctgactgatcagggcctaacacagggcaactgacattatctgttgggaagtacgccccacccgcctctgcctccgccccagaggttctgtccccgtggggccatgtccgtgtccacattggagtggtttcatagtgtttgtctgcttcctgcataccttgcacttagcatgtgccagcacctctgaaagctctggggtgactagtgtgcatcaccacaccgggcttaaccctagacttccagatggcttccactgccatctgcggtggcagcccttgactgggagaaccctgaagaagctgtagttggtgttggtggaagggtggagtgctgaagggaagatgtggctgcggccttgcaggcatgaggctctgagttccatcctcatcagtcaaagagatgggtgtggttccaaactgagaactatttaaacagactcttgtcaacattagtgggagcctgccatctgagagccctcatctctcttctgtttggtctgttgtctttcccagcttcatgtactggacagattggggaacacccgccaagatcaagaaagggggtttgaatggtgtggacatccactcactggtgaccgaaaacatccagtggccaaatggcatcacactaggtatatctgaggggtggtctagcctgatgggggtgggcacactgaagaggacaaagtacatagttgagaataggtgataggtattaattaccctcttcccatgcagctggaagggtcactggattaaggcagaagccacaatgtagccctcagcttcctatgtagctagagagatcccccaaagctataccctttaccctaatctagtgacctgaattttttcctggcatgttttgaaactttctggaacattttagaatcttctaaagcatactagaatatttaggcaattgaataatcttatctcacctctggcctctccatattttcgtatgtgtttgtgcgttttagatctttccagtggccgtctctattgggttgattccaaactccactctatctccagcatcgatgtcaatgggggcaatcggaaaaccattttggaggatgagaaccggctggcccaccccttctccttggccatctatgaggtgaacc

SEQ ID NO: 34623 - DNA, 1825 bp, Mus musculus
actactgaccgggtcctgggtaccatagccagtccctaacctcaggacttcctgcattgaccttcatcccagagccttcctgcctgactctgccgcccccatcagaagccaggaaagtgactcgtgacattcggtactgatcttgctggatcttgaggccggcagctgccagtgatggatacccgctcatgcctttgccaaaacgtcacccgttcctggagggacaagcccaagtcgccattctcccttaatatttatcaagtgcctgagacaactggttgccttgctcaggagtcctggcctgctcagtgtcctgctgctcaggggtggccggcaggacccctgtcctgtgcccagcccccgagtctccgagtgaggcttgcacttctctctgcgcacttttcccgttctgtgctgggcacccacgtggtccacatttgtactcctaggttgcactgaccctggtgcattggatgggacctcaggccggaagtggccccgaatcattgaccacagaagataattgccaggctccaagcatccattgccttcttcagtactggggggaactcagggcctctgtctggtgtttagttagtctgtttgtttgtttgtttgtttgtttgtttggtggtttctggctctgcacagcagagttgtttagctcctctggtaacgtcatcctctctcacagagacatccagcctgctgaaggggagagatggggcgaggggagggatacacgcatggtttctcaggtgtggtggcacttggctttaatcctatgctcaagaggaagaggtgggcacatgtctgaggtccaagcctacatagtgagaccttatatatctaaaaaccaaaagaaatcccagactatttggtgggacttggaagaatacttagaaattgccacagatttgtcacatgggtaacctaagaagacagtggtggccttacttggattcctgggtagatccacctgtccactactcaagacacaagggcacactgcccagcccactgggacacttgtaaagagctctgtaatgtgccgatggcacctggctcggttttcattctgtatattcaaggatatcacacatatgtattaaatctatttatttttgcaaaccctgattgctgcacctctctgcaatttctccaggttaggctggggtgatactctgggatgctctgtatacaaagatgatttgaatgggctgatctcaggcctgtcctgtgcgttgctttgagtgggtgggaactgctttgaaacccttgttcagatgtttttataggctgaaaatatcatactgtgatggattaaattcttttttggaaactttgtcatccttatgtgtgtgaggtgtggggtgcagaggaggcatcgggaggcttggaggatagctttgtgaagccacttctctgtattcacccaggcttaggaacaggcttgtgtgtgtgtgggggggagggggtcacgcacctctctccgtgtgggtgtcctgaaactccaaattgttcctttgaggcaaagttcttccctgaacctggggccccctcagctatgtctaatgccaacaaggcccagcctggctctgctctgctcagagtcaggggttacaaggttcagagaactcccatcttgctaagctggtgctcgagtgtgcgccgtgcccctggtgacaaagtgagcgtccttagctgctgagtccaccatttcgctagctgtgccttctgtttgagttgcgtggttttggtagtttggagccaggatctcacaatgtagcctgtgttgggttgcagggccaggaagagtagctga

SEQ ID NO: 34624 - DNA, 1270 bp, Mus musculus
taggcacgtctcaccgagcctaatgactggaattcaatccctgggacccactggtgggagaacagctatatacgttgtcatctgagtccacagggacactgtggcatgtttgcactcacacacacccagataaataaacataaaaagaaattagcctgatatcatcccagcacttgggaagctgaggcaggaggagtcaccacagttcaaggttagcgactggacctgggaggaccgaaaacactttcctttcatctcgtcctcagtccaccacggccccacagtggcccagcccatccacttggacagtgcacagctctcgccgaagttcatcagtgactacctctggagcctggtggacaccacgtgggagccagagccttgacctcataccttgcacagaactggggttgagggagccaaggaggggatcactctaaaattaaatgtctgtatgtgagtgcgttcattgatttatctacttgctttgagacagcatggagtccaggctggcctgcagcttcttttttatttgtaattacatttactgtatgaatgttttgtctgcatgtgtgtctgttagctgtgtattccaggagaggttagagagggcttcagaccccctgaaactggagttatgggtggttctgagctgccatgtggctactgggaatcgaacctgtattctatagaagagcagccagtgctcttaattgttgagctgtctctccatccccttaattacaattttaaaaaatgtgtgcctagccgggcgtggtggcgcacgcctttaatcccagcacttgggaggcagaggcaggcggatttctgagttcgaggccagcctggtctacagagtgagttccaggacagccagggctatacagagaaaccctgtcttgaaaaaacaaaaaaaaaaaaaaaacaaacaaacaaaaaaacaaaaacaaaaatgtgtgcagttggggctggagagatggctcagtggttaagagcacactgattgctcttccagaggttctgggttcaattcccatctgtaatgggatccgatgccctcttctggtgtgtctgaagacagccacagtgtactcacatacattaaataaatactctttttaaaaaaaagtgtgtgtgcagcatggtgggtgtgtatgtgtgtaacagcttgctggagttggttcttctgtgggggtatgtgcatgagtatgcttggtgcctgaggaggccagagttgtcagatcctctgaaactgaagctacagctggtt

SEQ ID NO: 34625 - DNA, 2591 bp, Mus musculus
agagtccggcttcgtcttcagccgaggagtgaatacagggaggagccagtgagtcccccaggacccaccagccacaagccacgcatcaaaccgtccctcctccatccctctgtcccattctgcctcggcattcctcagcccctgaacttccctgagggagccctgacatctaccaggctcaagctcctggaagcctttcccagcaccctgggttcaaagccagaaagccaagctacattctcctcccagttggcaccagttgacaacgccttgggtgtgggtttcttgtaaagaacatagagaacaatcagccggcaattatgggaggaggaagggggggcaagaagagaaaatactgtattcttgagtcattgttaggggatgggaggggtcagaattcagttgctaaatttgaatgtcactggaatgttacagtgtctattgtctcctcatctttacagcaggtctccacaaagcctgctcaccaccctttgtcacctcatttcattgtctagtgtacaatagggtcttgtccactgccctccacctccagactgtgtcttcagggcctggggtgtctcttgtgattgctttacagaataagattgccgtaccttagccgcctgcctccagtcagaaagcagtgttttcatttgcctttttcctttctctctctctctctctctctctctcacacacacacacacacacacacacacacacacacacacacacacgcacgcgcgcgcgcgcacacatgcacagggcttgtcatcttgcagctgatagctgatgtcctgtgacttggaaatgaccaacttacaagaagttatgctgacctccctgttccccacggggagtgcttggcagaggagactacttctagaaatactttcagacctacagacaaaaaagaaaaaaggccattccggagtgactcccagcatcacagcccagaacctcctcctcaaaggagagtaaacagagactgtgatactgaccaagtacaggcgctcgctatgaagcccatatgttcctgattaagagctggctggcctcagagcactcccagaactagcttaaagtgacaggctttgctgaaatccaaagggacaaaagagtagttttatgtttgtgtgtttgtttttaatgccctggagctcctgctggtgacaggagagacagacaggctgcacctttctctaactggggttcctttctggccccaggatctcagtgtggttcgtggggggattttgttgttgtttctttgtttcttttcttcataaagaagaaaaaggaaacaacttctagatgtgccttgcgatagggaggactttgtcctctcaagtctccctgtcgtatccagatcacagctgaacccactgggccttggcgccaaacctcagcagggcagcattgagactcatggactaaaggaaagtgttcactcttctagacaagtgggtctcttggtttgatggagtcttactccgcttgagttttgtagaaggggtttgtctaaggcatagaggcttggttggcataagaaaataagatggacagatggatgggtggatggatggatggctgattgagtgggtgggtgggtggatggatgcataaatgaatagatggatggatgaatgaacagatagatgaatggatggatggacaggtgggtggatggatgggtggacggatgagtgtggggtgggtggatggataaatgagcaatggatgagaaactgggttggctggtgggtagatgtcatgatggagtctttgcacgtgtatgaaacagaaaaccaaacttcaggacagacagctgctggtgtctctggatgctcacagcctagggcacatttgaaaggtcgtgctctgagctgagccctgagttccagccttgtagccagcaagggagtttatttaaggttctggaagcatcagctatgacccaaagcacacgctcctcagaaaagcccctgtttctgtcgctgctgctttctgtttctctgtcggggccaccagggccaaacacccaccagtctctcctctccttcccgctatactccagttttctttctactctgtgaccacggtacatccatgaagacagtgttacacgtaaatgaagtattcttttcttgtaatcatattttagaaagtaaaaggacttaataaagctacaaataaaaacattgcctcgtgtctgtttgttctccttctttttaggctagccttgaactcctgatcctcctgccttccatctcccaagtgctgggatgacaggcacgcacctccacaccaggctttcttccctaggaggatgaaagccggggccttgggcatgctagacaaccactctgatagctgagcgccagcctcagcctggatctctggttgcttagcacgtacttttgtgcagcaattgcatgcacaaggggacagtgccatgcagctcaggaagactcgagacgcacggtccagccttctccaagcagcaagaacttctaccagctccaccaaattctgggaacggaacttgggccctctaaagagcagcatgctacacggtcctacctgagcca

SEQ ID NO: 34626 - DNA, 1197 bp, Mus musculus
ctaatgtgaggtctgactgagggaaggacacctttgttcttggcattgatgggtgacatgaccagacaagaccttgttgatctacaatgggctgccagcactaacaaaagccacttgtgtccctgggctatcagctgggcagaaagggacacagcagtacttaaaggccttggctttccccaactccaggaacccctggtcaggcctccccagcggccttccccagcaaggagccagacccaccgtactcagtggaaacgccctatggctaccgcctggacctggattttcttaagtacgtggatgacattgagaagggccacacactgcgcagggtggcggtacagcgccggccgcgcctgggttccctgccacggggcccgggctcctggtggacgtccacagagtctctgtgctctgatgccagtggggacagccggcactcggcctactcctactgtggccgcggcttctacccacagtacggagccttggagacccgaatcggctccaaccctcgtgtggagcgcacgctgctggatgcgcggcgccggctggaggaccaggcggctgccccatcgtccggtggcctgggctccctcacacccagcgccgcgggctccaccagctccctggcaggcgtgggcctgctgccccccacgcctcgcagctccggcctgtccaccccggtggcacccagcgctggtcacctagcccacgtgcgcgagcagatggctggagccctgcgcaagctgcgccagctggaggagcaggtcaagctgatccccgttctccaagtcaagctgtcagtgctccaggaggaaaagagacagctcaccgtgcagctcaagagccagaagtttctaggtcacccctcagggacacggagccggagtgagctctgcctggaccttcccgaggcccctgacgaccctgctgcactagagacccgctcggtgggcacctgggttagagaacgggacttgggcattccagatggtgaagctgccctggtagctaaagtggccgtgttggagacccagctcaaaaaagcgctacaggagctgcgggcggctcagacccagcaggtcgacctccagccccaggcctggccaccaccagacacccaggtccgcgtggacaccgtgcgagtagtggagggtccccgggaagtggaggtggcagccagcacggcag

SEQ ID NO: 34627 - DNA, 1176 bp, Mus musculus
ccaccactgagccatgtccccagctttcagccagccatctgagcctcagtttccacacctgtgaaatagacatgattctaacatgctgtgaatcttctggtcagggaaagcaaaatggctaagtgattaaaggtgcttgcagccaagcttgaatacctgggtttgagtccccagaaaccacaaccacatggtagaagggaagattcggttctagtaagttatcttctgatgtctacacacacacacacacacagagagagagagagagagagagagagagagagcaaaaataaatgtgatttctttaaaagaaaaagatcaaatcgggctggacagaagaaaggccacacagattcttggaagggttttctgatgctggatgaagctgttggggtggactgtggagctggggtcctggggcctgctaacctgccttctgcccccaggagctccatgaacagatcaagtttcaggaaggctgacctctgacaaggctaagagccacacccagaagaccagcacccacacctcagctgcctgtgcctttctggagttatagctgccccgagtcgaagtcctaggagatgagccccctgtctgtctgcactgatggattctaaattttgtttttgtttgtttttaatttaaagtgagttttatatacaacctgtgtggtgtgctgacagttgacatggcccctgccctgggggcagtgacgttcattcagtgggagaagagaacacactcacattgtaacatggccatgggaaagagtgtttcctgtgtgcgaggtcacgtgtgtccacctgtggtgagggtttgcgtgtgcaagcgtgtgatgtacgagtattcctcagtctctccactttttgttttgtgtttactttgcttcccagcctggccttgaactcacaaagacccatccacctcagcctcagccttttctactaagtgctgggattaaatggtttatcatttttaattgtatttttttctcctctttctctctttctgtctgtctgtatgtttgtgggtgcatgggtgccatgacacacatgtggagtcagaggacagtttgcagaactcagttctccccttccactgtatagatcgcaggcattgagctttcaggcttgcagcaggcaccttcgtcttgacatctgacgagcctcccct

SEQ ID NO: 34628 - DNA, 1731 bp, Mus musculus
ggaactcagaaggctgagacaggaggataccctggtctacatagtgagttccaggtcagccagggttatgtagagagatcctgtctcaaataaataaacaagcaaacaatttttttaagttaaaaaaaaatttggctggggtcttagcaaagccatagagtcccaagctggaatcttgcagtgagaagctggggtgttactcagccctggagtgctcccttaacacggggcctctgagttcaatcgcagcacacatatacacgtgaaaagccggtgaccagcctttgtgatccgggtcccctggcatgttcctctgtctcacccctgtgtctgagatccccagacaggctcctgaggttcagggttccccatcccagcttggttccctctccatcccaccctgagtgtgtctggagtagaggccatctgcagagaggcctccatgccaacaccactggcttctctcagcccagcgtgtatttgggacatatttccgagtgggcttctatggcacacgatttggtgacctggatgaacaagagtttgtgtacaaggaaccgtcaatcacgaagcttgcagagatctcacaccggctggaggcacgtcctggcgctgggaggtgggctaggcaatgtgagttacagtgggggctgccccagctgacccggagtcaaccccgtgtctttaggagttctatacggaaaggttcggggatgatgtggtagagatcatcaaagattctaacccagtggacaagtccaagctggacccacagaaggtgggtcctctggtccctccctgcccccaaaatccaatattggcgtttgcatggtgggggcaagtccggtttcttgggagagtctggtacatccagttataggaagagctgggcctttcgattcaaagggttcaggcctgcagggaccaggacctcaggctggagctgtggtgtcaggtggaccccgcaccactcccatcctcttactcggccccgtgttccaggcgtacatacagataacctatgtggagccacatttcgacacttatgagctcaaggatcgggtgacctacttcgatcggaactatgggctgcgggccttcctcttctgcacacccttcacaccagatggacgtgcgcacggagagttggccgaacagcacaaacgcaagacgctgctgagcacggagcatgcctttccctacatcaagacacgcatccgagtgtgccaccgtgaggaggtgggaccccagacccctagggaggggagggagattcggggactcaaggtccagggggagacttttccagggaggaaaaggcagaggaaccccacaaacagtgcatttcagggatgctggatttgggaagaaagagatggggatatagcagattgggtttgggcagtagaaggacccaggctgtaggctccagatgcaagcctctaccatccagcctggagaaatgtggatatctcaactgtagagtccctagacccgagggcaaacagcaagtgaaacagaccagaaaccccagctgagtcaagacccaccagggagcacagatctccagcactgatcatagcctgggaccctcctgccccacagaacatcacaggccccagcaggtgtatccagacacgcagacacatgtactcatgatacatgtactcatgtacacgcagacacatgtactcatgatacacacaccccactcactccacagacagtgct

SEQ ID NO: 34629 - DNA, 1239 bp, Mus musculus
catctcatctctccagtgcctcacctctgagttaaccctatgcccatcgacagtactgttgcactgacattgtcaacacaccataagtgagcagaataatatcgtgatgatgccatgctgagccctcttgctggccccttctgaggcacttttaggagaggaaaatgggaaatagccggatttcggatatgtgtctctatcccaccccaaccagccacctccagctcttgatgctaactaactttagttatctccatggtagccatggtggtgagctttcacttctgacccttgacctgggcatccactctaccgtctgcagagctccaccttctccagccaggcccccgatccgaaggtgaccagcatgttcgagctgagcgggcccttcaggcagcagcacttcctgtccggactcctgctgacagagctggccctggccctggatccggaagctgaggggtgagtatggggcctgggcgcggcccagggacagtggcaggggccaggagccatgtctgcaccacaatgaacacctcgtcattccacagggcatcccttttgcacaagaaggctattagtgccgtgcacagcctgctgtgcagccacgatgttgactcccgctacgcagaagctaccgtgaaggccaaggtggccgagctgtacctgcccctcctctcccttgcaagggacacactgccacagctgcatggctttgccggttagagggctggggatgatggggtttcatgattgtggggtgtggggccagcctcaggctgagcagcttgggccagactcaccacagtgtctacatcaggccagtctcaccgggaaagtggaacagtgctggtatccattatgatagagaaacacgcatatggagaactcttgatgatggcagcccatgtccagaggcctcctgatgacatgtgttgtgttactctctgaggggaaggcgagggctcagtgggaaacagcggacgagaaaactggggcctgtgccctggggagcagtctagggcattgcttatgtggcaggacctgtagattcaggcctttctttagcgtagaggaattctcagctctgatcctctaagtgttttcctgcctccttccctttctccctggactccagtgacgtatgttagcgagtttctttgtataacatgtctgctgttttcccatgctttctgttctctgtgcctcttctgggtaacagcctgttggtctatttgg

SEQ ID NO: 34630 - DNA, 1502 bp, Mus musculus
cttccctgagtgagagaggggatgttcatgccttctgccttagaaccatttcccaggtctactcttcatatcgctggctgaagttgtcacctggcgtgggttgctgtccaacttagtcctggcagcctctctatctcaggtccaccagtttggccttgaaacctgcctgtgaactgactgctagccaaggacacaggcagggctgcagtctccatcctctgcctccctggcgtctaccggaagggaaaacctgttttctggttaaagaagggacagagttggagctacccctggcaccgggaactctccaaagtgccttcccagcttcccctgagtctatccactcagtgtgggttaatctactcccagaattaaattttggagtattccagggcctgtcacatggggctgagaatcgcccaccctagcagtccagctttctgtcagttcacctcagagccagggaactgaggccgcctgcccaggctcccatctgtctgcctggtggtggcttaggcaagagctttacaaaccttacatcctgtgtagaaacggaagtggagaaagcagcccacagagggtgtgcccttgctggtcagtttcttatgacaggatttgggcttctccacatgaggactcttgtgtagacccagtgtcagcatcatggccgttgcccagggacactggggctgtggggaaggactgggggaaggcactagtgggcaacccagtccgtcatgggagcaggagtccttcctgtgaattagggatgggctgtgggttgtgactgctttctctacaaagcttgagacgtagcccctaggaccctgggttctatttctattcactgaccagactcccctaaacactatctgacatttcatggtccaggtgacagatgctctgtgtcacacacccctgactctgtatggggggtggagtgtactccttcagcccccacagccagaatcacttctgcagccttcctgagctcagcaccctccctgactgtgtatgacctacagtgcctggttcagatgtatttctagccctgccagtggctgtctttgtacagattggacaagcagagtgaaggtgtctaaacacttagaggaaagactcaattttttaaaatgttgctttatcattaaatagtcaaaacggtgcaaattatgttcttaagattcagcaacctgcagggcgttgtggtggtgaaaatttttgatcccagcattctggaggcagaggcaggtggatctctgagttcgagaccagcctgatctacagagcaagttccaggatagccagggctacacagagaaaccctgttttgaaaaacagagagaaggagagagagagcaagagagaatgatgcagctagtctggaaggaacctggaactagctctctcgctagcatttgcctactgttttgcacagggtcctggcttgaagacccagcactgcacaaactaggcacgtgctccagggatgtcattctagt

SEQ ID NO: 34631 - DNA, 1337 bp, Mus musculus
tatttttttttttttttaatttatttttatttatttattttattttatgtacgagtacccagtccttgtcttcagacacaccagaagagggcattggatcccatcacagatggttgtgagccaccatgtggttgctgggaattgaactcaggacctctggaagagcagtcgcactcttaactactgagccagctctccagcccttcccccacctctccccaagtgcttcttaagagagttttgttacataggccaggcagttgtcagtcctgcctctactacaccacatgcccaggaggtcgtggtgctgaaggctgaacccaggcctgtttgcgtgctaggcagtccgcctgccagctgaaccccactgttgtccagtgctggggctggctcgggcttccgcatgctcttgcagtgactccatcccagccctatctctgtcttctctcctagaacctcaaggcctgcaaccagtctactgatcctgaagtctgcagaccaaggcctgcccaccctgggcttcctggccatcctctgggaagcaggaaccctgaggggctctaagccccacttctggcccaggcttgccaagccatgttcctgaggccccagtggcctccagagatgaataatgagctcgcctaccttggattcctaaggggagttagtccctgcacccacctcacccctgcctccccggctggtgggagataaatggatgacttgacctgtgacctcagaacaataaatgtgacttgtccacattgtgtggctgttttttaatttcattttttctgttggtttcactatgtagtccaggctaacctcagattgtctcctgccctagtctcccaaggcatggatgggccagtaagccaggctaggcggcctgccttcataagggtgagaactggacaggtgagcagacagtagatgtggagtgcggtggagactgctgtcacctgacagcacctaagttgcctaagagacaagccagggatgaagctgagatcaggcctggggtaagcactctaacccgatagctatcgctgcttcctgactgcaggtgcactgtggcctcaggctcctgccagatggactggactttttttttttccctagtttttcaagagggtttctctgtgtagccctggctgtcctgggaactcacccggtgttgtagaccaggctggcctcgaactcagaactttgcctgcctctgcctcccgagtgctgggattaaaagtgtgtgccaccactgcccggtagactggaatcttgaactgcgtcaggcccacatctcttctgtcacatctacaacgttaacatttgggaag

SEQ ID NO: 34632 - DNA, 3221 bp, Mus musculus
aggggacacaatggtgccctactcaggcctcccttgcccaggcctggcctatactgagagaaaggggagggaacaggtttaaaaatccccaaaacggcaaaaaaaaacaaaaaacaaaaaaacatgaaagaggggagtgggcgtccccatcccccgccccagtccctgagcagagaacagggagcagagttggggcagagcaggaagcagaaaaaaaaagggtggggtggggtgggaggggaagaaaaactctatttttgtaaaaagggaaaaagacctcgtggagaatttttactggggattcttgaacttgaaaaaaaatcacaaaaaaaaaaaagacaaaaaaaaaaaaaagaaactattttggcaagttatgtttaccaactactggggcaggggtgtagggagcagggctgagggctgagagtccatagggccagcatcacaggtacacacacacacacacacacacacacgcacgcacgcacgtgcacataagcaaacatggccacaggaaaggaaggacatgcacttggaccttggggacacagatacacaacacatagatacagaaacatttcaggatacattcaggatgaccaaatccacaccagagaacagagacacagacagacccttggcgctgcataaacagagatacagacgttggctgcttgtccacaaaaccatgtgatgtgtgaaatgcactgtgacagatccatttggatgtaagtctggacgccagtccccagtgagagctggggaggtagctcagttggtaggacacttgtccagctttcctgaagcctgggctcttccccagcactgcacaagcctggtgtggcacacagacctcattcattctagtgctcaaatggtagagtcagatcagatcaagactagccttggctacatagtgagtttaaggtcagcccgggctacataagaccctgtctcaaaatgcaaaaccaaataggtcacctagaagcatacaacaccagggacaaaagcccatgtccacagcatcctataggcccagacaaggtgttcctacttaagaccctggcccagttacttcctccagccaggctggtcccaccacttctccctgggtccccaacaagccccacccttgggttctctacacaaactccttagcccaccaggggcctccctgctgcccaacacacagacgtacacacatggcgtccatgcatccaaacacacgatacctcgttctactttggcatcaccgtgggctggagggggctctcactccccacaacactgaggccaaaggacccccctgtccctgggtctggggagaggtctgcagtcctcctccctcaagtagggacagagtgctccctacctgcaagcaagcacccagcacactccagcagacccaggggtggatggacccaaggtgtcccccaccccatccacttgtcgccctcttttgattgttgggtttttttgtcttttccggattgtgggggaatcatggatgcagccttcgtgagccccggcccggcttcggaatggattttgcagccatgccccacacacaccctgacttttcattcttttatgcaagttccaacagaagccacaggctggagccctgggagccccaaaccttcaacccaccccacagtgggcccagtcacaaccaagaatggtgaagcccctcccccactctacactctaggttctagttgctttcttccggtgtcctctgcgtttggtgtctggccacggccccatttgagcgtccaactctctctccccacccctcctggtgttgttcttaaccgtctgtggagtttctgctgcaaggaacaaaaagaaaaaaaaattttaaaaaaagaccaaaaaataaaaaatgaaaaaaaaaaagaagggaagaaaactcaaacagaagatgaaatatagcaaaaggaaagaaaagaaaaaagaaaaaaaccacaaagacgatttaaaaaaaaaaaaaaggaaaaaaaaagataaactgtcaccagttaactttcttgtacttttttgctgaatttagcttcatgtagttttaacttattgctgtgtttaactatttattctccttgttggcctgtaaggacctttgtgtatatttctgttccttcatgagtttgcaggttgaagggagctgttccttttctttcagttttgctgagatgtggttatgcctaatttatttatacaaaggggaagtggagtcattaaagtaataattattaataacagtaatggtagcagcgtgccccccgggggtgccgtgggctccgaggggtggggtggggtccccacagctggcggtgcccggggctctcaacgggattgttttgctattgtcttgagaagtttttctgtctatttagctggtgaactctagcttgctcacgatacaccgaacctatttattctggtggtttctaagtctgcccttccactccccactccctcccagcaggacagggactcctcacctccaggagggtccagccccttcttcccctgctgtttctggggtctcccctgccctccgcacatgcaggaggcatccgagcaataagggctgggtttgtcccccaccctggggggaggatgggctctgaagagggggcacctccccccaccccctcccaccaaggcctaggtccctgctgcctccaagactgggaggggggactttttttctaggacacaaagcttagcccagccaggtcccctccctggaggccagtcccccaagagggccaggccaggggctcccagggagaggggcccttgggtcttccaaagtccctggggggttggggcagggccagtgggaagagggctcagccctctaacccttccttcatcctgttgattgggaaagtttcaaacatgacagtctatgttggaggtgatataaaagaactgtagaaaaaaaaaaaaaaaccataaaacaaaaaccaaacctcaacccgaacccaagaacacttcaagttgcgttagacatttcttaccgagccccaggcctggccgcggtaactgacttttacatgggattctttaactatttgtacttttcatgccagaaaataaaaagttcagaatcttaagtctcaggtgctctgtgtgccactgtggcggggtggcctttgcgctgcaacaccggggaaggatggcatctgtccctgggccagggtctctaatga

SEQ ID NO: 34633 - DNA, 1500 bp, Mus musculus
tcttctataattagaactttccccatagctcaccttctatagtgtggatagtataccctagggagaggcagagtggtgtttcctcatcacttcacacaaaaggccgcaccagtaagcctttgaacttgctgagaatgttttaagcacctaggctgttctcatgggttaaagaaagaaaaagaaaaaagagagaagagactcaaatctcccaggggcagtccagcacttgagaggcatcagccaactttgtgctctggagcctcggtttcctcccaagtactgggcaggagcctaccgaggttaactggaactgggccaggactggaaaaactgctttttgaccccagtactcctgtccaagctggacactaggatgcctctttcacttcctggtctaggccagctatggcttatgtcctggctacctgcatgtctccccactttaacagccccttcccccgtggacccatggcacccactcctgcccctctcacccctagaaccacgtcaaccttgtgcaccgaaaagggaagaccaaagtgtgtcctcaccctggctgtggcaagaagttttatttatccaaccacctgcgacgccacatgatcatccattcaggtcaggccctgccagctagaacccataggccaggtgtagtgcacatgtgtaaattccagcgttcaggaagcctaggctgtacccgtgaactcccacatttatacctatacccggcactggtttttatgtgcagttgtcctgagtcccgacacgagtcatatgcaagctcattttagcttggcagttgacaccttgtgtcagaagccctcttcctacctgctgtcactccagtggatgttggtgcccgggtgggggtggggagagcttgctccttgtagccacctctactgggcggggtcctgaggccgctgccacctgcaggcgtccgcgagttcacctgtgagacctgcggcaagtctttcaagaggaagaaccatctggaggtgcaccggcgcacgcacactggggagacgcccctgcagtgagtgtccagcgctagggagggaggtgacctgagcgggttgcaggggaggctcagcccgcggtgaactgcctttgggccccctctcctgctacgcaggtgcgagatatgcgggtaccagtgtcggcagcgtgcttcgctcaattggcacatgaagaagcacacagccgaggtgcagtacaacttcacgtgcgatcgctgcgggaagcgcttcgagaagctggacagtgtcaagttccacacgctcaaaagccacccggaccacaaacctacctgacgtgcccatgcccatggacctcagcctctatttatttgtactcttggacattatgtccagacgatcagagccctagatagccagccacaggggctgccccaaccgcaggccggaaggaggcattcccactcttccctgggcaggtgccccaccctgccccatcacatcccacccatggagctggcac

SEQ ID NO: 34634 - DNA, 1180 bp, Mus musculus
tcagtttcctctctgcaaaatgagagtgggattcaagaggctgtctcaaactgggaattgttggccccagggggagtggagcacttgtcctcacatctgcctggggccctgtgtccacagggcggcggcgcaatgtgaactgcctgaagaacgtggtcatctggtatgaggaccacaaacaccgctgcccgtatgagccacacctggctgagcttgacccaacctttggcctttacacaacggctgtgtggcagtgcgaggctggacaccgctacttccaggatctacactccccgctcaagcccctcagtgactcagagcctgacagtgacaaaggtgggtctgcagggcaagggcactgcgtagcaggcacaggggcctctgcacacttcccttgtgggtcaggcaggactgtggcactggtggctttaggacagtagcttggacaagcccttttcaggacttgcagcctaagtccctgccaagttgagcagaattttgtcctcgtgtgtactagcaacctttttaagttccctccggcctttcagctctctcctgctcactctctttcccaccctttctcatcttgctcccctccattctcatcagctgggttactcactggcttccttgtaagagtttatgctttgtggttttgtggtgtttgtttgttttccatttgctttggggacagggtcccattatatagctctggctggcctgatttggtattttagacatgctgacttgagacttacactagtctgcctgtctctgcctcctgagcgctggaggtaaggtgtgcaccaccacactcagccctgttttgtgggtgtttgtttgtttgttttttaagatttatttctttattatacataagtacactgtagctatcttcagacacgccagaagagggcctcagatcccattacagatggttgtgagccaccatgtggttgctgggaactgaactctggtcctctggaagagcagtcaatgttcttaacctctgagcaggctctctagccccttcagcctttttacttttgagctatggtctcactgagtcacccacactggctgttaactctctagctcaagtgaacctcaagtttgaacttgaaatcctcctgcctcagcatcctaagcaactaggattacaggcctgggctgaactcag

SEQ ID NO: 34635 - DNA, 1184 bp, Mus musculus
ccttttgctgctaaggcaccaacaggttctcatctctacaccaggaatccagagtccagatcagcaagctgccctggcccgccacaacccatccaggcctgtttttgttgagggccccttccctctctggcttcgtaataagtgtgtctactatcacatcctaagagctgacctgccacctcctgaggaagaggtgagttactggccaaagcatttgctgccaagccagaccacctgagtttgacccccagggcccatgtagaaggagagatctcactcctacaagttgtcctctgaattacacaggggtatgcataaatgtttacccaaaaaaaaaaaaaaaaaaaaaaaaggcaaggcaggccgagctctctgagtttaaggccagcttggtctacacagcaacttccagattagccagaactacagattctgtgttgggggtggggctggcactgtcctgaaggctcagctgagggacaggttttgtgttctggcctctaatcctgcctgctctcttgcctgaggtagaaagtagaggagatcccagaagaatgggagctgtactacccacagaagctggacctggaatattcaaggagtggttgggacgactatgagtttgacgtggatgaaggtaaaagcaggtctcaacacagcacatctgtgtggtggccatttgtccacgctccacaggatgaggggtcatatgccccccagggtacctctccttggctactccctctcccctttgtactatcttttaaggagcattctatactgactagtgatgtgaccagaatacgcgcaagcctcaggtcagcagggaacagtcaagttatatgtggggagttgggaggaggcacatggtagcctccaagttagggctcaaacttagtctcttgatagtatctgagcagcgggtggcatggccaagggaaatgtagaacatttatgtggcacagggagctggctgtgaactcatggaggtgctcagagtacgtcacagtggtgagacacaaactcttctcctaacagtgacagaaggccctgtcttcgccatgtgcatggctggtgcccatgatcaggcaacattgatcaagtggatccaaggcttgcaggagaccaacccaaccctggcacagatcccagtggtattccgcctggccaggtccacgggggag

SEQ ID NO: 34636 - DNA, 1360 bp, Mus musculus
agaggtagagagtggccagctgctgccagcctctgacccctgtcctctgcaccacaggttttattccctctgcagttatgggacgaagaaagtccaaacggaagccgcccccaaaaaagaagatgacaggcaccctggagacccagttcacctgccctttctgcaaccacgagaagtcttgtgatgtgaaaatgtgagtgggtgttcagggtgggcatccaggctccccacttgcttcccctgggccttcctactgaaggggtcatctccagaggctcagggctcgcttctcatgcatacctacaccttgtctcactgcagggaccgtgctcgaaacactggagtcatctcctgtactgtgtgcctagaggaattccagacacccatcacatacctgtcagaaccagtggatgtgtacagcgactggatagatgcctgcgaggcagccaatcagtagcaaagtcagggacctgctcctccacagcccccatctggctaccaatccagagacattccagggctaggacagcccgccctctgcagatgggatggatgtgagtgagtagatttcgtggctgcagatgtgactgtagggatggaggcgagcgacactgggtctcaccaagcagcccagggtggcctcatggaaccctgagcctcaggtgactctacaagcctttgagttgctcccatcttcagcccccaccctgcccccacacttcaggctcctgtcttctctggtgacggttcctgacatccaggcaaggaatagctgtgggacctcctgtctcctcagccacctcaccagcaccttgcccttgggacctagactttctgtccttcccagtctcctagtgcttgtggtcgaggctactggccacccaggtcccctggctgggctcggctggggaacaccattttcttggtttgcctttgtagacaaggtaggggctagttggggtacagctgtcattcattcatgagcccatcaataaaacagccagtgtgtatccccgccgctgtacttcttggatatgaggtagctccagtatcagaaggggagggaggactctatgatgtatggtccagtcagtttttcttggatggatggttggttggttggttggttggttggttggtttagttttggtttgaggggtaaggtgacataggaccaggttggcctctgtgctcagagatcagcttgcctgcccaagtattgagatgaaaggtgtgagccaccatacccaaccagtggtagtgtttaagacaagatctcactgtgcagcccagaatagtctcaagttgatccttctgccccagcttctaaatggcagaattacagagatattataccact

SEQ ID NO: 34637 - DNA, 1103 bp, Mus musculus
ctcttcacccagctcactaagttcctacgggtgggctgttactacgccagccccatgcttcaactcccccaagacctttgcagtggacctcaggcaaacccacactttgctgccatacctttctctcttgaacccagataagccaccacacgaaggaaaacgcaacacaaatgcagttcagaaacaatggtaactcaattgctgagcacaacaactaaaatcctaacttgtaagccttattcaatctaagtcctctggtggtccgccactgaaaccaggaggcacttttaattacatcttgtcctcagctatccccgtccaaaaagacctaactctctcctgcttcctctcttccccatccaacccagaagtccctcctccttgcaccgtgattggctcctttattcattaggggattggttcacaagcagtcacctgagtacttaactccttgtctgaagcccctcccaggagagcggagttagcatcaaaatacaaacagtaccaggcccatccacaatagttatgctcatgtatctgtagaaaatgataaaatatagttaccaacaaaacttaaagattacatctgaccagggaaaagctcttatcagctgagacatgaatgtcttcacaaagcaagtagcccgggtgatttactcttacagactgtctcagttactgatttctcccccaaaatgcatgcacatcaccctcaaaagggctagcccgagtaaccaatcacacaaaaactggataataaatacatagacttgacaacacaaagactgggtagacaacactgagaatacacaatgcaaaaaaccgggcaataaatgctacagctagctttttaaaaaaaaaactaaccatttcaagctgggcatggtggcgcacgcctttaatcccagcactcgcaaggcagaggcaggcggatttctgagttcgaggccaccctggtctacagagtgagttccaagacagccagggctatacagagaaaccctgtcttgaaaaaccaaaaaactaaaacaaaaacaaaacaaacaaacaaacaaacaaacaactaaccatttccctctcctcaggccccaaacagaaattgt

SEQ ID NO: 34638 - DNA, 1293 bp, Mus musculus
gccttaaaaaacaagggtggagggagagtactgacttcagaaaattgtctcctaaggggctggcaagatggctcagtgggtaagagcactgactgttctcccaaaggttcagagttcaaatcccagcgaccacatggtgggtcacagccacctgtaatgagatctgatgccctcttctggtgcatctgaaaacagttatagtgtacttacatataataattaataaatctttagaccagagcaagcagggccaactgaagtgagcaaggttgagcagagcgagcagaggtcctaaattcaattcccaaaaaccacatgaaggctcacaaccatctgaagagctacaagtgtactcatatacataaaataaataaataattgtctcctaaatgtgcacgcatacacacaataaacaaaagcctaaatccattccttagttagttccaaaaagttaatataataattctcactattaaatgttatttagtaactaacactctcctgtttgttggttatttatgcatttttcaggggtaacgtactttcaagaggtagttttccaacagatcacagtatctgactggactggcaatttgagtgagaatggtcctcatagaccaacatggacttgggcatatggcattatggactttgtgaaggcgtggagcaggtgtatcattgggggtgggctctgagatttcaaagactggaactatccccagtgtgttctctgcctttatgtggatcatcatcattgaatgaacctgttgctgctaccatgctttgctctgccgtcctggactctaaccctctgaaccgtaaggctaaataaacactccattttttttataagttgccttggttgtgttttgtcatagtaatagaaaagtaactaaatatacctgtcattcttcattgtaccccagtgatcaccttgcacagctgtcacctagaatacatgaggttcatcccttctcccttattccctgttaccttttaaaaatgcatcatgtgcccttgctccttgcctacagtctcacttgcctatactgtattcaaagtggagttgaacagctttggtctaggaaaccccacatttactgtggtttttgtgcatgatctttttttgttttttgtttttttgttttgtttttgttttccgagacagggtttccctgtgtagccctggctgtcttggaactcactttgtagaccaggttggcctggaactcagaaatccgcctgcctctgcctctgcctcccgagtgctgggattaaaggcatgtgccacta

SEQ ID NO: 34639 - DNA, 1178 bp, Mus musculus
agatgcagagttgggagtttgccagctggttttcagtcctgctttggtccagtcttttctcactaggctctcttccctatgttttagaatggtgatgtgtatcctgtgccgtgatacattgaaagtatgtgctctgctttttatttatttatttaatttgaattttattttattttataggggattacaattaagaggttgtacaaacctcagaagagactttgaactttggactttaaaacattgttgagactgatagactgtggggattttttgaagttggactaaatgcattttgcattatattatggttacaagcctatgggggaaggaagtagaatgtggcagtttgaatagctatggccccattgtcaatggcctgaaaaccttttgataatcatgatctctattgggaagttaaggcaggagaatgaattcaaagccatcctcagccacatggcatgttccaggttacataagaccctgtttcagaaagcaaaaatagagctggctcaatggttaaaaaaaacagatgtccttccagaggatctgagttctatttccagcacccacatgacagctaacaactgtctataactccaattctaaatccaacaccttttgctggtctctgacagcaatgtacacgtgtggtccacagatatccatgctggtaaaatactcataacacatgaaataaaaataaataaataaacaaataattaaaatattttctagtctgagatgtaggtcccattgaggagtaaggaatgcatcaccacaaagcctgtacggtggtttgcataagaaatgttctcgcagacacaaacattcgaaccctgggccccagctgctggtgctgtctagaggaggttatggaaccctgcaaggttcagccttactggagaaaacacatgaggcagtcaggctttaaggccatatagcctatcaccacgtgttcactctgcttcctgcgtgtagttgaagcgtgctctctcagcttcctgttcctgcacttgcaaacatacacgtctctccaacagggtggactcttatcccttcaagaccaagttgaaagaagccttgtccgacattgcttttggtcatagcaacatagcactccccagggagacacagacataatgatatttgttgatgaattagtgaaaacaaatatg

SEQ ID NO: 34640 - DNA, 1651 bp, Mus musculus
taggcagcaagtcttggttcattgagggagttatgttttccaagcaaaggcattagggggctggtggtagggtggggtgcgtggaatggggggatggaagctgacctctgtttgcccttgcaggaactggctctctgcagatactaaagaagagcgggatctctggatgcagaaactcaaccaggtcattgttgatattcgcctctggcagcctgatgcatgctacaagcctgttgggaagccttaagccgaggagcttctgcaccgtgagagactttgctagctgtgtcttcttaagaagacagttagaagcagcagatttgcaggttgtattctatgctttaaatataaaagggtatgtgcaaatattcactacatattgtgcagtatttatatcttttctatgtaaaacttcacccagtttgtcttgcattcgtacatgtttgacagtcaaatactaacaatattcatgagaattgatatccatgctaaatataacattaagagtcttgttttatagaaacctcactagccagttattcatgacaaaaactattataatcaagttctgatttgtcctttggagctgtgggtttgaaggtattaaggtctcaaacagaaacatttcaggacatgtttagtaaagagatgagaaaaggcagcaaacactagtttaagctgctcagagctgctttccgcagagctgtgggcaggacaccgtaacatttgggcctgcatagtctatgctgaagggttaagagtcacacagctagtgctcactctgaccctacgtgtgcagtgtggggcaccttctcacagtgctcaggctttactaaagagttctttccatatggcttagagtcctcatattaacattagcttttctcttacaataaggacaaatgtaagttgaagagcacgtgcataagagcctgtaccaagctgctggggctactcctttgcttcccagagttcctgtctgaggtcctttcatgtttatctatgacactttctacaactctgttctgagatcactgaaaaatacagtaagctacgtgttacctttaaaagcccaatgcctccttgaaatttaaagatattgaatgcatggcttcagtttttaaatagtttgtatttcttctctgacttaattattgatggtttcatttataaacactaagtctatcacttgccattatatttcttactcatttaaatgtggattttcttatgtatattataaaagtattttatgacataaataaataattgtaaattgtcaaaagcatcagttatttaagaaattctctgtgtgatgtattgctgtgtatgtcctggttgtgtggggggcattgtgctgacactaggccatccatatcttcatatctagcccagtctctgtcttgctgaatgttcttggggttggtgttacatgagcaggtatgtgaaggaccctttctgggggtttcagcagaatgtgatgatgggtgcacatttgaggaggtgatgggtgagactgagtggtcagcagctagaacaggcaggcgcgaggtgaaaggagcgatgaggtggttctttgtacaaggctgttggctcacatttgcaacagctggagagcacaaagacgttacacagatatcttctcctgttc

SEQ ID NO: 34641 - DNA, 1147 bp, Mus musculus
aatgcagttcttattcttgggagtgaccacagccaaaggaaacagtgcagtgaatttgttgtgatttttcttttcccccaaagctttgagaaagagggtagttgttttccattctcagcattatcacttagcatacgtttgggtaaataagctaggatgcagtgtatcatagcatggaggctcttctcttctctcagcagacgcccagttttctcttctctgtagcctacttgtcctgtcctcatttcctttccccaatgtctcgctcactttaaaaatatcatgtgcaacatttaagggtttactctatattttatatacagtcatgtgtgtatatatatggagagagttatagttatgtatatagttatatacaaagagttatatagagtcagaagcctctcatttgagagatattctaactggaactagatgggggatttgtatcctggctgccaattacttaccatgtgtgcaggcctcctctgcctgatttctcattgacagaacagaaataatatgttctgatcaggagggctgggagggttgggtgagccaatgacatgcttggtaagtgacaggtcacatcctaagcctatacgtgcgtcagctgctgttgtttacctgatggtttctggtatttctgtagttataaagtgtgctcttggtttttgagacaaggttttgctggtagcacctcctgctctggaatgcactgtataggccaggcaggctccaaacttacagtgccttttttttttttaaacctgcctccagaatgttggtaatatagatgtgtgccactgtgcctggccatctcagggcaagaacagcacagtgagtgcattgcacattagcgggctgggtagtgacgaggcctgtccgtcgtggagctttaacacggaaaacaacgcatgctttcctcttaccttcttccttattattgcatttgcttttttccttcttgttttatttgaattttatcctttgagtaaatgataattaaacagaatcttcatgtcagagctatctctagattgtatagtcaagggctgataaaaatgacaggggaaattgtttttctttggcttttactttggtttgtataaaactgaactctgaaatgaattttcattctttctcctca

SEQ ID NO: 34642 - DNA, 1162 bp, Mus musculus
gatagtacagttgtcttcagagcccacttcttgcctacctcaagtgaggtgtccttccactttgttttagttactgtccatggcaggctgtttcaaaaacaaacaaaaatcaaattccagaaaaccggtgttctataacctaatttctctaggcttgacccttcttccttaaggagaagtgattccgctgtgtgagccttagacttctgtagaaggcgaggttattgtagtgaatgcgctgctcactttcctgctgtctgaaaattgcataaactcttatacatacatcttgaaaatatttaaactggttttcattgacttaacagaaaaatgacatgttcacctaaaaaaaaaaggtttgttttcctgtcatattttgaagttaatggaagaaagagtattgcatttttcttagaagtagctaaagcactagagagatttgattccttattagttgttaagcacctacctctggtttttaggctgtgaaaactgcagaggtctcactgtgggcttttgttgttcttttggatctagaaaaatcttgtacaaaaccatcaccatcaaaaaaacgttgttctgacaaaattgaagtgggagctccggacttagaaaatacagaacctattgatgttgcaaagccctgttctccgatgcctgcaccccggcaggcgaagcccccagcaccagctgccatcagcgagtctgtggctgccccagcagccctgctcagcgcggacagagggctgaactcaggatccgaagcatctgcaacctcctcagttaaaactcgaatgcaaaggcttgctgagcagcggcgccattgggatagtgatctcacaggtataaatgataggatgggtggcccctgaattgtttttgtaagattcagcatgtatagctggggtggtggtacacgcttgtaatcccagctcctgggaggctgaggcaggaagattatagatttgtggcctgcctggagtcgcatgacaggaaagggcttttgttttatctgtgtatgtgttctttgcttatagttgtttcgtgtaccaggagtatagccacaatcaaacaaacaaacagcaaaacaaaaacaaaaaaacaaacagtgagtgagaagagacgtttttccttaggtagatgatgaggttcttgaaccagg

SEQ ID NO: 34643 - DNA, 1166 bp, Mus musculus
tgatgccgattacctttgtatgagtatgttggcatagctgtgtgcgcaggtgcgcgggcacacacgtgcatgtggagaccgggttgacatcacacgtcttccttagactttcccttatgttctcagataggatttttcacctaacctgactcactgattggcctgattggccagccactgagtttcaggaatgctgatgtggccaggcttggctttttgtgagtactgggggtcagactaagctatcacttagtccctgattgtaccttttgattgtaacagacagcacacagcatttaaaatcttatgtaagtatctctacatgcttcctatttatatttaaactgactgtagtaattttgatatgcgtacttggtaaatcttggttcggttacttgagattttatctttgaaatgtatttgactgttctcctaacagttgttgattttagaaggcatctgaggttttatgagccttcagctaacattgtgttttaaccctggtataatatagaagttgctagaacgaactcgtgccagacgagagaatcttcagagaaaaatggctgagaggcctacggcagtagcgagatctgccccgcatgcgaagagaggcagagagccactttcagaagcaagtaatcagcagcagcccctaccagggggcgaaggtaagcgactccggaacagtacaacaggctttagagtacataaacccatgtagaagaaccagtctctgggagacacatgcaacagacttgggcaggaatagccttctgttacatttcaaggttgttatatcagaccagacagagaacttggttagatagccagggagactgacttttcataaattcacacttatcttaaacattttttttaaagatttatatattattatatgtaagtacactgtctgtcttcagacacaccagaagagggcatcagatctcactagggatggttgtgagccaccatgtggttgctgggatttgaactcaggaccttcggaagagcagtcagtgctcttacccgctgagccatttctccagccctatcttaaacatttttaaaccttttttgaaatacatttatttttatcttatgtgcctggatgttttaccttcatgtgtgtgtgtacagtgtctgtgggaggccagaagagg

SEQ ID NO: 34644 - DNA, 1193 bp, Mus musculus
taagattagcatatttttcttcttgggaagtctgttatgacagactaattacagttattttttgctgtttgtcacagtttcatatctgagtgtattagttttgaagctattacaagttattataagtttagggacttaagctgggcattgtgttgtacacctttaatcccagcactcaggaggcagaggcaagtggatctcttgtgaatctgagaccagcttggtttacatgatggattccaggaaaaccagggctacagagaccctgtctccaaaaaccaaaatattagtgacttaaagacttgatgtctgaaatggattttatcaggtcagtaaacgtgtaggtaggctcattcctgtcatgaggctctagttgaaaatctatttcctagctgtttgcagcttgtagatcttagataagatgtcttgtcttctgaccccttcatccctgctcagagcttcagttctcatcagtctacctctgcctctgccattatctttcctgactggtcctccttctccctttccccactgtacaccactgtgctaccctgtaggaaccattgtgattttcttgggtctactcagataacccaggataacgtttacatgtctaagattcttgatcacattaacaaaatttcttttgctataagataacacgaacatttgtaagtccaagtcaggagcacaggcatttttgtgggacttatttttctacctagcccactgacatacttaaacaacttccttctgttaattttttgcttgtttgtttttaagatttattttatatatgtgagcacactgtcactgtcttcagacccaccagaagggacatcagatcccgttacagatggttgtgagccaccatgtgggtgctgggaattgaactcaggacctctggaagagcagtcagtgctcttaaccactgagccatctctccagcctcctctgttaattttttgtttaatgggggaggttggagagatggcttagtagtgaatgaagagcatatgttgctcttacagagagagagagaacttggtttagttccccatacctatatgataattcacagccatctgtaactccagttccagggggtctgtcatcctcttcagacacaggtagcacattgttcatatacatgcacacactaattttttttttctaatttaaattcactcttg

SEQ ID NO: 34645 - DNA, 1147 bp, Mus musculus
caccaaacaaagaactagtcactggctgagagtgtggggacccgccagagtggtctctcaggaggtcaagctggctgtctagtcccacttctggtggcaggatcaggcccaaaggccagagggccggaccgggttcgtaaggcccacggaggaagaaggcagggcggcgggagctgacagagtcaggaagggacccgctacggcgtgcgtgggtgcgtgcgggatggcagggccctctccctaggcagttcaacggcagaaccgtctccacccaagcggaggagagagagcagtgctcgcagctccggaccagtcccaacttggccgcatcacgtgacctagctcaggggcgggggcaagcggcccgcccggccccgcccaccccgcgcgcatgcgtgtcgtccggggcgctgaaattcaaattttgaacggccgtggtagcctaccgactccgtgggtgcggagggcagagccgactgggtgtgagagcgcccgccgcctcgactgcagtcctcctccaggagctgcgccgagcctgcactcacttctttcctcttcctgagtttgaaccgtcggacccaccgtctagccgtccactggtgaggcctggggcgatggacccgtttaccgaggtgagagactctgcgggcgctgtgaaccatgacccctgccgactccgggacccccgcccgcgctgtcagcctgcggccagcgtggcgcgtgcgcacagcgagcgtgcagccggacggaagccgcggggtcgcagccgccccggcttcgctgctccgtccctggctctggggaaggcagggcctcaaaaaccccatgcaaaccccgagctctgtagtcgtttagccttcctccactcccccaagtgctggctcggggtgtgagcgcctgggcgctctggcttgagcctgcccccccggctcccgggacttaaagcacgcttccctccatccttcatccgtcttgctgtgacccgggagagtgccgctcaggggcctagtgggacaagccctgccctaaagctggaatagttggcagggtggagtcggcccagtgactcgtactgtgtgcttggaatctgatggaagtgataaaggacttcacaggcccagaggagcttgagcgcttaagaatcctg

SEQ ID NO: 34646 - DNA, 1168 bp, Mus musculus
ggcagagcttggaacttgctgtgcagtgggctcacagaggctcagacctggttctttagggccctgagtttcgtctcctcttccgtcagctccccctcccccccatccctgctcttcttactttttttttgagacaggtcttgctatgtatcaacagtatgtagactggcttggcctggaactcacaggatctgcctgcctctgccctcagggctgtaattaatgttgtgcccaccatgcctggctgcccccttcatcctctctcatttagctccctctgtagacctggctggctctgacgagacgctggctgccccaactgagccttgcgcagcttgagtcagtggcaggtacccactggtgtggttatttctcagcttagacctatgtctatgaagtgttctattaactcttagtagctgcagttatgagaccttcttgaagataatttgtaactttgagattctatctgaaataacacttaaaggcttctgatactgtcccttccacaggggcaccgagatgcttcatctggccgtgctgcactcccggaagctctgtgtctactccgtctcaggtaagaggttgctcttctctgtgggaggtatgtcacaagctgggtgcttggtggaagagtagatggtgtttgtgcgagggcttcctagtctctgttagcctccctgccagccattattcttgtctgtacatttcctggtccactattcttatgtattcctgtttttatcagagggtttcctataatctcgccattgtcaggaattgtgtccagaattgcctgtgactaactgcaggaggctctggttccctaggacccctgaagcttaagagatgctcagccatggcgacaggtgattagctgttgagtcacaggtgtgaaatgtctgttcattggtcagcctcaggtgtttctcttttagttcctggcttcttgtcctcactcagtcagacctcaagacccttgagtttgaggcaaaattggttttgttccatgatttggtcctgtgggtacgagtttagtgtgtcttggctttttagcattttggcccttattaaaattcaggatatttcaggggcaaatgtctgttaacttttaaaggcagccttggtacctaggggcatggtagatggtagaaaacaactagaaatt

SEQ ID NO: 34647 - DNA, 1112 bp, Mus musculus
tcataaatggatgcaaactgcagtccactgtggagaacagttacagcaagagaggccgtgaacggcagggtgcttgggagagactgaagggagggacggagcagggaaatgatgcaattataatttcaaaaaatgaaaaactgaggcagtgattgttgaaattataagcactgaaataacttctgctttttattacatttaggattgaacttatttgttagaaactttcttggatgaatgtgcttatttgtaaaggatttcactgctcctttaatatctctctttcagtgactgagaagcactggattcagatcaagcagatgcaattatccttaacagcagcctttaactcagaaaccaacatgcagtatttcctgtccctcccacccacttggcagccctggctctaccttgttcattatgctctaatcctaaacctgcacttcctgcttatacctcactgatttaggggggcacctagttgatttagtttaatgtttctctgtctgtctgtctgtctgtctgtctgtactcacatgcacccctgcatacacacacgtgctgtaatctgcaggcagataaagatcgccatgtattggtagcctccctctctcttgcactgtgggatatcccacggtgagaagcatttgaagtgacattgggcgtgatgagcctttccaggctgcagccacagccccatgttctatagtcagtgatgctcactccttctaccggaaaacagtttttagaatttcggttttctctgaagctctgtccaaatagactcttactttaacttttggcatctgtgttttaccctgagtgtctgttgatgtttttgacagagtgttttctatctcttttctagatttcctaatttcttttatcttaaatcttagaataactctttactatgatttccttctacacattgcttttgcatttataattttgttggtgacgtattctccagccattcaggatactctttctacatttgtatttcatccagaatagttattcaggaagacaaacttctacctattaacacgcatgcctgtggatagccatgttagtcatcttctcatccagcctgtcagccttttagaaat

SEQ ID NO: 34648 - DNA, 1167 bp, Mus musculus
agcagctgtttaagtgctaggaaattgcgttctattttttattagtaaattagcagattgattttgtgtagatttgtatatgtttgtgatgtgtgtcagtggcttttgtttcaaacaataaaagtggaggttataaaactaatttacttctagtgctttggtgtctaaacctcagttcactttgcgattctgtttgttgcagtgaaaaagagaaattcagctttttctctgtagcctgtcttcaggaaagatgttaaagataatccgctctccacagtgacacattgtgacacattgtgacacattgtgacacattgtgacacattgtgacacttggctcagccttcactgactggttttgccttgtccctgtagtcctgagccaagtcccatgtgctcctaatgcctattactctgttcacgtctgtccaactctttcacagcgtttaatgcattgtttgtactttaatataaacatcctttatagtttctatttaacaccaatgtaagacatttttccttatagctgcggataaatggtaaaaaattggaagaacttttatctgaaagagctgtacaatttcgggccattcagcgtcggcttctgacaagattcagagacaagacccctgccccactgcagcacctggacaccctgctggacgggacatacaagcaggtcagtgccatgtcggggcaaatgtgtgtcagtacacctgtctcttccttcccgagggtcaggcgccagggcactgacatatgctggacagtaggatcaggatgcgtgtgtgatgcttttggtgtagcctataagtattccttttcttctctgttttcccaagaaactaccacatgctcccagtatttgtatgattataatgaagacctcggccttcttgtgtcttcttgggtttctacatgggatcactactttgttttaaaaataatattggcagtatttacactgtgaattttaaaactgagattttagaaaactctaataactgcatattcctgtgtacttgtgacaggtaatttagacatatccacgtgtcactgctctagcttctcccagcggtgacactctagaaagctccagcaggatggtgccagcaggatgtgggcaccaattaaaaccctgcttgcctttagggttggctgtttttc

SEQ ID NO: 34649 - DNA, 1230 bp, Mus musculus
tctgcggctgaacttttcttctgcttcttgtttgatcttttgtcttcaagttggctctttgagatatactcagacataagatgtttctaatagtacaataaaactattgatggttctgttataagaaaatgaatatcttacctttttgtgtcagtgatgagtgaagaaacctagaagtgacctccagttttctgtaaccgtatgcgggttgctttcatatatgttatctgtttccatgtttgaccccatctagcacaattatcccgcatatctgctttctctaaattgagttctgaatggtttgattgctagttaatgatcgttacatgccttatagacctctcggtctgccctcttccatccctttcctacatctccttggtccttctttaaataaagggacacagtctatttccaaaggacatcattttgtgatctttcacaacagagagctgtgccctctttagaagaacatctgtgcacagcttcactttgtctaagcctagttgtgctttttctgtgtcagggatctcatgactcagtgaaccacttaaagtattagtgtagtccagggcccagggaggaaggaatcttcatcaaaggtgttcctgttagctctctctctctctctctctctctctctctctctctctctctctctctctctctcatccagggcccagggaggaaggaatcttcatcaaaggtgttcctgttatctctctctctctctctctctctcacacacacatacacacgtatatgtatatgtaatatgtgtgtgtgtgtatatatatatgtgtgtgtgtgtgggtgtgcgtgtgtgtgtgtgtttgtgagcaagtaggtaaaaataacttaatataactaaaagaaatgccatttacatatttaattgccattaattcaaaaccttttcactctttatgaaagccataaatggagtgttattcattaagatcagcagctattcagcatctgacttcactgtctcctaatggcacgtgtgtgtgtgtgtgtgtgtgtgtgtgtgtgtaaaatccagggcccagggagctacatacatagttttaagtttctctttaaatgattcctaaattcctatatcaggatgttaaactccagggaaatcctatctcccatccaaacttgcttgggtgattcctcagtcaccaagccatgctctgttgaatttttagggtcacttaagtccataaatatcaacttagt

SEQ ID NO: 34650 - DNA, 3230 bp, Mus musculus
tgtgtgacttaagagctatgctgattaatggaagtaggaaaagggtgatgagacaagaagtatagacactgctgtgctatctccacttggataatgtgcattgaccttaaactgtgctacttccctaggcctggatgcagcatgcctgaaatctgggatgtagaggatccagacaacgctgggaaaactcccctgtgcaacatcttggtgaaggattccaagcctcactttaccacagtgttccagaacagtgtttacaaagtcctagaagttctcagacagtgactgcacgtgcatctgccagagacgcaccagtaatggctttactgctttgccactaactcagagcgcaaacctttagaaagtctttgaaagtaactgtttcgaatggcaaacatttgatttggtcagtttgtcagtctgactgtaaaatggcttacatcagatcgattagttactgtttcactgcacctgttaaaatttgctatgcaaatgagtatatgtgtgtacttggtttaaatatttgtgttatggtgaacaaagccatctgtttagaaatacatcatgggtcatgacagatgatatgaaactacagtcacttctggactgataggggcctgttagcaccttgcttcctatttacctcctgatcttatctttgaacactgtctcagctctcagtccaggcgtggttggcctgtgggtcacctgttcacctcgcttccgggtgctccttttgttgtttgttgctctcgtgaatcaagtgtttcctgcctgttgttacccagactcctgggtatggtggcgaggaccagttccttaagtttccagctatgtgctgtgtgtttctccccacgcaggctggtttcttttccacataaatactgtcttgtctttaggttgattagcaagtgcttattcttggttaaaaaattagtaattgtgtatttttctcatttttagtattaatcaaatattatattttaatacctttaattcatttaaaaaattttatgattaattacgctgttaggaaaaactattttggacaaactcaaatatgatgcatctatagcttgatatatatgtacatatggagagaggggggagagagagagagagagagacatagcttgtggtggactgtagtctttgctaattttaccttcactattagaataaaataaaacctaagtaacctctgttaatgtaaatgagatgaatagagtcttttattttgctttcaaaattgcctatctttaataagacaaagccttaagccttataattttgcctcaaaaaaaaaaaaattcagtgtgtagagtgagtatgctctcagtctttcccatttttttcttgttttttttttttgaaaaattcctaaacttgctttgaatttcttatacaaattttgtttcttgaaagttaatttgtgtgaaatgagatacttcaaaactataatcttcattgttgcaagtaatggttttgaggttttaaattctaagtaaactgtgaccatggctgactacccattttttatacagtcttctctttattaaccacaggcagattaacctcagtgtggattgtccttgagacctgaaccctcagggatggcttccggtgcccactccagtcctgacagccacggaaggaagagctgttctttctgccttcttcccagagccgaaggacaagcttgtctgggggacattggtcacctgcaaagacagcacttgcaactgaggagtgtggcctcagtaaggagccagcctcaccagccagggcctccctccctgaagctgcccggggactgccattcccactgttgcagactgtggccaggcttcctcatctgatgcttagttttagttcccaagcttttacgaactccgaaaataggggagcaactggaggtcatggtttaggggtgtttgagtgatagtgtggcaatgcagggcaatgtaaagaaaggggcaggcatgggagtgagggacacatgccctgcctgctccgcagctcttctgcagcccaatatggctgctgtgtggatacagcagttagggttttttttttttatcaccctttaaaagttattttctgtccttaccctctaacaattcccttcataataagttcacatgtaatgattggaaattctgtacagagaaacaaaacattaaaatactgttagagccagttcacatgctgggaaacattaaaagtagtctaaattaggtttttttgcagaaaccttttgtaacaaacagtatgtcgtaatgtaactccagcagcaagctttgcttgtatttagtcaagtcagcttggaaatgcggccttggggcccactgcattctcagtccagcacatctagtagcagtgtggcggaaacacttttatggcaacatggagcagtattagattttatgtagctgacaatgcagtattaaagctcagtattttgcatatttttagcatttacaaatatttttgctttagtgtgagaaaaggaaagaaagacagaaggcagttgaatagttattattgtgacattaaacaaaaaataagctgggtaatatgtccattaaaagctaaacctctaaaatgcctgtcagagtgtgtgctgttctggtaggccagcagcatggatgagaagacaaaaggatgtgtctgagctaaagcgatcctgcacaggagtgttgtatttttatgaattttatgccccttgtttacatgtactatatatgttaaataaaaaaaaaaaacatgaaaaatgtgccatgtgttttctgcctgctactgttctctgcacccatctgtggctgcgcacattcccatctgtagtcagacggccgtgagctgatcgacatcctcttgcagtcttcgctaaaatggggaaaggtaacaacctggggcccattgttgatggtaggggctcgaatcatccaaaatggtatggtatttatggtcaaagccacacgttcctttgtccttttcatcaagggacatatgtattggtataattacagagttgctaacagcttttctcatacattacaccaaagaccatttgttgtaaaagattccccaagttatagtacatttatttgtgcattattgcttttgctgtttagggaaggcagtttagctgtgttcacccatatagaaactaacttacttttttcttttgttttgttgtcattgttgttagatttgtttgttcatttgtt

SEQ ID NO: 34651 - DNA, 1197 bp, Mus musculus
ttaaaaaaaagagttcacatcttgaaaaattagatacacatatatttttgtttaggtcttttatgtttcctttgtacaattttaagttttttaaaatgtaaatcttgaagatttcttatttcatttttttcttacctatgcatcaccagtaagacttgactacagaagagtctgtgggagaggctgagcttcgtttaactagatagagaaggagccaaagagcaggagcatgaaaagagagtttgacaattatgaaaaactctaaaatatatctagtaatgataacatttcttttcattttgtttgcttttttttttgtctttgtaaattttcaagacagggcttctctggggaaccccagacttttctggaattcactctagaccaggctggcttcaaactctgaaagatcttcttgagttctggaattaaaggagtgtgccaccactacctaccttggaaattactcatgacttctttattttctttaaaaaggtgatcttagccagctggtaccggatttataccaaaataatggatttgattggtattcaaaccaagatctgctggacagttacccgaggagaaggactcagtccgattgagagctgtgagggtgagcccctttccgtgttgtcctgttgtctgtgggactacagaagacttactgcaatcttagtgatacgagtagcaaacattttattatgcttttggattttgcaagtctcaattttgggcgggctggtttgcttccatggtcacagggcaatcgcatggctgtgcaaagtggactgaacaggaagctgctttgatcacattttgacccttgggctggattggttcaggtgttacctgagatgtctagatgccacctttccatagactttggttttttttttaatatactttttattatgtattttcctcatttacatttccagtgctatcccaaaagtcccccataccctcccacccactcccctaaccacccactcccactttttggtcctggcgttcccctgtactggggcatataaagtttgcgtgtccaatgggcctctctttccagtgatggccgactaggccatcttttgatacatatgcagctagagtcaagagctccggggtactggttagttcataatgttgttccacctatagggttgcagatccctttagctccttgggtactttctc

SEQ ID NO: 34652 - DNA, 1201 bp, Mus musculus
agagctacatcgttaaccctatctcttatctttttgtctcatgtcgtttcacctttgctacagtccttttcaaagtagcatgtcaagttctctcaaaatgcagccctcccagtccccagtgtcagctcctaggctgtgttgctatgggggaaatgatctgaaaaattattgtttaataggaatgtgaataatgtgcagtctttttaaaaaacacatttagatttttgagtgtaaatttggaggaaataagactgatatcatttcaggtaatgaatagactcttcatacatggcaaatgcagaattgcatgtatacatatttaaattctgatactatttttgaagctatttttccattaaattattttaattatgatgaaattcttctaaaatgtactttttttaacctaagaatttataaatgatcagaaacctgtgaaattaattgtaggtattacctgcttgagtgctcagtttttcaaagccagtgttttttaaatatttgtaatctacgaaactgagtaacgatggacttttattataactggagcatatcctcctttcaggggctgtattactcttacttcaagactattgtggaagcaccctcatttttgaatggagtatggatgataatgaatgacaagctgactgaatacccccttgttattaacacattaaaaaggttcaatctttaccctgaggtaagtcactgctgtgatttttcatgaaaaaaaatgctttttaaaaattaaatgtgagtctaacttttaagttctgatttaccatactaaattttatttcaccttttaataaaaaatatgtaccacatgaaggagggggaggggattttgaatctctgggatctataattgtgatggcattattagaaaatgagagacttctttacatttggtgactttatagctagagacggccatgattggcatggttcatttgtcagataacaactcttttctctacatcccttccctccctagggtaacattctcccctccctaggatagcatccttccctcacttgggtaacagctcttgggttcctcttttcattgagaacattttcttggacagggctagaaggaaggtgggctcatctaggaggtaagggagaaagactgtggtaatggtaacatttttagactttcattatcttcctgccttcatttgactaacttgac

SEQ ID NO: 34653 - DNA, 1216 bp, Mus musculus
ttttcttcaatgatacgtattatgtaaatgttcataactaaccaaagctatagctcatgtatttaaaggcatagcttctgtgtcataggatggatgtatcttatttataccatagtcttctcaaagattagtttatttgataaaccaggatcagaataataaaactgttgtatgaaattatccattattaaagaggctatatttgatactctaatttgtgtaacattaatatggtatacatgttgaatgttagattgatgtttttaatcttctgggtggagagatgtatgaattttgtgaaccaggcagtttctgaatggtacccaatggcacattcagtatgatctatatttttatagtaaatcacttaaaatatcgttatcgtttattttaatgttaaaatctaattggaatgtgttttcttatggagaggacttttagtagaattgttaaaacctggtagaaaacaaatacagatataatggtgtttcagttttgttgcaaagggtctgcagtctgtagaccgttccctttgcctttgaagtagctctctcggcctcagcgctgactgccgtgctgttgaatatttccaggagccacataacgcacctctttgaaaacgatcggcatttctctcacctctcaacgctggaaagggagatggctttccgcactgaaatggttagttctgtgtgtggatagtatttcattgtagtattttgggtctctaaatatttcaaagcttttttggcatgaaaagtttcaacaagacattcccaaagaaaaggagtagacagttctccctctttatcttgtagcttcaacaacagataatacctagtcatccatattccttaccaatgtctgcttaaaggaaattagacttaactcttgtgctgccgcatttgaagttcctcaaaggactttttgtccctagtaatttcttagcatcatcaaatgaaaatgtttgaaggagctgattatgattagcacttgatagcagctgatgtccttaactgaagatgcaaactgtctgtatttatgtttacctgctgtattgctgggtcttctaatctgtagacccctctttcttttttgtttttctgccctttatctattgaggaaccatatacccatatctatatctatatctctatatatctatctatctatatatacatatacatatatatacatatgtgtatatgtgtgtata

SEQ ID NO: 34654 - DNA, 1246 bp, Mus musculus
cctggggacagagtgtagggggttgatggagacatcccatttaggattgagtgctcaaggcctcactctgcacattgtcataatgttggtcttgtgttcattttcatacacttgcaagaagcttctctaatgtgggttaagtgaggcattgggtatataggtataggagtaggtaattttttctgctatgttccttaagcagaataatagtactaggctttcccttaggcctatgatctatctagtctcaggcgcttggccacttaagcaatggcaggtacaggtatcatctcatttattgtgtcaaaacatgatcaaaagaacaactcgggtcttagcgccatcttccttgagactcctgcaccatgagagcgaagtggcggaagaagagaatgcgcaggctgaagcgcaagagaagaaagatgaggcagaggtccaagtaagccagcccgtgcacctacgacgcctgcaggagcagaagtgagggatgctgagggccgagacaagctatcggactgtgtgctgccatgagtctcaatagacctggaacgtcacctcgccgcgatcgcctggagaaatgaccgcctttcttacaaccaaaacagtccctcagccctggacccccggcactctggactagctctgttctcttgtggccaagtgtagctcgtgtacaataaaccctcttgcagtcagctgaagaatcaaaaaaaaaaaaaaaaaaaaaaaaagaacaactcatggtgaacagtgccttggggatctgtaagagaggctcctggagaaaagcagagggctttttacctcaagtgtattttgttccttggatcattcttggaagtgatttagcacctcctgtgattcagtttatgtgatatgcttattcttgttggatgtaagagcatagggtattcttgcccaatcaggtcagtgtaccctgagcctggatatggtcttctgccttgcttttgagctttctcggatataatctataggatatgccgcacaattgtagaattggtctgtcctaagaaagctctgagaaaggaccgctctgttattaggtgcttactgacatttatttacatgctttcctgaacttgaacaatcttcctgggatcgtcgctttctttgttacagtcatgtataaaaggacactgaagttgaagatgcctacagcatcagactgtagtcttccgcattctttcaggtccccagataccaggtccagcagacaagatccgca

SEQ ID NO: 34655 - DNA, 1550 bp, Mus musculus
ataattcaagtttttttttcttttcagtgaaaatacattgcttaaaatgacagcatagttctatatggtccgctactgctgccgtttgttgtctagtatttatagtgctccttaccgcattgttttcttatcccttagaaccttggaaaagaacaagaagaaaggcaagatcttttaaactctattgaccaccagttatgtattagttgccaatatgccagcttggacatcagtgtttgttggatccgtttgaccaatttgcaccaattttatccataatgatggatttaacagcatgacaaaaattattttttgttgttctcgaaggagattaagatgccttgaattgtctaggatattgtgtacttagaaattaacagctctaagtacctttctacattttttttcttttttttttaaattaaaagatgtcttcagtttaatgcaagaaaacattttactgttgtacaatcatgttctggtggtttgattgtttacagaatattctaaaataaaaggactctggaaggttttcattgaggataaattgccataatatgatgcaaactatgcttctctatgataattataatacagaggttccattcgatgcagcctatacaataatgtatttagtctaacacagtggaccctattttttgacacttccattgtttaaaagtacacatggaaaaaacatatatgcttacagtgcacctagagctttttataacagccttttttgtttgtttgtttgttttggattctttaaatatataaatatattattctcatttagtgcccctgtagccagaacctcattactgcttcatttttgtaataacatttaatttagatattttccatatattggccctgctaaaatagaatatagcatctttcatatggtaggaaccaacgaggaaactttcctttaactccctttttacactttatggaaagtagcaggaggagaaatgcatttgtagatcatttctaggcaaattgtgaagctaacgaccagcctgtttcttcctatactcagtcttgttttactagaaatgggaatcatggcctcttgaagagaaaaaagtcaccattctgcatttagctgtatctatatattgcatacctgtatttttttgtttgtattgtaaaaaaaattcacataataaacaatgttgtgatgtaacagagtgcagtgtcttgtatattctgtagttgggaagaaacttgaattccccctaaggggtctgctgcacatctgtcttggtaagtatgtgcataagccagttctcagagcgccagcaccctcagctcttccgagttagtgctcattaataagttacttccaggaacattttcccattcatttggattatatctaccctggaaactattgcattttacttttaagagtgtagtgcttttttttgtttgtttgattggttggttggttggtttggttttctttttttttttttttcttttaataaagtcaaaatacttgactgagcttagatttttaaattattgaccaaagcagaaat

SEQ ID NO: 34656 - DNA, 1234 bp, Mus musculus
tcatagcaggtcctgcactgcgattgcacgcggatgccatccaccctcctagactgaaggttttgcaaggggaggggctgggttctgagtcatagttttggcacagcagcactagaaaattcatagcaagaatatgatagtcatatttattatttaatttgattcaagtgctattgtaagcattttatattcagtaactaacttcattctcacaccagcgagtgactaccgatgtccactatacacgtgaggacttccttgaagtatgtaagcacgcttgcagaagtcactcggctgctgaggagggagcaggccctggctcctttatggattagagaatctgaaaatgatgagagcccacatcaggcccaggacgggacagttctatacccagagaggctgtagagacagcatgagttgtgggaagggaccatgtgtctttgagagagctcaaggtggttgtcattccattgggtgccagccaggaagtcacccagtctgtcacagtgaggccagcagtgctgggctgtatggcagctgggtttgttttgaaattgaaatacatttttcaccttatgcagctcgttgcagtaaagtgatggttagtagtttttttttttttattcgaaatattttgctatagtcacaggtgagagttgtacaactgtcacccacggaatttcagaacatgtgcatcagttcatatgtattagccgtcacttcccattgcctgtcctttcttcttctgggcacttggctgtttgaactggactccttgcacttcgcatgtttcaaggttcatctacgttgtaacatgtgttagcaatccattttttttcccctgggagttgagtagtaaatttcactatcttgatggatactagttttttccgacctttaggctctgatgaataatattgacttgactatagaggaagacatttctatacggaaggtattttcattgctcttcacgatattcagagagtcaggttgctgggtcctagttaattctatgtttaacattctgaagaactgccaggctgtttgctcgagcagctgaatgatttcccacttctgtcagcagtacgtgagggctcaggttttccaagtgcctgccaacacttattattgtcttttggtttttaaccatagccatcctattggctatggtatagtgttgtcaggttttggattccattcccccactcgccagtgatgcttagcatcttcc

SEQ ID NO: 34657 - DNA, 1193 bp, Mus musculus
gactgaaggttcttgttcaagggatcaagtgcaatggtttggcttgggcttgtcattctaaattgcaatacatttgaagcaaaccttctttgtggatgtctcaagcttgtctgcgccactctcagccatgggaggtgacccttaaggatctagatactgatggtacccagctggcaagtggcacagaccactggcttcttaccacttttcctgatttcaattctccttggcatgtcattgcattcagagcagtccaatctcatgctggtagttaagaataagaactttctagaaagcgaaaccagaacatatcattgagctatagaagatagttttgcttcataaattacagctgaaatgtactgctccaagtaatagtgcccacacagaagcccagtgaagatgggctaggcaagaacaggccaacggagaggcttacagactgacagggtggctccctgagtaaggccaagactactgtagtcagggctactacagccactgagctaagcgcccagctaacttacttgtgagtggtcataggggcacaacccatgtcccactgggtctgagaaattgaggttgtgtctgtctgtctgtctgtctgtctgtctttttctcgatgtctctaagatggggtcatattataataatccagtctggccttgatcttctggttctcttgccttagcttcccaacttctgagattacaggcttgtagcatcatgcccaactcaaaggaaccttttttaaaaagccttttatttgtcttaaaaatttaaaataaaatcacttgataattatctgtttttgtgtctggggaaatgaggtgtatgagagccatgatgtgatgtgtgactgttcagagggcaggctgtgggagttggctctccttgtgtcccagggaacaaagtcaaattgtcagggatggtggagagtgcctttacccactgagccatcctactcaccctcagaggaagcctttcaaagtgaaacttgtagctgatgcctacagagcaaggcctgccaagcccccaagtttccccactcttgccaatttcttctgcgatgcccggaagatgaagcatcctgctaagatgcagaggagtccagggctacttgagcagagccagagccagagagcagtgtcatattgtcactttgtcttgcattacataagagcgggtttctg

SEQ ID NO: 34658 - DNA, 1234 bp, Mus musculus
cagccatggtgatgtcaaaaaactaaactgtgctttccattacaccagaagccactatgttgatggactcttcatacctccaagcaaaactgtgttacccactgtgcctgagtctcaagaagaagtaaagattagccagctttacagttcaacagaacaaattgttcagtctaacccctcccctcagctgcggagtgtaatgaaagtagagagctcagaaaatgttcccagccccacacatccgcctgttgtaatcaatgctgcagatgataatgaagatgaccatgatcagttttctgaggaaggtgatgagagcaagacacctgccctgcaaccaactcctgacgtccataatggattacgagtggcttctgcccgcaaacctggagtcagtttaaagcaaggtgaatgtttgaattttggaataaagactcttgaggaaattaaatcaaagaaaatgaaggaaaaatccaagaagcaagatagctcctcgggagtttccagggttttacatcagcctcagtccaatccaggccctgagaggagaatgtttgggctgtgatgaggatggtaactctatcaagcaaaccagaagagcccttggttagactgagtctttctgagagactggggaaacgaaaactttcagtaggtggtgacagtgaccctccattaaagtgaagccttgcacagagactggggaaaaaagtggaagcgccagaaactaacattgataaagcaccaaagaaagagcgaggtcataaagctggggagatccatgtgaagacactggaagaaattcttcttgaaagagccagtcagaaactggagatttgcaaactaaactgaggacagaagaaccttcaggagctgatgattctccatcgggaacaaaaagttcttcttcagtgcggatcaaaaccttctttgaagtcctgtccgaaaagaaacatcggcagcaggaaatggaaagacagaaatccaaaaaggatacaagttgcctcatgctaacagaagacactgaagtgaaaaagacagtgagtctgccgactgttgctgatagcaaaggacaaccagaggagtctgcaggaagagccaggtctaagcaggaggtgcatattaagccactagaggaaattaagctggagaaggcccagagggtgcagcaaagctctgagagtagtggcaactcctgacctcaagctgaggctgcctcagggacaaagaggctgca

SEQ ID NO: 34659 - DNA, 2626 bp, Mus musculus
ggaacccctgagaaaagcatccccgagcctctctcaagtactgttttgccctttcttccaactctgtaggaagtggtgttgtggcggaagggtgacatcgtacggaagagcatgtcccaccaggcagccattgcctcacagcgcttcgagggcacaacctccctgggtgaggtgcggacccctggccaactgtctgacaacaacagcaggcagtaggcccctggggccaagaagttgctgggcttccaccacagaacccccatctgccgaataccagccactgcgggagggggaggatggtgtgaggttcaactggctgttacttgcaaccttggaaacaaatcatgttttttacttaaatttttttctctgaagaacctaaggggcttgggttgggcagcagtctccccgggatgctgcagcctaggtagggataaggagaggaaacattctggaagctaatctcttccttgggaatgagctctgtgtcaaggctgtctcaagccttaaagcagagttgagagcacacatccttggctccaggttctctgggcttcctgatacagaagctgagtgtgtccctggcatttacctgccaccagggctctgggtagtcgtgtcttatactccctgtgactgttctgagatagtgacagaagggcctgtctcatctaacttggaagaacactcaagaacaggaagctacctctcggggtgtccgggacgtggtgctctcgagtttctacagtcacctctggcctctcactactgggaccagacccttctcttcttcatcttctctagcttgtcaagaactatacaggagcagaagcttaaggaagggtctgtgtctgactcctcttacttgtgagaaacaggcacagagaagccctgattcggtgtcacacatggatggcaaggggctgaactaggtctcctgagggggaaaaagaaacatcaggcaaggcaaccgtctgccttcaccacatgactcctcttggcaacccagtgtctgggttgttgtagggaattactttaagttatccaacaagccctaagcagagggtctgtttcctttagcctagatcctagaagaggctgggctccacttgcctcctaaagcagtttgtcctactccttgtcttctgcttgatttctggaactgggctttgtttcaagcatgtataagttttgtccttactcccacccaaaccctttcatcccaccatctacaaattaggggaggaaggacctctgcacagggctctgctactgtgactagagtaattctgcttgccaaatgacatctatcttcaccaattcactgactcaagtttaggaccactattttgttttgttttgaatttaaaaacaaaataggacaactgtggtggatgttgttatactagagaagaggtagttcttcctcctgctctatgcttggcctgcaagtagaaaaggggttgactgtctttctaccttgtctggaaatgactagaattaccatctcctgttggctgtcctcccctgtctgagaaagatcaagcagacctgatgttcaacaagtagtgttcgctggtctgtgttccttgtaatttggaaagtaaaggatttgttcctgtgtcatctttcagttcatgtagaaaatgggactcttgcaatctctggctttgacagggcgggccgttggatgaaagactcttggaatgactgggggtagcagagctaaggaaagtaaagttttctccatgcacaaccccaggtttaggtgtgacatacaatccccatgggaacaggttcacccatccagctgtccttggctatcaaggctgggccctagcatatgagggagttgggttctgggctcttgcccttttcaggatatgagactagactctgccgtgcctccttttaatatctcattaaaaagcatttgtcaatttctctgcctcccagccgacaacacaaaattattttccaacttttgctaatatcataagcctttcttctgggagaactagaaggtagaatatgctgtttctctcaggagctgtgcacaagccaagtatgttttctctgcctgtcccccgttctcctttctctgccaactgtgaaagtatgggaaggttcccatccccatcctttaaggttcccaaacctggagtgcataggtactaaaccaagcagtgcaacttgtaattaagaagctgcagtgtttacatgtttcttaatgtgttgtcttttcaatggctgtattttaaaagaacatttgttttaatgatgtctctaattaaaggaagccctatggctttggaggcattgtgcccgtgatccaccagattctgtggtctttccttcttaacactgtctcatctctgacacagtatgcagcatgcctttaacactgccttcttttccagtggatggtaaacagtaatgagcactgtactaaccacccattataggcaaacatggcccagttctggccacactgtctggcaatgtgcctgaaaccccgttttccaccgtggtgggacaaagaagactaaaagtagcatggaaagatcaagacatagatttactgagtgttcaaagaacaagagactcagtcctacattttgctgtt

SEQ ID NO: 34660 - DNA, 1193 bp, Mus musculus
tttaaatgaaaagaaagagtacatttcagcttcagaaagataatcttatatatgtgggataatatgaattatttttaattcttagatttattgcacaatatcttggatactgattatttaaatcacatactgtttgtttatttgcctatttgtttataaaaggtcttactgtgtgactcaggttggcctagaactcttgatcttctttcctcagcctcctgagttctgagattacaaggcttgggtcatcacaccccagtacattacactttcaaaaatgtatacaggagttatatatacatatagaaaggcaggcgcatgtgtgcattcatgagtgctcacacacacacatacacatacatgtgcacacttacccaactatcaatcattgtctttttacacacaagattataatgtggtggtcacatgaccagattgtccttcaaaagcaaggctacatagtggatcagagctgaatgtccatcagggttgtgtggagattgaagctttttatcatcttcagtgtatttcttactcctttttctaatgtagagcatagaagtggtgttaatattcattgtgctctgcaggcctgtatgtgctgtggtgctttcagtctggtgacaagccatgcgagcccttcattcccagcatcctaatcaaatggcacatgggcttctgtagctgctagatttgatgtacttaaagaagtagatcatggaaaagctattcttcagatgtgtgtgcatctaaagcatgcctttgtgtgtgttcctgcaggttcaaaagaggaatttcatagagaatattattccaatcatcatctccctgaagactgtgctggagaaaaataagatccctgctttgcgggaactcatgaactacctgagggtaaatgaggagcttgccctgtggggttttcctcccaagccccgctgccccaggttcattgcttcatgtagacagtgagtgacaagaactcagaatgctaggaagcctagtctataaaaatgtacccagcaggctgctgaggacagtcaggtaccgaagggtgtgacgagaagtaccactgaggttgctctctctgttccccaggccgctgaggttttaaagcttatgttcatgtcctacaccttctttgggaatatgttccactctaaagcttttctcagataaagctgaggacaagacat

SEQ ID NO: 34661 - DNA, 1112 bp, Mus musculus
gtagcagcaggcaacagcctgatgcctgtgacagtgccccaggaaggttttcaggcagtgccttgctccctggaccctgacccaccgtgttgcctctgttgattggccagtactgtcatttccatcctggagaatgtgtttggaatcagcattttataaaaaacccaaatcagaaaggtgaaattgcttgctgggaagagggctctgacccaggaaactctccttcccaagagatgccaggagataggagaacctgtctgtcttaagtctgaaatggtactgaagtctccttttctattggtcttgcttattttataaaaatttaacattctaaattttgctagagatgtattttgattactgaaaatttctatataaactgtaaatatattgccatacagtgtttcaaaacgtatttttttataatgagttcaacttaaggtagaaggcttgggctgctagtgtttaattggaaaataccagtagtaaagtcttttaaggagttttcttaaggaggctggctgaatattcctttgttcaaaagaagttttagcatttttcataagaaaacttactctgtctgaccactgttgcttaggaaaccattaaagaattccaatctagtcatgtttgtatttttttttttttaaagcaagaaactttgggaactcttggactagttttgaatggcctcatcctgtagatttcctcttcctagaaaggccctgtgcagtcctagttggatggtctcagggacccctcatggtactaacttgtgtgggatggaatgtccacttaaacctgcaccgccctcatctcagctctgcacctgattaaaatggtcactggtggtatcctgggctggtctccggcaggaggctgaagaagactggtggtcagtggttcctgtctttgagtgtctgtgacagaaccctagtctgttttgggtagcttataagacaaagccagtgagcttgcttgtaaaaatcattttaaatatttgtttagttgataatgtatccaagaccaaaggcaattttgaaactgaacatgtttaaaaagaagatcctttgttgtgatgaaaagagtcccagcactgcaggccgtctcct

SEQ ID NO: 34662 - DNA, 1165 bp, Mus musculus
accaggcatatggccctggactgtcttaactctgcctgtttagggaagccagacaaggaagttgggtcagataagtccttggcacccagctgagacaaggatattctgggtcctgctaggctccccacctctatacttttctatttctttctctctcttctctctgtacccatcatgcctttcttttgctctagatctccaaaagagtgggtatttttgaaggagcagaggctattgtcaatgccacaaacagcaagctgcccttgtaggctgatgtaagggccatgtgggggtggggataggggtgggggtgaggttgggggtggggttgtgactccatgacgaaggaaggttgcctttgctctctgactatgctgggtgctgactgcgtttggtgacacggccaccacggaaagtgttctgaaggttatgatgggcccctttttctttggctatgggagaaagagagcggatagatttgctctgatggattggtctgatggctcactgagctttgtccaccgtgttctcccaggccgggccagtcttcatgataaagcatctctgcggctggagcaggtgcgctctgaggaccagggttggtacgagtgcaaggtactcatgctggaccagcagtatgacacattccacaacggcagctgggtccatctcaccattaacggtacgtaaatcttttggtaatggccaaataagatgacctctgtggcttactccagaggaagcccctctactgagagaagccccagtaagccctggtcccatacaatcttggttaatatctcctttacatctcttcaatacattcctggaatttatgggtcagtagagtgtgtgaaagcagcaggtcccttgtgtgcagtgtcgcatcagagttcctctggggaaggtacaaatctgcttctaggaaccaggaggtttggattggtcagtgttggtgtcattgtctagcctcggatgactctgctagctcaggatgtatctcttgtcaggtggagttccttgagtctcagcatgaatcttcctagaccgctcacttagtttctcgttgagtgcatttatttgggtaataagtaccaagggtctgttaacttcctagccctacaccagctgctaggtaaatactgtggagtaaactcaggcccat

SEQ ID NO: 34663 - DNA, 1174 bp, Mus musculus
ctctgttggagagcgttgggcagtaaaggtatatggaggttatagagggctggcctggagatcgtgtagcagttagagatgtggtacagaaagggtgcctgagcctcacagcagctggaagcatctctgtaatggctacctgggctctgctgcctggacaccccatcttcagcatcccagagcttcctgagaggcctggcatgatagccctctcaatcaggagaggtgatgtttattcctgttctccccagggcctcccttcattgtttcccctcctgagaacatcaccgtcaacatctcccaggatgctctgcttacctgcagggcagaggcgtatcccggcaacctcacctacacctggtactggcaggatgagaacgtctacttccagaagtgagcagcaccctgctccaaccctctcacaagggtccccacaggcccctgccttgagagaggggccctggcagtgcctgggaaccctctaggggaggtgaagggactcattgttaccttgcttgtatttctgtcaacatccctcttctccttgtctacttgtcactgttttgcagtgacctgaagctaagggtgcggatcctgattgatgggacactgatcatcttccgagtgaagccagaggatgctgggaagtatacctgtgtccctagcaacagcctggggcgctccccctctgcctcagcatacctgactgtgcagtgtgagtaggggtgaggcaagagggttctgggcaatctagtaggtgcaagctgtacgagttagatttgaggttgaagacccaatatgtttctgaggtctagaggaatgcgtgagggaggagtaggatggctccagaggaggccatgagcagcctggccatagagttaactgtcagcggcagagatctgtgggctggtcatcactgggtgttagccaggtcattgattcaagcttagatcaggttcaaggataaacagaccttagctctgaacatttaccattcagaatggtggctcttgtgttaccaagtactggtttattatacctggaccttgaactagttgctgctgggccctttttcctgggtgtctgcgggatcagggttggtttttctccccgttctactctgcctttgcatatgggaacactgtgcactgaatggaacaggacttttctgggt

SEQ ID NO: 34664 - DNA, 1223 bp, Mus musculus
tactgaggccaagcgaggccagacacccagcacaagcaatacttacccttatgcttggaacatcattgtgcatagcactgacattgcttttttggggttaggatacaaaggagttggagaaatgcatggtcattgttggcttggcagggctagggtgaagtctgcagtgagggctgcttccgtattctgaagaccagggcagttttttaaaatatgcctctgaatgtctccaagcattctgcaacatcctaaggttttaaaagcgtagtaaattggacggatgaaaaaaaaaatgcacagcctacccgagcctgttgtgcgaggtgcctgcgagctgggattgttggtcttactcaccctggtggccctggctccccagcactatgttgaacactgagaatcttagctaggaggtggaaaggttcctatgcaaaggaatggggttcgtgcaccagcttaccttctgccttcattgctcaccgggcttctcatgtttccccacactgtccctttcacagacccagcccgtgtcctcaacatgccccctgtaatttatgtgcccgtgggaatccatggctatatccgctgtcctgtggatgcagagccacctgctactgtggtgaagtggaataaggatggccggcccctgcaggtagagaaggtatgagtgaggtgcaagatgggattccgaaggaagagcatccttctgacaataaagatgctgcctctgggctctggttctctgccagccccactcctcctaaaaagcctaggcaaacaaagagcaacgatctggcaggagtttggctgtgctccatgcccactggggatgccagcacccgccgagctgctgtcctgtcctgtgcttcgtctagcccagctcaaaccctgcctggaagtggctgggatgcagtgcctgtgtcctgaccacagcttgctgctcttttatctatgtctggcagaacttgggttggaccttgatggaggatggctctattcgcattgaggaggccacagaggaggctcttggcacttacacctgtgtgccttacaacaccttggggactatgggccagtctgcccctgcacggcttgtcctgaaggtgagtccccaggactgtgcgtggcccctgtggtgggcagtgttcctgtggccaaccttttatacctgtctctgtgcttccattaggaccccccgtacttcacggtgctaccaggctggg

SEQ ID NO: 34665 - DNA, 1099 bp, Mus musculus
cttctgctgcttcttcttcttcttcttcttcttcttcttcttcttcttcttcttcttcttcttcctcttcctcttcctcttcctcttctcctcttcctcctcctcttccttctcttcctcctcctcttcttctacttctcctcttgctcctcctcctcttcctcttcttccttctcttcttcctcctcttcctcctcctcctcttctccttcttgtatttctcctccttcttctacttctcctcttccttttcctcctcctcttccttctcttcttcctcctcttcttcttctacttctctttctacttcttccttctcttcctcctcttcttcctcatcttctccttttccttcttctacttctcctcttcctcctctttctcttcttctcctacttctcttcctcttcctcctcttcttcactttcttttgcctcagctcacatattggtcatattgggtagtggcagtgcatcttaaaacctagagaggagcctgtgggtatcagttgagtacagctcagggacaaatagtgcggtccagttgcccaggacaatgtctcctccctgtggtatcatctggaactgcacctgtagcaggtggtttactcctattgaagttgaagaagtgggtggctttagactggaaaacctcaccgctagattctttaccttccatcattataactttccctttggttgcaacttctagccttcaaggcattaggagccctgttcctgccatggggaaaaatctggtcaatttttaaaaatgctttggatatcctcagatgacctaaactggactgattgagtggaacatcctgtgatactctcggccctacttctgcctctccctggtagggcagacagcccatgtcatctgggttccttctctagtcacgacactgcccagcttccatcctcatgttcagtgtccctattctagcaagacagagtccatttatacagtagtacttggagtgggattctctcacaatgcaaatggtaactgaccagtgtctacagcatgatttacacctgaggacccttttcactggggaggtaccacaatggggtgtgccctagtgccatgaagg

SEQ ID NO: 34666 - DNA, 1187 bp, Mus musculus
atttctttatgacctgcagctataaaactgtcactatccaggaggccctagcattgtgtgtgaggctgactgtcagcctgcagccacccgtgttggcaagatcatatagttcttgggagctcacctgcttccggggcctcaggtggctccttggatggatggtgcagagcgggaagaatgattcacctccctgctctatgcctgtctaccccactgttcaccagcataggtgcattgttgccctcagggctttggtaggtgtgggacagctcttacccagttccttgaaagtggccaactctaatgtcctttgtgatttctgttttcccccactccactgactctgtgtttccccgtgtcttctccatatcagatctgagagaaccaagccacattatcactgtggcagacccagaaactaggggcagcagtgagggacagttgttcctctcctaggttttgggtagcatccctagcccagaagaacgaagtcctctacgtcgttcaagttaggtctttgtggtgctaggcaacagggacccctgctcattctcctgcttgctgaaagattccctggggcacaggagctgccgggtcatggggaagctgtggcccctctgtggatgctgtcttcgtgctgtgcctttgcatgtgtcccctggtcttgcttggagaagctgtgatgtgtattgtctgcgtttgtccttgctttgtttcttcccccttcagtttctctcccttcctcctgctcattccttttgtcattccccaatcctgtcgtcgtcttctctcttctctctttatcctcttaccagcttccatgtcagagtggggagttgcagtatgtggatctattctgtgggtgcctgggagcccagccactcactcagcgttcctccgatgctgatagtactctgttgactccatctccacttactaccttctgtgccctctgtgatgcagagggctggaaaggctaacacaatcccctctgattaggattactgtaggaaggggtcctcatctggacacaagcctttcctgaggcctgaggtaaaacactgagagaaggatccctttgggattgggctggcttaatgctagcttgtgaattcctggctgtctgtggggcatgtagagtgcgctcacctttttcctggctgtgatatgaatttgaatggatttcc

SEQ ID NO: 34667 - DNA, 1146 bp, Mus musculus
ggaaactgttccttttcagagcttccatctcgggggattgactgcatacgcagccaggccttggtgctcccttctctctccttgagagctggggatggactccacacttgaggcttcaccttgcaagtcctatcaccacagctttcttctggacatggcaaaaagaggtgctgagggcagagcttcttttgctctgagattagggccacataccttagaccctccaactgatgtgattttcagagatgttggagaccactggcccctagacctcaactctgacgaagcagaagggttgagttggaagactcacgttctttctcaaaagcggcacactgcttcttccactgtgacaccatgggctgctaactcagtgtctctgggtctgctgggaacaaggctacctgaaatactggggcagtatttggagattagtactggcctagcctatagtgtttgcttgctgtctcacatcacgtgactcctgaaccatggagtgtaaaggcaggatgtcagggcccctagattttgtattgaacttggacaactattctgaggaccctcctgggaattttggccactgtctgggctttgaagttacaactgagaagaggttgctgtcaaagactgcttctttgggatgttgtagggccaagagcctcagtccatggctaggcttgcaggctgggcttgcaggctgtgctaacaaaggtgctgactccttttttctcttcttgcctctggcagggctccttacctctgccttgctgaccaaatcgtgtaaactgcttttgactggccactgggtgacagctgtgctcttgtgtcccctgggctcagaaggggcacaaggtctacccattccgaagtggcctctcatacagtcttctcctaagaggtcttccttcttgtgactttccttagaggccagcagcattcctgaaattcaggaaactgtttcagcccttcctttgatgactgcatagcaaactggcagatacagtccccatggtcagtggctgaccagggtgtcataggcgcgatctcaattgctagatgtgagcacacgcttgacagtctgtttagaaatgtgtgatgttggggtgtattcacttctagggaccaattacctttacactcttcctc

SEQ ID NO: 34668 - DNA, 1423 bp, Mus musculus
atcatagctgcttcttaggatctaagtctgatactgaggccatttcttctgactttgttggaaaaacccttttaagaaggcttggggtggactgggaaaagtatagataagtacattttgttagtatatagagaactctaggaagtgaacagctaatggtttggatttgctttgtttgcatgtaagaagtgctttggggaactctgcagggacttaggggtggggggatagagtcaagagcagagatgtggggcatgggaggtgctgctgctcctgtttttctctcggatcccgagcgttctcactcgtgctccttggctgggcccttccctttgtgcaagctccaggccgtgctgattatctccgtctctttgggagcaggctcaggatgtggcttagcagtcatcctacactgaatatagtagttgatagggcaggtgggattgaggaagaggagttagactcaaggagtgtgagacttagaaggatgggagactggtcttcaaatgcccatggtagctccttgtcggtggaaagggaagggttgttctcgggagcttggtccttattcttatggctgctgtagcaggctgtgtctgaaagtgcctagtggacactggtgctgatggtggagaggagttgtgcctccagtcttgtcagttttcttcttgagctatcgagaatgccttcatcctgcaggctaacagtggccttgtgactagaggctttgctttcaatttctcttcctttgataggttaaagataccacactgtagctatgacagttaactaatttcatctgaaaccagacaccatctattgtgtccttactctgtagaacttcctcttggatcaagaggaaaaactgaagatctctttaagagaagtcaataaactgagaatcaaagcctggttggactctaagaactcttcccacgtcctgcaacttggtgttttcgtggctggcttataaccccttcacttttaatgctgaatcagcatgggtccagagccttgtgttagggcccctgtctctgcttccaaataagctttcagaaaaaatacactgtctgcaccagatgtttggtgtcatggattgccaagaggattgaagttgtttcatgaccccatttaaaaaaaaaaaaaaacaaaaccaaccctaatcaattgagtctggtctaaagacactcctagatcattgggaattctttgtagatttaaaaaaaaaatgcatcaatgcaaatctttttcatgactggtcatgtcttaggagggggaagagttgggatatcctaactgcaaaatagttgggtacatcagcagcgggccattgaacctcttagaggttctcctctgcagtgggtcaactgaagcagttagagattcttaggcatgctggtgaagagtggtcagctttgcacca

SEQ ID NO: 34669 - DNA, 1545 bp, Mus musculus
gcaatagtgctggctaaccgtgggagcttcaggtaagttgtccacatggggagtggggggggggtgatgtaagcagggagtggggctcgtgcccgctgcacatatatataaatataaagaaaacttatatagagctatctatctagcatatctatatatctatatatctatatgatgtcatagtttgctttatttttgtacctgtgcttagagacactttgagcagtatcgcctcccccaggtggtccggggtgctagctcatgccttgatcccactgatatttctccatcctcctcaagacagactgtgttggaagctgcttgagtctttctggtagatatgtgtatatatgaacaaaaacaaaaacaaaaaaaccacaaaaaaacaacaaaaaacaaaaaaacaaaactaaagtcatttatagaaaggacaggcaagccgaaggcgccaagctgctggatctgcatgtctcctgtcaggggggttccctaactcctgctgtctggtagatgtgctcagtgtagaaaggacgatggagagcttagcatgaatccatacccctctggctaagggttggtactcagttctttggaaacgatttagctcggcatcttggacagagggagctcagattctctaggtcgtctggtaacacctgtcctgctttgtagcacctgggctcaagcagcccccgtgtgaggtggtaggaaggtttttgaagctgactgcgtgggttcagtcttggagaagatacaccctggtaattactgctgcagagtcttggaaccagcatgaatgtgatatctagtataaatatagcatctgtgctttttcatttatttttaattggaaaataaactgttgtcggaaatggggcagtctagtcccagaacactgagcggaagatcaggaaaggggcactgacaccggttaggatgtgagggataggtcctactgctggctgcttggcccgggactctgaagttaacaaatgtattggaagaaggtggtttggatggagattccgggagttcacttgcgtttgggaaggaaactgtgtgctctgaagaatacctctttaagaattcaagacctcacatatgctgcgagggccccatgccctgcagccttagctggcgtctcctggtgctagctctttcttctcatgtgccaagtgatcagagtggtgtccttgaagctgatgcaaagccaggggagactcaaggctgaagtctctccagtcttcctgcttctcacttaagaaaaggcaaaagtgcccccccccacaccaatctgtccaaacaaaacatgatgctagccaagagctcttatttcagatgcctcaactgtgggaagggcttttatgtttttgtttttgtttttgtttttttctggtgggggaggggagtgaaaggcagagtaggctggagaggagcttgagtctaactcctgacccttaaggagaccttatgattcctttgatgatcttttcaaaatattaaaaaaatgtccaagggtattgtgagaaaatgggttctcctgtg

SEQ ID NO: 34670 - DNA, 2367 bp, Mus musculus
aagaacagcaaattctttgtccctttctagcttgagtcccctcctcacttaccaaagaggggattgggattccattgtttgttttttgttgttgttgtttttgttttttgcctcacttttggtcataagctatcagcagagcagatcatgttagcatctcagggctcatagctcatactccatgaagcccaggtttgctctgactctactctttccccgttgagctaaaggcttggtccttagaaacctcagcagcatcaaggaacatgagattgccctcctatttcatgatgtccaattggattcctctctggaaacgggaagatggacatgtccttcaccttgaagttttagggcttgaggaatgtgccactattactctgtctatgacctcagtcagacggtgcaaagtgtgcactggaggagaagggagtcggggctcagtatccatcacctagtctatagaagagccagctttccatgatggaacgcagagctaaggaggccaggatctgactatgtatggaaagagcaagctagctgaacgttgagtctcttagttaatgggactggtgttaatgggaaggctgctctgagaaagctactgccaggatcctgaactgtttccaatacttgtgattcaccttggtccctaggtcatgggagatttgttgacttgtgatgctctttcttcttggtaggagataggggaaatctaaggagacttagtttggctacctctgtctgttatatggaatgaacgtggaaacagatgtggaaattgttctcctaagggttgatgcagctctgtcctttccccattgtccttaaccaggagacttggggaaagggacacctctaccactcatcagttgcttgggcctcaccttatgctgtaggtactaactatgtggagccatttggacaatacaaaagcatggggggaggggcaggacacagctgtggatcatgatgttagagtaggggggtttgttctgtagtcaagaaagtgactgaaaggagttgctgtatggaatgaccttgatgccagaactcaagactgagctctcacaaaaggagcagctgaccattgagcgctgtatgcactgtcagacagtcttacagctccattcagatttaattttctaactgccatttgtggggtcggagactgagggcaggaatgggacatgctttcccaagttacctgtccttatacaatccttgactgagcagagggtgccctgctttggtcagcaactctggggcccccttcatcgccgcctcttctctctttcatgaggaggaactgtatcatcttggacacagttcttccctcgtgcagttaaaggcagtttttgttgtatgaattctttccctcctgtgtcccattagtgtgtagacacacggcagtggggaggtgaaggatcctggtgctccctgtcaggctccctcacagactgcacacctcttgcccctgacagcctcctggctgttagtcttaacatatctggacgtgactatcaatatcgtcatgagatttcttgctctcatttcagacctttattcttcctttggctttcgttgggggctcttcctcccccatgcctagtcttctcatgaagatggttcaaacctcatttctatttcttgaatgttgagtattacatcacagcgctagggtgcttcatggtgctgctcctgaagaggccagctggacgggatcagtccgcttcgtcccactggttccttagagcttgctgtatcttgtccctattagatgtttttccttgtgggttggggtgggagagttaggggtagtttttgtgttctctctctctctctctctctctctctcccctttctctctcccttcctctttctctctatatgtatgtatgtatggattggttaaagtcagttatcatgggcagctgactttgactccaaattaaagttaaactacacattgtacagctgcacacagaacacctttgagtgtgaatttggatggcaactagaggcatactttttgaacttcaggtatgtaactgaaaagtaaataaaaacactattttttcagtaacctttttttttccttctaaaagataacttaaaaatcaaactatacgaacattaaattggtgctgtaccaaagccttatgacatattccacactccgtatatcctgtctcccgggagctctctgcttattactcttttcaaaagcctgggaatgccagtgagcgtcaagcctgggtctgggtgctggggacccgtgggccaaggggactcgtgggagcagaagatgatggtggaggtgggggtacccatcttctgcctgagcagatactgaagggaaagcag

SEQ ID NO: 34671 - DNA, 1174 bp, Mus musculus
gaatttgggtcatggtatttactattttggagtctcccaataaggcttccattcagaggtgacttgacagactaagcttgtgagtgagtgacagttggggttgaagcgataaaggtgcagtgacagaaaaagaagtctctctaaaccaaatatcagacctggaatagtgatggctaataaaacctgctggaggctattctctaccgtttatttcagtgtgtttacttcatgtgtcttgtgttacataaacaatggtgtttgtgttaataaatgatgcagcagaagcgacttctgataacccgtgaagagatgtgtgtgtttatagctaccttgaaactttagatttaggttaggcaaagggtaagtgagctggttatggtgtaatccgcccataatcccagcatcacagcgtaaaggtagaaagatgacaggttcaaagccaggttgggttacatgaggctagaaaccctactgttgtacaacagtcccatcctgttcctttaagggaactatagcaatacagctatctttttaacctgtccattctgctgttaagaatagaataagacaggactggaatgatggctcaacagtcaagagaagataatgctcttacagaggaccaaagttggtaggtcacagcctcctgtaactcttaactacatccagtaactctaggtccagtggagttaaagtctccttatctctctgtatgccaacatgcatttacatacacacatcacacatcataaataataaagtatgttttaaggaactaaattttagaagactggggtaacatatggaatagagagatgaaatgaacaaacaaggaagggtgacagggtcatactcccttgaataatcctcatgtttgtcttcctcgtggtaggtagctcaacttccgagtgagcccagtaggattcaggagttaaagttggatggagaaagggaagagtggagctggagagatggtccaggggttacgaacattggcagctcttacagaggacctgagttacattcccagcaccatatggtggctggcagtggtctatagctacagccctaggggctccaaccccctcttctggcctccacaggccctgtacatatggtgcacagacatgcatgcatgtaaaatacccatacacataaaacaaaaaatctcaag

SEQ ID NO: 34672 - DNA, 1172 bp, Mus musculus
aggtgctctcactaaggtgactggcctctaacagcattgctgtcagctgttttacaagtcatttcaaggagggatggccactcttgttcctgactcatgccaggtatccacactctttttcctgtcacaatagtttttatttttgttttaaaatttcttcttttgaaaagaactatgacgaagacaacttgggaagtttgtcttgcttttgaacattttctgtcaacccgtgctgagcagaggtgaggtggaggcacaggtttctaatgatggaataaaaagtcaaagtgatgtctcacacttatggagaaggacgttctgggggctccaggagtatcttcattgggttatggaccagtaagactttgggttagggatcccctagtctcttctgcctattgtgtgcactgattggagggtttagaccaatccctcctcttatggagctcatcatgttagggaggaggctggaaggagcccagcgtggaagtcggctcctggagactctagatactgttgctagagcctcttcccctttgggcttgcttcttttgcatttcgtgtactgcagaaggatgagagggtctggcgactggctgagtgtgtatactgtgtatacatgggagctggctgctgaggtgacagcgacctcctcctaataaagtaggatatatttaaaacttgcatcttgtgtctgtctctgtatctcatccatgggcacattcttcatgctgtggtggggtgtcggggacaacagggtcaatggtagcgtcatcccactgcatgaaatctcagatgatgaggaggtagagcctaggccaaaaagcaaaggggcagtgtcctggaaatctgcatgggtgaagaagaaagccaaccagtgctaacgaagagaccctggtcccagtgtttgtgagtggtggatagtataacaagtcatgagtcttacagaagaggagttcaggtccaggctggggtcttagagaggacctcttggtctgtatttggtgggtgggggatgagtcacgaggacaggccagcatagtccactatagaggactttctgctactcaccttagggaaaaccttgtttcctaaggaaaagattcattgtattggcagaatatctaccttttcctagttccatgttgggttgacaatttcagcaaatatgc

SEQ ID NO: 34673 - DNA, 1099 bp, Mus musculus
tgaggagggtgccagaaaatgttgaccagcttagaactctgatcaggcgttcaagaatcaagctacaaagaccaggcaggtggtttggtacagaaaccagttgtgatttatatatgtttggcccaggtagtgacactataaggagatgtggccttgttggagtaggtgtgtcactgtgggcaagggcttaagaccctcatcctgagctgcctggaagtcagtcttccactagcagccttcagaggaagatatagaactctcagctcctcttgcaccatgcttgcttggactgtgccatacttctgccttgatgataatggattgaacctctgaacctgtaagccagccccaattaaatattgtccttataagagttgccttgggctggagagagggctcagtggttaagagcactgacaactctgaaggtcctgagttcaaatcccagcaactacatggtagctcacaaccatctgtcataagatctgacaccctcttctggtgtgtctgaggacagctacagtgtacttacatacaacaataaataaatcttttaagaaaagaaaaaaaaaaaggttgctttggtcttggtgtctgctcacagcagtaaaaccctaactaagagtctagtgttgagaaaaagcctgtggtagaataatttgaaaggacttaagcacaaaggtgctcattatctttattttctttcctgttgctgtgacaaattactattactataaaagcaacttaagtgacaaagggtttattcggcttacagttcaagagtatagccagtcataacagggatggttaggtaacaggagcttgaagcagctagtaacataccatctacaatcaagaatcaggacaaagaatgtgtgctgttgcccagtgtccttttttcatttatttgtacagtcccaacaactagggaatgctgtcgtccacagtgagctgaacttcacacacacacacacacacacacacacacacacacacacacacacacacagagggagagggagagagagagagggaggaggagcgtaaggcattgagttagggcccctcttgttgaacctgcagagatggcttgataaga

SEQ ID NO: 34674 - DNA, 1825 bp, Mus musculus
tatgacacgggatcttaccctatagcccaagccggtctcagacttactgtatagcataggaggtccttgaacttgtggcagcctgctgccttaaccttcatggtactaggattgtaggaatttgacaacagagcagaaaatgtatttttaatacattccatgcctgaagtttttctctctccatatcttactttaggctttttatttggcacagtgcctacatgaaaatagtataaatagttcatttcaactattacgctgtcgtttgatgttttgttttctgcttttgtttttggtttttttaggataattcagattcattgcatccttgaagagcatcaatagaagagggaaaaaaaagatgggtgtgaaaacatttactcacagctcctcttcccacagccaggaaatgctggggaaactaaatatgctccgaaatgatggacatttttgtgatatcactattcgtgtccaggacaaaatcttccgggctcacaaggtagtactagcagcttgcagtgatttctttcgaaccaaacttgttggccaaacagaagatgagaacaaaaatgtgttggatctgcatcatgttacagtgactggctttatacctcttttagaatacgcttacacagccactctgtcaattaacacggaaaatattattgatgttctagcggcagccagctatatgcaaatgtttagtgttgctagtacatgctcagagttcatgaagtcaagtattttgtggaatacacctaatagccaaccagaaaagagtctagatgctggacaagaaaatagctccaactgcaattttacttctcgagatggaagcatttctccagtgtcttcagagtgcagtgctgtggagaggaccattcctgtctgccgagagtcccggaggaagcgcaaaagctacattgttatgtctcccgagagtcccgtgaaatgtagcacccaaacaagttccccccaggtactgaattcttcagcttcctatgcagaaaatagaagtcagccagttgactcttctttagcttttccttggactttcccttttggaatagatcgaaggattcagcctgagaaagcaaagcaggcagaaaatacccggactttagaattgcctggcccatccgaggcaggtagaagagtggctgactatgtgacttgtgagagcacaaaacccaccttgcctctaggtacagaagaagatgtccgggtcaaagtagaaagattaagtgatgaggaggtccatgaggaagtgtcccagcctgttagtgcatctcagagctcactgagtgatcagcagacagtgcccggaagtgaaccagttcaagaggaccttctgatcagtccacagtcttcctctataggtataatgctttctgttttcttaagctttttatggtcaattcaaagatttcagcttttattttatgtgctcagtcctatagaaatcatttttaaagtggagttaaagcataattgaatttgtttgtttgtttgtttgtttgtttgtttgttttttagagccaggtttcagagaggtccaacctacctctgcttgcagagtactgggattaaaggcatgagccaccacacctggctgatgatttggggttttttggtttttggttttttgtttttagatttttttattttatgtatctgagtacacggttttgaccttcatgtggttgttgggaattgaatttaggacctctgcccactccagtcaatcccgctcactcgtgcccaaagatttatttattattataaataagtccactgtagcactgtcttcagacacaccagaaga

SEQ ID NO: 34675 - DNA, 1099 bp, Mus musculus
gcaggtcctcagttgagactccattctgatacaactctaggctgttgtcatggtgacacttaaagctaactaggataattaatttttgaagtctggaaagtacatcatttagaagaacattcagaaaataattcagtatatcttccctcattgcctcttccctgtcttgccctttttaaaacagtagtgacttcacatatcctgaaccacctctgaaacaacatcgagtctgttttattggcatttttttctcttaactatcgttataaaattgttgttcaggaatgtgtgattttatgacctgtcagtctattttatttttcagatggtattttgttgttctgttttataggaattaaaccatttcagtgtgactgctgtggaaaaaagtttaccagggcttactcgctaaagatgcatcgcctaaagcacgaaggtaaacgctgtttccggtgccagatatgtagtgccactttcacttccttcggggagtataaacaccacatgagggtttcccggcacattatccgcaagcctcggatttacgagtgcaaaacatgtggcgccatgttcaccaactctggaaatttaatcgtgcacctgaggagtctgaaccatgaagcatcagagctagcaaactacttccagagcaggtgaggtgcacagcgaaaaccccatcaggaaaaactgctttctgaactctcctgcttttagggcagcctgctgtgttattgtcaggttgccaggtagttagttagtcacagtcattttaaattgccactgcgcatactctgatctcctcatctgatgaaagtttggtaggtctcctaagttataaagtcatactatattgtatttaaaatatctcctacaaaataaataggaaaaatatccccacagaagactatttgtcctcttgggtttttgtttttatggagttaaatgaatttctatatactatatatcgtatatataatatactaggtttaactaaatcttattaccaaatataccacgtcacgtatatcttagtagagtataggtcagactataaatgttagcagagttctctttaaaatttatatatccaggcttggtg

SEQ ID NO: 34676 - DNA, 2741 bp, Mus musculus
ctctttattatagtttgaaaattaattttgtattttatcctttgcctctcatttagtgatttcttagtaccggactacttaaaccaggagcaagaagagacccttgttcagtatgatcttggagaacatacttttgaaagcaactcttctgttcaaatgcctgtgatttcacaggtctcctcaacccagaattgtgaaagcacttttcccctgggctctcttggtgggcttacagagaaggaggaggaactgcatgagcagccaaagaccagtgctcctgctgaggcgcccagggatgacccccctaaggcagagctgcctgctataactattgagtaattctgtgattggcctggggtttggttttttggaaagtgcctgtgcttggtctcatatgtttaaatttaatttaatttttaaagaagggttccctttgtaaaccctaaaactggagggttctatgttttgttttgttttttcatagctgagagattgcttctgtatgtatacaataaggtaacattgaaacagaacataaactttgagacttaaggaaaagcagctgacttagaacatggcagttcttcctcccattgttaaaagtgggcagcagcagatacaaaagaactcaggctgtggttgaccttcctgagagaagagggctaatgagaagttattaaacagtttgacaaggcctaagtaaatgtgtactcctaagtgcagggtgttataaaccctgtagttttggaagtatttgtggtgggtttgtttttgtttttgtttttttcagatgaaggtaaataacttctgaaatccagtatattcttttttaagccattttgaattttcatagtgaaaaattagtatcaggcaggtatttcctgtacctttatagcaccactccagaggctaagaggtgtggttgagaagagtcaggctgcatgtggaatggcagggtgcagaacgaggtacgtatacccagctttgcagaaactctcctgagactttctcttcctggtcattgaatgctgacacctggctaactagggcattgctcagagaagtgtcctcgtgtcccaccaacagcactttcatttgcatatactattgtgctgccatataaaggagaaatagtgaagatattctatattttatatataggtttatgtattgttgaggatgtcgatgctgtgctgttttggacaaaataaaagaattctgttttgaggctacattcttaacccaattaagattgtttacaaggtcacatatgacaacaatataatgtccttattccaaaatattttgaggtattgccaagtttgttaaaagctttcacgagatgtaagcaataatgtaaaagatacgacgaggttgtgagtgatcatctgtgactcagacatggagggagggattgttaagaccagaatcttaaaaactttgctactcagacgataacatttatatgatattctagattgggatatacttttttatcttttgccattaaagcctctttgatctaaaatatttatgaagccacgagtaatgaacttttgtgtaattttttatatagaaaatagccccaatgtttatcgttatgatagcccctgatggggttagaagataaaaacaacattttgtttgtttgtttgtttgtttgtttgactttggacactctcttttgttttgtgacaggatcataggtagtccaggttggtccagaactcatcatcctcttgcctcagtttcccaacaacctttgctaccattatatattatagacacacatcaccacacccagatcagactatagtcttagtcaaacacctgatctgacttttatcccaatgccaaaccttacttactttttatattatagtaatttgtttctttaaaatttattaattctgcaatttaatttctggttttttgtaggttttttggttttgttttgtttttgggttctttttttttttttttttttttttttttttccaagacagggtttctctgtgtagccctggctgtcctggaactcactttgtagaccaggctggcctcgaactcagaaatccgcctgcctctgcctcccaaattctgggattaaaggcgtgcgccaccacgcccggctgaaatttaatttctatctctgttcttttttcttcttgatactgagaattgcacccaggactttgtatatgatgcgcacgtgccctgtcactggtcacacccccaccctgagtcccagttgttttttacctgactcatggctgattgctcccaagcataggtgggtagctttcagaaaaaccaactaggaaagtcagtcatttttatttttttatcatacatgatctttgaaaactgtgcctagtaataaagaaatcctaaaactcactagaatcctattttagtatggtaaatgttcttggttctaaattgggttgttttgtcttggtttttttgttttttgttttgttttgttttgttgttaagagctagaaaaaagtaaaaggaagaaagaaatgagaataaatcagagatgaattgatttgaagaattctttttagattgttttgattgaaagtgtttgagtctactctatcctaagagtcgtgtgttaggacagccctggcagcctccctgtgaaggacacacctccctgtggatttttatccctagtggcaaagcttgtagccaaccttagtgacagatttgaatatactatgaatgcacaa

SEQ ID NO: 34677 - DNA, 4890 bp, Mus musculus
ataaacttacctaaccagtgtttaatataaaatgatacaaaggcttttttctgttccaatgagactctacatttttaaggatattttgtttatgggtctgttataggaaatacaactgcaagagataattgtatatatagtaatatttaaagtttatttaaagttgatttaagagaggaatgcctagatgtatacttttcaccagaacatatggaaaacattgaagagatgaaagccagttacgatcccgtcatagaaatcaccagggtaactaaacagagaatcattcttgtttagaatatttaaaggtagctatcttttgtaaggccaacaagggtacctttgtgatatttaaagggcttaaattttagaatgctagataaattactttttaaaaaacaaagcattttatataagaaaagctttgttttcagttttttttttttttttccaactaccaaatagataggatgtgctttagaagcaaagctcttcccgtgttgtcaggagtcgtagctcctcgtgtcagtctttgcatttccaaactctagccttcagagtgtaatgtcaggaaatcactaactcagaaacagaaatttgacagtaacctttactttatgcgtttaaatttttcaagaaatggatgtagataaatgttaatatccacttcccttaattggccattttaaacaatcctaatttttattttcagtttaatttcaagtttaaccacagttcattatattaataggttttattttgggtttttgtggagtgtttgttttttttttaagttcacagttttgctaagacaaagtgtgctaagctgtttaggtttgaccgtttggagtcccaatagataaacaggatccgtgttaagatacattccctttgctataaaaaacaaacaaacaaacatgcttgtgtttgttaaactgttttactaagagtgaagtagtcagggcctctgattcgctgagtcactggtaactcagcttccttctaactgctgagccaggctctcctgtcttataactcatccctgttcctttggaagctatgttaagtctttcactcctttaaaaaacaaaacaaaaacctcttattttattctcttagtctaattactagaagccacttttgcagagcgcgtgtccattttcagattaagctttagcctgttagctttggagtccctgcaaggtgcgtgaccatacagtgctatgcaggtggcttctctaccaggatcacagagaatgatttcttatgatggcaaatgaatgctcggtcctcaattttaactgaagagattttgatttgtagatgtaatgaacaggtgaattggaaacttgcattgtcctgcatcactcatctgccccaagggccttcaagctcggaagtatacatcttcgtgaaggagtgatttttgagttcttaactaggggtgggggaaggacctaggaaagctcacatggagcaaacagccccaaggtaggggaggaaggtgagttttcactgcactgctaagtgttgccatcagatgtctttttgtattttgatagtagaaaccagaaggcaatggacaaaagtgagggagtggagagatggtattgttgtaaacacagccatgaggaatatttataactaaatacatgttttaaatgagatcatcaaagttaagatttcttattttgcttatactagtatttatccctctttcgtttttgacagaatgtggtgacataggatagtttttatgtgaaagtcttcaacaaaacaaatttaccaaaatagcaatggttcagataaacaatgaagtggaatcgagccagtcctcaggctggttaagaagtaggctatagatgtttcactctggattatacataaattgagatttttgctgcaacctagaaacatgaattatgttgaacagggaatgatactgttactaccgggagttagactgttattaatgtatactaaagtgatgagcgagacgctttcccgatatcataaatgtatttttacaatagaaacaatagttcctgggtttggaagtagtcactgtagagtcagacagtgctgctggaaccttgctttggcagtgtctgaacagtgctgctgctttaacggcttctgcagcttagtagtgctccctctgagtgagacccaggccggctccagcagacacaggcttcctctgtacacaacaaaaaacgtaggagttcagaccatgattgaaaaacattagaattaatgtttttattaaaaatgaaagaaaaattaagtttttaagtgcctaatttatattcttgttttctaagtttattaagctttgctaagcctaaaagccctgactcagttgtgatgatttcctagtaaaatcaccaagaatcacttgaggagctagagtgtcatgacttttactgaattccttgttttcttaaatgccagtctgactacacctagaggttgacaggtcatcctgtgaatgagcgttcattaccaaagcgcatcgcccacccgctgaggagtcagcctctagctgccccaggaggggtggtagtgttggcttcgagatggggaagcattttctgcagttctgttttccagagagacccttttctgtgattagtgcgcttcctgtggtttgtcatgttaggtagcagttcccgggttgacagctgatatggaaggtcttatatattgagaatgcattacagttgaaggttgcactgcttttctgcccccgagagtgagtggcattgggtatttagaagtgaggtaataaacttattattttgtttatacaaaatgatggcttctgatgcttatatatgaaggtattgcttaaagaaacaacagtctctggtagggtaaaatctagttttgactcaagttccagtgatgtatttagtttatggatactggtgtctcctgttgcatcagctagatattgcctgcctctttgttaaggcacccttgtggcaccttacgttcaacttgaaggatggtatgtggcctctttgtgcctctactgtcttttcaaaagccattttataaaaaatcttaggtattttaatatttaaatatatatatatatttgtgaaagatacttttagaacgaactttttttttaacgttaaaattcctgtattcccatttttaagagtaaactaaagattttccaggcttaggactatctttttttcagaaccatgataagaaagtcagattgaggtaataaaccagagagttcggtgatggggaaagagatgtctggtgagaggagactgatttaaaggtgaaaacaatgactttgatgtaacaaattaactttttaaataaagtgtggttttgctcctgtgatttcgtatttgctgctatagtagctcactattttatagggctaacatataaatctggccccatttaaaactgaggtcctttctaatacaagcagcctagaaagagactgcgccacggtctgccgccggtggccaggcgttcctgtagctgatgcatgctttactagttgcctgcggctggcagcacggaggtcagggaagcttcctcccctgccaggtagagcattgtaactcatgggggctggcatctgggagacaggccaaagagggaaccgctgaggagagaatgtggaagcagttccatggagggctgtcccctgttctccaccgctctcctacaacagtactactccaactgtgccagtccccacgtcaccagcctggaccagttgtcatctcattcaagtatagctttacttggtgacagtggccatagctaaattacttggcatgtttgactttctacaatgacaaaaatggtcttaaatttttgttttgatttccttaaaaaaaatgtatacagtgtcataacttcatgttttataaactagtatctggctattagtattttacagaaaccatggttcttggtgactacataatatatatatatatatatatatatatttttgtgacttttttgtaaactaagtgccgtttcaacgttacaatcatttttagagttattgtaatcaatgtgaatatcatgttttttcaaatctgttctgagcctagtgtttgctttgtgaacatatgtgtattgtatatattctgtatagttatactgtactgaaatattagcttgtttgatatgagaaaaagtatgtattgagtacctttttgctagcctgattgcttaatctttttaaaaaaaggtttaaatttttttttaatctttaagctggcctttattaatggtcacaaagttgcagttagaagggatggacagggagaatctagtcttgagtgtctttggatagaaacatgagactaagatttgtttttgttttgttttgttttctcattaaaatatcttactgatgttttatgaaataagtctgctgttgttgtcattgactggtggttcctgagtgtgtgcacactggagacagtgagagtggacagcatttgtcagtgctcctatgtgtatgtgtaggtcccatcacaccacgcccagaccggggagcagaatgtaaggagggcagttagggaagccaggttcctgggtaaagctactcattggatggtggttgcctctaatatgtttttctgaaattgtttcatatttactattaattagatagagacacagtgctgctatttcagtggtgactgacaaatgggaaacaggaaagcagctcattgcagaaatgggtcataggggccaaagagaaaataacagtagcaagcacagtcaaccaggatcctgtcagttaggttcagagatgaagacagaggctttaataagtttaccaagcacttaaggtcagcaagcagtctggcttatcttgaacctgaacca

SEQ ID NO: 34678 - DNA, 1316 bp, Mus musculus
ttgaaaggcggaagctgggaccagaccagggagtggaggagccgtgcagaatgcgaagggaaagaggcagggtaaggaaagagaaaggcagggcaggggaagaggagggggtggggctaactaggccggagctggggataggtggggctggggagagcccggcaggggtaagcaggagtcctggggaagtcatgcttccgggagaggtcagttggccatgggagaggctacttaggttgaggcagctactaagagtttaggtaagggactactcacgcacaggattcggtatttatttatttatttatttatttatttatttatttattttgcgtagggtgactctggtggccccttgtcaagcgcggagaaagatgggcgaatgttccaggctggtgtggtgagctggggtgaaggctgcgctcagaggaacaagccaggcgtgtacacaaggctccctgtagttcgggactggatcaaagagcacactggggtatagcagcatggacagacagccgaccacaaacacccacagggatgcccgacatgcacacctggatacaggagaggaacactgacgacatttatgctgtggcctcccccccccaacacaacccagactgtgaactgcatccttaggactcagagttcttccaaagtgggaccccctcaagagttggagagagaacttgcgtgctagcggcccagcctgggggcaagggtttgatggcagccttccccctctagccctgagctgggtgaagatgatgctgtcccggagagctgcttccaactgtcattgagctcccgggagccctatgggaggaggggctcagggtcactcttttcaggaagcgccagccctaggaaccccagaaaagagtggtacctaaggctgaaattgttttgctgttgccaggggtgggtatttgagagtaaaacattttatttctttttaggtaatttgtttttcttgctatactactacacctccctcccccatcccctctatgaatagttttctttgcactaaactagaactaaatttcccctagtacagaccctgtgcagaccacagcgtcttgtcttccctaggccaagggctgtctgtccttggttataacaagtgctcacttgtaagccaggccctgattgcaacagaaacttggtcagaaggaagtttgggggagatgaatcatgtgactgtccaggactgaccctggccttgccctaccgggggttgagaggacaggcagtagtagtcatggtgacatgtcagaggaagagggagatgccaagtgttgtgggtttgcttt

SEQ ID NO: 34679 - DNA, 1224 bp, Mus musculus
acctgcctcgcgctgggcactgaggaggtgggaagccgtagggcccggaggcgtcggggttggggctggcaggatctccgtgggggtcaccattgctctgggctatcaatcagtgctccgagtgggtgacctgggctatggcaaggacaagttggagacttgtctgtccttggcctctgcacaaactcgttttagtcttcctggtcaaaggcgctttggatcttttgtaagggttgaactcagagcagagctttgtccacacagagtgtggagcccttgagaaggtggctgtctgggtagtggtgaagcatgtgtcctgagccttctggaagaagcctttagtaagcgggaagcagaagcctgagaagtctcttgaaagacctcagaagcatttcactttgctgcacacagtgggggagggcgttagttatcctgaaagacacacacgggtcgtggggtagtggtggcgccgtgctctggtgggactagcggccaggcttttttctgaaccgcagctagaggctggtgagcgaggcttgttgctctggcagaggcagtttcctggagccgagcctccccttccgccgctttttcatgcactccttctctgctgacttggagaagaccagatctcgggggaccgtgagctgggacttcacttctcaccccttgtaacagagtccccgcaacctgtgcttctgccctgcagtgagatgccacctgctgccgccttctccttctttctgtgattggggtgtttgcgagtccttagtaattgcctgcttggaactcgtgcctcctccgcaggtagcctgccgcttggtgtttgaccttcatctgtttttctctcattttcggtttgcccttccagacttccctttcgaagacgggtgctgatattgaaagtgggtcctctggtgactgaactcagtctcctgtttaggccacgtatccctagggtgggagccagggtggggctcaccactctagtccctgggctcctgatagattactattcaccaggaacgcctctttgccctcctcctaggttctcattcatctccatcacttgggttacgcctactcacttctgcggcttctttctcctgtgtggctggctcactctgtcttttttccactttggttgaacgaccccggtatcagtgctgggccagggactcactacccaaaggggctctcggggagcaataggatgtggttggt

SEQ ID NO: 34680 - DNA, 2606 bp, Mus musculus
tatgtaaaaaaaaaatagatcttaaaaataacaaaaaaataaagttcagtaaatgtgtcagtcagtcacagtgtgcttcagtttcacagcaacttgaaaaagggaacagtactgccaccttgtggtaaaaaaaaaaatgacagaaacaggaatcccaaggacccaactgaaattgtcaagtttgttgacagtgtatttgtctcaatgggaccaagctttcagagagaagctttgcctctctgaccgcctccctcccttcctatgtccttgacaccagctcctgtttgatctgtccagataaaaagcatgctgggctgctttgagtccacgggattggacagggaatagcctgatgtcctgatgctcagcaggcctcttcagtatcccacagtgacctgcggtctttgttcctacaggttgacccaatgctcaccccagaagagcgtcacctgaacaagatgcagaaccatggttatgaaaacccaacctacaaatacctggagcagatgcagatttaaggacagcgtgtgtgacaccctggctgaggctgctgcaggtgggctggaagaggctcagcgtttgtgcttgactgctgaccaccagtggtgccagaaggcctcatcctacatcctgctctcctggattgttaagactataaagtactactgtaggattgcaatttccattcttttaaatgggttaaaaagatgttaatataacaatatatgatatataaaccttaagtgaaatgaaagaaaaagatctattgcagatatctgatggatgtagttttctttttttaaattagaaatgccacttctattgtattgtctcacacatgctctatataaatgggaaatgttgatttttttgatgatagactatatacacaggctgttcccgttatgtaagtcagttcttcaggctcatttgctgtgctggttttactattatttgttttcaatgtataaaggcagtatttcccttttcaggttgctgagaaatgtaagaggagctgaagtacattgtatgcagttactgactgctttaggcatagtctccgcagaagcctcgtgtgtccagtgctgggtgtttgggtgcttctgtaccagccgtccccaagcagggctaaggcaccttgaactagccagatgcaaacatagattcactgtgctttcctttcaaatccagttcttccacagcaactagcccatagtcagtctgtgttcttccacagttgtttacggtagccttttcctatccacttcccttaccaagtgtatccaagcgtgcacccacctcctcattggatggctccctccatgcactgaccctctgcctgcctttgtacctcactcacctccaccgctctccagcccctctgatggccactcagagaataccataataaacatggctgaggacccaggagagttcacgggaggcttcatcatatgaaaggacaatgttctgggttgtgcatgaaattggatctgtagacactgtggaaacgtttgaaagtgtttgtttccttcatatgaacctgtaaaatgctgtgtagctggagttcacgctcacagcctttagcgctttgttgcttgttttgttttaatctgaaggttctggtaacctgtttttgtttgtttgtttatttgttttggtttggtttttgtacttttctgtgactcacctgcccttccttccccccttggccctagccgtgcctcgtcccactatgcacagattgaaacttcacctacaaacctgttagtgtgatctgtggagaatgtacagaacttaactacatcaataaacactttaacgtcccctgagcaccttgtgttcctgaccatggcttcgatctatgctgatggagcgttctaggcctgcttttggggatgaagggtgtctatcttccttcagtgaagagttactagcctgtattacagtggccatagtaagttgaatcaagagctccgttttcattccaaaaagaaggagaaagtgactggcttgctggctgttgtgggataatctcagcactgtgggggaggggttgctcacacggaggactgatgaggtgacggccactattgagcgggtagcaagaccctattttacgcgcaaagaaagatgaaggaaagcctgcctgtggcattttgcaaaatttaagtcaagacttcttcccactgttaagaataatgtcaatagagcttatggctgaattttcaggaagctgtccatagccgctgcggcgtctgagcttaagtgacttgccactagaagtccctgtgctcagcgacttgggcttttagctgcttccagggctttgggcctgagcactgttatcactcagtcttaaatactatgctacaagagttgatacatgttatgaaacatgcagttactggggtcataccgtatgagtttctaagccagtaagcatagggtggggacatgctgccagcagtctgattctctgttaacattcaacactgcccagctgcttctatgatgtcccctcaggttactgcccaagagagtcacaaagagagagagacctttatatttgaagtggctttaaagaggtaccactggaccctcta

SEQ ID NO: 34681 - DNA, 1173 bp, Mus musculus
aggcaagcttaggtgtgcagaggcacacaagcttagcaggcaagctcgggtgccacttcattgttctgtagggaaaaacagtctttcttacgctgatccttcagttagattatcctccagtaatttgtctttggtcagattatggaatactttctatcccaggcgtaatggcattggatagtcttgtcttgttaattcctgaaactctttaaagtgattcttagatcttaagttttagttgtttttgtctaagatgaaattataaattaagaaagacttcaagttcttacttaaaataatagtatgataacttcttgacagaacagttaacatgtccagaagagaatgcattacgacctaagatttcttctggatgaagctagagctggagggagcttgtgaaaatgtcctgatgtgatctgtggatttcttgtaggcatgtctgactgaggggctgaccttatatagctatggcatgctgctgccctgcggggtagaccagttccatggcaccgagtatgtgtgctgccctcagacaaagactgttgactcggactcgactatgtccaaagaagaggaggaagaggaagaggatgaagaggacgaagaggaagactatgatcttgataaaaggttaatttgtttaaagtgttggactcattttgtctggttttgtttgatttgggaggggtggaggcctttaaatctgtgcttgtgaaataggggtctcactttgtagtcttagctggcctggaactccttatacagaccaggctagtcttggatcagaaatctgtctgcctttgtctccagagttctgggattagaggtttacgacacatggcaggtctggtttttagcctttctgtaaaagtggctgttggtccctcattgctagataaggccatgggtttcttttcttttctttttttctaaatacaaagaatttattgatactgaatatgctgcaagggatagcgggctgagaagtcttagttaggtctctactgctgtgataaaacagtgaccacaaccaacctggggacttcacctcacagcttccagtccttcatgaaggagggcaggacctggaggtaggactgaaagaccttgaaggagtgctgcctactggcttgctcagtttactttctcctcccctcccctcccctcccc

SEQ ID NO: 34682 - DNA, 1147 bp, Mus musculus
agataaagggatgggtgtgaaggaatattaatgcagttagttctgagaggagcagttgtttgtgtgatagtggtcttctatgtgttcctgtttgggagtcgtatttgctgtggatctagtggggaggtgtcgcccttttttttacgacgcattccagttgtacccataagacatcttcaaagcctgtattttaacaacttttgtgacatatttaaaaataattattgtagagtgaatttatcactccagatcagggacacctaagttaatttcaaatgaagttaactaatttattttatttacatttctaaggaaaaactgggtctgtggtttaagatatagagtaacttttgggtggtaaagacgccctcctgaaaagtaatcatttggtttgaagtcactttatttattacgtagatcctgtgcttccctcttgggatctcattcatagaccatgtctgaagatttgggcatgaaaagaacctgggaaaattacctcaaaaaatgtgtggaaactgaaaatggactctgtatctttgccaacaaaaaggtaacagtaatttcaacatgaaatgttgactccagtcacgaaatgcaagactctgttcccccaagtcctgtggtgtaatgactgtaactgtctcgggttttccaaaaagcctgtagtgttgtaactatcccagggtcttatccagagagacttaggaggtaaggagcggtagaccatctcaaaggtacagttggagtttttgtaatttatatttgccctgctggagctgggcgtgggagtgcacacctttaatcccgcgcttggaaggttgagacaggattctctttgagttggaggccggccgctcctacaaagagttcaaggactgctagggctatacacagagaacccctgacttgaaaaaactacacaagtaaataaataaatttgatctgttggattctctttaatgtgagccagcaaggtatctcccctcttctcaggaataacccagtgattaaaataaagccaatcactgaaggaatgttggttttatgccagttatttttaacttttaaaatatacagaggaaaatactcttgaaggaccttttcatctctttctctttttttggtccttatatgaaataagtagatc

SEQ ID NO: 34683 - DNA, 1141 bp, Mus musculus
tgttaaagttttgtaattgccatgctcttgagtggtctctagcttctggttctgcctgctctctgttgctatgataaagattgtagaaaaagcaacttggggaggaaagggtttatttcagcttacagtccagccttcagggacatgaggtataacatggaggattacagacttgctcttcatggagtgctcatcttgctctctagatcacccaggaccatggccaggggtggcctcccatagcaatgactaatccagaaaatgcctcacacacagagatcagatggaggcagtccctcaagaaaggctttcttcccagatgacttagcttgtgtcaccttgacaaagcaaacagcacttgtgggaagtagactcagctgggttccttgtacagcactgcagctaatttaggaatttggcaaactggatatacacgccctgctctgacatcttggaattgttggtaaaaaagagaaacttaattgtggtccatcttttcctctccctcagctggaggatcgagttttggactggcagtcttctccagccagctccctcaacagctggttctctgctgcccccaactgggctgagttggtgttgcctgctctgcagtatcttgctggagaaagccgaggtgaggtcttgtctgtgaaattttatcatgttttccctcttttgtctaaattcttgcactagatttctccattttcatcagacacaccttaggtgtcttttctgacacacagaaatacacacacggcatcaacaacaaaaccaactcgagctgtgccagagcttgtgtctgtgttagtcttgtgtctgtattaaggtaagggttatgcttgttcatgcgatctatttcttgcagcggttccttctagtttctctccatttgttgaattcaaagagaaaacccagcagtggaaattgcttggtaagtagtctagactttgaagaggtttgttttgttttgcctacccccccacccccgctttttttttttttccttgatgagaggaatcaatgatgggaagattgtcactgagaggagtggctagagagccaggcaagcatggagatgtgccttagcgtttctgaggaggaactatatttcttgttaaagtagggggaagggaga

SEQ ID NO: 34684 - DNA, 1229 bp, Mus musculus
gagaccaggcccggtggatctcggccgacagaaagggagcagcaggaggctgcatcgttcttctgagctgtcctgcttgaggcagggtggtggagagtgatggcaactgcggcctaggttctgctgccacgctccagagtgaagctctgaaaggggtccctctttagggctccagggataatctgtctagtccaggaagagagaacatcagagtcttgggaggtcacagtcacacaagccagggttacctcccgagtgttggatgtccagggagcaggcctgccagttgctgagtgggccggcagggaataagcctcattctatgtgaggttttactttttagtttctgatcctcttggtgacttgttgagatgtgagttttgtgtccagaaaatttttgtgtaacttatttttttaaagaacctactatatgtcttttatcaaatagaaacctgggctttagtgcccctaaactgatcacttaccccttcaaccagaatgagaacatagcaaggctcttagtaggttggtggcttacttgatagtggagaggttatatagtaagaaatgtaggccatgaggtagcatggacccctcaagtgggactagttcagcacagtgtactgaatatgagtgtctgatcttggttgtccctgcgtcttctcctgtggggttatcctcaacaagcctgttcacatggaggttcagagctgttggacaagagagtagggaaagccggtgggatgctgctctcagagcacttgcttacagcccagacattgcacattctccttgctgtacaacagccattgcaaaccagacccttggagctggccacctgactggaacatagaagaaatggttaggtaggggcaggggtaggcactgcctggcagtgccagctagaggagaagtgagtaagtttggtgtttttattcctggccatttcacatttcttagccaccatcagccacagacagagctcagagggtactttacaaagtccaagtactttatggactgcttgtagcttgctgtggtgcaggggtgggtgggaaaacctttctgcagggatagggcttccttgtctctttgtgaaagtatccaaattattaaaaatgtatctttaatttctgggcctttaatcattgtgttttacggggaaacaactaggggacatgtagaatggaaatgctggtttaagtgggaggtgtgttgaaaccggttca

SEQ ID NO: 34685 - DNA, 1135 bp, Mus musculus
agccagattgtgtcttccatcactgcttccctcagatttgatgggccctgaatgttgatctgacagaattccagaccaacctggtaccctatcctcgcatccacttccctctggccacttatgcccctgtcatctctgctgagaaagcctaccatgagcagctttctgtagcagagatcaccaatgcctgctttgagccagccaaccagatggtgaaatgtgaccctcgccatggtaaatacatggcttgctgcctgctgtaccgtggtgatgtagttcccaaagatgtcaatgctgccatcgccaccatcaagaccaagcgcagcatccagtttgtagactggtgccccactggcttcaaggttggcattaactaccagcctcccactgtggtacccggtggtgacctggccaaggtgcagagagctgtgtgcatgctgagcaacaccacagccattgctgaggcctgggctcgcctagatcacaagtttgatctgatgtatgtcaagcgtgcctttgtgcactggtatgtgggtgagggcatggaggagggtgagttctctgaggcctgtgaggacatggctgccctagagaaggattatgaggaggttggtgtggattctgtggaaggcgagggggaggaagaaggagaggaatactaagtccattccttgagcccctgtgtcgtcaaactgctccagtattagttgcaggcactgatgcttctgtgctgtttccattctgtgatcatgtcttctccatgttgtacctcttaagttttccatgatgtctcaaagtaaaagctttaagaaaagaaaaaaaaaaaagaagtctcaacaatgttaaaaatccaaagttcaaggtctcttctgagatccatctaatcaatcacttaactgtaattcacagagcaagacaggaaaccagctgggcaaactccaaactctgcatctccatggctgataacaaagtggtcttcagatctccattcctttttcatctttgttgactgcaacaaacttctttctcctgggctgggttcactcccttctagcagcttttctcaacagatagcccatggctctgacatctcaaacatcttaggttctccaagtcaacttcagcttttcagatt

SEQ ID NO: 34686 - DNA, 1197 bp, Mus musculus
ttgtgggttcctttccttcctccttcctctcctttcacatcttctctgtcctttcagtcatccgtgtgcaacaccatccactgtgaagaccaaacccctggagtcacccttgactttttctctgtatcgaaggttagggctcgccaagtttaaccctcgtggtacagcctggttcagacctcatcttaattctctttcactgctaacaatgtaggctaagctactttctctcttgtaaacctgccaaaaatttctctgcccctgctccagactctgtcctttcccttacattccttatcacaggggccgaagtaatgataagtgtttgtcacatcttagcattctcctattaaatgactccaatacacttagtacagaaggcaaaccataaaattttaacacagaagcaaaacctttagcttgaccggtgtaagtggttctctagcagggaaggttttgcctataagggacattaaatagtgtttagggacagattggaattgcttctggcacctagtggactgaggtctggctctgctaagcatcctacagaatacagagcagtgtcaacaataacatagtgtgtagtctagcatgtctgtagcacatcgtcagatccccagttttcttccttgcttgtcttggtcattacgttatagtcacaatgattttccccattctttttaaaagactagtttgtcagtttatcagtcagtctatttagtgagatcggggatagataggatgcatggattatacatggtaggcaagcactctactgctgagcaatgtagacagatttttaggttcatagcaaaatggagtatgtggtcagaaatgtcctataaaattttccctactcccccatctaacagctccattaactagcagctccagtatggtccatttattgcagttgatgagcccataccaacacattatccaaaatagtttatttttggtgtacaaatggtaatgaaaggtgtattcaccattataccatatagagcagtgtcaccgctgtaaaagtcctctgtgtgtacatgttcctctgcatatgtacctctccctgcacgtctttttactgttttcatagttttgactttttcaaaatgtcttatagttagaatcatgtactgtgtagcctcaccccctttctctttgtgtgtgtgtgctcatgtggtacatctgtttcat

SEQ ID NO: 34687 - DNA, 1153 bp, Mus musculus
cttctgtgctattggatcagagagatttctgtttatgctgtgcctctttacctgctcattttacaccttggctgtgtttacattttgttattattgttatagaacatataaacacctcttcttcctccctccctccatcctctccctccctttctccctcttctccctccatcctctccctcccttattccctcctctccctctttctgtgtgtgtttgtgtgtgtgcacacatgcatgtgcatatgtggtcattattgtgttcatgtgtggagaccagtgtttgatattatgatgtctgactctgtcactgtcctaccttattttttgagacagaatcttttcactgaacctgaagtttgaagtttgggctcgacagagaggccaggatttacctacccctgctcatagtgttggagtttacagacatgtgtaaccatgctcattttttaataagtatgggtgttttccttgcgtgtatgttggtatgccatgtgtatagcttggtgcctaaggaggccagagagccatcagacagctctgtgcttccatgtaggtgctgggaatggaaactgggtcctctgtaagtgttatcagtattctcaactgttcagtcatgtcttcagccccacagatgacttcataggtaggttctagggaatccaatttaggtttttatatttctgtagaaggcattttatcaactcaaccacctcaagctagatataaatatttttatataaggtttatctgtgttttgtgatttttttctggctttataaaaattgttagaactctatcaaattatactgaggacttttctactgtaatattgttgtgaggagtgtcctgtggtattctgtgatttaattcgtagatttaaatccttggtttcctgggcatttattttactgtacagagtgaggaagactaactcacagccgcagggtctctgttggatgacagggatttgtacagggctgctgtgaccgtcctctcggcttggagtcatcacagagattgggatatactaggatttgtctcagtagaagctcgaatattttcccagttgtttttatgtaaaatgtcaggaaatttttccaaatccctactgtcagaaacagttggttttctaaacctgttttcagatttgc

SEQ ID NO: 34688 - DNA, 1196 bp, Mus musculus
aaggctttcctctagcaggcttgtccagcctttcgatattacagtatggtgttgtcatctacaaagttcatactcaagaaccatgcaatcaaattacaaaattaaaaagtcacataatggggactgacaaatggctcagcctgtaaaggcacttcctgcccaacaataaaaacatagccactttaatttgatccccaaaacccacacaaagatagaaggaaagaacaaactcctacagttatagtctgacttccacaaacatctttggaacatgtatatacatacagcacatacgcacacacatacacagagcagtaataataaaatgtaaaaattaagaaaagataattttgagtatcatacaataaaggaagaatagtcaccactaattttcagtaatataaatgcaaaatattgcacagtgaactaaaagtaaattaatagttaagctatgtactctgcattttcaactcacagaaaaacaactatctgaaaaatcaaaggcaaaacatgctgtagaatagatatcatcatctagaatttcttcacaaaattacaagattgtaaccttagtagcttttcaaagtagctcatctgttaactgaacaaggaaagctgattatcaatgaagtcaactcaattatgattaactatagcagcccaagaaactcatccagaaaatacaaactggcttaattccatttagagaaaattgttctttgaagacttgatataatatcagcagttggtaaaaaaaataaaataaaacaaaataaaataaaataagtgaattgtgttccttccttcttgatgaatataaatgtaaccaacatggctcagacactaatgagtttagaggataggaagccttggcctctgggagggatatgtatggaacatctacaggacagaatactcataaataacttaagattagttcaatacaacccaaagtacagtttacttttacctgatttggggaaaaatatgtgttttgctgaaaaaggcttggttggacatatttcaacatctatactgaacactaaaatatttagtaacttatttttgtaacagtcttggtatttctaaaggaacgtaacctaaaattatgaggcaaagcatggtttatgaagtcatttgaaaggctagtattcctagagtcatatgtattcacaagctactatatacacttttca

SEQ ID NO: 34689 - DNA, 1160 bp, Mus musculus
ggaaaatttggcagaaaagccacagatgtgtcttttaataaacacattttgtattttcagtacaaaggtacaaaacgaaagtcctgaaattagaagctgtagaatacggcctcatacgatgaggtattaaaagctaaaatccccacattaggcagtagctgaattcctctgtgaaaagtgccatcatttcagaggtaatcttccataccctcagtgatgaggtctctagagctattattattattattattattattattattattatttggtgttggcgatggggggtctcactttacagttctggttaaactgggatcctcctgcccttgcctcctgactgttgggattaaaggtgtttgccactatctctacctgatgtaattattaagtgcctaaggatctctaggtttctttttttccctcttagaaaaaaaccaatctatatgagactttgtaaagcaaagagttgctcttccctctggttatggtgagtctctctttttcagtcggttactcagatgcttacagcttacctgtcacgcctttcaactatcgctggcaacaagatcaactgtgggcctgcccttacctggatggaggtatctgtctgatcagctctgatgaaatcttattctaaaattatttgcttaaggcatttattagtaatttgattatagatgagtttcacaaataaagaaacaaagaatgtactcataatccaggaggattggtaactgatatttttaattttaacctgaatgcgtatgggtgttttacctccatgaatgtctgtgtgctctttatgtgcctgctgccccaaatggccacaagagggcttcagatgccctggacctgaagttatacatggtatgagccaccctgtggctctgggaatcagttcttctaagagcagccactgctcttaaatgctgagtcatctctccagagtgactggatttttggatagaaaatctttctctttatttttcaaaaaaataattttatcatctctataaatctggagattgttagacattgttatacctattgttatacatatacagcgtaagctacttgttttttcatttgcttaataattgaaaatattttttagtaatttatgagccaataaaccacccttttaaaggtaccaattt

SEQ ID NO: 34690 - DNA, 1101 bp, Mus musculus
catttctaagttggtcctcagcaccttgctttcatattttagcccctgttttacaaagaacaaatgtctttaagtagagattcaaaaagtagacattaggatgtagacaggcttgggtttcatgaaatcctgatgccctcatacactttcacaggattaggaaagtagttgaacttcttaggtcttcatttcatcagcttcttgtgtggttatctggttttaaaggacatctaactatacacaggtagctggctcttagtctggattcctgccatccctctgtccccactctctcctcgcctcagctgtcctatactgtcttctttgtggaggcttattatcaatgtcttctttgcactttttttcatcctgaggtgcacgtggtctttgaagctatagttcttgttgctccccacattagctcccatgccttgcagagctgcatggaaggctcctatgtggctcccattgtgcctctccaggctgttacattctttctattgtttgttcatttcttgttctgtaggaagggatagagccttggttatcttagtactgataaactactttttgtttcatagaaagaggcctcagaataagatgaaaaaatctcccgttggcagctggcgttcctttttcaatttggggaagtcctcttctgtctccaaacgcaagttgcagcgtaatgaaagtgagccctcagaaatgaaagccatggctttgaaaggtaagcactgagctgccctgttctgggtagcagactgcctggtggcttctggcacctaccactgtgctcacagccaacttctctgggtgtaccttcccgttgccatcatgacacacctcactgtaaagcatgcatagttgtgtggcccagcttggttgtctgcatgtgtgattgcagctcgtaagatagtatcagttacgtagagaagaactccgtttcttaaaaaaactgtgtagatgttacacacacacacacacacacacacacacacacacacacacacacacacacacaccagtagtgcatttgtgtcattgcttctctagggtaacatagcttgtatagtgctggtaataattctcctgtgttatgta

SEQ ID NO: 34691 - DNA, 1523 bp, Mus musculus
ctgagtcttttcctggccattcctgtggctttgctgccccagttcccccaacacggacaatggagagcaagatggctgctgccttgcactccagcgctgcagatgccaccagcagttcaaattaccactcctttgtcccttcgtcagcctcagtggatgatgtgatgcccgtgccactccccgtctcacagcctaagcatgcttctcagaagatagcctattcctcctttgctaggcctgatgtcaccgcagagccctttggtccagaaaactgtttgcatttcaatatgactccaaactgccagtttcgcccccagagtgttcctccacaccacaataagttggagccacatcaggtatatggtgcccggtcagagccaccagcctccatgggtcctcgttataacacctatgtggcgccgggaagaaacatgtctggacaccactccaagccgtgtagtcgggttgagtatgtctcttctctgggctcctcggttaggaatccttgttgccctgaagacattctaccttaccctaccatccggagggtacagtccctccatgcacccccaccttccatgatccgctctgttcccatttcacggacagaagttcccccagatgatgaaccagcctactgcccaagaccagtctaccagtataagccataccagtcctcccaggcccgctcagactatcacgtaactcagcttcagccttactttgagaatggacgggtccattatcgctatagtccgtactccagctcctccagctcctattacagtcctgagggggccttgtgtgatgtcgatgcctatggcacagtccagctgcggcccctccaccgcctgtccagtcgggactttgctttctacaatccaaggctacaaggaaagaacgtgtacaactatgctggtttgcctccacgcccacgggccaatgcaactggctatttctctggtaatgaccataatgtagtcactatgccccccactgctgacggaaagcacacctacacctcatgggaccttgaggacatggaaaaataccgcatgcagtccatccgccgagagagccgagcacggcagaaggtaaaagggcctatcatgtcgcagtatgacaacatgacaccagctgtgcaagaagacttgggagggatctatgtcatccatctgcgcagcaaatcagatcctgggaaaactggacttctctctgtggcagaggggaaagagggacggcacccagccaaggctgtcagtcctgagggggacgagcgtttctacaggaagcacccagagtccgaatttgacagagcccaccatcatggagggtatggcagcacacaggcagaaaagccatccctcccgcagaagcaaagcagccttaggaacagaaagcttcacgatatgggttgtagcctcccagagcacagggcgcatcaggaagcaagccataggcaattatgtgaatcaaaaaatggaccaccttatccccagggagctggccagttagattatggg
